United States Patent 9,061,059 (MODIFIED POLYNUCLEOTIDES FOR TREATING PROTEIN DEFICIENCY) - sequence listing, part 103

SEQ ID NO: 201225 - DNA, 15018 bp, Artificial Sequence
  Description of Artificial Sequence: Synthetic coding sequence
atggaccagcggaagaacgagagcatcgtgcccagcatcacccagctcgaagattttctgactgaacataattccaacgtggtttggttacttgtagctacaattctttcttgcggctggatcatttatcttacctattataattcccgcaatgtgggtctgatactaaccctggtcctcaaccggctgtacaaacacgggtacattcatatcggatcattttccttctcagtgttgtccggaaaggttatggttagggagatttactacatcactgaagatatgtcgatacggattcaggacgggttcataatttttcgctggtggaagatgtacaatccaaagcaaaagcaacacgacccgaaagccgagacccgcctgtacatcacagtgaacgacttcgagttccacgtgtacaaccgaagcgatctgtacggaaggctgcaggagctgtttgggctcgagccaacaattattccacccaaaaaagatgatgacaagactcgcgaaatagggagaacacgtacccagtctaaaattgaaagagtaaaagtgaagacagagtcacaggatccaactagcagttggcggagtctaatcccagtcatcaaagtcaacgttagcactggccgcttggctttcggaaatcattaccaaccccaaacattatgtatcaatttcgacgatgccttcctaacgtacactacaaagcctccctcgagccacctcgaccaattcatgcacatcgtgaagggcaagcttgagaatgtgcgggttatgttagtgcctagcccacgttatgttggattgcagaatgacgagcccccacgccttatgggagaaggcttcgtcgtgatgcagtctaatgatgtagacatttattattacatggatgaacccggcctcgtacctgaggagacagaggaaaatatagagggtgagatgtcatctgaggattgtaaactgcaagatctcccgccgtgttggggactggatatcgtatgtgggaagggcaccgattttaattacggtccgtgggccgaccgacagagagactgtctttggaaattcttttttcctcctgattaccaggtgttaaaagtgagcgagatcgctcaacctggacggccacggcagattttagccttcgagcttaggatgaatatcatagcagacgccacaattgacctcctgttcactaaaaaccgcgagactaatgcagtgcacgtgaacgtcggcgccggctcatacctcgaaattaacatccccatgactgtcgaagagaacgggtacacgcctgccatcaagggccaattgctgcacgtggacgctacaacctctatgcagtatagaaccctactggaagctgagatgctggcatttcacataaacgctagctacccacgaatatggaacatgccacagacctggcagtgcgagttagaggtctacaaggcgacctaccattttattttcgcacagaaaaacttttttactgacctcattcaggattggtccagcgacagtcctccagacatttttagcttcgttccatatacgtggaacttcaagattatgtttcatcagttcgagatgatctgggcggcgaatcagcataattggattgattgctcgactaagcaacaggagaacgtctacctcgcggcttgtggggagaccctcaatatcgatttttccctgcccttcaccgattttgtgcctgccacatgcaatacaaagttcagcctgcgcggagaggacgttgatctgcatttgttccttccagactgtcaccccagtaaatatagtctgtttatgctagtgaagaactgccatcccaacaaaatgatccacgataccgggattcccgccgaatgtcaatccggccaaaaaaccgtaaagcctaaatggcgcaatgtcacccaggaaaaatccgggtgggtggagtgctggacagtgcccagtgtgatgctcacaatcgattacacgtggcacccaatttatcctcagaaggctgatgaacagctgaagcagtctcttagcgagatggaagaaactatgctgagcgtcctgcgaccctcccagaagacatccgatagggtggtgagcagtcctagtaccagctctcgtcccccaatcgacccttccgagctaccccccgacaaactgcacgtcgagatggagctcagtcctgactctcaaattaccctctacggtccactgctcaatgcttttctctgtatcaaggaaaactacttcggtgaggacgatatgtacatggactttgaggaggtcattagcagccctgtgctgtcactgagcactagctcatccagcggctggactgccgtaggaatggagaacgacaaaaaggagaatgaaggttctgctaagagcatccatccgttagccttacgaccctgggacatcactgtccttgtaaacctttacaaggtccacggaagacttccggtgcatgggacaacggacggtccagagtgtcccacagccttcctcgagaggctttgcttcgaaatgaagaagggttttcgcgaaacaatgctgcagctgatcctcagtccgttgaacgtgtttgtatcagacaactaccagcagcgtccgcctgttgatgaggttctgcgggagggacacatcaacctatctgggctgcagctgcgcgctcacgccatgttctcagctgagggcttaccactgggctccgactcccttgaatatgcctggttgatagacgtgcaggccggtagtctgactgctaaagttaccgctccacagctggcctgcctactcgaatgggggcagaccttcgtgttccatgtggtgtgtcgcgagtacgagctggagcgccccaagtcagtgatcatttgccaacacggaatagacaggagattttgcgagagcaagctctcctgcattccaggcccgtgcccaacctctgacgacctgaagtacactatgataagactggcagtcgacggggcggatatttatatcgttgagcacggttgcgcaacaaacatcaagatgggggcaatccgagtggcaaactgtaacctacataatcagtctgtaggggaggggatcagtgccgccatccaggacttccaggtgaggcagtatattgagcagctgaataattgtaggatcgggctacagcccgccgtccttcgcagggcttactggttggaggctggaagcgccaatctcggtctaatcacagtcgacatagccctggctgccgatcaccactcaaagcacgaagcacagagacatttcttggagactcacgacgcacgcacaaagcggctttggttcctgtggcctgatgacatccttaagaataagcgatgtcgcaacaagtgcggctgtttgggcgggtgcagatttttcggaggtacagtaactggcctcgattttttcaagctggaagagctgacaccctcaagctcttcagccttctcttccacttccgccgaatcagatatgtattatggacagagcctcctccagccaggagaatggatcattactaaggaaatcccaaagattatcgacggcaacgttaacggaatgaaaaggaaggaatgggagaacaagtctgttggtattgaggtcgagcggaaaacacagcacttgagtctgcaagtgccacttcgctcacacagcagttcctcgtccagtgaggaaaatagtagctccagcgccgcacagccactgctggccggagagaaagaatccccttcttctgtggcggacgaccacttggtccagaaagaattcctgcacggtactaaaagggacgacggccaggcatctataccgactgagatttctggcaactccccagtgtcacccaacacccaggataaaagtgtcggccagtcacctttacgcagccctctgaagaggcaggcttccgtctgctctacccgattgggatccaccaaatccttgactgctgcgttctacggggacaagcagccagtgactgtgggcgttcaatttagttctgatgtatcacgcagcgacgagaatgtcctagacagccccaaacaaaggcggagtttcgggagttttccttacacacccagcgccgacagcaacagtttccaccagtataggagcatggattcgtccatgagcatggccgattcagaggcatattttagcgccgcagaagagttcgagccgatttcatcagatgagggcccagggacataccccggtcggaagaagaaaaaaaagcaaacgcagcagatagactatagcagaggttctatctatcactctgtcgaaggcccattgacggggcacggggagagtatccaggattcgcgtactctgcccttcaagacccatccatctcaggcttccttcgtgtcagcactcgggggcgaggacgatgtcatcgagcatctgtacatcgtggaaggagagaaaaccgtcgaatccgagcagattacacctcaacagcctgtgatgaactgctatcaaacgtatctaactcagttccaggtcataaattggtccgtcaaacaccccacgaataaacgaacttccaaatcttccctgcatcggcccctggacctggacacccccacaagcgaggaatcaagctcttcatttgaacagctttccgtcccaacattcaaagtcattaaacaaggcctgactgctaattcccttctcgacagggggatgcagctgtctggcagcaccagtaatacgccatatacaccactcgaaaagaagctagcggataatactgacgacgagaccctcaccgaggagtggacactggaccagcctgtgagtcagactagaaccaccgccattgtggaagtcaaagggaccgtcgatatagtcctcacccccctggtcgcggaagcgctggataggtatatcgaggctatggtgcactgcgcctctacaaggcatcccgctgccattgttgacgacctccatgccaaagttctgcgggaggccgtgcagaacagcaagacaacatttagtgaaaatctatctagtaaacaggacatccgaggaacgaagacagaacaatctacgatcggaaccacaaaccaaggacaggctcagactaacttaactatgaaacaggacaatgtcaccatcaagggtctgcagactaacgtgtctatacccaaggtgaacctgtgtttactccaagcctccgtggaagagtcaccgaccacagccccgtctcggtcagtcactcatgtgtccttggtggctctgtgttttgaccgcatagcaactcaggtcagaatgaaccggggcgtcgtcgaggaaacctccaataatgctgagcccggacgcacaagcaactttgacaggtacgtgcacgcgaccaaaatgcagccccagtccagcgggtccttgaggtccaacgctggcgctgaaaaaggaaaggagattgcagcgaagcttaacatccacagagtccacgggcaactaagaggccttgacaccaccgacattggcacttgcgccattaccgctattccattcgaaaaatcaaaggtcctgtttactctggaggagctggacgaattcactttcgtcgatgaaaccgaccaacaggctgtgcctgacgtcactagaattgggcctagccaggagaaatgggggtggattatgtttgagtgcgggctagagaacttaaccatcaaaggtggacgtcagtcaggcgcagtgctctataattcattcggcattatgggcaaggcctccgataccgaaagaggaggcgtattgaccagcaataatagtagcgactctccaactggctcaggctacaacacggacgtgtctgacgacaacctgccatgcgacaggaccagccccagttccgaccttaatgggaactcagttagcgacgaacaggatgagggagtcgaatccgatgatttaaaaaaggacctgccactgatgcctccacctccagatagttgcagcatgaaactcaccatcaaagagatttggtttagcttcgctgcgcctacaaacgtgaggtcccacactcatgccttctcaaggcaactcaacctactaagcacggcgactccggctgtcggcgcttggttggtcccaattgaccagctgaagagcagtttgaataagctggagacagagggcacactgaggatctgcgcagttatggggtgcattatgacagaggccctagagaataagagtgtgcactttcctctgcgcagcaaatacaaccgcctcacaaaagtcgctcgctttctgcaagagaatccctcttgtttactttgtaacatcctgcatcactatctgcatcaagcgaattattcgatcatcgatgatgccacgatgtcagacggtcttccagccctggtcactctaaaaaagggcctcgtagcactagctaggcagtggatgaagttcatcgtggtgactcccgccttcaagggtgtgtcattgcatcggcccgcccaacctctcaagccccagatcgctatggatcatgaacacgaggatggcctcggactggacaatgggggggggctgcagtctgatacatcggctgatggcgccgaattcgagttcgacgcagcaacagtgtctgagcacacaatgctgctggagggcacagcaaaccgcccccctcctggaagctctggtccagtcacaggtgccgagattatgaggaagctcagtaagacgcatactcactcagactctgcccttaaaatcaagggcattcacccctatcactcactgagctatacgtccggagataccgccactgacagccccgtccacgtcggaagagcaggtatgcccgtgaaggatagcccacgaaaggaaagcctgttaagctacctgaccgggtcttttccctccctccacaacttgctggaaggaactccccagcggagtagtgcggccgtgaagtcatcttccctgacccggacaggaaacactgtcgctactgatatgctatccgagcatcctctcctgagcgagccctccagcgtgtcattctataactggatgtctaacgcagtaggcaacagaggtagtgttctacaagagtctccagtcacaaagtcaggtcataactctctgccaacgggagtagcccccaatttgccaacaatacccagtgccagcgatttcaacacggtgctaagttcagatcagaacactctggacggaactcattcacagcactcgaccagccaggacgacgtggctggggtcgaggaggcaaaccagggtttccccgccgtccagctcgcagatgcacaggtcgtatttaagccattgcttagccatacaggcattcagtcgcaggacaccatgcctttctgctaccggatgtacttcggggagcacttatctttttcagggaccctggactgtcttagagcagatatcgtggactcagacaccgccaaagagcgaaaagggaagcgcgcccggcgacagggccatgtgaatttacctccactcgaattcaagccagcccttatgctgggtactttttctatcagcgccgtcgtgatggagaaatccgtttgcacaccgcaaaactccacttccgctttgagcttccacgacctatccaaaagatattacaatacgttccactgtaatttcacaatcagttgtcaaagcatttcgcagcatgtggacatggcactggtgcgacttattcaccaattctcaactatgatcgatgatattaaggcaacccagactgatatcaaactgagccgctacaccgccggtagtgctagtcccactcccacatttaagacacgaaaacatcgggattttaggagctcggatttttcacggagcagcaggggctccctgaacggtgggaaccgcgtgaataatgctaagaacaagcgaaccaataacgagaacaacaaaaaggaatcccgaaacaagaatagcttggggagatcagagaggcggacatctaaggtctccagaaagggaagcaaagacgttgtggaccatatgacaatccacatggacgactctgacagcatcacagtttctgagcaaagcgagccctccgctgagtgctggcagaatatgtataagctcttaaacttctacagcttgattagcgatcctaccggcatcttggaaaaatctagcgagaccttcggcccagccggggtgaggagccccactgagcctacatgcaaagtggtattcgaaaacgaacaggataatagttccttaactaagacacagcgaaagagatcactggtaaccagcgaaccacagcacgttaccctaattgtgtttgggatcggcatggtaaaccgcacacacctggaggcagacattggcggcctaaccatggagtctgagctgaaacgaattcatggctcattcaccctgaaagagaagatgaaagacgtgctgcatcagaaaatgacagagacctgcgccaccgcacacatcggtggggtgaacattgttctcttggagggcatcactcccaatattcagctcgaggacttccctacttctccgacgagcaccgccaagcaggagttccttacagtggtgaagtgctccatcgccaaatcccaagcactatactctgctcaaaggggactcaagactaacaacgccgccgtgttcaaggtgggggcgatatcaataaacattcctcagcacccagctactttgcattctatgatggtcaggagttcccatcagttatccaagcagatttccgatttgattaggcaacccagtaccgccccacagccagtgaaagaggatatcgcaacccctctaccctccgaaaagacacctacaagtgtgaaccagacgcctgttgagactaatgagttcccccagctccctgaggggctcgaaaaaaagcctatcgttttgaagttttcagcaatgctggatgggatcgccatcggtgctgctcttctcccatcactgaaagctgaatataagatgggacgcatgcgctcccacggcatgacaggggcccagactaggttcacctttgaactcccaaaccaccggctgaggttcacaagtaaagtgtcggcgacggacatgtctacaatccctccctccgcctcgctcaatctgcccccagtcaccatgtcaggtaagtacattatggaagaacatgactcctattctgaccaggtgtggtcaatcgacgaactccctagcaaacagggctactatctccagggaaattacctgaggtgtgtcgcggaggtcggatccttcgagcataaccttactaccgacctgctgaaccaccttgtatttgtgcaaaaggtgttcatgaaagaagtcaacgaagttatccagaaagtgtctggcggcgagcaaccgatccccctgtggaacgagcacgatggcactgcagatggagacaagccaaagatcctgctgtactccctaaatctccagttcaagggaatccaggttacagccaccacaccgtccatgcgcgccgtgcgtttcgaaactggcctcattgagctcgagctgagcaacaggcttcagactaaagccagtccaggatcctctagctatcttaaattgttcggcaagtgccaggttgacctcaatttggccctgggccagatcgtgaaacatcaagtgtacgaagaagctgggtccgacttccaccaggtcgcctacttcaaaactagaatcggacttcggaacgccctgagagaggaaattagtgggtcctcagatagggaggcggtgctgatcaccctcaataggcccatcgtttacgcccagcctgttgcatttgaccgggccgtgctcttctggttaaactacaaggctgcatacgataattggaatgagcagcgcatggccctgcacaaggatatccatatggccaccaaggaagtggtagacatgctgcctgggattcagcagacgtccgcacaggcttttggaacattgtttttgcagctcactgtcaacgacctgggcatttgtttgccgatcaccaatacggcccaaagcaaccacactggggacctagatacaggcagcgccctcgtgctgaccatagagagcaccctgatcacagcatgttcctccgaatctttggtgagcaaaggccattttaaaaatttttgtatcaggtttgcagacgggttcgaaacctcctgggacgactggaaacccgaaattcacggagacctggtcatgaacgcgtgcgtagtgccagacgggacttacgaggtgtgttcaaggacaacagggcaggccgctgccgaatcttctagtgctggtacatggaccctcaatgtgctgtggaagatgtgcggtattgatgtccatatggatccaaacatcggaaagagattgaacgcgctcgggaacaccctcacaactctgacaggagaggaggacatcgacgacattgctgaccttaacagcgttaatatagctgacttgtcagacgaggacgaggtcgatacaatgagcccaacgatccacactgaagccaccgattatcgcagacaggccgcgtccgcttcccagcccggagaacttcgtgggagaaaaattatgaaacgtatcgtcgatatcagagagctgaacgaacaggccaaagtgattgacgatctgaagaagctcggggcgtccgaaggaacaatcaaccaggaaattcagcgctaccaacagctggaatctgtagccgtgaatgacattcgccgcgacgtcagaaaaaaactcaggaggagctccatgagggcagctagcctcaaagacaagtggggactatcctacaagccatcctacagccgcagtaagtcaattagcgcgtctgggagaccaccccttaagcggatggaacgggcctcatcccgggtgggcgaaactgaagaactgcctgagatcagggtggacgcggccagtccaggaccaagagtgaccttcaatattcaggatacatttcctgaggagactgagcttgaccttctgtccgttaccatcgagggacctagccactacagctccaactctgagggaagctgttcagtgttcagctcgcccaagacgcctggaggcttcagccctggtatcccgtttcagacagaggagggccgtcgagacgactccctatctagcacgtccgaggattctgagaaagacgaaaaagatgaggatcatgagcgagaacggttttacatttaccggaaaccttcgcacacaagccggaagaaggccacaggttttgccgcagtccatcagctgtttactgaaagatggcccaccacacctgtgaatcgctctctgtcaggaacggctacagaacggaatattgacttcgaactagatatccgcgtcgaaattgattccgggaagtgtgtgttgcaccctactactttgctgcaggagcacgatgacatcagtctcagaaggagctacgataggtccagtaggagcctggatcaagattctcccagtaaaaaaaagaagttccagacaaattatgcttcaactacacacctgatgactggtaaaaaagtgccttctagtctacaaacgaaaccatccgatctggagaccacggtgttctacatcccaggcgtagatgttaagctgcactacaatagcaaaactctcaagactgaatctcctaacgccagccgcggtagcagcctgcccaggactttatcaaaagagagcaaactgtacggaatgaaagacagcgctacatcgccccccagtccccctcttcccagcacggtgcaatctaagactaataccctgctgcctccccagcctcccccgatcccagcagctaagggtaaagggtcgggcggggttaaaaccgccaagctctatgcctgggttgcccttcagtcccttcccgaagaaatggtgattagtccttgtctgctcgatttcctggagaaagctctggagacaattcccatcacacctgttgagagaaattacacagccgtgtctagccaggatgaggatatgggccattttgaaatcccagatcctatggaagagagtacgacttcgttggtgtccagttccacttcggcctacagtagctttcccgtggacgtcgtggtatatgtgcgggtgcagccgagtcagattaaattcagttgtctgcccgtctcccgggtcgaatgtatgctcaagctgccttctctcgatctcgtgttctctagtaacaggggcgagttagaaacactgggcacaacttaccctgccgagacactgagcccaggcggcaacgctacacagtccggtactaagacgtctgcctccaagactggtattccaggctcctcagggctcgggtcccctctggggcgatcacggcactcaagctctcaatctgatctgacttcttcctcctctagcagctcagggctcagttttaccgcctgcatgtctgacttctccctctatgtatttcacccttacggggccggcaaacaaaaaacagccgtgagcggcctcacccccggatccggcggacttggtaacgttgacgaggaacctacaagcgtcacagggaggaaagacagcttatctattaacctggagttcgtgaaggtgtcacttagccggatccggcggtctgggggggcttctttcttcgagagccagtctgtgtcgaagtcagcctctaagatggatactacacttatcaatattagtgccgtatgtgacatcggaagcgcttcctttaagtacgacatgcgtaggttgagtgaaatactggcattccctcgggcttggtatcggaggagcattgcccgcagactgtttttgggagatcagacgattaacctgcccactagtggcccagggacaccagacagcatcgaaggagtgagccagcacctgtcgcctgagtctagcaggaaggcatactgtaagacatgggaacaacccagtcagagcgcatcattcacccacatgccacagagccccaacgtatttaatgagcatatgactaactcaacaatgtccccgggcaccgtggggcagtccctgaaaagcccggcctcgattcggagccgtagtgtttctgatagtagtgtcccacgccgggattccctctctaagacctccacgccatttaacaagtccaataaagccgcctcccagcaagggacaccctgggagacattggtggtatttgccattaacctcaagcaactgaacgtgcaaatgaacatgagtaacgtaatgggcaataccacctggactactagtggccttaagtcccaggggagacttagcgtagggtctaatcgcgaccgggagattagtatgagcgttgggcttgggcggtcccagctggactcgaagggtggggtggtcggtgggacgatagacgtgaatgccctggagatggttgcacatatcagcgaacatcccaaccaacaaccaagtcataagatccagattacaatggggtctacagaagcccgcgtggactacatgggaagttcaattttaatgggcatcttcagcaacgcagatttgaagctgcaggatgagtggaaggtgaacctgtacaacaccctggattccagcataactgacaagagcgaaatttttgttcatggtgacctgaagtgggatatttttcaggttatgattagcagaagtacaactccggacctgattaagatagggatgaagcttcaggagttctttacccagcagttcgacacgtctaaaagagcactcagtacctggggaccagtgccctatctaccacctaaaacaatgacgagtaatttagagaaatccagccaggagcagctgctggatgcagcacatcaccgccactggcccggcgtcttgaaggtcgtgtctgggtgccacatctcattgttccagattcctttgcctgaagatgggatgcagttcggcggaagcatgtcactccacggaaatcatatgaccttggcctgtttccatggccctaattttcgaagcaaatcatgggcactcttccacttagaggagcctaatatcgccttttggaccgaggcacagaaaatctgggaggacggatcttccgatcactcaacttatatcgttcagactttagactttcatctgggacacaatactatggtcacaaaaccttgcggcgcactcgagtctcctatggctaccattaccaagattacacggagaagacacgagaaccccccccacggggttgcaagcgtgaaggagtggttcaactacgttaccgctacgaggaacgaagaacttaatctgctgagaaacgttgacgctaacaacacagaaaactctacaaccgttaaaaatagcagcctactcagtgggttccggggaggctcctcttataaccacgagactgaaacaatttttgccctgccgagaatgcagctcgattttaagtccattcatgtgcaggagccgcaggagccaagcctacaggacgccagccttaagcccaaagtggaatgttcagtggtcaccgaattcaccgaccatatttgtgttacaatggacgcagaattgattatgtttctgcacgacctggtatcagcttacttgaaggaaaaagagaaggccatctttcctcctagaatcctcagtactcgccctggccagaagagtccaatcataatacacgatgataacagctcagacaaagaccgggaggatagcattacttacacaactgtggattggcgcgacttcatgtgcaatacctggcatctggagcccactctgcggctaatttcctggactggccgcaagatagaccccgtgggagtcgactatatcttgcagaaacttggctttcaccacgctcgcacaaccatcccaaaatggctgcaacggggtgtgatggatcctctggacaaggtattaagtgtcctgattaaaaagctgggtacagccttgcaggacgagaaagagaaaaaagggaaggacaaggaagaacattag

SEQ ID NO: 201226 - DNA, 1287 bp, Artificial Sequence
  Description of Artificial Sequence: Synthetic coding sequence
atgggcggcctgttcagccggtggcggaccaagcccagcaccgtggaggtcctggaaagtatcgataaggaaattcaggcgcttgaagaattccgtgaaaagaaccaacgactccagaaactatgggttgggagactcatcctctatagctcagtcctgtatttgttcacgtgtctgatcgtgtacctctggtacctgcccgatgagtttactgccagactagcaatgacactgcccttcttcgcgttccccctgattatctggagcatcaggaccgttattattttttttttctccaaacgtaccgagaggaataatgaggccctggatgacctcaagagccagagaaagaaaattctagaagaggtcatggagaaagagacttacaaaaccgctaagcttatacttgagcgattcgacccagacagcaagaaagccaaggaatgcgaacctccgagcgccggagccgcagtcaccgccaggccaggtcaggagattagacagaggacagccgcccaaaggaatttaagcccaacgcccgcatcacctaatcaaggccctcccccccaagtaccagtgagccccggccctccgaaggattcgtccgcccctgggggacctcccgaacgcacagtcacaccggccctgtccagtaacgttttaccccgtcatctaggatctccagccactagtgtccccggcatgggcctgcacccacccggaccgcctctcgccagaccaatactgccccgcgagagaggagcgctagatcgcatcgtggagtacctcgtgggggacggcccacagaatcggtatgcgctgatctgtcagcagtgcttcagccataatgggatggccttaaaagaagaatttgagtacatcgcattcaggtgcgcttactgtttttttcttaatcccgcccgaaagaccaggccacaggctccccgcttgccagagtttagtttcgaaaaacggcaagtggtggaaggatcctcgtccgtgggacccctgccttccgggagcgtgctgtcttcagataaccagtttaacgaagaaagcttggaacacgatgttcttgacgataacacggaacagactgatgacaaaatcccagctactgaacagacgaatcaggtgattgaaaaagcaagtgactccgaggagcccgaagagaagcaggaaaccgaaaatgaggaggcatcagtcattgaaaccaacagtaccgtgcccggtgccgattccatccccgaccctgagttgagcggcgagtcattgacagcagaatag

SEQ ID NO: 201227 - DNA, 2718 bp, Artificial Sequence
  Description of Artificial Sequence: Synthetic coding sequence
atggacagcaccgcctgcctgaagagcctgctgctgaccgtgagccaatacaaagcagtcaagtcggaggcaaatgccacacaactgctgagacatctggaagtgatatctgggcaaaaattgaccagactgtttactagcaatcagattctgacttccgagtgcctgtcctgtcttgtggagttactggaagaccctaacatctctgccagcttgattttatccatcatcgggctactgtcgcagttggccgttgatatcgagactcgggactgcttacaaaatacctataatctcaattccgtgctggcaggagttgtatgcaggagcagtcataccgatagcgtgtttctgcaatgcatccagcttttacagaaactcacatataatgtcaagatcttctatagtggcgccaatatcgatgaactgatcacttttttaattgatcacatccagtcgtctgaagacgagctgaagatgccttgtctcggattgctggcaaatttgtgcaggcacaacctgtcagtgcagacacacataaaaacacttagcaatgtgaagagcttctatcgcactttaatcacccttctagcccactcctccctgaccgtcgtggtgtttgctttatcaatcttgtcgagtcttacactcaacgaagaggtcggagaaaagctgttccatgccaggaatattcaccaaactttccagctcatcttcaatattctcattaacggggacggcactctcacccggaagtattctgttgatttgcttatggatctgctgaagaatcccaaaatcgcagactatctgacacggtacgagcatttctcaagttgccttcaccaggttctgggcctgctcaacggaaaagatccagattccagtagcaaagtcctagagttgctactggctttctgttccgttacgcaactgcgccacatgttgacccagatgatgtttgagcagtctccacctgggtcagcaaccctaggaagccacactaagtgtttggagccaacggttgctctcttaaggtggctgtcacagccactggacggctccgaaaattgttcagtgcttgccctggaactcttcaaagaaatttttgaagacgtgatcgatgctgcgaattgcagctctgctgatcggttcgtgacgctcctgctgcccacaattctggaccagctgcagttcacagaacagaaccttgatgaagcgctgactaggaaaaaatgtgaaagaattgccaaggccatagaggtgcttctgacactgtgtggagacgatactctgaaaatgcacatcgctaaaatcttgaccacagtgaagtgcacaaccctcattgagcagcaattcacttacggcaagattgaccttgggttcggtacaaaggttgctgacagcgaattatgcaaattggcagccgatgttatcttaaaaaccctggacttgattaataagctcaagcccctcgttcctggcatggaggtgagcttctacaagatcctgcaggacccacgtttgattacacccctagctttcgcgttgacaagcgataacagggaacaggtgcaatctggtcttcgcattctcttagaagccgcacctctgcctgacttccccgccttagtgctgggcgagtcaatagcggcaaataacgcctacagacagcaggagacagaacacatccctaggaagatgccttggcagtcttctaatcatagctttcccacctccatcaagtgtctgactccccatctcaaggatggagtgcctggattgaatattgaagaactcattgagaagctgcagtccgggatggtggtaaaagatcagatttgtgatgtgcgaatttctgatattatggacgtttacgagatgaagcttagcacactcgcctctaaggagagccggctgcaggacctcctcgagacaaaagctttggcgctcgcccaggccgacaggcttatcgctcagcacaggtgccagaggacccaggccgagaccgaggctagaaccttggcatctatgctcagggaggtagaacgcaagaacgaagaattatctgttttgcttaaagctcagcaggtggagagtgagagggctcagtccgatattgaacacctattccagcataaccgcaaactcgaaagcgtggccgaagagcacgaaatacttaccaagagctatatggagttactgcagcggaatgaaagcacggagaagaaaaacaaggatctgcagataacatgtgactccctaaataagcagattgagactgtgaagaaactcaatgagagccttaaagagcagaacgagaaatcaattgcccagctgattgagaaggaggagcagaggaaagaagtgcaaaatcagctggttgacagagagcataagctcgccaatttacatcagaagaccaaagtgcaagaggaaaaaatcaagacactgcagaaagagagggaggacaaagaggagactatcgatatcctgcggaaggagctaagccggacagaacagatccgaaaagagctgtcgattaaggcaagctctctggaagtgcagaaagcacagctggagggccggctcgaagaaaaggagtctcttgttaagctgcagcaggaggagcttaataaacattctcacatgattgccatgatccactcgctaagcgggggcaagattaatcccgagaccgtcaacttaagtatctag

SEQ ID NO: 201228 - DNA, 2370 bp, Artificial Sequence
  Description of Artificial Sequence: Synthetic coding sequence
atgctggagggcaactaccaggtgatgctgaagagcggcaccaacatcttgtactggcgcactaccgggatcttaatgggcagtaaggcggtcaagcccgtgctcgtcaaaaacatcactattgaaggcgtggcttacaccagcgagtgctttccttgtaaaccaggaacgtttagcaataagcctggttcattcaactgccaggtttgtcccagaaatacatactccgaaaaaggggccaaagagtgtatcagatgtaaggatgatagccagttttcggaggaggggagttctgaatgcacagagagaccaccatgtacgaccaaagactattttcagatccacaccccctgtgatgaggaaggaaaaactcagataatgtataaatggatcgaaccaaagatttgcagggaagatttgacggatgcaataagattaccacccagcggagagaaaaaagactgccctccttgcaatccaggcttttataacaatggctcctccagctgtcacccttgtcctccagggacattctccgacggcaccaaagaatgcagaccctgccccgccggtaccgagcccgctctgggctttgagtacaagtggtggaatgtgctgccaggaaacatgaaaactagctgttttaacgtcgggaactctaagtgtgacggaatgaatggctgggaggtggccggggatcacatccagagcggcgccggaggatccgacaatgactacctgatcctgaatctgcacatccccggctttaagcctcctacttctatgactggcgcgacaggatcggaacttggtagaattactttcgttttcgagacactgtgctctgccgactgtgtgctctacttcatggtggacataaacagaaagagcaccaacgtggtcgaaagctggggcggcacaaaagagaaacaggcgtatactcacatcatattcaaaaatgccacctttactttcacgtgggccttccagagaaccaatcagggccaggataacaggcgctttattaatgatatggtgaaaatctactccatcacagcgactaacgccgtagacggagttgcctcctcttgcagagcctgtgccttagggtctgagcagagtgggagttcatgcgtcccttgtccccccggtcactacatcgaaaaggaaactaatcagtgcaaggagtgtccacctgacacgtacctgtccattcaccaggtctatgggaaggaggcatgcattccttgtggccctggatccaagaataaccaggaccattctgtttgctacagtgattgtttcttctatcacgaaaaagagaaccagtccttgcattatgacttttcaaatctatcctcggtgggatccctcatgaacggaccatcattcacctccaagggaactaagtacttccacttcttcaacatatccctttgtggccatgagggcaagaaaatggccttgtgcactaacaacatcacagactttaccgttaaagaaatcgtggccggctcagatgactataccaatctggtcggtgcatttgtatgccagagcactataatcccgtcagagtctaaagggtttcgggctgcactatcaagccagtcaatcattctcgcagacaccttcataggggttactgttgaaacgacactgaagaacatcaacatcaaagaagacatgtttccagttccaacctcccaaatacccgatgtccacttcttttacaagtcttcgaccgcaaccacaagctgcatcaacggacggagtacggcagtgaaaatgaggtgcaatccaaccaagagtggcgccggcgtaataagcgtgccatccaaatgtcctgctggcacatgcgatggctgcacattttattttctgtgggaatctgccgaagcctgccccctgtgcaccgagcatgacttccatgaaatcgaaggggcctgtaaacggggttttcaggagactctttatgtgtggaacgaacccaagtggtgcataaaaggcatctctctgcccgaaaaaaagcttgcaacgtgcgaaaccgtggacttttggctaaaagtgggcgcaggcgtgggcgcttttactgctgtgctccttgtcgcccttacatgttatttttggaaaaagaatcaaaagcttgaatacaaatactccaagctggtgatgacaacaaattccaaagagtgtgagctgccagctgctgactcttgcgcaatcatggaaggcgaagataacgaggaagaagtggtgtactccaataagcagagtctgctcggaaagctcaaaagccttgcgacgaaagagaaagaggatcattttgagagcgtccagctaaagacctcccgttcccctaatatatag

SEQ ID NO: 201229 - DNA, 336 bp, Artificial Sequence
  Description of Artificial Sequence: Synthetic coding sequence
atggtgcggaccaaggccgacagcgtgcccggcacctaccggaaggtcgtggctgcaagagctccccggaaggttttggggtcttcaacatcagctaccaactcaacatcagtgtctagccggaaagctgaaaataagtacgccggagggaacccagtgtgtgtgagaccaacccctaagtggcaaaagggcatcggggagttttttaggttgtcacctaaagactcagagaaagagaaccagataccagaggaggccggtagctcaggcctcggtaaagcaaaaaggaaagcatgtccactgcaaccggaccacacaaatgacgagaaggaatag

SEQ ID NO: 201230 - DNA, 2772 bp, Artificial Sequence
  Description of Artificial Sequence: Synthetic coding sequence
atgagccagttcaagcggcagcggatcaaccccctgcccggcggccgaaacttttctggtacagccagtacatccttgctcggtccgccgccagggctgctgacccccccggtagccaccgagctaagccagaatgcccggcatttacaaggaggtgagaaacagagggtgttcacgggaattgtgacaagtctgcacgactatttcggggtggttgacgaggaggtgtttttccaactcagtgtggtgaaggggagacttccccagctgggagaaaaagtgcttgtcaaggccgcttacaatcctgggcaggcggtaccttggaacgccgtgaaggtgcagaccctcagcaaccagccactccttaaatcccctgccccccctttattacatgtcgcagcgttagggcaaaaacagggcatcctcggcgcccaacctcagctcatcttccagccccacaggatccctcccttgtttcctcagaaacccctctcccttttccaaacaagtcacacccttcatctctctcatctaaaccgcttccctgctcggggaccacatgggcgcttagaccaggggagaagcgatgactacgactccaaaaagaggaagcaacgggctggcggcgaaccatggggcgcaaagaagccgagacatgacctgcctccgtatcgcgtgcacctgacaccatatacggttgacagccccatctgcgattttttagaattgcagcggcgctaccggagccttttagtcccatcagacttcttgtctgttcatctgagctggctgtctgcattccccctaagtcagccttttagtctccaccatccaagcagaatacaagtaagtagtgaaaaagaagccgcacctgatgcgggagccgagccgatcaccgccgactctgaccctgcttattctagcaaggtgctgcttctctcgagccccgggctggaggagctgtacagatgctgtatgcttttcgtggatgatatggccgaacctcgcgaaacccctgaacacccactgaagcagattaaattcttgctgggcaggaaggaggaagaagccgtgctggttgggggcgagtggtccccctcacttgatggacttgacccccaggccgacccacaggtgctcgttagaacagctatccgatgtgcgcaggcccagactggaattgatctgagcggctgcactaaatggtggcggttcgctgagtttcaatacttacaaccaggacctccacgcaggctccagaccgttgtggtttacctaccggatgtatggaccataatgcctaccttggaagagtgggaggcgctgtgccaacagaaggctgccgaggcggcacctcctacacaggaggctcagggcgagacagagccaactgaacaggcacccgatgccctggagcaggcagcagacacctctaggcggaatgcggagaccccagaagcaaccacacagcaggaaaccgacaccgatttacccgaggccccgcctccccccctggaacctgccgttatcgcaagaccaggatgcgtcaatttatccctgcatgggattgttgaggaccggagaccaaaggagcggattagcttcgaagttatggtactcgccgagctctttcttgagatgcttcagagagacttcggttacagggtctacaagatgcttctttctctccctgagaaggtggtcagccctcccgaacccgagaaggaggaggcggctaaggaggaggctaccaaggaggaggaagccataaaggaagaggttgtgaaggagccaaaagatgaagcccagaacgaaggacctgcaaccgagtcagaagcccccctgaaagaagacggcctgcttcccaagcccctctcctccggcggcgaggaagaggagaaacctcgaggcgaagcgtctgaggacctctgcgaaatggccttagacccggaactcctcctcttgagggacgatggagaggaggaatttgctggagccaaacttgaggactcagaggtgcgctcagtcgcctctaatcagagtgaaatggagttctcctctctgcaggatatgccaaaggagctggacccaagcgcagtactgcctctggactgcctgcttgcattcgtctttttcgatgccaactggtgtggttacttgcaccgaagagatctagaacgtatattactaaccctgggcataaggctgagcgccgagcaggctaaacagttggttagcagagttgtgactcaaaacatctgtcaatataggagcctccagtatagcagacaggaaggattggacggcggacttccagaagaagtcctgttcggaaacctcgatctcctcccaccccctgggaagtccactaagccaggcgctgccccaaccgaacataaagcattggtatctcataatggctcacttattaacgtcggcagcctgctgcaacgagcggagcaacaggattccggtcggctttatttggagaacaaaattcacacactcgaattaaagttggaggaatcacataaccggttctcagccacagaggttaccaataaaacgctggcggccgaaatgcaagaattgcgcgtgaggttggctgaggctgaggagactgctaggactgctgaaaggcagaagtctcagctgcaaaggttgctccaggagctccggcgtagactcacccccctgcagctcgaaatccagagggtggtggagaaggccgactcctgggtcgagaaggaagagcctgcaccctccaattag

SEQ ID NO: 201231 - DNA, 3480 bp, Artificial Sequence
  Description of Artificial Sequence: Synthetic coding sequence
atgctggacttcctggccgagaacaacctgtgcggccaggccatcctccggatcgtcagctgcggcaatgctattattgccgagctcctgagactgagcgagttcattccagccgttttcagactgaaggatagagcagaccaacagaagtacggggatattatctttgacttttcttatttcaaggggccagaactctgggaaagcaagctagatgctaaaccagagctgcaagatcttgatgaggaattccgagagaataacatcgagattgtgacacggttctatctggcttttcagtccgtgcataaatatattgtcgacctcaatcgttaccttgatgacttaaacgagggtgtctacatccaacagactctcgagaccgtcctcctaaacgaggacggaaaacagctgctctgtgaagctctgtacctgtacggggttatgttactcgtgattgaccagaaaatagaaggtgaagtgcgggaacggatgctggtctcctactataggtacagcgctgcaaggtcttcggctgactctaacatggatgacatttgtaaactgctgagaagcaccggatacagttcgcagcctggagcgaaaaggccatcaaattaccctgagagttattttcagcgcgtacctattaatgagtcgtttatttctatggtaattggccggttaaggtcagacgacatctataatcaggtgagtgcgtatcccttgcccgagcatcgatccactgcactggccaaccaggcagctatgctctacgtaatcctgtattttgagccctcaattctgcatactcaccaggctaaaatgcgagaaattgttgacaagtactttccagacaactgggtgatcagcatttacatgggaattacagtgaatctcgttgatgcttgggaaccctataaagcggccaaaacggctctgaataacaccctcgacttgagcaacgtgcgggagcaggcttccagatacgcaacggtctccgaaagagtacacgctcaggtgcagcagtttttgaaggagggttatctacgcgaggaaatggtgctggacaacatccctaagctactgaattgtctgcgggactgtaatgtagcgatacgctggcttatgctccataccgctgactcagcctgcgacccaaataataagcggctgcggcagatcaaggatcaaatcctgaccgattcacgctacaaccctcgcatcctgtttcagctcctgcttgacaccgctcagttcgagtttatcctgaaagagatgtttaaacagatgctgtctgaaaaacagaccaagtgggagcattataaaaaggagggctctgaacgcatgacagagctggctgacgtgttctccggggtgaagccgcttacccgggtggagaaaaacgagaacctgcaggcatggttccgcgagatctccaaacagattctgagcctgaactacgacgactctaccgccgcaggtagaaagaccgtccagttgatccaagctttggaggaggtgcaggaatttcaccagttagagtctaatctgcaggtgtgtcaatttttggctgacactcggaaattcctgcatcagatgattagaacaatcaacattaaggaggaagttctcattactatgcaaattgttggcgacctttcctttgcctggcaactcattgactcttttaccagcattatgcaggaatcgattagagtgaatccttccatggtaacgaaattgcgagccacctttctcaaattagcgtcagccttagacttgcctctcttgcggatcaaccaggcaaattcccccgacctcctctctgtctctcaatactactccggcgagctggtttcttatgttcgtaaggtgctccagatcattcctgagtcgatgtttacatctcttctgaaaataatcaagttacaaacgcacgatattatcgaggtgcctactcgcttagataaggataagctgagagattacgcccagctcggcccccggtatgaggtggctaagctgactcacgccatatccatatttactgaaggtatactgatgatgaaaacaactctcgtggggatcatcaaggtggatcccaaacaactcttagaagatggcatccggaaagagctggtgaagagagttgccttcgcattgcaccgtggactgatttttaatccacgggccaaacctagtgaactgatgccaaagctgaaggagctgggtgccacaatggacggctttcacaggagtttcgagtacatccaggattatgttaatatttatggcctgaaaatttggcaggaagaagtgtctaggataattaactataacgtggagcaggagtgtaataatttcctgcgcacgaagattcaggactggcaatctatgtatcaatccacacacatccctatccctaagttcacccctgtcgatgagtcggtgactttcataggcagactatgtcgcgagatccttcggatcactgatccaaaaatgacctgtcacatcgaccagttgaatacttggtatgacatgaaaactcatcaggaagtgacctcgagtcgactcttcagtgagatccagacaaccctgggcacctttggtctaaatggcctcgatcggctcctatgtttcatgatcgtgaaggaattgcagaatttcctgtcaatgtttcagaagattatcctaagggatagaaccgtgcaagacaccctcaagacccttatgaacgcagtctctccccttaaaagtatcgtggcgaattccaataagatttacttcagcgcaatcgccaaaacccagaagatttggaccgcttatctcgaagccattatgaaagtcgggcagatgcagatcttacgccagcaaatcgctaatgaactgaactacagttgccggttcgacagcaaacaccttgcagctgccctcgaaaatttaaacaaggctctgctcgctgatatcgaagcacactatcaagatcctagcctcccctatccaaaggaagataacaccctcctatacgagatcaccgcctaccttgaagctgctggcattcataacccacttaacaagatttatattaccactaaaaggctcccttattttccaatcgttaactttttattcttaattgctcaactccctaagcttcagtataacaagaatctgggtatggtatgcagaaaacccaccgatcctgtggactggccccccctggtgctgggcctgctgaccttgctgaaacagttccactcacgctacaccgaacagtttctcgcactgatcggccagtttatttgctcgacggtggagcagtgcacatcccagaaaatccccgagatccctgccgacgtggtcggagccttacttttcctggaagactatgttcgatacacaaagctcccacgtcgggtagcggaagcacacgtgccgaatttcatattcgacgaatttcgtacggtcctttag

SEQ ID NO: 201232 - DNA, 2424 bp, Artificial Sequence
  Description of Artificial Sequence: Synthetic coding sequence
atgttcagcgccggcgccgagagcctgctgcaccaggcccgggagattcaggacgaagagcttaaaaaattttgttcccgaatttgtaagctgctgcaggcagaggacctagggcctgacacactcgacagtctccagcgactgttcctaatcatctctgccacaaagtattcgagaagattggagaagacctgtgtggacctgctgcaggccaccttgggactgcccgcatgtcccgagcagctgcaagttctctgtgctgcgatcttgcgggagatgtccccaagtgactccctctcccttgcttgggaccacacccagaattcgcgacagctgtcactggtggcaagtgttttgttggcccagggggatagaaacgaagaagttcgggctgtgggacaaggcgtgctacgggctttagaaagcagacaacctgaaggccccagcctccgccacttactgccggtgatggctaaggtcgtagtcctctcccccggcacgcttcaggaggaccaagcgacactcctaagcaaacgtttggtcgattggttaagatacgcctctctgcagcaagggcttccacacagcggagggttcttcagcactcccagagccaggcagccgggacctgttaccgaagtggacggcgctgtagcaactgacttcttcactgtcctgtcctccggccatcgttttactgacgaccaatggctgaatgtgcaggctttctcgatgttgcgtgcatggctactgcacagtggacccgaaggtcccggtacactggatacagacgaccgctctgaacaagaggggagcacactctcagtcatttccgcaacttcgagcgccggcaggctgttgcctcctcgggagaggttaagagaggttgcatttgagtattgccagaggttaattgaacagagtaaccgtagagccctccgaaagggcgactctgatttgcaaaaggcttgcctggtggaagctgtgctagtgctcgatgtgctgtgccgccaggatccaagttttctgtacaggtctctgtcctgcctgaaagctctccacggacgggtaaggggcgaccccgcttccgtcagggttctccttcctcttgcccatttcttcctttcccatggcgaggcggctgccgtcgacagcgaggccgtgtaccagcacctgtttaccagaatacccgtggaacagttccatagccccatgttagcttttgagttcatccagttctgccgcgacaacctgcacctgttttcgggtcacctttccaccctgcggctgagttttccaaatctattcaaatttttggcctggaacagcccacctctaacatccgagttcgtcgcactcctgcccgctctggttgatgccggtaccgctctggagatgttgcatgcactcctcgacttgccttgcctgaccgccgtgctggaccttcagttacgatcagccccggccgcttcggaaaggcctctttgggatacgtccctgcgggcaccttcatgcctggaggcttttcgtgatcctcagttccaagggctgtttcagtatctgctcaggcccaaggcaagtggcgccactgaacgacttgctcctttgcaccaattactgcaaccaatggctggatgcgcgagagttgctcaatgtgcccaggccgtgcccacactgcttcaggcatttttcagcgccgtgacacaggtcgctgatggatctctgattaaccagctggccctactgctgctggggcggtcagatagcctttaccccgcccctggctacgcggcgggggtgcactcagtcttatctagccagttcctggccctttgcactttaaagcctagcctcgtagtggagctcgctcgggatctgcttgaattcctgggtagcgtgaacggcctgtgcagccgggcgagtctggtgacgagcgtagtttgggcgatcggtgaatatctgagcgtgacctacgacaggaggtgcaccgtcgaacaaatcaacaagttctttgaggccctggaagcattactgtttgaggtgacccaatgccgaccaagcgccgcgcttcctcgatgtccccctcaggtggtgacggtgctgatgactacactgaccaaactggcctccagaagtcaagacctgatccccagagcaagcttgttactgtccaagatgcgcacactggcccatagccctgctacttccagcacccactctgaggagggggccgaggcgatcaggacaagagctacggagttattgaccctcctgaagatgccgagtgtggcccagttcgtactgacgccatccacagaagtgtgcagtccgagataccatagggacgccaacactgccttacccctggcccttcggaccgtgtcccgccttgtggaaagagaggccgggctgatgcccggctag

SEQ ID NO: 201233 - DNA, 4086 bp, Artificial Sequence
  Description of Artificial Sequence: Synthetic coding sequence
atgggcgccgccggccggcaggacttcctgttcaaggccatgctgacaatctcatggctgacactgacctgttttcctggtgcgacgtccacagtcgccgctggatgtccagatcagtctcctgaactgcagccttggaacccaggacatgaccaggatcatcacgttcacatcgggcaaggaaagacgttgcttttgacgagctccgccactgtttacagcatccatatctctgagggtggcaagttggttattaaggatcatgatgaacctattgtgttacgcacaaggcatattctcattgataacggaggagagctccatgccgggtcagcgttgtgtcctttccagggtaatttcaccataatactatatggaagagcagatgaaggaatccaacccgacccatactacggcctgaagtacattggtgtgggcaagggtggcgccctggagctgcatggccaaaagaagctgtcttggacgtttctcaataagacactccaccctggcggaatggctgaaggcggctacttttttgaaagatcatgggggcatcgcggagtgatcgttcacgtgatagatccaaagtcggggaccgtgatccacagtgacaggtttgacacataccgctccaagaaggaaagtgaacggttagttcagtatcttaatgcagtgcccgacggtagaatactgtccgttgcagtcaacgacgagggatctaggaacctcgacgacatggcacgaaaagcgatgacaaagttaggaagtaagcactttctgcacctaggatttagacacccttggagctttctgacagttaagggcaacccttcttcaagcgtggaagaccacattgagtatcacgggcacaggggctctgccgcggccagggtgtttaaactgttccagacagagcatggagagtattttaacgttagcctgtcctctgagtgggtccaggacgtagaatggactgagtggttcgatcacgataaggtgtctcagacgaagggcggcgaaaagatctctgatctctggaaggcccatccaggcaaaatctgtaatcgccctattgatatacaagctactaccatggacggggtgaatctgtctaccgaggtggtgtacaagaagggccaggactacaggttcgcctgctacgatcggggcagggcctgccggagctatagagtgcgcttcctgtgtgggaaacctgtgaggccaaagcttactgtcacaatcgacacaaacgtgaactccactatcctcaatttagaggacaacgttcagtcttggaaaccaggcgacaccctcgtaatcgcttcaacagactacagcatgtatcaggcagaggaatttcaagtgctgccatgcagatcttgcgctcctaaccaggtgaaggtagctggcaagccaatgtacctgcatataggtgaggaaattgacggggtcgatatgcgagccgaggttggcctgctatctcgtaacattatcgtgatgggtgaaatggaagacaaatgctacccataccgaaatcacatctgcaattttttcgattttgacacctttggcggtcatattaaattcgcgctaggctttaaagcagcccatcttgaaggcaccgagctgaagcacatgggccaacagttagtgggccagtaccctatccacttccatttggcaggtgacgtcgatgagagaggaggctacgatccccccacctacattagagatctctccatacaccacacattttctaggtgtgttacagtccacggcagcaacggactcctgatcaaagatgtcgttgggtacaattctctgggccactgtttcttcaccgaagacgggcccgaggagcgaaacacattcgaccattgcctcggactgttggtgaaatctggaactttgctgccttccgaccgggattccaagatgtgtaaaatgattaccgaagattcgtaccccgggtatattccaaagccacggcaggactgcaacgcggtatctaccttctggatggctaatcccaataacaaccttataaattgcgccgctgctggttctgaagagactggcttctggttcatttttcatcatgtacccaccgggccgtctgtgggcatgtactcccctggttatagcgagcatatcccgctcggcaagttctacaacaatagggctcactcaaactacagggcaggtatgatcatagacaatggtgtgaagacaacagaagcctcagccaaggacaaacgaccgttcctctccataatttccgcacgatatagcccccatcaggatgcagatccgcttaagccgcgggagcccgccatcatcaggcacttcattgcctacaagaaccaggaccatggcgcctggctgaggggaggggatgtttggctcgactcatgtaggtttgccgacaacggcatcggcctcaccctggcctctgggggtaccttcccctatgacgacggctccaagcaggaaattaaaaattccctgttcgtgggggaatccggtaacgtggggaccgaaatgatggacaatcgcatctggggcccaggtggtctcgatcacagtggaaggacattaccgatcggtcagaatttcccaatccggggaattcagctgtacgacggcccaatcaacattcagaactgtactttccggaagtttgtggctttagaaggtaggcatactagtgccctggcctttcgactcaacaatgcttggcagtcatgccctcacaacaatgtgaccggtatcgcctttgaagacgtaccaatcacttcaagagtgttctttggcgaacccggtccctggtttaaccagctggatatggatggggataagacctcggtgtttcacgacgtggatgggtctgtttccgagtatcccggttcttacttaaccaaaaatgataactggttagtaaggcatcccgattgcattaatgtgcctgactggcgaggggctatttgtagcggatgttacgctcagatgtacatccaggcttacaagacatcaaatctccggatgaagattattaagaatgacttcccgtcccatccattatatttggagggtgctttgacccgctcaacccactaccaacaataccaaccagtagtcaccctgcaaaagggatacactatccactgggatcaaacggcccctgccgaactggccatctggctcattaactttaacaagggcgactggatccgggtcggcctctgttacccaagaggaactaccttctctattcttagcgatgtccataataggctcctgaagcaaacttcaaaaaccggcgtgtttgtgcgtacacttcagatggataaggttgaacagagttaccctggccgaagccattactattgggatgaggactctgggctcctttttctgaaactgaaggcacagaacgagcgagaaaaattcgcgttctgttccatgaaaggatgtgagagaattaaaataaaggcactgatacccaagaatgcaggggttagcgattgcactgccaccgcctaccccaagttcacagagcgcgccgtggtcgacgtgccgatgcccaagaaactcttcggatcccagttgaagaccaaggatcacttcctggaggtcaagatggaaagttccaaacagcacttctttcacttgtggaatgatttcgcctacattgaggttgacggtaaaaaatatccaagttctgaggatggtatccaggtcgtggttattgacggcaatcagggcagagtagtcagtcacacgtcctttagaaacagcatcctccaggggatcccttggcagctgttcaactacgtcgctacgataccagataatagtattgtgctgatggccagcaaaggtaggtacgtttcaagaggcccgtggaccagggtgctagaaaagctcggagctgatagaggtctcaagctaaaggaacagatggcctttgtggggttcaaaggatccttcagacctatctgggtgactctggacaccgaggatcacaaagcaaaaatctttcaggtcgtacccattccagtggtgaaaaagaaaaagctgtag

SEQ ID NO: 201234 - DNA, 1866 bp, Artificial Sequence
  Description of Artificial Sequence: Synthetic coding sequence
atggccaacgtgccctgggccgaggtgtgcgagaagttccaggccgctcttgccttaagcagagtggaactgcataaaaaccccgagaaggagccttacaaatccaagtatagcgcccgcgcactgctcgaggaagtgaaggcccttttaggtcctgctccagaggacgaggacgaaaggcccgaggctgaagatggccccggcgccggcgatcatgccctggggctaccagcggaggtggttgaacccgaaggacctgtagcacagagagcagtgcgtctggctgtgattgagttccaccttggggtcaaccatatcgacaccgaagaactgtctgcaggggaggaacacctggtgaagtgtctgagattgctgcgcagatacaggctcagtcatgactgcatctcactgtgtatccaggcgcagaataatctaggaattctttggtcagaaagggaggagattgagacagctcaggcctaccttgagtcatctgaggccctgtacaatcaatacatgaaggaggtgggatctccacctctggacccaactgaaaggtttctaccggaggaggagaagctcaccgaacaggagaggagcaagcgcttcgagaaagtgtatacacacaacttgtactatttggctcaagtataccagcacctggagatgtttgaaaaggcagcccactattgtcactctacgctgaaacgacagctggagcataatgcctaccatcccattgaatgggcgattaacgcagcaactctgtcccagttttatattaacaaactttgcttcatggaggctcggcactgtttatcagcagccaacgttattttcggacaaacgggcaagatctcagcaaccgaggatactcccgaggccgagggagaggtgcctgagctctatcatcagaggaaaggtgaaatcgccagatgttggatcaagtactgtctgactttgatgcagaacgctcagctgtcaatgcaggacaacatcggggagctggatcttgataaacagagcgaactgagggctcttcggaagaaagagcttgacgaggaggaatccattcggaagaaagccgtccaatttggtaccggcgagctgtgtgacgcaatctctgccgtagaggagaaagtcagctatctccgacctttagacttcgaggaagccagagaattgttcctgctcggacagcactatgtttttgaggccaaggagttctttcagatagacggctacgtgacggatcacattgaggttgtgcaggaccactcagccctattcaaggtgttagccttcttcgagacagatatggaacgccgctgtaaaatgcataaacggcgaatcgccatgctggaaccactgacagttgatctcaatccccagtactacctgctggtgaaccggcagatccagttcgagattgcccatgcctactacgacatgatggatctcaaagtggccatcgcagacagattgagagacccagatagccacatcgtcaagaagatcaataacctgaataagtccgctctgaaatattaccaactctttctggatagcttgcgggatcctaataaagtgtttcccgagcatattggtgaggatgtcctgcggccagccatgctggccaaattccgtgtcgccaggctatatggaaaaattatcaccgcagatccaaagaaagagcttgaaaatctcgctacaagtctcgaacactataagtttatcgtggactactgtgaaaaacacccagaagcagcacaggaaattgaggtcgagctcgaactcagcaaagagatggtgagcctgctccccaccaagatggaacgctttcgaaccaagatggcgctcacatag

SEQ ID NO: 201235 - DNA, 4551 bp, Artificial Sequence
  Description of Artificial Sequence: Synthetic coding sequence
atggacaaccagcaggacaaggccatcgtggccagcgccaacggcgaaaatactctgatcaatggtgtcaaagagaacgatagcgaggaccaagatgtggctatgaagagctttgccgccctcgaggccgctgccccaatccagccaacccctgtcgcccagaaagagactctgatgtacccgcgtgggctgctacccttacccagcaaaaagccgtgtatgcagtcacccccaagccccctgggacttattgaagctcccgaacatgccgctaacagtgcttccgttaacgctatttcattgactagtggcatcgccaagggcctgaacacgtggtctttgccgaatgagtgtgaaaaagccccttttgccattatggaacccgctgggatgagcgctctaaacggagactgtctgatgcagccgtccaggacatgcctcggatgctttatggaaagcaaagacgccgttgaccccgaacccggcatttccctcaaggtcggagacctcaaccgagactacgaaacatgcgccgtgagtgatattggaattcaatgcattaatgccggggaaaatatgaagtacggtgagcagcttctcagcgaccaattgctgggctttccactccataaatccagggccggagataggcgcgagacagagaaacccgacatagacctggaagaccctgcccagaagtcttattatgaggctctgcttctggataagtgcaacacggaggaagccctgcttgccaacagcaaccaggattggggctatttcgagacattcatcagcgagtccaagatcgagctcctggatttgtgctccaaaaatgaactctccgtgaatctgttttccgaggaggacgtggacaattacatgtttgacgatgatgagtccactcttggctccgatgtgtgctcactgaagatccgatacgaaagtttccaagacaacgtgagggacaaaactacgctgctcatgcaggaggatgcacagttcaatttcttcccaagcgtcttcactacctgtccaaaaagggagtcaaaaagcggcgctctgaaacagagcagtgacttttcacaattcaaggtgccagacgtgagcatcatctggggcgaggaagataaaaacctcgacaagaaaaagggcaaggaagaagggcaggaggataagggcgtagaaaagaaggatggtaaggacaacggcgaaaagcccgctctcaacaagccctgcagtggtacggaggtggagcaacttaagaacccaaaacagggccatctggccaacagtctggagacatcaggttccttctctgacgactccagtttcatagaaattagctacgacgcgatgggtgagatcaaagactgctcacgttacatggcccgtgacaccaactccggaagcagttcctcccagcagaattacgggctccgcgctaaacgcaaagtcaggtacagcgaagactacctgtacgatgtagacagtctggagggggagaaggtcaacgagcggaaggaatggctccccgttggatccaaagaggaggatgatgacgagtggtgtcctaagaaaaggagaaaagtgactcgcaaggaaccaccagtgatcatcaaatatattatcatcaaccggtttaaaggagaaaagaatatgctggtgaaactcggcaaggtcgacgccagtgaaactaccgtgaatctttccgagaaccaactcaataagtatgcgaaattagcccccctgaaaggtttttggcagaaaaagaagaaacaacggaacacaaacactgattcgatcaaaacgcccttctcacaaaaacaaagctttgagcccgggtctttcgaggtgtcttttctacccccagccaggaagaggaaaagcaaactcggaaatcggcacagaatccagaggatacctagtatcgagatctccgcaagctccaaacagatttctctctgcaatgaccagcgacatgcatctaatcacaaggaggatggaggtttgaaaggcaccttgaagagcgccccactgggagcccccagttgtgccaacggctcacatctcaatgacatcacggggcctgacagcgtcaaggtcaaagctcaagacactgaattcaaggggcctgaacggaaggtcctgaacaagatcaaattcaagtccgaggctagattgaagagcaagaaggtcaaagcggcgggtcaagaatctaaacccatagtgcagatgtctcctctgcttgaaaatcagtcctcaaaggctaacctcaaaaacgaggtgattcccggaacatctaattcatccagattgagcgagttccacgaggcgaaagctgctaaatccagcacattcctgccgacaacatgcagttccgaaatgccactctctagtgccaacgtaacaactaacattccagtgatccccggcggctacttacagactttgctggacgcttctgacctgtcaaacaacacttctattagttatttttcccatcactctccagagcagaacgaaggtagtttaacgcagactgagaagagctttgtgccccttcaaccaacccaggattgtgtcctgacctcaagcagtgattctgagctacagcagtcatctcacaactttaagatggaatcatctaattacagaaacgtctggcctaataaggctacttcgggcacgcaggaattcatggctgaagtgagccgcgagattgctcccacccagagttcagagttcggggcaagtcaggtcgtctcaatggagaacaacctgactccgacaacttataacccgatctgcttaaattcggggggaagtaattgtaacaaagtattatacgactccatgcaggacacacagctccctagcgatgatagctaccagctgtgccattttaacaatggtgagatatgctttccattccagcaggggccagttaacatggacgacggccggctcttctcgtttgactcaatggcccccctgagtgtgtcgtcatccaattactgtagtctgtccttaaaatcttgtgaaaaagatggtgatgatgatatcaccgatgactttctcgcccattgttcacctaaactcgtcatccagcaaagcatcgatgagattgcacctctgaaggaatctactgacctcctggacattagcaactttactccagacaagtttcgtcactcaagtttaagcgagatgtccccgcccgacactccgtcactgtctccccaaattaccaggtgtgaaagcatgaagaccctcgggactctaaaggggtttcaggagggcgtcccagggccccttgatagtgtcgagaagattaaatgggattgtagtactctgtcaaggcaggtccaaatggaagacggctttaccctgaataaccatcagttccaatttcatatgtttaacgacgaggacagcgttagcctgctgcaaaagaacccctgtttatctactttcaacgacccatccggtcaaatcagtactaacaacaaagtgtcaaagagtcggaaaaagtcctccccatccaagagcggtgcaatgaatcaaagctcttctcagaagaataccagaaaaaagtcacttaaaggtaacaataagggaatcgaaaaaccgcccgggaaaaactcaaggcaggtgccaaagtccacaaaaaaggggaagtatatggcggctattaatggggaaaagatgcagattggcatcggacggggtggtagccagaccaacacgatcagtagtaccggaaagacattggcggaatgtatacagcacggcggtcccatggcatccatgaaaatgccatcacagaagggactgagcggggactgggcgctggggaaggagtctagccctggatggagtgacatgtcaatgggcaccaacaccaatagcctgctggatgatgatcagcgggagtttcaagaaccgtcttatatcctttcaaacattgcctccgggatggctgacgtccagcggttcatgatggctagtatcgaacctctgtgggaacctatggaacaccacggggatcctaatatcttttactcgcccgagagtaatagtctgaaactgaaaacactcaagatcctggctgggaccccacaggagtccaaaaaaaagataaactcaggctcccagggcgctacaaaaaaccacaggtccatcaaaggtgtgtctaaatctaacggaaagactgcaatcggtgatccaggtcgggctaacatgccaggctataacgaagactctcgatcgactttcttcgataagaagtatagtaatatgagtaccctgggaaataacggtccaacacacaagaaactgtacaggcacaagagcagtagcaaagccctgcgtgatgaaaaatgcaaggggaagcatatggagcgggaacaagtgcataaggacgaaagcggcactgcctcgttcgagaagctccgggattccgattacaaccttctaaaggccgaaactaccttttgggtgctgcctgtcttcgaggaagagaccaggatcttccaaaaagatatctag

SEQ ID NO: 201236 - DNA, 4080 bp, Artificial Sequence
  Description of Artificial Sequence: Synthetic coding sequence
atgtacagcgtggaggacctgctgatcagccacggctacaagctgagccgagacccacccgccagcagggaggataacccaaaaggtaggcaggctgcgaggaccggcactagagctggccaggggttgcagaatggacacgaagacggacccgccgcccttgcgcatcggaagacatcagccggcaaagggcacgtgtctgacagcgaaagccgacgcagtacccccaggggacatggtgagcctcaatctacaagtgctagtcgtacaagtgaagctggattttgtaaccaacccccctctgcctggagttctcacccccctactggaaatgaccaggcttatagacggcgcggtcgccaggaggcgcgttcccagaagccgcgtgaacacgagaacctggaagccagggggatggctcaggctcactcactccccgtgcacgttagggaaggtccctgggaagtcgggggccgaagcgaacatgttatgaaaaagcccgtttgggaggaagagttgaggatgtccggaccagccaaatggcagaacgtgtccttggagtcatggaatcaaccgcgaaagctgggcaggcaaatgtccgacggtgacggggaaaggcttttccaggacctgtatccgttcattcagggggagcacgtgctaaattcgcagaacaagggcaaatctcggtccttacccagagtactgagtccggagtcactgagctgtaccgagatcccaatccccctcaacgaaaggcactcacctaaaatgcctccgtacccgcctacctgcgcccctaacctagatagtacgcgcaatagcgaaaagagcgggtgctctgctccctttccaaggccaaaattcggccgccctcttaagcccccaagttatagctcccaccaacagagccgcggcggagctgattcatcagatagccaggattctcagcagatggatgcttatgtcccaaggcatgagctatgtttgtccgacccgggattagagccgcccgtatacgtgccccctccttcttatcgcagccccccccagaatatcccaaacccttatttggaagatacagtgcccatcaacgtgtgtgggggccacagtcagcagcagtctccaacagaaaaagccggagcatcgggacagccacccagcgggccccctggcacaggcaacgaatacggggtctcccctcggctgcctcaggggctgcctgcacatccaagacctgtgactgcctacgacggattcgtgcagtatataccttttgacgacccgcgactccgccacttcaagctagcacagccccaagggttctgcgaggacataaaacttgatgacaaatcttacaacagctcccccgttaccgcccaggaaccagcgcacgggggcatgcaacccgacggtgctatttggaacccacagtctctgatcccgccttctggcgatgagcggggattggtattagctgattccagtccgaggtggctgtgggggcaacctccaggcgacggcgaaaattccgggttgccgaaccagcgggataggtgcgtggcccgaggccaatggccagatgtgcgaggctcccaacacggccacaccggcagacaggtgagcagcccctattcccagggcgaaagcacatgcgagacacagaccaaactgaaaaaattccaaactgggacccggaccaagaagtcctcaaagaagaaaatgaatgaaacgatcttctgccttgtctcaatcccagtgaaatctgagagccatctccccgacagggatatggataataatgacttgaaaccgtctgcggatcaaaaaaacggcagtgataagtcacccgctctgcaagagcagtcccttcttagcatgtcatcaacagaccttgagctgcaggccctcactggaagcatgggcggtcgtacagaatttcagaaacaggatctgggcgaaccagaggaagaccggcaaactaatgacttgtcattcatccacctgactaaacaccgagaattgaaacacagcggctcttggcctggacatcgttatcgcgaccagcaaacacaaacctccttctccgaagaaccacagtcttcacagttgctgccaggtgccaaactcggtggcccttccagagctgctctgagtccaaaatgctctgatcccgctgccagcgaggcccaaactcacaccgcttttcctactggagaccataagcagcgtcccagtgcacgtaacctgaagggacaccggagtctgagccctagtagcaattccgccttcagtagaaccagcctgtccgtggatcaagcaccaacacccaaagcgggtcggtctcagccatgcgtcgatgtgcatggcctgggggcccatccggggcccaaacgcgaggttgtgaaaggcgagcctacggggccttgtaatagcaaacagctatttggtcaattccttctgaaacccgtctcacgcagaccatgggacctgatctcccagctcgaatcctttaacaaggagctgcaggaagaagaggaatcttcatcttctagcagtagcagctcctcctcctccgaagagagcgaagctgaaccacagcaggagaacagagcacactgtcggcaggaagatgtgggcttccgtggtaattctccagaaatgcgggttgagccccagccacggatgtgggtgcccgagagtcccgtctgcagatctggccggggtgaatcaaagtcagagagttggtctgaggaacttcagccagggcatcctagggcttggccaccctctccaggcagattccgggtggaagaaggagggggagcccccttttgctcggctgacgggtcaactagcgcagagaaacgtcaccttgaagtatcaaatgggatggatgaactggcaggaagtccatttcccgtcacccggatgtcgtcaaggtcgtctgatgccaagccacttcctgctagttaccccgccgagcctagagagcctcaggaatcacctaagataacttccgcattcagtagtgttaaaccttctgaagcagttcctcgcaaattcgactccggtggagaacgtggagccgggctgcccctcagcctgagcaacaagaaccgtggactgtccgcgcccgatttgcggtctgtgggattaacccccggacaggagcagggagcttctgaactggagggttcattaggggaggcaagtacgatagagatacccccgggggagtctcttcaggcacgggcggcgagaatcttgggaatcgaggtggccgtcgagagcctgctgcccggtatacggcgcgcaggacagaatcagcccgcagagccagacgcttccgcttgcacacccgagagcccacaggaggagttactgtctaggccagcccccgccgatgtcccccgggtatccaccgacgccttttatggacgacgcaaatgtggatggacaaagtccccattattcgttggggatcgcgacagcgctaggcgggcacctcaggcttttgagcattccgatgtggatggcgtagtcacgtcgacagacccagtgccggaaccagagcctagcccactggaatctaaattttttgaacagaaagacgtggagactaaaccccccttcagatccaccttgttccactttgttgagcgaactcccagtgtagccggcagcgaaaaacgcctgcgtagcccaagcaaggtaattgagagtctgcaggagaagctggcttccccgcccaggcgcgccgatcctgacaggctgatgagaatgaaggaagtcagctcggtctctaggatgcgggttctgtcattcaggaatgctgactcccaagaggacgctgaggaactgaaggccaccacccgcgggcaggctggtttacctggaggattggtgtcacctggaagtggcgacagagcgcaacgtctaggacacagcctcagtgtatcaaaggattcaatatcaagggaggagaaagaacatcccgcagcacagaaggagaaaagcatggatcaggacttttggtgccccgattcttacgatcctagcagggtggaacgggtgtag

SEQ ID NO: 201237 - DNA, 3219 bp, Artificial Sequence
  Description of Artificial Sequence: Synthetic coding sequence
atggccccccccaccggcgtgctgagcagcctgctgctgctggtgactatagcgggttgtgctcgcaagcagtgctcggagggcagaacatacagcaatgctgtaatcagtcccaatcttgaaactactagaatcatgagggtcagccatacttttcccgtggtcgactgcaccgctgcctgctgtgacctgagttcatgcgacctggcttggtggttcgaggggcgctgctacttggtcagctgtcctcataaagagaactgcgaaccgaagaaaatgggacctatcaggtcgtatttgacctttgttctccgacctgtccagagaccggctcaactgctggactatggcgatatgatgctaaatcgcgggtcaccatctggaatatggggtgacagcccagaggacatccgaaaggacctgaccttcctggggaaggactgggggctcgaagagatgagcgagtatagcgatgactatagagagctcgaaaaagacctcctgcagccgtccggaaagcaggaaccacgaggttccgctgagtataccgattggggtttgctaccaggcagcgaaggggcctttaacagtagcgtgggtgatagccctgctgtgccagccgaaacccaacaggacccggaactgcactatctgaacgagtccgcgtctactcccgcccctaagctgccggaaagatccgtgctgttgccactgcctacaaccccttccagtggggaagtactggaaaaggagaaggctagtcagctgcaggagcaaagcagcaatagcagtggcaaggaagttttgatgccctcccacagcctgcctcccgcttcattggaactgagctccgtcacagtggagaagagtcctgtcctcactgtgacccctggctccaccgagcattccatcccaactccccctactagtgctgctcccagcgagagcaccccctctgaacttccaattagtcctaccaccgcgccacgcacagtgaaggaacttacggtctccgccggcgacaatctgattattacactgcctgataacgaggtggagttgaaagcctttgtggccccagcgccaccggtggagacaacatacaactatgagtggaacctaattagtcatcctaccgattaccaaggagagattaaacagggccacaaacagactttgaacctcagccagctttcagtcggtctgtatgtgttcaaagtcacagtgtcttctgaaaacgccttcggcgaagggttcgtcaacgtgaccgtgaagcccgctcggcgagtgaatctgccccctgtggccgtagtttccccacagctccaggagctgacgcttcctctgacgagtgcactgatagatggaagccagagcactgatgatactgagattgtaagctaccattgggaggagattaatggccccttcatcgaagagaaaacatccgtcgatagtccagttctgcggctgtccaacctcgaccccggaaactactcatttaggctgaccgtcacagacagcgatggggcaactaatagcaccaccgcagcactcatcgttaacaacgccgtggattaccctcccgtcgctaatgccggaccgaatcataccattaccctcccgcagaatagcatcacattaaatggaaaccagtcctccgatgatcaccagatcgtgctttatgaatggagtttaggtcccggctccgaaggcaagcacgtcgttatgcagggggtgcagactccgtacttgcacctctctgccatgcaagagggagattacactttccaactgaaggtgacagactcttcacggcaacagagcaccgctgtcgtgactgtcatagtccagcccgagaacaaccgcccacccgtagccgtggccgggcccgacaaggagttaatctttccagtcgagtcagccaccttagacggctcatcttcctccgatgaccatggcatcgttttctatcactgggagcatgttcggggccctagtgcagtggaaatggagaacatcgacaaggctatcgcaacggtgactggactacaagtgggcacttaccacttccgcctgaccgtgaaggaccaacaggggctttcctcaacatccactctgaccgtggccgtgaagaaggaaaacaacagcccacccagggccagagccgggggaaggcacgtgcttgtacttcccaacaactctattaccctggatgggagtaggagcactgatgatcagcgcatagtctcgtatctgtggatcagggacgggcagagccctgcagccggcgatgtgatcgatggaagcgaccactccgttgcattgcagctcactaatcttgtggaaggcgtatacacatttcatctcagggtgaccgattcacaaggtgccagtgacaccgacacagcgacagtcgaggtccagccagacccaaggaagagtggtcttgtagagctgacactgcaagtgggcgtaggacagttaacagagcaaagaaaggataccctggtgcgccaactcgccgttctgcttaatgtccttgactcagatatcaaggtccagaaaattcgggcccatagcgatctgagcacggtgatcgtgttctatgtccagagccgacccccattcaaggtgctgaaagcagcagaggttgctagaaacttacacatgcgtttatccaaggagaaagccgactttctgcttttcaaggtgcttagggtggatacagcaggatgtctgctgaagtgttcggggcatgggcattgcgatccgctcaccaaaaggtgcatctgctcccatctatggatggaaaacctgattcagagatacatctgggacggagagtcaaactgcgagtggtcaatcttttatgtcaccgtgctggccttcacattaattgtgctcacaggggggttcacttggctctgcatctgttgctgcaagagacagaagcgcaccaaaattcggaagaagaccaagtatacaatcctcgacaacatggacgagcaggagcggatggagcttagaccaaaatatgggattaagcacaggagcaccgaacacaattcatctctaatggtgtctgaaagcgaattcgactcggatcaagacaccatcttctccagagaaaagatggagcgcggcaaccccaaggtgtcgatgaatggcagcattaggaatggagcctcctttagctattgttccaaagaccgctag

SEQ ID NO: 201238 - DNA, 918 bp, Artificial Sequence
  Description of Artificial Sequence: Synthetic coding sequence
agccagctgcccgtgcgggccgaggagcggaccgagagctgcctgtggggctgctgggcttcttccagagtaaggcggacttcagacgcctgtagttcacctttagcaacatcccgctcagccaggtcctgcggagtgctcacagctccggtgaaaggggcctcctctagtctggtggtgaaacttgctgataccgaccgagagcgggctttaagaaggatgcagcagatggccggccatctgggcgccttccacccagccccgctgccactgggtgcctgcggtgcctatacaacagcaattctgcaacaccaagcagctctgctcgccgcagcgcagggcccagggctcgggcccgtggctgctgtagccgcccaaatgcaacacgtggcagccttttccctagtggccgcccctctgctgcccgcagccgcagccaacagtccaccagggtcaggtcccggaactttacccggcctccctgccccgataggggtgaacggcttcggcccactgactcctcagacaaatggacaacccggatcagataccctgtataataatgggctgagcccctacccagcgcaatctccaggcgtagccgatccactgcagcaagcatacgcaggaatgcatcactacgcaggccccgagggctgtaacttgttcatttaccacctgccccaggaatttggggatgccgagttaatccagacctttctgccatttggggccgtggtgagcgccaaagtttttgttgaccgagccaccaatcagagcaagtgtttcggattcgtaagcttcgataatcccacaagtgctcagaccgctatccaggccatgaacgggtttcagatcggaatgaaacggttgaaagtgcagttgaagaggcccaaggatgctaaccgcccttactag

SEQ ID NO: 201239 - DNA, 198 bp, Artificial Sequence
  Description of Artificial Sequence: Synthetic coding sequence
atggtgcggaccaaggccgacagcgtgcccggcacctaccggaaggtggtggccgcaagagctccaaggaaggtgttgggatcttcaacaagcgccaccaactccacatccgtctcctcccgaaaagagcatgttctgtgcaacctgataacacaaatgatgaaaaaaaatcgcactttctcattcatttttgaatag

SEQ ID NO: 201240 - DNA, 15018 bp, Artificial Sequence
  Description of Artificial Sequence: Synthetic coding sequence
atggaccagcggaagaacgagagcatcgtgcccagcatcacccagctcgaagactttcttacagaacacaactcaaacgtagtttggctgctggtggcgacaattcttagctgtggatggattatatacctgacctattataacagcaggaacgtggggcttatcctcactctcgttctcaacaggctctacaagcacggatatatacacattggatccttttcattcagtgtccttagcgggaaggtaatggtccgggagatatactacatcacagaagacatgagcatccggatccaggacggatttatcatttttagatggtggaaaatgtacaatcctaagcaaaagcagcacgatcccaaggcagagacaagattgtatataacagttaacgactttgaatttcatgtatacaacagaagcgatttatacggaaggctccaggaattgtttggccttgagcctaccataatccctcctaaaaaggacgacgacaaaacccgggagataggtcgtacacgaacgcagtccaaaattgagcgggtcaaggtgaagacggagtctcaggacccaacctcctcttggcgtagcttaattccagttattaaggtgaatgtcagtaccgggaggttagcatttggaaatcattaccagccccagactctgtgcattaacttcgacgatgcattcctcacttacaccacaaagccaccctcctcacatctggatcagttcatgcatattgtcaagggcaagctcgagaacgttagggtcatgctagtcccaagcccaagatacgtgggactccaaaatgatgagcccccgagactgatgggcgagggcttcgtggtgatgcagtcaaatgacgtggatatttactattatatggacgagcctgggctagttcccgaggagacagaggagaacatagagggcgaaatgagctctgaggactgcaagctgcaagatctccctccatgctgggggttggacatagtatgtggtaagggcaccgacttcaactacggtccatgggccgatagacagagagactgcctgtggaagttctttttcccccctgactatcaggtgctgaaggtcagtgagattgcccagcctggccgtccgagacagatcctcgccttcgaactgaggatgaacattatcgccgacgctacaattgacttgttattcacaaagaacagagaaactaacgcagttcacgtgaatgttggagctgggtcatatcttgaaatcaatatcccaatgacagtagaagagaacggctacaccccagccattaaagggcaactactgcatgttgacgcaacaacctccatgcaataccgaactcttctggaagcggaaatgttggcctttcatatcaacgcctcctatccgaggatttggaatatgcctcagacatggcagtgtgagctcgaagtttacaaagcaacgtaccacttcatctttgcccagaaaaatttcttcactgacctaatccaggattggtcctctgattctcctcctgacattttctcatttgtgccttatacctggaactttaagattatgtttcaccagtttgagatgatatgggcagctaaccagcacaattggatcgattgttccaccaagcagcaggaaaacgtctaccttgctgcctgtggcgagactttgaacatagatttctcactcccttttaccgattttgtgcctgcaacatgcaacacaaagtttagcttgagaggagaggacgtggacttgcaccttttcctgcccgattgtcacccgtccaagtactccctgtttatgttggtgaaaaactgtcatccgaataaaatgattcacgatactggcatccccgctgaatgtcagagcggacagaagaccgtgaaacccaagtggcgcaatgttactcaagagaaatctggctgggttgaatgctggacagtaccaagtgtaatgttaactatcgattacacatggcaccccatatatcctcagaaagctgacgagcaactgaaacagtcgctgagcgagatggaggagacgatgctgagtgtgttaaggccatcccagaagaccagcgacagggtcgtgtcctctccctctactagtagtcgcccacctattgaccccagcgaactcccccctgacaagctccacgtggagatggagctgtcacccgattcacaaatcactctctatggacccttactgaatgcctttctctgtatcaaggagaactattttggcgaagatgatatgtatatggattttgaggaggttatctcctcacccgtcctgtctttatctaccagctcgagctccggctggactgcggtgggtatggaaaatgataagaaagagaacgagggtagcgcaaagtcaatacacccactggctcttaggccctgggatattaccgtcctagttaatctgtataaagtgcacggcaggctccctgtgcacggtaccacagatgggccggaatgcccaacggccttcctagagcgcctgtgctttgagatgaagaaaggctttagggagactatgttgcagctgattttgtcacccctcaatgtatttgtgtcagataattaccagcagaggccgcctgtggatgaggtcttgcgagaaggacatattaatctaagcggtttgcagctacgcgcacacgccatgttctccgctgagggacttccactgggttctgactccctcgagtatgcctggctgatagatgtgcaggcagggtcgctgactgcaaaggtcaccgcaccacagttagcctgcctgttagaatgggggcaaaccttcgtgtttcacgttgtatgtcgcgagtatgagctggaacgccctaagagcgtaattatctgccagcatggcatagatcgccgcttttgcgaatctaaattaagttgcattcccggtccttgccccaccagtgacgatctgaagtatactatgatcaggcttgccgtcgatggcgctgatatttatattgtggaacatggatgtgccactaacattaaaatgggggctattcgtgtggcaaattgtaatctgcataaccagtccgtgggtgaaggaattagcgctgccatccaggactttcaagtacgccagtacatcgaacagttgaacaactgtagaatcggtctccagccagccgtgttacgccgagcctactggttagaggccggaagtgccaatttgggactcataacagtcgacatagctctcgcagccgatcaccatagtaagcatgaagcccagcgccattttctggagactcacgatgctcgcaccaaaagactatggtttctgtggccagacgacattctgaagaacaaacgttgtcggaacaagtgcgggtgcctgggcggctgccgcttttttggaggtacggtgactggccttgatttctttaagctcgaagagttgaccccgtcaagcagtagcgccttcagctctacttcagccgaatctgacatgtattatggccagagtctgctgcagccaggcgaatggattattaccaaggagattcccaagatcatagatgggaacgtcaatggcatgaagagaaaagagtgggagaacaagagcgtaggtatcgaggtcgagcgaaagacgcaacatttaagtttacaggtgcccctccgttcacacagttccagttccagttcagaagaaaattctagcagctcagcagctcagccgctgctggccggagaaaaggagagtccctcttcagtggctgatgaccacctggtgcaaaaggagtttctgcacggaaccaagagagacgacggccaggcaagcattcccaccgagatatccgggaactctcctgtgtcaccaaacacacaagacaagagcgtcggacagagtccactccggagccctctcaagaggcaggcatccgtctgttccacccgcttaggcagtactaagagccttaccgctgcgttctacggtgataagcagcccgtgactgtgggagtccaatttagctctgatgtgagtaggtctgacgaaaacgtcttggatagccccaagcagcgccggtctttcggtagctttccttacacgccatcggccgattctaacagctttcaccagtaccgatcaatggatagctccatgagcatggctgatagtgaagcctatttcagtgcagcagaagagtttgaacccatcagttccgatgagggacccggcacatatcccgggaggaaaaagaaaaaaaagcagacccaacagatcgactattcaagaggttcaatctatcacagtgtcgagggccccctgaccgggcacggcgaaagcatacaggactcacgaactcttccatttaaaacacatccatcacaagccagtttcgtctccgcgctgggcggtgaagatgacgtgatcgagcacctatatatcgtggaaggagaaaaaactgtcgaaagtgaacagatcactccccagcagcccgtaatgaactgttatcagacctacttgactcagtttcaagtcataaactggtctgtgaaacatcccacgaacaaaagaacctccaaaagtagcctccacaggcccttagaccttgatactccaacatcagaagagtccagctcaagctttgaacagctgtcagttcctacattcaaggtgatcaagcagggcctaacagcgaattcattgctggaccgggggatgcaactgtcgggttctacatccaacaccccatatacacccttggaaaaaaaactggcggataacactgacgacgagactctcaccgaggagtggacgctggaccagccagtttcacagacaaggacaactgccatcgttgaagtgaagggaaccgtggacattgtgctgacgccactggtcgctgaagctctggatagatacattgaggccatggtgcactgcgccagcacaagacaccccgccgctattgtcgatgacctgcacgccaaggtgcttcgagaggctgtgcagaatagtaaaactactttctccgagaatctcagctctaagcaggatattcgtggtacgaaaaccgaacagagcaccatcggcacgaccaaccagggccaggctcagacgaacttgaccatgaaacaggacaacgtgactatcaagggcctgcaaaccaatgttagcattccaaaagtcaacttgtgcttactgcaggccagtgtggaagagagtcccacaacagcacctagccgttcagtcacccatgttagcctggttgcactatgctttgacagaatcgccactcaggtcaggatgaataggggcgtcgtcgaagagaccagtaataacgcggagccggggcgtacttcaaatttcgaccgttacgtacatgctaccaaaatgcaacctcaatctagtggcagcttgcggtctaacgcaggggccgagaaggggaaagagattgccgctaaactcaatatccatcgtgtgcatggtcagctcagagggttagataccaccgacattggcacctgcgccatcactgccataccttttgaaaaatctaaggtactgtttaccctagaggagctggacgaatttacattcgtagacgaaactgaccagcaggccgtacccgatgtgacaagaatcggtccttcacaggaaaagtggggctggatcatgttcgagtgcggcctggaaaacctgacaatcaaaggaggccgccaatcgggcgcggtcctgtacaattctttcggcatcatgggaaaggcctcggacactgaaagaggcggcgtcctgacatctaacaatagctctgattctcctaccggctcagggtataatacagatgtgagcgacgataaccttccatgtgatcgcactagtccatcaagtgaccttaacggcaactcagtcagtgatgagcaggatgaaggagtcgagtctgatgacttgaagaaggacctgccactgatgcccccaccacccgatagctgctctatgaaactgactattaaagagatatggttttcctttgcggcacctacaaacgtacggtcacacacacatgccttttccaggcagctgaatttgctgtctacagcgactccagcggtgggggcgtggctcgttccgattgaccagctgaaatctagcctgaacaaattagagaccgaaggaaccctgcgaatatgtgccgtcatggggtgcattatgaccgaggccctcgagaacaaaagcgttcactttcctcttaggtccaagtacaacaggctcaccaaagtagcccggtttctccaggaaaacccgtcttgcctgttgtgcaacattctccaccattacctgcatcaggcaaattacagcatcatcgatgacgcaactatgagcgacggattgcccgcccttgtgacacttaaaaagggcctggtggctctcgcccggcagtggatgaagtttatcgtagttacgcccgcgtttaaaggagttagtttgcaccgccctgcccagccccttaagccccagattgctatggaccatgagcatgaagacgggctcggtctggataacggcgggggcctccagagcgacacatcagccgatggcgccgaattcgagtttgatgctgcaaccgtcagtgaacacactatgttgctcgagggaactgctaaccgtccccctccgggatctagtggtccagtgaccggagcggagatcatgcggaaattaagcaaaactcatacacactccgattccgccctgaaaattaaaggtattcatccctatcacagtctcagttatacttctggagacaccgcaactgactcccccgtgcatgtcgggcgagccgggatgcctgtcaaagactcacccaggaaggagtcactgctgtcctatctgactgggagctttcccagcctgcacaatttacttgaggggacccctcagaggtcgtcagccgctgtgaagagctccagccttactaggactggcaacaccgtggctacggacatgctaagcgagcaccccctattatccgaacccagcagcgtaagcttctacaactggatgagcaatgcagtgggcaaccggggaagcgttctgcaggaatcgcccgtcactaagtctgggcataactccctgcctactggcgttgctccgaacttgccaacgatcccttctgcctcagatttcaacaccgtgctgagttcagatcagaacactctggacggcacgcactcccaacactctacctcccaggatgatgtggccggagttgaggaggccaaccaggggtttcccgcagtccaactggccgacgcgcaggttgtgttcaagcccctactgtcacacacaggcattcaatcacaggacacgatgcctttctgttatcggatgtacttcggcgaacatctgtccttctccgggaccctggattgtctacgcgctgacatcgtcgatagtgatactgccaaggaaagaaaaggaaagagagccagaaggcagggacacgtgaatctccccccattggaattcaagccggcactgatgttaggtacattctctatctcggctgtggtcatggaaaagagcgtgtgtactccgcagaatagcacttcagccctcagttttcacgacctgagtaaacggtattacaataccttccactgtaactttacaatcagctgtcagtcgatctctcagcacgtcgatatggcattggtcaggctgatccatcagttttccacgatgatcgacgatatcaaggccacacagaccgacatcaagttgtcccggtacaccgccggctccgcgtctccgacccctactttcaaaactagaaaacatagagattttaggtctagtgactttagtaggagctctcggggctcactgaatggagggaacagggtgaataacgccaaaaacaagagaaccaacaacgagaacaacaagaaggaaagtcgcaataaaaactccctcggacgaagcgaaagaagaactagcaaggttagtcggaaggggtccaaagatgtagtcgatcatatgactatacacatggacgactccgactcaataactgtatccgagcagagtgaaccctccgccgagtgttggcaaaacatgtacaagctgctcaacttctacagtctgattagcgacccaaccgggatcctggaaaaatcttcagaaaccttcggtcctgccggggtgcggtcccctacagagccaacttgcaaggtcgttttcgagaacgagcaggataattctagtctgacaaaaacgcagagaaagaggtcccttgtgacatccgagccccagcacgtgaccttgatcgtattcggtattggcatggtgaatagaactcaccttgaagccgacatcggcggccttacaatggaatctgagttgaagagaatacatggaagctttacactgaaagaaaaaatgaaagatgtactgcaccaaaaaatgaccgaaacatgtgcgaccgctcacatcgggggcgtcaatatcgtcttgctggaaggcatcactcccaacatccagctggaggacttccccacttcgccgacatcaacagccaaacaggaatttctgacggtggttaagtgcagcattgctaagtcgcaggccctgtacagcgctcaaaggggcctgaagaccaataacgctgccgtgttcaaagtcggcgctatcagtataaacataccacagcacccagccacccttcactccatgatggtcagaagcagccatcagctctctaagcaaataagtgatctaatccgacagccaagtaccgcacctcaaccggttaaagaggacatcgcgaccccactgccgtcagagaaaactcccacttcagtgaatcagacacccgtggaaacgaatgagtttccacagctcccagagggactggaaaagaagccgatagtgttgaaattttccgcgatgctggacggaatagcgattggcgccgccctgctcccctccttaaaagccgaatacaaaatgggccgaatgagatcccacggcatgaccggcgcccagacccgcttcacttttgagctgccaaaccatcgcctgcgcttcacatctaaggtgtccgccacagacatgagcactatccccccatcagcgtcgcttaacctgcccccagtaacgatgtctggtaagtatatcatggaggagcacgactcctatagtgaccaagtgtggtccatcgatgagcttccttccaaacaagggtattaccttcaggggaactatctccggtgcgtagccgaggtcggatcctttgaacataacctcacaaccgatcttctaaatcatctcgtgtttgtgcagaaagtgtttatgaaggaggttaacgaggtaatccaaaaggtctctggtggagagcagcccattccactttggaacgagcacgatggcaccgccgatggagacaagcctaaaatcctgctgtattctctgaatctgcagtttaaagggatccaggttaccgctaccacaccttccatgagagctgtgcggtttgaaaccggccttatcgagctcgaactgtccaaccggctgcagaccaaggcctctccgggatcctcctcatatctgaaactgttcggcaagtgtcaggtagacctgaatttggccctcgggcagattgtgaaacaccaggtatacgaggaggctggctccgatttccaccaggtggcctattttaagacacgaatcggattacggaatgctctgcgggaagagatttcaggttcctccgaccgggaagccgtgttaatcacactgaacagacccatcgtgtatgcgcaaccagtagcattcgaccgggctgttctgttctggctaaactacaaggctgcgtacgataactggaacgaacagcgaatggcactgcacaaggatattcatatggccaccaaagaggtggttgacatgctccctgggattcagcaaacttctgctcaggctttcggaaccttgtttctgcagctaacagtgaacgacctgggtatctgtctgccaataacaaacaccgcccagagcaatcacacaggtgatttggatactggctcagccctagtgctcaccattgagagtactctgattactgcctgtagttccgaatccttggtatccaaggggcactttaagaatttttgcatcagattcgcagatgggttcgagacttcctgggatgactggaagccagagattcacggcgacctggttatgaatgcctgcgttgtgcccgacggtacgtatgaggtctgctcccgtacaactggtcaggctgctgccgaaagctcgagtgctggaacatggacgctgaatgtgttatggaagatgtgtggaatcgacgtgcacatggatcccaatattggaaagcgcttgaacgccctgggaaacaccctcaccaccttaaccggggaagaggatatcgacgatatcgcggacctgaactcggtcaatatagccgatcttagcgatgaggatgaggtcgatacaatgtctcctaccatacatactgaagcaacagactaccgtcgccaagcagccagtgcaagtcaaccgggggaactcagaggtcggaagattatgaagaggatcgtggacatcagagagcttaacgagcaggcgaaggtaattgacgacctgaagaagctgggtgcgagtgaggggacgattaatcaggaaatccagcggtatcagcagcttgaatctgtggctgttaacgacatccggcgggacgttcgaaaaaagctgagacggtcctccatgcgggcagccagcctcaaagacaagtgggggctttcttataaaccgtcgtattcccgctccaagtctatctctgcttctgggcgcccacccttaaagcggatggagagggccagctctagggtcggtgagaccgaagagttacctgaaatccgagtcgatgccgccagtccagggccccgggtgacgtttaatattcaggatacttttcctgaggagacagaattggacctgttgagcgtaacaattgaggggcccagtcattatagttccaactcagagggctcctgttccgtgttctctagccccaagacacccggaggctttagtccagggatcccatttcagaccgaggaaggtcggcgggacgattccttgtctagcacctccgaagactcagaaaaggacgaaaaggatgaagatcacgaaagggaaaggttttatatctatagaaagccctcgcacacatccagaaaaaaggctaccggttttgccgcggtgcaccagctgtttactgagaggtggccgacgacaccggtgaacaggtccttgagcggcaccgctacagagagaaatatcgacttcgagctcgacatccgggttgagattgacagcggcaaatgcgtcctgcatccaacgaccctgctgcaagagcacgatgatatatcacttaggcggagctatgaccggtcttcccgcagtctcgaccaagacagcccctcgaagaaaaagaagttccagactaactacgcgtctaccacccacctgatgaccggtaagaaagtcccctccagtttgcagacaaaaccatcagacttggagactacggtgttctacatcccaggcgtggacgtgaagctccactataactccaaaactctgaagaccgaatcccctaacgcttccaggggatcctcacttccacgcactctatcaaaggagtctaaactgtacggaatgaaggactctgccacgtccccaccctccccccctctgccgagcacagtgcagtctaaaaccaataccctgctacctccccagcccccccctattcccgctgctaaggggaagggttctggtggcgtaaagaccgcaaaactttacgcctgggtggccctccaatctttacccgaggaaatggttatctcaccttgcctccttgattttttggagaaggccctagaaaccatacctattacgcccgttgaacggaactacaccgccgtgagtagtcaggacgaagatatgggccacttcgaaattcctgacccaatggaggagagtaccacgagtctggtctcatcctccacgagcgcgtatagctcttttccagtcgacgtggtcgtgtacgtgcgggttcagccatcacagattaaattctcatgccttcccgtgtcccgtgttgagtgtatgctaaagttacctagtctggacctggtattctcttctaatcgtggggaactcgagacactgggcacaacttacccagctgagaccttgagcccgggaggcaacgctacacagagcgggaccaagacatctgcatccaagaccggcataccagggtcaagtggactcggatccccattaggtagatcacggcactccagctcacagtctgacctgacatcctccagttccagcagcagcgggttgtcattcaccgcctgcatgagtgacttttctctgtatgtatttcatccctatggggcgggtaagcagaagactgctgtgtctggactaaccccgggctctgggggtctcggaaacgttgatgaggagccgacctcggtgacaggacggaaggactctctcagcattaacctggagttcgtcaaagtctctctcagccggatcaggcgctcgggcggcgcctcatttttcgagagccaatctgtctccaaaagtgcatccaagatggacactacactaatcaacatttccgcagtgtgtgatatcgggagtgcaagcttcaagtatgacatgcgtaggctgtccgagatactggcctttcctcgagcatggtaccgccgaagtattgccaggcggctgtttttgggagatcaaacgataaaccttcccacaagcggcccgggtacccctgattcaattgagggggtctcccagcatctgtccccagaatcaagtagaaaagcttactgtaaaacatgggaacaacctagccaatctgcctcttttacacacatgccacagtcaccaaacgtgtttaacgagcatatgacaaatagtactatgagccccgggaccgttggacagtcactaaagagccccgcctcaattcggtcccggagcgtaagcgattcctccgtacctcggagggacagtctgtcaaaaacttcaactccatttaataaaagtaacaaggccgctagccagcagggtacaccatgggagacactggtggtgtttgctatcaatctcaagcagcttaatgtgcagatgaatatgtccaacgtcatgggcaacacaacctggacaacatccggattaaagtctcaaggccgactgtcagtgggaagcaaccgggacagggagattagcatgagcgtcgggctgggccgtagccagttggattctaaaggcggagtggtgggcggcaccatcgatgtcaatgccttggagatggtggcccacatatccgaacatccaaaccagcagccttcacacaaaattcagataacaatgggctccacagaggctcgggtggattatatgggatcctctatcctgatgggcatcttttccaatgcggacttgaagttgcaggatgagtggaaagtcaacctgtacaataccttagattcctctatcaccgacaaatccgagatcttcgtccacggcgatctgaagtgggacatctttcaggtgatgatcagtagaagtactacccctgatcttataaaaatcggaatgaaattgcaggagttcttcacccaacagtttgacacctccaagagggcgcttagcacctggggaccagtgccttatttacctcccaaaactatgaccagcaaccttgagaagagctctcaggagcagttactcgatgcagcccaccatcgacactggcccggcgtcctgaaggttgtgtctggctgccatataagcctttttcaaatcccccttcccgaagatgggatgcagttcggtggatcaatgtcactgcatggcaaccacatgactctagcgtgtttccacgggccaaactttcggagcaagagctgggcactgttccacctggaagagcctaacattgcgttttggacagaagcccagaaaatctgggaggatggcagttccgatcacagcacctatatagtgcaaacattggatttccacctgggacataacaccatggtgaccaagccttgcggggccctggaatccccaatggccactataaccaagatcacgcggcgacggcatgaaaaccccccccacggcgtggcgtccgtcaaggagtggttcaactatgtcaccgcaactcgaaacgaggagctgaacctcctgaggaatgtggacgccaacaataccgagaactccaccactgtgaagaattcttctctgctgagtggctttaggggcggtagctcatataaccatgagacagagacaatctttgctcttcccaggatgcaactggatttcaagtcgatccacgttcaagaaccccaggaaccttctcttcaggatgcttcactaaagcctaaagtggaatgctccgtggtcaccgagtttaccgatcatatctgcgtgacgatggacgcagagctaatcatgtttctgcatgatctggtgtccgcatatctaaaggaaaaggagaaggcaatatttcccccccggatcctgagcacccgccctgggcaaaaatctcctatcattattcatgacgacaatagttccgataaagacagagaggacagcataacgtacactactgtcgactggagggacttcatgtgcaacacctggcacctggagccaaccctgcgcctgattagctggactgggcgcaaaattgatcccgtaggcgttgactacatactccaaaaattgggattccaccacgctagaaccaccatccccaaatggctccagcgtggggtcatggatcccctcgataaagtcctgagtgtgctgatcaagaagctgggcacagctttgcaggacgagaaggagaaaaaaggaaaggataaagaagagcactag

SEQ ID NO: 201241 - DNA, 2772 bp, Artificial Sequence
  Description of Artificial Sequence: Synthetic coding sequence
atgagccagttcaagcggcagcggatcaaccccctgcccggcggccgaaatttctcgggcacagcgtccacttcactgctgggaccccctccaggtttacttaccccacctgtggctacggagctcagccagaacgcccgacaccttcaaggtggtgagaaacagagagtcttcactgggatagtgacttctttgcatgattacttcggtgtggttgacgaggaggtgtttttccagctgtcggttgttaagggccgcttacctcaactgggagagaaggtgcttgtgaaagccgcttacaatccagggcaggccgttccatggaatgctgtgaaggtgcagactctgtctaatcagcccctcctgaaatcgccagctccgccacttcttcacgtcgctgcactgggtcaaaaacaaggtatcctcggcgcacagcctcagctaattttccagccgcaccgtattccccctttgtttccacagaaacctctttctctgttccagaccagccataccctccatttgtcacatctcaacagatttcctgcgagaggtccccacggacgcctggatcagggaagatcggatgactatgactcgaaaaagagaaaacagcgagcaggaggcgaaccatggggggctaagaaaccccgccatgacctgcccccctaccgcgtgcatctgactccctatacagtagactcacctatctgcgacttcctggaactccagcggcgatatcgctccctgttggtgcccagcgactttttgagtgtccatttgtcgtggctgagtgcgtttccactgtctcagcctttctccctacaccatccgagtcgcatccaggtaagttctgagaaggaggccgcgcccgatgccggtgctgaacctattacagctgactcagaccccgcatactccagcaaggtcctgttactgtcttcaccaggtctagaggagctctaccgctgctgcatgctattcgtcgatgacatggctgaaccccgcgaaaccccggagcaccctctgaaacagatcaagtttctgctgggtagaaaggaagaagaggccgtccttgtcgggggagaatggtcccctagcctggacgggctggatccacaagcagacccacaagtcttggtccgcacagccatccggtgcgcccaggctcagacggggattgatttgtccggttgcacaaaatggtggcgattcgccgagttccaatacctgcagccaggacctccaaggagattgcagaccgtggtggtctatctgccggatgtttggacaattatgcctacattggaggagtgggaggctctttgtcagcagaaagcagcggaagctgctcctccgacacaagaggctcagggtgagacagagcctaccgagcaggcaccagatgcccttgagcaggccgctgatacctctaggcgaaatgcggagactcccgaagccacaactcagcaggaaactgatacagacctgcccgaagctccccctcccccacttgagcccgcggtgattgcccgtccaggctgcgtaaaccttagcctgcacggtattgtcgaggaccgcaggccaaaagagaggattagcttcgaggttatggtgttagccgagctctttctagaaatgctacagagggactttggctaccgggtgtacaagatgctcctgtctctacccgagaaggttgtatcaccgcctgagccggaaaaggaagaggccgcaaaggaggaagccactaaggaggaggaagcgattaaggaagaggtggtgaaagaaccaaaagacgaggcccagaatgagggaccagcgacagaatccgaggctccactgaaagaagatggcctgctgcccaaaccactctccagcggaggggaagaggaagagaaacccaggggcgaggcaagcgaggacctgtgcgagatggcactggaccctgagctgcttttgttgagggatgacggagaagaggaattcgccggagccaaactggaggactctgaagtaagatccgtggcctccaatcaatccgaaatggaattttcgtcactgcaggacatgccgaaggagttagatccatccgccgtgcttccactcgattgtctcctggcctttgtgttctttgatgccaactggtgcggatatctgcaccgaagagatctggaacgcattcttcttaccttgggtatccgtctgtctgccgagcaggctaaacaactggtgagtcgagtggtcactcagaatatttgtcagtaccgtagtctccagtattcaaggcaagaaggcctggacgggggactcccagaggaggtgctcttcggcaatctcgatctgctgccaccacctgggaaaagtactaaaccaggagcagcccccacagagcacaaagctcttgtgagtcacaacggatcactaattaacgtcggcagcctgttgcagcgggccgagcagcaggactcaggacggctctacctggaaaataagattcatactcttgagttaaagttagaagaatcacacaatagattctctgcgacggaggttacgaataaaacactggccgccgagatgcaggagctccgcgtaagactggccgaagccgaggagactgctcggacggctgaacggcagaaatctcaactccagcgtctgcttcaagagctgaggaggagattaactccactgcaactggagatccaaagggttgtggaaaaggcagatagctgggtggagaaggaggagccagcccctagtaactag

SEQ ID NO: 201242 - DNA, 2982 bp, Artificial Sequence
  Description of Artificial Sequence: Synthetic coding sequence
atgggcgccgccggccggcaggacttcctgttcaaggccatgctgaccatcagttggttaaccctgacctgtttccccggagccacatctactgttgccgcgggatgccctgaccaatcaccagaattacagccatggaatccgggccatgatcaggatcatcacgtgcatattggccaggggaagaccctgctgctgacatcctctgccaccgtctacagtatacacatttctgaaggtgggaaactggtcattaaagaccacgatgagccaatcgtccttcgcactagacatattctgattgacaacggcggtgaactgcatgcagggagtgccctatgccccttccagggcaacttcacaatcatactttacggacgcgcagacgaagggatccagcccgacccctactacgggctaaagtatataggcgtcggcaagggaggcgctctggagttacatgggcaaaagaaactgtcttggacgttcttgaataagaccctgcaccccgggggcatggctgaagggggatattttttcgagcgctcttggggacatagaggggttatcgtacatgtgattgaccctaagagcggaaccgtgattcactcagatcgatttgacacctacagatctaagaaagagtcggaacgccttgtacagtatttaaatgccgttccagacggtaggattcttagcgtagctgttaacgacgagggcagccgaaacctggatgatatggccaggaaagccatgaccaaactgggcagcaaacacttcttacacctgggtttcagacatccatggtcgtttttaaccgtgaaaggtaacccatctagctcagtagaagatcacatcgaataccacggtcatcgcggaagcgctgcagcacgggtgttcaagttgtttcaaacagaacacggcgagtattttaacgtgtccttgtcatcagaatgggtgcaggacgtagagtggaccgagtggttcgatcatgacaaggtgagccagacgaaaggcggggagaagatcagtgacctctggaaggcacaccccggaaagatttgtaatcggccaatcgacattcaggctacaacaatggacggagtcaatctgagcacagaggtggtctacaagaaaggacaggattatcgcttcgcctgttatgatcgaggcagggcttgcagatcgtatcgcgtgaggttcctgtgtggcaagccagtaagaccaaagctcacagtgactatcgatacaaatgtcaattccacaatcctgaaccttgaagataacgttcaaagctggaagcctggcgacaccttagttatcgcgtcaactgactactctatgtaccaggccgaggaatttcaagttttgccatgtcgaagttgtgccccgaatcaggtgaaggtagcgggaaagcctatgtatctgcacattggcgaagagattgacggagttgatatgcgagctgaagttggccttttaagcaggaatattatcgttatgggtgaaatggaggataagtgctacccttaccggaatcacatttgcaatttttttgatttcgatacgtttggaggccacataaagttcgcactggggtttaaggcagcccacctggagggcaccgaactcaaacacatgggccagcagctcgttggccagtatcccatccatttccatctggctggcgacgtggatgagcgaggtggctacgatcctcctacgtatattagagacctgagtatacatcacaccttttcacgctgtgtgacagtgcacggaagcaacggactgcttattaaggatgtcgtggggtacaattccctgggacactgcttctttacagaagacggaccagaagagaggaacacctttgaccactgcctgggccttttagttaaaagcggaacacttctgccatctgatcgggactccaagatgtgtaaaatgattactgaagactcctatccggggtatatccccaaacctaggcaggactgcaacgctgtctcgaccttttggatggcaaaccccaataataatttgataaattgcgccgccgcgggtagcgaagagaccggcttctggttcatttttcatcatgtccctacaggaccctcggtcggcatgtactcacctgggtactccgaacatattccattgggcaagttctacaataaccgggcacattcaaactacagggccggcatgattatcgataacggagttaagaccacagaggcaagtgccaaggacaagcgcccatttctctccatcatttcagccaggtatagccctcaccaggacgctgaccccctcaagcccagggagcctgctattatcagacactttatagcctacaagaaccaggatcatggtgcttggctacggggcggagacgtatggttggacagctgtcgttttgcagataatgggatcgggctcaccttggccagtgggggcaccttcccgtacgacgacgggtctaagcaggagattaagaattctctgtttgtgggcgaatctgggaacgtcggtacagagatgatggataaccggatttgggggcctggggggctcgatcactctggtcggaccctgcccatcgggcagaattttcccattcgcggcattcagttatatgacggtcccatcaatattcaaaactgcacctttagaaagtttgtggccctggagggcaggcatacctccgctctggcatttcgcttgaataacgcctggcagtcgtgtccacacaataatgtcacaggcattgctttcgaggacgtccctatcacaagccgggtgttcttcggagagccaggcccctggttcaaccaactcgacatggatggcgacaagacttctgttttccacgatgtggatggatcagtgtcagagtaccccggttcctacctgaccaagaatgacaacaaatggcatagtctggcatcaaaggctgctagcggacctagcggctag

SEQ ID NO: 201243 - DNA, 4086 bp, Artificial Sequence
  Description of Artificial Sequence: Synthetic coding sequence
atgggcgccgccggccggcaggacttcctgttcaaggccatgctgacgattagttggttgacactgacatgtttccctggggccactagcaccgttgcggcaggctgccccgatcagtcacccgagctgcagccttggaatcctgggcacgatcaggatcaccatgtgcacatcggacaggggaagacactcctattgacctccagcgctaccgtgtattccatacatattagcgaaggaggcaagctggtcattaaagaccatgacgagcctatcgttctgaggacacggcatattctgattgacaacggcggggaattgcatgccggctcagctctctgtccgttccaagggaacttcaccatcatcctttacgggagagccgacgaaggcattcagccggatccttattatggtctcaaatatattggcgttggcaaagggggagcactggaactgcacggtcagaaaaagctatcttggaccttcttaaataagaccctacatcctggaggaatggctgagggcggttactttttcgagcgctcttggggccatagaggcgtcatcgtgcacgtgattgatcctaagtcaggcacagttattcactctgacagatttgacacctacagaagtaagaaggagagcgaacgactagtgcagtatctgaatgctgtgcccgacggtcggattctctcagtggctgttaatgatgagggttccaggaacctggatgacatggcacgcaaagccatgacaaagttaggctccaagcactttctacatttgggtttccgacacccgtggtcctttctaacagtaaagggcaacccatcgtccagcgttgaagaccacatcgaatatcatgggcacagagggagcgctgctgcacgggtgttcaagctttttcagactgagcacggagagtacttcaacgtgtcactttcgagcgagtgggttcaggatgtcgaatggaccgaatggttcgatcacgacaaggtgagtcaaaccaagggaggggagaaaatttccgatctctggaaggcccatccaggcaaaatatgcaataggcctattgacatccaggccactaccatggatggcgtgaatctgagtaccgaggtcgtctacaaaaaaggccaggactacaggttcgcttgttatgaccgcggccgagcgtgtcgtagttatagagttagattcctgtgtgggaagcctgtgaggcctaagcttacagtcacgattgacaccaacgtgaacagcacaatcctgaacctcgaagataatgtgcagagctggaaaccaggcgacacattggtcattgcatccacagattattcaatgtaccaagcagaggagttccaggtgctgccgtgccgctcctgtgctcctaaccaagtaaaggtggccggcaaacccatgtatcttcatattggggaggaaatcgatggagtcgatatgcgggccgaagttgggttgttgagtcggaacatcattgtgatgggagagatggaggacaaatgttacccctacagaaaccacatttgtaacttttttgactttgatacgtttggagggcacataaaatttgctctcggatttaaggcagcccacctggaaggcacggagctcaagcatatgggccagcagctggtgggtcaataccctatccactttcatctggccggcgatgtagatgagcgaggaggttacgatccgcctacctacatcagagacctgagcatacatcacaccttctctaggtgtgttacagttcatgggtcgaatggcctgctaatcaaagacgttgtgggatataacagtttggggcactgtttttttaccgaggacgggcccgaagagagaaatacctttgaccattgtctgggtctactggtgaagagcgggaccctgctccctagtgatcgagactcaaagatgtgcaaaatgatcactgaagattcctatccaggatacattccgaagcccagacaggattgtaatgcagtctctactttctggatggccaatcctaataacaaccttattaactgcgctgctgctggatcagaggaaacaggattttggtttattttccaccatgtgcccactggcccctctgtggggatgtatagcccaggatactccgagcacatccccttgggaaaattttacaacaacagggcgcacagcaactaccgggccggtatgatcatcgacaacggtgtgaaaactacagaggcctctgccaaggataagagaccattcctgtccatcatctctgcccggtattcgccccaccaggacgcggatcccctcaaaccaagagagcctgctataatcaggcattttatcgcatataaaaaccaagaccacggtgcctggctacgggggggagacgtctggttagatagctgccggttcgccgataacggcatcggtcttaccctcgccagcggtggcacatttccttatgacgacggtagcaagcaggagataaagaattctctgtttgtgggagagagcgggaacgtgggcactgaaatgatggacaacagaatctggggcccaggaggattggaccattccggacgcaccctgccgattgggcagaactttcctatccgcggtatccagttgtacgatgggcccatcaatattcagaactgcacttttcgcaaattcgtggctctggaaggacgtcatacatccgctctggcttttcggttaaacaacgcttggcagtcgtgccctcacaataacgttacaggcatcgcgtttgaggatgtaccaataacctcgagggtgttttttggagagccggggccttggtttaatcagctggatatggacggtgataagacgagtgtatttcatgatgtagacggtagcgtgagcgaataccccgggagctacctcaccaagaatgataactggctcgtgcggcatcctgattgcatcaacgtgccagattggcgtggggctatatgcagcgggtgctacgctcaaatgtatatccaggcttacaaaacaagcaacttgcgcatgaagatcatcaaaaatgattttccaagccatcccctgtatctggaaggcgcgttaacgagaagcacacattatcagcagtatcagcccgtggtgacactccagaaaggttatacaatacactgggatcagacagctccggcagagctggcaatatggctgattaatttcaacaagggcgactggatccgcgtgggcctgtgctatcctcgcggcactactttttctatcctatccgatgtgcataaccgactcctgaagcaaacaagcaaaacaggagtatttgtccgtacattgcagatggacaaagtggagcagtcgtatccagggaggagtcactactattgggatgaggactctggtctgctgtttctgaagttaaaagcacagaacgagcgcgagaagtttgccttctgctccatgaagggctgcgaacggatcaaaattaaagctcttatcccaaaaaatgcgggcgtgtcggactgcaccgcgaccgcatacccaaagtttacagaacgagcggtggtagatgtaccaatgcccaaaaagctctttggatcccaactgaagaccaaggaccacttcctggaagtcaagatggagtcttcaaagcaacatttctttcatctgtggaacgactttgcgtatatcgaagtcgatggcaaaaagtatcctagcagtgaagatggtattcaagttgttgtgattgatggaaatcaggggagagtggtttcacacacgtcgttcaggaatagcatcctgcagggcatcccgtggcagttatttaactacgttgccactatcccagacaattcaattgtcctcatggcttctaaaggacgctacgtgagcaggggcccatggactagggtgttggaaaaactaggggcagatcgtgggctcaagctgaaggaacagatggcttttgttggatttaaaggcagctttcgcccaatctgggtcacactggacaccgaggaccacaaagctaagattttccaggtggtgccgattcctgtggtgaagaaaaagaagttgtag

SEQ ID NO: 201244 - DNA, 1947 bp, Artificial Sequence
  Description of Artificial Sequence: Synthetic coding sequence
atggaggtgaagggcaagaagcagttcaccggcaagagcaccaagactgctcaggagaagaatagattccacaaaaattcagatagcggtagttctaaaacctttcctactcgaaaggtcgccaaagaaggggggcccaaggtgacttcacgcaacttcgaaaaatctataaccaaacttggtaaaaagggggtaaagcagttcaagaataaacaacaaggagacaaatcaccaaaaaataagttccagccagcaaataaatttaataaaaagcggaaatttcagcccgatggtcgatccgatgaatccgcagccaagaaacctaaatgggatgattttaagaagaagaaaaaagagctcaaacagagtaggcagctcagcgataagactaactatgacatcgtggttcgagcgaaacagatgtgggaaattctgagaagaaaggactgtgacaaggagaaaagagtcaagcttatgagcgacttgcagaagcttattcagggcaagatcaagacaatcgcttttgcccatgactcaacaagggtcattcagtgctatatacagtacggtaatgaggaacagcgaaagcaggcatttgaagagctccgcgatgacctcgtagagctgtccaaagccaaatactctcggaacatcgtgaaaaaatttcttatgtacggatcaaaacctcagatagctgaaatcattcggtccttcaaggggcacgtgaggaagatgctgagacacgccgaagcctccgcgatagtggaatatgcctacaacgacaaggctattctggaacagcgcaatatgcttaccgaggagctgtacggaaatacttttcagctctacaagtccgcagaccaccgaacgctggacaaagtcctggaggtgcaacccgagaagctagagctgataatggatgagatgaaacagatcctcaccccaatggctcagaaggaggcggtcattaagcacagtctcgtgcataaagtatttctggacttcttcacgtacgccccacccaaactccggagcgaaatgatagaggcaatccgtgaagctgttgtgtatctggcccacacacatgatggggcccgtgtggcgatgcactgcctttggcacgggacacccaaggaccggaaggtgattgtgaaaactatgaagacctacgttgagaaggtcgctaacgggcagtatagccacctagtgcttctagcggccttcgattgtattgatgacactaagctcgtgaagcaaatcattatttcagaaattatcagctccctgcccagcattgtgaatgataagtacggtcgaaaggtgctgctctacctactcagccccagagaccctgcccacaccgtgagagagataatcgaggtcctgcagaagggtgatgggaatgctcacagcaaaaaagacactgaggtccgccggcgtgagcttctggaatcaatcagccctgcactgctctcatatctgcaggagcacgctcaggaggtcgttttggacaaatctgcttgtgttctggtgagtgatattcttggttcagctacaggtgacgttcaaccaacaatgaatgccatcgcctctttggctgcgacaggtttgcatcctggagggaaggatggcgagctgcacatcgcagagcaccccgcaggccatctcgtactcaagtggcttattgagcaggataagaagatgaaggagaatgggcgcgaaggatgttttgctaagacactcgtcgagcacgtgggcatgaagaatctaaaatcttgggcctccgtaaaccgtggagcaattatcctctctagcctgctgcaatcgtgcgatctggaagtggctaataaggtaaaagccgccctgaagagcctgattcctaccctggagaagactaagtccacttctaagggcattgaaatactcttggagaaactgtccacatag

SEQ ID NO: 201245 - DNA, 339 bp, Artificial Sequence
  Description of Artificial Sequence: Synthetic coding sequence
atgaagaaccaggtgtgcagcaagtgcggcgagggcacctacagcctcgggtcgggtatcaagttcgatgagtgggatgaactgccagcaggtttttcaaacattgcaacattcatggatactgtggtgggtccttcggactcaaggccagacgggtgcaataactcatcatggatccccagaggtaactacattgaatccaatagagacgactgcaccgtgagtctgatttacgcagtgcatctgaagaaatctggatacgttttttttgagtaccagtatgtggacaataacattttcttcgaattcttcatccagaatgatcagtgccaggaatag

SEQ ID NO: 201246 - DNA, 1842 bp, Artificial Sequence
  Description of Artificial Sequence: Synthetic coding sequence
atgttcagcgccggcgccgagagcctgctgcaccaggcccgggagattcaggatgaagaactgaaaaaattttgtagcagaatttgtaagttactgcaagccgaggatctgggccccgacactttggacagcctccagaggctcttcttgataatcagcgccactaaatatagtagaaggcttgaaaaaacctgcgtcgatcttctccaggcaacattaggattgcctgcttgtcccgagcagctgcaggtcctttgtgcagcaattttgagagaaatgtcgccttcagatagcctatctctcgcctgggatcatacccaaaattcgcggcagttgtctctggtcgcttcggtcctcctcgcccaaggagacaggaatgaggaggtgcgtgctgttggacagggcgtgctgcgcgctctcgaatcccggcagcccgaaggccctagcctgcgccaccttcttcctgttatggccaaagttgtggtgctttctcctggtacactacaagaagaccaagcaaccctgctgtctaaacgtttggtcgactggctacggtatgcctcactgcaacaggggttaccacactcagggggctttttcagcacgccgcgcgcgcgacagcctggaccagtgactgaagtggacggcgcggtcgccactgacttcttcaccgtattgtcgagtggtcaccggttcacagatgatcagtggctgaatgtgcaggccttttcgatgttgagggcctggctgctccattccggcccagagggacccggaacactcgacactgacgatcgctcagagcaagagggttctacactgtcagtaatcagcgctacatcaagtgcaggaagattactgcctccaagagagcggctgcgggaggtcgccttcgagtattgtcagaggcttatagagcaatccaatagacgcgcgctccggaaaggagattctgacctgcagaaggcttgcctggtggaggcagtgctcgtgctggatgttctgtgtcgccaggatccgtctttcctatacagaagcctgtcgtgtctgaaggcattacacggtagggtgcgtggtgatcctgcgagcgtccgagtgcttttacctctcgctcacttttttctgagccacggagaggccgcagccgtcgattctgaggctgtgtatcagcatctcttcacaaggatcccagtggaacagttccacagccccatgctcgccttcgagttcatccagttttgtcgggacaatctgcacctttttagcggacacttatccacgttaagactgtccttcccgaatctatttaaattcctagcatggaatagcccgcctttgacttccgaattcgtcgccctgttgccggcgctggtcgacgcaggtacagccctggaaatgcttcatgcccttctggacctgccctgtctgaccgcagtgcttgacctgcagctgcgctccgcaccagccgcctcagaacgcccactatgggatacgagcttgagggccccgtcctgcctggaagcattcagagacccccagtttcagggactctttcagtatctgctccgccctaaagcatctggcgctaccgaaaggctcgctcctctgcaccagctgctccaacctatggctggctgcgcaagagtcgcacagtgtgcccaggccgtccctacgctactgcaggcctttttctctgccgtaacacaagtcgcggatggaagcctgataaaccaactggccctgctactgctgggaagatccgactccctctacccggcccctggatacgccgcgggcgtgcaccgacccgatgcctgcagaccaatactcgttcctttatag

SEQ ID NO: 201247 - DNA, 918 bp, Artificial Sequence
  Description of Artificial Sequence: Synthetic coding sequence
atggagaaggagacctacaagaccgccaagctgatcctggagcggtttgatcccgattcaaagaaggccaaggagtgtgagcctcccagcgcaggggctgccgttacagcccggcctggacaagagatccgccaacgcaccgcggcacagcgcaatctgtcacctacacccgccagcccaaaccaaggacctccaccacaggttcccgtgtctcccggcccccccaaagattcatcggcacccggaggaccaccggagagaaccgtgaccccagctctgtcgagtaatgtcctgcctcggcacctgggttctcccgcaacctctgttccgggaatgggactgcaccccccaggcccacccttggcccggccaatcctgccacgagagcggggcgcgcttgataggattgtggaatacctcgtgggcgatggcccgcaaaacagatatgccctgatctgtcagcagtgtttcagtcataacggcatggcgctcaaagaggaatttgagtacatagctttccggtgtgcatactgtttcttcctgaacccagcacgcaagaccagaccccaagctcctaggctccccgagttcagcttcgagaagaggcaggtcgtggaaggatcgtcttcggtagggccacttccatctggatcagtcctttccagtgataatcagttcaatgaggaaagtcttgaacacgacgttctggatgacaacaccgagcagaccgacgacaagatccctgctacggagcagactaaccaggtgatcgagaaggcctccgactcagaggaacctgaggagaagcaggaaacggagaatgaggaagctagtgtaatcgagactaatagtactgtccccggagcagattccatcccagatcccgagctgtctggggaaagccttactgctgagtag

SEQ ID NO: 201248 - DNA, 2589 bp, Artificial Sequence
  Description of Artificial Sequence: Synthetic coding sequence
atgcacagcagctggatcccccggggcaactacatcgagagcaacagagatgactgtacggtgagtcttatttacgctgttcacttaaagaaatccggctatgttttctttgaataccaatatgtcgataataatatattctttgaatttttcatccagaatgaccagtgccaagagatggatacaaccaccgacaagtgggtgaaactgactgacaacggggaatggggtagccacagtgtcatgctcaaaagcggtacaaacattttgtattggcgaactactggtatcctgatgggatcaaaggcagtgaagcctgtgctggttaagaatataacaatagaaggggtagcctacacctccgaatgctttccatgcaagcctggtacctttagtaacaagccagggagcttcaactgccaggtttgcccaagaaacacatactctgaaaagggcgcaaaagaatgcatccgctgcaaggacgactcgcagtttagcgaagaagggtcttctgagtgtacagagcgcccgccctgtaccaccaaggactacttccagatccatacaccctgtgacgaagaaggaaagacccaaatcatgtataaatggatcgaaccaaagatatgtagggaggaccttaccgacgcaataagactgcctccgtccggcgagaagaaggactgtcctccttgtaaccctgggttttacaataacggctcgtcatcatgccacccttgtcctcctggaacattcagtgacggaacaaaggaatgtcgtccatgccccgctgggaccgaacctgctcttggattcgagtataagtggtggaatgtgctgccaggaaatatgaagacaagctgcttcaacgtgggcaattccaagtgcgacggcatgaatgggtgggaagtagctggcgaccacattcaaagtggcgctggaggttccgacaacgattatctcatccttaatctacacattcctgggtttaaaccccccactagcatgacgggggcaactgggagcgagctaggccgcataacctttgtgtttgagacactgtgttccgctgactgtgtgctgtatttcatggtcgacatcaatcgcaagtccaccaatgtggtggagtcgtgggggggtaccaaggaaaagcaagcctacacacatatcatttttaagaatgccactttcacattcacatgggctttccaaagaacaaatcaggggcaagataaccgtcgcttcatcaatgatatggtgaaaatctacagtattaccgcaaccaacgccgtggatggcgtggctagcagctgccgggcgtgtgccctaggctccgaacagtccggctcatcatgcgtgccttgccctccagggcactatattgaaaaggagaccaaccagtgcaaagaatgccctcccgacacttatctctccatccaccaggtgtatggcaaagaagcatgcataccctgcggacccggctcaaagaataaccaggatcacagcgtttgctattccgactgctttttctatcatgaaaaggaaaaccaatctctgcattatgattttagtaacctgagcagtgtgggctctctgatgaacggaccaagcttcacttctaaaggtactaagtattttcactttttcaacatcagtctctgtgggcacgaggggaaaaaaatggccttatgtaccaacaatataaccgattttaccgtaaaggagatcgtggcaggaagtgatgactacactaatctggtcggagctttcgtgtgccagtccacgattatcccaagcgagagtaaggggtttagggctgccctgagtagccagtccatcatcttggcggacaccttcattggagtcacagtcgaaacaacccttaaaaacattaatattaaggaggatatgtttccagtgccaacctctcagattcccgacgtacactttttttataagtcatctacagccacaaccagttgtattaatggccggtctactgccgtgaaaatgcgctgcaaccccaccaagagcggcgctggagtgatatcagtgcctagtaagtgtcccgccggcacctgtgacggttgtaccttttacttcctttgggaatctgcagaggcctgccccttgtgcacagaacatgactttcacgaaattgagggcgcatgcaagcgcgggtttcaggaaactttgtacgtctggaatgagccaaaatggtgtattaagggcattagtctgccagagaaaaaacttgctacttgtgagaccgttgatttctggctgaaggtgggggctggagtgggcgccttcacagcagtcctgttggtcgccttgacatgctatttctggaagaaaaatcagaaactggagtacaaatacagtaaactcgtcatgacaactaactctaaagaatgcgaactccctgccgctgactcttgtgccatcatggagggggaggacaatgaagaagaagtggtgtacagcaataagcagtctctcctcgggaagctcaaaagcttagccacaaaggagaaagaagaccatttcgagtccgtccaactgaagacaagcagatcccctaatatctag

SEQ ID NO: 201249 - DNA, 5853 bp, Artificial Sequence
  Description of Artificial Sequence: Synthetic coding sequence
atgcccggcgcccggcggcggcggcggggcgccgccatggagggcaagccacgcgctggagtggctctggcccccggcccctctggccggcgacctagcgcaagatgcgcacgacgtcgacgtcctgggctgctcctaccaggactctggttgctgctgctggctcggcctgcctcctgtgctcctgacgaattgtcccctgagcagcacaatctgtcattgtacagtatggagctagtacttaagaagtcaactggtcacagcgccgcccaggtggcattgacggagaccgcgccaggaagccaacactcatccccccttcatgtgactgcaccaccatcagcaaccacattcgacactgccttcttcaaccagggaaagcaaaccaaatccactgctgaccctagtattttcgtggctacttacgtgtcagttacctcaaaggaggtagcggtgaacgatgacgagatggacaacttcctcccagacacacattggacaacgcccagaatggtctcaccgatccagtacatcacggtgtctccacctgggctgcctagggaagctctcgagcccatgctgacgccctctctcccaatggtgagtctacaggatgaggaagtgaccagcggctggcaaaacactactagacaacctgccgcttacgccgaatcagccagccacttccacaccttcagaagtgcgtttaggacctcagagggaattgtgcccacacccggtagaaatctggttctgtacccaacagacgcttactcacacttgagctctaggaccctgccggagatcgtggcctctttgacagaaggcgtggagactaccctttttctctcctccagatccttaatgccacagccacttggggacgggatcacaatccccctgcctagcctgggtgaagtgtctcagccccccgaagaggtttgggctactagcgccgatagatacacggacgtgactactgttctcagccaatccctggaagagacaatctctcctagaacctatccaactgtaacagcatctcacgcagccctcgctttctccagaactcacagcccgctcctgtctacaccactggcatttgcctcctctgcatctcccactgatgttagctcgaatccttttctgccttctgattcatcaaagacaagcgaactacactctaacagcgcactccccggtcctgttgacaatacccacattctgtccccagtgtcctcattccgcccatatacttggtgcgccgcctgtactgtgccttccccccagcaggtcctggcgacctcgctgatggagaaggacgtcggtagtggcgacggcgctgaaaccctttgcatgacagtgctagaagaaagcagtatctctttgatgagcagcgtggtggctgatttctccgagtttgaagaggacccacaggtttttaacacactttttccttcacggcctatcgttcccctctcaagtcgctccatggaaatctctgaaacgtcagtgggtatttcagccgaggtcgacatgtcatcggtcacgaccacccaggtaccccctgcccatgggcggctcagcgttcctgcatcgttggatcccacggcaggcagccttagcgtggcagaaacccaggtgacaccctcatctgtcaccacagcttttttttccgtcatcaccagtattctgctcgacagctccttctctgtgatcgctaacaagaacaccccatctctcgctgtccgagatccatccgttttcacaccttatagtttagttccgtcagtggagtccagcttgttttccgatcaggagcggtcaagtttttccgagcacaagccacgaggcgcactcgacttcgcctcttcctttttctctaccccaccgctcgagctctcaggatccatatcctccccatcagaggcacccgcttcactcagcctgatgcccagcgatctgagtccttttacaagccagagcttttcacccctggtggagaccttcacgttgttcgattcctctgacttacaatctagccaactgagtctacctagttcaaccaatcttgagttttcacagttacagcccagtagtgaattacctctaaacacaattatgctgctgccttcacggtctgaggtgtctccctggagttcttttcctagtgactctctcgagttcgtggaggcgtctacagtgtctctgaccgactccgaagctcattttaccagtgcctttatcgagactactagctatctggagtcaagcttgatctcccatgaaagcgccgtaactgccctggttcccccaggaagcgaaagttttgacattttgacagccggcatccaagcgacaagcccactcactacagtgcatactaccccgattctcaccgaaagctcgttgttctcgactctaaccccaccggacgatcagataagcgccctagacggccatgtctctgttctggcttcttttagcaaggccattcccactggaacagtccttatcactgatgcatacctgccatctgggagtagcttcgtctccgaagctacaccgtttcctctccccaccgagttgacggtagtagggccttccctcacccctactgaggtcccattaaatacatctaccgaagtgtccacgacatccaccggagccgctacaggcgggccactcgattctactctcatgggagacgccgctagccaatcccccccggaatccagcgccgccccgcccctgcctagcctcagaccagtcacagcatttacccttgaagccactgtggatactcccaccttagccaccgctaagccaccatacgtctgcgatattaccgtgcctgacgcctacctgatcaccactgttctagctaggagagccgttcaggagtatatcatcaccgccatcaaagaggtactgaggattcactttaatcgggcagtggaactaaaggtatacgaattgtttacagactttacatttctggtcacctcaggtccatttgtgtatactgcaatttcagtcatcaatgtgctcatcaattctaagctcgttcgtgaccaaacaccactgatcctgagtgtgaagccgtccttcctcgtgcctgaaagtagatttcaggttcagacagtactccagtttgtgcctccttcggtcgacactggcttttgcaatttcacccaacgaatcgaaaaaggcctgatgaccgccctctttgaggttagaaaacaccaccagggtacctataaccttaccgtacaaattcttaacataaccatctcctcaagtcgtgtgacacctcggcgcggcccagtgaacatcatatttgcagtgaagtcaactcaggggttcctgaatggcagcgaagtttcagaactgctgcgtaacctgtccgtcgtggagtttagtttctatttggggtaccctgtgttacaaatcgccgaaccctttcaataccctcaattgaacctgtctcaactcctcaagagtagttgggttagaacagtactcctgggggtgatggagaaacagttgcaaaacgaggtctttcaagccgagatggagagaaagctggcacaattactatctgaggtttctacacgccggagaatgtggcggagagctacggtcgctgccggcaattccgtcgtgcaggttgttaatgtttctcggctggaaggggacgataacccggtgcaattgatatattttgtggaagatcaggacggcgagaggcttagtgccgttaaatcttcagaccttattaataagatggacctgcagagagccgccatcattctgggttataggatccagggagtgatcgctcaacctgtggatcgcgtaaaaagaccgagccctgaaagccagtccaataatctgtgggtaattgttggcgtagtaattcccgttctagtggtgatggtgatcgtggtgatcctctactggaaactctgtcggacagataaactcgactttcagccagatactgtagccaacattcaacagcggcagaagctgcaaatcccaagtgtcaaggggttcgacttcgccaaacaacacctcggacagcacaacaaagacgacattctgattattcatgaaccagcccccctgccgggcccattgaaagaccacaccaccccatctgaaaacggcgacgtgccgtcccccaagagtaaaatccccagtaagaacgtccgacatagaggtagggtttcgcccagcgatgcggactctacagtgtcagaggaatcctccgagcgcgatgccggcgacaagactcctggggctgtaaacgatgggcgaagtcatcgggcgccacagtctgggcctcctctccccagttcgggcaatgaacaacacagctcagcctctatcttcgagcacgtagataggatcagcaggccccctgaagcgagtcgccgagtgccctccaaaatccagctaatcgccatgcagccaatcccagcgccaccggtgcagcggccgtctcctgcggatcgggtggccgagtctaacaagattaataaggagattcagacagcccttcgtcataaatcagaaattgagcaccacaggaataagattcggctgcgcgctaagcgacgcggacactatgaattccccgtggttgatgacctgtcctcaggcgatacaaaggagaggcatcgagtctaccgccgagctcaaatgcagattgataaaatactggatccaacagcgtccgtacctagcgtattcatcgaacccaggaagtcttcgagaataaagcgtagcccaaaacctcggaggaagcatcaagttaatggttgtccggccgacgcagaaaaggatcgcctgataactacggacagcgacgggacttatcgtaggcccccaggcgttcacaattccgcatacataggttgcccttcagacccagacttgcccgccgacgtccaaacaccttctagcgtggagctgggccggtatcccgcgctaccatttcccgcgagccagtatatccctcctcagccttcgatagaggaggcccgccagacaatgcacagtctgcttgatgatgctttcgccctcgtcgccccaagctctcaaccagcctctactgcaggggtgggccccggggtcccccctggattgcctgctaactcaaccccgtcacaagaagagaggagggctactcagtggggtagcttctattcccccgcccagaccgcaaataatccgtgctcaaggtatgaggattacgggatgacaccacctacgggcccgttaccccggcctggctttggcccgggcctgctccagtccactgaacttgtgccccccgatccccagcaaccccaggctagcgccgaggccccattcgccgctcgagggatatactccgaggagatgccctccgtggcaagacctcgacccgtcggaggcaccacaggtagtcagattcaacatttaactcaagtgggtattgcctcaagaataggtgcacagcctgtcgagatacccccctctagggggagccaatatggagggcccggctggccaagttacggcgaggatgaggcgggccgcagagaagcgacacatatgttaggacatcaggagtactcatcctcccccctctttcaggtaccaaggacttccggaagagaaccttctgctcccagcgggaatctgccacaccgcggccttcaggggcccggccttggctatcctactagctcgacggaggatttacagcccggtcattccagtgcctcattgattaaggccattcgcgaggagttgctcaggctctcccaaaaacaatctactgttcaaaattttcattcgtag

SEQ ID NO: 201250 - DNA, 357 bp, Artificial Sequence
  Description of Artificial Sequence: Synthetic coding sequence
tgaaagagcaacggcaagaccgccatcggcgaccccggccgggccaatatgcctggctataacgaggactcccggagcactttttttgacaaaaagtattccaacatgagcaccctgggtaataacggaccaacacacaagaagttgtaccgtcacaaaagctcctccaaagctctgagggatgagaagtgtaagggcaaacacatggagagagagcaggtacataaggacgaatccggcacggcaagttttgaaaagctcagagacagcgactacaatctgctaaaagccgaaaccaccttttgggtcctgccggtctttgaagaggaaaccaggattttccagaaggatatttag

SEQ ID NO: 201251 - DNA, 3084 bp, Artificial Sequence
  Description of Artificial Sequence: Synthetic coding sequence
atgcgggtgagccacaccttccccgtggtggactgcaccgccgcctgttgcgatctctccagttgcgatcttgcatggtggttcgagggtcgttgctacctggttagttgtccccacaaggaaaactgcgagcccaaaaagatggggccgattagatcctaccttacatttgtattgcgacccgttcagcgccccgcccagctgcttgactatggcgatatgatgctgaacagaggctcccctagcggcatctggggtgacagccccgaagatattcgcaaggatctgacctttctgggtaaggattgggggttggaggaaatgtcagaatattcagacgattacagagagctggagaaggacctgctgcagccctctggcaaacaggagccacgggggtctgctgaatataccgactgggggctgctgcccggaagtgagggggcatttaactccagtgtgggtgacagccccgctgtgcccgctgagactcaacaggatcccgaattgcattatctgaacgagtccgcaagcacacctgcgccaaagcttcccgagcggagtgttctgcttccattgcctaccacccctagttcgggcgaggttttggaaaaggagaaggctagccagcttcaggagcaatcctcaaatagctccgggaaagaagtgctaatgccttcccattccctaccacccgccagcttggaactttcctctgtgactgtggagaagtctccggtgctaactgtgacgcccgggagcacggaacactccatccccacaccacccacgtccgcagcaccgtcggaaagcaccccgtctgagctacctatttcacctacaactgcccctagaacagtgaaggaattaacagtcagtgccggggataacttaatcatcaccctaccagataatgaggtggagttgaaggccttcgttgccccagctccaccagtggagactacttataactacgaatggaatcttatatctcacccgaccgactatcaaggggaaatcaaacaggggcacaaacagacccttaatctgtcccagctgagtgtcggtctatatgtctttaaagtgactgtctccagcgagaacgccttcggtgaagggttcgtcaatgtcactgtcaaacccgcccgcagggtgaacttaccccccgtcgctgtagtgagcccccagctgcaggagttgaccctgcccctgacatcggctttaatcgatggatcacaatccacagacgacaccgagattgtgagctatcattgggaagagatcaacggaccattcatcgaggagaaaacgtctgtagatagccccgtactcagactaagtaatctggacccgggtaattatagtttccgcctgacagtgaccgattctgacggtgctaccaatagtaccaccgccgctcttattgttaacaacgctgtcgattatccccccgtggctaatgctggccctaaccacacgataaccctaccacagaattccatcaccttaaacggaaaccagagttcagacgatcatcagattgtgctgtacgaatggtcgttgggcccgggaagtgagggtaaacacgttgtaatgcaaggagtccagaccccatatctgcatctctctgccatgcaggagggagactacacgtttcagctgaaggtcactgattcttcaaggcagcagtccactgcggtggtgacagtgatcgttcagcctgagaataaccgacctccagtggctgttgcgggccctgacaaagagctgatattcccagtggagagtgcaaccttggacgggagctcgtccagtgatgatcacggcattgttttctaccattgggagcacgttcgcggtccgtcagctgtcgaaatggaaaacatcgataaagctatagctactgttaccggactgcaggttggaacctaccacttcagattaacagttaaagatcagcagggcctctctagtacttctaccttaaccgtggccgttaaaaaggagaataactctccacctcgtgcaagagctggagggaggcatgtcctggtgttgccgaacaacagtatcactttagacggaagccgctctaccgatgatcagcggattgtatcatatctgtggatccgggatggccagagtcctgcagctggcgatgttatcgatggtagcgaccactctgtggccttgcagctgaccaacctggtggagggcgtctatacctttcatcttcgtgtaactgattctcaaggcgcgtcggacactgatactgctaccgtggaggttcagcctgatccacggaaatcaggcctggtagagcttacactacaggtcggagtgggccaattgaccgagcagcgaaaggataccctggtacggcagctcgcggtgctcctgaatgttctagattccgatatcaaagtgcagaagattcgggcccacagtgaccttagtacagtgattgtattctacgtgcagagccgccccccttttaaggtgttaaaggccgcagaagtggcccggaatctgcatatgcgtttgtccaaagagaaagcggacttcctgctctttaaagtcctgagggtcgatacagcaggctgcctgctgaagtgctccggccacggtcactgtgaccccctcacaaaaaggtgcatatgcagccatctctggatggagaatctgattcaaagatacatttgggacggcgagtccaattgcgagtggagcatcttttacgtgaccgtacttgcttttacacttatcgtgctgactgggggctttacctggctgtgtatctgctgctgcaaaagacagaagcgtacaaagatcagaaaaaaaactaaatataccatcctcgacaacatggacgagcaggaaagaatggagctaagacctaaatacggcataaaacatcgaagcaccgagcacaactcaagtcttatggtgagcgagtctgaatttgattccgatcaagatacaatcttttctcgtgagaagatggagcgcgggaatccaaaagtgtctatgaacggatcaatcaggaatggggctagcttcagctattgctcaaaagacaggtag

SEQ ID NO: 201252 - DNA, 1821 bp, Artificial Sequence
  Description of Artificial Sequence: Synthetic coding sequence
atgggcaacacctgccgggtgtgctaccagctggaggccatcaagaggtcaaacgaaatgagcaacgttatgggtaacacaacgtggactacctccggcctgaagagccagggacgactttctgttggatctaaccgagaccgggaaattagtatgtcagtgggattgggcaggagccaactcgacagtaagggcggtgtagttggaggcaccatcgacgtcaacgcactggagatggtcgcacacatctccgagcaccctaatcagcagccaagtcataaaatccagatcacaatgggctcaacagaagcccgggttgattatatgggatcttctattttgatggggattttttccaatgccgacctgaaactccaagacgagtggaaggtgaacctatacaataccctagactcatccattacggataagtccgaaatcttcgttcacggcgaccttaaatgggatattttccaggtgatgatctcccgcagtaccactcccgatttgatcaagattggaatgaaactgcaggagttcttcacacagcagtttgacacttccaagagagcgttaagcacatggggtccggtaccgtatctccctcccaagacaatgacctcaaaccttgaaaaatctagtcaggagcagttactcgacgccgcccatcatcgacactggcctggcgtgctcaaagtcgtgagcgggtgtcatattagcctgttccagatcccccttcctgaagacggcatgcagttcggaggttccatgtcactccatgggaatcacatgaccttagcctgtttccacgggcctaattttcgctctaaaagttgggcgctcttccacctggaggaacccaacattgccttctggacagaggcacaaaaaatttgggaagacggctcgtccgatcattcaacatacatagtgcagacattagatttccatctgggccataacacgatggttactaaaccctgtggtgcgttagagtcccccatggcgactatcactaagataacccgccgacgtcacgagaaccccccgcacggcgtggcttctgtgaaggagtggtttaactacgttactgccacaaggaatgaagaattgaatttattacgaaacgtcgatgctaacaacacagaaaattcaactacagtcaaaaacagcagtctgctgtctggattccgggggggctccagctacaatcacgagactgagaccatctttgccttgccccgtatgcaactcgactttaaatcgattcatgtgcaggaaccccaggaacctagcttacaggatgctagcctgaagcctaaagtagagtgttctgtcgtcaccgaattcaccgaccatatttgcgttacgatggatgctgagctgatcatgttcctgcacgacctggtttccgcgtacctgaaggaaaaggagaaggccattttccccccaaggattctgtctaccagacccggacagaaaagtcctatcatcatccatgatgacaactcctccgacaaggatagagaggactcaatcacctacaccacggttgattggagggattttatgtgcaacacctggcacctggagcctaccctgcgcctcatatcctggactggccgcaagattgacccagtgggagtcgactacatattgcagaaactgggtttccaccacgcaagaactaccatcccaaagtggttgcagcggggcgttatggatccacttgacaaggtgctaagcgtccttattaagaagttaggcactgccctccaggacgagaaggagaaaaagggaaaagataaagaggaacattag

SEQ ID NO: 201253 - DNA, 5805 bp, Artificial Sequence
  Description of Artificial Sequence: Synthetic coding sequence
atgcccggcgcccggcggcggcggcggggcgccgccatggagggcaagccccgcgctggggtcgcccttgctcctggcccctctggccgaagaccgtctgcacgctgtgcccggaggcgccggcctgggttgctgcttccagggctgtggcttcttctcctcgcgcgacctgcctcttgcgcacctgatgaactgtctcccgaacagcacaatctctccttatactcgatggagctggttctgaagaagtctacagggcactcagcagcccaggtggcacttactgagacagcccccggctcccagcattcctctcccctccatgtgacagccccaccatcagcaaccacatttgacacagctttcttcaatcagggaaagcaaacaaagagtacggccgacccctctatcttcgttgcaacttatgtctcagtaactagcaaagaggtggctgtgaacgacgatgagatggataactttctgccagacacccactggactaccccccggatggtcagcccaatacagtacatcacggtttcccctcctgggctgccaagggaggcactggagcctatgttgacgccatccctgcccatggtcagccttcaggatgaggaggttacatcaggatggcagaataccacacggcaaccagccgcttatgcggaaagcgcaagccacttccacacatttcgatctgcatttcgaacctccgagggtattgtccctactcccggtcggaacttagtgctgtaccccactgatgcttatagtcacctctcatcccgaaccctacccgaaattgtggctagtctcacagagggcgtcgagactaccctgtttttaagtagcagatctctgatgccacagcccttgggtgatggtatcactatcccgctgccttctctgggtgaggtctcccagcctccagaagaggtatgggccacaagcgccgatcggtatactgatgtaacaacggttcttagtcagtctctggaagaaacgatttccccgcgcacataccctactgtcacagcctcccacgccgcgctcgctttctcacggacgcatagcccattactcagtacaccgttagctttcgcttcgagtgcttccccaacggacgtttccagcaacccattcctccccagcgatagtagcaagacgagcgaactccatagtaattctgcactccctggtcctgtggacaacactcatatcctgagtcccgtctcgtcttttcgcccctacacctggtgcgccgcatgcaccgtaccctctccccaacaagttttggctacctcactcatggagaaggatgtcggatcgggagatggggctgagaccttgtgtatgactgtgctggaggagtctagtattagtctgatgtcttctgtcgtggctgacttctctgagttcgaggaagatccccaggttttcaatacgctgtttccttctagaccaatcgtccctcttagcagtagatcgatggagatatctgagacctccgtagggatttcagccgaggtcgatatgtcaagcgtgactaccactcaagtccctcccgcccatggaaggttatctgtccctgccagcctcgaccctacagccggatctctgtcggtcgccgagactcaggtcacaccaagctctgtcactaccgccttcttcagcgtaattacgagtattctactcgatagctcatttagtgtaatcgctaacaagaacactcccagcttggctgtgagggacccatccgtgttcaccccctactccctggttccaagcgtggagtcttcactattctctgaccaagaaagaagttcctttagcgaacacaagccacggggtgccttagactttgcttcaagctttttttctacgcctcctctggagcttagcgggagcataagctccccttccgaggccccagcttccctgtcacttatgccgtcagatctgtcacctttcacctcacagagttttagtcctctggtggaaacatttactctctttgattcatctgacctccagtccagccaactgtcgctgccttcctcgaccaatcttgagttcagccagctgcaaccgtcaagtgaattgcctctgaacacgataatgttgttgccttcgcggagtgaagttagcccatggtcctcttttccctcagattccctcgagttcgtagaggcctccaccgtgtccctgacggactcagaggcacatttcacttctgcctttatcgaaaccaccagttacctcgaaagtagcttgatcagccacgagtccgccgtgaccgccctcgtcccgcccggctccgaatcatttgatattcttacggccggcatccaggcaacctctcccctgaccaccgtacacaccaccccaatactcactgagtcatccctgtttagcaccctgacccctccagacgaccaaattagtgccctagacggccacgtcagcgtactggcaagtttctcgaaggcaatacccactggcactgtgctgataaccgacgcctacctacccagcggtagtagttttgtttccgaagcaacaccttttcctctgcctacggaattgaccgtcgtaggtccctccctaactccaactgaagttccactgaatacaagtactgaggtgagcacaacaagcactggtgccgctactgggggaccactcgactccactcttatgggcgatgccgcttcacaatcaccacccgaaagctctgcagcgccaccattaccttccctgaggcccgtcactgcatttactctggaagcaactgtggacaccccgacactcgcaacagccaagcccccctatgtctgtgatattacggtgcctgatgcgtacttgattacaacggtattggctagaagggccgtacaggaatatataataacagcaataaaagaggttctgaggatccatttcaatagagccgtagagctaaaggtctatgagctgttcactgacttcactttcctggtcacttccggaccattcgtgtatacggctattagcgtaattaatgttctaatcaacagcaagctggtgagggatcagacaccactcattctcagcgttaagcccagttttctggtgccggagtcccgattccaggtacagactgtcctccaattcgtcccaccctccgttgacaccggcttttgcaacttcacacaaagaattgagaagggtctgatgacagcactgtttgaagtgcgcaaacaccatcaaggcacctataacctcaccgtgcaaatcctgaacataaccatcagttcatcaagagtgacgcccaggagaggacccgtgaatattatcttcgccgtgaaaagtactcagggttttttgaacggctctgaggtgagtgagctgctcagaaatctctccgttgtggaattcagcttttacctgggatacccagtgctgcaaatcgccgagccgttccagtatcctcaacttaacctcagtcagctgctgaagagctcatgggtcaggacagtgctgctaggagtcatggagaaacagctgcagaatgaggtttttcaggccgagatggagcgaaaactcgcacagctgctttccgaagttagcaccagaaggaggatgtggcgcagggcaactgtggcagccgggaacagcgtcgtgcaggtggtaaatgtgtcacggctagagggtgatgataatcccgtgcagttgatatacttcgtggaggatcaggatggagagcgtctcagcgctgtgaaaagcagcgatctgattaacaagatggacctacaacgggcagccataattcttgggtataggatacagggtgtgatcgcgcagcccgtcgatcgcgttaagcggccctcgccagaaagtcagtcaaacaatttatgggtgattgtgggcgtggtgattccagtgctcgtggtgatggtgattgtggtcatcttatattggaaattgtgcaggacagacaagctcgactttcaacctgataccgttgcgaacatccagcagagacagaaactgcagatcccctctgtcaagggctttgactttgccaagcagcacctgggccagcataacaaagacgacatcctaataattcacgagcccgctccacttccagggcctctcaaagatcacaccacaccatctgaaaatggtgatgtgccaagccctaaatcaaaaatcccttctaagaacgtacgacatcggggcagagtttctcccagtgacgccgactctaccgtcagcgaggagagttccgagagagatgccggcgacaaaacgcctggagctgttaacgacggaaggagccatcgcgccccccagagtgggcccccgctaccctcctctgggaatgaacagcacagttctgctagcatctttgagcacgtcgaccgtatcagtaggccccccgaagcaagcagacgggttcccagtaagatccagttgattgcaatgcagccaatacccgccccgcctgtgcaacgcccctcccctgccgacagagtggcagaatctaataagatcaacaaggagatccagactgcattgcggcacaagtccgaaattgagcatcataggaacaagattcgtctgcgggccaagcgtcggggacattatgaattcccagtcgtggacgaccttagttccggagataccaaagagcggcacagggtctatcggagagcccaaatgcaaatcgacaaaatcctcgatccaacagccagtgtgccgtccgtgtttatagaacctaggaaatcatctagaattaaacgttctccgaagccccgccgaaaacatcaagtaaacggctgcccagccgacgccgagaaggacagacttatcacgaccgatagcgacggaacctatcgcaggccgcccggggtgcataattccgcctacattggttgtccttcggaccccgacctgcccgccgacgttcagactccaagttcggtggaacttgggagataccccgcactgccatttcccgcctcacagtacataccgcctcagccgtctattgaagaagccagacaaactatgcatagtctcctcgacgatgcgtttgcccttgtggctccctctagtcagcctgcctccactgccggtgtggggcccggagttccacctggcctgcctgccaattccaccccctcccaggaagaaaggagggctacccagtggggctcattctattccccagctcagactgcaaacaacccatgttctagatacgaagattatggtatgacccctcccactggcccgttgccgaggcctggattcggccccggtttgctccagtctactgaactggtccctccggatccacagcagccacaagcatcggctgaagcccccttcgcagctcggggcatctattccgaagagatgccaagtgtcgcaaggcccagaccagtgggcggcacaaccggcagtcaaattcagcacctgacgcaggttggcatcgcctctagaattggcgctcagcccgtagaaattcccccaagccgcgggagtcagtacgggggtcccgggtggcctagctatggcgaagatgaagcaggccgccgggaagcagtgccacggacaagtgggagggagccatcggccccaagtggaaatctgcctcacaggggactccagggtccaggactggggtaccctacaagtagtactgaagaccttcaacctggacattccagcgcctccctgataaaagccatccgtgaagaattgctgcggctttcccaaaagcagagcaccgtccaaaactttcactcttag

SEQ ID NO: 201254 - DNA, 252 bp, Artificial Sequence
  Description of Artificial Sequence: Synthetic coding sequence
atgggcggcctgttcagccggtggcggaccaagcccagcaccgtggaggtgctggagtctattgacaaggaaatccaagccctagaagaatttcgcgaaaagaaccagcgtctgcagaagctctgggtagggagactcattctctactctagcgttctgtaccttttcacctgcttgatcgtgtacctgtggtacctgccagacgagttcaccgctcgacttgctatgacgcttccattttttgcattttag

SEQ ID NO: 201255 - DNA, 3090 bp, Artificial Sequence
  Description of Artificial Sequence: Synthetic coding sequence
atgctgttccgggcccggggccccgtgcggggccggggctggggccgccccgctgaagcccccaggagggggcgtagtcccccatggtctcctgcttggatatgttgttgggcactggcaggatgccaagcagcttgggcaggtgacctgcccagcagcagcagcaggcccctgcctccttgtcaggagaaggactatcactttgagtacaccgaatgcgattctagcggaagcaggtggagagtggccatccctaacagcgcagtggattgcagcggactccccgatccagtgagaggaaaagagtgcaccttctcgtgcgcttctggcgagtatctcgaaatgaaaaaccaagtttgctccaaatgtggggagggtacttacagcctgggttcaggtatcaagttcgatgaatgggatgaactgcccgccgggtttagcaatatcgctacattcatggataccgtcgtgggcccttcggattcccggcctgatggctgtaataatagctcttggatcccacggggtaattacatcgaatccaaccgagacgactgcaccgtttccctgatctatgccgttcacctgaagaagtccgggtatgtgttcttcgagtatcaatacgtggataacaacatattctttgaattttttattcaaaacgaccaatgccaagagatggacacgaccaccgataagtgggtgaagctgactgataacggggagtggggctcacactccgtgatgctgaaaagcgggacaaatatcctctactggaggacaacggggatcctcatgggcagtaaagccgttaagccagtcctcgtgaaaaacataaccatagaaggcgtcgcttatacgagcgaatgtttcccatgtaaacccggaaccttctccaacaaaccaggttcatttaactgtcaggtctgcccacgcaacacttatagtgaaaaaggagccaaggaatgcatccggtgtaaggacgacagccagttttcagaagaggggtcatctgaatgcactgagcgccccccttgtaccactaaggactacttccaaatacacaccccatgcgatgaggaaggcaaaacccagattatgtacaaatggatagagcctaaaatctgccgcgaggaccttacagacgcgattcgcctgccgccgagtggtgagaaaaaggattgccctccatgtaaccctggcttttacaataatggctcgagctcatgccacccctgcccccccggcacgtttagcgatggaaccaaagaatgccggccttgcccagctgggaccgagccagctctcggcttcgaatataaatggtggaacgtgctcccgggaaacatgaaaactagctgtttcaatgttggtaactccaagtgcgacggaatgaatggctgggaggtggccggagatcacattcagagcggtgcgggaggctcggataacgattacttaattctaaacctgcatataccggggttcaaaccacctacatccatgaccggcgcaactggtagcgagctggggcggatcacattcgtgttcgaaacactctgttctgctgactgtgttctttactttatggtggatatcaaccggaagagcactaacgtcgtggagtcatggggtggaacaaaggagaaacaggcttacacacatattatttttaagaatgccacgttcaccttcacgtgggctttccagagaacgaatcaggggcaggataatagaagattcatcaatgatatggtgaaaatttactctatcactgccacaaatgccgtggatggcgtggccagctcgtgcagagcttgtgcccttggctccgagcagagcggctcatcatgtgtgccttgtccaccaggccactatatcgagaaggagaccaatcagtgcaaagaatgcccacctgacacatatctcagcattcatcaggtctacggaaaggaagcttgtatcccctgcggaccagggagtaagaacaatcaggaccactccgtctgctacagtgattgcttcttctaccacgagaaggagaatcagtccctccattacgatttttcaaacttgagcagcgttggcagcctaatgaatggtccatctttcacatccaagggtacaaagtactttcatttctttaacatctctctgtgtggacatgagggaaaaaagatggccctctgcaccaataacatcaccgatttcaccgtgaaagaaattgtcgcaggcagcgacgattataccaatctggtgggcgcatttgtatgtcagtcaacaatcatcccttccgagtccaagggatttcgggctgccttgtcatcacagagcattatcctggccgacacattcattggagtgacggtggagactaccttgaaaaacatcaacattaaggaagatatgtttccagtgccgacatcccagatcccagatgtacattttttttacaaaagctccaccgccacaaccagctgtatcaacggacggtcaacagccgtcaagatgagatgcaaccctaccaagtcaggggcaggagttattagcgttccctcaaagtgtcctgcggggacatgcgatggctgcaccttctactttctctgggagagtgctgaggcctgtcccttatgcactgagcacgactttcacgagattgagggagcttgcaagagaggatttcaggagactctctacgtttggaatgaacctaaatggtgtatcaaagggattagtctgcccgaaaagaagttggccacgtgcgaaaccgtggatttttggctgaaggtaggggctggcgtaggcgcttttaccgctgtcttgcttgtggctttaacctgctacttctggaaaaagaaccagaaactcgaatataaatatagcaagcttgtgatgaccaccaacagcaaagaatgtgagctgcccgccgccgattcttgcgccataatggagggcgaggacaatgaggaggaggtggtgtacagcaataaacagtcccttctcggaaagctaaaatcccttgccaccaaggaaaaagaagaccattttgagagcgtgcagctgaagacgtcaaggagccctaacatttag

SEQ ID NO: 201256 - DNA, 11043 bp, Artificial Sequence
  Description of Artificial Sequence: Synthetic coding sequence
atggaccagcggaagaacgagagcatcgtgcccagcatcacccagctggaggacttcctgactgagcataattctaacgtggtttggctcctagtcgccactatcctgagctgcggctggataatatatctaacatactacaacagcaggaatgtcggactcatactgaccctagtgctgaaccgcctctacaaacacgggtatattcatatcgggtcttttagcttctctgtcctgagcggtaaggttatggtccgggaaatatattacatcaccgaagatatgagtattcggatccaggacggattcattatctttcgttggtggaagatgtacaacccaaagcagaagcagcacgatcccaaagctgagacaagactttacataaccgttaacgattttgagttccacgtctacaacaggagcgatctctatggaaggttgcaagagctgtttggactggagccgaccatcataccacctaaaaaggacgacgacaagactagggaaatcggccggacccggacacagagtaagattgaacgcgtaaaggtcaagacggagagtcaggacccaacgtcttcgtggcggtcattgatcccagtaattaaagtgaacgtttctacaggcaggttagcttttggaaaccactatcagcctcagaccctctgcatcaacttcgatgacgcctttttgacttacaccacaaaacctcctagttcccatctggatcagtttatgcacattgtcaaaggcaaattagagaatgtgcgcgtcatgctggtgcctagcccccgctatgttggccttcaaaacgatgagccaccgcggctgatgggagagggctttgtcgtgatgcaaagcaatgatgtggatatttactactacatggacgagcctggcctcgtccctgaggagacagaggaaaacatcgaaggtgaaatgtccagtgaggattgtaaattacaggacctgccaccttgctggggactagatatcgtctgtggaaagggcactgattttaattatggcccttgggccgataggcagcgcgattgtttatggaaattcttctttccccctgattatcaggtgcttaaggtatccgagattgcccaacctgggcggcccaggcaaattctcgcctttgaattgcgcatgaacattattgcggatgcaactatagatttgctgtttaccaagaatcgcgaaactaacgccgtccacgtgaacgtcggagccggatcatacctagaaatcaatattcccatgaccgttgaagaaaatggttacacaccggcgattaagggacagctgctacacgttgatgccaccacctccatgcagtatagaaccttacttgaggcagaaatgctggccttccatatcaacgcgagttatccacggatctggaacatgcctcaaacatggcagtgtgagctcgaggtgtataaggccacgtatcactttatcttcgctcagaagaacttctttacagaccttatccaggactggagctccgattcacctccagacatcttcagttttgtgccctacacctggaatttcaagatcatgttccaccaattcgagatgatttgggctgctaatcaacacaattggattgactgtagtacgaagcagcaagagaacgtttaccttgcagcttgtggcgagaccctgaacatcgacttctcactcccattcactgacttcgtcccggccacttgtaacacgaagttctcactgaggggcgaagacgtagatctgcacctgttcctgcccgattgtcatccatcaaagtactccctgttcatgttggtgaaaaattgtcatccaaataaaatgatacacgacaccggtattcccgccgagtgtcaatcaggtcagaagaccgtgaagccaaagtggaggaatgtgacccaggaaaagtctggatgggtcgagtgctggacggtcccaagcgtgatgctgaccatcgattatacgtggcaccccatctacccacaaaaggctgatgaacagctcaaacagagtttgtctgagatggaggagacaatgctttcagtgttacgacccagtcaaaagacatccgacagggtggtgagcagccctagtacttccagccgtccaccaattgacccaagcgagttaccaccagacaagcttcatgttgagatggaactgtctcccgattcccaaatcacactgtatggccctcttctcaatgcgttcctgtgtataaaggaaaattactttggggaggacgacatgtacatggactttgaagaagttataagctctccggtattgtcactgtccacgtcttcatcatccggctggactgcagtcggtatggaaaatgacaagaaggagaacgagggatcagcgaaatcaattcatccccttgctttgcgcccatgggacatcactgtgctggtgaatctgtacaaggtccacgggcgccttcccgtgcacggtacgaccgacggtccagagtgtcccaccgcgttcctggagcggttgtgcttcgagatgaagaagggctttcgcgagacaatgctccaactcatactgtcccccctcaatgtgtttgtcagcgataattaccagcagcgccctcccgtggacgaggtcctgcgggagggccatataaacctgtctgggctccagctccgcgctcatgcaatgttcagcgctgaaggcctgcctctgggatcggactcacttgaatatgcttggctgattgatgtgcaggcagggtctctaactgccaaagtgacagctcctcagctcgcctgtttgctggagtggggtcagacgtttgtcttccacgtagtttgtagagaatatgaactagagcgaccaaaaagcgtgattatctgccagcatggtatagacagaagattctgtgaatctaaactgagttgtataccaggcccctgccctacgagtgatgacttaaagtatacaatgattcgactcgccgtggacggggctgacatctatatcgtcgagcatggttgtgccacaaacataaagatgggggctattagagtcgctaactgcaacttgcataaccagtctgttggtgagggaatctcagccgctattcaggacttccaggttaggcagtacatcgaacagctaaacaactgtaggattggattgcagccggctgtgctccgaagagcatactggctcgaagccgggagtgccaatctggggttaatcacagtggacatcgccctggctgcagaccaccattccaaacacgaagcacaacggcatttcctagaaactcacgatgccaggaccaaacggctctggttcctgtggccagacgacatcctgaaaaacaagcggtgtcgtaacaagtgtggatgtctgggcggatgccgtttcttcggtggcacggtgaccggacttgatttcttcaaactggaagagctgacacccagtagcagcagcgccttttctagcaccagtgctgagtctgatatgtactatgggcaaagtttattgcagcccggcgagtggataattacgaaagagatacctaaaatcatcgatgggaatgtgaatgggatgaaaaggaaggagtgggaaaacaaatccgtgggcatcgaggtcgagaggaaaacgcagcacttgagccttcaggtcccattaaggagtcactcctctagcagctcatcagaggaaaatagttcttcatctgcagcacaaccactattggcaggggagaaggagtccccaagctccgttgccgatgaccacctagtccagaaagagttcctccacgggacaaaaagggatgacgggcaggcctcaattccaacggagatcagcggaaattccccggtgtcgccgaatacccaggataagtcagtcggtcagtctcctctgcgcagccccttgaagcgccaggctagtgtttgctctaccagattgggctcaacaaaaagcctcaccgcagccttttacggggacaaacaaccagtaaccgtcggggttcaattttcatcagacgtgtcccggtcagatgagaatgtgctggacagcccaaaacagcggaggtctttcggatccttcccatatacgccatctgcggactcaaacagcttccaccagtaccgctcaatggactcctcaatgtctatggctgatagcgaggcatacttctcagcggcggaagagttcgagccaatctccagcgatgagggccccgggacttacccaggacgcaagaagaagaaaaaacagacccagcagattgactactcaagaggctccatttaccacagcgtcgaggggccactgacagggcacggcgagtctatccaggactcccgcaccctgccctttaaaactcacccttcacaagccagcttcgtaagtgccctcggcggggaggacgacgtgatcgagcacctgtacatcgtggagggagagaaaaccgtggaatctgagcagattacaccacagcagccggtcatgaactgttaccagacttacctgacacagtttcaagtcattaactggtcggttaagcaccctaccaataagcgtacttctaagtcgtccctgcaccggccattggatctggatacaccaacctcagaggaatccagcagctcttttgagcaactcagcgtgcccacatttaaagtgataaaacaggggttgacagcaaactccctgctggataggggcatgcagctctcgggcagcacttctaataccccatatacccccctcgaaaagaagttagccgacaacaccgacgatgagacactcacagaggaatggacactggaccaacccgtgtcccaaacgaggaccacggccatagtggaggtgaaggggaccgtcgatatcgtgctgactccactggtcgccgaggccctggatagatacatcgaggccatggtccattgcgcatccacacgccaccccgcagccatcgtggatgatctgcacgccaaggtcctccgggaggccgtccagaacagcaagaccactttcagcgagaatctctcaagcaagcaggatattcgaggtaccaaaaccgagcagtctactatcgggacgaccaaccagggacaggcccagacgaacctaacaatgaagcaagataacgtgacaatcaaggggcttcagactaatgttagcatccccaaagtcaacttatgcctccttcaggccagcgttgaagaaagcccaacaacagccccttcccgctctgtcacccatgtctcgctggtggctctctgttttgaccggatcgcgactcaggtacggatgaaccgtggggtggtggaggagacctcaaacaacgctgagccaggcagaacttctaactttgacaggtatgttcacgcaaccaagatgcagccccaaagctctggttctctgcgcagcaatgctggtgccgagaagggcaaagaaatcgctgctaaactgaatatccatcgggtgcatggccagttgcgtggcttagataccacagatattggaacatgtgcaatcaccgccatcccctttgaaaagtcaaaggtgctgtttactctcgaggaactagacgagttcacgttcgtcgacgagactgaccagcaggcagtaccggacgtcacgcgaattggtccatcacaggagaaatggggatggatcatgttcgagtgcgggctggaaaatttgactattaaaggaggtcggcaatctggagcagtcctttacaacagctttggtatcatggggaaggcaagtgacacagagagaggcggggttctgacgagcaacaattctagcgattctcctaccggtagtggatacaacacagatgtcagcgatgacaatctgccctgcgataggacctctcccagctctgacttaaatggcaattccgtcagtgatgaacaggatgagggtgtggagagtgacgatttgaagaaggatctgccattaatgcctccaccccctgattcatgttccatgaagctaaccatcaaagagatctggttttccttcgcagcgccaacgaatgtgcgcagccatactcacgccttttctcggcagctgaatctgctgagtaccgctacaccagcagttggagcatggttggttccgatcgatcaactgaaatcaagccttaataagctggagaccgaaggaacactccggatttgcgcagtgatgggctgtattatgaccgaggccttggagaacaaaagcgtgcacttccccctcagatcgaaatataacagactgactaaggtcgcccgttttctgcaggagaatccctcttgcctactgtgtaacatcctacaccattatctgcaccaggctaactacagtatcattgacgacgcaaccatgtctgatggcctgcctgccttggttacacttaagaagggcctcgtcgcactggccagacagtggatgaagtttatagttgtaacacccgcatttaagggggtcagcctgcacaggccagctcaaccactaaaacctcagatcgcaatggatcatgagcacgaggacggattggggctggataacggagggggtctgcaatcagataccagcgccgatggtgccgagtttgaatttgacgcggccactgtgtctgaacacaccatgctgctggaaggtacggctaatcggccaccacctggtagcagtgggcctgtgaccggggcggaaatcatgaggaagcttagcaagacacacacacactcagattcagcccttaaaatcaaggggatccacccttatcactctctgagttacacctcgggggacacagccacagactcccctgtgcacgtgggaagagcaggaatgcccgtgaaagacagccccagaaaggagtccttgctgtcatatttaaccggatcattcccttcactccataatctgctcgagggaactcctcagagaagctctgcagcagtgaaatcctcttcactgacccgaacgggaaacactgtggccaccgacatgctgagcgagcaccctctcctgagtgagccgtcgtcggtatccttctacaactggatgtccaatgccgtgggcaatcggggaagcgtgctccaagaaagtccggttactaaaagtggtcacaattccctgccaaccggagtggcccctaacttgcctacgatcccctccgccagcgattttaacactgtgctctctagtgatcaaaacaccctggacggcacacactcacagcatagcacttcccaagatgacgttgccggggtggaggaagccaaccaaggatttccagctgttcaactggctgatgcccaggtcgtatttaagcctcttctaagccatacagggatccagtcccaggacacaatgcccttctgctaccggatgtacttcggggagcatctgagcttttctgggacactcgactgtttgagagccgacatcgtggatagtgacacagcgaaagaacgaaagggcaagagggctcgccggcaaggacacgtcaatctcccacccctcgaattcaagcctgcactgatgctgggcacttttagcatcagcgccgtggttatggagaaatctgtgtgtacccctcagaatagtacctccgctctgtcttttcacgatctgtcaaaaaggtattataatacattccattgcaactttaccatctcctgccagtccatctcacagcatgtggacatggcactcgtcaggttgatccaccagttcagcacaatgattgacgacattaaggctacgcagaccgatataaagttatctaggtatactgcgggaagtgcttctccaacaccaactttcaagactcgcaaacacagagacttccgtagttctgactttagccgtagtagcagaggaagcctcaacggtgggaatcgtgtaaataacgctaaaaataaacgtactaacaacgaaaataataaaaaggaaagtagaaataagaattcactcgggaggagcgagaggcggacatccaaggtgagtagaaaaggttccaaggacgttgtggatcacatgacgatccatatggacgactctgattctattactgtgagcgagcagtctgaaccaagtgccgaatgttggcagaatatgtataaattgcttaatttctattcacttatttccgatcccactggcatcctggaaaagtccagtgagacattcggacccgctggagtgcgctctcccactgaaccaacttgtaaagtggtgttcgagaatgaacaggataattcttccctgactaagacgcaacgcaagcgctcactggtgacctccgagccccagcatgtcactctgatcgtgtttggaattgggatggtcaaccgcacccacttagaggccgatatcggagggttaactatggagtctgagctgaaacggattcatggaagcttcaccctgaaagaaaaaatgaaagatgttcttcaccagaagatgactgaaacttgtgcaacagcgcatattggaggcgttaatattgtgctcctcgaagggatcactcctaacatacagttagaggactttccaacctcccccacctctaccgctaagcaggagttcctgaccgtcgttaagtgctctatcgcgaagtcccaggcgttgtatagcgcccagcggggactgaaaactaataatgccgccgtgttcaaggtcggcgccattagcatcaatatccctcagcacccagcgactcttcactccatgatggttcgcagcagccatcagttgtcaaagcagatatcagatctcattcggcagccaagtacagccccgcagcctgtaaaagaagacatcgctaccccccttccttccgagaagacacctactagcgtcaaccagaccccagttgaaaccaatgaattcccacagttacctgaaggcctggagaaaaaacctatagtgctaaaattctccgcaatgctggacggtatcgcaatcggcgcagcgctactgccttctcttaaggccgaatataaaatgggcagaatgcggtcacacggaatgacaggcgcccagacacggtttacgttcgagctacctaaccaccgtctaagattcacgagtaaagtgtccgcaactgatatgagcacgatcccacctagcgcctccctgaacctgccacccgtgacaatgtctgggaaatacattatggaggagcacgattcatactcagaccaggtgtggtcaatcgacgagctcccctcgaaacagggatattaccttcaaggcaactaccttcggtgtgttgccgaggtagggagcttcgaacataatctgaccactgatctgttgaaccacctggtgttcgtccaaaaagtgtttatgaaagaggtgaatgaagtcatccagaaggtctccggtggcgagcagcccatccctctctggaacgagcatgacggaactgccgatggcgataagccaaaaatactgctttattccctcaacttacaattcaaaggaatccaggtcacagcgactactccttctatgcgcgcagtacgcttcgagacagggttaatagaactggaactgagcaatagattgcagaccaaggccagcccaggcagttcttcatacctgaagctgtttgggaagtgccaggtcgatctcaacctggcccttggacagattgtgaagcaccaggtctacgaggaagctggctccgatttccaccaagttgcctacttcaagacccggatcggcttgcggaacgcccttcgcgaagagatttccgggtcttccgacagggaggcagtgttaataaccctgaaccggcctatcgtttacgctcagccagttgcctttgaccgcgccgtgttgttttggctgaactacaaggccgcatatgataattggaatgagcagcgtatggccctccataaggacatacacatggccacaaaagaggtggtggacatgctgcccggaatacagcagacatccgcacaagcctttggaactctgttcttgcaactcacagtaaacgatctcggaatctgtctccctattactaacaccgcgcagtctaatcacacaggtgatctagataccggaagtgctctcgtcctgaccatcgagagtactctgattacagcctgctcctccgagagcctggtgagtaaaggtcattttaagaacttttgcatccggttcgccgacgggtttgaaacgtcctgggatgattggaagcctgagatccatggggaccttgtgatgaacgcttgcgtggtacctgacggcacttacgaagtgtgtagccgcacaacgggccaggccgccgccgagtcttcgtctgcaggcacgtggacattgaatgtgctgtggaagatgtgcggtatcgacgtgcacatggacccaaatatcggcaagagactgaatgctttagggaatacccttaccactctgacaggcgaggaagatattgatgacatcgccgatctgaacagtgttaatatagctgatctgtctgatgaagacgaagtggatacaatgtctcccacaatccatacagaggctaccgattatcgcagacaggccgcatccgcttcacagccaggggagcttcgtggaagaaagattatgaagcgaatcgtcgatattagagagctgaatgagcaagccaaggtgatcgatgacctgaaaaaattgggcgcttctgaggggaccattaaccaggagatacaacgttatcagcagcttgagagcgttgccgttaatgatattagaagggacgtgaggaaaaagctccggagaagtagcatgcgagcagcctcacttaaggataagtggggtttgtcctataagccctcctattctaggtccaaatcaatctcggcatcaggacgtcctcctctcaagaggatggaacgtgctagcagtagggtcggagaaaccgaagaactcccagagataagagtggatgccgcctcacctgggcctagagtaacctttaatatccaggacactatcgcggagattcgacgaaaaaaaatctcatttaaggtcgtgttctag

SEQ ID NO: 201257 - DNA, 2241 bp, Artificial Sequence
  Description of Artificial Sequence: Synthetic coding sequence
atgccctgcctgggcctgctggccaacctgtgccggcacaacctgtccgttcagacacacattaaaactctgagtaacgtgaaatcattctataggaccttgatcacactgctggcacactccagcctgacggtcgttgtgttcgcactgtccatcctgtcctccttgaccctcaacgaagaggttggcgagaaactctttcacgccagaaatatacaccagactttccagttaatttttaacattctcattaacggggacggcacattaacgcggaagtatagcgtcgaccttctgatggacctgttgaagaatccaaagatcgctgattatctcacgcggtacgagcacttctcctcctgtttgcaccaggtgctaggattgcttaacggcaaagaccctgacagctcttctaaagttctggaattgctgctcgcattctgcagcgtgacgcagctccggcacatgctgacacagatgatgttcgaacagtctccccctggctctgccactctggggtcgcacactaaatgtcttgaaccaacagttgccctccttcgatggttgtcacaacccttggatgggagtgagaattgcagcgtgcttgccctcgagcttttcaaggaaatcttcgaggacgtcatagacgccgccaactgtagctccgccgataggtttgtgacactgctgctgccaacaattctcgatcagctgcaatttacggagcagaatttggacgaagctcttacaaggaagaaatgtgagagaatcgcgaaggccattgaggtcctgctgactttgtgcggtgacgacacccttaagatgcatattgcaaaaatactaacaacagtgaagtgcacgaccttaatcgagcagcagtttacctatggcaaaattgacctggggtttggcacaaaggtagctgatagtgagctatgcaagctagctgctgatgtgattctgaagacactcgatctgataaataagctgaaaccactcgtgcctggcatggaagtgagtttttataaaatcctccaggaccctagactgattaccccacttgcgtttgcgttgacctctgataatcgagaacaggtccagtccgggctccgaatattactggaggctgctcccctgcccgatttcccagcccttgtcctgggcgagtccatcgcagccaacaacgcataccggcagcaagaaactgaacacatccccaggaagatgccttggcaatcgtctaatcactcctttcccacatctattaaatgcctgacaccccaccttaaagatggcgtgcccggcctcaacattgaggaactgatcgaaaagctgcaatctggcatggtggtcaaggatcagatctgcgatgtcagaattagcgacataatggacgtatacgagatgaaattgtctacattagcgagcaaagaaagtcggctgcaagatctactggagaccaaagcacttgcattagctcaggctgatcggcttatcgcacagcatcgctgccagcggacacaggcggagacggaagcacgcaccctggcgtcgatgttacgggaggtggagcggaaaaatgaggaattatctgtacttctgaaagcccagcaggtagagtcagaacgggcccagagcgacatagagcacctgttccagcacaaccgaaaactcgagtccgtggcagaagaacatgagatcctgactaagtcttatatggaactgttgcaaagaaacgaatcaaccgagaaaaaaaataaggatctgcagatcacgtgcgatagtctcaacaaacagatcgagacggttaagaaactcaacgaatcgctaaaggagcagaatgagaaaagcatcgcacagctcatagagaaagaagagcagcggaaagaagttcagaatcagctcgtggaccgcgagcacaaactagccaatcttcaccagaaaaccaaagttcaggaggaaaagatcaagactctacagaaagagagagaggataaggaggagaccatcgacatcctgcgcaaagaactctccaggaccgagcagattcgcaaagagcttagtattaaagcttcctctctggaagtccagaaggcccaacttgaaggtaggcttgaggaaaaggaatccctcgtcaaattgcaacaggaggaattgaataagcacagccacatgatcgctatgatccactccctgtctggcggaaagatcaacccggagaccgtgaacttatctatttag

SEQ ID NO: 201258 - DNA, 840 bp, Artificial Sequence
  Description of Artificial Sequence: Synthetic coding sequence
atgaccctgcccttcttcgccttccccctgatcatctggagcatccgaaccgtgataattttcttcttctcaaagcggactgaaagaaacaacgaggcattagacgacctcaagagccaacgcaaaaagatactcgaagaggtcatggagaaggaaacgtacaaaacagccaaactgatattagaacgcttcgatcccgactctaagaaggctaaggagtgcgagcctccatctgcgggggctgcggtcaccgcaaggccaggccaggaaattcgccagcggaccgccgcccaacggaatctctccccaaccccggcctccccaaaccaaggacctcccccacaggttcccgtgagcccaggaccgcctaaagacagcagcgcccccggtggaccccccgagagaaccgtgacgccagccttgtcatcaaacgtgctgcctcgccacttaggatcaccggcaacctccgtgccaggaatggggcttcacccccctggtccgccgctggcaagacccatcctgcctcgagagcgcggagctctcgaccgcattgtggagtacctggttggagacggcccccagaatcgctatgcgttgatttgtcaacaatgcttctcccacaacggcatggcactgaaagaagaatttgagtatatcgctttcaggtgtgcatattgcttttttctgaacccagcacggaagacaagaccacaggccccacgcctccccgaattcagtttcgaaaagaggcaggtcgtggaagggagctccagcgttggaccccttccgagtggttccgtgctttcaagtgataaccagttcaacgaggtgcagtactag

SEQ ID NO: 201259 - DNA, 3192 bp, Artificial Sequence
  Description of Artificial Sequence: Synthetic coding sequence
atgacccggctgggctggcccagcccctgctgcgcccggaagcagtgctcagagggtcgcacttattcaaacgcagtgatatccccgaaccttgagactacacgcattatgcgggtaagccatacttttcccgtcgtcgactgtactgctgcctgctgtgatctgagtagttgtgatctggcctggtggtttgagggccggtgctacctcgtgagttgccctcacaaagaaaactgtgaaccaaaaaagatgggacccatccgatcgtacctgacttttgtcctccggcctgtgcaacggcccgctcagcttcttgactacggcgatatgatgcttaaccgggggtcgccctcgggaatttggggagactcgcccgaggatatccgaaaagatctgaccttcctgggtaaggattggggcctggaggaaatgagcgagtactcagacgactatcgggaactggagaaagacctgcttcagccgtcaggaaagcaagagcctcgcggctctgccgaatacaccgactgggggttgctgccaggctctgagggcgcattcaatagctcagtcggtgattcacctgctgtacctgccgagacccagcaggaccctgagctgcattacctgaacgagtccgctagcacccctgcacctaagctgcccgaaaggtccgtgttgctgcccttacccacaacaccctcatctggtgaggtgcttgagaaggagaaagcctcacagcttcaagagcagtcatctaacagcagcgggaaagaagtgcttatgccaagccatagtctgccgcccgcaagcctggagctatcatctgtgaccgtggagaaaagcccagtactcactgtcacaccaggcagcactgagcattcaattcccaccccacccacaagcgccgcgcctagcgaatctacccccagcgaactgcctatttctccaaccactgcacctaggacagtaaaggagctaacggtctccgctggggataatcttataattaccctgcccgacaacgaagttgagttgaaagcgtttgtcgcccctgccccacccgttgagaccacatacaactatgaatggaacctgatctctcatcccactgactaccagggagagattaaacagggccataagcaaactctcaacctgtcccaattgtccgtcggcctgtatgtgtttaaggtgaccgttagtagcgaaaacgcgtttggggagggcttcgtaaacgtcaccgtcaagccagccagaagggtcaatttgccaccagttgccgtagtctccccacagttgcaggagttgaccctgccactaactagcgctctaattgacggttcccagagcaccgacgacactgagatcgtgtcttatcattgggaggagatcaacggccctttcatcgaggagaaaacttcagtcgattctcctgtgctaaggctttctaatcttgacccaggcaactactccttccgcctcacagtgactgatagcgacggcgctaccaattctacaacggccgccctgatcgtcaataatgctgttgattaccctcctgtggcaaatgccggacccaaccatacaatcactctgccacaaaacagtataacattgaacggtaaccaatcctcagatgaccatcagattgtcttgtacgagtggagcctaggccccggttcagagggtaagcatgttgtgatgcaaggggtacaaaccccgtatctgcatctttcggccatgcaggagggagactatacattccagcttaaggtgaccgattcctctagacaacagagcaccgccgttgtcaccgtcatcgtgcaacccgaaaacaacaggccacccgtcgccgtagccggaccagataaggaactgatctttccagtggaatctgctaccttagatggctccagctcatcagacgatcatggcattgtgttctaccattgggaacacgtgcgcggcccgagcgccgtggaaatggaaaatatagacaaagcaattgctacggtgaccggtttacaggtaggcacttatcatttccgcctcaccgtgaaagaccagcagggtctttctagcacatccaccctgaccgtcgcggtgaagaaagaaaacaattccccacctcgagcgcgggccggaggccgacatgtgctcgtgttgcctaataattcgataacccttgacgggagccgctctactgacgaccagcggattgtttcttacctgtggatacgcgacgggcaaagcccagccgccggagatgtgatcgacggctccgaccatagtgtggctctacagctgaccaatctggtggagggggtttatacgttccatctgagagtgactgattcccaaggcgcaagtgacaccgataccgccacagtagaggtgcagcccgacccccggaaaagtgggctggtggagttgacacttcaagtgggggtcggacagctgactgaacagcgaaaggatacgcttgttaggcagttagcagtgctactgaacgtgttggactccgatatcaaagtgcaaaaaatcagagcccattcggacctgagtaccgtgatcgtgttttatgtgcagtcgcgccccccttttaaagtgctgaaagcagccgaagtggctcggaacttacacatgcgcctaagcaaagagaaagcagatttcctgctgttcaaggtgctgcgcgtggatactgctggctgcctgttaaaatgctccggccatgggcattgcgaccctctaacaaaaagatgtatctgtagccacctgtggatggaaaatcttatacagcgttatatttgggacggtgaatctaattgcgagtggtccatcttctatgtcaccgtgctagcgtttaccttgattgtcctgaccggggggtttacatggctgtgtatctgctgctgtaagagacagaagcgcaccaagatcaggaagaaaactaagtacacaattttagataacatggatgaacaagaaaggatggagctccgtcccaagtacggcatcaagcaccgctctacggagcataacagctcactcatggtaagcgagagcgagttcgactccgatcaggatactattttcagtcgggagaagatggagagggggaatcccaaagtttctatgaatggcagcattcggaacggagctagtttcagctactgttccaaggataggtag

SEQ ID NO: 201260 - DNA, 1293 bp, Artificial Sequence
  Description of Artificial Sequence: Synthetic coding sequence
atgggccggagctggcccggcctgagcctgtgccagtggcggctgctgccagctctagaggctggatgggctgtcgccgccgagactggcggaggcggcaggcctggtagagcagccccagcctcttgctcttgtgaatttctgtggacaatcgacgacatctaccactgcgcacagtttcttcagattaaagatggatggatcattttctcaatggaggctcgcctcgccatgactttgcccttctttgcctttccccttatcatctggtctattcgtaccgtcattatctttttcttctccaagcgcaccgagagaaataacgaggccttagatgatttgaagtctcaaagaaaaaaaatcctcgaggaggtcatggaaaaggagacatacaagactgccaaactaatcttagagcgttttgaccccgactcgaaaaaagctaaggagtgcgagcccccgagtgcaggagcagcggtaactgctcggccaggccaggagatcagacagaggacagcagcccagaggaatctgagccccacaccggcgagcccgaatcaggggccacccccgcaagtccccgtgtcccccggaccaccaaaggactcctcagccccagggggtccgccagaaagaacagtaactcctgccttatcttccaatgtcttaccacggcatcttggctccccagcgacatctgtgcccggcatgggactgcacccacctggccctccgttggccaggcccatacttcctagagagcgcggcgctctggacagaattgtggagtacttagtgggcgacggtccccagaaccgttatgcgctgatctgtcaacagtgtttttcacacaacggaatggcattgaaagaggagttcgaatacattgcttttaggtgtgcttactgttttttcttgaaccctgcgaggaagacgagaccccaagccccccgtctgcccgagttttccttcgagaagcgccaggtggtggaaggctcatcctcggttggtcccctgccatcaggctctgtactttcatctgacaatcagttcaatgaggaatcgctggaacatgatgtactcgacgacaatacggaacaaacggatgataaaatacccgcaactgagcagactaatcaggttattgagaaggcatctgacagtgaagagcccgaagagaaacaggagactgagaatgaagaagcatccgtgatcgagaccaacagtaccgtgccgggcgctgattcaattcctgaccccgagttgtcaggggagagtctgactgcagaatag

SEQ ID NO: 201261 - DNA, 3036 bp, Artificial Sequence
  Description of Artificial Sequence: Synthetic coding sequence
atggccccccccaccggcgtgctgagcagcctgctgctgctggtgaccattgctggatgtgcccggaaacagtgctctgaggggcgtacatactctaatgccgtgattagcccaaacctagaaacaacacgaattatgagggtgtcacacacttttccagttgtggactgtacagccgcctgttgcgatctgtcgagttgtgatttggcatggtggtttgagggtagatgctatttggtgtcctgtccccacaaagaaaactgcgagcctaagaagatgggcccaatccgaagttacctaacttttgtgttgcgccccgtgcaaagacctgcacagctactggattacggtgacatgatgctgaacagagggagccccagcggcatttggggggactcacccgaggacatcagaaaggatctgaccttcctcggcaaagactggggactagaagaaatgagcgaatactcagatgactaccgagagctagaaaaggacctcttgcagccctctggcaagcaagaaccccgggggtctgccgagtatacagattggggcttgcttcctggctccgagggcgcatttaacagcagcgtgggagattccccagctgtgcccgcggagactcaacaggaccctgaactgcattatctcaacgaatccgcttcaactcccgcgcccaagttaccagagcggagcgtgctcctgcctttgccaacgaccccatcctccggcgaggtactggaaaaggagaaggcttcccagctgcaggaacaaagttcaaactcatccgggaaagaagtccttatgcccagccacagcctcccacctgcctcactcgagctaagcagcgtgacagtggagaagtctccggtgttgactgtaacccccggctctacggaacacagcatccccacacccccgacaagcgccgcacccagcgagtctactccctcagagcttcctatctctccaactaccgcacctcgcacggtcaaagaactgaccgtttcagcgggcgataatctgatcattaccctgccggataacgaagtggaacttaaggcttttgtagcccccgccccccccgtagagaccacctacaattatgagtggaatctcatatcacatccaaccgattaccagggtgagatcaaacagggccacaaacagaccctcaatctgtcacaactgtctgttgggttgtacgtctttaaggtcactgtgtcttccgagaacgcatttggcgaaggcttcgttaacgttacggtgaagcccgcaagaagggtgaatcttcccccagttgcggtcgtttcacctcagttgcaggagctgactctgccactgacttcagccctgattgatggctcacaatccaccgacgacacggagatcgtgtcgtatcattgggaagagatcaatgggccgtttatcgaggaaaaaacctccgtcgactcacccgttctgcgcctgtccaatctggatcctgggaactacagtttccggcttaccgtgactgatagcgatggtgcaactaatagcacgaccgctgctctgatcgttaacaacgcagtcgattatccacccgtggccaatgctggaccaaatcacactatcacacttccacagaactctatcacgttaaacggcaaccagtcgtccgacgaccaccagattgtcctatacgaatggagcttaggtccaggctccgaaggaaagcacgtggtcatgcagggcgttcagactccatacctccacctgtccgcaatgcaggaaggagattatacctttcaactgaaagttactgactccagtaggcagcagtccacggcagttgttaccgtgatagtgcagcctgaaaataaccgccctcccgtggcggtggccggaccggacaaagaacttatattccccgtcgaaagcgccactttggacggtagcagctccagcgacgaccatggaatcgtgttctaccactgggaacacgtccggggacccagtgccgttgaaatggaaaacatcgataaggctatcgcaacggtgactggactgcaggtgggaacataccactttaggctgacagtgaaggaccaacaaggattatcgtctacatccaccttgacagtggccgtgaagaaagagaataatagtcctcctagagctagagctggagggagacacgtcctggtcctgccaaacaacagtattaccctcgacggatccaggagcacagatgatcagcgaatcgtcagttatctgtggatccgcgatggccagagcccagctgcgggggacgtgattgacggcagcgatcacagtgtcgcactgcaactcactaacctagtggagggagtctatacttttcacctgcgggtaactgacagccagggagcaagcgacactgatacggccaccgtggaggtccaaccagacccgagaaaatccggactggtcgagctgacgctgcaggttggtgtgggacagctgacggaacagaggaaggatacgctcgtgcggcagcttgccgtcctcctgaacgtgctcgattctgacatcaaagtgcagaaaatccgggctcactcggacctgtctaccgtcatcgtgttttatgtgcaaagcaggcctccgttcaaagtgctgaaggcagccgaagtagcaagaaatttgcacatgcggctatctaaggagaaggctgacttcctcctgttcaaagtcttgcgcgtcgacaccgccggctgcctgctcaaatgctccggccatgggcactgtgatcctctaacaaaaagatgtatttgttctcacctatggatggagaaccttatacagagatatatatgggacggagagagcaactgcgggatcaagcaccgctcaacggagcacaattcttctctgatggtatctgagagtgaattcgattctgatcaggataccatcttctcacgagagaagatggaaagaggaaaccccaaagtatcaatgaacggatccattcgcaacggggcctccttctcatactgctcaaaggatcggtag

SEQ ID NO: 201262 - DNA, 1206 bp, Artificial Sequence
  Description of Artificial Sequence: Synthetic coding sequence
atggagacccccgaggtgcccgtgggcagcctgatcgacttcggcccagaggcacccacctctagccccctggaggcaccaccccccgtccttcaggatggcgatgggagcctcggcgatggggcatcagagtccgaaactacagaaagcgctgactccgagaacgatatgggagagtctccctcccacccatcatgggaccaggaccgtaggtcttcctccaatgagagtttctcatctaaccagagcaccgaatccacacaggatgaagagaccttagctctgcgggatttcatgagaggttatgtagagaaaattttttcagggggtgaagatctggatcaggaggaaaaggcaaagttcggagagtactgtagctcagaaaacgggaagggacgagagtggttcgctcgctatgtgtctgcccaacgatgcaacagcaagtgcgtgagtgaggccaccttttacaggcttgtacagagctttgcggtggtccttttcgagtgccatcagatggacgattttgggccggccaagaatctaatgacgatgtgcttcacatattatcatattggtaagccacagctgctgccccctgaaagtcgggagaagccagctggctccatagatagttatctgaagtcagccaatagctggctcgccgagaagaaggatatcgctgagcgcttgctgaaaaacactagtgcccggacagaaaatgtaaaaggatttttcggtggactcgagactaaactgaaaggtcccctagctcggaggaatgaagaagatgaaaacaaaccccaggagaagagaccaagggctgttactgcgtatagtcccgaggatgagaaaaagggagagaagatctacctgtacacacatttgaaacaacaacctatttggcacaccttaagattttggaatgctgctttctttgatgccgttcattgtgagagaacaaagagatcgccgacaactagagagaagtggtgccatatgacccaagaggaaagggacgatagcctgagattcaatgaaaacatcacatttggacaactcggtaccttcactcacaatatgttagcctttggtctcaacaagaaactgtgtaacgattttctgaagaagcaggcggtgattggcaatctcgatgaggaacagtataaacttctgtccgaccatatcgagcaaatggctacagagtag

SEQ ID NO: 201263 - DNA, 3219 bp, Artificial Sequence
  Description of Artificial Sequence: Synthetic coding sequence
atggccccccccaccggcgtgctgagcagcctgctgctgctggtgactattgcggggtgcgcgaggaagcagtgttctgagggacggacctacagcaacgccgtcataagtcccaacctagagaccaccaggattatgcgcgtgtctcacactttccccgtggttgattgcacggcggcctgttgcgatctgtcttcatgcgacctcgcctggtggtttgagggtaggtgttacttggtaagttgtcctcacaaagaaaactgtgagccaaagaagatgggacctatccgctcttatcttacctttgtcctgcgccctgttcagagacccgcacaactcctagactatggcgacatgatgttaaaccgagggtccccatccggcatatggggcgactccccagaggacattcgcaaggaccttaccttcctcggtaaggattggggcctggaggagatgtctgagtactctgacgattatcgcgaacttgaaaaagatctcttacaaccttcaggcaagcaggaaccaagggggtcagccgaatacactgattggggcctgctaccaggatcagagggagcgtttaactcttccgtgggggactctcctgccgtgccagctgaaacgcagcaggaccctgaactgcactatctgaatgagagtgcgtctactccagcccccaagcttcctgaacgttcagtgctcctgccactcccaactacgccatcatctggagaagtattggaaaaagagaaggctagccagttacaggaacagagtagtaactcctccggcaaggaggtacttatgcctagccacagtttaccacccgcctctttggagctgtccagtgtgaccgtcgagaagtcccccgtcctgacagtgacgcctggcagtaccgagcactctatcccaaccccaccaacaagcgctgcacccagcgagagcaccccttcggagcttccaatctctccaaccaccgcccctaggaccgtgaaggaattgaccgttagcgccggtgacaatctaattatcacactgcccgacaacgaagttgaactgaaagcctttgtggcccccgccccgcctgtagaaactacatacaattatgagtggaacctgataagccaccccacagattaccagggtgaaatcaagcagggacataagcagactctcaacctttcccagctgtctgtgggtttatatgtattcaaggtgaccgtctccagcgagaacgccttcggagaggggtttgtgaatgtaacggtcaaacccgcccgccgcgttaacctgcctcctgtcgcggtcgtgtctccgcagctgcaagaactcacactccccttaacttccgccttgattgacggcagtcagagtaccgacgatacagaaattgtctcctaccactgggaggagataaatggcccttttatagaggaaaaaacaagtgtcgactctcctgtgttacgcttaagcaacttagatccaggcaactactcattcaggctgacagtcacagattcagacggagccactaattctacaaccgcagctctcatcgtgaacaatgccgtcgactatcctcccgtggcgaatgctggacccaatcatacaattaccctgccgcaaaattctataacactcaacggtaaccagagtagcgatgaccatcagatcgtcctgtatgaatggagtttggggcctggcagtgagggaaaacatgtggttatgcaaggggtgcaaaccccctaccttcatctaagcgccatgcaggaaggggattacaccttccagcttaaagtgaccgattcttctagacagcagtctaccgctgttgttactgttattgtacagccagagaacaacaggccccccgtggcggtcgctgggccagataaggagttgattttcccagtcgaatccgctacactcgacggatcctcatcatccgacgaccacggaatcgtgttttatcattgggagcatgtgcgcggccccagcgccgtcgaaatggagaatatcgataaggcaattgctaccgtgacaggtctgcaggttggcacctaccactttcgattgacggtgaaggaccagcaggggctctcttccaccagcaccctgacagtcgccgtcaagaaggaaaacaatagtcctcctcgcgcacgtgccggaggcaggcacgtgcttgtactgccaaataacagcataacactggacggaagccgctcaacagacgatcagagaattgtcagctatctttggattcgagatggccagtctccagccgccggcgatgtcatcgatgggagcgatcatagtgtggccctccagctgaccaatctggtggagggggtttatacttttcacctgagagtcaccgactcgcagggggcttctgatacagataccgccacagtggaggtccagcccgatcctcgtaaaagcggtctggtcgaattgaccttgcaggtgggtgtcggccagctcacggagcagcgaaaggataccctggtgcgacagcttgccgtgttattaaacgtgcttgactccgacatcaaggtgcagaagattcgagctcatagcgatctcagcaccgtgattgttttttatgtgcagagtcgacctccattcaaggttctcaaggctgcggaggtggcccggaacttacacatgagattatctaaggagaaggcggacttcctattatttaaagtgctccgcgtggataccgccggatgtctgttgaaatgtagcgggcatgggcactgcgacccactaaccaaaaggtgcatatgcagccacctgtggatggaaaatctgatacagaggtatatttgggacggggagtcgaactgcgaatggagcattttctacgttacggtgcttgcatttaccctcatcgtgttgaccggcggatttacctggctgtgcatctgttgttgtaaacgccagaaacgcaccaaaatccggaaaaaaaccaaatacaccattcttgacaacatggacgagcaggagagaatggaacttcgccctaagtatgggatcaagcatcgatcaactgagcacaattccagcctgatggtgtcggagtcagagtttgactccgaccaggatactatcttcagtcgagaaaagatggagcgagggaaccccaaggtcagtatgaacggctccattagaaacggagccagcttttcatactgcagcaaggatcgctag

SEQ ID NO: 201264 - DNA, 1380 bp, Artificial Sequence
  Description of Artificial Sequence: Synthetic coding sequence
atgggcggcctgttcagccggtggcggaccaagcccagcaccgtggaggtactggaatctatcgacaaggagatccaggctttggaagagtttagagagaaaaaccaaaggctgcagaagctttgggtgggccgactgatcctgtactcaagcgtactgtaccttttcacctgcctgatcgtgtacctatggtacctgcccgatgagttcacagctcgactggcaatgacactgcccttcttcgctttccccctgattatatggtctatccgcacagtcataatattcttttttagcaagcgcactgagaggaacaacgaagcccttgacgatttgaaatctcaacggaagaagattctggaggaagtgatggaaaaagagacctacaaaaccgccaagttaatcctcgaacgttttgatcccgactctaaaaaagccaaggagtgtgaacctccatctgcaggcgccgccgttacggccagacccgggcaagagatccggcagaggacagcagcgcagcggaatctgtcccccacccctgcatccccgaatcaggggccaccacctcaagtgcccgtgtcccctgggccccctaaagactcgtctgcacctggtggcccccccgaaaggacagtcacccctgccttgtcctcgaatgtgttaccacgtcatctgggcagcccagcaacatccgtcccagggatggagatgggccttcctcacatagcgcaagcgggcctcgaacacttgagcagctctgacctgagcacatccacttctcagagtgccggcatcactggcctgcatccccctgggccaccccttgccaggcccatccttccccgcgagagaggggccctggataggattgtggagtacctggtcggagacggcccacagaatagatacgctttgatctgccagcagtgctttagccataatggtatggccctgaaggaagagttcgaatacatcgcttttcgttgcgcctattgcttcttcctgaatccagccaggaaaacaagaccacaggcccccaggctgcctgaattttcattcgagaagaggcaggtcgtggagggctctagctcagtggggccactcccttctgggagtgtgctgagctccgataaccagtttaatgaggagtctctcgaacacgacgtcctcgatgacaacaccgagcagactgatgacaaaattccggctaccgagcagaccaaccaggtcatcgagaaggcctccgactccgaagagccagaggaaaaacaggaaaccgagaacgaggaagccagtgttattgaaacaaattccaccgtccccggcgccgacagcattcccgacccagaattgtctggtgaaagcctcacagctgagtag

SEQ ID NO: 201265 - DNA, 240 bp, Artificial Sequence
  Description of Artificial Sequence: Synthetic coding sequence
atgcaccccgacctgagcccccacctgcacaccgaggagtgcaacgttttgattaatttgctgaaagaatgccacaagaaccacaatattctgaagttttttggttactgtaatgatgtagatagggagttgcggaagtgcctcaagaacgaatacgtggaaaacaggactaaatccagagagcacggaatagccatgcgaaagaaactgtttaatccaccggaggaaagtgaaaaatag

SEQ ID NO: 201266 - DNA, 1569 bp, Artificial Sequence
  Description of Artificial Sequence: Synthetic coding sequence
atgagccggcagctgctgcccgtgctgctgctgctgctgctgcgggcatcctgcccctggggacaggagcagggtgcacgatctcctagtgaagaaccgccagaagaggagataccgaaggaggacgggattttggtgctaagtaggcacacattaggccttgccttgcgggagcatcctgctctactggtagagttttatgctccctggtgtggtcactgccaggcccttgccccagaatactcaaaagctgccgctgtcttggccgcagagagcatggtagtcactctggccaaggtggacggacctgctcagcgggagcttgcagaagagttcggagtaaccgagtatccaacactgaagttctttagaaacgggaataggacccaccccgaagaatatactggtccccgggatgcggaagggattgctgagtggctccgcagaagggtgggaccttctgcaatgcgcctggaggatgaagcagcagctcaagcgctgatcgggggccgtgacttggtcgttataggtttctttcaagatgaagacgtggctacttttctcgctttggcgcaggacgcccttgacatgacctttgggctgaccgataggcccaggctgttccagcagtttgggctaaccaaagatactgtggtgctgttcaaaaagtttgacgagggccgcgctgacttccccgtggatgaagaacttggtctggacttgggggatctctcgcgattcctagtgactcacagcatgcgtctcgtgaccgagttcaattctcaaacatctgcaaagatatttgcagctcgaattttgaatcacctgttactgtttgtgaaccagacgcttgcagcccatcgagaactgcttgccggctttggtgaggccgcgcctaggtttagggggcaggtgctctttgtggtggtcgacgttgctgctgataatgaacatgtgctgcagtattttggactgaaggctgaagctgcaccaacactgcgcttggtgaatctggaaactactaaaaaatacgcaccagtcgatggaggccctgtgaccgcggcgagcataaccgccttttgtcacgccgtgctgaacggccaggtcaagccctacctcctttcccaggagattcctcctgactgggaccagaggccagtcaaaacactagttggcaaaaattttgaacaggtcgcctttgacgagactaagaacgtgtttgtgaagttttacgctccttggtgcacacattgcaaagaaatggcccccgcctgggaagccctcgctgaaaagtatcaagatcacgaagacatcatcattgcagagctggacgcaacagcgaacgagctggacgctttcgccgtgcatggatttcctacactgaagtacttcccggcaggtccgggacggaaggtaatagagtataaatctacccgggatctcgagacctttagcaaattccttgataacggaggggtgctccctaccgaggagcctcctgaagagcccgccgctccatttccagagccccccgcgaattcgacaatgggcagcaaagaagagttgtag

SEQ ID NO: 201267 - DNA, 1485 bp, Artificial Sequence
  Description of Artificial Sequence: Synthetic coding sequence
atgggcagcggcaccggcagcgaggagcccctgggcggcgccagcaggggcggcaatccgcaaggggggtgggatcttggcgccgagcccccacatcccggccctggacccgccggcgctccctgccctgctggggggatcctttgccccgtggtatgggctctgcctggacccggaccccgagtgcaacaaggtagctgtcgagcgaggggccgggtcaatggaggtcacgcagaagagtttggggtgacagaataccccactcttaagttctttaggaatggcaacagaacgcatccagaggagtatacagggccaagggacgcggaaggcattgccgagtggctaagacgcagagtcggacctagcgccatgcggctcgaagatgaggccgcagcccaggctctgattggagggagggatttagttgtgatcggcttttttcaggacctgcaggatgaggacgtggctaccttccttgccctggcccaggacgcgctcgatatgacttttggtctgactgacagaccccgtctctttcagcaattcgggcttaccaaggatactgtggtgctgtttaagaagttcgacgaagggcgagctgactttccagtcgatgaggagctaggcctcgacttgggcgacctgtcaaggttcctggttacccattccatgcggctcgtcacagaattcaactctcagacctctgcaaagatctttgccgccagaattcttaatcaccttttgctgtttgttaaccaaacattagccgcccaccgggagctgctggcgggtttcggcgaggctgctccacgttttcgcggtcaggtgctgttcgtggtggtcgatgtggcagccgataacgaacatgtcctgcagtattttgggttgaaagctgaagcagctcctacactgcggttagtgaatctggaaactaccaagaaatatgctccagtcgacggtggcccagtcacagcagcttcgatcactgctttttgtcacgcagtgctaaatggccaagtcaagccatatttactgtcacaggagattccccctgattgggaccagaggccagtaaagacgctggtgggaaaaaacttcgagcaagtggcgtttgatgagactaaaaacgtgttcgttaaattctacgctccatggtgcacccactgtaaggagatggcacccgcctgggaagccctcgccgagaaataccaagatcacgaggatattattatcgctgagctggatgccactgcaaacgagttggacgcgttcgctgtacacggatttccaacattaaaatatttccctgctggacccggacggaaggtgattgaatacaaaagcacacgcgacctcgaaacattttctaagtttctggataacgggggcgttttgcccaccgaggagccacccgaggagcctgccgccccttttccagaaccacccgccaattcaactatggggtccaaggaggagctttag

SEQ ID NO: 201268 - DNA, 1323 bp, Artificial Sequence
  Description of Artificial Sequence: Synthetic coding sequence
atggccctgctggtgctgggcctggtgagctgcaccttcttcctggcagtgaacggattgtacagtagctccgatgacgtcatagagctcactccttcaaatttcaatagagaggtaatccagagtgattcactgtggcttgtggaattttacgcgccatggtgcggccattgccaacgcctgacaccggaatggaaaaaggccgccactgctcttaaggatgttgttaaagtcggagccgtggatgcggataagcaccactcactgggcggccagtatggtgttcagggctttcccaccattaagatcttcggttctaacaagaaccgaccagaggattaccagggagggcgaacaggtgaagccatcgttgacgcggcactttcagcgctgaggcagctcgtgaaagaccggctggggggtcgctctggaggctacagtagcggcaagcaaggccgatctgacagtagttccaaaaaagatgtaatagagctgactgacgattctttcgacaagaacgtgctggactccgaagatgtgtggatggtagaattttatgcaccttggtgcgggcactgcaaaaatctggagccggaatgggcagcagccgcgtctgaagtgaaggaacagactaaggggaaggtgaaactcgctgccgtggacgctacggtcaaccaagttttagctagtcgatacggaatccgaggatttccgactattaaaattttccagaaaggcgaatcccctgtggactacgatggtggaagaactcgctccgacatcgtcagccgagccctcgacttattctcagacaatgccccccctcccgagctcctggagattattaatgaggatattgccaaacgaacgtgcgaggaacatcagttgtgcgtagtcgccgtgctgccccacatactagacacaggggctgctggccgaaactcctatctggaagtcctgctcaagctagcagataagtacaaaaagaaaatgtggggttggctttggacagaagccggggcacagagcgaactggaaactgctctgggcattggtggcttcgggtaccccgcaatggccgccattaacgcccgcaagatgaaattcgctctccttaaaggctccttctcagagcagggcattaacgagttcctgcgggaactaagcttcgggcgcggaagcacagcgccagtgggtggcggtgcctttccaacaatcgtcgaaagagaaccctgggatggtcgggacggagagttgccagtagaggacgacattgacctgtccgatgttgagctggacgatttgggaaaggacgagctgtag

SEQ ID NO: 201269 - DNA, 1338 bp, Artificial Sequence
  Description of Artificial Sequence: Synthetic coding sequence
atgtaccccagcaccaccatggccaacgcccccggcctggtgagctgtaccttcttcttggctgtgaatggcctctacagctccagtgacgacgttattgagcttaccccgtccaacttcaaccgagaagttattcagagtgattcattatggctggtggagttttacgccccttggtgcgggcactgtcagcgcctgacacccgaatggaagaaggcagcgaccgcactgaaagatgtcgtaaaggtgggagcagtcgacgccgataagcaccattctctcggtgggcagtatggcgtgcaaggcttccctacgataaagatcttcggatccaacaagaaccgacccgaggattaccaaggtggtcgcacgggtgaggcgatagtggatgctgccctcagtgccctgaggcagctggtaaaggaccggctggggggcagaagcggaggctacagctccggcaagcagggtcgatcagatagctcgagtaaaaaagacgtcatagagcttacagatgactcattcgacaagaatgtgctggatagcgaagatgtgtggatggttgaattttatgctccttggtgcggtcattgtaagaatctggagccggaatgggctgcagctgcttctgaagtgaaggaacagactaagggcaaggtcaaattagctgctgtagatgcgacagttaatcaagtcctggcatctcgttacggcattcgcggttttcctaccatcaaaatattccagaaaggggagtcgccagtagattacgacgggggacgcacacgcagtgacatagtgtcccgtgcactggatctgtttagtgacaatgcaccccccccagaactgttggagataattaatgaagacatcgccaagcgtacatgcgaagaacatcaactgtgtgtggtggccgtcctcccccatatcttggacaccggcgctgccggaagaaactcttatctggaggttctcctgaaactagccgataagtacaaaaaaaaaatgtggggttggctgtggaccgaggcaggcgcccagtcagaactggagaccgcactgggtattggtggctttggttatcctgccatggctgccatcaacgcccgtaaaatgaagtttgccctgctgaagggctccttcagtgagcagggcatcaacgagtttttgagggagctgtctttcggacgggggagtaccgctccagtagggggtggcgccttcccaacaatagtggaacgtgagccctgggacggtcgggatggtgagctgcccgtagaggatgatatcgacctgagcgacgtcgaactagacgatctgggtaaggacgagctctag

SEQ ID NO: 201270 - DNA, 36 bp, Artificial Sequence; identical to SEQ ID NO: 95076
  Description of Artificial Sequence: Synthetic coding sequence

SEQ ID NO: 201271 - DNA, 1314 bp, Artificial Sequence
  Description of Artificial Sequence: Synthetic coding sequence
atgatcctgggcctggtgagctgcaccttcttcctggccgtgaacggactctactcttcctctgacgatgtcatagagttgactccatcgaatttcaacagagaagtgattcaatctgactctttgtggctagtggaattctatgcaccctggtgtggacactgtcagcgcttaacccccgaatggaagaaagcagctacagctctgaaagatgttgtgaaggtgggggccgtcgatgccgataagcaccactcactgggggggcaatacggtgtgcaaggcttccccactatcaaaatctttggtagcaacaagaaccggcccgaagattatcagggcggaagaaccggagaagccatcgtggacgcagcacttagcgcactcaggcagttggttaaggatcgactgggaggaaggtccgggggctattccagcggcaaacagggccgatccgatagtagcagtaagaaggatgtgatagagttgaccgacgacagcttcgacaaaaacgtccttgacagtgaggatgtctggatggtggaattttatgcaccgtggtgtggacactgcaaaaatttggagcctgagtgggccgccgctgcctcggaagtcaaggagcaaactaaagggaaagtgaaactggccgccgtggatgcaactgtcaaccaagtgctcgctagtcgatacggaatcagagggtttcctacaatcaagatctttcagaagggcgaatctccagttgattatgacggtggtcgcacaaggtcagacatcgtctcccgcgcattggacctcttttctgacaatgcacctcctcccgaactgcttgagattatcaacgaagacatcgctaagaggacatgcgaagagcaccaactgtgtgtagtggctgtgctaccacacattctagatacaggcgccgctggcagaaattcatacctagaggtgctactgaaattagcagacaagtacaagaagaagatgtggggatggctgtggaccgaggcaggagcacagagcgaattggagactgctctgggcatcggtggatttggatatccggcgatggctgcaatcaacgctcgcaaaatgaagttcgccctactgaagggttcattctctgaacagggaatcaacgagtttcttcgagaactctcgtttgggaggggctccacggctcccgtgggtgggggagcatttccaactattgtcgaaagggaaccctgggatgggcgagatggagagcttcctgtggaagatgatattgacctgtccgatgttgagctggatgacctcggtaaagatgaactatag

SEQ ID NO: 201272 - DNA, 1956 bp, Artificial Sequence
  Description of Artificial Sequence: Synthetic coding sequence
atggccgacagcgccgagctgaagcagatggtgatgagcctgcgggtgagtgagctccaggtcctgctcgggtacgccggccggaacaaacatggccgcaagcatgaactcctcaccaaggcgctgcaccttctgaaagctggatgctccccagccgtgcagatgaaaattaaagaactctaccggcgccgcttcccccagaaaatcatgactcccgctgacctttccattcctaatgtgcactcttctcctatgcctgcaacactgtctcctagcaccatcccccaactcacatatgacggacaccccgcttccagccctctgctgcctgtgtcattgcttgggcccaagcatgagctcgagctgccacatttaacctctgccctgcacccggtgcatccggacattaaattgcagaagcttcccttttacgatctgctggacgaactgataaagcctaccagcctggcctcagacaattcacagcgctttcgggaaacctgcttcgccttcgcccttactcctcagcaggtgcagcagataagttcgtctatggacatctctggcaccaaatgcgatttcacagtgcaggttcagctgcgattttgcctgtccgagacctcctgtccgcaggaggatcatttccccccgaatctctgcgtgaaagtgaacaccaaaccttgtagcttacccggataccttccaccaaccaaaaatggggtggagccgaaaagaccctcaagaccgatcaatatcactagtctggtgcgtctgagcacaactgtgcccaatacaatcgtggtctcttggacagccgaaattggacgaaattactcaatggcggtttatttagtcaaacagctctcctccaccgtgctgcttcaacgcctgagggccaaggggatcagaaatcccgaccattccagggccctgattaaggaaaagctcacggctgatcctgacagcgaaattgccactacatccctaagagtaagcctgttatgcccactcgggaaaatgcggctcaccattccttgccgagctttgacctgcagccacctgcagtgcttcgacgctaccctgtatattcaaatgaatgagaaaaagcctacgtgggtctgcccagtgtgcgacaagaaggccccgtatgagcaccttattatagacggactttttatggagatccttaagtactgcacggactgtgatgagatacagtttaaggaagatggcacctgggccccaatgagatcaaagaaggaggtgcaagaagtctcggcttcatataacggggtggatgggtgcttgtcaagtaccctcgaacatcaggtggcaagccatcatcagagctctaacaaaaacaaaaaagtggaggttatcgacttaaccatcgactcttcatcagacgaagaggaagaagaacccagcgcaaaacggacctgtccgagcttgtcccccaccagtcccctgaacaacaagggtattcttagcctgccgcatcaggcctccccggtgagtcgtactccctcacttccagctgtggatacaagttacattaatacgtcgctgattcaggattacaggcatccttttcacatgacaccaatgccatatgaccttcagggtttagatttctttcctttcctgagtggtgataatcagcattataatacctcattgttggctgctgctgctgctgctgtcagtgatgaccaggatctgctccactccagccggttctttccctatacctcctcccagatgttcttggaccagctgagcgccggggggagcacctccctgcctaccaccaatggatcctcctctggatcgaacagcagtctggtgtcctcaaattccctccgggagagccatagccatactgtcactaaccggtcttccactgacacagcgagcatattcgggataattccagatatcatatctctggactag

SEQ ID NO: 201273 - DNA, 1962 bp, Artificial Sequence
  Description of Artificial Sequence: Synthetic coding sequence
atgttcaccctgcaggacagctacgtgaagcagatggtgatgagcctccgggtgtccgagctacaggtgctgcttggctatgcaggccggaataagcatggacgtaagcacgagcttctcacaaaggccctgcatcttctgaaagcgggctgttctcccgcagtccagatgaaaatcaaggaactgtatcgaagacgctttccccaaaagattatgaccccggccgatctatccatccctaacgtccactcttcaccaatgcccgccaccctttcgccgtctactattccacagctcacctacgatggacatcctgctagctctccactgctgccagtgtccctcctcggtcccaagcatgaactggaattgccccatctcacgtctgcactgcatcctgttcatcctgacattaaactacagaaactccctttctatgacctgctggatgaactgatcaaacccaccagtctggcatcagataactctcaaagattcagggagacctgtttcgcctttgcgctgacccctcagcaagtgcaacaaatcagttcatctatggatatctcaggtaccaaatgcgactttactgtccaggttcaactgcgcttttgcttgtctgaaacatcctgcccacaggaggaccactttcctcctaacttgtgtgttaaagtcaataccaagccgtgttccctacctggatacctgccgccaactaagaacggagtggagcctaagaggccgtcgagacccatcaacattacatctttggtgagactatccactactgtgcctaacacgatcgtggtgagttggactgcggaaataggtagaaattactctatggccgtctacttggttaaacagctttcctccaccgtattactacagcgtctgcgagccaaggggatcaggaatcccgatcattctcgggctttgattaaagaaaagctgaccgccgatccggatagcgaaatagcgacaaccagtcttcgggtctccctcctgtgccccctgggcaagatgaggctaaccatcccgtgcagggctcttacctgttcccacctgcaatgtttcgatgctaccctgtatatacagatgaacgaaaaaaaaccgacttgggtatgtcccgtgtgcgataaaaaagccccatacgagcatctgatcatcgatggcttattcatggagatcctcaagtactgtacggattgtgacgagattcagtttaaagaagacggcacatgggcccccatgcggagcaagaaggaggttcaagaggttagtgcctcgtacaatggcgttgatggatgtctgtctagcaccctggaacatcaagtagcctcacatcatcaatccagtaataaaaataagaaggtagaagtcattgatctcactattgattcgtcctcagatgaggaggaagaggagccttctgctaaacggacatgtcctagtctcagtccaacctccccactgaataacaaaggaatactgtctctcccccaccaggcctctcccgtgagtagaacaccctcgctgcctgctgtcgacaccagttacattaatacatcgcttatacaagattataggcacccctttcacatgacgcctatgccttacgacctgcagggcctcgacttctttccctttttaagcggcgataatcagcactacaacaccagtctacttgcggctgcggccgctgcagtgtcagatgatcaggatctgttacactcgtctcgattctttccatacacgtcctcccagatgttcttggatcagctgagtgccggaggcagcacttcactgcctaccactaacggtagctccagtggcagtaattcatcactcgtgagctctaatagtctgcgggagtcccatagtcacaccgtgacaaaccggagtagtaccgatacagcctccattttcgggattatccccgacattattagcctggactag

SEQ ID NO: 201274 - DNA, 1782 bp, Artificial Sequence
  Description of Artificial Sequence: Synthetic coding sequence
atggccgagctgggcgagctgaagcacatggtgatgagcttccgggtaagcgagctgcaggttctccttggcttcgctgggcggaacaaatctggccggaaacatgagctcctcgcgaaagccctgcatctgctgaagagttcctgcgcaccaagtgtacagatgaaaattaaagaactctatagaagacgatttcctcgtaagaccctggggcccagcgacttgtctctgctcagcctcccacctgggactagtcctcccgtacaccccgatgtcaccatgaaacccctcccattctatgaagtgtacggcgaacttatccgacccaccacccttgcatcgacgtcatcgcagcgatttgaagaagcccacttcacgtttgcgctcactcctcagcaggttcagcagattctgacctctagggaggtgctgccgggggcaaaatgcgactatacaattcaggttcagctgagattctgtctgtgcgaaacttcgtgcccccaagaggattactttcccccaaacctgttcgttaaagtgaacggcaagctctgccctctgccaggatacctgccacctaccaagaatggggcggagcctaagaggccaagccgcccaattaatatcaccccgctggctaggctgagcgcaaccgtgcctaatactatcgtggtgaactggtcttctgagtttgggcggaattactcgttgtcagtttacctcgtcagacagctgaccgccgggaccctgttgcagaagctgcgcgccaagggaatacgtaatcccgaccactcacgtgcacttatcaaagagaagctgactgccgaccccgacagtgaggtggccaccacctccttgagggtgtctctgatgtgccccctcggaaagatgcgattgaccgtgccatgcagagcacttacatgtgcccacctccaaagttttgacgctgcactttacctgcagatgaacgaaaaaaaacccacttggacctgccccgtatgcgacaaaaaagccccatacgagtccctgataatagatggccttttcatggagatcttgtcctcgtgttctgattgtgacgaaatccagttcatggaagatgggtcctggtgccctatgaaaccaaaaaaagaagccagcgaggtgtgtccaccacctgggtatggactggatgggctccaatacagtccagtgcaggggggagaccccagtgagaataagaagaaagtggaggtgatagaccttacaatcgaaagttcctcagatgaggaagatcttccgcctacaaagaagcattgttccgtcacttcagccgccattcctgctctccctggatctaagggcgtgctgacctctggccaccagccctcaagcgtcctgagatcgcccgccatgggcaccctaggaggggactttctgtctagtctgcctctccacgaatatcccccggccttccctctcggcgccgacatccagggtttggacctattttccttcctccagaccgagagccagcactatggtccttccgtcatcacatccctggatgagcaggacgccttgggtcacttcttccagtaccgaggcaccccctctcacttcctgggacctctcgcacccacgttgggaagctctcactgcagcgcaacccctgccccgccccccggaagggttagttccattgtggcacccggtggggctctgagggaaggccacggagggcctctgccgtccggcccaagtttaacaggctgtcgctccgatatcattagtctagattag

SEQ ID NO: 201275 - DNA, 873 bp, Artificial Sequence
  Description of Artificial Sequence: Synthetic coding sequence
atggtgatgagcttccgggtgagcgagctgcaggtgctgctgggcttcgccggaagaaataaaagcggccgaaaacatgagcttcttgcaaaagccctgcatctgctgaaaagctcctgtgccccctccgtgcagatgaaaatcaaagagctttacaggcggcgcttcccaagaaaaactttggggccttccgatttatctctccttagcctgccccccggtacatcgccagttggatcccccggtcctctggcaccaatccctcccactctcctagcccccgggacccttctcggccctaaacgcgaagtggacatgcacccaccgctgccccagcccgtacatcccgatgtgaccatgaagccccttccattctacgaagtgtacggcgaactcatacgaccaaccaccttggcctccactagtagtcagcgctttgaggaggcccacttcactttcgccctcaccccacagcaggtccagcagatcttgacctcccgagaggtgctccccggggcaaagtgtgattatacaatccaggtgcagctaagattttgcctgtgtgagacatcttgtccacaagaagactacttcccaccaaacttgtttgtgaaagtgaatgggaagctgtgccccctgcctgggtacctgccccctaccaaaaatggagccgagccaaagagaccttctagacctataaatattacccccctcgctcggttgagcgcgactgttcctaacaccatcgtggttaactggagctcagagttcggaagggtgtctactgcgaaagcgggcgcctggaagtctcttctgagagtgaaggggaatcatcctgtctcttgggtcggagaggcctttagcagcctgtag

SEQ ID NO: 201276 - DNA, 1887 bp, Artificial Sequence
  Description of Artificial Sequence: Synthetic coding sequence
atggccgagctgggcgagctgaagcacatggtgatgagcttccgggtcagcgaactgcaggtactgcttggattcgcgggcaggaataaatcaggaaggaagcacgagctgctggcaaaggccttgcacctgctaaagagttcttgtgcgccctccgtccagatgaagattaaagagctgtatcggcggcggtttccacgcaaaactcttggcccgagtgacttaagtctcttatctttacctccaggtaccagtcccgttggctctcctggtcccctggccccaataccacccaccctgctggcgcccggaacactgcttggcccaaagcgtgaggtggacatgcatcctccactaccccagcctgttcacccggatgtaacgatgaaacctctgccattttatgaggtttatggggaactgattcgaccaacaaccttggcaagcaccagttctcaaagattcgaggaggcccacttcacttttgcactcacccctcagcaggtgcagcagattctcacctcaagagaagtgctgcctggggcaaaatgcgactacaccatccaagtccagctaaggttctgcttgtgtgagacgagttgccctcaggaagactacttcccaccaaatctctttgtgaaggtcaacgggaagttgtgcccactgcccggctatctgcctcctaccaaaaacggcgccgaacccaaaagaccaagtagacccatcaacattactcctcttgcgaggctctccgccaccgtccccaacacaatcgtcgttaattggagttcagaattcggcagaaattacagcttaagtgtgtatctggtgaggcaactgactgctgggactcttctccagaaactaagggctaaaggcattcgcaaccccgaccatagtagagcgctgataaaggaaaaactcacagcggatcccgattccgaagttgcaacaacgagcctgcgggtctccttaatgtgcccactcggcaaaatgaggctgaccgtaccatgccgcgcacttacctgcgcccacttgcagtcttttgatgccgccctgtacctgcagatgaacgagaagaagcccacttggacttgccccgtgtgcgataagaaggccccttacgagtcgttaattattgatggtttgttcatggaaatcctctcaagctgttctgactgcgacgaaatccagttcatggaggatggctcctggtgtccaatgaagcccaaaaaggaagcctccgaggtttgtcctcccccaggctacgggctagacgggctccagtatagccctgttcagggcggcgacccaagcgagaacaagaagaaggtcgaggtcattgacctgacaatagagtcctcaagtgacgaagaagacctgcctccaaccaagaagcattgcagtgtcaccagtgcagcaatacccgcacttccaggatctaaaggagtgttaactagcggccaccagccatcaagcgtgctcaggagtcctgccatgggaaccctgggaggcgattttctgtcatcactcccgcttcacgaataccccccggctttcccattaggtgccgatatacagggactcgacctcttcagcttcctacagacagagagtcagcactatggcccaagtgttattactagcttggatgagcaggacgcattgggacattttttccaataccgggggacacctagccatttcctcggccctcttgcgcccacacttgggagctcacattgctccgcaacaccagctcctcctccagggagggtgagttctattgtcgcccctggaggagcccttcgagagggtcacggcggacctctcccaagtggtccatcattgactggatgtaggagtgacattataagtttagattag

SEQ ID NO: 201277 - DNA, 780 bp, Artificial Sequence
  Description of Artificial Sequence: Synthetic coding sequence
atggtgatgagcttccgggtgagcgagctgcaggtgctgctgggcttcgccggcaggaacaagtcaggcagaaagcatgagttgctggcaaaggccttacacctactcaagtctagctgcgcacccagtgtccaaatgaaaattaaagaactctaccgcaggcgttttcctcgtaaaacgcttggccccagcgacctgagcttgctgtcccttcccccaggtaccagtcctgtagggtctcctggtcctctggcccctattcctcccaccctactggctcccggaaccctgctgggccctaaaagagaggtagatatgcacccccccttaccccagcccgtgcacccagatgtcacaatgaaacccctgcccttttacgaggtttatggtgaactaatcagacccacaacgctagcatctacgtcttcccagcgcttcgaagaggcccacttcaccttcgctctgacccctcagcaagtccagcagatccttaccagccgcgaggtcctgccgggtgccaaatgtgattacacaatccaggttcaacttaggttctgtctgtgtgagaccagctgtcctcaggaggactactttcccccgaacctgtttgtgaaagtgaacggaaagctttgtcccctgcccgggtatctcccgcccacaaaaaatggcgccgaacctaagaggccaagccgaccgatcaatatcacacccttggcacggctcagcgcaacggtgccaaataccatcgtcgtgaattggtcttccgagttcggccgctag

SEQ ID NO: 201278 - DNA, 1248 bp, Artificial Sequence
  Description of Artificial Sequence: Synthetic coding sequence
atgttcgccgacctggactacgacatcgaggaggacaagctgggcattcctacggtacccgggaaagtgaccctgcagaaggacgcccaaaatctgatcggcattagtatcgggggcggagcgcagtactgtccctgcttgtacattgtccaggtgtttgataatactccggctgcccttgacggtaccgttgcagctggcgatgaaataactggtgttaacggcaggagcatcaagggaaagaccaaggtcgaagtcgccaagatgattcaagaagttaaaggtgaggtgactatccactacaacaaactgcaagcggaccccaagcaaggcatgtcacttgacatcgtcctcaaaaaggtgaagcacaggttagtcgaaaatatgagtagtggaactgcagacgccctgggtttatcccgagctatcttatgtaatgacggtctggtgaaaagactggaggagctcgagcggactgccgaactgtacaaaggcatgacagagcacacaaagaacctgctacgcgccttctacgaactgagtcagacccatcgcgcatttggcgacgtcttttcagtgattggcgtgcgagagccccagcccgcggccagtgaagccttcgttaagttcgccgatgcccatagaagtatagagaaattcggaatacgactgctcaaaacgataaaacctatgctcaccgatttgaacacatacttgaacaaggctattccagacactaggctaacaatcaagaagtatctggatgtcaaatttgaatatctgtcctactgtttgaaggtcaaggaaatggacgacgaggagtactcatgtatagctcttggtgagccactctacagagtgagtactggaaattacgagtaccggttgattctgagatgcaggcaggaggccagggcccgcttcagtcagatgcggaaagatgtgcttgaaaaaatggaattgttggaccaaaagcatgtgcaagatattgtcttccagctccaacgcctggtaagtactatgtccaaatactataatgactgttacgccgttctccgcgacgctgatgtttttcctattgaggtcgatttggcccacacaacactcgcttacggactgaaccaggaggaatttaccgacggggaggaggaggaggaggaggaggatacagctgctggagagccttctagagatacaaggggcgccgccgggccattggataagggggggtcgtggtgcgattcctag

SEQ ID NO: 201279 - DNA, 1248 bp, Artificial Sequence
  Description of Artificial Sequence: Synthetic coding sequence
atgttcgccgacctggactacgacatcgaggaggacaagctgggcatcccaacggtccctggcaaggtgacattacagaaggacgcccagaatttaatcggaatctcaatcggaggcggggcacaatattgcccctgtctgtacattgttcaggtgttcgataacacacccgccgccttggatggtactgtggctgccggggacgagatcaccggtgtgaacgggaggtctatcaaaggcaagactaaagtagaagtggctaagatgattcaggaagtgaagggagaagtaaccatacattacaataagctgcaggcggatcccaaacaggggatgtcccttgacatcgtccttaagaaagtgaagcatcggctcgtcgagaacatgagttcgggaacggccgacgctttgggactttctcgggcaattctgtgcaacgatggactcgtgaagcggcttgaggagctcgagagaacagcagaactgtataagggtatgaccgaacacacgaagaacttactccgcgcgttctatgagctcagccaaacccacagagcattcggagatgtgtttagcgtgataggcgtgcgggaaccccagccagctgctagcgaggcgttcgtcaaatttgccgatgctcatcgcagtatcgagaaatttggcattagactgttgaagactatcaagcctatgttgactgacctcaatacctacctgaataaggccattccagatacaaggctgactatcaaaaaatacttggacgtaaagtttgagtacctctcgtattgtctcaaggtgaaggaaatggatgacgaagaatactcgtgcatcgcactgggggagcccctgtatcgggtgagcaccgggaattacgaatacaggctgattttacggtgcaggcaggaggcacgcgctcgattcagccaaatgcgaaaagatgtgctggagaagatggaactgctcgaccagaaacacgtgcaggatatcgtcttccagttgcaacggctggtaagcactatgtccaagtactacaacgattgttatgccgtgttgagggatgccgacgtcttcccaatcgaggtcgaccttgctcacactactctggcttatgggctgaaccaagaagaattcactgatggcgaagaagaggaggaggaggaggataccgcggctggtgaaccctctagagatactcgcggagctgccgggccccttgacaagggtgggtcatggtgtgattcctag

SEQ ID NO: 201280 - DNA, 690 bp, Artificial Sequence
  Description of Artificial Sequence: Synthetic coding sequence
atgttcgccgacctggactacgacatcgaggaggacaagctgggcattcctactgtccccggaaaggtgacattgcagaaagacgctcagaacctcattggaatctctattggaggtggtgcacagtattgtccctgcctgtatatcgtgcaggttttcgacaatacgccagccgctcttgacggaactgtcgcggcaggagacgagatcactggcgtgaatggccggagcattaaaggcaagaccaaggttgaggttgccaagatgattcaggaggtgaaaggagaggtgacaatacactataacaaactgcaggccgatcctaagcagggaatgtctttggatatcgtgctgaagaaggtcaaacacaggcttgtggagaacatgtctagcggcaccgctgatgccctgggtctgtcccgtgccattctgtgtaatgacgggctggttaaaaggctggaggaattggagaggactgctgaactgtacaaaggcatgacagaacataccaaaaacctattgcgtgctttttacgagctgagccagactcatagggccttcggggacgtgttctctgtgatcggggtgcgtgaacctcagcccgccgcgtcagaagctttcgtgaaattcgctgatgctcatcgaagtatagagaaatttggcatccgcctgttaaaaaccataaaatag

SEQ ID NO: 201281 - DNA, 405 bp, Artificial Sequence
  Description of Artificial Sequence: Synthetic coding sequence
atgttcgccgacctggactacgacatcgaggaggacaagctgggcatccccacggtccctggtaaggtgacccttcagaaagacgcccagaacctcatcggtatctccatcgggggaggagcccagtactgtccatgtctctacattgtgcaggtgttcgacaatacacccgctgccctcgatgggacagtggctgctggcgatgagataactggggttaatggcagatccataaaggggaaaacaaaagtcgaagtggccaagatgatacaagaagttaaaggagaagtcactattcactacaataagttgcaagcagaccccaaacaaggtatgtcccttgatatcgtgctgaaaaaggtgaaacatcgcctagtcgagaatatgagctccggcaccgcgtag

SEQ ID NO: 201282 - DNA, 393 bp, Artificial Sequence
  Description of Artificial Sequence: Synthetic coding sequence
atgttcgccgacctggactacgacatcgaggaggacaagctgggcattcccaccgtgccggggaaggtgaccctgcaaaaggatgcgcagaacttaattggcatctcaattggagggggagctcagtattgcccgtgcttgtacatcgtgcaggtgttcgacaacacacctgcagcgctagatggcactgtggccgccggagacgagataactggcgtcaacggccgatctatcaagggtaaaactaaggttgaggtggcaaaaatgatccaggaagttaagggggaggtaaccattcattacaacaagcttcaagccgaccctaaacaaggtatgagcctggacataggccagaggctgggctttcacgggcccggcccacactcctcctag

SEQ ID NO: 201283 - DNA, 117 bp, Artificial Sequence
  Description of Artificial Sequence: Synthetic coding sequence
atgttcgccgacctggactacgacatcgaggaggacaagctgggcatccctaccgtgcctggaaaggtgactctccagaaagacgcccagaatcttatcggtattagtatcgggtag

SEQ ID NO: 201284 - DNA, 231 bp, Artificial Sequence
  Description of Artificial Sequence: Synthetic coding sequence
atgaccgacgtggagaccacctacgccgacttcatcgccagcggccgcacgggccgtagaaatgcaatccacgacatcctggtgagcagcgcgtcaggtaattcgaacgagctagccttgaagctggccggcttagacatcaacaaaactgagggagaggaagatgcacagcgatcatccaccgaacagtctggtgaagctcaaggagaagccgccaaaagcgagtcatag

SEQ ID NO: 201285 - DNA, 231 bp, Artificial Sequence
  Description of Artificial Sequence: Synthetic coding sequence
atgaccgacgtggagaccacctacgccgacttcatcgccagcggccgcactgggcggaggaacgccatacacgacatcctggtgtctagcgcttccggcaattctaacgagctggctttgaaactggccggcctggacattaataagaccgagggagaagaagatgctcagagatcgagcacagaacagtcaggggaagctcagggtgaagcagcaaaatcggaaagctag

SEQ ID NO: 201286 - DNA, 231 bp, Artificial Sequence
  Description of Artificial Sequence: Synthetic coding sequence
atgaccgacgtggagaccacctacgccgacttcatcgccagcggccgaactggccggcggaacgccatccatgacatcctggtctcaagcgctagtgggaacagcaacgaactggccctcaagctcgctggattggatattaataagacagagggtgaagaagatgctcaaaggagttctacagagcaatctggcgaagctcagggtgaagccgccaagtcggagtcttag

SEQ ID NO: 201287 - DNA, 258 bp, Artificial Sequence
  Description of Artificial Sequence: Synthetic coding sequence
atgagccaccaggacgtggccatgcggaccgacagcagcaagatgaccgacgtggagtctggcgtcgccaacttcgcctcaagtgctagagcaggacgaagaaacgcacttcctgatatccagagttcagccgccactgatggcacttctgatctgcccctgaaattagaagccttgtccgtaaaggaggacgctaaggaaaaggatgaaaaaacaactcaggatcagttagaaaagccccagaacgaggaaaagtag

SEQ ID NO: 201288 - DNA, 237 bp, Artificial Sequence
  Description of Artificial Sequence: Synthetic coding sequence
atgcggaccgacagcagcaagatgaccgacgtggagagcggcgtggcgaactttgcttcaagcgctcgtgctggcagaagaaacgccctgccagatattcaatcctctgctgctacggatgggacgtcagatctgccactgaagctagaagccctctcagtgaaagaggacgcaaaagagaaggatgaaaagaccacccaggaccagttagaaaagccgcagaatgaagaaaaatag

SEQ ID NO: 201289 - DNA, 264 bp, Artificial Sequence
  Description of Artificial Sequence: Synthetic coding sequence
atgcacatcctgttcgtggacgtggccatgcggaccgacagcagcaaaatgaccgatgtggagagcggagtcgccaacttcgcctctagtgccagggcagggagacggaatgctttgcccgacattcagtcttccgccgccactgatggcactagtgatttgccactcaagctggaggcactgagtgtgaaagaagacgcgaaggagaaggatgagaaaaccactcaagatcagctcgaaaagcctcaaaacgaggaaaaatag

SEQ ID NO: 201290 - DNA, 237 bp, Artificial Sequence
  Description of Artificial Sequence: Synthetic coding sequence
atgcggaccgacagcagcaagatgaccgacgtggagagcggcgtggccaacttcgcctctagcgcccgagctgggagacggaatgccttgcctgacatacaaagcagtgccgccaccgacggcacatccgacttacctttgaaactggaagctctttcagtcaaagaggatgctaaggagaaggatgaaaagactactcaggaccagttagagaagcctcagaatgaagagaaatag

SEQ ID NO: 201291 - DNA, 237 bp, Artificial Sequence
  Description of Artificial Sequence: Synthetic coding sequence
atgcggaccgacagcagcaagatgaccgacgtggagagcggcgtggctaactttgcttcatccgccagagccggaagacgtaacgcgttacctgacattcagagttcggcggccaccgacggcacttccgatctgccactgaaacttgaagctctgtctgtaaaagaggacgcgaaggagaaagacgagaagactactcaggaccagctggagaagccacaaaacgaggagaagtag

SEQ ID NO: 201292 - DNA, 237 bp, Artificial Sequence
  Description of Artificial Sequence: Synthetic coding sequence
atgcggaccgacagcagcaagatgaccgacgtggagagcggcgtggccaatttcgcctcctcagctcgcgccggtcggcggaatgctttgcccgatattcagagtagcgcagccaccgatggaacgtccgacctgccactcaaactggaagccctatccgtgaaggaggacgctaaggaaaaggacgaaaaaactacccaggaccagctggaaaagccccagaacgaggagaagtag

SEQ ID NO: 201293 - DNA, 237 bp, Artificial Sequence
  Description of Artificial Sequence: Synthetic coding sequence
atgcggaccgacagcagcaagatgaccgacgtggagagcggcgtggctaactttgcatcatctgccagagccgggaggcgtaacgccctgcccgacatccaaagctcggctgccaccgacggcacgagtgatcttccattaaaattggaggcactttccgtgaaggaggacgccaaagaaaaggatgaaaagactacccaggaccagctcgagaaaccccagaatgaggaaaaatag

SEQ ID NO: 201294 - DNA, 231 bp, Artificial Sequence
  Description of Artificial Sequence: Synthetic coding sequence
atgatggaggtggagagcagctacagcgacttcatcagctgcgaccgcacaggccgcagaaatgccgttcccgatattcagggggactctgaagcagtctccgtgcgcaagctggcaggggacatgggagaactggcgcttgagggtgcagagggtcaggttgaaggaagcgctccagataaggaggcagggaaccagcctcagtcatctgatggtactacaagcagttag

SEQ ID NO: 201295 - DNA, 195 bp, Artificial Sequence
  Description of Artificial Sequence: Synthetic coding sequence
atgatggaggtggagagcagctacagcgacttcatcagctgcgacagaaccggacggcggaacgcagtgccagacattcagggcgactccgaagccgtgagcgtcaggaagcttgcaggagatatgggtgagcttgcgcttgagggagcagagatggacttaacaatgttgccatggctcgtgagcaactcttag

SEQ ID NO: 201296 - DNA, 231 bp, Artificial Sequence
  Description of Artificial Sequence: Synthetic coding sequence
atgatggaggtggagagcagctacagcgacttcatcagctgcgaccgcacaggcagacggaacgcagttcccgacatccaaggcgacagcgaagccgtcagcgtaaggaagctggcaggcgacatgggagagctggccctagaaggagctgagggccaagttgagggatcagcgccagacaaagaggcaggcaaccaaccgcagtcctctgatggcacgacctcttcatag

SEQ ID NO: 201297 - DNA, 231 bp, Artificial Sequence
  Description of Artificial Sequence: Synthetic coding sequence
atgatggaggtggagagcagctacagcgacttcatcagctgcgacaggacaggcagaagaaatgctgttcccgacattcaaggtgactctgaagcggttagcgtgagaaagttagccggagatatgggggaattagcgttggaaggggccgagggtcaggtggaaggcagcgcacctgacaaggaagcgggaaaccagccccagtccagtgacgggaccacctcttcgtag

SEQ ID NO: 201298 - DNA, 231 bp, Artificial Sequence
  Description of Artificial Sequence: Synthetic coding sequence
atgatggaggtggagagcagctacagcgacttcatcagctgcgacaggacaggacggcggaatgcagtccccgacattcagggcgatagcgaggctgtcagcgtgcggaaacttgcaggtgatatgggggaactggcactggaaggcgctgaaggccaagtggagggaagcgcgcccgacaaggaagccggcaaccagcctcaaagttccgacggaacaacaagctcctag

SEQ ID NO: 201299 - DNA, 231 bp, Artificial Sequence
  Description of Artificial Sequence: Synthetic coding sequence
atgatggaggtggagagcagctacagcgacttcatcagctgcgacagaactggccgacgaaatgccgtccctgatatccaaggggattcggaagcagtatctgtgagaaagctagcaggtgacatgggagagcttgccctagagggcgcggagggccaggtcgaaggatccgcaccggacaaggaggccggtaaccagcctcagtcttccgatggtaccacgtcttcctag

SEQ ID NO: 201300 - DNA, 231 bp, Artificial Sequence
  Description of Artificial Sequence: Synthetic coding sequence
atgatggaggtggagagcagctacagcgacttcatcagctgcgaccgcacggggcgccgcaacgctgtgcctgacatccaaggcgattctgaggcagtgagtgtccgcaagctcgcaggggatatgggggaactcgccttggagggtgccgaaggacaggtcgaagggagtgcccctgacaaagaggccggcaatcagccccagtctagtgacggaactacctcttcctag

SEQ ID NO: 201301 - DNA, 1578 bp, Artificial Sequence
  Description of Artificial Sequence: Synthetic coding sequence
atgcccctgctggacggcgacctggagggcagcggcaagcacagcagtcggaaggtggattcccctttcggacccggctcacctagcaaaggtttcttcagcagggggcctcagcctaggccgagtagccctatgagcgcccctgtgcgacccaaaacatcccctgggtcgcccaaaaccgtgtttccttttagctaccaggaaagtccacccaggtcacctcgcagaatgtcgttctccgggatcttccggtcctcatctaaggagagctcacccaattctaatcctgctacctcacccggaggcatccggtttttttcacgttctagaaagacatctggcttaagctctagcccatcaacgccaactcaggtgacaaagcaacatacattcccactggagtcttacaagcatgagccagaacgactggagaataggatttacgcatcctcttctccccccgacactggacagagattttgcccttcttcctttcagagccctacacgacctcctctagccagtccaacccactacgctccatctaaggccgctgcactcgctgcagctttgggtcctgccgaggctggtatgctggaaaaactggaatttgaagacgaggctgtagaagactcggaaagtggggtgtacatgaggtttatgcggtctcataaatgttacgatatagtgccgacttcgtcaaaattggtggtcttcgacacaacactgcaggtgaaaaaagctttttttgctctggttgccaatggggtgcgggccgccccactttgggaatctaaaaaacaaagcttcgtgggcatgctgactattaccgattttatcaacattctgcatcgttactacaaaagtccgatggtacagatctacgagctcgaggagcacaagatcgaaacctggcgagaactatacctccaagaaacatttaaacccctcgtgaacataagccccgacgcgagtctttttgatgccgtgtactccctgatcaagaataagatccatcgattgcctgtcattgatcccattagcggcaacgccctgtacattctcactcataagcgtatactgaaattcctgcagcttttcatgagtgacatgcccaagccagcctttatgaaacagaatcttgatgaactcgggatagggacctaccataacatagcattcatccatccagatacgccaattatcaaggctcttaatatcttcgtcgagcgacggatttccgccctccctgtggtggacgagagtggcaaggtcgtggatatatattctaagttcgatgtcattaacctagcagctgagaagacgtataacaacctggatattaccgtgactcaagctctccagcacagatcacaatacttcgagggagtggtgaagtgcaacaagctggaaatattggagacaatcgtggacagaatagttcgggccgaggtgcacagactggttgtggttaacgaagccgacagcattgtcgggataatctctctctcagacattcttcaggccttaatcctaacccctgccggcgctaaacagaaggagaccgagacggagtag

SEQ ID NO: 201302 - DNA, 987 bp, Artificial Sequence
  Description of Artificial Sequence: Synthetic coding sequence
atgctggagaagctggagttcgaggacgaggccgtggaggacagcgagtccggggtttatatgaggttcatgagaagccataagtgttatgacattgtccctacgtcgtccaagctggttgttttcgacacaacactccaggttaaaaaggccttctttgctctcgttgctaatggcgtgagagccgcccccttgtgggagtctaaaaagcagtcatttgtggggatgctcactataactgactttataaatatcctgcatagatattataagtcacccatggtgcagatatacgagcttgaggagcataaaatagagacctggcgcgaattgtatctccaagagactttcaagccgcttgtgaacattagccccgacgccagtctgttcgacgctgtctattccctgattaagaataaaatccacaggctgcccgtaatcgacccgatctctggaaatgctctctatattctgacacataagcggattctcaagttcctgcaactgttcatgagtgatatgccgaagcctgcctttatgaagcagaatcttgacgagctggggatcggtacctatcataatattgctttcatccacccagatacacccattatcaaggccctcaatatcttcgttgaaaggaggatttctgccctgcctgtcgttgacgagagtggtaaggtagtagacatttattccaagtttgacgttattaacctggccgccgagaagacctacaataatttggacatcacggttacacaagcgctccagcataggtcccagtacttcgagggtgtggttaagtgtaacaaacttgaaattcttgaaaccatcgtggatcgaattgtgcgggccgaggtgcacaggttagtggtggtgaatgaggccgactccattgtgggtattattagtctgagcgacattctacaggctctgatcttgaccccggctggggccaaacagaaggagaccgaaacagaatag

SEQ ID NO: 201303 - DNA, 1335 bp, Artificial Sequence
  Description of Artificial Sequence: Synthetic coding sequence
atgagcagcagctacgacgaggccagcctggcccccgaggagaccaccgactctttctgggaagtcggtaactacaaaagaacggtgaaaaggatcgacgacggacataggttatgcaatgacctgatgaattgcgtgcaggaacgggcaaagatagaaaaggcgtacggacagcagctgactgattgggcgaagcggtggcgacagctcattgaaaagggtccacagtacggatcacttgagcgggcctggggggccattatgaccgaggccgataaagtgtccgagcttcaccaggaggtaaaaaataaccttctgaacgaggatctggaaaaggtcaaaaattggcaaaaggatgcatatcacaagcagattatgggtggttttaaagagacaaaggaggccgaggacggatttaggaaagcccagaagccttgggctaagaagatgaaggagctagaggccgccaaaaaggcttaccatttagcctgtaaagaagagaagctcgctatgaccagagaaatgaacagcaagacggagcagtccgtgacccccgagcagcagaagaaactgcaggacaaggtggacaagtgtaagcaagacgtgcagaaaacacaggaaaagtacgaaaaagtgcttgaggacgtcggtaaaaccactccgcagtacatggaaaacatggaacaggtgtttgaacagtgccagcagtttgaggagaagagattggtgtttttaaaggaggtgctgctggacattaaaagacatctgaacctcgccgaaaacagcagttatattcatgtttacagggagctcgagcaggcaattaggggggccgacgcccaagaagatctgcgctggttccggtctacatcaggccctgggatgccgatgaactggcctcagttcgaggaatggaaccccgatctaccacataccacgaccaaaaaggagaaacagccgaagaaggctgagggagtggctctcacaaacgcaactggggccgtggaaagcacatcacaagctggagaccgcgggagcgtttcaagctatgatcgcggtcagccttacgccacagagtggtctgatgacgagtccggcaacccatttggtgggtccgaaactaacggcggcgccaacccctttgaagatgactccaagggtgtgcgggttagagcactgtacgattacgacggccaagaacaggatgagctttcttttaaagcgggcgacgagttaaccaagctgggcgaagaagacgagcagggatggtgcagaggaagactggattctgggcagctggggctttatccagctaactatgtggaggcaatctag

SEQ ID NO: 201304 - DNA, 1281 bp, Artificial Sequence
  Description of Artificial Sequence: Synthetic coding sequence
atgagcagcagctacgacgaggccagcctggcccccgaggagaccacagactctttttgggaggtcgggaattacaagaggactgttaaacgcatagatgacggtcatcgtctttgcaatgacctgatgaactgcgtgcaggaacgggccaagatcgagaaagcttatgggcagcaactcactgactgggccaaacggtggcgacagctgatcgaaaaggggcctcagtatggatcactagagcgagcctggggggctattatgacagaggccgacaaggtcagtgagctccaccaagaagtcaaaaataatctcctcaacgaggatcttgaaaaagtcaagaattggcagaaggatgcatatcacaagcagattatgggtgggtttaaggagaccaaggaagcggaagatggcttcagaaaggcgcaaaagccatgggctaagaaaatgaaggaactggaggctgcgaagaaggcctaccaccttgcatgcaaggaggaaaaattagcaatgaccagagaaatgaactcaaagactgagcagtcggtgacccctgagcagcagaagaagctgcaagacaaagtcgataagtgtaaacaggatgtgcagaaaacccaagagaagtacgaaaaggtactggaggacgtggggaagacaacaccacagtatatggagaacatggagcaggtgtttgagcagtgccaacaatttgaggagaagcgccttgtttttctaaaagaggtgctgctggacattaaacgccaccttaacctcgcggagaatagttcatacattcatgtctacagggaactcgagcaggctatccgtggtgctgatgcacaagaggatctaagatggttcagatccacatctgggccggggatgcccatgaattggcctcagtttgaagaatggaatcctgacctgcctcacaccacgactaagaaggaaaagcagccaaagaaagccgagggcgtggccctgaccaatgccactggcgcagtcgaaagcacctcgcaggccggagatcgtggaagtgttagctcctatgaccgcggtcagccgtatgcaaccgagtggagcgatgatgaaagtggaaatccattcggcgggtcggaaacgaacggcggcgctaatccatttgaggacgattccaaaggcgtgcgcgtgcgcgcactctacgactacgatggacaggaacaggatgaactgtctttcaaggccggggatgaattgaccaagctgggtctctaccccgctaattacgtggaggcaatatag

SEQ ID NO: 201305 - DNA, 1335 bp, Artificial Sequence
  Description of Artificial Sequence: Synthetic coding sequence
atgagcagcagctacgacgaggccagcctggcccccgaggagaccacagactctttctgggaagttggcaattacaagcgaactgtaaagaggatcgatgacgggcaccgcctgtgcaacgacctgatgaactgtgtccaagagagggccaagatcgagaaggcctacggtcagcaactcacggactgggctaagagatggcggcagctgattgaaaagggaccacagtatgggtccctggaacgcgcttggggagcaatcatgaccgaagccgataaggttagtgagctgcatcaagaagtaaagaataatctgctcaatgaagacctggaaaaagtgaagaactggcaaaaggacgcataccacaaacagatcatgggcggatttaaagagactaaggaggcagaggatggttttcggaaggcgcagaagccgtgggccaaaaagatgaaggagttagaggccgccaaaaaagcgtatcatctggcctgtaaggaggaaaagctggctatgacgcgtgagatgaattcaaaaactgagcagtccgtgactcccgagcagcagaaaaagttgcaggataaggtggacaaatgtaagcaggatgttcagaagactcaagagaagtacgaaaaagtgttggaagatgtaggcaagaccactcctcagtatatggaaaatatggaacaggtatttgaacaatgtcaacaatttgaagagaaacggctagtgttccttaaggaggtcctattagatatcaagagacacctaaacctggccgagaatagctcatacattcatgtataccgggaactagagcaggcgatcagaggggcggatgcacaggaagatctgcgttggttccgaagcacaagtggcccaggtatgcctatgaattggccgcagtttgaggagtggaatccagacctacctcacacgacaactaaaaaagaaaagcagcccaagaaggccgagggcgtggcactgaccaacgcaaccggcgccgtggaatctactagtcaagcaggcgatagaggctctgtatccagttacgatagggggcagccatatgcaaccgaatggtcagatgatgaatctggaaaccctttcggcggtagtgagacaaacgggggcgctaacccctttgaagacgactcaaaaggcgtgcgcgtgcgagcattgtatgactacgatggccaggagcaggacgaacttagctttaaggctggcgatgaactaacaaaactgggtgaagaagacgaacaagggtggtgccgcggcagactggacagcggacaactgggcctgtatccagcaaattatgtggaagcaatatag

SEQ ID NO: 201306 - DNA, 1275 bp, Artificial Sequence
  Description of Artificial Sequence: Synthetic coding sequence
atggcccccgaggaggacgccggcggcgaggccctgggcggcagcttttgggaagctggcaactaccgaagaaccgtacagcgcgtggaagatggccaccgcctatgcggggatctggtatcatgtttccaggaacgagcgaggatcgaaaaagcatacgcccaacagctcgctgattgggctcgaaagtggcgtggcactgtggaaaaggggcctcagtatggcactctggaaaaagcatggcacgctttctttactgccgctgagcgcctctccgcactgcatctcgaagtccgcgagaagctgcaagggcaggactctgagcgggtgcgggcctggcagagaggcgcctttcacagaccggtgttggggggttttagggagagccgagctgcagaggacggattcagaaaggcccaaaaaccatggttaaagagacttaaggaggtggaggctagcaaaaagagctaccacgccgccaggaaagacgagaagaccgcgcagactcgcgagagccacgccaaggctgattcagccgtcagccaagaacagctgcgcaagcttcaggaacgcgtggagaggtgcgctaaagaggctgaaaaaacgaaggctcagtacgaacagactttggctgaattgcaccgatatacacctcgctacatggaggatatggagcaagcctttgagacttgccaggcagccgaacggcaaaggttactgtttttcaaggatatgctgttgaccttacatcagcatcttgacctctcctcatccgaaaaatttcatgagctgcacagggacctgcaccagggaatagaggcagcgagtgacgaggaggatctcaggtggtggaggtctactcatggacccgggatggccatgaactggccccagttcgaagagtggagtctggacacacaaagaaccatctctcggaaggaaaagggaggccgtagtcccgacgaagtgactcttacaagcatcgtacccacccgcgatggaacagctcctccaccgcagagccccggctccccaggaacgggccaggatgaagaatggtccgacgaggagagtccaagaaaagctgcaaccggagtcagggtcagagcactctacgactacgctgggcaggaagcagacgagttatccttccgcgccggggaggaattactcaagatgtcggaagaggacgagcagggctggtgccaggggcaactgcaatccggcagaattggactctaccccgccaattacgtcgaatgtgtaggcgcgtag

SEQ ID NO: 201307 - DNA, 879 bp, Artificial Sequence
  Description of Artificial Sequence: Synthetic coding sequence
atggcccccgaggaggacgccggcggcgaggccctgggcggcagcttctgggaggcaggcaattaccgtcgaacagttcagagagtcgaggacggacatcggttatgcggcgatttagtgtcctgcttccaagagagagccagaatcgagaaggcctatgcgcaacagcttgcagactgggctcgcaaatggcggggtacagtagagaaaggacctcaatacggtaccctggagaaggcttggcacgcctttttcactgccgcggagcggctttctgccttgcatctggaggtgcgcgaaaaacttcagggtcaggacagcgagagagttcgggcctggcagcggggtgcctttcacaggcccgtactaggaggatttcgggaatccagggcggccgaagacgggttccggaaggcccagaagccctggttgaaaaggctcaaggaggttgaagcttcaaaaaaatcctatcatgctgcccgtaaggacgagaaaaccgctcagacacgagagacacaacgacagacagctccatcccctcggtccagctgtgctaattgtaggaacggatggaacgctgttccccgccggcctaggaggcagaagctgtcaatgagcagaaggtggcagtcttgtatagctactttgcatgcgacatggcggacatggaataggccacttagaccagctcggcctcctagcgccagtggcttcttctccagccgtatctgctgtagtccgtacacaagcacctggaccttccctgccgtccgctccagtatgaattccaccgtcacctgcactagggctctgcgccaacccgttacgaagcggatctgcgcaggcggagctgcacctacagggcaggcatggccatag

SEQ ID NO: 201308 - DNA, 210 bp, Artificial Sequence
  Description of Artificial Sequence: Synthetic coding sequence
atggcccccgaggaggacgccggcggcgaggccctgggcggcagcttctgggaggcaggtaactatagaagaaccgttcagagggtcgaagacggccaccgactctgcggcgacttagtcagttgcttccaggaacgcgcacggatagagaaggcatacgcccagcaattggcagactgggctagaaaatggcgagggacggtggagtag

SEQ ID NO: 201309 - DNA, 429 bp, Artificial Sequence
  Description of Artificial Sequence: Synthetic coding sequence
atggcccccgaggaggacgccggcggcgaggccctgggcggcagcttttgggaggccggcaattatagaagaacagtgcagagggtcgaggacggacaccgtctgtgtggagatttggtcagctgttttcaggagcgggcaaggattgagaaggcttacgctcagcagctcgcggactgggctcgcaaatggcggggtaccgtggagaaggggccacaatatggaactctcgagaaggcctggcacgctttctttaccgcagccgagcgtctgagcgccctccatctagaagtgagggagaaattgcaaggacaggattctgagcgcgtgcgcgcatggcaaaggggcgcctttcatcgtcctgtcctcggaggcttccgcgagtctcgcgccgccgaggacggcttccgtaaagcccagaaaccttag

SEQ ID NO: 201310 - DNA, 1218 bp, Artificial Sequence
  Description of Artificial Sequence: Synthetic coding sequence
atggcccccgaggaggacgccggcggcgaggccctgggcggcagcttttgggaggccgggaactaccgccggacagtacagcgcgttgaggatggacaccggctgtgtggtgacttggtcagttgctttcaggagcgagctagaatcgaaaaagcctatgctcagcagctcgccgattgggcaaggaaatggcgcggaaccgtggagaagggtccccaatacggtaccctggagaaagcttggcacgcttttttcaccgccgctgagaggctgtcagcattacacctggaggtccgggaaaagctccagggccaggactccgagcgcgtacgagcatggcagcgaggtgccttccatcgacctgtactcggcgggtttcgggaaagccgagcagctgaggacgggttccgcaaagcccaaaagccatggcttaaaagactgaaagaggttgaggcgagcaagaagtcttaccacgccgctcggaaagacgagaaaactgctcagacacgagagtctcacgccaaagcagacagcgccgtgagtcaggagcaactccgcaagctacaggaacgagtggagcgatgtgccaaagaagcagaaaaaacgaaagctcagtacgaacagactctggctgaattgcatcgatatacaccccggtatatggaggatatggaacaggccttcgagacgtgtcaggctgccgaacgccagcggctgctgttcttcaaggatatgctcctgactcttcaccagcatctcgatctcagcagttcagagaagttccatgaattgcaccgggatttgcaccagggcatagaagcggcttctgatgaagaagacctaaggtggtggaggagcacccatggacctgggatggctatgaactggccacagttcgaggagtggtccctggacacccaaagaacaatcagtcgaaaagaaaagggcggccggtctccagatgaagtgacactaacaagtatagtgccaaccagagatgggactgctcccccccctcagagcccaggttctcccggcaccggccaagatgaggagtggtcggatgaagagagtcctaggaaagcagctaccggagtgagggtgagagcactatacgactacgcaggacaggaagccgatgagctcagctttagggccggcgaagagcttttaaaaatgtccgaggaggacgagcagggttggtgtcagggacagtag

SEQ ID NO: 201311 - DNA, 210 bp, Artificial Sequence
  Description of Artificial Sequence: Synthetic coding sequence
atggcccccgaggaggacgccggcggcgaggccctgggcggcagcttttgggaggccggtaactatcggcgaaccgtgcagcgagtcgaggacggccatcggctatgcggggacctcgttagttgtttccaggagagggccagaatagagaaagcctatgcgcagcaacttgccgattgggccaggaagtggagaggcacggtggagtag

SEQ ID NO: 201312 - DNA, 447 bp, Artificial Sequence
  Description of Artificial Sequence: Synthetic coding sequence
atggcccccgaggaggacgccggcggcgaggccctgggcggcagcttctgggaagcaggtaattatcgtcgcacagtacagcgggtggaagacggacatcgcctttgtggtgacctggtgagctgtttccaggagagagcccggattgagaaagcatacgcccagcaattggcagattgggctaggaagtggagaggaacagtcgagaagggcccacagtacggaaccctggagaaagcctggcatgctttctttacggcggcggagcggctgagcgccctgcatctggaagtgcgggagaaactacaggggcaggatagcgaacgggttagggcctggcagcggggagcctttcacagaccagtgctcggcggatttcgggaatctcgcgcagcagaggacggattcagaaaggcacagaaaccgtggctcaagaggttgaagtag

SEQ ID NO: 201313 - DNA, 1275 bp, Artificial Sequence
  Description of Artificial Sequence: Synthetic coding sequence
atggcccccgaggaggacgccggcggcgaggccctgggcggcagcttttgggaagctggaaactatcgccggacagtccagagggtcgaagacgggcacagactctgcggggatctggtgtcttgctttcaggaaagggcacggattgaaaaggcatacgctcagcagctggcagattgggcgcgtaagtggagaggcactgtggagaaaggcccacagtacggtaccctggagaaggcctggcacgcattttttacggctgcagaacgtctgtctgccctccacttggaagtgagggagaagcttcagggccaggattctgaacgcgtccgggcctggcagcgcggtgccttccaccgacctgttttgggcggattcagggagagccgggccgccgaagatggttttaggaaagcccagaaaccgtggttgaagaggctgaaggaagtggaggcttcaaaaaagtcttatcacgccgcaaggaaggatgagaaaaccgcccagacccgagaaagccacgcaaaggccgacagcgccgtgagccaagagcaattgaggaagttacaggaaagggtggagcgttgtgccaaagaagctgagaagactaaagcacaatacgaacagacgctggccgaactccaccgctacaccccacggtatatggaagatatggagcaggcctttgaaacatgtcaagcagcagagcgacagaggcttctgttctttaaagatatgcttttaaccctccaccaacaccttgatctaagctccagcgaaaagtttcatgagctgcatcgtgacttacatcaggggatcgaggcggcaagcgatgaagaagatttgagatggtggagaagcactcatggccccgggatggcaatgaattggccacagtttgaggaatggtccctagatacgcagcggacgatttcccggaaggaaaagggagggagaagcccggatgaagtaacactcacttctatagtgcccacaagggatggaaccgccccaccccctcaatctcccggaagtcccgggacaggccaggacgaagaatggtcagacgaagagagtccacggaaagccgccacaggggtgcgtgtccgcgctctgtatgattacgctggtcaggaggccgacgagcttagcttcagggctggagaggaattgctcaagatgtctgaagaagacgagcagggctggtgccaggggcagttgcagtccgggcgcattggcctgtaccctgctaattatgtggagtgtgtcggcgcttag

SEQ ID NO: 201314 - DNA, 1587 bp, Artificial Sequence
  Description of Artificial Sequence: Synthetic coding sequence
atgctgctgcccctgctgctgctgctgcccatgtgctgggccgtggaggttaagaggccccgcggcgtgagtttgacaaaccaccatttttatgacgaaagcaaaccgtttacatgtctcgatggttctgcaaccatcccattcgaccaagtaaacgacgactactgtgactgtaaagacgggagcgacgaacctggcaccgccgcctgtcctaacggttctttccattgtacaaataccgggtacaagccactttatattcctagcaatcgcgtcaacgacggagtctgtgattgctgcgatgggacagacgagtataactcaggcgtcatctgtgagaacacatgtaaagagaaaggcaggaaagaacgcgaatctctccagcagatggcggaagttacacgcgagggcttccggctcaaaaaaatattgattgaagactggaaaaaagctagagaggagaaacagaagaagctgatcgagctgcaggcagggaagaagtccttggaagatcaagtggaaatgctcaggaccgtaaaggaagaggcggaaaagccggaacgcgaagccaaggaacagcatcagaaactttgggaggagcagctggctgctgcaaaggcccaacaggaacaagaactcgccgccgatgcattcaaggagttggacgatgacatggacgggactgtctcagtaaccgaattacagacccatcctgagctcgataccgatggagatggagctctcagcgaagcggaggcccaagcactcctttctggagacactcaaacggatgcaaccagtttttacgaccgggtttgggccgccatccgggataagtacagatccgaagctctgccaaccgatcttccagcaccaagtgccccagacttaacggagcctaaagaagaacagccacccgtgccgtcctctcctaccgaagaagaagaagaagaagaagaagaagaagaggaagaagcagaggaggaggaggaagaggaggattcagaagaggcccctcctcctctgagtccgcctcagccagcgtctccagccgaagaggataaaatgcctccatacgatgagcagactcaggcatttatagacgcagcacaggaggcccgcaataaatttgaagaggccgaacggtctctgaaagacatggaggaaagcattaggaaccttgaacaagagattagctttgacttcggtccaaatggtgagtttgcttatctgtattcacagtgttacgagctcacaactaatgaatatgtctacagactgtgtccgtttaagctagtcagccagaagcccaaactcggaggatccccgacatcccttggcacatggggatcttggatcggaccagaccacgacaagtttagcgccatgaagtatgaacaagggactggctgttggcagggacctaaccggagtactactgtacgcttactgtgcgggaaggagactatggtgacttcaaccaccgaacctagtcgttgcgagtatcttatggaacttatgactcccgcggcttgcccagagccccccccagaagcccccacagaggacgaccatgacgagttgtag

SEQ ID NO: 201315 - DNA, 1578 bp, Artificial Sequence
  Description of Artificial Sequence: Synthetic coding sequence
atgctgctgcccctgctgctgctgctgcccatgtgctgggccgtggaagtcaagaggccccggggcgttagcctcactaatcatcatttctatgacgagtcaaagccttttacttgtctcgatgggagcgcaaccatcccattcgaccaggtaaatgatgattactgcgattgcaaggatgggtctgacgagcccggaacagccgcctgtcctaacggtagctttcactgtactaacaccggatataaaccactgtatattccttctaaccgggtgaacgacggggtctgtgactgctgcgacgggaccgatgagtacaattccggtgtcatctgcgaaaatacatgcaaggagaaaggcaggaaggaaagagaatcacttcaacagatggcagaggtcacaagggaaggttttcggctgaagaaaatactcatcgaagactggaaaaaggcacgcgaggagaaacagaaaaagctcatcgagcttcaggctggaaaaaagtccctcgaggatcaggtggagatgctcagaacagtgaaggaagaagccgaaaagcctgagagagaagccaaggagcagcaccagaaactgtgggaggagcagcttgccgcggcaaaggcacaacaagaacaagaactggcggcagacgccttcaaggagctggatgatgacatggacggcactgtgtccgtaacagaactgcagacccatcctgagctcgatacagacggtgatggggcactgtccgaagccgaagctcaggctcttttgagcggagatactcaaacggacgctacatccttttacgaccgggtatgggctgctattagggataaatatcgtagtgaggcgttgccaacagatctgcctgcccccagcgcgccggatctcaccgagcctaaggaagaacagccccccgtgccatcctctccaaccgaggaggaagaagaggaagaggaagaagaggaagaagaagccgaggaggaggaagaggaagaggatagcgaggtgcagggggagcagcccaagcccgccagcccagctgaggaggataaaatgccgccttacgatgagcaaactcaggctttcattgacgcagcacaggaggcccgcaacaaattcgaagaggccgagagatcactgaaggacatggaggaatcgatccggaatttggaacaagaaatctccttcgactttggccctaatggcgagttcgcatacctatactcccaatgttatgagctgaccaccaatgagtatgtgtacaggctctgccctttcaaactagtgagccagaaaccaaaactgggcgggtccccaactagtctgggcacatggggtagttggattggcccagaccacgataaattcagtgccatgaaatacgaacaggggaccgggtgttggcagggtcccaaccgttctaccaccgtgcggctcctttgcggtaaggaaaccatggtgacgtccacaacagagccctcgcgatgtgagtacttaatggagctcatgacccctgcagcctgccccgaacctcccccggaagcgccaaccgaagacgaccacgacgaattgtag

SEQ ID NO: 201316 - DNA, 2031 bp, Artificial Sequence
  Description of Artificial Sequence: Synthetic coding sequence
atggcccccttcctgcggatcgccttcaacagctacgagctgggctccctacaggcagaggatgaagctaatcaacccttctgtgccgtgaagatgaaggaggccctgtctacagagagagggaagaccctcgtacagaaaaaacctaccatgtaccctgagtggaagagtactttcgatgcacatatatatgaaggccgggttatccagatcgtcctgatgagagccgccgaagagccagtgtccgaggtgaccgtgggcgtcagcgtgctcgcagagcgttgtaaaaagaacaatggtaaggcagaattctggctcgacctccaaccccaagccaaggtactcatgagcgtccaatatttcttggaggacgtcgattgtaaacagagcatgagatctgaggacgaggccaaattcccaacaatgaaccgccggggcgcgattaaacaggccaagatacactatattaagaaccacgaatttatcgcaacattcttcggccaacctaccttttgcagcgtgtgtaaagatttcgtttggggcctaaataaacaaggctataagtgtcggcaatgcaacgctgccatccataagaagtgtatagacaagataatcgggagatgcactggcactgcagctaatagtagagatactatatttcagaaagaaaggtttaatattgacatgccccatcggtttaaggtccataactacatgtcacccacattctgcgatcattgcggctccttattgtggggcttggtgaaacaggggctgaaatgcgaggactgtggaatgaacgtgcaccacaagtgtagagagaaagtggccaatctgtgtggaatcaaccagaagctgctggcggaggccctgaatcaagtcacgcaacgagcctctcggcggtcagattcggcatcatctgaacccgtaggaatataccagggttttgagaagaagacaggagtggctggcgaggacatgcaggataactctggcacatatgggaaaatctgggaggggtcctccaagtgcaacatcaacaacttcatctttcacaaagtgctgggaaagggctcattcggcaaagtgctgctcggcgaactgaagggcaggggcgaatacttcgcaattaaagcattgaagaaggatgtggtcctgatcgacgatgacgtggagtgcactatggtggagaagcgggtcctcaccctggctgccgagaatccattccttacgcacctgatctgcaccttccaaaccaaggaccatctgttctttgtgatggagttcctcaacggcggcgacctcatgtatcatatccaggacaaaggcaggttcgaattatatagagccactttttatgccgccgagatcatgtgcggcctgcaattcttgcattctaaaggtattatctatcgggacctgaaactggataatgttttgctcgatagggacggacatattaaaattgcggacttcgggatgtgcaaagaaaacatcttcggggagagccgcgcaagtactttttgtggcacccctgactatatcgctcctgagatactacaaggtctgaaatacaccttttctgtggattggtggagctttggtgtcctgctgtacgagatgctaatcggccaatccccattccacggggatgacgaggatgaattgtttgagagcataagggtagatacacctcactaccccagatggatcacgaaggaatccaaggacattcttgagaagctgtttgagcgagaacctaccaagagattgggtgtcactggaaacattaaaatccacccattctttaaaacaataaattggacgctgctagagaagcgtcggctggaacctccgtttcgccctaaggtgaaatctcctcgagactactcaaatttcgaccaggagtttctgaacgaaaaggctagactgtcgtattccgataagaacctgatcgactccatggaccagtcggcctttgctggattttctttcgttaacccaaagttcgaacacttactagaggactag

SEQ ID NO: 201317 - DNA, 2031 bp, Artificial Sequence
  Description of Artificial Sequence: Synthetic coding sequence
atggcccccttcctgcggatcgccttcaacagctacgagctgggcagcctccaggccgaagatgaagccaaccagcccttctgcgcagtgaagatgaaggaagctttgtctacagaacggggcaagactcttgtgcagaaaaaacctactatgtaccccgagtggaagagtacttttgacgcacatatttacgaaggaagagtcatccagatagtcctgatgagggccgcagaagaacccgtgtccgaggttacggtcggagtgagcgtcctcgcagagcgctgcaaaaaaaacaatggtaaggcggaattttggctggatcttcagccacaggcaaaagtgctaatgtccgtgcagtatttcttggaggatgttgactgcaaacagagcatgaggtctgaggacgaagcaaaattcccaaccatgaataggaggggagccataaagcaagccaaaattcactatatcaaaaaccatgagttcattgctactttcttcgggcagcccacattttgtagcgtctgcaaggactttgtttggggccttaataagcagggatataaatgtaggcagtgcaacgccgccatccataagaagtgcatagacaaaattatcgggaggtgtacaggcacagcagccaacagccgagacaccatttttcagaaggaacgatttaatatcgacatgccccatcgatttaaagtccacaattatatgagtccaacgttttgcgatcactgcggtagccttttatgggggctggtgaagcagggcttgaagtgcgaggattgcggcatgaatgtccaccacaagtgccgggagaaggtcgccaacctctgtggaataaaccaaaagctgttggcggaggccttaaaccaggtgacccagcgagccagtcgacgcagtgattccgcttcttccgagcctgtgggcatctaccagggcttcgagaaaaaaaccggagtcgctggcgaagacatgcaagataactctggaacatacggaaaaatctgggaggggtccagcaaatgcaatattaacaatttcatcttccacaaggtgttaggcaagggttcctttgggaaggtcctcctgggggaactgaaaggcaggggcgagtacttcgcaatcaaagctttaaaaaaggacgtagtcctcatcgatgacgacgtagagtgcacaatggtggagaagcgtgtgctgacgctggccgccgagaacccttttctgacccacctgatctgcacgtttcaaaccaaagaccacctattctttgttatggagttcctaaacgggggcgatttaatgtaccatattcaggataaagggcggttcgagctgtaccgtgccacattttatgcagccgagattatgtgcgggctccagtttctccactccaagggaattatctaccgtgacctcaagttggacaatgtgctcctcgaccgcgatggccatattaaaatcgctgacttcggcatgtgcaaggagaacatcttcggcgagtcccgagcctctacattctgtggaaccccagactacattgctcccgagatactccagggactgaaatatacgttttcagtggattggtggtcatttggggtgttgctgtacgagatgctgatcgggcaatctccctttcacggagatgatgaggacgagctgttcgaatccatacgtgtcgacaccccacactatccgcgttggatcaccaaggaaagcaaagatatcctggagaagcttttcgagcgcgagccgacaaagagactgggagtgacaggaaacataaagattcatccctttttcaaaacaattaattggacactcctggaaaagagacggttagaaccaccttttagaccaaaagtgaagtctcctagggattattctaacttcgaccaagaattcctgaatgagaaggccaggctcagttacagcgataaaaatctgattgactccatggatcagagcgcttttgccggtttttccttcgtcaatccaaagttcgagcacctgcttgaggattag

SEQ ID NO: 201318 - DNA, 234 bp, Artificial Sequence
  Description of Artificial Sequence: Synthetic coding sequence
atggcccccttcctgcggatcgccttcaacagctacgagctgggctcgctgcaagctgaggatgaggctaaccagcctttctgtgctgtaaaaatgaaagaagctctctccacagagagagggaagactctggtccagaaaaaaccaactatgtacccggaatggaaatcaacatttgacgctcacatatacgaagggcgggttatacagattgtcctcatgcgggctgcctag

SEQ ID NO: 201319 - DNA, 378 bp, Artificial Sequence
  Description of Artificial Sequence: Synthetic coding sequence
atggcccccttcctgcggatcgccttcaacagctacgagctgggcagtctccaagccgaggatgaagcaaatcaacctttctgtgccgtgaagatgaaggaggctttatctaccgaacgaggtaaaacactggtccaaaagaagcctacgatgtatcctgagtggaagagcactttcgatgcacacatatatgaaggacgcgtgatccagattgtgctgatgcgagcagcagaggaacctgtgtccgaggtgaccgtaggggtgagtgtgctcgctgagcgttgtaagaagaataacggaaaagcggagttctggcttgatctccaaccgcaggcgaaagtgcttatgagcgtacaatattttctcgaagatgtttag

SEQ ID NO: 201320 - DNA, 2052 bp, Artificial Sequence
  Description of Artificial Sequence: Synthetic coding sequence
atgagcagcggcaccatgaagttcaacggctacctgcgggtgcggataggcgaggcagtgggcctgcagcccacaagatggtccctgaggcactccctgttcaaaaagggtcaccaactgttagacccttacctgaccgtgagtgtagatcaggtaagagttggccaaacttcaacgaagcaaaaaacaaacaaaccaacctacaacgaggaattctgcgctaacgtgactgacggaggacacttagaattggcagtatttcacgaaacgcctttggggtacgatcactttgtcgccaattgtacacttcagttccaagaactcctgcgcactactggcgcttccgatacctttgaggggtgggtagacctcgagcctgaagggaaggtgttcgttgtgattaccctgacaggctcattcaccgaggccacgctgcagcgagataggatcttcaaacacttcacaaggaaaaggcagcgcgctatgagacgccgagtgcatcaaatcaacggccacaaatttatggccacatatttgcggcagcccacatattgctcccactgtagagagttcatatggggtgtgttcgggaagcaggggtaccagtgccaagtctgtacatgcgtcgttcacaaaagatgtcaccaccttatagtcactgcctgtacatgtcagaataatatcaataaagtagatagtaagatcgcggagcagcggtttgggatcaacattcctcacaaattcagcatacacaattacaaagtgccaaccttctgtgatcattgtggcagcctgctgtggggaatcatgcggcagggcttgcagtgcaagatttgtaagatgaatgtgcacatcagatgccaggcaaatgtggcacccaattgtggtgtgaatgcagtcgaactagctaaaacccttgcagggatgggactgcagccgggcaatattagccccaccagcaaattggtttcacggtccacactgcgtcgacaagggaaggagagcagcaaggaaggtaacggaatcggggtaaactctagtaacaggcttggaattgacaacttcgagttcatccgggtcctgggtaagggatcatttggaaaggtcatgcttgcgcgcgtgaaagaaaccggagatctttatgctgttaaagtgttgaagaaggatgtgattctacaggatgacgatgtcgaatgtactatgacggaaaagcggattttgtccttggctaggaaccatccctttctcacacagctcttttgctgtttccagacacccgatcggttgtttttcgtcatggagtttgtaaacggaggtgatctgatgtttcacatccagaagtccaggcggtttgatgaggctagggctcgcttctatgcagcggaaatcatttccgcgttgatgttcctacatgacaaaggtatcatctatagagatttgaagttggacaacgtgctgctggaccatgagggccattgcaagttggccgactttggcatgtgcaaggagggaatctgtaatggcgttaccaccgctactttctgtggtactccagattacatcgcaccagagatcctgcaggagatgttgtatgggcctgccgttgattggtgggcaatgggagtgttactgtacgaaatgttgtgcggacacgcccccttcgaggctgagaacgaggacgacctatttgaggcaatcctgaacgatgaggttgtctaccctacttggttgcacgaagacgctaccggaatcctgaaatctttcatgaccaagaacccaacaatgcgactaggtagtcttacccaagggggggagcatgcgattcttaggcaccctttttttaaggagatcgattgggctcagcttaatcaccggcaaatagaaccacctttcagacctagaattaaatccagggaagatgtgtcaaattttgatcccgatttcattaaagaggagcctgtgctcactcccatcgacgagggtcacctgcctatgattaaccaggatgaattcaggaattttagctacgtatcacccgagcttcaaccctag

SEQ ID NO: 201321 - DNA, 357 bp, Artificial Sequence
  Description of Artificial Sequence: Synthetic coding sequence
atgagcagcggcaccatgaagttcaacggctacctgcgggtgcggattggcgaggccgtgggactccagccgacacgttggtctttacgacacagcctgtttaaaaaggggcatcagctgttggatccatacctcaccgtgtctgttgatcaggtcagagtcggccagaccagcacgaagcagaagaccaataaacccacatataacgaagagttttgcgctaatgtcaccgacggcgggcacctggagctcgctgtcttccacgagactcccctgggatacgaccacttcgtggccaattgcaccctgcagtttcaggagctgctgaggacaacaggagcaagtgacaccttttag

SEQ ID NO: 201322 - DNA, 1791 bp, Artificial Sequence
  Description of Artificial Sequence: Synthetic coding sequence
atgcccacccagcgggacagcagcaccatgagccacaccgtggccggcggcggctctggggaccactctcatcaggtgcgggtcaaagcctattaccggggggatattatgattacccattttgagccgtctatctcatttgaaggattgtgtaacgaagtcagagatatgtgctcctttgacaatgaacagctgttcaccatgaagtggattgacgaagagggggatccttgtaccgtcagtagccagctggagttagaagaggcattccgcttgtatgaattgaataaggattcggaacttctgatccacgttttcccatgtgttccagaaagacctggtatgccctgcccgggtgaagataagtccatttataggcggggcgcgcgccgctggaggaagctatattgtgccaacgggcatacctttcaggcaaagcggttcaacaggagggctcactgcgcaatctgtactgacaggatctggggcctgggtcgacagggctacaaatgtatcaattgtaagttgctggtgcacaagaaatgtcataaactggtcaccattgagtgcgggagacatagcttgcctcaggaaccagtgatgccgatggatcagagtagtatgcactccgaccatgcccagaccgtcattccctataatccgtcctcccacgaatcactggaccaagtgggtgaggagaaagaagcgatgaacacccgggagagtgggaaagcgagcagcagtctggggctgcaggatttcgatctattgagggtgatcggaagaggatcgtatgccaaggtactcctggtgaggctgaaaaaaactgatcggatctatgccatgaaagtcgtcaaaaaggaactggtgaatgacgacgaagacattgattgggtccagactgagaaacacgtctttgagcaggcttcaaaccaccctttcctggtaggcctgcattcatgctttcagactgaaagtcggctgttctttgtcatcgaatatgtcaacgggggtgacctgatgttccacatgcagcgccagcgcaagctgcctgaggaacacgcgcgcttttacagtgcagaaattagtctggctctgaattacctacatgagcgcggcataatctatcgcgatctgaagctcgataacgtcctattggattcagagggccacataaaactgacagattacggcatgtgtaaagagggcctccggcccggcgacaccacttccaccttttgcggcactcccaactacatcgcaccggagatactccgcggggaagactacgggttctctgtggactggtgggcccttggcgtccttatgttcgaaatgatggctggcagatctccttttgatatcgtgggctccagcgacaatcctgatcagaataccgaggattacttgtttcaggtcatcctcgagaaacaaatcaggatccctaggagcttgtccgtgaaggccgcctctgtgcttaagtcttttctgaataaagaccctaaagagcgcctggggtgtcatccccagacgggtttcgcagatattcagggccacccattcttccgtaacgttgactgggacatgatggagcagaaacaggtggtgcctcccttcaagccaaacattagtggtgaattcggattggacaattttgactctcagttcaccaatgaaccagtccagctgacacctgatgatgacgacatagtgaggaagatagatcagtcggagtttgaaggttttgagtacattaatcctttactgatgagtgcagaggagtgcgtttag

SEQ ID NO: 201323 - DNA, 2121 bp, Artificial Sequence
  Description of Artificial Sequence: Synthetic coding sequence
atgagccccttcctgcggatcggcctgagcaacttcgactgcggctcctgccagtcatgccagggcgaggctgtgaacccttactgcgccgtgctcgtgaaggagtacgttgagagcgagaatggccagatgtacattcagaagaaacctaccatgtacccgccatgggacagcacctttgatgcccacatcaataaagggagggtcatgcaaatcatcgtgaaagggaagaatgtggatctcatatctgaaacaacggtcgagctgtactcattagccgagcggtgccgaaaaaataacgggaagacagagatatggctcgagctgaaaccccaggggcgcatgctgatgaatgctagatactttctagaaatgtccgatacaaaagacatgaacgagtttgagaccgagggtttctttgccctgcaccagcgtaggggagctatcaagcaggctaaggttcaccatgttaagtgtcacgagtttactgccacatttttccctcaacctactttctgctctgtctgtcatgagtttgtttggggattgaacaagcagggttaccagtgtagacagtgcaacgccgcaattcataagaagtgtatcgataaagtcatagctaagtgcacagggagcgctataaatagccgggagaccatgttccataaggagagatttaagatcgacatgccgcacagatttaaggtgtacaactacaaatcccccacgttttgcgagcattgcggaacgctgttgtggggtctggccaggcaagggctgaagtgtgacgcttgcggcatgaatgtgcaccacagatgtcaaactaaggtggccaacctgtgtggtataaaccagaaactaatggcggaagccttggctatgatcgaaagcacgcagcaagcaaggtgcctgcgtgacaccgaacagattttccgagaaggccccgtggagatcgggctgccctgctctatcaagaacgaagctaggccaccttgtctgcctacacctggaaagcgggagccccaggggatttcctgggaatctcccctggacgaggtggacaagatgtgtcaccttccagaacccgaattaaacaaggaacgcccaagtctgcagattaagctcaagatcgaggattttatattgcataaaatgctggggaaggggtccttcggcaaagtgttcctggcggagttcaaaaagaccaaccagttttttgccattaaagctctcaagaaagacgtggtgttgatggatgacgacgtggaatgtacaatggttgaaaagcgtgtgctgtccctggcatgggaacacccattcttaacgcatatgttctgcacctttcagaccaaggaaaatctatttttcgtgatggaatacctgaatggcggggatttaatgtaccatattcagtcctgccataaatttgatctcagccgggcaactttctacgctgccgaaatcattctcgggctgcaattcctccattctaagggcatcgtgtatcgggacctcaaactggataacatcctgctcgataaagacggccacatcaagatcgcagatttcgggatgtgcaaggaaaacatgctgggggacgccaaaactaatacgttctgtggaactcctgattacatagctccagagatcctgcttgggcaaaagtacaatcattccgttgattggtggagctttggggtcttgttatacgagatgctcattggccagagcccatttcatggccaggatgaggaggagctattccatagtatccgcatggacaacccgttttacccgagatggctcgaaaaagaagcaaaggacctgctggtaaagctctttgtgcgggaacccgaaaaacgcctgggcgtgagaggagacattcggcaacatcctctctttcgagagataaactgggaggagctggaacggaaagaaattgaccccccatttcggcctaaggtcaagagcccttttgactgtagcaatttcgacaaagaatttttgaatgaaaagccaagactctcatttgcagaccgggctcttatcaatagcatggaccagaatatgtttagaaatttcagcttcatgaatcccggtatggaacgattgatttcatag

SEQ ID NO: 201324 - DNA, 1932 bp, Artificial Sequence
  Description of Artificial Sequence: Synthetic coding sequence
atgagccccttcctgcggatcggcctgagcaacttcgactgcggctcatgtcagagttgccagggcgaagccgtcaatccttactgcgccgtcctcgttaaggagtatgtggaatctgaaaacggccagatgtacattcagaagaagcctacaatgtatcctccctgggatagcacattcgatgctcatataaacaagggacgagtgatgcagatcattgtcaaagggaaaaacgtagacctcatcagtgagactaccgttgagctatactcactggctgaacgttgccggaagaataatgggaaaaccgaaatctggctggaactgaagccacagggcagaatgctaatgaatgcaagatatttccttgaaatgtcagacaccaaggatatgaatgagttcgagacagaagggttttttgctttacatcaaagaaggggtgcaatcaagcaagctaaagtgcatcatgtgaaatgccatgaattcactgccacattctttcctcaacctaccttttgctctgtctgtcatgagttcgtgtgggggctgaataaacaaggatatcaatgccgacaatgcaatgcagccattcacaagaagtgtatagacaaggtgattgctaaatgcacaggtagtgctattaattcgagagagactatgtttcacaaggagagatttaagatcgacatgccccaccgttttaaggtatataattacaagagccccacattctgtgaacattgtgggacattgctgtggggccttgcacgccagggtctgaagtgcgacgcttgtggtatgaatgtccaccacaggtgccagacgaaggtggccaacctctgcgggattaaccagaaactgatggcagaggcgctcgcgatgattgagagtacccaacaggctcgctgcttaagggatacggagcaaatcttcagagaaggacctgtagaaatcggtctgccatgttctattaagaatgaggctcgtcccccttgcttgcccacaccaggcaagcgggaaccgcaggggatttcctgggaaagtccgctggacgaggtggataagatgtgtcacctgcctgaacccgaactgaacaaggagcgcccttcgctccagataaagttgaagattgaggactttatcctccacaagatgcttgggaagggaagtttcggcaaggtgtttctggccgagtttaagaaaactaaccagttcttcgccatcaaagctctcaaaaaggatgtggtgctgatggatgatgatgtggagtgcacaatggtggagaagagggtcctcagtttagcctgggaacacccttttctgacacatatgttctgtacttttcaaaccaaggagaatttgtttttcgtgatggaatatcttaacggcggagacctgatgtatcatattcaaagctgtcacaaattcgacctctctcgggccaccttttatgctgccgaaatcatacttggattgcagttcctgcattcgaaaggtatcgtttatagggaccttaagctggataacatcctcttggacaaggacggtcacattaagatagcggatttcggcatgtgcaaggaaaatatgctcggggacgccaagacaaacacattttgcggtaccccagactacattgcccctgaactgttcgtgagggagccggagaaacgcttaggcgtgcggggggatattcgccagcaccccctcttcagagagatcaattgggaggaattggagcgcaaggaaattgaccctcctttcaggcctaaggtgaagagtccctttgattgctcaaacttcgataaggaattcttaaatgagaaacctcgattaagtttcgccgatcgagccctcattaattccatggatcagaacatgttcagaaatttttccttcatgaatccggggatggagcgtctcatctcatag

SEQ ID NO: 201325 - DNA, 1440 bp, Artificial Sequence
  Description of Artificial Sequence: Synthetic coding sequence
tgactgagcctgctgccctgcctgctgttcctgcccaccatcatcccaaagaaaattgtcatccagcgggattctctgccatctaagaaactgtcttacgggctgatagcttgcgggatgaacgtgcatcatcggtgccagacaaaagtggccaacctgtgcggtatcaaccaaaagctgatggctgaggctctggcaatgatcgaatcaacgcagcaggcccgttgcctgcgggacacagaacagatatttcgcgaaggcccagtcgaaattgggttgccatgttccattaagaatgaagccaggccaccgtgtcttcccacacccgggaaaagagaacctcagggcatcagctgggaaagccctttggatgaggtcgataaaatgtgtcatctgccagaacctgagctcaacaaagaacgcccatctctccaaattaagctaaagattgaggacttcattctgcacaaaatgctgggcaagggttcttttgggaaggtttttctcgcagaatttaaaaagacgaatcagttctttgcaataaaggccttgaagaaagatgtggtgcttatggatgacgatgttgaatgcaccatggtagagaagcgggtcctctcactggcatgggaacatccgttcctgacccatatgttttgcacattccagactaaggagaacctgttcttcgttatggaatatctgaatggcggcgatctgatgtaccatatccagtcatgccacaagttcgacctgtcacgagccaccttctacgctgccgagataattctcggcctccaatttttacacagcaaaggcattgtgtatcgggatcttaagctggacaacattctccttgataaggacgggcatatcaagattgctgatttcgggatgtgcaaagagaacatgttgggcgatgcaaagacaaatacgttctgcggtaccccagattatattgcacccgaaatattactgggtcagaaatacaatcattccgtggactggtggagttttggtgtcctcctgtatgaaatgcttatcggccagtcccccttccatggccaggacgaagaggagcttttccactcaatccggatggacaatcccttctacccacgctggttggaaaaggaggctaaagacctgctggtgaaactcttcgtaagagaacctgaaaagaggcttggagttcggggagacatcaggcagcaccccctgttcagagagataaactgggaagagcttgaaaggaaggagattgaccccccatttcgccctaaggtgaagtcaccttttgactgctccaactttgataaagaattcctcaatgagaaaccgcggctgagcttcgccgatagggcccttatcaattcaatggaccagaatatgttcagaaatttcagctttatgaatcccgggatggagcggctcattagctag

SEQ ID NO: 201326 - DNA, 1746 bp, Artificial Sequence
  Description of Artificial Sequence: Synthetic coding sequence
atggacaccaaggacatgaacgagttcgagaccgagggcttcttcgccttgcatcagagaagaggtgcaattaagcaagctaaggttcatcacgtgaaatgccacgagttcactgccactttctttccccagcccactttctgttccgtttgtcacgagttcgtgtgggggctaaacaaacagggctaccagtgtagacagtgcaatgctgccatccacaaaaaatgtatagacaaggtgatcgccaagtgtaccgggagcgcaattaacagccgtgaaaccatgttccacaaggaaagatttaagatcgacatgcctcatcggtttaaagtctacaattataaatccccaacattttgtgaacattgcggtacgttactttggggattagcgcgtcaaggtctgaaatgtgacgcctgtggcatgaatgtccaccacaggtgccagaccaaggttgccaacctttgcggcatcaatcagaagcttatggccgaggccctggcaatgatagagagcactcaacaggcccgctgcctccgtgacaccgagcagatcttccgcgaaggacctgtcgaaatcggtttgccctgctccatcaagaacgaggcccgtcctccgtgtcttcctacgcccggtaaaagagaaccacaaggcatcagctgggagagccctcttgacgaagtcgataaaatgtgtcacctcccagaaccagagttgaacaaagagaggccaagccttcagatcaaactgaagattgaagattttattctacacaagatgctcggcaaggggtcatttggtaaggtgttcctagccgaatttaagaagacaaaccagttcttcgcgatcaaagccctgaaaaaggatgtggtattaatggacgacgatgtagaatgcacaatggttgagaagagggtgttgtcgctcgcttgggagcacccgtttctgacacacatgttctgcacttttcagacaaaggagaaccttttcttcgttatggagtacttgaacggaggcgacctcatgtatcacatccaatcctgccacaaattcgatctgagccgcgcaacattttacgccgctgagatcatattaggcttacagtttttgcactctaagggcattgtgtaccgtgacttgaaactagataacatactgctagacaaagatggacatatcaaaattgcagactttgggatgtgcaaggagaatatgctcggcgacgcaaaaactaatactttctgcggcactccggactacatcgcccccgaaatcctcctcggacagaaatataatcatagtgtggattggtggagctttggcgtgctgctgtatgagatgctgatcggccagtctccctttcatggccaggatgaggaagagctctttcactcaatcaggatggacaatcctttttacccacggtggctcgagaaggaagccaaggacctgctggtgaagctattcgttcgagagcccgagaaacggctgggagttaggggggacattcggcagcatccgcttttccgggagattaattgggaagagctggagagaaaggagatcgacccaccattccgccccaaagtgaaatccccgttcgactgcagcaatttcgataaagagttcttgaacgagaagccaagattgtctttcgctgaccgcgcactgattaacagcatggaccagaatatgttccgcaacttctctttcatgaacccgggcatggaacgcctgatttcttag

SEQ ID NO: 201327 - DNA, 1032 bp, Artificial Sequence
  Description of Artificial Sequence: Synthetic coding sequence
atggccagcaacagcagcgacgtgaaggagttcctggccaaggccaaggaagactttctgaaaaagtgggaatctcctgctcaaaacactgcccaccttgatcagttcgagagaataaagacgttaggcacagggtcctttgggagggtgatgctggtgaaacacaaggagaccggaaaccactatgccatgaagatcctcgataagcagaaagtagtcaagcttaagcagatcgagcacactctcaatgaaaagaggattttacaggctgtgaattttccattcctggtgaagctagaattcagtttcaaggataactcaaacttatatatggtcatggagtatgtcccaggtggcgaaatgttttcccacctgaggcggatcgggaggttctctgaacctcacgctaggttctacgcagcacagattgtgttgacattcgagtatctacattcactggatctgatctatagagacctaaagccagaaaaccttctgattgatcaacaaggctacattcaggtgaccgacttcgggttcgctaagcgtgtgaaaggcagaacatggaccctatgtggcactcctgaatacctcgctcccgagatcattctctctaaaggctataataaggctgtggactggtgggcactgggtgtgctgatctacgaaatggccgccggctatcctccattcttcgcggatcagcccatccagatatacgagaagattgtctccggtaaggttaggtttccatcccactttagctctgacctcaaggacctccttaggaaccttcttcaggtggacctgacaaagcggtttggaaatttgaagaacggagtaaatgacatcaaaaaccataaatggtttgccactaccgactggattgcaatctaccagagaaaagttgaagccccctttatcccaaaatttaagggtcccggcgatacctcaaacttcgatgattacgaagaggaagaaattagagtctcaatcaatgaaaaatgcggtaaggagttttcagagttctag

SEQ ID NO: 201328 - DNA, 1146 bp, Artificial Sequence
  Description of Artificial Sequence: Synthetic coding sequence
atggagagcggcagcaccgccgccagcgaggaggcccggagcctgcgagaatgcgagctgtatgtccaaaaacacaatatacaggctctgctgaaggactctatcgtgcagttatgcaccgctcgacccgaacgaccaatggccttcctccgggaatactttgaacggctcgaaaaggaagaagccaaacagattcaaaatctgcagaaggccggtactcgtaccgacagccgggaggatgaaatctctccacctcctccgaacccagtcgtgaagggacggcgccggaggggggccatcagtgccgaagtgtacaccgaagaggatgctgctagctacgtcagaaaggttataccaaaagattacaagacaatggctgcactggcaaaagccattgaaaaaaacgtgttgttcagtcatctggacgataatgagagatctgatatttttgacgccatgttctccgtgagcttcattgccggagagaccgtcatacagcagggggatgaaggggataacttttacgtcatcgaccagggagagaccgacgtttacgttaacaacgaatgggcaacttccgtcggagagggcggatcgtttggcgagttagccttgatttatgggacacccagggctgccaccgtcaaggccaagacaaatgtgaaactatggggcattgaccgcgattcctatcggaggatccttatggggtccacattgaggaaacgaaagatgtatgaggagtttctgtccaaagtgagtattctggagagcctggacaagtgggagaggcttaccgtcgctgatgccctcgagcccgtacagtttgaggacggacaaaaaatcgtcgttcagggggaacctggcgatgaatttttcattattctggagggctccgcagcagtactccagagacggagtgaaaacgaagaattcgtcgaggtcggtcggctgggaccttctgactacttcggcgaaatagctttgttgatgaataggcctcgagccgccaccgtggtggccagaggtccattgaaatgtgtaaaacttgaccgacctagatttgagcgcgtgctgggtccatgctctgacatactcaagcggaacatccagcagtacaacagcttcgtctccctcagtgtgtag

SEQ ID NO: 201329 - DNA, 2739 bp, Artificial Sequence
  Description of Artificial Sequence: Synthetic coding sequence
atgagcgccccccccgtgctgcggccccccagccccctgctgcccgtcgctgccgccgccgccgcagccgcagccgcacttgtcccgggttccggtccaggtccggctccttttttggcgcccgttgccgcccccgtaggtggaatatccttccacctgcagatcggcctttctagagagccggtgctgctcctgcaagattccagtggcgactactccctcgcccacgtgcgagagatggcttgcagcattgtggatcagaagtttcctgagtgtgggttttacggaatgtacgacaaaatcttgctgttccgccacgaccctacatcagaaaacatcctacagctagtgaaggccgcatctgatatccaggaaggggatctcattgaggtcgtgctttcggcttcagctacattcgaagactttcaaatacggccacacgctttattcgtacactcctatcgggcccccgccttttgcgatcactgtggggaaatgctttggggtctggtcagacagggcctgaaatgtgagggttgtggtttgaattatcacaaaaggtgcgcgttcaaaattccaaataattgtagtggcgtgcgtaggcgacgtttgagcaacgtaagcctgacaggagtgtccacaataaggaccagcagcgctgaactcagtacgtcagcgccagatgaacctctcctccagaaatctccatccgaaagcttcatcggtcgagagaagaggagcaactctcagtcttatatcgggcgtccaatccacttggataagattctcatgtcaaaagttaaagtgccccacacattcgtcattcattcctacactcgaccaacagtttgccagtattgcaaaaaactgctgaagggattgtttcgccagggtctgcagtgtaaagattgtaggttcaattgtcataagcgatgcgcccccaaagtccctaacaactgtcttggcgaagttactatcaacggcgacctcttatcacccggagccgaaagcgacgtggtgatggaggaggggtctgacgataacgacagcgaaaggaacagtggcctgatggatgatatggaagaggcaatggttcaagacgcggagatggcaatggctgagtgccaaaatgattcaggcgagatgcaggatcctgatcccgaccacgaagatgctaataggacaatttcaccctccaccagtaacaatattcctttgatgcgcgtcgttcaaagcgtcaagcacaccaagagaaaaagctccacggtcatgaaggaaggttggatggtgcattatactagcaaagacactttgcgaaagcggcattattggagactggactcaaagtgcatcactctgttccagaatgacactgggtctagatactacaaagaaattccactcagcgagatcctctctctcgaacccgtgaaaacaagtgccttgattcccaatggggcaaacccacactgctttgagatcaccactgcgaacgttgtatattacgtcggtgagaatgtggttaatccatcctcacctagtccgaataacagcgtcctcacctcaggtgtgggcgccgatgttgctcggatgtgggaaattgcgatccagcatgcactcatgccagtgattcctaaagggtccagcgttggtacagggaccaacctgcacagagatattagcgtcagtatttctgtgagcaattgccaaatccaggaaaatgtggacatctccaccgtttaccaaatattccccgatgaggtactgggaagcggccagttcggtattgtgtacggcggcaaacacaggaagactggccgggatgtcgctattaagatcatcgataaactgaggttccccaccaagcaggaaagccagttgcgcaatgaagttgccattcttcagaatctgcatcaccccggggtcgttaacttagaatgtatgttcgagacgcccgagagggtgttcgtcgtgatggaaaagctgcatggtgacatgcttgagatgatcctgtcaagcgagaagggcagactccctgaacacatcaccaagtttttgattacccagatattagtcgctctgagacatcttcatttcaagaacattgttcattgtgaccttaagcctgagaacgtgctgttggccagcgccgaccccttcccacaggtaaaactgtgtgacttcggctttgccagaatcataggcgagaagtcttttcgtcgcagcgtggtcgggacacccgcctacctggccccggaagtgctcaggaataaaggatacaataggtccctagacatgtggagcgtcggcgtcataatctatgttagcctgagcggaacgttccccttcaatgaggatgaagacattcatgaccagatacaaaatgcggcctttatgtatcctcccaatccctggaaggagatttcccatgaggccatcgatttgataaataacctactgcaggtgaaaatgcgcaaaaggtatagcgtggataagacactgtcccacccatggttgcaggactatcaaacttggctggacttgagagagctggaatgtaagatcggagaacggtacattacgcatgaatccgatgacctgcggtgggaaaaatacgccggagaacaaggcctgcagtacccgacccacctgataaatccgagcgcatctcactcagatacacctgagacagaggaaacagagatgaaagccctgggagagcgcgtgagcatcctgtag

SEQ ID NO: 201330 - DNA, 2637 bp, Artificial Sequence
  Description of Artificial Sequence: Synthetic coding sequence
atggccaccgcccccagctaccccgccggcctgcccggcagccccgggccaggcagcccgcccccaccaggaggccttgagttacagtcaccgcccccgctccttccacagatccccgccccaggtagtggagtcagctttcacattcagatagggctgacacgggaatttgtcctcctgcctgctgcctcggaactggcgcacgtaaagcagcttgcttgttccatagtggaccagaaattccctgagtgtggcttttacggcctgtatgataaaatactgctgtttaagcacgatcccacttccgccaatctgcttcagcttgttcgcagctcaggtgatattcaggagggcgatttggtcgaggtcgtgctctcagcttctgcgacatttgaggacttccaaatcagaccccatgctctgaccgtccacagttatagagccccagctttctgtgatcattgtggcgagatgcttttcggcctggtgaggcaggggctgaagtgcgacgggtgcgggctaaattatcataagcgctgcgccttctccatccccaataactgtagcggcgctcgtaagcgcaggctctcatccactagtttggccagcgggcatagtgttagacttggtacatccgagtccctgccctgtacggctgaggagctctccagaagtaccacggagctcctgccacgccggccaccgtcaagcagctcttcttcttccgcttcaagctacactggtcgaccgatcgagctagacaaaatgctcctctccaaagtgaaggtcccccacaccttcctaatccatagctacactcggcccaccgtttgtcaggcgtgcaagaaactgctgaagggtctgtttcgtcaggggctacagtgcaaggactgtaaattcaactgccacaagcggtgcgccacacgggtgccaaacgattgtctcggggaggccctcatcaacggcgacgtcccaatggaggaggcgaccgacttcagtgaggcagataaaagtgccctcatggatgaatcagaggactctggagtgatcccaggcagccatagtgaaaatgcactccatgccagcgaagaggaggagggcgaggggggaaaagcccagagcagcctagggtacatccctctgatgcgcgttgttcaaagcgtccggcatactacacgaaagtcttctacgacgctcagagagggatgggtagtgcactactctaataaggataccctgaggaagcgtcattattggaggttggactgcaaatgcatcacgctgttccaaaacaataccacaaaccgctattacaaggagattccactcagtgagatcttgaccgtggagtctgcacagaacttcagcttagtgccccctggcacaaatccacactgcttcgagatagtaaccgctaatgcaacatattttgtgggcgagatgccaggcggtacacctggcgggccttccggccaaggcgcggaagctgctagaggttgggagacagcaatcagacaggccctgatgcccgtgatcctgcaggacgccccaagtgcccctggacacgctcctcatcgccaggcatcactgagcataagcgtgagtaattcccagatacaagaaaacgtcgacatcgctaccgtgtaccagatctttcccgacgaagtgctggggagcggccaatttggggtggtgtatgggggtaaacatagaaaaacagggcgcgacgtcgcagtcaaggtgattgacaagctcaggtttccaaccaaacaagaaagccagcttcgtaatgaagtggccattctgcagtctttgagacacccagggattgtcaacctggagtgtatgttcgaaactcctgaaaaggtatttgtcgtgatggaaaagcttcacggggatatgttagagatgattctgtcttcagagaaaggccgcttaccagagaggttgactaaattcctcattacacaaattcttgtcgccctccggcatctgcactttaaaaatattgtgcattgcgatttgaaacctgagaatgtgctccttgcctctgccgatcccttccctcaggtgaaattatgtgacttcggtttcgcaaggatcattggagaaaaaagctttcgtaggagtgtagtgggaacacctgcatatctcgctcctgaggtgctcctgaaccagggctataatcgatcattagacatgtggtctgtgggggttatcatgtatgtgtccctgtcaggcacctttccattcaatgaggacgaagatattaatgaccagatccagaatgcggcgttcatgtacccagcttctccatggagtcacatatccgctggtgctattgacctcatcaataatctgctgcaggtgaaaatgcgaaagagatattccgtggacaagtccttgagccatccatggcttcaggagtatcagacatggttagacctgagggagctggaggggaaaatgggtgagcgatacatcacgcatgaatccgatgatgtaagatgggagcagtttgcagccgaacatccattaccaggaagtggcctccctacggaccgcgacctgggcggcgcctgccctccacaggaccacgatatgcagggattggcagagcggatcagtgttttgtag

SEQ ID NO: 201331 - DNA, 2637 bp, Artificial Sequence
  Description of Artificial Sequence: Synthetic coding sequence
atggccaccgcccccagctaccccgccggcctgcccggcagccccggtccgggcagcccccctccccccggaggattggagcttcagtcacctcccccactgttgccacagattcccgcacccggtagcggcgttagctttcacattcagatagggcttactagagagttcgtgctcctgccagcagcttccgagctagcccacgtaaagcagctggcctgttccatagtggaccaaaagttccccgaatgtggcttctacggactatatgacaaaatactgctcttcaagcatgaccccacaagtgcaaatctgctgcagctggtgagatctagcggggatatccaggagggagatcttgtcgaagtagtgctgagcgcaagcgctacgttcgaagactttcagataagacctcacgccttaacggtgcactcctaccgtgcacccgctttctgcgatcactgcggcgaaatgctattcggcttggtcaggcagggcttaaagtgtgacggctgcggactgaactatcataagcgctgtgctttctcaattcctaataattgctcaggagctagaaaaagacgcctgtcaagcaccagccttgcttctggtcacagtgtgcggctcggtacctctgagagtctgccatgcaccgcagaagaattatcacgcagcacaactgaattgctgccccgccgccctcctagttcaagctcctcctcatcggcttcctcttatactggaaggcccattgaattagataagatgctactgtccaaggtgaaggtgccccatactttccttatccattcatatacccgacccactgtttgccaagcctgcaagaaactgctcaagggcctgttccgccagggcttacagtgtaaggattgtaagtttaattgtcacaaaaggtgtgcaacgcgagtgcccaatgactgtctgggtgaagccttgattaacggggatgtgccgatggaagaagcaacagatttttccgaggcagataagtccgcactgatggacgagagtgaagactctggcgtaatcccaggatctcattctgaaaacgcattacacgcttcggaagaggaggagggagaaggagggaaggcgcagtcttcactggggtacattcccttaatgcgggtggtgcagagcgtaaggcacaccactcgcaagagcagcactacactccgcgaggggtgggttgtacattacagcaacaaggatacactccgcaaacgacactattggagactggactgtaagtgtatcacactgtttcagaataatacaaccaacaggtattataaggaaatccccctgagtgaaatcttgactgtggagagtgcacagaacttcagcctggttcctccaggaacaaatccgcactgttttgagatcgtcacggctaatgccacatacttcgtcggtgagatgcccggagggacaccaggtggaccatcaggacagggagctgaggctgcgcggggctgggaaacagccattcggcaggccctcatgcctgtgattctgcaggacgcaccttctgccccgggacatgctcctcaccggcaggccagcctgtctatctccgtgagcaattcacagatccaggagaacgtcgatattgcaacagtttatcagattttccccgatgaagtcctggggtctgggcaattcggcgtcgtctacggcggaaaacacaggaaaacaggacgcgacgtagcagttaaggtcatcgacaagttacgcttcccaactaagcaagaaagtcagctcaggaacgaggtggcaattcttcaatcccttagacaccccgggattgtcaacttggaatgtatgtttgagacccctgaaaaggtctttgttgtcatggaaaagctgcatggggacatgctggaaatgatcctgagctcagagaagggccggctacctgagcgtctgactaagttcttgatcactcaaattctggttgcactcaggcatctgcatttcaagaacatagtgcattgtgacctgaagcctgaaaacgtcttgctcgcgtcagccgacccatttcctcaggtcaaactgtgtgacttcggatttgccaggattatcggcgaaaagtctttccgccggagcgtggtcggtacccccgcttatctggcccccgaggtgctcctgaaccagggctataaccggagcctagacatgtggtcagtgggagttattatgtatgtcagcctttctggaactttccccttcaacgaagacgaggacattaatgatcagatccagaacgctgcctttatgtatccagccagcccctggagccatatctccgcaggggcaatcgatctgattaataacctgctgcaggtcaagatgcggaagcgctacagcgtagacaagtcgctaagtcacccatggctgcaggaatatcagacttggctcgatctgcgcgagctcgagggtaaaatgggcgagcgatatataacgcacgaaagcgacgacgttcggtgggaacagtttgccgcggaacacccactgccaggcagtggcctgccaaccgatcgcgatctgggaggtgcctgtccccctcaggaccatgatatgcagggcctcgccgaacgaatttccgttctttag

SEQ ID NO: 201332 - DNA, 2166 bp, Artificial Sequence
  Description of Artificial Sequence: Synthetic coding sequence
atgctgttcggcctggtgcggcagggcctgaagtgcgacggctgcgggctgaattatcataaacggtgcgccttttctatccccaacaattgttccggagccaggaagcgccggctgagttccacctccctagcgagcggtcattcagttcgcctgggcacatccgagtcactgccctgcacagcagaggaactaagccgatcaacaactgaactgctgccgaggaggccccccagtagttctagtagttctagcgcgtccagttatacgggacgacctatagagctggataagatgttactgtctaaagtcaaggttccccatacattcttgatacacagctacactagacctaccgtgtgccaggcctgtaagaaactgttgaagggactctttcggcaaggtctgcagtgcaaggactgcaagttcaactgtcataagcgttgtgctacacgcgtgcccaacgactgtctcggggaggcacttatcaacggggacgtacctatggaggaggcgaccgacttcagcgaggcggacaagagtgcattaatggacgagtcggaggatagcggcgttataccaggcagccactccgaaaatgctcttcatgcctcggaggaagaggagggcgagggcgggaaggcccagtcatccttgggatatattcccctgatgcgtgtggttcaaagcgtgcgacacactacccgtaagagtagtacaacgttacgcgagggctgggtggtccactacagcaataaagataccctccggaagcgtcattactggaggctcgattgtaagtgcattacgctgtttcaaaacaacaccaccaaccgctactataaagagattcctcttagcgagatcctgaccgtcgaatccgcccaaaacttcagtctcgtgccccccggcaccaatccacactgttttgagatcgttactgccaatgcgacatatttcgtcggagaaatgcctggcggcaccccaggcgggccaagtgggcagggtgcagaggctgctcgaggctgggaaacagccatccgccaagcactgatgcccgtgatcctacaggatgctccctctgctcctggacacgccccccatcgccaggctagtctatctatcagtgtgagcaatagccagattcaagagaatgtggatattgccacagtgtaccagatcttcccggatgaggtgctggggagtggccagttcggcgtggtgtacggtgggaaacacagaaagacaggtagggacgtcgccgtgaaggtgattgacaaattgagattccccacaaagcaggagagtcaattgcgcaacgaagtcgccattcttcagtccctgagacatccaggcatcgtcaacttggaatgcatgtttgagaccccagagaaagtgttcgtggtgatggagaagctgcacggggacatgttagagatgatactgtcaagtgagaaaggacgcctgccagagcgactcaccaaatttctgattacacagatacttgtagccctgagacatctgcacttcaagaacattgtacattgtgacctgaaacccgagaacgtgctacttgctagtgccgatccgtttcctcaggtcaagctgtgtgattttggttttgcgagaataatcggcgaaaagagcttcaggaggtctgtcgtcggcacccccgcctatctggctcccgaggttttgctcaaccaagggtacaatcgatcccttgatatgtggtcagtgggcgtgatcatgtatgtgtcactctccgggacatttccgtttaatgaggatgaagacattaacgaccagattcagaatgcagcgttcatgtacccagccagtccatggtcacatatctctgcgggagcgattgacctcataaacaacctgctgcaggtgaaaatgcgaaagaggtatagcgtggacaaatccctctctcacccctggttgcaggagtatcagacctggctcgacctcagagagctcgaaggcaaaatgggcgagcgctacattactcatgaaagtgacgacgtgcgctgggagcagtttgccgccgaacatcctctgccaggaagcgggctgcctaccgatcgagaccttggcggtgcatgcccaccgcaggatcacgacatgcaggggctcgccgaacgtatatccgtgctttag

SEQ ID NO: 201333 - DNA, 1482 bp, Artificial Sequence
  Description of Artificial Sequence: Synthetic coding sequence
atgcggcggcggcgggccgccgtggccgccggcttctgcgccagctttttgctagggagcgtgctgaacgttctctttgcgccagggtcagagccacctcgccccggccagtcccctgaaccaagccccgcccctggtccggggagaagggggggacgcggcgaactggcaagacagataagagccagatacgaagaagtgcaacgatatagcagggggggccccggccccggcgcgggtcgacccgagcgcagaaggttgatggacctcgccccaggtggtcccgggctgccaagacctcgtcctccttgggctcggccactgtccgacggggcacctggctggccgcctgcccctgggccgggctcaccaggccccgggcccagactgggctgtgcagcattgagaaatgtctcgggcgctcagtacatgggcagtggctacacaaaagctgtgtatagagtgagactccctggaggcgcggccgtggctctgaaagctgtggacttttccggacacgatctgggatcctgcgtaagagagttcggtgtccggaggggctgttacagactggcggcacacaagctgcttaaagaaatggtcttgctggagcggcttaggcatcctaatgtcctacagttgtatgggtattgttatcaggactcagaggatatccccgacactttgaccacgatcactgagctgggagcccccgtcgagatgattcagttgctgcagaccagctgggaggacagattcaggatctgtctgtcactgggtagactgctgcatcatttagcccattcaccacttggatcggtgacactgttagatttccgcccacgacagttcgtgcttgtggatggcgagctgaaggtgactgatctcgatgacgctcgagtcgaagaaacaccgtgtgcaggctctacggactgcatcttggagttccccgctcggaactttacactgccttgctcagcccagggctggtgtgaggggatgaatgaaaaacgcaacctctataacgcttaccggttcttttttacttacctgctccctcactccgcccctccctccttgcgacctctgctcgatagtatagtgaacgctacaggggagcttgcctggggggtcgacgagacacttgcacagctggagaaggtgctgcatctgtatagaagtgggcagtatctgcagaatagtacggcctcctctagtactgagtatcagtgtatcccagactccactattcctcaagaggattaccgatgttggccgtcctatcatcatggaagctgcctcctttccgtgttcaatctggcggaggccgtcgatgtttgcgaatcacatgctcagtgcagagcttttgtcgtgacaaaccagaccacttggactgggagacagctggtctttttcaaaaccggttggagtcaggtcgtgccagatccaaataagactacctatgtcaaggcctcggggtag

SEQ ID NO: 201334 - DNA, 2829 bp, Artificial Sequence
  Description of Artificial Sequence: Synthetic coding sequence
atggccagcgacgccgtgcagagcgagccccggagctggagcctgctagaacagctgggactggcgggggccgatctggccgctccaggggtgcaacagcagttggagctggagagagagcggctgcgacgtgagattagaaaggagctgaaattgaaggaaggcgctgaaaacctgaggcgggccaccaccgatctcgggcgttctctgggtccagttgagctactcttacgcgggagttcccggaggctcgatttgctacaccagcagctccaggaactgcacgcacatgtggtactgcctgatccggccgccacacacgacgggccccagagcccaggcgccggaggaccaacctgctccgcaaccaatctgtccagggtagccggtctggagaagcaactggctatagagttgaaagtcaaacagggcgctgagaacatgattcagacttactctaacgggtcaaccaaggatagaaagcttctgttaacagcacagcagatgctccaggatagcaagactaaaatagatattatacgaatgcagctgcgtagagccctgcaggccgggcagctagaaaaccaggctgcaccggatgacacacagggctcccctgacctgggcgccgtggagttacgcatcgaggagttgcgtcaccactttcgtgtcgagcacgcagtcgctgaaggcgcaaaaaacgttctcaggttgttatcggccgccaaggcaccggaccgcaaagccgttagtgaagctcaagaaaagctcaccgagtcaaatcagaagctgggacttctgagggaggccctggaacgacgtctgggtgagctgccagctgaccatcctaaaggtaggttgctgcgagaagaactcgccgccgcaagttcggcagccttcagcaccagactagcgggcccctttcccgctacccattactccactttgtgtaagccagcacctctaacagggaccctcgaggttagggtcgtaggctgtagggatctgccagaaactatcccttggaatccaaccccttcaatgggaggacccggtactccagactcaaggcccccatttctatctcggccagccagaggactgtattctcggtctggcagcctgagcggccggagcagtctgaaggctgaggcagaaaacacgagcgaagtgtctaccgtgctaaagttggacaacacagttgttgggcagacatcatggaagccttgtggcccaaacgcctgggatcaatcattcactttggaacttgaacgtgcacgcgagcttgagttggcagtgttttggagagatcagaggggactctgcgcactgaagtttctaaagcttgaggacttcctcgacaatgaaaggcatgaggtgcagcttgacatggagcctcaaggctgcctcgttgcagaggtgaccttcaggaaccctgtcatcgagcgcattccacgcctacggcgacagaaaaaaatttttagcaaacaacaggggaaggccttccagcgggcacgtcaaatgaacatcgacgtggcgacatgggtacgcttgctgcgcaggctgatacctaacgcaacaggcactggaaccttcagcccaggggcaagcccaggcagtgaggcccgcacaactggcgacatctctgttgagaaactaaatctcggaaccgactccgatagctctccccagaagagctctagggatccacctagcagcccgagcagcctgtccagcccgatccaagaatccaccgcccccgaattaccgtccgagactcaggaaaccccaggccccgctctctgttcccctttgagaaagagccctcttactctcgaggattttaagttcctcgccgttctggggcgcggacactttgggaaagttctgctgtccgagtttaggccgtccggggagttgttcgcgattaaagcgctgaaaaaaggggacatcgtggcccgagatgaggtggagtccctgatgtgtgaaaaacggatcttggcggcagtcacgtcggcagggcatccattccttgttaatctgtttgggtgcttccagaccccggagcacgtgtgcttcgtcatggagtatagcgccggcggggacctgatgcttcatattcatagcgacgtattttccgagccaagggctattttttattcagcctgtgtggtgctggggcttcagttcctgcacgagcataaaatcgtgtatagagatctcaagctggacaatctcctgctggacaccgaaggttacgtaaaaattgcggattttgggctttgcaaagaaggaatgggatatggcgatcggaccagtacattctgcggaaccccggagttcctcgcaccagaagtgctcacagacacctcctacacgagggctgtcgattggtggggactgggagtattactgtatgagatgctggtaggggaatcccctttccctggtgatgacgaggaagaggtctttgattcaatcgtgaatgatgaagtgcggtacccacggttcctttctgctgaagccatcggcataatgagaagactgctcaggagaaatcccgagcgccgcctggggagctctgaacgagatgcagaggacgtgaaaaaacaaccattttttcgcaccctggggtgggaggctttgttagcgcgcaggctgccccccccattcgtgcctaccctctccggacggacagatgtgagcaatttcgatgaggaatttaccggagaagcacctacactgagtccacctcgcgatgcaaggccactgaccgcagctgaacaggccgcgtttctggactttgactttgtggctggcggatgctag

SEQ ID NO: 201335 - DNA, 2847 bp, Artificial Sequence
  Description of Artificial Sequence: Synthetic coding sequence
atggccgaggccaacaaccccagcgagcaggagctggagagcgagccgcggagctggagtctgctcgagcagctggggctggccggggccgatctcgcagcccctggcgtgcagcagcagcttgagttggagcgagagagactgcgaagagagattcgaaaagaacttaagttaaaggagggagctgagaatctgagaagagccaccacagacctcggccggtccctgggaccagtcgaactgttgctgcgtggttccagccgccgactggatctgttgcatcaacagctccaagagctgcacgcccatgtagtgctgcccgacccagccgctacacacgacgggcctcagtctccaggggcggggggcccaacgtgcagcgccaccaacctcagcagagtcgcaggcttggaaaagcaactggccatcgagctcaaagtcaagcagggagccgagaatatgatacagacttacagtaatggttccactaaggaccggaagttgctccttaccgcacagcaaatgctgcaggactcgaagaccaaaatcgatataatcaggatgcagctccgcagggccctccaggccgggcagttggaaaaccaagccgcccctgacgacactcagggtagcccggatctgggcgcagttgagttgcgaatcgaggaattgcgccaccatttcagggtcgagcacgccgtggcagagggtgccaaaaatgtgcttaggctgctgagtgccgccaaagcacctgatagaaaggctgtttccgaggcgcaggaaaagttaaccgagtctaatcagaagctcggcctgctccgtgaggcccttgaaaggaggttgggggaactgcccgctgatcaccctaagggcagactgctcagagaggagttagctgctgcctcttccgctgcgttctcgacgagattagcaggtcctttccctgccactcattatagcactctttgcaaaccagcaccgctgacagggacattggaagtccgcgtcgtcggatgcagggatttgcctgagaccatcccctggaaccctacaccctccatgggtgggccaggcacgcccgactcacgccctcctttcctgagtaggcctgccagggggttgtatagcagatcgggctccttgtcaggccgaagttctctcaaggccgaagcagaaaatactagcgaagtctctacagtgctgaagctggacaatacggttgttgggcaaacatcttggaagccatgcggacccaacgcatgggatcagagctttaccttggaactggaacgcgctagggagctggagctggccgtgttttggagagaccaacgggggttatgcgccttaaagttcctcaagctggaggattttcttgataacgaaagacacgaggtgcaactggacatggagccccagggctgcctcgtagcagaggtaacattcagaaatcctgtgattgagcgcataccaaggctccggaggcagaagaaaattttctccaagcagcagggcaaggcgttccagagggcccggcaaatgaatatcgacgtcgccacttgggtgcggctcttaaggcgtctaatccccaatgctaccgggaccggcaccttctcaccaggagcttctcccgggtcagaggcacgcaccacaggtgatatctccgtggaaaagcttaatctcgggaccgattccgattcctcacctcagaagtccagtagggaccctccaagttcaccttcatctctgagttcaccaatacaggaatctaccgcccctgagctaccttccgaaacgcaagagacccctggaccagctctctgctcaccgctacggaagtcacctctcacactcgaagacttcaaatttctcgctgtcctgggaagagggcatttcggcaaagtgcttctcagtgagttccggccttcaggagaactgttcgctatcaaggcacttaaaaaaggcgatattgtagcccgagatgaggtggagtctctgatgtgtgaaaagagaattctcgccgcagtgacaagtgctggccacccctttctggtgaacctattcggctgctttcagactccggaacacgtctgcttcgtaatggagtatagcgcaggcggagatctgatgctccacattcattcagacgtcttctccgagcccagagcaatattctactcagcctgcgtggtactgggcctccagttcctgcacgaacacaaaatagtttacagggaccttaagttggataacctgttacttgacacagaaggctatgtgaagatagccgacttcgggctgtgcaaggaagggatgggttatggggatcgaacttctaccttttgtggcacacccgaattcctagcacccgaggtgctgaccgacaccagttatacccgcgccgtagactggtggggtctcggggtcctactgtatgagatgctggtcggagagagcccttttcccggcgatgacgaggaagaggtattcgatagcatcgtgaacgacgaagtgaggtaccccagattcctgagcgccgaggcaattggcataatgaggcgtttgttacggcgaaatcctgaacggaggctgggttcgtccgagcgcgatgctgaggacgtgaagaaacaacccttcttccgcacactgggatgggaagctctgctggctcggcgcctgccccctcccttcgtgcccacgttatctggtcgtactgacgtaagcaactttgatgaagaattcacaggcgaggcgcccaccctgtctccacctagggatgctagacctctgactgctgctgaacaagctgcttttttagatttcgacttcgtcgccggtggttgttag

SEQ ID NO: 201336 - DNA, 1815 bp, Artificial Sequence
  Description of Artificial Sequence: Synthetic coding sequence
atggccagcaaccccgagcggggcgagatcctgctgaccgagctgcagggggactctcggtcactcccattttctgaaaatgtgtcagctgtccagaaactggatttctcggacaccatggtgcaacaaaagttagacgatatcaaggataggatcaagcgagagatcagaaaagaactgaagatcaaggaaggcgcggaaaacttacgtaaagtgacaaccgataagaaaagcctggcgtacgtcgacaacatacttaaaaaatcaaataaaaagctcgaagaactccatcataagctgcaagagttgaatgcacatattgtagtctcggaccctgaagacatcaccgattgccctcggacccccgatacgccgaataacgaccccaggtgtagcacgagtaacaatcgcctaaaagccttgcaaaaacagctggacatcgagctgaaggtcaaacagggggcggagaacatgattcagatgtactctaacggttcctctaaggataggaagctgcatggaacagcccagcaactgctgcaggactctaaaacaaagattgaggtaatacgtatgcagattctgcaggccgtgcagacaaatgaattagccttcgacaacgccaaacccgtaattagccctctggagctgagaatggaagaactccgacaccacttccgcatagaattcgcggttgctgagggcgctaagaacgttatgaaactcctgggatctggaaaggtgacggaccggaaagcactgtcagaagcccaggcccggttcaacgagtcgagtcagaaactggacctgcttaaatactctctcgagcagagactgaacgaagtccctaagaatcaccccaagtcacgtatcatcatcgaagagctaagcctcgtcgcggcctccccaactctgagcccgaggcagtccatgatcagcacacagaaccagtactcaaccctctctaaaccggcagcgctgacaggaacgttagaagtcaggctgatgggatgtcaggatatactggagaacgtgcccgggcggtcaaaagccacctcagttgcgctgcctggctggtcaccttctgagacacggtcttcattcatgtcacgtacgtctaaaagtaaaagcggatccagtaggaacctgctcaagaccgacgatctcagcaatgacgtgtgcgccgtcctgaaattggataatacagtggtgggccaaacatcatggaaacctatctccaatcaatcatgggatcaaaaatttaccctcgagttagacagatccagggagctggagatatccgtctactggagggattggaggagcctctgcgccgttaaatttctccgattggaggattttctggacaatcaaaggcatggcatgtgtctgtacctcgaacctcagggcaccctgtttgccgaggtcacttttttcaaccctgtgatcgagagaagaccaaagctgcagcgccagaaaaagatcttttccaaacagcaggggaaaacgttcctccgggctcctcagatgaatattaatatcgctacatgggggcgcctggtccgacgggctatacccactgtgaatcactccggcaccttctctccccaggcccccgtgcccacaacagtgccggtggtagatgtacggataccacagctggccccgccagcacgttacgtcagcgagattctgtccatcagttacaccaagctcctgggccattcctatgttctgattattgccggtgtgctgtcactggcttttttcccgtctagcatcttaaaagttgtgttttgtctactgaagaagtag

SEQ ID NO: 201337 - DNA, 2484 bp, Artificial Sequence
  Description of Artificial Sequence: Synthetic coding sequence
atgatccagatgtacagcaacggcagcagcaaggaccggaagctgcatgggacggcacagcaattattgcaagattccaagaccaaaatcgaggtgatcaggatgcagattctgcaagcagtacaaacaaacgagctggcttttgacaacgcgaagccggtaatctcaccgttagaactgcggatggaggaattgagacaccactttaggatcgaatttgccgtggccgaaggagcaaagaatgttatgaaactgctcgggagcggcaaggtgacagataggaaggcactctccgaagcccaggcccgttttaacgagtctagtcaaaaactcgacctgctgaagtactctctcgagcagcgattaaatgaagtgcccaagaaccaccccaagagccgcatcattattgaagagttgagcctggtggcagcctcccctacgctgagtccaagacagagcatgatatcaacacagaatcagtactccactttgtccaagcctgccgctctcacgggcacacttgaggtcagacttatgggatgtcaggacatcctggagaacgtgccgggccggagcaaagcaacctctgtggcccttccagggtggtccccaagcgaaactagatccagctttatgtctcggacaagcaaatccaagtccggttcttcccggaacctcctcaagaccgacgacctgtcaaacgacgtgtgcgctgtactgaagctggataacactgtagtgggccagacttcctggaaacctatttcaaatcaaagctgggatcagaagtttacactcgaactagataggagccgagagcttgagatctctgtttactggagagactggagaagcttgtgcgcagtgaagttcctgaggctggaggactttctggataaccagcgacatggcatgtgcctctaccttgagccccagggtactctgtttgctgaagtgacattttttaaccccgtgattgagaggcgtcccaagcttcaaaggcagaagaaaatctttagcaagcaacagggaaagacctttcttagagccccccaaatgaacattaatattgctacatggggtaggctggtgaggagggccatccctacggttaaccactctgggacctttagccctcaagcccccgtccccacgaccgtgcctgtggttgacgtgcgcatcccccagctggctccacccgcaagtgatagcacggtcactaaactggactttgacctggaacctgagccaccacccgcccctccaagggcttcgtcgctgggcgagattgatgaatcgtctgagcttcgcgttctcgatatcccaggccaggactcagaaaccgtattcgatatccagaatgaccgaaacagcatattgcctaaatcccagtcagaatataagcccgacactcctcaatctgggctggagtatagcggcatccaggaactggaagacagacggtcgcaacagcgctttcagttcaatttgcaggacttcaggtgttgtgccgtcctgggaagaggacatttcggaaaggtactcctggccgagtacaagaataccaacgagatgttcgctatcaaggcactgaagaagggtgacatcgttgctagggatgaagtcgacagtcttatgtgtgaaaaaagaatcttcgagaccgtcaacagcgttcgacatccctttctcgttaatctgttcgcctgttttcagactaaagagcatgtgtgttttgtaatggaatacgccgctggtggcgacctgatgatgcacatacataccgatgtgttctctgaaccacgggccgttttttatgcggcatgtgtagttctaggactacagtatctgcatgagcacaagatcgtctatagggacctgaagctggataacctgttgcttgataccgaaggattcgttaagatcgccgatttcggactctgcaaagaggggatgggttacggtgatcgtacatcgaccttttgcggtactcctgagtttctggcccctgaggtgcttaccgagacttcgtacactcgtgctgttgattggtggggcttaggggtcctgatttatgaaatgcttgttggggagagccccttcccaggtgatgacgaggaagaggtgttcgatagcatcgtcaacgacgaagtgcgatatcctaggttccttagtacagaggctatctccatcatgcggcgactgctgcggaggaaccctgagagacggctaggcgcctctgagaaagatgccgaggacgtgaaaaaacaccccttctttcgcctgatcgattggtccgccctcatggacaagaaggttaagccgccattcatcccaacgataagagggagggaggacgtttctaacttcgacgacgagtttaccagtgaagctccgatcctcaccccaccccgcgagccccgcatactctccgaggaggagcaggagatgttccgggactttgactacatcgctgattggtgctag

SEQ ID NO: 201338 - DNA, 2811 bp, Artificial Sequence
  Description of Artificial Sequence: Synthetic coding sequence
atggccagcaaccccgagcggggcgagatcctgctgaccgagctgcagggcgattctaggtctttacccttctcggagaatgtctcggccgttcagaaactggacttttccgatactatggtgcagcagaagttagatgacataaaagaccggatcaaacgtgagatccgcaaggagcttaagataaaggaaggagccgaaaatttgagaaaagtcaccaccgataaaaagagccttgcttacgtcgataacattttgaagaagagcaataaaaaactggaggaacttcaccataagcttcaggagctgaatgcacacattgtcgtcagcgatcccgaggacataactgattgtcccaggacccctgacactcccaataatgaccctcgttgttccacttccaataacagactgaaggccctccagaaacagctggatatcgaactgaaagtcaagcagggcgcggaaaacatgattcagatgtacagtaatggttcgtcgaaagatcggaagctgcatggaacagcccagcagcttttgcaggattccaagactaaaattgaggtcatccgcatgcagatccttcaagccgtgcagacaaacgagctggctttcgacaatgcgaaacccgtaattagtccattagagcttagaatggaagaactgcgacaccattttaggattgaattcgccgtcgccgaaggcgctaaaaacgtgatgaagctcttggggtctgggaaggttacagaccggaaggctctgagcgaggcccaagcccgattcaacgagagcagccagaagttggacctcctgaagtactcccttgagcaaagacttaacgaggtacctaagaatcatcctaagtcccgcatcattatcgaagagttgtccctggtagccgcgtccccgaccttgagtcccaggcagtctatgatttccacccagaaccaatatagtacactgagcaaaccagcagccttgaccggcaccctcgaagttaggctgatggggtgccaggatattctcgagaacgtcccgggccggagcaaggccactagcgtggctcttccaggttggagtccttccgagaccaggtcgtcgtttatgtcaagaacaagtaagtcaaaaagcggctctagccgcaatctgctgaaaaccgacgatctgtctaatgatgtctgtgcagttctcaagctggataataccgtcgtgggtcagaccagctggaaaccaatcagcaaccaaagttgggaccaaaagttcacactggaactcgatagagtcacttttttcaaccctgtgatcgagaggaggccaaagttgcaaagacagaagaaaattttttcaaagcagcaaggtaagacctttcttcgcgccccccagatgaacattaacatcgccacctggggacgcctggttcgtagagctattcctaccgtgaatcattctggtacctttagcccgcaggcaccggtgcccaccaccgttcccgtcgtagatgtccggatcccccagttggccccgcccgcatccgactctacggttacgaaactagatttcgaccttgagcctgaaccccccccggccccccctagagcgagcagcctgggcgagattgacgaaagctccgaacttcgggtactggacatacccgggcaagactctgagacagtcttcgacatccagaatgaccgtaactctattctaccaaaaagccagtccgaatacaagcctgacacaccacaaagtggcctggagtacagtggcatccaggaactggaggataggaggtctcagcagcgattccagtttaacctgcaggactttagatgctgtgccgtcctaggccgcggacattttggaaaggtgctactggctgagtataaaaacaccaatgagatgttcgccataaaagcactgaaaaagggggacattgtcgcccgcgatgaggtggatagcctgatgtgcgagaagagaatattcgagaccgtcaatagcgtgaggcatccattcttggtgaatctctttgcttgtttccagactaaggagcacgtgtgtttcgtgatggaatatgctgccgggggcgaccttatgatgcacattcacactgacgtgttttccgaaccccgcgccgtgttttatgccgcctgtgtcgtcttggggttgcagtatctacacgagcacaaaatcgtctaccgtgatctgaaattggacaatctccttcttgatactgagggtttcgtcaagattgccgactttggtctgtgcaaggaagggatgggctacggcgataggacatctacattttgcggtacaccagaattcttggctcccgaggtcctgaccgagacgtcatatacgcgtgcagtggattggtggggcctgggcgtattaatttacgagatgctcgttggggagtccccatttccgggagatgatgaagaagaggtctttgatagtattgttaacgacgaagtgcgctatccacggttcctgtccaccgaggctatctcaattatgaggagactactgaggcgaaaccccgagcggaggctcggcgcctctgagaaggatgccgaggatgtgaagaagcatccttttttccgactcatcgattggtccgccttaatggataaaaaggtgaaaccacccttcatacctaccattcgtggtcgggaggacgtctctaacttcgatgacgagtttacatccgaagccccaatcttgactccccctagagaaccccgaatcctgtcagaagaggagcaggaaatgttccgggactttgactacatagccgattggtgttag

SEQ ID NO: 201339 - DNA, 2955 bp, Artificial Sequence
  Description of Artificial Sequence: Synthetic coding sequence
atggccagcaaccccgagcggggcgagatcctgctgaccgagctgcagggcgacagccgttcactcccattttccgagaacgtcagtgccgttcaaaagttggacttcagcgatactatggtgcaacagaagctggacgatataaaagaccggatcaagcgcgagattaggaaggagctcaaaattaaggagggagccgagaacttgcgaaaggtcacgacagacaagaagagtttggcatatgtcgacaacatcctcaagaaatccaacaagaaactggaggaacttcaccacaaactgcaggagcttaatgcacatatcgttgttagcgatccagaggacatcacagactgccccagaactcccgacactcctaacaacgatcctcgatgctcgacgagtaacaataggttgaaagcattgcagaagcagctggatattgaactgaaggtgaaacagggagctgaaaatatgattcagatgtactctaatgggagttcgaaggataggaagttgcatgggaccgcacagcagttgctccaggattctaagaccaagatcgaagtgatccgaatgcagatcctacaagcagtacagacaaacgagctggccttcgacaacgccaaacctgtgattagccctcttgaattgagaatggaggaactgcgacaccacttccgcattgaattcgctgtcgcagagggggcgaagaacgttatgaagctcctaggaagtgggaaggtaaccgatcgcaaggccctttcagaagcccaagctcgctttaatgagtcgagccagaaactcgatttgcttaagtactccctggagcaacgcctcaatgaggtccccaagaaccatcccaagagccggattatcatcgaggagctttctcttgttgctgcctctcctactttatccccgcggcagagtatgattagtacccagaatcagtacagcacacttagcaaacctgccgcgctgaccggcactctggaggtgaggttgatggggtgccaggatatcctggaaaacgtgccaggacgcagcaaggctacttctgtagccttgcctggctggtcccccagtgagacgagaagctcttttatgagtaggacatccaagagtaagtctggtagtagccgcaacctccttaagactgatgacctctctaacgacgtgtgtgccgtactgaagcttgacaacacggtggttggtcagacgtcttggaagccaatcagcaaccagtcctgggaccagaaattcactttggaactcgatagaagccgcgaattggaaattagtgtctattggagagactggaggagcctgtgtgccgtgaagtttctgcgattggaggactttctggataatcagaggcacggaatgtgtctgtacctggagccccaaggaactctgttcgcggaagttacgttcttcaatccagtcattgagagaagaccaaagctccagcgccagaagaaaattttctctaagcaacagggtaaaacattcctgcgggctccccaaatgaacataaacatcgccacatggggcagattggtacggcgtgcaattcctactgtgaaccacagcgggacgttctctcctcaagccccggtacctacaacagtaccggtcgtggacgtgaggattccccagttggctccaccagcctccgatagcacagtcacaaaactggacttcgatctggaaccagagcccccgccagcccctccgagggccagctctctgggagagatcgatgagtcttcagagctcagggtcctggacattcccggccaagactccgagacagtctttgatatccagaatgacaggaactccattctgcccaagtcccagtcagaatacaagccagacacaccacagtcaggtttggaatactcaggcatacaggagctggaggatagacggtcacagcagcgctttcagtttaacctgcaggacttcaggtgctgtgcagtcttggggcgcggacattttggcaaggtcctattagccgaatataaaaatacgaatgagatgttcgccatcaaggccctgaagaaaggggatattgtggctagagacgaagtggacagccttatgtgtgaaaaaaggattttcgagacggtgaactctgttaggcaccctttcctcgtgaaccttttcgcgtgtttccagacaaaggaacatgtgtgctttgtgatggaatacgctgccggtggtgatctcatgatgcatatacacaccgatgtcttctcagaacccagggcggtgttctacgcagcctgtgtcgtccttggtctgcagtatctgcatgagcacaaaattgtatatcgcgacctgaaactggacaatttgctgctggataccgagggcttcgttaagattgcagattttgggctatgcaaagaaggtatgggctatggagacagaaccagtaccttttgtgggacacccgagttcctggcgccagaggtgctgaccgagaccagctacactcgggcagtggactggtggggcctgggagttcttatttacgagatgctcgtcggcgagtcccctttccccggagatgacgaggaggaggtgttcgattccatcgtgaacgatgaagtgcgataccctagattcttgagcacagaagctatttctattatgaggcgcctgctcagaagaaatcctgagagaagattgggtgccagtgaaaaagacgccgaagacgtcaaaaagcaccccttttttcggctcatcgattggagcgcgctgatggacaaaaaggtgaagcctccatttatcccaaccatccgtggccgcgaggatgtctctaactttgacgacgaatttacatcagaggctcctattctgacaccgcctcgcgagccaagaattctttcggaagaggagcaggagatgttccgcgactttgactacatcgccgattggtgctag

SEQ ID NO: 201340 - DNA, 636 bp, Artificial Sequence
  Description of Artificial Sequence: Synthetic coding sequence
tgagaggagctgcggcaccacttccggatcgagttcgccgtggccgagggagcaaaaaacgtgatgaaactcctcgggtcaggtaaagtgacagacaggaaagctttgtccgaggcacaggcgaggtttaacgagtcaagtcagaaactcgatctgctcaagtacagcctggagcagcgcctaaacgaagtcccaaagaatcatccgaagtcaagaatcataattgaagagctgtcactggtagctgcttctccgactctgtcgccacgccagtctatgatcagtacgcagaatcagtactcaacgctgtccaagccagcagccctgacagacgatgtgtgtgcggtgttaaagttggataatacagtcgtcggccagactagctggaagcccatcagtaaccagagctgggatcagaagtttaccctcgagcttgacaggagccgggaactggaaattagtgtctactggagggattggagatccctgtgtgctgtgaaattcctgaggctagaagacttcctggacaaccagaggcacggcatgtgcctgtaccttgagccccaagggactctgttcgccgaggtgacattcttcaatccagtgatcgagcgtagaccaaagctgcagcgctag

SEQ ID NO: 201341 - DNA, 198 bp, Artificial Sequence
  Description of Artificial Sequence: Synthetic coding sequence
tgaggcttcgtgaagatcgccgacttcggcctgtgcaaggagggcatgggctacggggatcggacctctacgttctgtggtactcccgagttcctggctcctgaagtgctcacggaaacatcctatacccgtgcagtggactggtggggcctgggcgttctcatttatgagatgttggtgggcgagactagtgtgtag

SEQ ID NO: 201342 - DNA, 1977 bp, Artificial Sequence
  Description of Artificial Sequence: Synthetic coding sequence
atgaacagcaccctggaggtgcggctgatgggctgccaggacatccttgagaacgtgccgggacggagcaaggccacctcagtcgcactccccggctggagcccatctgagactaggtcttcattcatgagtcgcacctctaagagtaaaagcggcagtagccgcaatcttctaaaaacggacgacttgtctaacgatgtatgcgccgtgctaaagctcgacaatacggtggttggccaaacgtcctggaagccgatttctaaccagtcttgggaccagaaatttacgcttgaactggatcgaagccgcgagctggaaataagcgtgtattggcgcgactggaggtcactctgtgccgttaagttcctgcgcttggaagattttctcgacaaccagagacacggtatgtgcctatatctcgaacctcaggggaccctgttcgccgaagtcactttctttaaccctgtcatcgagaggcgacccaagctacagaggcagaagaagattttcagtaaacagcaaggaaaaacatttctgcgcgctccccagatgaatattaatatcgctacctggggccggttagtgagaagggccatacccacagtgaatcactccgggactttcagcccacaggcccctgtccctacaaccgtgccggtggtggacgtgcgtataccacagctggccccaccagcatcagatagcacggtcaccaagttggatttcgatctggagcccgagcctcctcctgccccaccacgagccagcagcctcggcgagattgacgagagttcggaattgagggtgctggatataccaggccaggattccgaaacagtatttgatattcagaacgatagaaacagtattctccccaaaagccagagtgaatacaagcctgatacaccacaaagcggtcttgagtactctgggatacaggaactagaggataggcgcagccagcagcggttccaatttaacctgcaggacttcagatgttgtgccgtcttggggcgaggacatttcgggaaggtgctgctcgccgaatataaaaacactaatgaaatgttcgcgatcaaggcgctgaaaaaaggggacattgtggcgagagatgaggtggactctcttatgtgtgagaaaagaattttcgagactgtgaatagtgtgcgacaccctttcctggttaaccttttcgcatgctttcaaacaaaggaacacgtgtgcttcgtgatggaatacgccgctggcggcgacctgatgatgcacatacacaccgatgtgttctcggaaccgcgagcagtgttttatgcagcatgcgtagtgctgggccttcagtacttgcatgagcataaaatagtctaccgggacctgaaacttgataacctgctcctggatacagagggattcgtgaagattgctgatttcggactgtgcaaagaggggatggggtacggtgaccgcacaagtacattttgcggcacaccagaattcttggcccccgaagttttgaccgaaacgtcatacacccgagcagtagattggtggggactaggcgtgctgatttatgagatgttggtgggcgagtccccatttcccggtgatgacgaggaagaggtctttgacagcatagtcaatgacgaggtgcgctatccaaggttcctctccaccgaagcaattagtattatgaggaggctcctccggcggaatcccgagcgaagactcggcgccagtgaaaaagatgctgaagatgttaagaagcatcctttcttcagactgatcgactggtccgcactcatggacaaaaaagtgaaaccaccatttattcctacaatccgaggcagagaagacgttagtaacttcgatgatgagttcacgtctgaggcacccatcctaactcctccacgcgaacctcggatactatcggaggaggaacaagagatgttccgtgatttcgattatatcgctgattggtgttag

SEQ ID NO: 201343 - DNA, 336 bp, Artificial Sequence
  Description of Artificial Sequence: Synthetic coding sequence
atgcacatccacaccgacgtgttcagcgagccccgggccgtgttctacgctgcttgtgtggtgttgggcctccagtatctgcatgaacacaaaatcgtatatagggatctaaagctcgataacttgttgctggacaccgaaggattcgtaaaaatagcagacttcggcctttgcaaggagggtatgggatatggcgaccgcactagtacattttgtggaacacccgagttcctggcacctgaggtactgacagaaacatcttacacaagggctgtggactggtggggacttggagttttaatctatgagatgttggtcggggagacctccgtctag

SEQ ID NO: 201344 - DNA, 2670 bp, Artificial Sequence
  Description of Artificial Sequence: Synthetic coding sequence
atggaggagggcgccccccggcagcccggccccagccagtggcccccagaagatgaaaaagaggtcattcgccgcgctatccagaaagagctgaaaataaaggagggtgtggaaaatctcagacgcgtggccaccgataggaggcatctgggacacgtgcagcagcttttgcggtcttcgaatcgtcggttggagcaattacacggggaactgagggagcttcatgcacgtattctcttaccgggacccggtcccggtccggccgagccagtggcaagcggaccacgtccatgggccgagcaactcagagcacgacatctcgaggctctgaggcgtcagctgcacgttgaattgaaagtgaaacaaggagctgagaatatgacgcatacatgtgcgtcaggaactcctaaggagcgcaaactccttgctgcagcacagcagatgcttagggattctcagttgaaagtagccctactccggatgaaaataagctcactggaagcatccggatcaccagaaccaggtccagaattactggctgaggagctgcagcatcgccttcacgtcgaggctgctgttgccgaaggagcaaagaatgtggttaaattgttatcttctagaagaacacaggatagaaaagcacttgcagaagcacaagcacagctccaggagtcctctcaaaagctggacctcctccgcctggccctcgaacagctacttgaacagctgccccccgcgcatcctttgcgctctagagtcactcgggaactgagggcagccgtgcccggctaccctcagccctctgggactccagtgaagccgactgccctgaccggcaccctgcaggtaaggctcctgggctgtgagcagctgctgaccgccgtgcctgggcgttcgcccgctgctgctctggcctcctctccttcagaaggatggctgagaacgaaagccaagcaccagaggggccgcggcgagttagcatcagaggtgttggctgtgctgaaggtcgataaccgtgtggtgggacagactggctgggggcaggttgccgaacagtcctgggatcaaacgtttgtgattcccctggaaagggcgagagaactcgaaataggagttcactggagagattggagacagctctgtggggtagctttcttgcgtttggaggatttcctggacaacgcatgccatcagctcagcctgagtttagtgccccagggacttctgttcgcccaggtaacgttctgcgatccagtcattgagcgtagacccagactgcaacggcaggagcggatctttagcaagaggcggggtcaggacttcctgcgcgcttcccagatgaacctgggaatggccgcttggggaaggctggtgatgaatctgctcccaccgtgttcctccccaagcaccatttctcctcccaaaggctgcccacgcacacctacgactcttcgggaagccagtgatccggccaccccttccaactttttgcccaagaagacccctttgggagaagagatgactcccccgcccaagccccctcgcctgtatctcccgcaggaaccaacaagcgaggagacccctcgtacaaaaagaccgcacatggagcctcgtacgaggagaggccccagcccacccgcatcacccacccggaaaccccccaggctccaagatttccggtgccttgccgtgcttggtaggggtcattttggaaaggttttacttgtccaatttaaaggaaccggcaagtactatgctatcaaagccttgaaaaaacaggaggtgttatcgagggatgagatagagtctttatactgtgagaaaagaatcctggaggctgtgggttgtacgggccacccttttctgctttctctcctggcgtgctttcagactagttcccatgcctgcttcgtgaccgagtttgtaccaggtggcgatctcatgatgcagatccacgaggacgtatttcccgagccccaggcgagattctatgtagcatgcgtcgtgctggggctgcagttcctgcatgaaaaaaaaatcatttaccgcgatctgaagctggataacctgctgctcgatgcacaagggtttttgaagatcgcagactttggactgtgcaaggaaggcatcggattcggtgaccggacttcgaccttctgcggcaccccagagtttctggctcccgaggtgcttactcaggaggcctacactagggccgtagattggtggggactgggcgtgctcctgtacgaaatgctcgtgggcgaatgtccttttccaggagacacagaggaagaggtgtttgattgtatcgtgaatatggacgcaccttatccaggctttttgtcagtgcaggggctagaattcattcagaagctgctgcagaagtgccctgagaagcgactgggcgctggtgaacaggatgccgaagagatcaaggttcagcccttcttccgcaccaccaattggcaggctttgctagctcgtacaatccagcctccgtttgtgcccacactctgcggccctgctgatctgagatactttgaaggagagtttactgggttgcctcccgctttgacccctcccgctccccactccttgctgacggctagacagcaagccgcgtttcgagacttcgattttgtgagtgagcggtttctggagccctag

SEQ ID NO: 201345 - DNA, 1725 bp, Artificial Sequence
  Description of Artificial Sequence: Synthetic coding sequence
atgcggcggctgagcagctggcggaagatggccaccgccgagaagcagaagcatgatggacgggtgaaaattggccactacatcttaggcgatactctgggcgtcggaactttcggcaaggtgaaagtcggaaagcatgagctgaccgggcataaggtggccgtgaaaatcttaaaccgacaaaagattcgtagtctcgacgttgtcgggaagattagaagggaaatccagaatctgaagctcttccggcatccgcatatcattaagctttatcaagtgatcagcactccgtctgatattttcatggtgatggaatacgtgagtggcggcgagctatttgactacatatgtaagaacggtcgtaaaagtgacgttcctggggtcgtaaaaaccggcagtacaaaggagctggatgagaaagagtcccggcgtttattccagcagattctgtcgggtgtggattattgccaccgtcatatggtggtccaccgggacttgaagcctgaaaatgtgctcctggacgcacatatgaacgctaagattgcagatttcgggctctccaatatgatgagcgatggcgagtttctgaggacaagttgtggcagccccaattatgccgcacctgaagtgatttcaggacgactgtacgccggcccagaagtggatatctggagctctggcgtgattctctacgcccttctgtgtgggaccctgccttttgacgacgaccatgtgccgactctgttcaagaagatctgtgacgggatcttctacactccgcagtacctcaatcctagcgtaatcagcctgctgaagcacatgctgcaggtggaccctatgaaaagggctacaatcaaggatattcgggaacacgaatggtttaaacaggaccttcctaagtacctctttcctgaggatccatcttactctagcactatgattgacgatgaggcattaaaagaagtttgcgaaaaatttgagtgctccgaagaggaggtcctgtcatgtctgtacaaccgaaaccaccaagaccccctggcagtcgcctatcacttgatcattgacaacagacggatcatgaatgaggcaaaggacttttatttagccacaagtcctcccgacagctttttagatgatcatcacctgaccaggccacatcccgagcgcgtaccgttcctcgtggccgagacacctagggctcgccatacacttgacgagctcaacccacagaagtccaaacatcagggcgtgcgcaaagccaagtggcaccttgggatcagatctcaatcacggcctaacgacatcatggcggaagtctgcagggcgattaaacagcttgattatgaatggaaagtagtcaatccctattatctgagagtaagacgcaaaaatccggtgacctcaacatattcaaaaatgagtttacagctatatcaagtggattctaggacttatctgctggactttcgcagtatagatgacgagatcactgaagccaaatccgggaccgctacaccacagagaagcggatcagtttccaactatagaagctgtcagcgttccgacagcgacgctgaggctcaaggaaaaagctctgaggtaagccttacatcaagtgtcaccagcctggattcaagccccgtcgacctgaccccaaggcctggatcccatacaattgagttttttgagatgtgtgctaacctgatcaaaattctggcacagtag

SEQ ID NO: 201346 - DNA, 1680 bp, Artificial Sequence
  Description of Artificial Sequence: Synthetic coding sequence
atgcggcggctgagcagctggcggaagatggccaccgccgagaagcagaagcacgacggacgggtgaaaataggtcactacatcctcggggatactctgggcgtcgggaccttcgggaaagtaaaggtaggaaagcatgagttaacaggtcacaaagttgcagtaaagatcctgaaccgtcaaaagattcgtagcttggatgtggtgggaaaaatccgacgggagatccagaatctcaagctctttcggcatcctcatattatcaagctttaccaagttatctccaccccgtcagacatattcatggtgatggaatacgtgagtgggggagagctgttcgattatatatgcaaaaacggccgcctcgacgagaaagagtcgaggagactcttccagcagatcctgtcaggcgtagattattgtcatcggcacatggtggtacacagagacctcaagccagagaacgtcctcctggatgcacatatgaacgctaagatcgctgactttgggctcagcaatatgatgtctgatggcgaatttcttcggacctcatgcggatcaccaaactatgccgctcctgaggtgatcagcggtaggttgtatgccgggcccgaggtagatatatggtcatcgggtgtgattctctacgcactgctgtgtggtacactgcccttcgacgacgaccatgtacccaccctttttaagaagatatgcgacggaattttctacactccacaatacctcaatccatcagtgattagcctattgaagcatatgcttcaggttgaccccatgaaaagagctacaatcaaagacatccgggaacacgaatggttcaagcaggatcttccaaagtatctgttcccggaggatccatcctatagctcgaccatgattgatgacgaagctctcaaggaagtatgcgagaagttcgaatgctcagaagaagaagtgctgagttgcttgtacaatcggaatcatcaggatccccttgccgtggcctaccaccttatcatcgataaccgacgcatcatgaacgaggctaaagatttttatctggccactagccccccagattctttcctggatgatcatcatctcaccaggccacaccctgagcgggtgccgttccttgtcgcagaaaccccgcgtgcgagacacaccctcgacgagctaaacccccagaagtcaaagcaccagggagtacggaaagcaaaatggcatctgggtatcagaagtcagtcccgccctaatgacattatggctgaagtatgccgggctataaagcaattggactacgaatggaaagttgtgaatccctactacctccgcgtcagacggaagaatccggtcacttctacatactctaaaatgtcccttcaactgtatcaggtggactctagaacgtacctgctagattttcgctccatcgatgatgagattacagaagcgaaaagcggaaccgctactccacagaggtcaggctccgtgtcaaattaccgatcatgtcagaggtctgattctgatgccgaggcccaaggaaaatccagcgaggtgagtctgacgagctccgtcacgtcattggacagtagccccgtggacctgactcctcgccctggctctcacactattgaattcttcgaaatgtgcgcaaatctcattaagattctcgctcagtag

SEQ ID NO: 201347 - DNA, 1659 bp, Artificial Sequence
  Description of Artificial Sequence: Synthetic coding sequence
atggccgagaagcagaagcacgacggccgggtgaagatcggccactatgtgttgggagacacgctcggggtgggtacatttggaaaagttaagattggagagcaccagctgaccggtcataaggtcgccgtcaagatcctgaacaggcagaagattcgcagcctggatgtcgtgggcaagataaaacgtgaaattcagaatctaaagctttttcgccatccccatattattaagctctaccaagtgatttcgacacccaccgatttcttcatggtgatggaatatgtgagtgggggggagctgtttgactatatatgcaagcatggccgagtggaggagatggaggctagacgtctctttcagcagatcctaagcgcagtggactactgccatagacatatggtcgtgcaccgtgacctcaaacccgaaaacgtcctcttggacgcacatatgaatgcaaagattgctgacttcggactgtctaatatgatgtcagatggagaattccttaggacctcttgtggatcgcccaactacgcagctccagaggttataagcggaagactctacgcagggcccgaagttgacatctggtcatgcggcgtgatcctgtacgcgctcttgtgtggcaccctgccgtttgatgatgaacacgtgcctacattgtttaaaaagatccgggggggggtcttctacatccctgaatacctgaacagaagtgtggccacgctgctcatgcatatgctccaagttgatcccctgaaacgtgcgacgatcaaggacattcgggaacatgaatggttcaagcaggacttgccttcttatctcttccccgaggacccttcgtacgatgccaacgtcatcgatgatgaagctgtgaaggaggtgtgtgaaaaatttgaatgcaccgagtcagaagtgatgaatagcctctactctggtgaccctcaggatcagctcgccgtcgcctaccacctgattatagataatcgacgcatcatgaatcaggcttcagaattttatcttgcctccagtcccccctcaggcagcttcatggacgattcagctatgcatatccccccaggattgaaaccccaccctgaaagaatgcctcccctgatcgcggattcccccaaagcaaggtgccctctggatgcactgaataccaccaagcctaaaagccttgccgtcaagaaagcgaagtggcatctgggcatacgctcccaatccaagccatatgatattatggccgaggtctacagggccatgaagcaattagacttcgagtggaaggttgtgaatgcttaccacctgcgtgttcgacgcaaaaatcctgtgactggtaattatgttaagatgtctcttcaactgtatctcgttgacaatcgcagctatttactggactttaaatccatcgacgatgaagttgtagaacagcgaagcggcagctcaactccgcagcggagctgctcagctgcgggtctccacaggccccgcagctccttcgatagcaccactgctgagagccactccctgagcggttctcttacaggctccttgacaggctcaacactgagctccgtctctccccgcctcgggtcccacaccatggacttttttgaaatgtgcgcatcactaatcactacccttgcaagatag

SEQ ID NO: 201348 - DNA, 744 bp, Artificial Sequence
  Description of Artificial Sequence: Synthetic coding sequence
atgctgaccatcaccgacttcatcaacatcctgcaccggtactacaaaagtgctttggtgcagatctacgaacttgaagaacacaagattgaaacgtggcgtgaagtgtacttacaagattcatttaaacctctggtgtgcatttcacccaacgcgtcactattcgacgccgtcagcagcctaattagaaataagattcacagactcccggtaattgaccctgagagcggcaacaccctttatatcctcacccataagcgcatcttgaaatttctgaaactcttcatcactgaatttcctaagccagagtttatgagcaagagcctggaagagctgcaaatcgggacctacgcaaatatagccatggtaagaaccactacgccggtgtatgtagccctgggcatcttcgtgcaacatcgggtgtccgcactgccggttgtcgacgaaaaagggagagttgttgacatatactccaaattcgacgtgattaacctggccgccgagaagacatataacaaccttgacgtgtcagtgactaaggcactgcagcatcggtcccattattttgaaggagtcctgaagtgttacttgcacgagaccctcgaaactattatcaatcggctcgttgaggcggaagttcaccgcttagtcgtggttgacgaaaacgatgttgtgaaaggcatcgtgtcactcagcgatatcctgcaggcccttgtgctcacaggcggagagaaaaaaccctag

SEQ ID NO: 201349 - DNA, 996 bp, Artificial Sequence
  Description of Artificial Sequence: Synthetic coding sequence
atggagaccgtgatcagcagcgacagcagccccgccgtggagaacgagcacccccaggaaacacctgagtcaaataactccgtgtacacctccttcatgaaatctcaccgctgctatgacctcatacccacttcatcaaaacttgttgtgttcgacaccagcttgcaggtaaagaaagcttttttcgctcttgtgacgaacggagtcagagccgcccctctctgggactccaaaaagcagagtttcgtggggatgcttactattactgacttcatcaatatcctgcatcggtattataaatccgctctggttcagatctatgaactggaggagcacaaaatcgaaacttggcgggaggtgtacctccaggactcttttaagcctctggtgtgcatttctcctaatgcaagcctcttcgacgcagtgtcgagtctgattcggaataagatccacagactgcccgtcatcgaccccgagagtggaaatactctgtacatcttaacacacaaaagaatcttgaaattcttgaaattgtttattacagaattccctaaaccagaattcatgagcaaatcattggaggaactccaaattgggacttatgctaacattgcaatggtccgcacaactaccccagtctatgttgcgctgggtatctttgtccagcatcgcgtgagtgcccttcctgtagtggacgagaaggggcgcgtggtcgatatttattccaagttcgatgtgattaacctggcagccgaaaaaacatataataacctggacgtatccgtcaccaaggcccttcaacaccgcagccactattttgagggcgtgctcaaatgctatctgcatgaaaccctcgagaccattataaataggctagtggaggccgaagtgcacagacttgtcgttgtagatgagaatgatgtggtcaaaggcatagtttctctgtccgacatcctccaggcgctggttctaactggcggggagaaaaaaccttag

SEQ ID NO: 201350 - DNA, 1710 bp, Artificial Sequence
  Description of Artificial Sequence: Synthetic coding sequence
atgggcagcgccgtgatggacaccaagaagaagaaggacgtgagctctcctggaggctctggcggaaaaaagaatgccagccagaaacgtagatcacttagagtgcacatccctgatctaagcagcttcgctatgcctctcctagatggggacctcgagggtagcggcaagcatagcagccggaaggtcgacagcccctttggccccgggtcccctagcaagggattttttagcaggggtccccaacctcgaccaagttctcccatgtcagcccctgtgagaccaaagacctctccaggatccccaaaaaccgtgttccctttttcgtaccaagaaagtccgcccagaagccctagaaggatgtcatttagcgggatttttcgcagttcatctaaagagtccagcccgaactcaaaccccgccacctccccgggtggaattagattcttcagtcggtctagaaaaaccagcggccttagctcttccccgtctaccccgacacaagtgacaaaacagcacacttttcccctggagtcctacaagcacgagcccgagaggttggagaaccgcatctacgcctcctccagcccacccgatacgggacagaggttctgcccgagctctttccagtcacctacacgccctcctctggcctcacctacacattatgctccatctaaggctgccgccttagctgctgccctgggacctgccgaggccggcatgctcgagaagctggaattcgaggacgaggctgttgaggacagtgagtcgggtgtgtatatgcgcttcatgcgaagtcacaagtgctacgacatcgtgcccacctcatcgaagcttgtggtgtttgacacaaccctgcaagtcaaaaaggcttttttcgccctggtagctaacggtgttcgcgctgcccctctgtgggaatctaaaaagcagtcattcgttgggatgttgactattactgactttattaatatcctgcaccgatattataagagcccaatggttcagatctatgagctggaggaacacaagattgagacctggagagaactatatctccaagagacatttaaaccacttgttaacatcagcccagacgcaagtctctttgacgccgtgtacagtctgatcaaaaacaaaatccatcgactcccagttatcgaccccatcagcgggaatgcattgtacattctgacacataaacggatccttaagtttctacaactatttatgagcgacatgcccaaaccagcgtttatgaaacaaaacctcgacgagctcggcatcggaacttatcacaacatcgcattcatccaccccgatacgcccattattaaagccctgaacatttttgtcgagcggcggataagcgccctacctgttgtagatgagagcggaaaggtggttgacatctactcgaagttcgacgtgatcaacctggccgcggaaaagacttataacaacttggacattactgtgacacaggctctgcaacatcgctcccagtactttgagggcgtggtcaaatgcaataagctcgaaatactggaaaccattgtcgacagaatcgtcagagccgaagtgcaccgcctcgtggttgtaaacgaggccgacagtatcgtgggtatcatcagcctgtctgatattctgcaggcgttgatcctcacgcccgcaggtgcaaagcaaaaagaaaccgaaaccgaatag

SEQ ID NO: 201351 - DNA, 1335 bp, Artificial Sequence
  Description of Artificial Sequence: Synthetic coding sequence
atgaagcggttcggcagcctgcggagcaacaagaagcacaaggaccagaacagaagcactgagaggagacagtcagagcctcacggattatttgcaagcggcctttctagctcgccaagcactccgacacaggtgaccaaacagcacacttttccactggagtcctataaacatgagcccgaaaggttggagaacaggatctatgcttcgtcctcgccaccggatacaggccaacgcttttgccccagtagctttcaatcccctactagacctccccttgcttcgcccactcattatgccccttctaaggccgctgcgctggccgccgccctgggacctgccgaggccggcatgcttgaaaagctggaattcgaggacgaggtggaggattcagaaagcggcgtgtacatgagattcatgaggtcacacaaatgttatgatattgtgccaacgagttctaagctcgtcgtattcgacacaaccctgcaggtgaagaaggccttcttcgcactggtggccaatggggtgcgcgcagcccctctatgggagtctaagaaacagagctttgtgggaatgcttaccattaccgatttcatcaatatcctgcacaggtactacaagagccctatggttcaaatatacgagctggaggagcacaaaattgagacctggcgtgaactgtatctgcaagaaacatttaagcccctggtaaatatctcacctgacgcttctctttttgatgcggtgtactccctgattaagaataaaattcacagactgcctgttatcgatcccatcagcgggaatgccctttacatccttacacataagcgaatccttaagttcttacagttattcatgagcgacatgccaaagccagcgtttatgaaacagaatctggacgagttggggattggcacctatcataacatagcctttatacacccagacactcccatcattaaagccctcaatattttcgtcgagcggcgaatctcagcccttccagtcgttgatgagagtggcaaggtggtggacatctactcaaaatttgatgtgatcaacttggccgcagaaaaaacttacaacaatctcgatatcaccgtgacccaggccctacagcaccgaagccaatattttgaaggagttgtgaagtgtaacaaactggagatccttgagaccatcgtggacagaatagtgcgagccgaggttcataggctggtcgtggttaacgaggccgactctatagtgggaattatcagcctttctgacatactgcaggcactgattttaacccctgccggcgcgaagcaaaaagaaactgaaaccgagtag

SEQ ID NO: 201352 - DNA, 309 bp, Artificial Sequence
  Description of Artificial Sequence: Synthetic coding sequence
atggccggccaggccttccggaagttcctgcccctgttcgaccgggtgcttgtcgaacgcagcgcagctgagacggtcacgaaaggtggcataatgctccccgagaaaagccagggtaaggtactgcaagccactgtggtggccgtcggcagcggaagcaagggcaagggcggagagatccagccagtaagcgtaaaagtaggcgacaaggtcttgctcccagaatatggcggaacaaaggtagtgctggatgataaggactatttcttgtttcgcgatggagacatcctgggcaaatatgtggactag

SEQ ID NO: 201353 - DNA, 1062 bp, Artificial Sequence
  Description of Artificial Sequence: Synthetic coding sequence
atggagcccggcctggagcacgccctgcggcggacccccagctggagcagcctgggcggctccgaacatcaggagatgtcatttttggaacaggagaactcttcctcttggccctcccctgcggtgacttcatcctccgaaaggattcgcggcaagaggcgggccaaggctctaagatggactcggcaaaagagtgtggaagagggagaaccacccgggcaaggagaaggtcccaggagtcggcctgcagccgagtcaacaggtctggaggccacgttcccgaagacaaccccccttgcacaagctgatcccgcaggagtgggaactcctccaactgggtgggattgtctcccctccgattgtactgcatctgctgctggatcctccacagacgatgttgaactggctacagagtttcctgctaccgaggcttgggagtgtgagcttgagggtctgctcgaggagagacccgctctgtgcctgtctcctcaggcccccttccctaagttgggctgggatgacgagctgaggaaacccggtgctcagatttatatgaggtttatgcaagaacatacatgctatgacgctatggctacttcttctaagctggtgattttcgatactatgttggagatcaagaaagccttctttgcattggttgcaaatggcgttagagctgctccgctatgggacagtaaaaagcagtcatttgtgggaatgctcacaattacagacttcatcctagtgctgcaccgctactatagaagtccgttgcggtccacatgcaaagccgcttcgtcgctttggagccctagcctgctgatgattgcctgcctgaagttgtcaacaccatctagcaggacaggcagcattgcctgcctatttctgacacgttgtcaagctacatacagcacctcttcccataccaacgcttgctccagttcttgtactagtttagtaccatgctgtccaggaccgccctcttccaccgccctgagcaaaatctgggctagcgcccactctgagacatggctctggtgctggcggcagcaccccagttag

SEQ ID NO: 201354 - DNA, 1395 bp, Artificial Sequence
  Description of Artificial Sequence: Synthetic coding sequence
atgagcttcctggagcaggagaacagcagcagctggcccagccccgccgtgaccagcagtagtgagagaatccgggggaaaagacgtgccaaagccctacggtggacgagacagaagagcgtggaggagggcgagcctccagggcagggagagggaccgcggtctagacctgcagcggagagtaccggcctggaggcgactttccctaaaactacgcctctggcacaagccgatcctgctggagtcggaacaccacctacagggtgggactgcctgcccagcgactgcactgctagcgcagctgggagttccacagatgacgtagagctggccaccgagtttcctgctacagaggcctgggagtgcgaactggaaggacttttggaggaaaggcctgctctgtgcctctcaccccaggccccttttcccaaattggggtgggatgacgaactgagaaaacccggagctcaaatctacatgagattcatgcaggagcatacttgctatgacgccatggccacctcatctaagctggtgatcttcgatacaatgctagaaatcaagaaagcgttcttcgctctcgtagctaacggcgtgcgcgctgcccctctgtgggacagcaagaagcaaagtttcgtgggcatgctcaccatcacagactttattctggtccttcaccgctactaccgttcaccgctcgtacagatatatgagatcgagcagcataagattgagacgtggcgggaaatatacctgcaaggatgtttcaaacccctcgtgagcataagccctaatgattcactcttcgaagctgtgtacacccttattaagaatcgaattcaccgactaccagtccttgatcctgtttcaggcaacgtgttgcacatcctcacacataagcgcctgctcaaattcctgcacatctttggaagcctgttacccaggcccagttttctgtatcgcactattcaagatttggggattgggactttcagggatctggccgtcgtcctggagactgcccccatactcaccgccctggatatctttgtggatcggcgtgtctcagccctgcctgtagttaacgaatgcggccaggttgtgggactctattcccggtttgatgtcattcacctagccgcccagcagacttataaccacctggatatgtctgtcggggaggctcttaggcagagaacgctctgtctggagggtgttctcagttgtcagcctcacgagagtctaggagaagtgatcgaccgcatcgcacgagagcaggtccatagactggtgctggtcgatgaaacacagcacttattgggcgttgtctcgctcagcgatatcctccaagcactggtgctgtcccccgccgggattgacgccctgggggcttag

SEQ ID NO: 201355 - DNA, 1470 bp, Artificial Sequence
  Description of Artificial Sequence: Synthetic coding sequence
atggagcccggcctggagcacgccctgcggcggacccccagctggagtagtctgggaggaagtgaacaccaggagatgagcttcctggagcaggagaacagcagcagctggccttccccagccgtcacgtcctcaagcgaaagaattaggggcaaaagaagagcaaaagctttgcgatggactcgtcagaaatctgtagaggagggtgaaccccctgggcagggggaggggccccgttctcgaccagctgcagagagtaccgggcttgaagctacattccctaaaaccacccctctggcccaggccgacccagcaggagtgggcacccctccaacgggttgggattgtctgccctctgactgcacagcttccgcagcaggctcaagtactgacgatgtcgaactcgccaccgagtttcctgcaacagaagcctgggagtgcgaactcgaaggacttcttgaagagcgacctgccctgtgcctgagccctcaagccccctttcctaaactggggtgggatgatgaactgcgtaagcccggagcacagatctacatgagattcatgcaggagcacacgtgttacgacgctatggccacgagttcaaagttagtcattttcgacactatgctcgagatcaaaaaggctttttttgccctcgtcgcaaacggggtgcgagccgcacccctttgggactctaagaagcagtctttcgtagggatgctaacaataacggattttattttggttctgcaccgttactaccgctctccccttgtgcagatatacgaaatcgaacaacacaagattgagacgtggcgggagatataccttcaaggctgtttcaagcccctggtgagtatctcccctaacgactcgcttttcgaagctgtctacactctgattaagaaccgaattcatagactacccgtccttgacccagttagtggtaatgtgctgcatattctgacacataaacgactcctgaaatttttgcacatctttggctccctgctcccaagaccgtccttcctgtatcgcaccatacaagatctgggcattggaaccttccgggacctggccgttgtgctggaaaccgcacccattctaactgccctagatatctttgtggatcgtagggtatccgccttgcctgtcgtgaatgaatgtgggcaagttgtggggctttacagcagatttgatgtgatccatctggccgctcagcaaacctacaaccatctggacatgagtgtcggagaggcgctgcgtcagcgcactctatgccttgaaggtgttctcagctgccagccacatgaatctctgggcgaggttatcgacaggatcgcccgcgaacaggttcaccgtcttgtgttggtggacgaaactcagcacctgctcggcgtcgtctcactgagtgatatactgcaagccctagtgttgtctcccgctggtatagacgcactgggggcatag

SEQ ID NO: 201356 - DNA, 918 bp, Artificial Sequence
  Description of Artificial Sequence: Synthetic coding sequence
atgcggttcatgcaggagcacacctgctacgacgccatggccaccagcagcaaactcgtaatcttcgacacaatgctcgagatcaaaaaggcttttttcgcattggttgctaatggcgtccgcgctgctccactgtgggacagcaaaaaacagtcattcgtggggatgctgacaattactgactttatccttgtgctgcatcggtactatcggagccctctggtgcagatctatgaaattgaacagcacaagatcgagacttggcgggagatctacttgcagggctgctttaaaccgctggtgagcatctctcctaacgattccctgtttgaagctgtgtacacgctaataaagaatcgcatacatagattgccggtcttggatccggtctctggaaacgtgctgcacatcctgacgcataagagactcctgaaattcctccacatcttcggatctctactgcctcggcctagctttctgtataggacaatccaggatttaggcattgggacctttcgggacctggcagtcgtcctggagaccgcccctatactgacggccctcgatatattcgttgatagacgtgtgtcagccctgcccgtagtaaacgagtgtgggcaggtcgttggtctgtactcacggtttgacgtgatacacctggccgcccagcagacctataaccaccttgacatgtccgttggtgaggcactgcggcagcgcactctgtgcctggaaggcgttcttagctgtcagccccacgaatcgctaggtgaagtgatcgaccggatcgccagagaacaggttcataggcttgtcctagtcgatgaaacgcagcatctactcggcgttgtgtcgctcagcgacattctccaagccctggttctgagccccgcagggattgatgcccttggcgcatag

SEQ ID NO: 201357 - DNA, 1056 bp, Artificial Sequence
  Description of Artificial Sequence: Synthetic coding sequence
atgggcaacgccgccgccgccaagaagggcagcgagcaggagagcgtgaaggaattccttgcgaaggccaaagaggacttcctaaagaaatgggagtctcccgcccagaacaccgctcatcttgaccaatttgaaagaattaaaacattaggtacagggtccttcgggagggtgatgttagtcaagcacaaagagactggaaaccactatgccatgaaaatcttagataagcagaaggttgttaagctgaagcagattgagcacactcttaacgagaagagaattctgcaggctgtgaactttcccttcttggtcaagctggagttcagcttcaaggataattcaaacttgtatatggtgatggaatatgtgcctggcggggagatgtttagtcacctgagacgcattggtaggttctcagagccccatgctcgcttttatgccgcccagattgttcttactttcgagtacctgcatagtctggatctgatctatagggatttaaagccagaaaacctcctcatagaccagcagggatatatacaggtgacggacttcgggttcgcgaagagggttaagggccggacctggacactatgcggcacccctgagtacctggccccggagattattctttctaaaggttataacaaagccgtggactggtgggctcttggggtgctcatctacgaaatggccgccggttatccccctttctttgcagatcagcccatccagatttacgaaaaaatcgtctccggaaaagtccggttcccttcccatttcagctcagacttgaaagatctgttgcgcaacctgctacaagtggacctcacaaaacggtttggtaacctcaaaaatggtgtgaacgacattaaaaatcacaaatggtttgccaccacagattggatcgccatttatcaaaggaaggttgaggcaccctttattccaaaattcaaagggcctggcgatacctcaaatttcgacgactacgaggaggaggagatccgggtcagcatcaatgaaaagtgtggaaaagaattcagtgaattctag

SEQ ID NO: 201358 - DNA, 1032 bp, Artificial Sequence
  Description of Artificial Sequence: Synthetic coding sequence
atggccagcaacagcagcgacgtgaaggagttcctggccaaggccaaagaggattttctcaagaagtgggagagccccgcacaaaacacagcccatctggaccagttcgagcggattaaaaccttagggacgggatcgtttgggcgcgtaatgcttgttaagcataaggagaccggaaaccactatgctatgaagatattagacaaacagaaggtcgtgaaactgaaacagattgagcataccctcaacgaaaagaggatcctgcaggctgtgaactttccctttttagtcaaactggagttttcattcaaggataattcaaatctgtacatggtcatggagtacgtcccgggcggcgagatgttttcgcatctcagacgcattggccgtttttcagagcctcatgccagattctacgcagcgcagatagtcttgaccttcgagtacctgcacagtctcgacctgatttacagagacttaaagccagagaatctcctaattgaccagcagggctacatccaggtgacagattttgggtttgccaagcgcgtgaagggtcggacttggacattgtgcggaacacctgaatatctcgcccccgagatcattctctccaagggatataacaaagcggtagattggtgggcactgggtgtgctcatatacgaaatggccgccggctaccccccattttttgcggatcaacccatccaaatctacgaaaagattgtgtcgggcaaggttaggtttccttcacattttagctctgatctgaaagatcttctacggaaccttctgcaagtggatctgaccaaaaggtttggaaatcttaagaacggggtgaatgacattaaaaaccataaatggttcgctaccaccgactggattgccatttatcaacgaaaggttgaagcaccatttatccctaagttcaaggggccgggagatacatctaattttgatgactatgaggaagaggagatcagagtctcaatcaatgaaaagtgtggtaaggaattttcagagttctag

SEQ ID NO: 201359 - DNA, 1056 bp, Artificial Sequence
  Description of Artificial Sequence: Synthetic coding sequence
atgggcaacgccgccgccgccaagaagggcagcgagcaggagagcgttaaggagtttttagcaaaagcaaaggaggacttccttaaaaagtgggaaagccccgctcaaaataccgcacacttggatcagttcgaacgcattaagacactggggaccgggtctttcgggcgcgtcatgctggtgaagcataaagaaacagggaatcactacgccatgaaaatcctggataagcagaaagttgtgaagctcaagcaaatcgaacatacactgaacgagaagaggattttgcaggccgtcaattttccattcctggtaaagttagagttttcattcaaagataattcaaatctttatatggtgatggagtacgtgccgggcggtgagatgttctcgcatctgcggcgaataggcagatttagcgagcctcatgcacgcttttatgctgcccagatcgtgctgacatttgagtatttacactccctcgatttaatatatcgggacctgaaacccgaaaatctgcttatcgatcaacagggctatattcaggtgacagatttcggattcgccaagcgggtgaaaggccggacctggacattatgcgggaccccagaatacctggctcccgagatcatactctcaaaaggctataataaagccgtggactggtgggccctgggggtgctcatctatgaaatggccgcaggctacccgccatttttcgcagatcagccgatccagatctatgaaaaaatcgtgagtggtaaagtgcgcttcccaagccatttcagctccgatctgaaagatctactgcgcaatctactccaagtggacttgactaaaaggttcggcaacctcaagaatggtgttaatgacatcaagaatcacaagtggttcgctactactgattggattgccatttaccagcgcaaggtcgaggcccctttcattcctaaattcaaaggcccaggagacacatccaactttgatgactacgaagaagaggaaatccgcgtgagcattaatgagaagtgtggcaaggagttctcggagttctag

SEQ ID NO: 201360 - DNA, 693 bp, Artificial Sequence
  Description of Artificial Sequence: Synthetic coding sequence
atgctggtgaagcacaaggagaccggcaaccactacgccatgaagatattagacaagcaaaaggtagtgaaattgaaacagatcgaacataccctgaatgagaagagaatactgcaggccgtcaatttcccattcctagttaagctcgaattcagttttaaggacaactcaaacttgtacatggtcatggaatacgtgcccggaggcgagatgttcagccaccttagacgtattggccgcttcagcgaaccccatgctcgattctatgcagctcagattgtgctaacttttgaatacctgcacagtttagatctcatctatcgtgatctcaaaccggaaaacctcctcattgaccagcaaggatacattcaggttacggactttgggtttgcaaaacgtgtcaaaggcaggacctggacactttgtggcactccggagtatctggctcccgaaatcattctcagtaagggatacaacaaagctgttgattggtgggcactgggagttttaatttatgaaatggccgccggttatccaccctttttcgctgatcaacctatacaaatctatgagaagatcgtgagcggtaaggtgcggagtggatgtggcgacaccgcactcgaagagactgatcggagcctgctgacgcaccctatcccatggggggccctgttggttgttcggataatatag

SEQ ID NO: 201361 - DNA, 1074 bp, Artificial Sequence
  Description of Artificial Sequence: Synthetic coding sequence
atgggcctgagccggaagagcagcgacgccagcgcctgcagcagcagtgagatttctgactttgtcaaggagtttttagcaaaagccaaagaggattttctgaaaaagtgggagaaccctactcagaataacgccggactcgaagactttgagcggaagaagacactcggcactgggtcttttggcagggttatgctggtgaagcacaaggcaactgaacagtattacgctatgaagatcctagataagcaaaaggtggttaaactgaagcaaatcgagcacaccctgaatgaaaagcggatcctgcaagccgttaactttcctttcttggtgcgattggaatatgcatttaaagacaacagcaacctgtatatggttatggagtacgttcctgggggcgagatgtttagccatttaagacggattggacggttttccgaaccccatgctaggttttacgctgctcagatcgtgctcacctttgagtatctccatagtctcgatctgatctacagggaccttaagcccgagaatctgttaatagaccatcaggggtatattcaggtgacagatttcggatttgctaagcgagttaaaggacggacatggaccctatgtgggacgcccgaatatctggctcctgagatcatactgtccaaagggtacaataaggccgtcgattggtgggccctgggcgtgctgatttatgaaatggctgcgggctaccctccattttttgccgatcagccaatccagatctacgaaaagatcgtgtctggtaaagtgcgcttcccttcacacttctcatctgatctcaaggacctgctccggaatctgcttcaggtggatctaaccaagaggttcgggaacctgaaaaacggagtctctgacatcaaaacccacaagtggttcgcgactactgactggatcgcaatctatcagagaaaagtggaggcaccgtttattccaaagttccgtgggtccggtgataccagcaattttgatgattatgaagaagaggatatcagggtgagcatcactgagaagtgtgcaaaagaattcggcgagttctag

SEQ ID NO: 201362 - DNA, 795 bp, Artificial Sequence
  Description of Artificial Sequence: Synthetic coding sequence
atgagcgcccggaagagcagcgacgccagcgcctgcagcagcagcgaaatttctgactccttcgtcaaagaattccttgctaaggcaaaagaagacttcctcaaaaaatgggaaaaccccacgcagaataacgctggactcgaagacttcgagcggaaaaagacacttggcaccggatcctttggccgcgtcatgttggtgaaacacaaggccaccgagcagtactacgccatgaagatcctggacaaacagaaggtggtaaagctaaaacagatagaacacacactgaacgagaagcggattctccaagctgtcaattttccctttttagtgcggttggagtacgcattcaaggataacagcaatctgtacatggtcatggaatacgttcctggaggggagatgttttcccatttgaggcgaatcggtagattctccgaaccacatgcccgtttctacgctgcgcagattgtactgacatttgagtatttgcattcccttgatttaatttatcgggatttgaagcccgagaacttactcatagaccaccaaggctatatccaagtcacagacttcggttttgccaagcgggtaaaagggcgcacttggaccctctgcggaaccccagagtacttggcacctgagatcattctgtccaagggctataacaaggcggttgattggtgggctttaggagtccttatatacgaaatggcagcaggatatcctcccttttttgctgatcagccaattcaaatctatgagaagatcgtctcgggcaaacagaatttctag

SEQ ID NO: 201363 - DNA, 942 bp, Artificial Sequence
  Description of Artificial Sequence: Synthetic coding sequence
atgcccgacctgaagatcctgaagggcaagaccctgggcaccggcagcttcggcagggtaatgctagtcaaacacaaagctacagagcagtactatgccatgaaaatcctcgacaagcaaaaggttgtcaaacttaagcagatagagcataccttgaacgagaagcgaattctgcaagccgtgaatttccccttcttagtgagacttgagtatgcattcaaagataactcaaatctgtacatggtgatggagtacgtgcccggaggtgagatgttcagtcatctccgtcgaatcggcaggttctctgagcctcacgcccggttttatgccgcacagatcgtcctcacgttcgagtacctgcacagcctggatttaatctaccgagacctgaagcccgagaacttactcatcgaccaccaaggttacatacaggtgaccgattttgggtttgcaaagcgggtcaagggccggacatggacactttgcggcacccccgagtacttggctcccgagatcattctatctaagggctataacaaggccgtggattggtgggcactaggcgtgctgatttatgaaatggccgccgggtatcctccctttttcgcagaccagccaattcagatctatgaaaagattgtgagtggaaaggtgcgattcccttcccacttctcatccgacttaaaggacctcctccgaaacctgctccaagttgacctgacgaagcgatttgggaatctgaagaatggggtgtctgacattaagacccacaaatggtttgcaaccacggactggatcgcaatataccagcgcaaggtggaggctccttttattcctaagttcaggggctccggtgacacctcaaatttcgacgactacgaagaggaggacattcgggtcagtatcactgagaagtgtgccaaagaatttggggaattttag

SEQ ID NO: 201364 - DNA, 1068 bp, Artificial Sequence
  Description of Artificial Sequence: Synthetic coding sequence
atgggcctgagccggaagagcagcgacgccagcgcctgcagcagctccgagatttctgtgaaggagttcctggccaaagccaaggaggactttctgaagaaatgggaaaatcctactcagaacaatgctggacttgaggactttgagcggaagaaaacattgggtactggtagcttcggcagagtgatgctcgtcaaacataaggcaactgaacaatactatgcaatgaagattctggacaaacagaaggtagttaagctgaaacagattgaacatacactaaacgagaagagaattcttcaagccgtcaacttcccctttctggtgcgacttgaatacgcttttaaggacaattctaatctgtatatggtgatggaatatgtccccggtggggagatgttctcacacctgaggcggattggacgctttagcgaacctcatgctcgattctacgccgcccaaatcgtactgacatttgaatatttgcattccttggacctgatatatcgcgaccttaaacctgaaaacctcctgattgatcaccaaggctacatacaagtgactgatttcgggtttgcaaagagagtgaaaggaagaacatggaccctgtgtggaactcctgagtaccttgcacccgagataatcttatcaaagggctacaacaaagccgtggactggtgggcactgggcgtgttgatctatgaaatggccgccgggtacccaccgtttttcgccgaccaacccatccagatttatgagaagatcgtctccggcaaggtgcggttcccaagccatttttcttccgatcttaaggatttactgagaaacttgctgcaggtggacctcacaaaacgcttcgggaacctgaagaacggtgtgtcagacataaaaactcacaaatggtttgctacaaccgactggatcgctatataccagcgcaaggtcgaggccccattcatccctaagttcaggggtagcggcgataccagtaatttcgatgactatgaggaagaggacatacgcgtgagtattaccgaaaaatgcgccaaggagtttggagaattctag

SEQ ID NO: 201365 - DNA, 738 bp, Artificial Sequence
  Description of Artificial Sequence: Synthetic coding sequence
atgggcctgctgaaggagttcctggccaaggccaaggaggacttcctcaagaagtgggagaaccctactcaaaacaacgccggcttggaggactttgagcgaaagaagactctgggtacgggctccttcggcagggttatgcttgtgaagcacaaagctacagagcaatactacgcaatgaagatcctcgacaaacagaaggtcgtgaaactcaagcagattgaacacaccctcaacgagaagcgaattctgcaagctgtgaattttccattcctggtacgtctcgaatacgcatttaaggataattctaacttgtatatggttatggaatacgtgcctgggggggagatgtttagtcatctaaggcgaattggtcggttcagtgagccacacgcccggttctatgcagcacagatcgtgctaacttttgagtacctacattctctggacctaatctaccgtgacctgaagcccgaaaacctgctgatcgatcatcaggggtatattcaagttactgactttgggttcgctaaaagagtcaagggaaggacatggacactgtgcggcactcccgagtatctagcaccagagattatcctctctaaaggctacaacaaggccgtcgattggtgggccctcggggtattgatctatgaaatggctgccggttacccccctttcttcgccgatcaaccaatccaaatctatgaaaagattgtcagtggaaagaatttttag

SEQ ID NO: 201366 - DNA, 1197 bp, Artificial Sequence
  Description of Artificial Sequence: Synthetic coding sequence
atggccgcctaccgggagcccccctgcaaccagtacaccggcaccaccactgcgcttcagaaacttgagggcttcgcttcccggctgtttcaccggcactcgaagggtacagcacacgatcagaagaccgcactggaaaacgatagcctgcactttagcgagcataccgcgctttgggatcgatcaatgaaagagtttctggccaaggctaaggaggattttctaaagaaatgggagaatcccacccagaacaatgcgggacttgaagacttcgagaggaagaaaacattgggaaccggttcatttggcagggtcatgcttgtaaaacacaaggctaccgaacagtactacgcaatgaaaatcctcgataaacagaaggtggtcaaattgaagcaaatagagcatactctcaatgagaaaagaatcctgcaggcagttaactttccattcttggtgcgtctcgagtacgccttcaaagacaattccaacctctacatggtaatggaatacgtgcccggcggcgaaatgttctcacacctccgacgaatcgggcgctttagcgaaccccacgccaggttttatgcggcccaaattgtcttgacattcgagtacctccactccctcgacctaatttacagagatttaaagccagagaacctgttaattgatcatcaggggtatatccaagtgactgacttcggttttgccaaacgggtcaaaggtagaacttggactttgtgtggtacgccagaatacctggcccccgaaattattctgtcgaagggctacaacaaagctgtggattggtgggcactgggcgtgctgatttacgagatggctgccggctaccctccattctttgctgatcagcccattcagatctacgagaaaatagttagtggcaaggtgagatttccttcccacttcagcagcgacctgaaagacttactccgcaatcttttgcaagtggacctaactaagagatttgggaatctgaaaaatggtgtgagcgatatcaaaactcacaaatggttcgctacaaccgactggattgccatataccagaggaaagtggaggctccattcatacccaaattcaggggctcgggtgatacctccaacttcgacgattatgaggaagaggacatccgagtaagtattacggaaaagtgcgccaaagaattcggggagttctag

SEQ ID NO: 201367 - DNA, 774 bp, Artificial Sequence
  Description of Artificial Sequence: Synthetic coding sequence
atgggcaacgccgccaccgccaagaagggcagcgaggtggagagcgtcaaggaattcctggccaaggccaaagaagactttttaaagaaatgggaaaatcccacacagaacaatgccggtctggaagacttcgagcgcaaaaagactctggggacaggttcttttgggcgggtaatgcttgtgaagcacaaggccactgaacagtactacgccatgaagatcctggataagcagaaggtggtgaaactgaagcagatagagcatacactaaatgagaaacgtatcctgcaagccgtgaactttccctttttggtgaggctggaatatgcctttaaagacaatagtaatctttacatggtgatggagtacgtgccaggcggcgaaatgttcagccacctgcggcgaatcggacgcttctcagaacctcacgccaggttctatgccgctcagattgtgcttacgttcgaatacctacactcacttgatctgatatatagggacttaaagcctgagaaccttttgatagaccatcaggggtacattcaggtgacggattttgggttcgcaaagcgcgttaaagggaggacttggacactgtgcggcacacctgagtacttggctcccgaaattatcttatctaagggctataacaaagctgtcgattggtgggcgctcggggtgttaatatacgagatggccgctggatatcctccctttttcgccgaccagccgatccaaatctatgagaaaattgtgagcggcaaaaatttctag

SEQ ID NO: 201368 - DNA, 1056 bp, Artificial Sequence
  Description of Artificial Sequence: Synthetic coding sequence
atgggcaacgccgccaccgccaagaagggcagcgaggtggagagcgtgaaggagtttctggcgaaagccaaagaggactttctgaagaaatgggagaacccgactcaaaacaacgcagggctggaggacttcgagcggaagaagacactggggacaggttcatttggacgcgttatgctcgttaagcataaagcaaccgaacagtactacgccatgaaaatactggacaaacagaaggtggtcaaactgaagcagatcgagcacactctcaacgagaagcgaatcttacaggcagtgaactttccgtttcttgtcagactggagtacgccttcaaagacaattctaacttgtatatggtcatggagtatgtgccgggaggcgaaatgttttcccacctccgacgtatagggaggttcagcgagccacatgcacggttttacgcagcccagattgtcctgacgtttgagtacctgcactccttggacctgatctacagagacctaaagcctgaaaatctgctgatagatcatcaggggtacattcaagtgacggattttggctttgcgaaacgcgttaagggccgcacgtggacattatgcggaaccccagagtacctggccccagaaatcatcttatccaaaggttacaacaaggccgtggactggtgggcactgggcgtcttgatctatgagatggcggcggggtacccacctttttttgccgaccagccaattcaaatatacgagaaaatcgtatctggtaaggtcagatttccaagccatttttcctcagatctgaaagatcttctgcggaatctgcttcaggttgacttgaccaagcgattcgggaacctcaaaaacggtgtgagcgatattaagacccacaagtggtttgccacaacagactggattgcaatatatcagcgtaaggtagaggccccctttatacctaagttccgcgggtcaggagacaccagcaactttgatgactatgaggaggaggatatccgggtaagtattacagagaaatgcgccaaggagttcggtgagttctag

SEQ ID NO: 201369 - DNA, 1077 bp, Artificial Sequence
  Description of Artificial Sequence: Synthetic coding sequence
atgggcctgagccggaagagcagcgacgccagcgcctgcagcagctctgagatatcagactctttcgtgaaagagttcctagcaaaggccaaggaggattttctcaagaaatgggagaaccccacacagaacaatgccggactcgaagacttcgagagaaagaaaactctcggtaccggaagcttcggacgggtcatgctggttaagcataaggctactgagcagtattatgccatgaaaatcctcgacaaacagaaagttgtcaagctcaagcagatcgagcacacacttaacgagaaacgcatcctgcaggccgtgaatttcccattcctagtgaggctggagtacgcgtttaaggataatagtaacttatacatggtgatggagtacgttcctggtggcgagatgttcagccatctccgccgcataggccggttttcagagccgcatgctaggttctatgcagcccagattgtgttgacatttgaatatctgcactccctcgacctaatctatagagatctcaaaccagagaacttacttatagaccaccagggttacatccaggtgactgactttggatttgccaagcgcgtgaaaggccgcacgtggactctgtgtggcacgcctgagtacttggcaccagagataatactgtccaaggggtacaacaaggccgtggactggtgggccctgggggtgttaatctatgaaatggctgcaggttatcctccgttctttgcggaccaacctatccaaatctacgagaaaatcgtttccgggaaagtgcgcttccccagtcacttcagctctgacctgaaggacctccttagaaacttactgcaggtggatctgacaaaaagattcggtaacctcaagaatggtgtgtctgatataaagactcacaagtggtttgccaccaccgactggatagctatataccagaggaaggtggaggcccctttcatacccaaatttagaggcagtggtgacacgtctaatttcgatgactacgaggaagaggatatcagggtgtccatcaccgaaaaatgtgcaaaggagtttggagagttctag

SEQ ID NO: 201370 - DNA, 966 bp, Artificial Sequence
  Description of Artificial Sequence: Synthetic coding sequence
atgagcgcccggaagagcagcgacgccagcgcctgcagcagcagcgaaatatctgtgaaggaatttctggctaaggccaaagaagattttcttaagaaatgggaaaatcccacgcagaacaacgctgggctggaggacttcgagcggaaaaaaacgttgggtaccggctcctttgggagagttatgctggtgaaacataaggctacggagcagtactacgccatgaagatacttgacaagcagaaggataatagtaacctttacatggttatggagtacgtgccaggtggcgagatgttcagtcacctgagacgcatcgggcgcttctcagaaccccatgcacgattttatgcagctcagattgtccttacttttgaatacttgcattccttggatctaatttaccgggacttgaaaccagagaatctcctcatcgatcatcaagggtatattcaggtcacagacttcgggttcgcgaagagagtcaagggacgaacttggactctgtgcggcacacccgagtacctcgctcccgaaataattctgtcgaagggctataataaagctgtcgactggtgggcactcggcgtcttaatctacgagatggcagcagggtacccaccgttcttcgctgatcagcccattcaaatctacgaaaagatcgtgagcgggaaggttcgcttcccttctcacttctcgtctgacctcaaggacctgctgaggaacctgttacaagttgaccttactaaacggttcggaaatctcaaaaacggtgtctcagacatcaagacacacaagtggttcgctacgaccgactggatcgccatttatcagaggaaggtggaggcaccatttataccaaagtttagaggcagtggcgataccagtaattttgacgactatgaggaggaagatattcgcgttagtatcacggagaagtgcgccaaggagtttggggagttctag

SEQ ID NO: 201371 - DNA, 630 bp, Artificial Sequence
  Description of Artificial Sequence: Synthetic coding sequence
atgagcgcctgcagcagcagcgagatcagcgtgaaggagttcctggccaaggcgaaagaggattttctgaagaagtgggagaaccctacccagaataatgcgggtctcgaagactttgagaggaagaagactctggggacaggaagcttcgggcgagtgatgctcgtcaaacacaaggctaccgaacaatattatgccatgaaaattttagacaagcagaaggtcgtcaagttgaaacagatagaacacactctgaatgaaaagagaatactccaggctgtgaattttccttttctggtcagattagagtatgctttcaaagacaactccaatctttacatggttatggagtatgtgcctggcggggagatgttttcccacctcaggaggatcggtagattttcagaacctcatgctagattctatgcagcacagatcgtgctcacatttgaatatctccactcccttgaccttatttaccgggacttgaaacccgaaaatttactgatcgatcatcagggttacattcaagtgactgattttggatttgccaaacgcgtaaaggggcgcacctggaccctatgtggcaccccggaatacctggctcccgagattattttgtcgaagtag

SEQ ID NO: 201372 - DNA, 594 bp, Artificial Sequence
  Description of Artificial Sequence: Synthetic coding sequence
atgagcgtgaaggagttcctggccaaggccaaggaggacttcctgaaaaagtgggagaaccccacacagaacaatgcgggacttgaagacttcgagcggaaaaagaccctgggcaccggatcatttggccgcgttatgcttgtgaaacataaagccacggagcagtactatgctatgaagatcctggataagcaaaaagtggtgaagttgaagcaaattgagcatacccttaatgagaaacgtattctgcaagctgtgaactttccgtttctggtacgcctggagtatgcttttaaggataactctaacctgtatatggtgatggaatacgtccctggaggcgagatgttcagccacctgaggcgcattgggaggttctccgaaccccacgccaggttttatgcagcccagatcgtgctcactttcgagtacctacatagcctagatctgatctaccgtgaccttaagccagagaatttactcatcgaccaccagggctatattcaggtgacagatttcggattcgctaagcgtgtgaaaggccgtacatggacactatgtggcacacccgagtacctggctccagaaatatag

SEQ ID NO: 201373 - DNA, 645 bp, Artificial Sequence
  Description of Artificial Sequence: Synthetic coding sequence
atgggcctgagctgcagcagcagcgagatcagcgtgaaggagttcctagctaaggccaaggaggatttcctgaaaaagtgggagaatccgacccagaataatgcaggcctggaagactttgaaagaaagaagacactaggaaccggctcttttggtagagttatgctggttaagcacaaggccacagagcagtattatgctatgaagattcttgataagcaaaaagtagtaaagctgaaacagattgaacataccctcaatgaaaagaggatactccaagcagttaattttcccttcttagtacgactggagtacgccttcaaagacaactcgaatctgtacatggtcatggagtacgtacccggaggcgagatgttcagccatctgagaaggattgggcgtttctccgagcctcacgccagattttacgctgcccagatagtcctgacctttgaatacctgcattccctagacctgatctaccgggacctgaagcccgagaatcttcttatcgatcaccaggggtatatccaggtcacagactttggatttgccaaaagggtcaaaggtcggacctggacactatgtggtacccccgaatacctggcaccagaaatcatcttatctaaagggtacaataagtag

SEQ ID NO: 201374 - DNA, 561 bp, Artificial Sequence
  Description of Artificial Sequence: Synthetic coding sequence
atgggcctgagccggaagagcagcgacgccagcgcctgcagcagcagcgagatttccgttaaggaatttttagcaaaggccaaagaggatttcttaaaaaaatgggaaaatccgacacagaataatgcaggcctggaggattttgaaaggaaaaaaacactcggaacagggtcatttggcagagtgatgctagtgaaacacaaagcaacagagcaatattacgccatgaaaatcttggataaacagaaagtcgtcaagttgaagcagatagaacatacactgaacgaaaagagaatcctccaggccgtcaacttcccgtttcttgtgcgacttgaatacgccttcaaggataattctaacttgtacatggtaatggagtacgtgccaggtggtgagatgttcagtcatctccggcggatcgggagatttagcgagccccacgccaggttttacgcagcacagatcgtacttactttcgaatatctgcactcactcgatctgatttatagagatctgaagcctgagaatttgctgattgaccatcaagggtacattcaatag

SEQ ID NO: 201375 - DNA, 528 bp, Artificial Sequence
  Description of Artificial Sequence: Synthetic coding sequence
atgggcctgagccggaagagcagcgacgccagcgcctgcagcagctccgagatttcagatagctttgtgaaagaattccttgctaaagctaaggaggattttctgaagaaatgggagaacccaactcagaataacgcaggcttagaggattttgaaaggaaaaaaacactgggtactggctcctttggccgcgtcatgttagttaagcataaagccaccgaacagtactatgcgatgaagatactggacaagcagaaagtggtgaaactgaagcagatagagcacaccctgaacgagaaaagaatcctgcaggctgtgaacttcccatttctagtccgtttggagtacgccttcaaggacaacagcaatctctatatggtgatggaatacgtacctgggggcgagatgttctcccacctcaggagaatcggtcgattcagcgagccacacgctagattctacgcagctcagattgtgctaacgttcgagtaccttcattccttagacctaatatatcgtgatttgtag

SEQ ID NO: 201376 - DNA, 621 bp, Artificial Sequence
  Description of Artificial Sequence: Synthetic coding sequence
atgagcgcccggaagagcagcgacgccagcgcctgcagcagcagcgagatatctgtgaaagagtttttagctaaagcaaaggaagacttcctcaagaagtgggagaatcccacacaaaacaatgccggtcttgaggatttcgagaggaaaaaaacattgggtacagggagttttggccgtgtgatgctcgtcaagcataaagcaacagagcagtactacgctatgaagattttggataaacagaaagtggtgaaactgaaacagattgagcacaccttgaacgagaaaagaatcttgcaggctgtgaatttccctttcctggtgagactcgaatacgccttcaaggacaactcaaacctgtacatggtcatggagtatgtcccagggggcgagatgttttcgcatctcaggaggatcggcaggttctctgaacctcacgctaggttttacgccgcgcagatagttctgacgttcgagtaccttcacagcttggacttgatctaccgcgacctgaagccagagaatctgctaattgatcaccaggggtatatacaagtgacggacttcgggttcgcgaagagggtcaaaggcaggacatggaccctctgcggcacaccttag

SEQ ID NO: 201377 - DNA, 1056 bp, Artificial Sequence
  Description of Artificial Sequence: Synthetic coding sequence
atgggcaacgcccccgccaagaaggacaccgagcaggaggagagcgtgaacgagtttctggcaaaagccaggggcgatttcctgtaccgctggggcaaccctgcccaaaacaccgcctccagcgatcagttcgagagactgcggaccttgggcatgggcagttttggacgagttatgctcgtgaggcatcaagaaacaggagggcattatgctatgaaaattttaaacaaacaaaaagtcgtgaagatgaagcaagtggagcacatcttgaacgaaaaacggatcttacaggctatagacttccccttcttggtaaagttacagttctcatttaaggacaactcgtacttgtacctcgttatggaatatgttccagggggggagatgttttcccgcctccaacgtgtgggaagattcagcgaaccgcatgcttgcttttatgccgcacaagtggtgttggcggtacagtacctccactctctcgacttgatccaccgggacctgaaaccagagaacctgctgatcgatcagcagggctacttgcaagtgaccgacttcgggttcgcgaagcgagtgaagggacgcacctggactctgtgcggtacacctgagtacctggccccagaaattattctgtctaaagggtataacaaggctgtggattggtgggccctaggcgtgttaatttacgaaatggcggtgggtttcccaccattttacgccgatcaaccaatccaaatttatgaaaaaattgtgtccggaagggttagatttcccagtaagctgtctagtgacctgaaacacctcctgcgatccctcctccaggtcgatctgacgaagcgcttcggaaatctgcgaaacggcgtaggcgatattaagaaccacaaatggttcgccaccacgtcctggatcgcgatttacgaaaagaaggtcgaggcaccctttatcccaaagtacacaggccccggcgatgcgagcaactttgacgactacgaggaggaggaactgcgtatcagcattaacgagaagtgcgcaaaagagttttctgagttctag

SEQ ID NO: 201378 - DNA, 1146 bp, Artificial Sequence
  Description of Artificial Sequence: Synthetic coding sequence
atggagagcggcagcaccgccgccagcgaggaggcccggagcctgcgggagtgtgagttatacgtgcagaaacacaacattcaggcccttctgaaggattccatcgtacagctttgcacagcaaggcccgagcgacccatggccttcctcagagagtatttcgagagattagagaaggaggaggccaaacagattcaaaacctgcagaaggctggcacacggaccgactcgagagaggatgaaatctccccacctccgcctaatcctgtcgtcaagggacggaggagacgaggagcgattagtgctgaagtgtacacggaggaagacgccgccagttatgtacgaaaagtgatcccaaaagactacaagacaatggccgctctggctaaggctatcgaaaagaatgtgctgttttcccatctggacgacaatgaacgctcagacatcttcgatgccatgttttcggtgtccttcatagccggcgagactgtaatccaacagggagacgagggagacaatttttacgtcatcgatcagggggaaaccgacgtctatgtgaacaacgaatgggccacttccgtgggggaaggggggtcttttggagaactggctcttatttatggcacacctcgagccgctactgtgaaggcaaaaacaaacgtaaagctctgggggatcgaccgggatagctacagaaggatcttgatgggttcaacccttcgtaagaggaagatgtacgaagagttcctcagcaaagtgagcattctagaatcactggacaagtgggagagactcaccgtggccgacgctttagaaccagtgcagttcgaggatgggcagaaaatcgttgtccaaggcgaaccaggcgatgagttcttcatcatcctcgaggggagtgcagctgtgctacaaaggcgttctgaaaatgaggagttcgtcgaagtcggaagactaggtccgtctgattactttggcgagattgcactgttgatgaatcgaccaagggcggctacagttgtggccaggggccccttgaagtgtgttaaactcgacaggcctagatttgaacgtgtgcttggcccatgcagcgatattttgaagagaaatattcagcagtataactccttcgtcagcctctccgtgtag

SEQ ID NO: 201379 - DNA, 1146 bp, Artificial Sequence
  Description of Artificial Sequence: Synthetic coding sequence
atggagagcggcagcaccgccgccagcgaggaggcccggagcctgagggagtgtgagctttatgtacaaaagcacaacatccaggcgctgctgaaagactctatcgtgcagctttgtactgcacggcccgagcgccctatggcgttcttgagagagtatttcgaaagactagagaaggaggaggctaagcagattcagaatctccagaaggccggtacaagaacagactccagagaggatgaaatttccccgccccctccgaatcccgtggtgaagggacgaagacgtcgcggtgcaatctccgctgaagtctatactgaggaggacgctgcatcctatgtgaggaaggtgattcccaaggattacaaaaccatggcagccctggccaaagctattgaaaagaatgtgctgttctcacacctggatgacaatgaacggtcagatatcttcgatgctatgtttagcgtgagctttatagccggggagaccgtcatccagcagggcgacgaaggcgataacttttacgtgattgatcagggagagacggatgtttacgtgaataatgaatgggctacatcagtcggcgaaggcggatcgttcggcgagctcgcgctgatctatggaacgcctcgcgccgccacagtcaaagccaagaccaatgtgaagctatgggggatcgatcgcgacagttaccgtagaattctaatggggagcacactgcgcaaacggaagatgtacgaagaatttctctccaaggtttcaattttggagtcattggataaatgggagcgactcactgtggccgatgccttggaacccgtgcagttcgaggacggccagaaaatcgtcgtacagggcgaacctggggatgagttcttcattatcttagaagggtcagctgcagtgcttcagcgcaggagtgagaatgaagagttcgtggaggtaggtcgcctcggcccctccgattatttcggagagatcgccctgctaatgaatcgcccaagggctgcaactgtggtggcgcgaggccctttgaagtgcgtgaaattggaccggccgagattcgaacgcgttctgggtccctgttctgatattctgaagcgtaatatacagcagtataattccttcgtgagtctctctgtttag

SEQ ID NO: 201380 - DNA, 1146 bp, Artificial Sequence
  Description of Artificial Sequence: Synthetic coding sequence
atggagagcggcagcaccgccgccagcgaggaggcccggagcctgagagaatgtgagttatacgtccagaaacacaacattcaggctctgcttaaggactctatagtacagctctgcacagcccgccctgagagacctatggccttcttgagagagtacttcgaacggctggagaaggaggaagctaaacaaatacagaacctgcaaaaagctggtacccggacagattctagagaagatgagatctctccacctccaccaaacccggtggtcaaggggagacggcgtagaggcgctatctcagccgaggtgtataccgaggaggatgccgcatcatatgtgaggaaggttattcctaaggactataagacaatggccgcactcgccaaagccattgaaaagaatgtcctgttttctcatctcgatgacaatgaaaggtcagacatcttcgatgctatgttttccgtgtctttcatcgcaggagaaactgttatccaacagggtgatgagggagataatttttatgtcattgaccagggggaaacggacgtctacgtaaataatgaatgggcaacgagcgtcggagaaggaggttctttcggggaactcgcgttaatttatggtacccccagagcagctactgtgaaagcaaagacgaatgttaagttgtggggcattgacagagacagctaccgccgcatcttaatggggagcacactgagaaagagaaagatgtacgaagaattcctgagcaaagtctctattctcgagtccctggacaagtgggagagactgacagtagcagatgctctagaacccgtgcaatttgaagacggccagaagattgtggttcagggtgagcccggcgacgagttttttatcatcctggaggggagcgccgccgttctgcagcgtcgaagcgaaaacgaggaattcgtggaggtggggcgactcgggccaagcgattactttggcgaaattgccctcctcatgaatcgccccagggcagcgactgttgttgcaagagggcctctgaaatgtgtgaaattggacagacctagattcgagagggtgcttgggccatgcagtgacatacttaaacggaacatccagcagtacaattccttcgtctctctttcggtgtag

SEQ ID NO: 201381 - DNA, 1146 bp, Artificial Sequence
  Description of Artificial Sequence: Synthetic coding sequence
atggagagcggcagcaccgccgccagcgaggaggcccggagcctgagagagtgtgaattatacgtacagaagcataatatccaagctctcctgaaggactccattgtacagttgtgcactgcaaggccagagagacccatggcgttccttagagaatatttcgagaggctcgaaaaagaggaggctaagcagatccaaaatttacagaaggccggtacccgcacagactcccgagaggatgaaatcagcccacctccaccaaaccccgtcgtgaaggggcgccgaaggagaggggcaatttcggccgaggtatacacagaggaggacgcggctagctatgtgcgcaaggtcattccaaaggactacaagactatggcggccctggccaaagccattgagaaaaatgtgctcttttcacacctggatgacaatgaacgaagcgacatctttgatgcaatgttctccgtatcattcatcgcgggggaaacggtgattcagcagggcgatgaaggtgacaacttctacgtaatcgaccagggcgagaccgatgtgtacgtcaataacgagtgggcgacctccgtgggagagggcgggtcattcggagagctggcattgatttatggcacccccagagcagcaacagtcaaggcgaaaaccaacgtgaaactgtggggcattgatcgcgatagctaccgtaggatcctaatgggatccacactgcggaagcggaaaatgtacgaagagtttctctccaaggtgagtattctggagagcctggataaatgggagcgcttaacagtagctgacgctctcgagcctgtccaattcgaggatgggcagaaaatagtagtgcagggggagcctggggacgagttctttattatcctcgagggttctgccgcggtactgcagcgtcggtccgaaaacgaagaatttgtagaagtggggcgtctgggtccttcagactattttggcgagattgcgctcctgatgaacagaccgcgggccgcgaccgtggtggctcgcgggccacttaagtgtgtcaaactggaccggccccgttttgaacgcgtcttagggccttgttctgacatcttgaaacggaacatacagcagtacaatagcttcgtatccctatcggtctag

SEQ ID NO: 201382 - DNA, 243 bp, Artificial Sequence
  Description of Artificial Sequence: Synthetic coding sequence
atgggcagcaccctgcggaagcggaagatgtacgaggagttcctgtcaaaggtctcaatcttggaatcgctggagaaatgggagaggctcaccgtagctgacgctctggagcctgtgcagtttgaggatggcgaaaagatcgtcgtacaaggcgagcctggcgacgacttttacatcatcacagaaaagaatctgcctggcgtggttgcacacgcctgtaatccttcatacctgggcggctag

SEQ ID NO: 201383 - DNA, 1146 bp, Artificial Sequence
  Description of Artificial Sequence: Synthetic coding sequence
atggccagcccccccgcctgccccagcgaggaggacgagagcctgaagggctgcgaactgtacgttcagctccatgggattcaacaggtcctgaaggactgcatagtccacttgtgtatctcaaaacctgaacggccgatgaagtttttacgggaacactttgaaaagctggaaaaggaggaaaatcggcagatcctggctcgccagaagagtaatagccagagtgattcccacgacgaagaggtcagtcccacaccaccgaaccccgtcgtaaaggccaggcggagacgaggtggagtgtcggctgaggtatacaccgaggaagatgcagtttcttacgtaagaaaggtaattccaaaagactacaagaccatgacagcccttgccaaggccatcagtaagaacgtgctttttgcacacctcgacgacaatgaacgaagcgacattttcgacgccatgttcccggttactcacatcgccggggagaccgtgattcagcaagggaatgagggcgataacttctacgtcgtggatcagggcgaggtggatgtgtacgtgaacggcgaatgggtcacgaatatcagtgagggcggttctttcggcgaactcgcccttatctacggtactcctcgcgccgcgacagtaaaggccaagaccgacttgaaactgtgggggatcgatagggacagctaccgcaggattctcatggggagcactcttcgtaaacgcaagatgtacgaggagttcctgtcaaaggtctcaattctcgaatctctggagaagtgggaacgacttaccgttgcggatgcgcttgagccagtacaatttgaggatggagaaaagattgtcgtgcaaggggaacctggggacgacttctatatcattactgaaggtactgcctcagtcctgcagagaagatctcctaacgaggagtacgtggaggtgggcagacttggaccatccgattactttggcgagatcgccttgctgctgaataggcccagagcggccaccgtcgtggctagggggcctctgaaatgtgtcaaattggatcgtccccgcttcgagagggtattgggaccttgcagtgaaatcctcaaaaggaacatccaacggtataattccttcatcagcttgacagtctag

SEQ ID NO: 201384 - DNA, 1146 bp, Artificial Sequence
  Description of Artificial Sequence: Synthetic coding sequence
atggccagcccccccgcctgccccagcgaggaggacgagagcctgaagggctgtgagctttatgtgcagttgcacggcatccagcaggtcttgaaagactgtattgtgcacctgtgcatcagtaagccagagaggcctatgaagttcctccgagagcatttcgagaaactggagaaagaggagaaccggcaaattttggccagacaaaagtccaactcccaaagtgattcccacgacgaagaggtttccccaaccccaccaaaccccgtggttaaggcacgccgccgccgcgggggagtctctgccgaagtgtacactgaggaagatgccgtgagctacgtgaggaaagtgataccgaaggattacaagacgatgaccgctctagccaaagccattagcaagaacgttctctttgctcatcttgatgacaacgagcggtccgacatctttgacgcaatgtttccagttactcacattgccggagagacagtgattcagcaggggaacgaaggtgacaatttctatgtcgtggaccaaggtgaagttgacgtctatgtgaatggtgaatgggtgactaatattagcgaaggcgggtcgtttggagaattggcactgatttatggcactcctagggccgctacggtcaaagccaaaacagacctgaagctttggggtatcgacagggacagttacagacgcattctgatgggaagcacgttgagaaagagaaaaatgtatgaggagtttctgtctaaagtcagcatcttagaatcgcttgaaaagtgggagcggctaaccgtcgctgacgcgctggagcccgtgcaattcgaggatggcgagaagatcgtagtccagggggagcctggtgacgacttttacataatcacagaagggactgcctccgtcctgcagcgacggagcccgaatgaggagtatgttgaggtgggtagactgggcccatcagattacttcggagagatcgcgctgttgctgaacagaccccgagctgccaccgtagtggcccggggcccactgaaatgtgttaaactcgacagacccaggttcgagagggtgctcggaccctgtagtgagatccttaagcgcaatattcagcgctacaatagctttattagcctgactgtgtag

SEQ ID NO: 201385 - DNA, 1146 bp, Artificial Sequence
  Description of Artificial Sequence: Synthetic coding sequence
atggccagcccccccgcctgccccagcgaggaggacgagagcctgaagggatgcgaactctacgtgcagctccacggcatccagcaagtgttaaaggattgtatcgtccacctgtgcatatccaaacctgaacgccctatgaaatttctgagggagcattttgagaaactcgagaaggaagaaaataggcagatacttgcgcgacagaaaagtaattctcagtcagacagtcatgacgaagaggtgagcccaacaccgccaaatccagtggtcaaggcccggcgacgaaggggtggagtgagtgcagaggtctacaccgaagaagacgctgtgagctacgtccgaaaggtgatccccaaagattacaaaactatgacagctttggctaaggctatcagcaaaaacgtcctctttgcgcacctggatgacaacgaacgatccgatatctttgatgccatgtttccggttacgcacatagccggtgagaccgtaattcagcagggtaacgaaggagataatttctatgtcgtggaccagggcgaggtggatgtgtacgtgaacggcgagtgggttactaatattagcgaaggggggagtttcggagaactcgcactgatctacgggaccccgagagccgctacagtaaaggccaaaacagatctgaagctgtggggcatagatcgggactcttaccgacgaatcctgatggggagtacgctgaggaagcggaagatgtacgaagagtttttgtcaaaggtatcgatcttggagagcctcgaaaagtgggagagactgacagtggccgacgcccttgagcctgtccagtttgaggatggagagaaaatagtcgtgcagggcgaaccaggggacgatttctacataatcactgaggggacagccagcgtgcttcagagacggagccctaacgaagaatatgttgaggtcgggcgcctgggtccttctgactactttggtgaaattgcgctgctgctgaatcgccctcgggctgccactgttgtggcccggggccctctgaagtgtgtaaagttagaccgcccaagattcgagagggtgctgggcccgtgttctgaaatcttgaaaaggaacatccaaaggtacaactccttcatcagtctgactgtgtag

SEQ ID NO: 201386 - DNA, 498 bp, Artificial Sequence
  Description of Artificial Sequence: Synthetic coding sequence
atggccagcccccccgcctgccccagcgaggaggacgagagcctgaagggctgtgaattgtacgtgcagttacacggaattcaacaggtgttgaaggactgcatcgtccacttgtgcatctccaagcctgagcggccgatgaaattcctgcgtgagcattttgaaaagctggaaaaggaggaaaatcgccagattctggcccgccagaaatccaattcccagtctgactctcacgatgaggaggtctccccaacacccccaaacccagtcgtgaaagctaggcgaaggcgtggcggagtgtctgccgaggtgtacacagaagaagatgcagtgagctacgttaggaaggtcatcccgaaggactacaaaaccatgaccgcgctggcgaaggcgatcagcaaaaacgtgctgtttgcccatttggacgacaacgaacggagtgacatctttgatgcgatgttcccagttacgcatatcgcaggcgaaacagttatctag

SEQ ID NO: 201387 - DNA, 894 bp, Artificial Sequence
  Description of Artificial Sequence: Synthetic coding sequence
atggccagcccccccgcctgccccagcgaggaggacgagagcctgaaggggtgtgaactatacgtacagctgcacggaatccagcaagtgctgaaagattgtattgttcacctatgcatatctaagcctgaacggccaatgaaatttttacgggaacactttgaaaagctggagaaagaggagaacagacagattctcgccaggcagaaatccaatagccagagcgacagccacgatgaagaagtgtcacctactcctcctaaccctgtggtaaaggcccgtaggaggaggggaggggtgagcgccgaggtgtacactgaagaagacgccgtgagttacgtgcggaaagtgattcccaaggactataagacaatgacagctcttgccaaagctatttccaaaaacgtgctgtttgcgcaccttgacgacaacgagcgatctgatatttttgatgccatgtttcctgtcacccacatagccggtgaaaccgtcattcagcaggggaatgagggtgataacttctacgtggtagaccagggggaagttgatgtctatgtcaatggggagtgggtgaccaatatcagtgaagggggcagttttggcgagctagccctgatctatgggactccccgagccgccaccgttaaggcaaaaaccgatttgaaactgtggggcattgatagagacagctacaggcgcatccttatggggtctaccctgcgaaaaaggaagatgtacgaggagttcctatccaaggtgagcattctggagagcctcgaaaaatgggagcgactgaccgtggctgacgctttagagcctgtacagttcgaggacggggagaagattgtcgttcagggggaacctggggatgacttttatatcatcactgagtag

SEQ ID NO: 201388 - DNA, 177 bp, Artificial Sequence
  Description of Artificial Sequence: Synthetic coding sequence
atggccagcccccccgcctgccccagcgaggaggacgagagcctgaaagggtgcgagctgtatgtgcaactgcacgggattcagcaagtcttaaaagactgcatcgtgcatctctgtattagcaaaccggagcgtcccatgaaattcttgcgtgaacactttgagaagcttgagtag

SEQ ID NO: 201389 - DNA, 1146 bp, Artificial Sequence
  Description of Artificial Sequence: Synthetic coding sequence
atggccagcccccccgcctgccccagcgaggaggacgagagcctgaagggttgtgagctgtatgtccagttgcacggcatccagcaggtcctgaaggactgtatagtgcacttatgcatatcaaaacctgaaagaccgatgaaatttttacgcgagcacttcgaaaaactcgagaaggaagaaaatagacagatcctggcacggcagaaaagtaattcacagtccgatagtcatgatgaggaggtatccccaacacccccgaaccctgtggtgaaggcacgacggaggagaggcggcgtttctgctgaagtctataccgaggaagatgccgtcagctatgtccgcaaagtcattcccaaggactacaaaacaatgactgccttagcaaaggcaatttccaaaaacgttctgtttgcacaccttgacgacaacgaacgttccgatatatttgacgctatgttccccgtgacacacattgccggggagaccgtcattcagcagggcaatgaaggcgacaatttttacgtggtggatcagggggaggtggacgtgtatgtgaatggtgagtgggtaactaacatttctgagggtggtagcttcggagagctcgcactgatttatggtacacctcgagcggctacagttaaggccaagacagatctcaagctctggggaattgatagggattcctataggaggatcctgatgggtagtacattgcggaagcgtaagatgtacgaggaattcctctccaaagtcagcatccttgaaagcctcgagaaatgggagcggctaacagtggctgatgctctggagccagtgcagtttgaggatggagagaaaattgtcgtgcaaggcgaacccggcgacgacttctacattattaccgaaggaacagcatccgtgctgcagcggcggtcaccaaacgaagaatatgtcgaggtggggcgtctgggcccaagcgattatttcggggagatcgcactgctactgaaccgccctagagcagccacagtggtggcccggggcccattaaagtgcgtgaaactggatcgccctcggttcgagcgtgtgctcggcccttgcagcgaaatcttaaagagaaatatccagaggtataattcgtttatcagtcttacggtatag

SEQ ID NO: 201390 - DNA, 1146 bp, Artificial Sequence
  Description of Artificial Sequence: Synthetic coding sequence
atggccagcccccccgcctgccccagcgaggaggacgagagcctgaaggggtgcgagctgtacgtgcagctccatgggatccagcaggtgctgaaagattgcatcgtgcacctgtgcattagcaaacccgagcgtcccatgaagtttctgagggaacatttcgagaagctggagaaagaggaaaataggcagatcctcgctagacagaagtccaactctcagtccgacagccacgatgaggaggtgtcccctaccccaccgaatcccgttgtgaaggctcgccggcgaaggggcggagtgtccgctgaggtctacactgaggaagatgcagtcagctatgtgcgtaaagttattccaaaggactataagaccatgaccgccctcgctaaggccattagcaagaatgtgctttttgcgcacttggatgataacgaaaggagcgacatctttgacgctatgtttcctgtcactcatattgcaggagagacagtaattcaacaaggtaacgagggcgataacttctatgtagtagaccagggtgaggtagacgtctatgtgaacggggaatgggtgactaacattagcgagggtgggagcttcggtgagctggccttgatttatggcaccccccgggctgctaccgtgaaggcaaaaactgatctcaaactgtggggcattgacagggatagctatcgtcgaatcttaatgggatctactctgcggaagcgaaaaatgtacgaggagtttctgtccaaggtgtcaatcctggaaagcctggagaagtgggaaaggttgaccgttgccgacgcactggaacccgtgcagttcgaggacggcgagaagattgttgttcagggcgaaccgggtgacgatttttatataattactgaagggacagcctcggtcctgcagcgccgaagccccaacgaggagtacgtggaggtcggcaggctgggaccgtcggactacttcggagaaattgccttacttctcaaccgacctcgagcggccacggtggtagcccgggggccgctaaagtgcgtgaagcttgatcgtccccgttttgagcgagtgctgggaccctgcagtgagatccttaagcggaacattcagcgatacaacagttttatcagtctgactgtatag

SEQ ID NO: 201391 - DNA, 1215 bp, Artificial Sequence
  Description of Artificial Sequence: Synthetic coding sequence
atgagccacatccagatcccccccggcctgaccgagctgctgcaggggtatacagtggaagtcctaagacagcagccacctgacctcgttgaatttgcggtagaatactttactagactgcgggaagctcgggctcctgcctctgtgctccccgccgccactcctcggcagtctttaggacaccctccccccgagcctggacccgatcgagtggccgatgcaaagggcgactctgaaagcgaagaggacgaggatttggaggtgcccgtgcccagcagatttaaccgcagagtcagtgtgtgcgccgagacctataaccctgatgaggaagaagaggacactgaccctcgggttatccaccccaagactgacgaacagaggtgccgtcttcaagaggcctgcaaagacattctgttgttcaagaacctggatcaagaacagttgtcccaggttttggacgccatgttcgaacgtattgttaaggcagatgagcacgtcatagaccagggcgatgacggggacaatttttacgtaatcgaaagaggcacttacgacattctggtcaccaaagataatcagacccgtagcgtcggacagtacgataaccgaggtagcttcggagaactggcattaatgtacaacacacctagagccgcaaccatcgtcgctacttctgaaggcagtctctggggcctggatagggtcaccttccgtcgcataatcgttaaaaataatgcgaagaagcgaaaaatgtttgaatcctttattgagtctgtgcccctcctgaagagtttggaagtgtctgagcgtatgaagatcgtagatgtcatcggcgaaaagatttacaaggacggggagcgcataatcacgcaaggggaaaaggccgatagcttttacatcattgagtctggagaggttagtatcctgattagatctcggactaagtcaaacaaggatggagggaaccaggaagtcgagattgcgcgttgccacaagggccagtacttcggcgagttggccctggtgaccaacaagcccagagcagcgtccgcatacgccgtcggcgacgtgaagtgcttggtgatggacgtccaggcgtttgaaaggctgttgggcccctgtatggacatcatgaaacggaacataagtcattacgaagaacagctcgtgaaaatgttcggctcctccgtggacctaggcaacctggggcagtag

SEQ ID NO: 201392 - DNA, 1149 bp, Artificial Sequence
  Description of Artificial Sequence: Synthetic coding sequence
atgagccacatccagatcccccccggcctgaccgagctgctgcagggttacacagtcgaagtgctgagacagcagccacctgaccttgtggagttcgccgtggagtatttcactagactacgcgaggcccgggcccccgccagcgtgttgcccgctgccactccaaggcagtctctgggccaccccccgcccgagccggggcccgaccgcgtagctgatgctaagggcgacagcgaaagtgaggaagatgaagacctggaggttccagtcccctctcggtttaaccgccgtgtatccgtctgcgctgagacatacaatccggatgaggaggaagaggacaccgacccaagggttattcaccctaaaaccgacgaacagcgctgcaggctccaggaggcctgcaaagacatcctcctctttaagaacctcgatcaggagcagttgagccaagtgctggatgcaatgtttgaaaggatcgttaaggccgacgagcatgtgatcgatcagggagacgatggtgataacttttacgtcatcgaaagggggacttacgatatactggttaccaaagacaatcaaacacgttcagtaggccagtatgacaatcgcggatctttcggcgagctggccttaatgtacaatactccccgcgcagcgacgattgtggcaacgtccgagggatcactctggggcctggaccgcgttacctttagaagaatcatagtaaagaacaatgccaagaagcggaagatgtttgaaagctttatcgaatccgttcctttgttgaagtcgcttgaggtttccgagaggatgaaaatagtagatgtgatcggggagaagatttacaaggatggtgagagaatcatcactcagacaaaatccaataaggatggcgggaaccaggaggtggagatagcaaggtgtcataaaggccagtatttcggggaactagccctcgtcactaacaagccccgggctgccagtgcttatgccgttggggatgtgaagtgcttggttatggatgtgcaggcatttgaacggctcctgggcccttgtatggatattatgaaacgtaatatcagccattatgaagaacagttagttaaaatgtttggttcctcggtggatctgggcaacttggggcagtag

SEQ ID NO: 201393 - DNA, 1215 bp, Artificial Sequence
  Description of Artificial Sequence: Synthetic coding sequence
atgagccacatccagatcccccccggcctgaccgagctgctgcaggggtacaccgtagaagtgctccgtcaacagccgcccgacctggtggaattcgccgttgagtactttaccaggctgagagaagctcgcgccccagccagtgtcctgcctgcggcaacccctcgacagtccctcgggcaccctccgcctgagccgggaccagacagagttgcagatgcgaaaggtgatagcgagagcgaagaggacgaggatctggaagtgcccgtacccagccgttttaataggcgagtctcagtgtgcgcagaaacatacaatccagatgaggaggaggaagacacggatcctagagtgatccatcctaagactgatgaacaacgctgcagattgcaggaagcatgcaaggatatcctgctcttcaagaatttggaccaggaacaattgagtcaagtgttggatgcaatgttcgagagaatcgtgaaggccgacgagcatgtgattgaccagggagatgatggggacaacttttacgtcattgagagaggtacctatgacatactggtcactaaagataatcagacgcgcagcgtcgggcaatatgataatcgcgggagcttcggcgaattagccctaatgtacaatacacctagggctgctactattgttgccacatcagagggctcgctctggggcctagatcgtgtaacatttcgccgcatcatcgtgaagaataacgctaaaaagcgaaaaatgttcgagtccttcattgaatctgtgcccctcctgaagagtttagaagtgtctgaaaggatgaaaatcgtggacgttattggagaaaaaatttacaaggatggcgagcgcataataacccagggggagaaagccgacagcttctatatcatagaatcgggtgaggtgtccatactgatcagatcccggaccaaatccaacaaggatgggggtaaccaggaagtcgagatcgctagatgtcacaaaggtcagtattttggggaacttgcgctcgtgactaataaaccgcgggccgccagcgcttatgccgtgggggacgttaaatgtctcgtaatggacgtgcaggccttcgaacggctgctgggaccttgcatggatataatgaaaaggaatatctcccactacgaggagcagttagttaagatgtttgggtcttccgtagatctggggaaccttggacagtag

SEQ ID NO: 201394 - DNA, 1257 bp, Artificial Sequence
  Description of Artificial Sequence: Synthetic coding sequence
atgagcatcgagatccccgccggcctgaccgagctgctgcagggcttcacggttgaagtcttgaggcaccagccggcggatctactagagttcgcccttcagcacttcacccgcctgcagcaggagaatgagagaaaggggactgctcggtttgggcacgaggggcggacatggggtgatcttggagcagctgccgggggagggacacctagcaagggagtaaactttgcggaggagccaatgcagtcagactcggaagacggggaagaagaagaagccgcaccagcggatgctggcgcatttaacgcccctgtgataaataggtttacgcgacgtgcaagcgtctgtgcagaggcttataaccccgatgaggaagaagacgacgcagagtcaaggattattcacccaaaaaccgatgaccaaaggaaccgcctccaggaggcttgtaaagatatccttctgttcaaaaacctggatccggaacaaatgtcgcaggtgctggacgccatgttcgagaagttagtaaaagatggggaacatgtaatcgatcagggcgatgacggagataatttctacgtgatagaccgcgggacctttgacatctacgtaaagtgcgacggagttggccgttgtgtgggcaattacgataaccgggggtcctttggcgaactcgcactgatgtacaacactccaagagccgccaccatcacagccaccagtcctggggctctctgggggttggacagagtcactttcaggcggattattgttaaaaacaacgctaagaagagaaagatgtatgaaagctttatcgagtcactaccctttctgaaatccctggagttctcggagaggttaaaagttgtggacgtcatcgggactaaggtttataatgacggggagcagattatcgctcagggcgattcagccgattctttttttatcgtggagtctggggaggtgaagatcactatgaagcgtaagggcaagtcggaggtggaagaaaatggagctgtcgaaatagcgcgctgtagccgcggccagtattttggggaactggccctggttacaaataaaccccgtgccgctagcgcacacgctataggcacagtgaagtgtttggccatggatgtacaggcttttgagcgtttgctgggcccatgcatggagatcatgaagcgtaatattgccacctatgaggagcagttagtggctctgtttggcactaatatggacattgtggagcctacagcgtag

SEQ ID NO: 201395 - DNA, 1218 bp, Artificial Sequence
  Description of Artificial Sequence: Synthetic coding sequence
atgagcatcgagatccccgccggcctgaccgagctgctgcagggcttcacagttgaggtgctcaggcaccagccggcagaccttttggaatttgctctccagcatttcactagactccagcaggaaaacgaacgcaagggaactgcgcggtttgggcatgagggccgtacatggggagacctcggcgccgccgctgggggcgggacgcctagcaaaggggttaactttgcagaagaggcagcacctgcggatgccggggcgttcaacgccccagtgatcaacaggtttacccggcgtgcttccgtttgtgcggaggcatacaatccggacgaggaggaggatgacgccgagtcaagaattatccaccccaaaactgacgaccaacggaaccgacttcaagaggcctgcaaagacattctcttgttcaagaacctcgatccagagcaaatgtctcaggtgctggacgctatgtttgagaaactggtcaaggacggcgagcatgtgattgaccaaggcgacgatggggataacttttacgtgatcgatcgcggaacgttcgacatttatgtgaagtgcgacggagtaggacgctgcgtaggaaattatgataatagggggagttttggcgagttggccttaatgtacaacaccccacgagcagcaaccatcacggcgacaagccccggggcactttggggactggatagggtcaccttcagaaggataatcgtaaaaaacaatgctaagaaacgtaaaatgtatgaatcctttatcgaaagcctcccctttcttaagagccttgaattcagtgaacgcctgaaagtcgtggacgtcatcggaaccaaggtctataacgatggagagcaaattatcgcccagggtgacagtgcagactctttctttattgttgagagtggggaagtcaaaattactatgaagcgcaagggaaagagcgaagtcgaagaaaatggagcagttgaaattgcgcgctgctcccgagggcagtatttcggcgagctcgccttggttaccaataagcctagagccgcctctgctcatgctataggcactgttaagtgccttgccatggacgtacaggcgtttgaaaggctccttgggccctgcatggagataatgaaaagaaatatcgccacgtatgaagagcagcttgtcgcgttattcgggactaacatggacatagtggaaccgaccgcctag

SEQ ID NO: 201396 - DNA, 1257 bp, Artificial Sequence
  Description of Artificial Sequence: Synthetic coding sequence
atgagcatcgagatccccgccggcctgaccgagctgctgcagggcttcaccgtggaggtcctgcgccatcagccagcagacctcctcgagtttgccctgcagcatttcacgcgactgcagcaggagaatgagaggaagggtacagcaagattcgggcacgagggccgcacatggggggacttgggcgctgctgccggcggcggtacaccatctaagggagtaaattttgctgaggaaccaatgcagtcagactccgaagatggtgaagaagaagaagcggcccctgccgatgctggtgccttcaacgcacctgtcatcaacaggttcacgagaagggcaagcgtgtgcgcagaagcatacaaccctgacgaggaggaggacgacgctgaatcgaggatcattcaccctaaaaccgacgatcagcggaaccgactccaggaggcctgtaaggacatactgctgttcaagaatctggaccccgagcaaatgtctcaagtgctagacgcaatgttcgagaagttagttaaggacggagaacatgtgatagatcagggcgacgatggggacaacttctatgtcatagatcgaggaaccttcgacatttatgttaagtgcgatggagtgggaagatgcgtggggaattacgacaaccgaggcagttttggcgaacttgccctgatgtacaatactccaagagctgcgacgataaccgccacttcccctggtgccctgtggggcctggatcgcgtgacgttccgcagaattatagtgaagaacaatgccaagaagcggaagatgtatgagagctttatagagagcttaccctttttgaagtctctagaattttccgaacgcctcaaagtggtggatgtgattggcactaaagtgtacaatgatggcgagcagataatagcacagggggattccgccgatagcttctttattgtggagagcggtgaggtaaaaataactatgaaacggaaaggaaaatctgaggtcgaggagaacggggctgttgaaatcgcccggtgtagccgtggccaatactttggagagctggccctagttaccaacaaaccaagggctgcatctgcccacgccattggtacagtaaaatgccttgccatggacgtgcaggcttttgagcgtcttctgggcccttgcatggaaatcatgaagaggaatattgcaacttacgaagagcagctggtggcactgtttggaactaacatggacattgtggaaccgactgcatag

SEQ ID NO: 201397 - DNA, 1170 bp, Artificial Sequence
  Description of Artificial Sequence: Synthetic coding sequence
atggagaagcagaacatgttcctgcacggcagctacatcctgcgggaagatgttcggaccgcaaatgtcatagcagcagaagctgtcacatgtctcgttatagaccgggactcttttaagcacctgattggcggcctcgacgatgtctctaataaagcttatgaggatgcagaggcaaaagccaagtacgaggccgaggctgcttttttcgccaatctgaaattaagcgacttcaatattattgatacgttaggagtaggggggttcgggagggtggagctagtccagctgaagagcgaagagtctaagactttcgccatgaagatacttaaaaagagacatatcgtagacaccaggcagcaggaacacatcagaagcgaaaagcagattatgcaaggggcacattccgatttcatcgtcaggctgtaccgaaccttcaaagactccaaatacttatacatgcttatggaagcttgcctggggggcgaactgtggaccattctccgggatcgtgggtcttttgaagattcaaccacccgcttctataccgcatgtgtagtcgaagcctttgcgtatttacacagcaaaggaatcatctaccgggatctgaagccagagaacctgatcctggaccaccgtggatacgcaaagctggttgatttcggattcgccaagaagataggattcgggaagaaaacttggaccttctgcggcacccccgaatacgtcgcccccgagataatcctgaacaagggccacgacatttcagctgactactggagccttggaatcttgatgtacgagttacttaccggatcacctcccttttcagggcccgatcctatgaaaacgtacaatatcatcctacgcgggattgacatgatcgagttccctaagaaaattgccaaaaacgccgccaatttaatcaagaagctgtgccgtgacaacccaagtgagcggttaggaaatctcaagaacggagtaaaggatatccagaagcataagtggttcgagggattcaattgggaagggctcaggaaaggcactttaaccccccccattattcctagtgtggcaagccctaccgataccagcaattttgatagttttcccgaggataacgacgaaccaccccctgatgacaatagcggatgggacattgacttttag

SEQ ID NO: 201398 - DNA, 852 bp, Artificial Sequence
  Description of Artificial Sequence: Synthetic coding sequence
atgaagatcctgaagaagcggcacatcgtggacacccggcagcaggagcatattaggagcgaaaaacaaatcatgcagggagcgcattctgatttcatcgttcgattgtatagaacattcaaggactccaagtacctgtatatgttgatggaagcttgcctgggaggagagttgtggacaatcctgcgggatcgagggagctttgaagattctaccacacgcttttacaccgcctgtgttgtggaggctttcgcctatttgcatagcaaaggtatcatttacagagacttaaagcctgaaaacctcatacttgaccatagaggttacgctaaattggtggattttggttttgcaaagaaaataggatttggcaaaaaaacttggaccttctgtggtaccccggagtacgtggccccagagataattttgaataaaggccatgacatttcagcagactattggtctttgggaatcttgatgtatgagttactcactgggtctccaccgttttccggtccagatccaatgaagacctacaacatcattctaagaggaatcgatatgatcgaattccccaaaaagatcgctaagaatgctgctaatctcatcaaaaaattatgcagagataacccaagcgagcggcttggaaacctgaaaaacggcgttaaagacattcagaaacacaagtggttcgaaggatttaactgggaggggttgcgcaaaggcaccctgaccccacccattattccgtctgtggcctcgccgaccgataccagtaacttcgatagcttccccgaggacaatgatgagcccccgcctgatgataacagtggctgggacatcgatttctag

SEQ ID NO: 201399 - DNA, 546 bp, Artificial Sequence
  Description of Artificial Sequence: Synthetic coding sequence
agctgcatcatcaaggagggcgacgtgggcagcctggtgtacgtgatggaagacggtaaggtcgaagttacaaaggaaggggtcaaactgtgcactatgggaccaggcaaggtgtttggggagctggcgattctgtacaactgcactagaacggcgaccgtgaaaacacttgtgaacgtgaaactatgggctatcgatcggcagtgcttccaaacgattatgatgaggacagggcttatcaagcacactgagtatatggagttcctcaagtctgtgccaacatttcagagtctgcccgaagagattctttccaagctggctgatgtgttagaggagactcactatgaaaacggagaatatatcatccgtcagggagctagaggtgatacgtttttcatcatatctaagggaactgttaacgtcacaagggaagacagcccgagtgaggatcctgtctttttgcggactctggggaaaggcgattggttcggcgagaaggcactgcaggggtggacctggaatctattcgaatacgtggtggagtag

SEQ ID NO: 201400 - DNA, 2061 bp, Artificial Sequence
  Description of Artificial Sequence: Synthetic coding sequence
atgggcaccctgcgggacctgcagtacgccctgcaggagaagatcgaggagttgaggcagcgagatgccctgattgacgagctggagctggaacttgatcaaaaagatgaactgatacagaagctccaaaatgagctagataaataccggtccgtgattagacccgcaacccagcaggcccagaagcagagcgcaagcaccctgcagggagagcctagaactaagagacaggcgatttccgctgaaccaacggcatttgacattcaagatctctctcatgtgacactgccattctaccccaagagtccacagtctaaggacctcatcaaagaagcgattctcgacaacgattttatgaaaaacttagagctttcgcagattcaagaaatcgttgattgcatgtaccccgtcgaatacggcaaagactcctgcataatcaaagagggtgacgtcggttctctagtgtacgttatggaggacgggaaagtagaggtcacaaaggaaggagtaaaactatgcaccatggggccgggtaaagtatttggcgagctggcgatactgtataactgcaccagaaccgccaccgttaagaccctggtcaatgtcaaactgtgggccatagataggcaatgttttcaaacaattatgatgcggactggcctaattaaacacacagagtacatggagtttcttaagtcagtccccacatttcagagcctccctgaggaaatcctaagcaaattagccgacgtcctggaggagacccattatgaaaacggtgagtacataatacgccagggagctagaggagatacattttttataatttccaagggaaccgtgaacgtcactcgtgaggacagcccctccgaagatccggtgttcttgcgcacactgggcaaaggcgattggtttggggagaaagcactgcagggggaggatgtacgcaccgccaatgtaatcgcagcggaggcggtaacttgcctggttatcgatcgcgactcattcaagcacttgatcggcggattagacgacgtgtcaaacaaggcttacgaggacgccgaagctaaagctaaatatgaggcggaggcggcctttttcgccaacctgaaactgtccgacttcaatataatagacacactgggcgtcgggggtttcggccgggtcgaactggtccagcttaaatctgaggagtcaaaaacattcgccatgaaaattttgaaaaagcggcacatcgttgatactcgtcaacaggagcatatccggtcggagaagcagatcatgcagggggcacattccgatttcatcgtgaggttgtatcggacgttcaaagatagcaagtacctgtatatgctgatggaggcctgcctgggaggagaactgtggacgatactgagggatcgcgggtctttcgaggatagtacaacccggttttacaccgcctgcgttgttgaagcttttgcctacctacacagcaaggggatcatttacagagacctgaaacctgaaaatctaatcctggatcatcggggctatgcgaagctcgtggatttcgggtttgctaaaaaaatcggctttggcaaaaagacttggaccttctgtggtactccagagtatgttgcccccgaaataatactcaacaagggccacgatatttctgctgactattggtcattgggcattttaatgtatgagctactaacaggatctccccctttctccggtccagacccgatgaaaacatataatatcattctgagaggaattgatatgatcgaatttccaaaaaaaatagcgaagaatgccgctaacttgattaaaaaactgtgccgagataatcctagtgagagactgggaaacttgaagaacggcgtgaaggacatccagaagcacaaatggtttgagggcttcaattgggaaggcctcagaaaaggcacactgacaccacctattataccatctgtggcaagccccaccgatacgagcaatttcgattctttccccgaggacaacgacgagcccccccccgatgataacagcggctgggacatagatttttag

SEQ ID NO: 201401 - DNA, 1980 bp, Artificial Sequence
  Description of Artificial Sequence: Synthetic coding sequence
atgctgaaggaggagcggatcaaggagctggagaagcggctgagcgaaaaggaagaggaaatacaggagctgaagcgaaaactgcacaaatgccagagcgtcctcccagtaccctcaactcacatagggccccggaccacaagggcccagggaatctctgccgaaccccagacatacagaagtttccacgacctgcggcaggctttccggaagttcaccaaaagcgaaagaagcaaagatctgatcaaggaggccatcctggacaacgatttcatgaaaaacctggagctgtctcaaattcaagaaattgttgactgcatgtatcctgttgagtacggtaaggattcttgtatcataaaagagggcgatgttggttcgcttgtgtacgtaatggaagacggcaaagtggaagtaaccaaggagggtgtgaaactctgcacaatgggccctggtaaggtgtttggagaacttgctattctgtacaattgcactcgcaccgccacagtaaaaactttggtgaatgtgaaactgtgggccatcgatcgtcagtgttttcaaacaatcatgatgcgcaccgggctgatcaaacacacagaatacatggagttcttgaagagtgtacctaccttccagagcctaccagaagagatcctaagtaagcttgcagatgtgctggaggagactcattatgagaacggcgagtacattatccgccagggtgcaagaggtgacacctttttcattatttccaagggcactgtaaatgtgacccgggaggattctccaagcgaggatcccgtcttcttgaggacgcttggcaagggagactggtttggcgaaaaagccctgcagggggaagatgtcaggactgcgaacgtgatcgccgcagaagctgtgacttgcctggtgattgatcgggatagcttcaagcatttgattggggggctcgatgacgtgagtaataaagcatacgaggatgcagaagctaaggcaaaatacgaagctgaagccgcattttttgctaacctgaaactgtccgattttaatatcatcgataccctaggtgtaggcggattcggacgtgtggagctggtgcagctgaaatctgaagaatcgaagacatttgctatgaaaatactcaaaaaaagacatattgtagacacccggcagcaggaacacatcagatctgagaagcagattatgcagggagcgcatagcgatttcatcgtgaggctgtacaggacgtttaaagactccaaatatctttacatgctcatggaagcatgtctcgggggtgaactgtggacaatcctaagagacagaggctctttcgaggattcgactacccgcttctatacagcgtgcgttgtcgaggctttcgcttatctgcatagcaagggcatcatttatcgagatttgaagcccgagaatttgatcctggatcaccgagggtacgctaaactggtggactttggatttgctaagaaaattggctttggcaagaaaacatggactttctgtgggaccccagaatacgtagccccggagatcatcctgaacaaggggcacgacatatcagccgactattggagcctgggcattctgatgtacgaactgctgacaggctcaccaccgttttctgggcctgaccctatgaagacatacaacatcatcctgaggggtattgacatgatcgagttcccaaagaaaatagccaagaacgccgctaatttgattaagaaactgtgtcgggacaatccctccgaaagactcgggaatctgaagaatggtgtgaaggatatccagaaacacaaatggtttgagggtttcaattgggaaggtctcaggaagggaacattaacaccacccattatcccctccgtggcgagtcctacggacacttccaattttgacagttttccagaggataatgacgagccaccccctgacgacaactctggctgggacatcgacttttag

SEQ ID NO: 201402 - DNA, 2016 bp, Artificial Sequence
  Description of Artificial Sequence: Synthetic coding sequence
atgagcgagctggaggaggacttcgccaagatcctgatgctgaaggaggaaagaattaaggagctggaaaaacgactaagcgagaaagaggaagaaatccaagagctcaaaagaaaactccacaaatgccagagcgtcctgccagttccctctacgcatatcggaccgagaacgaccagagctcaggggatttctgccgagccacagacatacaggagctttcatgacctgcgacaggcttttcggaagtttactaaaagcgaaaggtcgaaggacctaatcaaggaggctatactggacaacgactttatgaagaaccttgaattaagtcagatccaggaaattgtcgattgcatgtatcccgtggagtacgggaaagactcctgcattattaaggagggagacgtcgggagcctcgtttacgtgatggaggatgggaaagttgaagtcactaaggagggcgtcaaactatgtaccatgggccctggaaaggtattcggggagctggccatattgtataactgcacgagaacagcgacagtaaagacgctggtcaacgtcaaactgtgggccatcgatcggcagtgttttcaaactatcatgatgcgcactggcctcatcaaacacactgaatatatggagtttctgaagagtgtgccgacgtttcagagcctgcctgaagaaatcctctccaagctcgctgacgtactcgaggagacacactacgagaacggtgagtatattattcgacagggagctcggggggacactttcttcatcattagcaaaggaaccgtgaatgtcactagagaggactcccccagtgaggatcctgtgttcctccgaaccctgggcaaaggagattggtttggagagaaagcgctgcaaggcgaagatgtcagaaccgccaatgtgatcgctgcggaggccgttacttgtctggtgatagaccgcgactcattcaaacacctgatcggcggcctggatgacgtgtccaataaggcctatgaggacgcagaagccaaagcaaaatatgaagctgaagctgctttcttcgcaaatctaaaactaagtgattttaacattatcgatacgttgggcgtcgggggctttgggagagtggagctggtgcaacttaagtctgaagagagtaagacctttgcaatgaagatcctcaaaaaacgacacatagtggataccagacagcaggagcacatcaggagcgaaaagcaaataatgcagggagcccacagcgatttcatcgtgcgtctgtaccggactttcaaagatagtaaatacttgtatatgctcatggaagcgtgtctcggcggcgagctgtggaccatcctgcgggaccgcggcagtttcgaggactccacaacccgattttacacagcctgcgtggtggaggcttttgcctacttacacagtaagggcatcatatatagagatctgaagccagaaaacctaattttagaccaccgcggctacgccaaactggtcgactttggtttcgccaaaaaaattggctttggaaaaaagacttggaccttctgcgggacgccagaatacgtggcgcccgagatcatcctgaacaagggtcatgacatttcagccgattactggtcattaggtatactgatgtatgagctgctgactggatctcctccattctccggccccgaccctatgaaaacatacaatattatactgcgaggcattgatatgatagaattcccgaaaaagatcgcaaaaaacgccgctaacctgattaagaagctgtgccgtgataatccatctgaaagactgggaaacttgaaaaatggcgtcaaagatattcagaaacataaatggttcgagggcttcaactgggagggtctgcgtaaaggaacattgacgccccccatcatcccctctgtggcttcaccaaccgacactagcaactttgactctttcccggaggataatgacgaacctccccccgatgataacagcggatgggatatcgatttttag

SEQ ID NO: 201403 - DNA, 2289 bp, Artificial Sequence
  Description of Artificial Sequence: Synthetic coding sequence
atgggcaacggcagcgtgaagcccaagcacagcaagcaccccgacggtcactcaggtaatctcacaacagacgccttgcgtaacaaggtgacagaactggagagagagctgcgacgcaaggatgctgaaattcaggagagagaataccatctcaaggaacttcgagagcaactctcaaagcaaaccgtggccatcgccgaactcacagaggaactgcagaataagtgtatccagttgaacaagttgcaggatgtggtccacatgcagggcggatctcctcttcaggcctcccctgacaaggtccccctcgaagtgcatcgcaagaccagtggactggtttcgctccattctagacgcggcgcgaaagctggcgtgtccgccgagcctacaacgcgaacatacgatttgaacaagcctcccgagttttcttttgagaaggccagggtgagaaaggattcttctgaaaagaagttaattactgacgctctcaacaagaatcagttcctcaaaagactcgacccacagcagatcaaagatatggtggaatgtatgtatggccgaaattaccagcaggggagctacatcattaagcagggagagcccggcaaccatatttttgtgctcgccgaaggacgccttgaagtgtttcagggcgaaaaactactaagtagcatcccgatgtggacgacttttggtgagcttgcaattttatataactgcacccgcaccgcttcggtaaaagctatcacaaatgtaaagacctgggccttggacagggaggtttttcaaaacatcatgcgacgcactgctcaggccagagatgagcagtatcgtaacttcctgaggtccgtgagtctcctcaagaacctgccagaggacaagctgaccaaaattattgactgcctggaagtcgaatactacgacaagggtgactacattatcagagaaggagaggagggctcaacctttttcatcctggctaagggaaaggtgaaagtgacccagagtaccgagggacacgatcagcctcagctgataaagactctgcagaaaggcgagtactttggagaaaaggcgctcatcagtgatgatgttcgatccgcaaacattattgcagaggagaacgatgtggcatgcctcgtaatagacagggagacctttaatcagacagtcggcactttcgaggaattgcaaaaatacctcgagggctacgtagcgaatctgaatcgggacgatgaaaaaaggcatgccaagagaagtatgtctaattggaagttaagtaaggctttgagcctcgaaatgattcagctgaaagagaaagtggccaggttcagttcttccagcccgtttcagaacttggagattatcgccactctgggtgtgggggggttcggccgggtggaactggttaaagtgaagaatgaaaacgtggccttcgccatgaaatgtatccgaaagaaacatattgtggatacaaaacaacaggaacacgtttatagcgaaaaaaggatcctggaggaactctgcagtccgttcatcgtgaaactgtatcgcacatttaaagataataagtacgtctatatgctgttggaagcgtgcctgggaggtgagctgtggagtatcctccgcgatagaggctcctttgatgagcccacttcaaaattttgtgtggcttgcgtgacagaagctttcgactatctgcaccgccttgggataatttatcgtgaccttaaacctgagaacctgattctagatgctgaaggctaccttaagctggtggatttcggattcgcgaagaagattggctccgggcaaaagacctggaccttttgtggtacacctgagtacgtggcccccgaggtgatactcaataagggccatgattttagcgtcgacttctggtcacttggcatcttagtttacgagctgctgactggcaaccctccttttagtggcgttgaccagatgatgacttataacctgatcctgaaaggaatcgaaaaaatggactttcctagaaaaattacacggcgtcccgaggatcttatccgacgactctgtagacagaatcccactgagcgtcttggcaacctgaagaacggcattaatgatatcaaaaaacacagatggctcaacgggttcaactgggaaggattgaaggctcggtcactgcccagccccctgcagcgagagctgaaggggcccatcgatcactcctattttgataaatatcctcctgaaaagggcatgccccccgacgaactttccggatgggacaaagatttctag

SEQ ID NO: 201404 - DNA, 2289 bp, Artificial Sequence
  Description of Artificial Sequence: Synthetic coding sequence
atgggcaacggcagcgtgaagcccaagcacagcaagcaccccgacggccactcaggaaatttaaccactgatgccctgaggaataaggttactgagctggagagagaattgaggcgtaaggacgcagaaatccaggagagggagtaccacctgaaggagttacgggagcagttgtccaagcaaacagtagccatcgccgagctaaccgaagagctccagaacaagtgcatacagttgaacaaattgcaggatgtggtgcatatgcaaggggggtcgcctctgcaggcatcccccgataaggtgcctctggaggtgcatcgcaagactagcggattggtgtcccttcactccagacgaggcgccaaagctggcgtgagcgccgagcctactaccagaacctacgatttgaacaaaccccccgaattttctttcgaaaaagcacgcgtaagaaaagattcaagtgagaagaagttgattacagatgccctgaataagaatcaatttcttaagcggttggacccgcagcagattaaagacatggttgagtgtatgtatggaagaaactaccaacagggctcctacattatcaagcaaggcgaacccgggaatcacatcttcgtcctggcggaagggcgacttgaagtgtttcagggcgagaaattattaagcagcatccccatgtggaccactttcggggaattagcaatactttataactgtactcggaccgcttccgtgaaggctattacaaatgtgaagacgtgggccttggatcgagaagtgtttcaaaacattatgagaagaaccgcccaagcccgcgacgagcagtatcgcaacttccttcggtccgtgtcgttactgaaaaacctgccggaggacaagttgacaaagatcattgactgtcttgaagtggagtactacgacaagggggattatattataagagagggcgaggaaggctccacattctttatcctggcaaaggggaaggtaaaagttactcaatcaacagagggccacgaccagccccagctgatcaaaacccttcagaagggcgaatactttggcgagaaagccctgattagcgatgacgttcgcagcgccaatatcattgctgaggagaacgatgttgcatgtttagtgatagacagagagactttcaaccagactgtagggacatttgaggagttacagaaatacctcgaaggatatgtggccaacctcaatcgggatgacgaaaaacgtcatgccaagaggagcatgagcaactggaaacttagtaaggccctgagcttggaaatgatacagttaaaggaaaaggtagcccggttttccagctcttccccttttcagaaccttgaaattatcgccaccttgggagtgggtggattcggcagagtggaacttgttaaggtcaagaatgagaacgtggcgtttgctatgaaatgtattaggaagaaacatatcgtggacactaagcagcaggaacacgtgtattctgagaagaggatcctggaagagctctgctctcccttcattgtgaaattgtacagaacatttaaagataacaagtacgtatacatgctgctagaggcatgcctggggggggagctctggtcaattcttagggatcgtggctcttttgatgaacctacttctaaattttgcgtggcttgcgtgacagaggcatttgattatttgcaccgcctggggatcatttaccgggatcttaagcccgagaaccttatcttggacgctgagggttacctgaagctcgtagacttcggctttgcgaagaagatcggatccggccagaagacatggaccttctgcggtactccggagtatgttgcccccgaagttattctcaataagggacacgacttctccgtggacttttggtctctgggtatactcgtgtatgagctcctgacaggaaaccctccatttagtggcgtggaccaaatgatgacgtataacctgatcctgaagggcatcgagaagatggatttcccgcgtaagattacgcggcggccagaggacttgatccgcagactctgccggcagaaccctacggagcgcctgggaaacctaaagaatggaattaacgacatcaagaaacaccggtggctgaacggattcaattgggaaggcctaaaggctcgatctctcccatcccctcttcagcgcgagctgaaaggcccgatcgatcactcctatttcgacaagtaccccccggagaaaggaatgcccccagatgagttgtcaggatgggacaaagacttctag

SEQ ID NO: 201405 - DNA, 2202 bp, Artificial Sequence
  Description of Artificial Sequence: Synthetic coding sequence
atgggcaacggcagcgtgaagcccaagcacagcaagcaccccgacgggcatagtgggaacctcactactgacgcactcaggaacaaggtcaccgagctggagagggagttgcgccggaaagatgccgaaattcaggaaagggaatatcatttgaaggagcttcgggagcagctctcaaaacagactgtcgcaatcgcggaactcaccgaagagcttcagaacaaatgcattcaattaaataaacttcaagatgtggtgcatatgcagggcggaagtccgctccaggcttcaccggacaaggtgcctctggaagtgcatcgaaaaacctctggattggtcagcttgcactcgaggcggggcgccaaggccggcgtgagcgcggagccaaccacccgcacatatgacttgaataaaccccccgaatttagcttcgagaaagccagggtgagaaaggactccagcgagaagaaactgataaccgacgcactgaataagaatcagtttctgaagaggctggacccccaacagatcaaagatatggtggaatgcatgtacgggcgcaactaccagcagggctcctacataatcaagcaaggcgaacccggaaatcatatttttgtactagccgaaggccgcctggaagttttccagggcgagaaactgttatcaagcattcccatgtggaccacctttggtgagctcgctatcctgtataactgtaccaggacagcatccgtgaaagcgatcaccaatgtgaagacttgggccttggaccgggaggtgttccaaaacatcatgcgcaggacggcccaggctcgcgacgagcagtaccgaaatttccttcgtagtgtctctttacttaaaaacttgccggaggataaacttacaaagatcatcgattgtctggaggtcgaatattatgacaagggcgattacatcatcagggaaggagaagagggcagcacattctttattttggcaaaggggaaagtgaaggtgactcaatctaccgagggacacgaccagccccagctgataaagactctccaaaagggagagtattttggcgaaaaggccctcatcagtgacgacgttcggagtgccaatattatcgccgaagaaaacgatgtcgcctgtctggtgatcgatcgggagacctttaatcaaactgttggaacttttgaagagctgcagaaatacctcgagggctacgttgcaaatctcaatagagacgacgaaaaacgtcacgccaaacgttccatgtctaattggaagttatccaaggccctgtcccttgagatgatccagctcaaagaaaaagtgaaagtgaagaacgaaaacgttgcatttgcaatgaaatgcatccgaaagaagcatatcgtcgacaccaagcagcaggaacatgtttactcagagaagaggatcctcgaggagctatgttcaccttttattgttaaactctatcgtacgtttaaagacaacaaatatgtctacatgcttctggaggcctgcttgggaggtgagttgtggtctatcttgagagacaggggtagtttcgatgagccgacatccaaattctgcgtggcctgtgtgaccgaggccttcgactatctgcatagactcggtatcatatacagggacctcaaacctgagaatctgatcctggacgctgaaggatacttgaaactagtggattttggattcgccaaaaagattggtagcgggcagaaaacatggaccttctgtggaacccccgaatatgtagcgcctgaagtgatcctcaacaaaggccatgacttcagcgtcgacttttggtctttggggatactggtgtatgaattactaacaggcaacccacctttctccggagtcgatcagatgatgacctacaacctcattctgaaaggcattgagaagatggatttccctcgcaaaatcaccagaaggccggaagacctaatccgccggctctgtcgccaaaacccgaccgaacggctcggtaacctgaaaaatggaatcaatgacatcaaaaagcataggtggttgaacggctttaactgggaaggtttaaaagcgagatcactcccaagccccctgcagagggaattgaagggccctatcgaccattcctacttcgataaatacccccctgaaaagggcatgcccccagacgaattgagcgggtgggataaagacttctag

SEQ ID NO: 201406 - DNA, 1029 bp, Artificial Sequence
  Description of Artificial Sequence: Synthetic coding sequence
atgagcaactggaagctgagcaaggccctgagcctggagatgatccaactgaaagaaaaggtagcccggttctcttcgagcagtccttttcagaacctggagatcattgccaccctgggcgtggggggatttggccgtgtggaactcgtgaaggtgaaaaacgaaaacgtggccttcgcaatgaagtgcatacgcaagaagcacatcgttgatacgaaacaacaggaacacgtgtacagtgaaaagaggattctcgaagagctttgttcaccattcatcgtgaagctgtaccgcacatttaaggacaataaatacgtctacatgctcttagaggcatgcctaggtggggaactgtggtcaatccttagggaccgtggaagtttcgatgaacccaccagcaaattttgtgtggcatgcgtgacggaagcatttgattacctccatagactcggcatcatctacagggatttaaagccagaaaatctgatcttagatgcggaaggatatctcaaacttgttgactttggcttcgccaaaaaaatcgggtctgggcagaagacttggacgttttgcggaaccccagagtacgttgcgccagaggtgatattaaacaaaggacatgatttttcggtggatttttggagcctgggcatcttagtatatgagctcctcactggtaaccccccatttagtggagtcgaccagatgatgacctacaatcttatccttaagggaatcgaaaaaatggattttcctcgcaagattacccggaggccggaggatctgatcaggcgcctgtgcaggcagaatcccacggagagactgggcaatctgaagaacggaatcaacgatatcaaaaagcacaggtggctgaacggcttcaactgggaggggctgaaggcgaggtccctacccagtccccttcagcgcgagctgaagggaccaatcgaccatagctactttgacaagtatccacctgaaaaggggatgcctcctgatgaactatccgggtgggataaggatttttag

SEQ ID NO: 201407 - DNA, 942 bp, Artificial Sequence
  Description of Artificial Sequence: Synthetic coding sequence
atgagccagagccggcaccgggccgaggccccccccctggagcgggaggactccggcacattttctttgggaaagatgataaccgctaagcctgggaagactccgattcaagtgctccacgagtatggcatgaagactaagaatattccagtgtacgagtgtgagaggtctgatgtgcagattcacgttcctacttttacatttcgagtgacggtgggggacatcacttgtaccggagagggcacctcaaagaagcttgcaaaacaccgagccgcagaagcagctatcaatattctcaaagcaaatgctagcatttgttttgccgtccctgaccctctaatgcctgatccttctaagcagccaaagaatcagctgaacccaattgggagtctgcaggaattggcgatacaccatggctggcggcttcctgaatatactctgtcccaggaagggggaccggcacataagagggagtacaccactatttgcagactagaatcctttatggaaacaggaaagggtgcatctaaaaagcaggcaaaaagaaatgcagccgaaaaattcttggccaagttttccaatatcagcccggagaaccacatctctctcactaatgtcgttggccattcactgggctgtacatggcacagcctgagaaattcgcccggggagaagattaacctgcttaagcggagtctgctgtcgatccccaatacggactacattcagctcctatccgagattgccaaggaacagggcttcaatatcacatatctcgacatcgacgagttaagcgctaatggacagtatcaatgccttgccgaattatctaccagtccaatcacagtctgccacggcagtgggatttcatgcggaaatgcacagtctgatgccgcccacaatgctctccagtatttgaagataattgccgagagaaagtag

SEQ ID NO: 201408 - DNA, 909 bp, Artificial Sequence
  Description of Artificial Sequence: Synthetic coding sequence
atgcagagcacccccttctgcggcttctgcagcctgggcaagatgatcactgccaagccaggtaagacacctatccaggtgctccatgaatatggcatgaagacaaagaacatccctgtatatgagtgcgagcggagtgatgttcagattcatgtgcctacattcactttcagggtgactgttggcgatataacatgcaccggagaaggcacatcaaagaaacttgcaaaacacagagcagccgaggccgcgatcaacatcctgaaggctaacgcctccatatgtttcgcagtgccggacccgttaatgccagacccttcaaagcagcccaagaatcaacttaatcccattgggtcgcttcaggaactggccattcaccacggctggcgcttaccagaatacaccctcagccaggaaggaggaccagctcataaacgcgagtatactactatatgtcggctggaatcttttatggagacaggcaagggagcatctaagaagcaagctaagaggaatgccgccgaaaagtttctggcaaagttttctaacatcagtccggagaaccacattagcctgaccaatgttgtgggtcacagcttgggctgtacgtggcactccctgcgaaatagccccggggagaagatcaacctgttaaagcgctcactgctcagtattccaaacactgactatatacagctcctgagtgagattgctaaggaacaaggctttaacataacgtatctggatatcgatgagctgagcgcaaacggtcaatatcagtgcttagccgaacttagcacctctccaatcactgtgtgtcacggctcaggaatttcttgcggaaacgctcagtccgatgccgctcataacgccctgcaatatttaaagattatcgctgaacgcaagtag

SEQ ID NO: 201409 - DNA, 603 bp, Artificial Sequence
  Description of Artificial Sequence: Synthetic coding sequence
atgcccgaccccagcaagcagcccaagaaccagctgaaccccatcggatccctgcaggaactcgccatccaccatggctggcgcctgcctgagtacacactgtcgcaggaaggcggacccgcgcataagcgtgagtatacaacgatctgtaggctcgaatctttcatggagaccggcaagggagcctccaagaagcaggctaagcgaaacgcggctgaaaaatttttggctaagttcagcaatatctctcccgagaaccacatctcgctaactaacgtcgttggccactccctcgggtgcacctggcactccctccgcaatagtcctggcgagaagataaacctcttgaaacgatctctgttgagtattccaaatactgactatattcagttgctctccgagatcgctaaagagcagggcttcaatataacctacctagatatcgatgagttgtcagctaacgggcagtaccagtgcctcgctgaactctccacatcacctatcactgtgtgtcatggaagtggaatctcttgcggaaacgctcagtcggatgcagcccataatgccctgcagtatctcaaaatcattgcagaaagaaagtag

SEQ ID NO: 201410 - DNA, 867 bp, Artificial Sequence
  Description of Artificial Sequence: Synthetic coding sequence
atgatcaccgccaagcccggcaagacccccatccaggtgctgcacgagtatggcatgaaaaccaagaatattcctgtatatgaatgcgaaagatcagatgtgcagatccacgtcccgacattcactttccgggtgactgtaggagacatcacctgtactggcgagggaacctctaaaaaactggctaaacatagggccgctgaagccgcgataaacattctgaaggccaatgcctccatctgctttgcagtacccgaccccctcatgcctgatccttccaaacagccaaagaatcagttgaatccaataggctcgcttcaagagttggccattcaccatggatggagactgcctgagtatacactctctcaagagggcggaccggcccacaaacgagagtacactacaatatgtaggttggagtcgttcatggagaccggcaagggcgcctctaaaaagcaggctaagcggaatgccgctgagaagttcctggcaaaattcagtaatattagtccagagaatcacataagtctcaccaatgtggtgggccactccctcgggtgtacctggcatagccttaggaactcacctggtgagaaaattaacctcctaaagcggagtttgcttagtatccctaacactgattacattcagttattgagcgaaatcgcaaaggaacaggggtttaacatcacatatctagatattgatgagctttccgccaatggccagtatcagtgcttagccgaattgtccaccagccccattacagtgtgtcatggatccggcattagctgtgggaatgcccagagcgatgccgcacacaatgctttgcagtacttaaaaattattgccgagcgtaaatag

SEQ ID NO: 201411 - DNA, 1077 bp, Artificial Sequence
  Description of Artificial Sequence: Synthetic coding sequence
atggaggcccccggcctggcccaggccgccgccgccgagagcgacagccgaaaggtcgctgaggagacccccgacggagcacccgctctctgcccgagccccgaagccttgtcacccgaacccccagtatacagtttgcaggacttcgacacactggccacagtgggcaccggaacatttggacgagtgcatctggttaaagagaagactgcgaagcacttctttgcgctcaaagtgatgtctatccctgatgtcatcaggctgaagcaagagcagcacgttcataatgagaaatcagtgctgaaggaagtatcccatccattcctgatccggctgttttggacatggcatgatgagaggtttttgtacatgctcatggaatatgtcccaggaggggaactgttctcctacttacggaatcggggcaggttctcgagcacaacagggttattctattcggctgaaattatttgcgctatcgagtacttgcactctaaggaaattgtgtacagggacctgaagcccgaaaacattctgttagacagagacgggcacatcaaattaaccgacttcgggtttgccaagaaacttgtcgatcgcacgtggacactgtgcggcactccagagtacctagccccagaggtgatacagtcaaagggtcacggccgggcagtagactggtgggcactgggcatcctgatcttcgaaatgctgtccggtttccccccatttttcgacgacaacccatttggaatatatcagaaaatcctggcgggcaaaatcgactttccacgacacttagattttcatgtcaaggacctgatcaaaaagcttctggtggtggataggacccggcgacttggaaacatgaaaaacggcgcaaacgacgttaaacatcacagatggttccggtcagtggattgggaggctgttccacagcgcaaattaaagcctccaattgtacccaagattgccggcgatggagacacttccaacttcgaaacctacccggagaacgattgggacacagcggctcccgtcccacaaaaggacctagaaatctttaagaacttttag

SEQ ID NO: 201412 - DNA, 1983 bp, Artificial Sequence
  Description of Artificial Sequence: Synthetic coding sequence
atggacgactggaagcccagccccctgatcaagcccttcggcgccaggaaaaaaaggagttggtatctgacatggaagtacaagctgaccaatcagagggccctgcggcggttttgtcagacaggcgctgtacttttcctcttggtgacagttattgtgaacattaagttgatcttagacactcgtagggccatctccgaggcaaatgaagacccggagccagaacaggattacgatgaagctttggggcgattggaaccccccaggcggcgcgggagtggacctcggagggtgctggacgtggaggtctattctagtcgttcaaaagtgtatgttgccgtggacggcacaactgtgctggaagatgaggcaagagagcagggacgtgggatccacgtgatcgtgctcaatcaggccaccgggcacgtcatggctaaacgtgtctttgatacctattccccgcacgaggatgaggctatggtcttgttcttgaatatggtggcaccagggagagtgttaatctgtacggtgaaagatgaaggatccttccacctcaaggataccgccaaggcgcttctgcgatctctggggagtcaagcggggcccgcgcttggatggcgggacacctgggcattcgtgggtagaaagggaggtccagtgtttggtgagaaacactccaaatcccctgcactgagctcctggggcgaccctgtgctcttgaaaacagacgtccccctgtcgtcagccgaggaggccgagtgccactgggctgacaccgaactcaatagaaggaggaggcgattctgctctaaggtggaaggatacggaagcgtgtgttcttgcaaggacccaacacctatcgaattctcccccgaccccctcccagataacaaggtacttaacgttccggtggctgtaatcgctggaaaccgcccgaactatttgtacaggatgctgaggtcattactgagcgctcaaggagtctcaccacagatgatcactgtgtttattgatggatactacgaagagcctatggatgtggtggcactgttcggactccgtggcattcagcacacccctatatccatcaagaacgctcgagtgtcccagcactacaaagcaagtctcacagccactttcaacctgttccctgaggccaagtttgcagtggtgctggaggaagacctggacatcgcagtggacttctttagcttcctgtcacagtctatccatctgctggaagaggatgactctttatattgtattagcgcatggaatgatcaggggtatgagcacacggctgaggaccccgcactgttgtaccgcgttgagaccatgcctggactggggtgggtcctacggcggtctctttataaagaagaattagagcctaagtggcccaccccagagaagctctgggattgggatatgtggatgcggatgcccgaacaaaggaggggccgcgaatgcattatccctgatgtttctcgcagttaccacttcggcatcgtgggactaaacatgaacggttatttccatgaggcttattttaaaaaacacaaattcaacacggtgcctggggttcaactgaggaacgtcgacagcctgaaaaaggaggcgtatgaggtcgaagtccacaggcttctctccgaggccgaggttctcgatcactccaagaacccatgtgaggattcatttttgcccgataccgaaggacatacttacgtggcctttattcgcatggagaaggatgacgacttcactacctggacccagctggcgaaatgcttacatatttgggacctcgatgttagaggcaaccaccgagggctctggaggctgtttcgtaaaaaaaaccattttctgatggtgggagtcccagcctcgccatacagcgtgaagaaacctccttccgtgacacctatcttcttggaaccccccccaaaggaggagggagcgccaggtgccccagaacagacgtag

SEQ ID NO: 201413 - DNA, 2247 bp, Artificial Sequence
  Description of Artificial Sequence: Synthetic coding sequence
atggacgactggaagcccagccccctgatcaagcccttcggcgcccgcaaaaagcgatcctggtacctgacttggaagtacaaactgaccaatcagcgagctttacgacggttctgccaaacaggtgccgtactttttctactcgttacagttattgtaaatatcaagttaattcttgatacgagacgtgctataagcgaagcaaacgaggatccagagcctgagcaagactatgacgaagccctggggagactggagcctccccgccgtagggggtccggtccacgtagagtattggatgtcgaggtttactcctctagatctaaggtctacgttgccgtcgatgggactaccgtgctggaggacgaggcccgggaacagggtcgtggaattcatgtaatcgtactcaaccaagctactggccacgtgatggcaaagagggtgttcgatacttacagcccacacgaggacgaagcaatggtattgtttctaaatatggtagcgcctggccgagtccttatctgcaccgtcaaagacgaaggcagcttccacctcaaagatacagcaaaagcactactgcgcagcctcggctcacaggcagggcccgctctcgggtggcgcgatacctgggcctttgtcggcagaaagggcgggcctgtgtttggagagaagcatagcaagtcccccgcattatccagctggggcgacccagtcctactgaaaaccgacgtgccattatccagtgcggaggaagctgagtgtcactgggctgacaccgaactcaataggcgcaggcggcgattctgttcaaaagtggaagggtatggatccgtatgttcttgcaaggatcctacacccatagagttcagccccgatcctctgccggataataaggtcctgaacgtgcccgtggcagttatagctggtaaccgccctaactacctatacagaatgctgaggtccctactcagcgcacagggagtgagcccgcaaatgataacagttttcatcgacggttattacgaggagccgatggatgtcgtcgctttatttggactgcggggaattcagcacacgcctattagcatcaaaaacgcacgcgtgtcacagcattataaggccagtctgacagccacctttaacttattcccagaggccaagttcgcggtggtactggaggaagatctggacatagcagtcgacttcttctcttttttatcccagtcaatccatttactggaggaagatgattccctctactgtatctcagcctggaatgaccaaggctacgagcataccgcagaagaccctgcgcttctctatcgagttgaaacaatgcctggccttggctgggtgctccggcggagtctttataaagaagaacttgaacctaagtggcctacccccgaaaagctatgggattgggatatgtggatgaggatgccagagcagcggcgagggagggagtgcattattccagacgtgagccggagttatcattttggcatcgtcgggcttaatatgaacggatattttcatgaggcctacttcaagaagcataagttcaacacagtgcccggggtccagctccgcaatgtagattccctcaagaaggaagcgtacgaggttgaggtgcatcgcttattgagcgaagcagaggtgctcgatcattccaagaatccttgcgaagactcattcctgccagacacagagggccacacctacgttgccttcatccggatggagaaagacgacgattttaccacctggacccagcttgccaagtgcttgcacatttgggacttggatgtgagaggaaaccatcggggactctggagactgtttcgcaagaagaatcacttcctgatgtcagaagaggcgacactctctcatcccaactttcctggagcgacccccaaaggcggagggagtccgagaagtcctcggaccgatatgcgacccccccctgggccatgtggcgccgggcccggcagtgagtctaatttgtttattgattgcccggagggcctggagaatcggcctaatctcgagggactggacttttttctgggttggaatgccgccttacgcgtggggcttgccctcactcaggagactgcggtgcctaatccctggaccggcccggcaggggcccatatgctgacccagacgcattcagagaccctgcgccactggactcgccctcctctgagcctacttttcgtccagatctcgaaagctggatag

SEQ ID NO: 201414 - DNA, 2247 bp, Artificial Sequence
  Description of Artificial Sequence: Synthetic coding sequence
atggacgactggaagcccagccccctgatcaagcccttcggcgcccgcaaaaagcggtcgtggtacctcacttggaagtacaagcttacaaatcagcgggccctacggcggttctgtcagactggggcagtcttgttcctattggtcacagttatcgttaatattaagctgatcctggacactcgccgtgcaattagcgaggctaacgaagacccggaacccgagcaggattatgatgaagctctgggaaggctggagcccccacgtcggcggggaagcggtccgagacgggtcctggatgtggaggtgtactcaagtaggtcgaaggtttacgtggccgtggatggaacgaccgtgttggaggatgaggcgcgcgagcaagggcgggggattcatgttatagtgttaaaccaggcaactggacacgtcatggctaagagagtgttcgacacatactccccgcatgaggatgaagcaatggtgctctttctgaatatggtcgcacctggccgagtgctgatctgcactgtgaaggatgagggctccttccacctcaaggataccgctaaagctcttctaaggtccctgggatcacaggctggccccgctcttggctggcgcgacacatgggccttcgttggcagaaagggggggcctgttttcggtgagaagcatagcaagagccccgcactgtcctcttggggtgatcccgtcctgttaaagaccgacgtgcccttgtcctccgctgaggaggccgagtgccactgggccgacaccgaactcaaccgtcgtcgacggagattctgcagtaaggtggaagggtacggatccgtttgtagttgtaaggatcccacaccgatcgaattttccccggacccactccctgataataaggtgctaaacgtccctgtggcagttatcgcaggaaacagaccaaattatttgtaccgtatgcttcgttctcttctgtccgcacagggtgtttcaccccaaatgataacagtgtttattgacggctattatgaagagcccatggatgtagtcgccctgttcggcctgagaggcatccaacatactcccatctcaatcaaaaatgctagggttagtcagcactataaggcctctttgaccgccaccttcaatctttttcccgaagcaaagttcgccgtggtgctggaagaagatctggacattgctgtggatttcttttcttttcttagtcaatctatccatctgttggaggaggatgattctctgtactgtatctctgcatggaatgatcagggctatgaacataccgccgaggatccagcgctgctctacagggtggagacaatgcccggactggggtgggtgctacggcggagtctgtataaggaggagttggagcctaagtggcccacacccgaaaagttgtgggactgggatatgtggatgcggatgcccgagcagaggagaggcagggagtgcattatcccagacgtgtctaggagctaccattttgggatcgtgggtctgaacatgaatggttactttcacgaagcctactttaaaaaacataaattcaacactgtgcctggcgtgcaattgcgcaacgtggactcactcaagaaggaggcttacgaggtggaagtgcaccggttgctgtctgaggcggaggtcttggaccatagcaaaaacccttgtgaagattcttttcttcctgacacagagggtcacacttacgttgctttcattcggatggaaaaggacgacgatttcacaacatggactcaattagcaaagtgcctgcatatttgggatcttgacgtacgcggcaatcacaggggtctgtggagattgttcagaaaaaaaaaccatttcctgatgagtgaggaagcaaccttgtcacatcctaactttccaggggccacccctaagggtgggggcagtccccggtccccacggactgatatgcgaccgccacctggaccatgtggcgccgggcccggcagcgaaagcaaccttttcatagactgccctgaagggcttgaaaacagaccaaatttggaagggctcgatttcttcctgggctggaatgccgctctgagagtgggactcgcactgacgcaggagactgcagttcccaatccctggaccggtccagccggcgctcatatgctgacgcagacacacagcgagacccttcgacactggaccagaccaccactgtctctgttgtttgtgcagatcagcaaggccggctag

SEQ ID NO: 201415 - DNA, 603 bp, Artificial Sequence
  Description of Artificial Sequence: Synthetic coding sequence
atggacgactggaagcccagccccctgatcaagcccttcggcgcccgtaagaagagatcctggtatctcacctggaagtataaactgactaaccagcgagctttaagaagattttgccagaccggagctgtgctgttcctgcttgtgaccgtgatcgtcaacatcaaactgattctggatactagacgcgccatctctgaggccaacgaggacccagaacctgagcaggactacgatgaggcccttggtcggttggagccccccagacggaggggaagtggcccgcggcgagttctggacgtggaagtttattccagccggagcaaggtttatgtggctgtcgacggcactacagttctcgaggacgaagcgcgggagcagggcagagggattcatgtgattgtcttgaatcaagcaacaggccatgtcatggccaaaagagtgttcgatacctattcaccacacgaggacgaggctatggtgctgttcctgaacatggtggccccgggaagagtgctgatctgtaccgtaaaagtgctgtcctcgggacgcaatatccttaaccaccttccatcgctgcccggtgggacacagtcttgttag

SEQ ID NO: 201416 - DNA, 1917 bp, Artificial Sequence
  Description of Artificial Sequence: Synthetic coding sequence
atggagggcaccaaggagatcaaggtgagcaaccggcggatccaggaacattggacaggagccgtgttgttcctcctggtcacagtgatcgtaaacataaagttgattctggacacacggcgggccatcagcgaggcaaacgaagatccagagcccgaacaggactacgacgaggctctgggacgcctcgagccgccacggcggaggggcagcgggccccggagggtcctggatgtggaggtgtacagcagcaggtccaaggtctatgtcgccgtggacggaaccaccgtgttggaagacgaggcccgagagcaggggagggggatccatgttatcgtccttaaccaagctactggccatgtgatggccaaaagagtgttcgacacttacagtccccacgaggatgaggctatggtgctgttcctcaatatggtcgcacccggccgggtactgatatgtaccgttaaagacgagggaagcttccatcttaaagatacagcaaaagcacttctgagatcactcggctcccaggctggacctgctcttggatggcgcgacacttgggcatttgttgggcgaaagggcggtccagtttttggcgagaagcactctaagagccctgccctctcttcctggggcgaccccgttctgctcaaaacagacgttccactgtcatctgctgaagaggctgaatgtcactgggcagacactgagctgaatcgccgccggcggcgcttctgcagtaaggtggaaggctatggcagtgtttgctcttgcaaagacccaactcccatcgagttctcccctgaccctctcccagacaacaaggtgctcaacgtgcccgtggcggtaatcgctggcaaccgccccaactacttgtacaggatgctcaggtccctcctgagtgcccagggcgtgtctccccagatgatcaccgtgtttattgatggatactacgaggagcctatggatgttgtcgccttgtttggcctacgcggcatccagcatacgccgatctccattaaaaacgcccgggtgtcgcagcactacaaagcgtccctgactgccactttcaacctgttccccgaagcaaaatttgcagtagtacttgaggaggacctcgacatagcagttgatttcttctcctttttgtctcagtccatccacctcctggaagaagacgactctctctattgcatatccgcatggaacgaccagggctatgagcacaccgctgaggacccagccctgctgtatagggtagagacgatgcctggcctgggctgggtgctgcgcaggtctttgtacaaagaagagctggaacctaagtggcctactcccgaaaagctgtgggactgggatatgtggatgcgcatgcctgagcagagaagaggcagagaatgtatcatccccgatgtctccaggtcttaccatttcggcatcgtcggtctcaatatgaacggctacttccacgaagcctactttaagaagcacaaatttaacacagtgccaggggttcagttgcgcaacgtggattccctgaagaaagaagcgtatgaagtggaggtacatagactcctcagcgaagctgaggtcttagatcacagtaaaaatccttgcgaggatagcttccttccagataccgaggggcatacttacgtcgcattcatcaggatggaaaaagatgatgactttactacctggacgcaacttgccaagtgcctacacatctgggatctcgatgtcagaggcaatcatagaggactgtggaggctgttcagaaaaaagaaccattttctgatggtgggcgtccccgcctccccatacagcgtcaagaaaccacctagtgttactccaattttccttgaaccccctccaaaggaggaaggagcccccggcgccccagagcagacctag

SEQ ID NO: 201417 - DNA, 861 bp, Artificial Sequence
  Description of Artificial Sequence: Synthetic coding sequence
atgagcgacagcgagaagctgaacctggacagcatcatcggccggctgcttgagggggacattcacggccaatactacgacctgctgcgcctgttcgagtatgggggcttccctcctgagagcaattatctgttcttgggagactacgttgaccgcggcaagcagagtcttgaaactatctgcctcctgctggcttataaaataaaataccccgaaaacttctttctgctgcgaggaaatcacgagtgcgccagtatcaataggatctacggtttttacgacgaatgtaagcgtcggtacaatattaagctgtggaaaacttttaccgactgttttaactgtctgcccatcgctgccattgtggacgagaagatattctgttgccatggcgggctcagcccagacctgcagagcatggagcagatcagacggatcatgaggccaaccgacgtacccgatcagggcctgctgtgcgacctgctgtggtccgatccggacaaagacgtgcaagggtggggagagaatgatagaggtgtgtcctttactttcggggcagaagtagtggccaagtttctacacaagcacgacctggacctgatctgccgcgcccaccaggttgtggaagacggatatgaattcttcgctaagaggcagctggtaacactcttctcagcaccgaattattgcggggagtttgacaatgccggcgcaatgatgtcagttgacgagacattgatgtgtagctttcagatcctgaagccggccgacaagaataagggtaagtacgggcagttctccggtctaaacccagggggaagaccaattactccaccccgaaacagcgcaaaggctaaaaagtag

SEQ ID NO: 201418 - DNA, 1548 bp, Artificial Sequence
  Description of Artificial Sequence: Synthetic coding sequence
atggccgagctggagcacctgggcggcaagcgggccgagagcgccaggatgcgcagggctgagcagctcaggaggtggaggggctccctgaccgagcaggaaccagcagagagaagaggggcgggccgacaacctctgacacgccggggatccccccgtgtgaggttcgaggacggtgccgtgtttctggccgcatgctctagcggagacacagacgaagtaagaaaactgctggcgaggggagcagatatcaacaccgtgaatgttgacggcctgaccgcccttcatcaggcatgcatcgacgagaatctggacatggttaagtttcttgtcgaaaaccgggccaatgtgaaccagcaggataatgagggctggacgccactgcacgccgcggctagctgcggatatttgaatatcgccgaatatttcattaaccacggtgctagtgttggtattgtgaactcagagggcgaggtgccaagtgaccttgcagaggagccagctatgaaagacctccttctagagcaggtgaagaagcagggcgtcgacctcgagcagagccggaaggaggaggagcagcaaatgcttcaggacgcccgccagtggctgaatagcggcaagatcgaagacgtccggcaggcacgctccggagccacagccttacacgttgcggcagccaagggctactccgaggtgctcagactcctgattcaagctggttatgaattgaacgtgcaggactacgatggttggacgccactccacgccgcagcacattggggagtgaaggaggcttgctccatacttgccgaggccctttgtgacatggatattaggaacaagctcggccagaccccctttgatgtggcggacgaggggctcgtggagcatctcgaacttctgcagaaaaagcaaaatgtgctcaggagcgagaaggagactaggaacaagctcatagaatcagacttgaacagtaagatccaaagtggttttttcaagaataaggagaagatgctttatgaagaggagaccccaaaatcccaggaaatggaagaggaaaataaagagagctcctcatcctccagcgaggaggaagagggcgaggacgaggcctccgagtcggaaaccgaaaaggaggctgataagaagccagaggcatttgttaaccacagtaattctgaatccaagtcctctattaccgaacagatcccggcaccagcccagaacactttctcagccagttccgctcgccgtttctcatcgggattattcaataaaccggaggaacccaaagacgagagcccatcaagttggcggctgggcctgcgcaaaaccggttctcacaacatgctctccgaggttgccaacagtcgtgagcctatccgggaccgcggctcgtctatatatcgcagcagctcctctccccgtatttctgccctactggacaacaaagataaagtgcaatttggaagggtatggggtaatagtaaggccgtgttcttctttcacgagaattcaatattaggaaccaacgagaatattttttag

SEQ ID NO: 201419 - DNA, 4125 bp, Artificial Sequence
  Description of Artificial Sequence: Synthetic coding sequence
atgctgaagaccgagagcagcggcgagcggaccaccctgcggagcgcctcgccgcataggaatgcctacagaaccgagttccaggcattaaaatcaacattcgacaagcccaagagcgacggagaacagaaaaccaaagaaggggagggctctcaacagagccgcggtagaaagtacgggagtaacgttaacaggatcaagaatctattcatgcagatggggatggagccaaacgagaatgcagccgtgattgccaaaacaaggggaaagggcgggcacagctcgccacaacgccgaatgaagcccaaggagttcttggagaaaaccgacgggtctgtggtgaagttagaatccagcgtttccgagcgcatcagccggttcgatacaatgtatgacggaccttcctacagtaaatttaccgaaactcgtaaaatgtttgagagaagtgtgcatgagtcgggacagaataatagatattcccccaagaaagagaaggctgggggaagcgaaccccaggacgagtggggtggctccaagagcaaccgagggtcaaccgacagcctagattccctgagtagtaggaccgaagctgtttcccccaccgtatcacagctgtccgctgtcttcgagaacacggattcccctagtgccatcatctcggagaaagcagaaaacaatgaatattccgtcaccggacattatcctttgaacttgcccagtgtgaccgtgactaacttggatactttcggacacctgaaagacagcaacagttggcctccaagcaacaagagaggcgtggataccgaggacgcccataagagtaatgccaccccggtgcccgaagtcgcaagcaaaagcacatccctcgccagcatacccggggaggaaattcagcagagtaaagagccagaggatagcacgtcaaatcaacagacccccgactcgatcgacaaagatgggcctgaagaaccatgtgccgagtcgaaagccatgcccaaaagtgagatcccttccccacagagtcagctcctggaggacgcggaagctaacttggtgggacgcgaagcagccaaacagcaacgcaaagagctggctgggggcgatttcactagtcctgacgcttccgcgtcatcatgtggcaaggaggtccccgaagactcaaacaactttgacggctcacacgtgtatatgcacagcgactataatgtgtaccgtgtcagatcccgctataacagtgactggggggagactgggacagaacaggacgaggaagaggactctgatgagaactcatattatcagcccgacatggagtatagcgagatcgtaggcttacctgaggaagaagaaattcctgccaatcggaagattaaattcagttccgcacctatcaaggtttttaatacctatagcaacgaggattacgaccgaagaaatgacgaggtcgatccagtggctgcaagcgcggagtacgagttggagaaacgagtcgaaaaactcgagctcttccctgtcgaactcgaaaaagacgaagatggcttaggaatctccattataggcatgggtgtcggagccgacgctggactcgagaagctgggtatctttgtcaagactgttaccgaagggggtgcagcacagagggacggcaggatccaggtgaatgatcagattgtggaggttgatggaataagtctggtgggggtgacacagaacttcgctgccacagtgctccggaacacaaaagggaatgtgcgctttgtcataggcagggaaaagcccggtcaagtgtcagaggtagctcaactaatctctcagacgctggagcaggaacgtagacagagagaactgcttgagcagcactatgcccaatacgacgctgatgacgacgaaaataccgtggctgagctgcaggggatgtccggcaattgcaataacaataataactacttcctgaagactggcgagtatgccacagatgaggaggaagatgaggttggacccgtcctgcccggcagcgacatggccattgaggtatttgagctgcccgagaatgaggatatgttcagcccatcggagctggatacaagcaaactatctcataagtttaaggagctccagattaaacacgccgtcaccgaggccgagatacaaaaactgaagactaaattgcaggcagccgagaacgagaaagtgcgatgggaactggaaaaaactcagctccaacaaaacattgaagagaacaaagagcggatgcttaagctggagtcctattggatcgaggcccaaactctgtgtcatacagttaacgaacatctaaaggaaacccagtctcagtaccaagcgctagagaaaaaatataacaaggcaaaaaaactgattaaagatttccaacagaaagagctcgatttcataaagcgtcaggaggctgagaggaaaaagatagaagatctcgaaaaagcccatctcgtggaggtccagggccttcaggttcgcatccgtgacctcgaagccgaagtctttcgactactgaagcaaaatggcacgcaggtaaataacaacaacaacattttcgaaaggcgcacatcactgggggaagtctcaaaaggtgatactatggagaatctcgacggaaagcagacctcttgccaagatggcctgtcccaggatctgaacgaggcggttcccgagactgaacgactggattcgaaggccctgaagactagggcacagctgagtgtgaaaaatcggcgccagcgtcctagccgcacaagactgtatgactctgtcagctcaacagatggggaggatagcctagaaaggaaaccgagcaatagcttttataatcatatgcacatcacaaaattactgccccccaaggggcttaggacctcctccccggaaagcgactccggagttccaccactcacccccgtggactccaatgtgccattttcatccgatcatattgctgaatttcaggaggagccattggacccagaaatgggaccactgagctctatgtggggcgatacatctctcttctcaaccagtaaaagtgatcatgatgtggaggaatcgccctgtcaccaccagaccactaacaagaaaatccttcgagaaaaagacgacgcaaaagatccaaaaagtttgagagctagctcctctcttgccgtccagggaggtaaaataaaaagaaagtttgtggatctgggcgctcctttgcgcagaaactcctctaaggggaaaaaatggaaagaaaaagaaaaagaagcctcacggttctctgccggatctagaatctttcggggcaggttggaaaactggacccccaaaccgtgctccacggcccagacttcaacaaggagtccatgtatgcctttttcctggtttaatgactcccgcaagggctcttatagttttaggaacctcccagctcccaccagcagtctgcagccaagtcctgaaactctgatctctgataagaaggggagtaaggtagagaacacctggatcacgaaagccaacaagaggaacccgaaccccagttcatcttccatattcggccgacacagtcaactcatgagcgtcgtgtggattcaggagacaaacaatttcactttcaacgacgatttctccccaagttccacgagcagcgcggacctctccggcctcggagccgagcctaagacaccagggctcagccagtcactcgcactttcttccgacgaaatcctcgacgatggtcaaagcccgaagcacagtcagtgccagaatagagccgtacaagagtggtcagtgcagcaggttagccactggctaatgtcactcaatctggaacagtatgtttccgagttttcggcccagaacatcaccggagagcagcttctccagttggatggaaacaagttaaaagcactgggaatgactgcctcccaggacagagcggtcgtaaaaaagaaactgaaggaaatgaagatgtccctagagaaagctcgcaaagcccaagagaaaatggagaagcagcgggagaagcttaggcggaaggaacaggagcagatgcagcggaagtctaaaaaaactgaaaagatgactagtactacagccgaaggagccggggaacaatag

SEQ ID NO: 201420 - DNA, 1026 bp, Artificial Sequence
  Description of Artificial Sequence: Synthetic coding sequence
atgagcgacagcgagaagctgaacctggacagcatcatcggccggctactagagggcagtcgtgtcctgactccacactgcgcacccgtgcagggatcccgtccaggcaaaaacgtccagttaaccgaaaatgaaatccgcggcctatgcctcaaatctagggaaatatttttgagccagcccatacttctcgagctggaggccccattgaagatctgcggcgacattcatggtcaatattatgacttactcagactgttcgaatatggaggtttcccgcctgagtccaattatcttttcctgggagattacgttgatcgagggaaacagagccttgaaactatctgcctgttgctcgcgtataaaataaagtacccagagaactttttcctgctgcgtggtaaccatgagtgtgcaagtatcaatagaatctatggattttacgacgaatgtaagagaagatacaacataaagctgtggaaaacattcaccgattgtttcaattgtctgccgattgcggccattgttgacgaaaagatcttttgctgtcacggaggtctgagcccagatctccaatctatggaacagatacggagaatcatgaggcctactgacgtcccagaccaaggactgttgtgcgacctcctctggtcagatccagataaagatgtccaggggtggggggagaatgatagaggagttagttttaccttcggtgccgaagtggtcgcaaagttcctccacaagcatgacctggacctcatctgccgggcacaccaggtggtcgaggacggatatgagttttttgctaagcgccaacttgtgaccctgttcagcgcgccaaactattgcggcgagttcgataacgccggggcgatgatgtccgtggatgaaaccttgatgtgttcgttccagatactcaagccagcagacaaaaataaaggtaaatatggccagtttagcggtctcaaccccgggggcagaccgattacaccccctcggaactcagctaaagcaaaaaagtag

SEQ ID NO: 201421 - DNA, 993 bp, Artificial Sequence
  Description of Artificial Sequence: Synthetic coding sequence
atgagcgacagcgagaagctgaacctggacagcatcatcggccggttgttggaggtccaggggagtaggcccgggaaaaatgttcaactcaccgaaaatgagatcaggggcttgtgcttgaagtcccgcgaaattttcttgtctcaaccaatactgctggagcttgaagcccctctgaagatttgcggagacatccacggccagtactacgatttgctccggctgttcgaatacggtggcttcccgcctgagagcaattatttgtttctgggcgactacgttgacagaggaaagcagagcctcgagacgatttgcctgcttctggcatacaaaatcaagtatccagagaacttctttcttcttcgtgggaatcatgaatgcgcctccatcaacagaatatatggcttctacgacgaatgcaaaaggaggtataatattaagctctggaaaacattcactgactgctttaattgcctgcctatagcggcaatcgtagacgagaaaatcttttgctgccacggcggactgtcaccagacttgcagtctatggaacagattaggcgaataatgcgacctactgacgtcccagatcaaggcttactgtgcgacctattatggagcgacccagacaaggatgtccagggatggggcgaaaatgatcggggggtgtccttcactttcggggcagaagtagtcgctaaatttctccataaacacgatttagacctcatttgtcgtgcccaccaggtcgtcgaagacggatacgagttcttcgcgaagagacaactggttacattgttcagcgctcctaactattgcggcgagttcgataacgctggggccatgatgtcggttgatgagacattaatgtgcagctttcagattctaaagcccgccgacaaaaacaagggtaaatatgggcagttctccggcctgaaccccggcggaagacctataacaccaccacggaatagcgctaaagccaaaaagtag

SEQ ID NO: 201422 - DNA, 1245 bp, Artificial Sequence
  Description of Artificial Sequence: Synthetic coding sequence
atgcggcagcgggccgaccggcggagcatggtgagcaccagcggcgcagccaccgccagcagcgctgcgggtccaagcagaggagcagcgcacagcccttcctctgcacctcacgcctctcggcatcgcccgccgttctcatctagggccacagggctgctgcagcagcgccagcattgcgtgcaccattgtacccagctatgccctcgcgtgcaaaccccatgtttgccaccacctcctgccccagccaccgaactgcactcttatctgcagcaggggggtgaaagaggcctcctggacacaacacccggcaccgccggctgggggacgtcagctaccggcgctgtccaaggcagccggcctggcaagaatgtgcaattgacggagaacgagatacgagggctgtgcttgaaatcccgggagattttcctgtcacagccaatactgcttgagctagaagcaccgctgaagatctgcggagacatacatggccagtactacgaccttctgcgtcttttcgagtatggaggttttcccccagagtccaactatctattccttggtgactatgtggacagaggcaagcaatcactcgagacaatttgcctgctgctcgcatataaaatcaagtacccagaaaacttttttttgctcagagggaaccacgagtgcgccagtattaaccgtatctatgggttctacgacgaatgtaaacgccgctataatatcaaactgtggaagactttcacagattgctttaactgcctgcccatagcggcgatcgtagacgagaaaatcttctgctgccatggtggcctgtcgcccgacctgcagtcaatggaacagatcaggcgtataatgcgcccaacagatgtgcccgaccagggacttctctgcgacctgctgtggtccgatccagataaagacgtgcagggatggggggaaaatgaccggggggtctcctttactttcggggcggaagttgtggccaaatttttgcataaacatgatctggatctgatttgtagggcccatcaagtggtagaggacggttacgagtttttcgcaaagagacaactagtgaccctgttctccgctcctaactactgtggcgaattcgacaacgcaggcgcaatgatgtccgtggacgagacgctgatgtgctccttccaaatactcaaaccggctgacaagaacaaggggaagtacggccagttctccggcctgaatcccggagggagatag

SEQ ID NO: 201423 - DNA, 984 bp, Artificial Sequence
  Description of Artificial Sequence: Synthetic coding sequence
atggccgacggcgagctgaacgtggacagcctgatcacccggctgttagaagtccgaggatgcagaccagggaaaatcgtacagatgaccgaggctgaagtgaggggcctctgcattaagtcccgggagattttcctctcccagccaatcctactggagcttgaagcgccactaaaaatctgcggagatatccatgggcaatacaccgacctactgagattgtttgaatatggtggattccccccggaggcaaattacctgtttctcggggactacgtggaccgggggaagcagtctctggaaactatctgcctgttgcttgcatataagatcaagtatccagaaaatttttttctcctgagaggcaatcacgagtgcgcctcgattaacagaatatacggcttctacgacgaatgcaagcgaaggttcaacatcaaactctggaagacgttcacggactgcttcaactgcctccccatcgccgctatcgtcgacgagaaaattttttgttgccacggaggtctttcgcctgatctgcagagtatggagcagatcaggcggattatgaggcccactgacgtgcctgacacgggactgctctgtgacctcctgtggagtgatcccgataaagacgtgcaaggctggggcgagaatgaccggggagtctctttcacttttggggccgacgtcgtaagcaagtttttaaatcggcacgatctggacctaatctgccgtgctcaccaggttgtggaggatggctatgagtttttcgccaagagacaacttgtaacactcttctctgcgcctaattattgcggggaatttgacaacgctggaggaatgatgagtgtcgatgaaacactcatgtgcagctttcagatcctaaagcctagcgaaaagaaagctaaataccagtatggtggtctgaactcgggtcggcccgtgactcccccgcgcacggctaatcccccaaagaaacggtag

SEQ ID NO: 201424 - DNA, 984 bp, Artificial Sequence
  Description of Artificial Sequence: Synthetic coding sequence
atggccgacggcgagctgaacgtggacagcctgatcacccggctgcttgaagtgcgcggatgtagacctgggaaaatcgtgcagatgactgaagccgaggttcgcggcctttgcatcaagtcacgagagatcttcctttcgcagccgatcctgctggaactggaagctcccttaaagatttgtggcgacattcatggacagtatacagatcttcttcgtctgtttgagtacggcggctttccacccgaagcaaattacctattccttggagactatgttgataggggaaaacagagcttggagactatctgtcttctgctggcctacaagatcaagtaccctgaaaactttttcttgctaagaggcaaccacgagtgtgcctcaatcaaccgcatttatgggttttatgacgagtgcaagcggcgctttaacatcaagttatggaaaacctttactgactgtttcaactgtctgcccatagcagcaatcgtcgatgagaaaatcttttgttgtcatggtggtttatcaccggacttgcagagtatggagcagattagacggatcatgaggcccaccgacgtccccgatacgggcctcctctgtgatctgttgtggagcgatccagacaaggacgtgcaaggctggggcgagaacgatcgaggggtttccttcacgttcggtgcggatgtggtttccaagtttctcaataggcatgacctagacctcatttgtcgggcgcatcaagtcgtggaggatggctacgagttcttcgccaaaaggcaattagttaccctcttttctgcacccaattattgcggagaattcgacaatgctgggggcatgatgtctgttgatgaaacactcatgtgttccttccagatcctcaagccatccgagaagaaagcgaaataccagtacggtggcttgaatagcggacgcccagtgactcctccacggaccgccaatcccccaaaaaagcgctag

SEQ ID NO: 201425 - DNA, 984 bp, Artificial Sequence
  Description of Artificial Sequence: Synthetic coding sequence
atggccgacggcgagctgaacgtggacagcctgatcacccggctgctggaggtgaggggatgtcgaccgggaaaaatcgtccaaatgactgaggcggaggtgagaggactttgtattaaatcaagggagattttcctttctcaaccaattcttctggaactcgaggccccgctcaaaatttgcggggacattcacggccagtacactgacctgctgcggctgtttgaatatggcggatttccgcccgaagccaattatctgttcctgggcgattatgtggaccggggcaagcagagcctggagaccatctgcctgctccttgcctataagattaagtatcccgaaaatttttttctgctgagaggtaatcatgaatgcgcctctattaacaggatttatggtttctacgacgagtgcaaacgccggtttaatatcaagttgtggaagacttttactgactgctttaactgtcttcctatcgctgctattgtagacgaaaaaatcttttgttgtcatggcgggttaagccccgatctgcaaagtatggagcaaattcgcagaattatgagaccaacagacgttccagatacaggcctgctgtgcgacttattgtggagtgacccagataaagacgtccaaggctggggagaaaatgatagaggagtctcctttacttttggagccgatgtggtgtccaaatttctaaacagacatgacttggaccttatttgcagagctcaccaggttgtggaagatgggtacgagttcttcgccaagaggcagctggtgacgctgttttccgcacccaactactgcggcgagttcgacaatgctgggggtatgatgagtgtggacgagacactgatgtgtagcttccaaatcttgaagccttctgaaaagaaggctaaataccaatatggaggactgaacagcgggcgtcctgtcacacctccgcgaaccgcgaatcccccaaagaaaagatag

SEQ ID NO: 201426 - DNA, 378 bp, Artificial Sequence
  Description of Artificial Sequence: Synthetic coding sequence
atggccgacggcgagctgaacgtggacagcctgatcacccggctgttggaggtgcgaggctgtagacccggcaaaatcgtacaaatgacagaggccgaggttaggggcctgtgtattaagagccgcgaaatcttcctgtcccagcccatcctcctagagcttgaggcccccctcaaaatttgtggagatattcacggccagtatactgacctgcttcgcctgtttgagtacggaggattccccccagaggccaattacctctttctgggggactacgtagatcgcggcaagcagtccctggaaacgatctgcctgctcctggcatataagataaaatacccagaaaactttttcctgctccgaggaaaccacgaatag

SEQ ID NO: 201427 - DNA, 417 bp, Artificial Sequence
  Description of Artificial Sequence: Synthetic coding sequence
atggccgacggcgagctgaacgtggacagcctgatcacccggctgctggaagtgagaggttgtaggcctggaaagatcgtgcagatgaccgaagcagaggtgcgcggactctgcattaagtcccgagaaatctttctgagtcaaccaatcttgctcgagcttgaggccccactgaaaatttgcggtgacatccatggtcagtacactgacctactgcggctcttcgagtatggaggcttccctccagaggccaattacctattcctgggcgattacgttgatcgcggcaaacaatcactggaaacaatctgtttgctgcttgcgtataagatcaagtaccccgagaatttctttctgctccgtggtaatcatgagtgcgccagcataaacagaatctatggattctacgacgaatag

SEQ ID NO: 201428 - DNA, 510 bp, Artificial Sequence
  Description of Artificial Sequence: Synthetic coding sequence
atgaccgaggccgaggtgcggggcctgtgcatcaagagccgggagatctttcttagccaacctatcttgctggagctggaggcccctctcaagatctgcggagacattcacgggcagtataccgatctgctgcggctgtttgagtacggtggctttccaccagaggccaattacctgtttctgggcgactacgtggatagaggcaaacagagcctggaaacgatctgcctgttgctggcatacaagattaaatatcctgagaactttttcttgctgcgtggaaatcacgaatgtgcatctatcaacaggatttatggcttttacgacgaatgtaaaaggcggttcaacatcaagttgtggaaaaccttcaccgactgcttcaactgcctgcccattgctgctattgtggatgaaaaaatcttctgttgtcacggtggcctctccccagatctccaatccatggaacagatcaggagaatcatgcggcctactgatgtacccgacacctag

SEQ ID NO: 201429 - DNA, 972 bp, Artificial Sequence
  Description of Artificial Sequence: Synthetic coding sequence
atggccgacctggacaagctgaacatcgacagcatcatccagcggctgctcgaggttcgaggatctaagccaggcaagaatgtgcagttgcaggaaaatgaaatacggggcctttgtctgaaatcccgggagatatttctgtcccagccgatccttctggagctggaggcgcctttaaagatctgcggggatatccacggccagtactacgatctcctccgcctgtttgagtacggggggtttcctcctgagtcaaactacctgttcttaggtgactatgtggataggggaaaacaaagcctcgaaacgatttgtcttctcttggcctacaagattaaatatcctgagaacttctttttgctgagggggaatcacgagtgtgcaagcatcaacagaatctatggtttctatgacgagtgcaaacgaaggtacaatattaagctgtggaaaacattcactgattgctttaattgtctgccaattgccgctattgtggatgaaaagatattttgctgccatggcgggctgagccccgatctccagtcaatggaacagattagacgcatcatgaggcccacggacgtccccgatcagggcttgctctgcgacctattatggtccgatccagataaagacgtgctgggatggggggaaaatgataggggcgtgtcttttacgtttggcgctgaggttgtggcgaaattccttcataaacacgatctggatcttatttgtcgggcccatcaggtggtggaagatggttatgagttttttgccaaacggcagctggttacgttgttttccgcacctaattactgtggtgaattcgataatgcaggcgccatgatgtctgtcgatgagacacttatgtgcagtttccagattcttaagcccgccgagaagaaaaaaccaaatgccacccggcctgtcactcccccacggggaatgatcacaaagcaggctaaaaagtag

SEQ ID NO: 201430 - DNA, 1014 bp, Artificial Sequence
  Description of Artificial Sequence: Synthetic coding sequence
atggccgacctggacaagctgaacatcgacagcatcatccagcggctgctggaggtcagaggcagcaagccagggaaaaacgtacaactacaagagaatgagattaggggactctgtttaaagagtagagagattttcctgagccagcccatcctgctggagcttgaagccccactgaaaatttgtggcgacatccacgggcagtactacgatctactcaggttgtttgaatatggtggcttcccccccgaatctaactatctctttctgggtgactatgttgacaggggcaaacagagcctcgagactatatgtctcctcctagcctataaaattaagtatcccgagaactttttccttcttagaggcaaccacgaatgtgccagtattaaccgcatatacggattttacgacgagtgtaagcgacggtacaatattaagctgtggaaaactttcaccgattgtttcaattgcttgcctatagcagccattgtggacgaaaaaattttctgctgtcatggagggctgagtcccgatctgcagtccatggaacagattagacgaattatgagaccaaccgatgttccagatcagggcctcctttgcgaccttctttggtctgacccagataaggacgtgctcgggtggggggaaaacgatcgtggcgttagcttcacctttggggccgaggttgtagcgaagttcctgcacaagcatgatttagacctgatctgtagagcacaccaagtggtcgaggatggctacgaattctttgccaaaagacagctggtgactctgttttccgcgccaaattactgtggtgaattcgacaatgctggcgcaatgatgtctgtcgatgagacgttaatgtgtagttttcagattctcaagccggccgaaaaaaaaaagccaaacgccactcggcctgtgacccccccccgcgttgctagtggcctgaatccctccatccagaaggcttcaaactatcggaacaatactgtgttatacgaatag

SEQ ID NO: 201431 - DNA, 999 bp, Artificial Sequence
  Description of Artificial Sequence: Synthetic coding sequence
atgttcctgcccctgtacctgaacctggtgctgtacttcgtgttctggctgcactggactaactgcgacttttcgctggccgtgagaggcagcaagcctggaaaaaatgtacagttgcaggaaaatgagattaggggtctttgcctaaaaagccgggagatcttcctgtctcaacctattctgctggagctggaggcccccctcaaaatctgtggtgacatacatgggcagtattacgatctattgaggctcttcgagtatgggggattcccaccagagagcaactacttgtttcttggcgactacgtcgatcgcggcaaacaaagcttggagactatctgtctccttctcgcatacaagatcaagtatccggaaaacttctttctgcttaggggcaatcacgagtgcgcctccattaaccgcatatacgggttctacgatgaatgcaaacgccgctacaacataaagctgtggaagacttttactgattgtttcaactgtctgccaattgctgccattgtggatgagaagatattctgctgtcacggcggcctgagtcctgatcttcagtcgatggagcagatccggagaattatgagaccaaccgatgtgcctgatcagggacttttgtgcgatttgctgtggtctgatcctgacaaagatgtgctcggctggggcgaaaacgaccgtggtgtatccttcacctttggtgcagaagtggtggcaaaatttctgcataaacatgatctagatctgatctgtcgggcccaccaggtagtggaagacggatacgagtttttcgctaaacgccagctggtgactctgttctccgctccaaattactgcggcgagtttgataacgcaggagcaatgatgtctgtagacgagaccctgatgtgcagctttcagatacttaagcccgctgaaaagaaaaaacccaatgccacccgaccagtgaccccgcctcgtggtatgatcactaaacaggcaaaaaagtag

SEQ ID NO: 201432 - DNA, 426 bp, Artificial Sequence
  Description of Artificial Sequence: Synthetic coding sequence
atggagcagatccggcggatcatgcggcccaccgacgtgcccgaccagggactcctgtgcgatctgctatggagtgacccagacaaagacgtgctagggtggggagaaaacgacagaggcgtctcatttacttttggagcagaagtcgtggcaaagttcctgcataaacatgacctcgacctaatctgtcgggcgcatcaagtggtcgaggatggatacgaattctttgctaagcggcagttagtgacgctttttagcgccccaaactattgtggcgagtttgacaatgccggagctatgatgtccgtcgatgaaaccttgatgtgtagttttcaaattttgaaaccagctgagaagaagaagcctaacgcaactcgccccgtcactcctccccggggaatgatcacaaaacaggccaaaaaatag

SEQ ID NO: 201433 - DNA, 225 bp, Artificial Sequence
  Description of Artificial Sequence: Synthetic coding sequence
atgggccggcggagcagcaagtgctgctgcatctacgagaagccccgggcctttggagagagtagtaccgagtccgacgaggaggaggaggaaggctgtgggcatacgcattgcgtgcgcgggcataggaaaggaagaaggcgtgccacgctgggtcctaccccaactacccccccgcagccaccagacccaagtcagcccccgccgggccccatgcaacactag

SEQ ID NO: 201434 - DNA, 225 bp, Artificial Sequence
  Description of Artificial Sequence: Synthetic coding sequence
atgggccggcggagcagcaagtgctgctgcatctacgagaagcccagagcctttggcgagagcagcactgaatccgatgaagaagaggaggaggggtgcggacatacacactgcgtacgcggacatagaaagggtcggagacgcgctaccctgggccccacaccaactaccccaccacagccccctgatccctcccagcctccacccggccctatgcagcattag

SEQ ID NO: 201435 - DNA, 225 bp, Artificial Sequence
  Description of Artificial Sequence: Synthetic coding sequence
atgggccggcggagcagcaagtgctgctgcatctacgagaagccccgcgccttcggggagtctagcaccgagagcgatgaggaagaagaggagggctgcggacatactcactgtgtcaggggacatcggaagggcagacgccgagccacgctcgggccaacacctacaactcctccccaacctccagatccatctcagccaccacctggtcctatgcaacattag

SEQ ID NO: 201436 - DNA, 225 bp, Artificial Sequence
  Description of Artificial Sequence: Synthetic coding sequence
atgggccggcggagcagcaagtgctgctgcatctacgagaagcccagagcgttcggagagtcaagcacggagtctgacgaagaggaggaagaaggctgtggacatactcattgcgtacggggccaccgcaaagggcgccgtagggccacgctgggacctacccccacaacacccccacagcctccagaccccagccagccgccaccaggccccatgcaacattag

SEQ ID NO: 201437 - DNA, 381 bp, Artificial Sequence
  Description of Artificial Sequence: Synthetic coding sequence
atggccgaggccggcgccggcctgagcgagaccgtgaccgagaccaccgttactgtaacaacggagcccgagaatcgcagtctcacaattaaactgcgcaaacgaaagccagagaaaaaagtagagtggactagcgatacggtggacaatgaacatatgggcagaagaagcagtaagtgctgttgtatttatgagaagccgagagcttttggcgagtcttccaccgaatcagatgaagaggaagaagaagggtgcggacacactcactgcgtgcggggacacagaaagggccggaggcgtgcaactctaggaccaacacccacaacacccccccagcctcctgacccttctcaaccccctccaggccctatgcaacactag

SEQ ID NO: 201438 - DNA, 225 bp, Artificial Sequence
  Description of Artificial Sequence: Synthetic coding sequence
atgggccggcggagcagcaagtgctgctgcatctacgagaagccccgcgcgtttggcgaaagctccaccgaatccgatgaggaggaagaggaagggtgcggccacactcactgtgtgagggggcatcgtaagggaaggaggagagctaccctgggtcctacccctacgacacctccgcagccaccagacccctcacagccaccgccaggccctatgcagcactag

SEQ ID NO: 201439 - DNA, 381 bp, Artificial Sequence
  Description of Artificial Sequence: Synthetic coding sequence
atggccgaggccggcgccggcctgagcgagaccgtgaccgagaccactgtgacagtgactacagaacctgaaaaccgtagcctgaccattaagctccggaaaagaaagccagagaagaaggtcgaatggacctcggatacggtcgataacgaacacatggggaggaggtcttctaaatgctgctgtatttatgagaagccacgcgctttcggtgaatcctccaccgaaagcgatgaggaggaggaagagggctgcggccatactcactgcgtgcgaggacaccggaaaggacggaggcgggcaacactgggccccactcccacaactcccccccaaccgcctgatccttctcagcctccacctgggccaatgcaacactag

SEQ ID NO: 201440 - DNA, 225 bp, Artificial Sequence
  Description of Artificial Sequence: Synthetic coding sequence
atgggccggcggagcagcaagtgctgctgcatctacgagaagcccagggctttcggagaatcatccactgagtcggacgaggaggaagaagaaggttgcggtcacacccactgtgtcagagggcacaggaaaggccgtcgccgcgctacccttggacccacgcccacgacaccaccccagcctcctgacccatcccagccaccccctggccctatgcagcactag

SEQ ID NO: 201441 - DNA, 225 bp, Artificial Sequence
  Description of Artificial Sequence: Synthetic coding sequence
atgggccggcggagcagcaagtgctgctgcatctacgagaagccccgggcgtttggagagtcttcgacagagagcgacgaagaggaagaggaggggtgtggtcatacacactgcgttcgcgggcatcgcaagggtaggagaagagcgaccctcggacctacgccaactacccctccgcaaccccccgaccccagtcagcccccaccggggcccatgcaacattag

SEQ ID NO: 201442 - DNA, 225 bp, Artificial Sequence
  Description of Artificial Sequence: Synthetic coding sequence
atgggccggcggagcagcaagtgctgctgcatctacgagaagcccagagcgtttggagaaagttctaccgagtccgatgaggaggaggaagaggggtgcgggcatactcactgtgtgcgcggccatcgaaaggggcggcgacgggcaacgcttggcccaactccgaccactccaccacagccccctgatccctcccagcccccccccggccctatgcaacactag

SEQ ID NO: 201443 - DNA, 225 bp, Artificial Sequence
  Description of Artificial Sequence: Synthetic coding sequence
atgggccggcggagcagcaagtgctgctgcatctacgagaagccccgcgcatttggtgagtcgagcactgagtccgatgaagaggaggaagaggggtgcgggcatactcattgcgttaggggccatcggaagggcaggcgaagggccacactggggccaacaccgaccacaccaccacagccgcccgatccctcacagcctccacccggccctatgcagcattag

SEQ ID NO: 201444 - DNA, 225 bp, Artificial Sequence
  Description of Artificial Sequence: Synthetic coding sequence
atgggccggcggagcagcaagtgctgctgcatctacgagaagcccagggcttttggcgagagttctactgagagcgatgaggaagaggaggagggatgtgggcacacccactgcgtccgagggcacagaaaagggaggcggcgggccactttgggacccacacctactaccccaccacagccaccagaccccagtcaacccccccctgggccaatgcagcactag

SEQ ID NO: 201445 - DNA, 225 bp, Artificial Sequence
  Description of Artificial Sequence: Synthetic coding sequence
atgggccggcggagcagcaagtgctgctgcatctacgagaagccccgggcctttggtgagtcctctacagaaagcgatgaagaggaggaggagggatgtggccacactcactgcgtacgggggcatcgtaagggccgacgtcgggccactttgggcccaacaccgacaacaccacctcagcctcctgacccctcgcagcctccccccgggccaatgcagcactag

SEQ ID NO: 201446 - DNA, 225 bp, Artificial Sequence
  Description of Artificial Sequence: Synthetic coding sequence
atgggccggcggagcagcaagtgctgctgcatctacgagaagccccgcgccttcggggaatcatccaccgaaagcgatgaggaagaggaggagggttgtgggcacacccattgcgtccggggtcaccggaagggaagacggagggcaactctgggccctactccgacaactccacctcagccgcccgatccttcccagcctccgccaggccctatgcagcactag

SEQ ID NO: 201447 - DNA, 225 bp, Artificial Sequence
  Description of Artificial Sequence: Synthetic coding sequence
atgggccggcggagcagcaagtgctgctgcatctacgagaagcccagagcctttggggagagcagcacggaatcagatgaagaagaggaggagggttgcgggcatacacattgcgtgagaggtcaccggaaggggaggcgaagagccacacttggaccgactccaaccacaccccctcagccccccgatccctctcaaccaccacccggccctatgcagcactag

SEQ ID NO: 201448 - DNA, 225 bp, Artificial Sequence
  Description of Artificial Sequence: Synthetic coding sequence
atgggccggcggagcagcaagtgctgctgcatctacgagaagcccagagccttcggtgagtcaagcaccgaatctgatgaggaagaggaagagggatgcgggcacacacattgcgtgcgggggcacagaaaaggaagacggagagctacactgggacctacaccgaccactccaccacagccccccgaccctagtcagcccccgcctgggcccatgcagcattag

SEQ ID NO: 201449 - DNA, 225 bp, Artificial Sequence
  Description of Artificial Sequence: Synthetic coding sequence
atgggccggcggagcagcaagtgctgctgcatctacgagaagcccagggcattcggcgagtcctcgactgagagcgacgaagaggaggaagaaggctgcggccacacccactgtgtgcgtggccacagaaaggggcgccgtcgcgcgacgctgggtcctacccccacaacacctcctcagccaccagatccaagtcagcctccacccggcccaatgcagcattag

SEQ ID NO: 201450 - DNA, 225 bp, Artificial Sequence
  Description of Artificial Sequence: Synthetic coding sequence
atgggccggcggagcagcaagtgctgctgcatctacgagaagccccgggctttcggagagtccagcaccgaaagcgacgaggaggaggaggaaggctgtggccacacacactgtgtcagggggcacaggaaaggcagacggagggcgaccttaggtcctactccaaccacgccaccgcaaccccctgacccgtcccagccgccacctggaccaatgcaacactag

SEQ ID NO: 201451 - DNA, 225 bp, Artificial Sequence
  Description of Artificial Sequence: Synthetic coding sequence
atgggccggcggagcagcaagtgctgctgcatctacgagaagccccgagcttttggcgaatcttccaccgagtctgacgaggaggaggaggaggggtgcgggcatacccactgtgtgagaggtcaccggaaaggcagaaggcgcgcaacacttggccccacaccaacgactccgccgcaacctccagatcctagccagccacctccggggcctatgcaacattag

SEQ ID NO: 201452 - DNA, 225 bp, Artificial Sequence
  Description of Artificial Sequence: Synthetic coding sequence
atgggccggcggagcagcaagtgctgctgcatctacgagaagcccagagcattcggggagtcttccacagagtctgacgaagaagaggaagagggctgcgggcacacgcattgcgtccgcggtcaccgtaaaggcagacgtagagctacacttggcccaacacctacgacaccaccgcaaccacccgatccctcacagcctcccccaggcccaatgcaacactag

SEQ ID NO: 201453 - DNA, 225 bp, Artificial Sequence
  Description of Artificial Sequence: Synthetic coding sequence
atgggccggcggagcagcaagtgctgctgcatctacgagaagccccgggcttttggcgaatcatccacagaatcagacgaagaggaggaagaagggtgtggccacacccactgtgttcgtggccaccggaagggaagaaggcgagctacactggggcctactccaacgacaccaccacagccccccgatccttcacagcccccgcctggtccgatgcagcactag

SEQ ID NO: 201454 - DNA, 225 bp, Artificial Sequence
  Description of Artificial Sequence: Synthetic coding sequence
atgggccggcggagcagcaagtgctgctgcatctacgagaagccccgggcgtttggcgaatccagcaccgaatcagatgaagaggaagaagaagggtgcgggcacacacactgcgtgagaggtcaccgcaagggtcggcgcagagcgacactgggccccactcctaccacgccaccacaaccacctgacccgagccagccacctccgggacctatgcaacattag

SEQ ID NO: 201455 - DNA, 381 bp, Artificial Sequence
  Description of Artificial Sequence: Synthetic coding sequence
atggccgaggccggcgccggcctgagcgagaccgtgaccgagaccactgtgactgtcactacggagccagaaaacaggagtctcaccattaaactgagaaaaagaaagcctgaaaaaaaagtagagtggacgtctgacaccgtagataacgaacacatgggtcggagaagctcaaaatgctgttgtatctatgagaagcctcgggccttcggagaaagcagcacagagagtgacgaggaggaagaggagggatgtggtcacacccattgcgtcagaggccataggaaaggccggcgccgcgcgactctgggccctacacccaccacacccccacagccaccagacccatctcagcctccccccggccctatgcagcactag

SEQ ID NO: 201456 - DNA, 381 bp, Artificial Sequence
  Description of Artificial Sequence: Synthetic coding sequence
atggccgaggccggcgccggcctgagcgagaccgtgaccgagaccactgtgaccgtcacgactgaaccagagaatcgcagtttaacaatcaagctaagaaagagaaaacccgaaaagaaggtggaatggacttccgacacggtagacaacgaacacatgggcaggcgaagctccaaatgctgctgtatatacgaaaagccccgagccttcggagaatcctctaccgagtctgatgaagaggaggaggagggatgtgggcatactcactgcgtccgcggccaccggaaagggagacgcagggctacgttggggcccacacccactacccccccccagcccccggaccccagccagccaccccccgggccaatgcagcactag

SEQ ID NO: 201457 - DNA, 225 bp, Artificial Sequence
  Description of Artificial Sequence: Synthetic coding sequence
atgggccggcggagcagcaagtgctgctgcatctacgagaagcccagagccttcggggagtcttctactgaatcagacgaagaggaggaggagggatgtggccatacccattgcgtccgggggcacaggaaaggaaggcggagagctaccctgggtccaacccctacaacccctccccagcctccagatcccagccaacccccccccggaccgatgcagcactag

SEQ ID NO: 201458 - DNA, 225 bp, Artificial Sequence
  Description of Artificial Sequence: Synthetic coding sequence
atgggccggcggagcagcaagtgctgctgcatctacgagaagccccgcgcttttggcgagtcatccactgaaagtgatgaagaggaggaagaaggctgtggacatacccactgcgttcgaggacatcggaaaggcaggcgaagggctaccttaggtcctaccccaactactcctccgcagccccctgatccatctcagccgcccccaggacccatgcagcactag

SEQ ID NO: 201459 - DNA, 225 bp, Artificial Sequence
  Description of Artificial Sequence: Synthetic coding sequence
atgggccggcggagcagcaagtgctgctgcatctacgagaagccccgagctttcggggagagcagtacagagtcggacgaggaagaagaagagggctgcggccatacacactgtgtcagaggccacagaaaggggcgccgacgtgccacactgggcccgacgcccactacccccccacaacccccagaccctagccagcctccaccgggtccgatgcagcactag

SEQ ID NO: 201460 - DNA, 381 bp, Artificial Sequence
  Description of Artificial Sequence: Synthetic coding sequence
atggccgaggccggcgccggcctgagcgagaccgtgaccgagaccactgttacagttacaacagagccagagaaccggtcgttaacaattaagttgaggaagcgcaaaccagagaaaaaggtggagtggacctctgacaccgtggacaatgaacatatgggccggcggtcctctaaatgttgttgcatctatgaaaaaccacgcgcttttggcgagtcatccaccgagagtgatgaggaggaggaagagggatgtggccacactcactgcgtgagagggcatcggaaggggcggcggcgtgctactctgggtccgaccccaactacacccccccagcctcccgacccttctcaacctccccctggaccaatgcagcactag

SEQ ID NO: 201461 - DNA, 225 bp, Artificial Sequence
  Description of Artificial Sequence: Synthetic coding sequence
atgggccggcggagcagcaagtgctgctgcatctacgagaagcccagggcattcggcgaatcgtctacagagtcagatgaagaggaggaggagggttgtggacatactcactgcgtccgaggtcacaggaagggcaggcgtagagctacactcgggcctactccaacaaccccccctcaacctcccgatccgtcccagcccccacccggcccaatgcagcattag

SEQ ID NO: 201462 - DNA, 225 bp, Artificial Sequence
  Description of Artificial Sequence: Synthetic coding sequence
atgggccggcggagcagcaagtgctgctgcatctacgagaagcccagagctttcggcgagagtagtactgagtctgatgaggaagaagaggagggttgtggccacacgcattgtgtcaggggccaccggaagggccggaggcgagccactctcggccccacacctacgacaccgccccaaccacccgatccatcccagccccctccaggtcctatgcagcattag

SEQ ID NO: 201463 - DNA, 381 bp, Artificial Sequence
  Description of Artificial Sequence: Synthetic coding sequence
atggccgaggccggcgccggcctgagcgagaccgtgaccgagaccactgtgacggtgaccaccgagccagagaatcgctccttgactatcaagcttcggaaaagaaagccggagaagaaggtcgagtggacttctgatacagtcgacaacgagcatatggggcgccgaagtagcaaatgttgctgcatttacgagaagcctcgcgcgtttggagagagcagcaccgagagcgacgaggaggaggaagagggctgtgggcatactcattgcgtccgcgggcaccggaaaggcaggcgccgggcgactctggggcccaccccaacaactccaccacagccacccgaccccagtcagcctccccctgggccaatgcagcattag

SEQ ID NO: 201464 - DNA, 225 bp, Artificial Sequence
  Description of Artificial Sequence: Synthetic coding sequence
atgggccggcggagcagcaagtgctgctgcatctacgagaagccccgagcttttggcgagtcttccaccgaaagcgacgaagaggaagaagagggatgcggacacactcactgcgtcagaggtcatagaaaaggacgtagacgagccacactgggtcctactccaacgaccccaccccagccacccgacccctcccagcctccaccagggcctatgcagcactag

SEQ ID NO: 201465 - DNA, 225 bp, Artificial Sequence
  Description of Artificial Sequence: Synthetic coding sequence
atgggccggcggagcagcaagtgctgctgcatctacgagaagccccgggcctttggggagtcgagcactgagagcgatgaggaggaagaagagggatgcgggcatacccattgcgtccgcgggcataggaaggggcgacgccgggccaccttaggtccaacgcccacaactcctccacagcccccagacccatcccagcccccacctggtccaatgcaacattag

SEQ ID NO: 201466 - DNA, 225 bp, Artificial Sequence
  Description of Artificial Sequence: Synthetic coding sequence
atgggccggcggagcagcaagtgctgctgcatctacgagaagcccagagcgttcggcgaaagtagtacagagtcagatgaggaagaggaggagggctgcggccacacccactgtgtccgtggtcatagaaagggccggcggcgcgccactttggggccgaccccgacgactccgccccaaccgccggacccctcccaaccgccccccgggcctatgcagcattag

SEQ ID NO: 201467 - DNA, 225 bp, Artificial Sequence
  Description of Artificial Sequence: Synthetic coding sequence
atgggccggcggagcagcaagtgctgctgcatctacgagaagccccgggcgtttggcgagtcttcaaccgaatctgacgaagaggaggaagagggctgcggccacacacactgcgtcagggggcaccgcaaaggtcgacggcgagcgactttgggccctactccgacaaccccaccccagccaccagacccatcgcaaccccctccaggccctatgcagcactag

SEQ ID NO: 201468 - DNA, 225 bp, Artificial Sequence
  Description of Artificial Sequence: Synthetic coding sequence
atgggccggcggagcagcaagtgctgctgcatctacgagaagcccagagcttttggtgaatcttctaccgagtccgatgaagaggaagaagaggggtgcggccacacccattgcgtgcgagggcatcgtaagggaagacgccgtgctacgctgggccccacacctactacacctccccaaccgccagacccaagtcaaccaccacctgggcccatgcagcactag

SEQ ID NO: 201469 - DNA, 225 bp, Artificial Sequence
  Description of Artificial Sequence: Synthetic coding sequence
atgggccggcggagcagcaagtgctgctgcatctacgagaagccccgagcatttggagagagcagtacagaatccgatgaggaggaggaggaaggctgtgggcacacacactgcgtccgcggccaccgcaagggtaggcggcgcgctaccttgggcccgacacccactacccctccccagccaccagatccctcccaaccaccaccgggtcctatgcaacactag

SEQ ID NO: 201470 - DNA, 381 bp, Artificial Sequence
  Description of Artificial Sequence: Synthetic coding sequence
atggccgaggccggcgccggcctgagcgagaccgtgaccgagaccacagtgacggtgacaactgaacccgagaatcggtccctgacgatcaaattacgtaagcgcaagcctgaaaagaaggtcgagtggactagcgacacagtcgataacgagcacatgggaagacgcagctcgaagtgctgctgtatttacgaaaagcccagggctttcggtgagagctctaccgaaagtgacgaagaggaagaggaggggtgtggacacacgcattgcgttcgcgggcacaggaaaggccgaagacgggccacgctgggcccaacacctaccactcccccccagcccccagaccctagtcaaccccccccagggcctatgcagcactag

SEQ ID NO: 201471 - DNA, 225 bp, Artificial Sequence
  Description of Artificial Sequence: Synthetic coding sequence
atgggccggcggagcagcaagtgctgctgcatctacgagaagcccagagcatttggcgaatcctcaacagaatcggacgaagaggaggaggaggggtgtggccacactcactgcgtgagaggtcatcgcaaaggaagaagaagggccacactcggacctacgccgaccacccctccccaacccccagacccttcacagcctcctccggggcctatgcagcactag

SEQ ID NO: 201472 - DNA, 225 bp, Artificial Sequence
  Description of Artificial Sequence: Synthetic coding sequence
atgggccggcggagcagcaagtgctgctgcatctacgagaagcccagggcctttggtgaatctagcaccgagtccgatgaagaagaagaagagggctgcggccacacccactgcgtgagaggacatcgcaaagggcggaggcgcgctactttgggccccacacccaccaccccaccacaaccccctgacccatcccaacctcccccaggtccgatgcagcactag

SEQ ID NO: 201473 - DNA, 225 bp, Artificial Sequence
  Description of Artificial Sequence: Synthetic coding sequence
atgggccggcggagcagcaagtgctgctgcatctacgagaagccccgcgcttttggcgagagtagcacggagtctgacgaagaagaggaagaagggtgtggacacacccactgcgtccggggtcacaggaaaggccggcgacgcgctactctggggccaacgccaaccacacctccccaaccccctgacccaagtcagcctccaccagggccgatgcagcattag

SEQ ID NO: 201474 - DNA, 225 bp, Artificial Sequence
  Description of Artificial Sequence: Synthetic coding sequence
atgggccggcggagcagcaagtgctgctgcatctacgagaagccccgggcttttggagagtcaagcaccgagtccgacgaagaggaagaggaaggatgcggccatacacactgtgtaagaggccatcgcaaagggcgccgcagggcgacactggggccgacaccaaccactcctccccagcccccagatccatcacagccacccccgggtcccatgcaacattag

SEQ ID NO: 201475 - DNA, 225 bp, Artificial Sequence
  Description of Artificial Sequence: Synthetic coding sequence
atgggccggcggagcagcaagtgctgctgcatctacgagaagcccagagcctttggggaatcaagtacagaaagcgatgaagaggaggaagaaggctgtgggcatacccattgcgtgagggggcataggaagggccgcagaagagccacactgggaccaactcctactactccaccgcagcccccggatccctcccaacctcctccgggtcctatgcagcactag

SEQ ID NO: 201476 - DNA, 225 bp, Artificial Sequence
  Description of Artificial Sequence: Synthetic coding sequence
atgggccggcggagcagcaagtgctgctgcatctacgagaagccccgcgccttcggagagtcctccaccgaatctgacgaggaggaagaggagggttgtggacacacccactgcgtcagggggcacaggaaaggtaggcgccgcgccacccttggcccaacacctaccaccccccctcagccgcctgacccgtcgcaacctcctccaggcccaatgcagcattag

SEQ ID NO: 201477 - DNA, 381 bp, Artificial Sequence
  Description of Artificial Sequence: Synthetic coding sequence
atggccgaggccggcgccggcctgagcgagaccgtgaccgagaccaccgttacagtaactactgaacctgagaatcggtcattgacaatcaaacttcgcaaaaggaagccagaaaaaaaagttgagtggacctcggataccgtggataatgaacatatgggacgtcggagcagtaaatgttgttgcatttacgaaaagcccagggccttcggtgaatctagcacagaatcagacgaggaggaagaagaggggtgcggacatacccactgcgtgcggggtcaccgcaaaggcagacgacgtgctaccctaggtcctaccccaaccacacctccccagccccccgatccctcgcagcctccacctggccccatgcagcattag

SEQ ID NO: 201478 - DNA, 225 bp, Artificial Sequence
  Description of Artificial Sequence: Synthetic coding sequence
atgggccggcggagcagcaagtgctgctgcatctacgagaagcccagagcatttggcgagagctctaccgaatccgatgaagaggaggaggaaggctgtggtcatacccattgcgtcagaggccataggaaggggcggcgccgggccacattggggcccactcccacaactcccccccagcccccggacccctcacaaccgcccccagggcctatgcagcactag

SEQ ID NO: 201479 - DNA, 225 bp, Artificial Sequence
  Description of Artificial Sequence: Synthetic coding sequence
atgggccggcggagcagcaagtgctgctgcatctacgagaagccccgtgctttcggggagagcagcaccgaaagcgatgaggaagaggaagagggttgtggacatacccactgcgttagggggcaccggaagggcagacgccgggcaacgctggggcccactccgacaaccccccctcagccaccagatccctcacaaccacccccgggccccatgcagcactag

SEQ ID NO: 201480 - DNA, 225 bp, Artificial Sequence
  Description of Artificial Sequence: Synthetic coding sequence
atgggccggcggagcagcaagtgctgctgcatctacgagaagcccagagcttttggagagagctccaccgaaagtgatgaagaggaggaggaggggtgcggtcacacccattgcgtccgcggccaccgaaagggtagaaggagagctaccctggggcctacaccgaccacgccaccccagccccctgatcctagtcagcctccaccaggacctatgcagcattag

SEQ ID NO: 201481 - DNA, 444 bp, Artificial Sequence
  Description of Artificial Sequence: Synthetic coding sequence
atggccgacagcggcaccgccggcggcgccgccctggccgcccccgcaccgggacccggcagcggcggacctggcccccgggtctatttccagagcccgccaggtgccgccggggaaggtccaggcggcgccgatgatgaaggaccagttcgacggcaaggcaaggttactgtgaagtacgatcggaaagagttaaggaagcgattgaatctggaggagtggattctggaacagctcacccgactttacgactgccaggaagaagagattccagagttggagatagatgtggatgagctgctcgacatggaatccgatgacgcacgcgccgctcgtgtgaaagagttactagtcgactgctacaaacctacagaagcctttatttcgggcttgctcgacaagattagaggcatgcagaagctgtctacaccgcaaaagaagtag

SEQ ID NO: 201482 - DNA, 498 bp, Artificial Sequence
  Description of Artificial Sequence: Synthetic coding sequence
atgagcgtggccaccggcagcagcgagaccgccggcggcgccagcggaggcggcgcacgagtattctttcaaagcccacgcggtggagcgggggggagccctgggtctagctctggcagcggctcctctcgcgaggatagcgctcccgtggccaccgcagccgccgccggtcaagtgcagcaacagcagcagaggcggcatcagcagggaaaggttacagttaagtatgacaggaaggaactcaggaagagattagtgctggaggagtggatcgttgagcaactgggacaactgtacgggtgtgaggaggaagagatgccagaggtggagattgacattgacgacctgctggatgccgactccgacgaggagcgggcctcaaagctccaggaagccctcgtcgactgttataaaccaactgaggaatttatcaaggagctcctgagcaggatccgcggtatgcgcaagctcagcccacctcagaaaaagtcagtgtag

SEQ ID NO: 201483 - DNA, 438 bp, Artificial Sequence
  Description of Artificial Sequence: Synthetic coding sequence
atgctgagcagcagccccgccagctgcaccagccccagccccgacggggaaaatccgtgtaaaaaggtacactgggccagcgggcgaagacgcacaagcagcaccgatagcgagagtaagtcccatcccgattcctctaaaatccctcgttctcggagaccatcaaggctgaccgttaagtacgataggggccagttgcaacggtggttagagatggagcagtgggtggacgctcaggtgcaggagttattccaggaccaggcaacaccttccgagcccgagatagacctggaggctctgatggacctgagcactgaagagcagaagacccaactcgaggctatcttgggtaactgtccgcgccccacggaagcgtttattagcgagctcctgagccagctcaaaaagctgcgaagactgagccgccctcagaagtag

SEQ ID NO: 201484 - DNA, 603 bp, Artificial Sequence
  Description of Artificial Sequence: Synthetic coding sequence
atgctgagcagcagccccgccagctgcaccagccccagccccgacggcgaaaacccctgcaagaaggttcattgggccagtgggaggcggcgaacgtcaagcactgacagtgagtcaaaatcacatccagatagctcaaagattcccaggagcaggaggcctagccgcctgactgtcaagtatgatcgtgggcaactgcagcgatggttggaaatggagcagtgggtcgacgctcaggtgcaggagctgtttcagtcgctggccttgtcaccaaggctggaatgtagtggcgtcatccattcgctgcagttgctcccccctgggttcaaccgattcagttgtctgagttcatggagcagttgggactacgggatcaagcagcccttgctatcactccgcctgacctggaaactgagctggatatatccccagaggtcgcggaggttgtcttggcgcccattcttaggtaccgcccccgcacctcagcgtttgctgagcctgtcctgttctgtcaatagcagaaattctggagacagcgccgggctgagaaataagcctgagcgaccatccctagccgcctctgcactgcctggattgccttag

SEQ ID NO: 201485 - DNA, 516 bp, Artificial Sequence
  Description of Artificial Sequence: Synthetic coding sequence
atggagcaggacaacagcccccggaagatccagttcaccgtgcccttgctggagcctcacctggaccctgaggcggcagaacagatccgcaggaggaggccaaccccggccactcttgtcttgacaagtgatcagtcgagccccgaaattgacgaggaccgcatccctaatcctcatctgaagtccactttagccatgagccctaggcaaagaaaaaagatgactagaatcactcccacaatgaaggaactgcagatgatggtcgaacaccatttgggccagcagcaacagggggaagaacctgaaggagccgctgaatctactgagacacaggagtctcggccaccagggatccctgataccgaggtggaatcaaggctgggaacgtccggaacagccaaaaagactgctgagtgtattcctaagactcacgagcgcggtagcaaagagcccagcactaaggaaccatccacccatataccccctctcgatagcaagggtgcaaatagcgtgtag

SEQ ID NO: 201486 - DNA, 462 bp, Artificial Sequence
  Description of Artificial Sequence: Synthetic coding sequence
atggagcaggacaacagcccccggaagatccagttcaccgtgcccttattggagccacacctagatcctgaagccgccgaacagataagacggagaagacccacccctgccactcttgtgctgacctcggaccagtcctctccagagattgacgaagatcggatccccaatccccacttgaagaagttacagaacgcaagcctgaaacttactcgggaagctgtaagaaatccagcacagaaaaacccccagcccatttatcatcattggattcccagagagcctaccagatgtcatcggagaggcggcaccggcggacaaaaatctgttgggggcttcccttgctctacccacacactggcgcccttctatgttttcacacgcagtattcttctactaaagcgtggggagcgcatgtcccatcccctggaaccacgggacgaccccactaagatgccctag

SEQ ID NO: 201487 - DNA, 330 bp, Artificial Sequence
  Description of Artificial Sequence: Synthetic coding sequence
atggagcccaacagccccaagaagatccagttcgccgtgcccgtgtttcaatctcagattgctccagaggctgccgagcagatacggaagcgccgccccaccccagcgtcgctggtgattctgaatgaacataaccccccggaaattgacgacaaaagaggacctaatacccaaggtgagctccaaaatgcctcaccgaaacagaggaagcagagtgtgtatacaccccctaccattaagggagtgaagcacctgaaaggacagaatgaatctgcatttcctgaagaggaggaaggcaccaacgagcgggaagaacaaagggaccattag

SEQ ID NO: 201488 - DNA, 330 bp, Artificial Sequence
  Description of Artificial Sequence: Synthetic coding sequence
atggagcccaacagccccaagaagatccagttcgccgtgcccgtgttccagtcccagatcgccccagaggccgctgagcaaattaggaaaagacgtcctacgcctgcgtccctggtgatcctgaatgagcataacccacctgagattgacgataagcggggtccaaacacccagggtgaactgcagaacgcgagccctaagcagcgaaagcagagcgtgtacacccctcctaccatcaagggagtgaagcacttaaaaggacaaaatgagtccgccttccccgaagaagaagaagggaccaatgagagggaagagcagcgagatcattag

SEQ ID NO: 201489 - DNA, 330 bp, Artificial Sequence
  Description of Artificial Sequence: Synthetic coding sequence
atggagcccaacagccccaagaagatccagttcgccgtgcccgtgttccaatcccagatcgcacctgaggcggccgagcagatcagaaagaggcggcccaccccagccagtctagtgattctgaatgagcacaacccacctgagattgacgacaaacgaggccccaatacgcagggagagctccagaacgccagccccaaacaaagaaaacaatccgtttacactccccctacaatcaaaggcgttaagcacttgaaagggcagaacgagtccgcatttccggaggaggaagagggcaccaatgagagggaggagcaacgtgatcactag

SEQ ID NO: 201490 - DNA, 618 bp, Artificial Sequence
  Description of Artificial Sequence: Synthetic coding sequence
atggccgccagcaccgccagccaccggcccatcaagggcatcctgaagaacaaaaccagtacaacctctagcatggtcgcaagcgccgaacagccgagggggaatgttgacgaggagttgtcaaaaaaatcacaaaagtgggatgagatgaacattttggcgacgtatcatcctgctgacaaagattacggtctcatgaagatagatgagccatcgactccttatcacagtatgatgggagatgacgaggatgcctgcagtgacacagaggctacggaggccatggcaccggatatcctggcacggaaactcgctgctgctgaaggactggagcccaagtaccggatacaggaacaagaatcctccggtgaagaagacagcgatctatcccctgaggagagagaaaagaagcgacagttcgaaatgaaaaggaagctgcactataacgagggactgaatattaagcttgctcggcagctgataagcaaagacctacacgacgacgatgaagacgaagagatgctcgagaccgccgatggcgaaagcatgaatacagaagaaagcaaccagggctctacaccatcagatcagcagcaaaacaagctgcgaagttcctag

SEQ ID NO: 201491 - DNA, 3093 bp, Artificial Sequence
  Description of Artificial Sequence: Synthetic coding sequence
atgaagatggccgacgccaagcagaagcggaacgagcagctgaagagatggataggcagcgagacagacctggagcccccagtcgtcaagaggcagaagaccaaggtgaaattcgatgatggggctgtgtttctggctgcatgtagctccggagacacagatgaggtcctcaagctgcttcacagaggggccgatattaattatgcgaatgtggacgggttgacagcacttcatcaggcatgcatcgatgacaatgtggatatggtgaagttcctagtagaaaacggagctaatatcaatcagcccgataacgagggctggattcctctgcatgccgccgcctcctgtgggtatctggacattgctgagtttctgattggccagggggcccacgttggcgccgtgaactccgaaggagacacgccgctcgacattgccgaagaagaagccatggaggaactcctgcagaacgaggttaataggcagggagtagatatcgaagcagccagaaaggaagaagagagaatcatgctacgcgacgctaggcagtggctgaactccgggcatataaatgacgtgagacacgccaagtcaggtgggactgctttgcacgtggctgccgccaaagggtacacagaagtgttgaagcttctgatacaggcggggtatgacgtcaacatcaaagattatgatggttggacacctctgcacgcggccgcacactgggggaaggaggaagcatgtcgcatactggtcgacaacctctgcgatatggaaatggttaacaaggtaggtcaaactgccttcgatgtggccgacgaagacatcttgggctatctggaggaattgcaaaagaagcaaaacctgctccatagtgaaaaacgcgacaaaaagagccctctaatagaatctaccgctaacatggacaataaccagtcacaaaagacctttaaaaacaaggagactttaattatcgaaccggagaagaacgcttctcggatcgaaagcctggaacaggagaaagttgacgaagaggaggagggaaaaaaggacgagtcctcttgtagtagtgaagaagacgaggaggacgacagtgagtccgaggcagaaactgataagaccaaaccccttgcaagtgtgaccaatgctaacacaagcagcactcaggccgcccctgtagctgtgacaacccccactgttagctcggggcaggctacgcctaccagccccattaaaaaattccccactacagccactaaaataagccccaaagaggaagaacgtaaggacgaatctcctgcgacttggcggctaggccttaggaaaacaggaagctatggagccctcgcggagattacggcgtccaaagagggccagaaggaaaaagacacagctggcgtcactcggtctgcttcctctcctagactttcttcaagcctggataacaaggagaaggagaaagatagcaagggcactaggctcgcctacgtcgcaccaaccattcccagacgactagcctccacctccgacattgaggagaaggaaaaccgggattcatcatcactgcggacctctagctcatatacaaggcggaagtgggaagacgacctcaaaaaaaactcctcagtgaatgagggcagcacataccataagagttgctcctttgggagacggcaggatgacctgatatcctcttctgtcccttctactacctctacacccaccgtaacatcagccgcaggtctgcagaaaagccttctcagtagcacctcaaccactacaaaaatcactacagggtccagttctgctggaacgcaatcgtctacttcaaacagactttgggccgaagactctaccgaaaaagagaaggattctgtgccgactgctgttaccatccccgtggcaccgaccgttgtgaacgcagccgcctccaccaccacgctgactacaacaacagctggcaccgtatcaagtaccacagaggttagagaaaggagacgctcctaccttacccccgttcgtgatgaagaatccgagagccaacgtaaagcccgctccagacaggccagacagtctcgccgatcaacacagggcgtcaccttaacagatcttcaggaggcggaaaagaccattggcaggagccggtccactcgtacgcgcgaacaagagaatgaagagaaagaaaaggaggaaaaagagaaacaggacaaggagaaacaggaagagaaaaaggagtccgaaacttcccgcgaagatgagtacaagcagaagtatagtcggacttatgacgagacgtaccagaggtatcggcccgtgagtacgtcttcatctactaccccctctagctccttaagcaccatgagctctagtttatacgcatccagtcagctgaaccgcccaaactctttagtgggcattaccagcgcctatagcagaggaatcactaaggagaatgaaagagagggcgagaaacgggaagaggagaaagagggcgaagataaatcgcaaccaaagtccattagagagcgccgcagaccgcgagaaaaacggaggtccaccggggtgagtttttggacccaggattctgacgaaaatgagcaggaacagcagtcagatacagaggaagggtcaaataagaaggagacccaaacagactctattagccgatacgaaacatccagcaccagcgccggcgataggtatgacagtctccttgggcggtccggaagctacagttacctagaggaaaggaagccatactcttcccgcctggaaaaagatgactctacggactttaagaagctgtacgagcaaatcctagcagagaacgaaaaactgaaagcccagctccacgacactaacatggaactgaccgacttgaagttgcagcttgagaaggcgacccagcgccaggagcggtttgccgatagaagcctgctggaaatggaaaagcgtgagcgtcgagcactagagaggcggatatccgaaatggaagaggagctgaaaatgttgcccgacctgaaagcggataaccagcgccttaaggacgaaaacggggctctcatccgcgtgatctctaaactgagcaagtag

SEQ ID NO: 201492 - DNA, 2916 bp, Artificial Sequence
  Description of Artificial Sequence: Synthetic coding sequence
atgaagatggccgacgccaagcagaagcggaacgagcagctgaagcgttggattggctctgagaccgatctggagccacccgtggtgaagaggcagaagacaaaagtcaagtttgatgacggcgctgtcttcctcgctgcttgttcctctggtgatacggacgaagttttgaagctcctgcaccgtggtgcagatatcaactatgcaaatgtggatggtctgaccgcactgcaccaggcctgtattgacgacaatgtagatatggtcaaatttcttgtggagaatggggctaacattaatcaacccgataatgagggatggattcccctccatgccgccgcgagctgtgggtatctggacatcgctgagtttctgattggtcagggcgcccacgtaggcgccgtgaatagtgagggcgataccccactcgatattgcagaggaggaagctatggaggagctgctgcagaacgaagtgaatcgccaaggggtagacatcgaggcagcccgaaaagaagaagagcgtattatgttgcgtgacgccagacagtggctcaatagtgggcacataaatgacgttcgtcacgcgaaatcgggggggacggccctgcatgttgctgcagcaaaaggctacaccgaggtgctcaagctgctgatccaggctgggtatgatgtgaatattaaggattatgacggctggacacccctacacgcggctgctcactgggggaaggaagaagcctgtaggattctagtggacaatctgtgtgatatggaaatggtgaacaaggtcggacaaaccgcatttgacgtagctgatgaagacatccttggttatcttgaggagctgcaaaagaaacaaaatttactccacagtgaaaagagagataagaagtccccactgatcgaatcaaccgccaacatggataacaaccagagccaaaaaacatttaagaataaagagactctcatcattgagcctgaaaagaatgcatcgaggatcgagtctctagagcaggaaaaggtcgatgaggaagaggaggggaaaaaagacgaaagctcttgcagctctgaagaagacgaggaagacgactcagaaagcgaggcggagacagataaaaccaagcctctcgcctccgtgactaatgcaaacacgagttccacccaggccgctccagtggctgtgaccactcccactgtttcctccggccaggccactcccaccagtcccattaagaaatttcctacaaccgctacgaaaatttcaccgaaggaagaggaacgtaaagatgagtcgcccgcaacctggcggctgggcttgcgtaagacaggatcttacggcgcactggccgaaatcaccgcatcaaaggagggacagaaggaaaaagacaccgctggggtgactagaagtgcctcatctcctcgtctcagttcctctttagacaacaaagaaaaggagaaggattctaagggcactagactcgcatacgttgctccaactattccacgaagactcgcctctaccagcgacatcgaagagaaagagaaccgtgattcttcttctcttagaacctcatccagctacacacgtcgtaaatgggaggacgacttgaaaaagaattcatcggttaatgagggcagcacgtatcataaaagctgcagttttggtagacggcaagatgatcttattagctcctcggttcccagcaccacatcgaccccaactgtgacttctgcggccggcctgcagaagtctctgctgagcagtacatcaactactaccaagattactacaggatcctcttccgcaggcactcaaagccgttcatatcttactcccgtgcgggacgaggaaagcgaaagccagcggaaggcccggagtcggcaggcccgtcagtctcgccgcagcacacagggcgtaacacttacagacctccaggaagccgagaaaactattggacgatcacgctctacccgcacccgcgagcaagagaatgaggagaaggagaaagaagagaaggaaaaacaggataaagaaaagcaggaggaaaagaaagagtcggaaacatcacgggaggatgaatataagcagaaatattctcgaacctacgacgagacctatcagaggtatcgccccgtttcgacaagctcttcaacgactccctcgtcctccctgagcacgatgtcatcttcgctctacgcctcgtcacagctgaatcgccctaatagcctggtcggcatcacttcagcttatagtcgaggaatcactaaggaaaatgaacgcgagggagaaaagagggaggaggagaaagaaggcgaagacaaatctcagcctaaatctatcagagagcggagacgcccacgcgaaaagagaaggagtacgggggtttcattttggactcaagacagcgacgagaacgaacaagagcaacagagcgataccgaagaaggtagtaacaagaaggagactcaagttaataccattacgttatacgagacctcaagtacatccgccggtgacaggtacgacagccttctgggcaggagcggctcctatagctacctagaggagcgaaagccctatagttccagattagagaaggatgatagtaccgatttcaagaaactgtacgagcagattctcgccgaaaacgagaagctcaaagcacaactacacgatactaacatggaactcaccgacctgaaactccagctggagaaggctacgcaacggcaggagaggtttgctgatcgtagtctcctagaaatggagaaacgagagaggagggctttggaacgccgcatttcagagatggaggaggaactcaagatgctaccggatctcaaggctgataaccagcgactaaaggatgagaatggagcgttaatccgcgtaatttcaaagctgtccaagtag

SEQ ID NO: 201493 - DNA, 2925 bp, Artificial Sequence
  Description of Artificial Sequence: Synthetic coding sequence
atgaagatggccgacgccaagcagaagcggaacgagcagctgaagcgatggattggatcagagaccgatctcgagccacccgtcgtcaagaggcagaagaccaaggtgaagttcgacgatggggccgtatttctcgctgcttgttcctctggggacaccgacgaggtgttgaaactgttgcaccggggcgctgatattaattacgccaacgtggacggactgaccgccctgcatcaagcgtgcatcgatgataatgttgacatggtcaaatttttggttgagaacggcgcgaacataaaccagcctgataacgaaggctggatccctctgcatgctgccgcctcttgcggatatctggatatcgccgaatttctgatcggacagggggcccacgtgggcgccgtcaatagtgagggagacacacccctcgatatcgcagaagaagaggccatggaagagcttttacagaatgaagtgaatagacagggtgtggatatcgaggccgcacggaaagaagaagagcgcattatgttgcgggacgcccgacagtggctgaacagcgggcatatcaatgatgtccgccacgcaaaatccggcggtaccgcattgcatgtcgctgctgccaagggatacaccgaagtgctgaagctgttgatacaggcgggttatgacgtaaacatcaaggactacgatggctggacacctctgcacgccgcagcacactggggtaaggaggaagcctgtaggattttagtggataatttgtgcgacatggaaatggtgaataaggtcggacagacagctttcgatgttgctgacgaagacattctgggatacctggaggagttacagaaaaaacaaaatctactgcacagcgagaagagagacaagaaatcacccctcattgagtcaaccgctaacatggacaataaccagtctcagaagacattcaaaaacaaggagacgctgataatcgaacccgagaaaaacgcaagccggatcgagagcttggagcaagaaaaagtggatgaggaagaggagggaaagaaggacgagtccagctgctcctccgaagaggacgaggaggatgacagtgaatcagaggcggaaaccgataagactaaacctctggcgagtgtaactaacgctaatacaagttccacccaggccgctcccgtagccgtgaccaccccaactgtctccagcgggcaagctacacccacctcaccaatcaagaagttcccaacaacagccaccaaaatcagtcccaaggaggaggaaaggaaggacgaatcccccgccacctggcgtctaggcctacgaaagacgggcagttatggggcgttagctgagattacagcctctaaggagggccaaaaagagaaggatactgctggggtcaccaggtcggcaagtagccctcgactatcgtcctccctcgacaacaaagaaaaagagaaggactcaaagggcacaagactggcttacgtggcgccaaccatcccccgaagactggcctccacatccgatatagaagaaaaagagaacagggattcatccagcctacggactagctccagttatactagaagaaaatgggaggatgatctcaaaaaaaattcatccgtgaacgaaggtagtacctaccataagtctaccagcaatcgcttgtgggctgaagactcgaccgaaaaggaaaaggatagcgtccctaccgcagtgacgatacctgtggcccctactgttgtcaacgctgcggcctctactacaacattgacaactacgacggccgggactgtctcctcaactactgaagtaagagaacgcaggaggagctacttgacccctgtccgtgatgaggagtctgagtcccagcgcaaagctagatccagacaggcgaggcagagtcggcggtccacccagggcgtgacgctcactgacctccaagaagcggagaaaactatcgggcgaagccggtccactcgaactagagagcaggagaacgaggagaaggagaaggaagagaaggagaaacaagataaggagaaacaggaagaaaagaaagagagcgaaacctctagggaagatgagtataaacagaagtattctaggacatatgacgagacctaccagaggtaccgcccggtgagcacctcctcaagcaccactccaagttcctccctcagtactatgtcctcctcattatacgcttctagccagttgaacaggcctaattctttagtaggtatcaccagcgcttattctagagggattactaaggaaaacgagagagaaggggaaaagcgagaggaagagaaggagggagaggataagagccagcccaaaagtattagagagcgccgtaggcccagggaaaaaaggagatcaactggggtgtcattttggactcaggactcagacgagaatgagcaagagcagcagtcagacaccgaggaggggtcaaataaaaaagaaacccaagtcaacaccatcacactctatgagactagttctacctctgccggcgatcgttatgactcactgctgggaagatccggttcatactcttatctagaggaacggaaaccttactcgagcagactggagaaggacgatagcacagatttcaagaagctgtacgagcagattctggccgaaaacgaaaagctgaaggctcaactgcatgacacaaatatggaactgacagacctcaaacttcagctggagaaagctacgcaaaggcaggaacggttcgctgatcggtctttgctcgagatggaaaagagagaaaggagggcgcttgagcgcaggatctctgagatggaagaagagctgaagatgttgcctgacctcaaggccgacaatcagcggctgaaagacgaaaacggagcactcataagagtgatctccaagttgtcaaaatag

SEQ ID NO: 201494 - DNA, 2988 bp, Artificial Sequence
  Description of Artificial Sequence: Synthetic coding sequence
atgaagatggccgacgccaagcagaagcggaacgagcagctgaagagatggatcggaagcgaaacggacctggaacctcccgtagttaagcgacagaagactaaggtgaagtttgatgacggcgcggtgttcctcgccgcctgcagctccggcgacacggatgaggtgctgaaactgctgcaccgcggcgcagatattaactacgctaatgtggatggactgacagccctgcaccaagcttgtattgatgataatgtggacatggtcaagtttctggtcgagaacggcgccaatataaaccagcctgataacgaaggctggattcccctgcacgcagcagctagctgcggctatcttgatatcgctgaattcctcattggccagggcgcgcacgtgggagcggttaatagtgagggcgatactccccttgatatagcagaagaagaagccatggaggagctgctccagaacgaggtgaatcgccaaggcgttgacatcgaagctgcgaggaaagaggaagagaggattatgcttagggatgcccgacagtggctaaactcggggcatataaacgacgtcagacatgctaagtctggcggaacagctctgcacgtcgctgccgccaagggatacacagaagtcctgaaactgctgatacaagctggctatgacgtgaacatcaaagactatgacggttggacaccactccacgcagctgcacactgggggaaagaagaggcttgccgcattctggttgataatttgtgcgacatggagatggtcaacaaagttggtcagaccgctttcgacgtggcagacgaggatattctcggttatctagaagagctgcaaaagaagcaaaatttgttgcattccgaaaaaagagacaagaagagtccactgattgaatcaaccgctaatatggataacaaccagtcccagaaaacctttaagaacaaagaaactctcattatcgagcccgaaaaaaatgctagcaggattgaatcactcgagcaggagaaagtcgacgaggaggaggagggaaaaaaagacgagagtagctgtagcagcgaagaggacgaagaggatgacagcgaatccgaagcagagaccgacaaaacaaagccccttgccagcgttacgaatgctaacacatcatctactcaggctgctcccgtcgccgtgacgacacccaccgtgtccagcgggcaggccactcctacatcacccataaagaaatttcctactactgccaccaagatttctcctaaggaagaggaaagaaaggacgagtctcccgccacgtggcggctcggactgagaaagacagggtcctatggcgctctggctgaaattactgctagcaaggagggacagaaagagaaggacaccgcaggcgttacccggtctgcttccagccctcgactgtcttcctcgctggacaataaagaaaaggagaaggactccaagggcaccaggctggcgtacgtggctcccaccatccctaggcgactcgcctccacatccgacatagaagagaaagaaaaccgcgattctagcagcctgcgaacaagcagtagctacacacgccggaagtgggaagatgatcttaaaaaaaattcttccgtgaatgagggaagtacctaccacaaaagttgctcattcggcaggcgtcaagacgatctcatctcctcttctgtgcccagtactacaagcacacctacagtgacgagtgcagccggattacagaaatctctgctgagttcaactagcaccactactaagataacgactggatcctcttccgccggcacccagtcatctacttctaaccgcttgtgggccgaggattcaactgagaaagagaaggattcggttcctaccgcggtgaccatcccggtggcgcctaccgtggttaacgcggcggcttctactaccacgttaaccacgactacagccggcacagtatcaagtactaccgaggtgagggaacgcaggcgcagttatctgactcccgttcgggatgaggagtcagaatcacagagaaaagccagatcgcgccaggcgcggcaatccagacggagtacccagggcgttaccctgacagacttacaggaagctgaaaagactattgggagatcccgctcgactaggaccagggaacaagagaacgaggaaaaagagaaagaagagaaggaaaagcaggataaagaaaagcaggaggagaagaaagaatctgagacatccagggaagacgaatacaagcagaaatattcccgcacatacgacgagacttatcagcggtaccggcctgtgtcgactagctcctccaccacccccagctcatctctgtccacgatgtcctcttcattgtacgcaagttcccagctcaacagaccaaacagcttggtcggcataacatccgcctacagtagaggcattacgaaggagaacgaacgcgagggggagaaaagggaggaggagaaggaaggggaggacaagagccagccaaagtcgatccgcgagcgccggcgacccagagaaaagaggcgctccacaggcgtgagcttttggactcaggattccgacgagaacgagcaggagcagcaaagcgatactgaggaggggtcaaacaagaaggaaacccaagtgaacaccatcacactgtacgaaacaagctcaaccagcgccggcgaccgctacgacagccttctcgggaggtctgggtcatattcttacctggaggaacgaaaaccatattcctcccggctggagaaagatgacagtacggactttaagaagcggcaagagcggttcgctgatcgcagcctactggagatggagaaacgtgagcgtagagcacttgagcgtagaatcagcgagatggaggaggagctaaaaatgctgcccgatctgaaagccgacaatcagaggctcaaagatgaaaacggcgctctgatccgtgtgataagcaaactctctaaatag

SEQ ID NO: 201495 - DNA, 2988 bp, Artificial Sequence
  Description of Artificial Sequence: Synthetic coding sequence
atgaagatggccgacgccaagcagaagcggaacgagcagctgaagcggtggattggctcagagactgacctagaaccacccgtcgtaaagcgtcaaaagactaaggttaaatttgatgacggcgctgtctttctcgcagcttgcagtagtggggatacagatgaggtgctgaagctcctgcaccggggggccgacattaattacgctaacgtcgacggattgacagctctccaccaagcctgcatcgacgacaacgtggacatggtgaagttcttggtggagaatggggcaaatattaaccagcccgataacgagggctggattcccctgcatgccgcggcgtcttgtgggtaccttgatatagccgagtttctcataggacaaggggcccacgttggagccgttaatagcgaaggcgacactccactggatattgctgaagaagaagccatggaagagctgcttcagaacgaggtaaataggcagggcgtggacattgaagctgcccgcaaggaagaggaacggatcatgttgagagacgccaggcagtggcttaattccggccacatcaacgatgttcgacacgcaaagagtgggggaaccgccctccatgttgctgcagctaaagggtatactgaagtccttaagttgctgattcaagccggttatgatgtgaatattaaagactacgacggctggacaccactgcacgctgcagctcactggggcaaagaagaagcttgccggattctagtggacaacctgtgcgatatggaaatggtcaataaagttggccaaactgcttttgatgtcgccgatgaggacatcttgggttacctagaggaactccaaaagaagcaaaacctcttacattccgagaaaagggacaagaagagtcctctcattgaatccaccgctaacatggataacaaccagtcccagaaaacttttaagaacaaggaaactctgatcatcgaacctgagaaaaacgctagtaggattgagagcctcgaacaggagaaggtggatgaggaagaagagggcaaaaaagatgagagctcctgctcaagcgaagaggacgaggaggatgacagtgagtccgaggccgagactgataagacaaaacccttagcttcagtcaccaatgctaacacgtccagcacgcaagctgcccccgtggcggtcaccacccctactgtgagttccgggcaggctacacccacaagccccatcaaaaaattccctacaaccgcaactaagatctctccaaaggaggaagagaggaaagacgagagtcccgcaacatggcgtctcggcctgcgaaaaaccggatcctatggagccctagcagagattaccgcatctaaagaaggacagaaagagaaagacaccgccggcgtgacaaggagcgccagcagcccgcgcctgagctcctcactcgataacaaagaaaaagagaaggatagcaagggtaccaggctagcatacgtggctccaacaataccgagaaggcttgcatccacctccgatatcgaagagaaggagaatagggactcaagtagtctgcgtacatcctcatcctacacccggcggaagtgggaagatgatcttaaaaagaacagctccgtgaacgagggtagcacctaccataaatcctgtagctttggacgaagacaggatgatctgatctcctcgtctgtaccgagcaccacttcaaccccaacggtaacaagcgcggccggtctgcagaaaagcctgctgagctctacatccactacaactaagatcacaacaggctcatcttctgcagggacccagtcctctacatccaaccggctctgggctgaagatagtaccgagaaggaaaaggatagtgtgcccacagctgttaccattcctgttgcgccaacagtagttaatgctgcggcatcaactaccacgctgactacaacaacagccggcacagtatcttccaccaccgaagttcgcgaaaggcggcggtcctacctgacccctgtccgggacgaagagagcgaatctcagcgcaaggcacgcagtaggcaggccaggcaatcacgtcgttccactcaaggagtgacgttaacagacctacaagaggctgagaaaactattgggcgaagccggtccacaagaactagagaacaagagaacgaggaaaaggaaaaggaagagaaagagaaacaggacaaagagaagcaggaggagaagaaagaaagcgagacctcccgcgaggatgaatacaaacaaaagtattctcgcacctacgatgaaacctaccagagatatagacccgtgtcaaccagctcttccactactccgtcatctagtctaagcactatgagcagctctctctatgcctcctcccaactcaatcgtcccaatagcctggtgggcatcacctccgcttatagccgggggatcactaaagaaaacgaacgtgaaggagagaagagggaggaggaaaaggaaggagaggacaagtcccaacccaaaagcatcagagagcggcggagacctagggagaagaggcggtccaccggcgttagcttctggactcaggattctgacgaaaacgaacaagagcaacaaagcgacacagaggaaggttcaaacaagaaggaaacgcaaaccgatagcatttcacgatacgagacctcctcaacttctgcaggagacagatacgatagtttactcggaaggtcgggatcttattcatatctcgaagagaggaagccctactcatctaggctggagaaggatgattctacagattttaaaaagaggcaagagcgtttcgcggatcggtcacttttagaaatggagaagagagagaggcgggccctcgagcgtcgtatatctgaaatggaggaagaacttaaaatgcttccagacctcaaggccgataaccagcgccttaaggatgagaacggcgccctgatccgcgtcatttctaagttgtcgaagtag

SEQ ID NO: 201496 - DNA, 3093 bp, Artificial Sequence
  Description of Artificial Sequence: Synthetic coding sequence
atgaagatggccgacgccaagcagaagcggaacgagcagctgaagaggtggataggatccgagacagacctggagccccccgttgtaaagcgtcagaagactaaggtaaaattcgacgatggtgctgtgttcctagccgcctgctcaagcggtgataccgacgaagtgttgaagctgttgcacaggggtgcggatataaactacgcaaatgtggatggcttgactgctctccatcaggcttgtattgatgataacgttgatatggtaaagttccttgtggagaacggcgctaatatcaatcagccagataacgaagggtggatcccattgcatgcagcggccagctgcggctacctggacatcgcggagttcctgatcggacagggggcccatgtcggtgctgttaattccgaaggggacaccccactcgacattgccgaagaggaagcaatggaggagctcctccagaatgaggttaaccgccagggagtggacattgaggccgcacgtaaggaggaggaacgaatcatgctgcgcgacgctcggcagtggctgaactctggacacatcaacgatgtgcgccacgccaagtccggtggcactgccttacatgttgctgctgcgaagggctacaccgaggtgcttaagttgcttatccaggcgggctatgacgtgaacataaaggactatgatggctggacccccctgcacgccgccgcacactgggggaaagaagaggcgtgcaggatcctcgtcgacaacctctgtgatatggagatggtgaacaaagtggggcagactgcattcgatgtggctgatgaggacatactcgggtatcttgaggaactgcagaagaaacagaatttgttacacagcgaaaaaagggataagaagtcacctctcatcgaaagcactgcgaatatggacaacaaccagagccagaaaacatttaagaacaaggagacgctgatcatagaaccggaaaagaacgcatcacgtattgagtcactagaacaggagaaagtggatgaagaagaggagggcaagaaggacgaaagcagctgctcatccgaagaggatgaggaagacgatagtgagtctgaggccgaaaccgataagaccaagcctctggcctccgtgactaacgcaaacacatcgtctactcaggctgcaccagtcgccgtgactactccaactgttagtagtggccaggcgacacctacatcccctatcaaaaagttccccaccacagcaaccaagatctcacctaaagaggaagaacgcaaggacgaaagcccagctacctggcgtctcggcctgcgcaaaacaggatcttacggagccttggcagagatcactgctagcaaagagggccagaaagaaaaggataccgctggcgtgacacggtcagcatcatccccccggctctcgtctagtctggataataaggaaaaggaaaaggacagcaaagggacccggctagcatacgttgcccccacgattcctaggaggctcgcctcaacctctgacattgaggagaaggagaacagagattcttcgagcctcaggacttccagcagctacactagacggaagtgggaagacgacttgaagaaaaacagcagcgtcaacgaaggttccacgtatcataagagctgttcctttggacggcggcaagatgacctaatcagcagctccgtgccaagcactacatctactcccactgtcacgtccgcggcgggtctgcagaagtcactcttatcatctacctcaactaccacaaaaattaccaccggcagttcatcggcaggaactcagtcctcaacgtccaatcgcctctgggcagaggattccacagagaaagagaaggatagcgtcccaacagcggtgacaataccggttgcccctacagtggtcaacgccgccgccagtactaccacactaactactaccactgcgggaaccgtttcaagtacgactgaggtcagggaaaggcggcgcagttatctaacgcctgttagagacgaagaaagtgaaagtcagcgcaaagctcgatctcgccaggctcggcaatcaaggcgcagtactcagggcgtgacccttacagacctacaagaggctgagaagaccattgggagatcccgctccactcggactagggagcaggaaaatgaagagaaggaaaaggaggaaaaggaaaagcaggacaaggagaaacaagaagagaaaaaggagagcgaaacctcccgagaggacgagtataagcaaaagtattcaagaacctacgacgagacctaccagagatataggcccgtgtccacatccagttcgacaactccatcaagttccctgagcaccatgagttcgagcctatacgccagctcccagctcaataggcctaactctctggtggggataaccagcgcatatagccggggtataacgaaggagaacgagcgggagggagagaaaagagaggaggagaaagaaggagaagataagtctcaacccaagtccatccgcgaacgaagacggccccgcgagaagcgaagaagcacaggtgtttcattctggacacaggactccgatgaaaacgagcaggagcaacagtctgataccgaggagggttcaaataaaaaagaaactcagacagattctatttcaagatacgaaacatctagtacatctgctggagatcggtatgattctctgctgggtagatccggctcgtactcctacctcgaagaacgcaagccctacagttcacggttggagaaagatgactcaaccgacttcaagaaactgtatgagcagatcctcgcagaaaacgaaaaactgaaggctcagctgcacgacactaacatggagctcacagaccttaagctgcagctagaaaaggcaacccagcggcaggaacgcttcgcagaccggagccttctagagatggagaaaagagagcgtcgggctctggaacggcggatcagtgagatggaagaggagttaaagatgctgccagacctgaaagccgacaaccagagactgaaggatgaaaatggcgccctgatccgtgtcatctctaaattgtcaaagtag

SEQ ID NO: 201497 - DNA, 3093 bp, Artificial Sequence
  Description of Artificial Sequence: Synthetic coding sequence
atgaagatggccgacgccaagcagaagcggaacgagcagctgaagcggtggataggcagtgagacagatctggagcctcccgtggttaaacggcagaagaccaaggtgaaattcgatgacggtgccgtatttttggcagcatgctcatctggcgacacagacgaggttctcaaactccttcatcggggggcagacatcaattatgcgaatgtcgatggactgacagccctgcatcaagcttgtatcgacgacaatgtcgacatggtcaagtttctggttgagaatggtgccaacatcaatcagcctgataatgaaggctggattcctcttcacgcagccgcctcatgcgggtacttggatatcgcagagtttctgatcggccagggagcccatgtcggagccgtcaacagcgagggcgacactcccctcgatattgccgaggaggaggctatggaggagctgctccaaaatgaggtaaaccggcagggagtcgatattgaggcggcaaggaaggaagaggaaaggatcatgctgcgtgacgcgagacaatggctgaactcaggacatattaacgatgtccgccatgcaaaatcaggaggtactgcgttacatgtcgcggcagctaagggctacaccgaggtcttgaaacttctgatacaggcaggttacgatgtgaacatcaaagactacgacggctggactccgctgcatgccgctgcacactgggggaaggaggaagcttgtcgcatcctcgtggataacttatgcgatatggaaatggtgaacaaggtcggccagaccgcctttgacgtggcggacgaggacatcctcggataccttgaggagctgcaaaaaaaacagaacttgctccattctgagaagcgggataaaaaaagtcctttaatcgagtccaccgctaacatggataacaatcaatcacaaaagacattcaagaataaagagacccttattattgaacccgaaaagaacgcctctcggattgaaagtttagagcaggagaaagtggacgaggaagaggaaggcaaaaaggatgagtcttcatgttcgagtgaggaggacgaagaagatgattcggagagcgaagctgaaaccgacaaaaccaaaccattggctagcgtgacaaatgcaaacactagcagtacccaagctgcccctgtggcagtgactaccccgaccgtgtcctccggccaggccaccccaacgtctccaattaagaagttccctactacagcaacaaagatctcaccaaaagaggaggagcgaaaagatgagtcccccgcaacctggcgcttagggctgcgaaaaaccgggagttatggcgccttagcggagatcaccgcttctaaggagggccaaaaagagaaggatacagccggcgtcaccagaagtgcttccagcccccggctttcctccagtttggataacaaggaaaaggagaaagactctaaaggaactagactcgcgtacgtggctccaactatcccgagacgcctcgcatccacgagtgacatcgaggaaaaggaaaatcgcgacagctcctccctgcgcacctcatcgagttacacaaggaggaagtgggaggatgacttgaaaaaaaatagctcagtcaacgagggaagcacctaccataaaagctgctcctttgggcgtaggcaggacgacttgatttcctctagcgtcccgagcactacgtcgacccccaccgtcacttccgcggctggtctgcagaaaagcctgctgagttccacttctaccaccaccaaaatcacgacgggctcaagttccgctgggacacagagtagcactagcaataggctgtgggcagaagatagcacagaaaaggagaaggattctgttcctacagccgtcaccattcccgtggcccccaccgtggtcaatgccgctgcctctacaactacgttgacaactacaacggccggcaccgttagctctacgaccgaggtgagggagagaaggcggagttatcttacccccgttagagatgaggagagtgaaagccagagaaaggctaggtcgcggcaagctagacagagcagacgctccacacagggggtgactttaaccgacttacaggaggccgagaagacaattggccgctcacgaagcacgagaacacgagagcaggaaaatgaagaaaaagagaaggaagaaaaagagaagcaagataaagagaagcaggaggagaaaaaagagagcgagaccagccgcgaagatgagtacaaacagaagtatagtagaacctacgacgagacctatcagagatatagacctgtctccacaagttcttctacaacaccttcgtcaagtctgtccacgatgagctcgagtctatatgccagttcgcagttaaaccgccctaattcactcgtgggaattacttccgcctactccagagggatcaccaaagagaatgagcgagagggagagaagcgggaggaggaaaaggagggagaagataagtcccagccgaagtccatccgggagaggcggcgacctcgcgaaaagcggaggagtacaggcgtgtctttctggacccaggattctgatgaaaatgaacaggaacagcagtccgatacagaagagggctctaacaagaaagagactcaagttaataccattaccctttacgaaacctcctctacttcggcaggtgatcgctatgattctctcctaggtagatcagggtcttactcctatctggaggaaagaaagccttactccagccggctggagaaagacgattcaaccgatttcaagaaactgtacgagcaaatactggctgaaaacgagaagcttaaagcccagctccacgacaccaacatggagctcacggatttaaagctgcagctggagaaagccactcagcgccaggagaggtttgcagatcggtcactgctggaaatggaaaagagagaaaggcgggctctggaacgccgcatttccgagatggaggaggagctgaagatgttacctgatctcaaagccgataaccagcgactcaaggatgagaatggagcgctgatccgggtcatcagcaagctgtccaagtag

SEQ ID NO: 201498 - DNA, 2832 bp, Artificial Sequence
  Description of Artificial Sequence: Synthetic coding sequence
atggtgaagttcctggtggagaacggcgccaacatcaaccagcccgataacgaaggttggatcccgctccacgccgctgcctcatgtggttatttagacattgctgagtttctgattggtcaaggcgcccacgtgggagctgtgaatagcgagggggacactccgctcgatatcgcagaggaggaagccatggaggagttgttacagaacgaggttaaccgacagggagtcgacattgaggccgcaagaaaagaggaggagcggattatgctgagggatgccaggcagtggctgaatagcggccacatcaacgatgtccgccacgccaaaagcggcggtactgctctgcacgtggccgccgccaaggggtacacagaggttctgaagctgttgattcaggctgggtacgacgtcaacataaaagactacgatgggtggacccctctgcacgccgccgctcactggggaaaagaagaggcgtgtcggattctggtggataacttgtgtgacatggagatggtaaataaggtgggacagaccgcctttgatgtagccgatgaggatattctaggttacctcgaagaactgcaaaagaaacaaaacttactccactctgaaaaaagagataaaaagtctcccctgatcgagagcactgctaacatggacaacaatcagtcgcagaagacctttaaaaataaggaaaccttgattatcgagcctgagaagaacgcttcccgcattgaaagccttgaacaagagaaagttgatgaagaagaggagggaaagaaagacgaatcatcctgttcctcagaagaggatgaggaagatgacagtgaatcagaagctgaaaccgacaaaacgaagccactggcctccgtgacaaatgcaaacaccagcagcactcaggctgctccagtggcagtgaccactccaacagttagcagcggacaggcaacgcctacatctcccataaaaaagttccctacaactgcaaccaaaatttcacccaaagaggaagaaagaaaagatgagagcccagcgacctggcgcctggggctccggaaaacagggagttacggggctcttgccgagatcactgctagcaaagagggacagaaggagaaagatactgccggggtgactcgttcggcatccagccctcgactttccagcagcctggataataaggagaaggagaaggattctaaggggacccgcctggcttacgtcgccccgaccatcccccgcagactggccagcacatcggacatcgaggagaaagagaatcgagattcttcctcattgcgcactagcagcagttacaccagaaggaagtgggaagacgacctgaaaaaaaatagctccgtgaacgagggctccacgtatcataaatcttgcagctttggaagacgccaggacgacctcatctcatccagtgtgccatctacaacctctacacctaccgtgacctctgcagcaggtctccagaaatccttgctttccagcacatccaccaccacaaaaatcacaacaggctccagttctgcaggcacacagtcctccacctccaataggctctgggcagaggacagtacggagaaagagaaggacagtgtgccaactgcagtaactattcccgtcgctccaactgtggtgaacgccgccgcctccactacaactttgaccacgactaccgccgggacagttagctcaaccacagaggttcgcgaacggaggcgctcatacctcacaccggttcgtgacgaggaaagcgagtcacaacggaaagctaggtctcgccaagctaggcagtcgaggcgttcaacccaaggcgtgacccttaccgacctgcaagaagccgaaaagacgataggccgctctaggtccacgaggacaagagaacaggagaatgaagagaaagagaaagaagaaaaggagaagcaggataaagagaaacaggaggagaagaaggagagtgaaacatcaagagaggacgagtataaacagaagtactctaggacatatgacgagacataccagcgatacagacccgtttcaacctcaagtagtaccaccccctcttccagtttgagtaccatgtcttcaagtctctatgcgagcagccagctcaatcgccccaacagtctcgtgggcatcacctccgcatatagtcgcggcatcaccaaggaaaacgagagagaaggcgaaaaacgggaggaagagaaggagggggaggacaagagtcaaccaaaatctattcgggagcgccgcagacccagagaaaagcgacgttccacgggcgtaagcttttggacacaggatagtgacgagaacgagcaagagcagcagtcagataccgaagaagggtctaacaaaaaggagacccagacagacagcattagcagatacgaaacatcatcaacctcagcaggcgatcgttatgattccctcctcggaagatccggaagttacagctatcttgaggaacggaagccctatagctccaggctcgaaaaggatgactccaccgacttcaagaaattgtatgagcagatattggctgaaaatgaaaagcttaaggcacagctgcacgacacgaacatggaactgaccgacctgaagcttcaactggaaaaggcaactcagagacaggaacggtttgccgataggtctctgcttgagatggaaaagcgtgagcggagggccctggagaggcgcatcagtgagatggaggaggagttaaaaatgctacccgatctgaaggccgacaaccagcggctcaaagatgagaatggagcactcattcgggtgattagtaagctgagcaagtag

SEQ ID NO: 201499 - DNA, 2925 bp, Artificial Sequence
  Description of Artificial Sequence: Synthetic coding sequence
atgaagatggccgacgccaagcagaagcggaacgagcagctgaagaggtggatcggatctgagacagacctggagccaccggttgtcaagagacagaagaccaaggttaaatttgatgatggagctgtattcctggctgcctgttcctctggcgatacagacgaggtacttaagctcctgcataggggagcagacatcaactacgctaacgttgatggtctgaccgcactccaccaggcctgcatcgacgataatgtggatatggtgaagtttcttgtcgaaaacggagccaacatcaaccaaccagacaacgaaggctggatccccctccacgccgccgccagctgcggatacctagacatcgcggagttccttatcggtcagggagcccacgttggcgccgtcaactccgaaggtgacacccccttggatattgccgaagaggaggccatggaggaactactgcagaacgaggttaaccgccagggtgttgatatagaggctgcccgaaaagaagaagagaggatcatgctcagggatgctcgtcagtggctcaactctgggcacatcaatgacgtcaggcatgctaaaagtggcggcacggctctgcacgtggcagccgctaagggctacacagaggtactgaaacttctaatccaggcaggctacgatgtgaatattaaagattatgacggctggactccactgcacgccgccgcacactggggcaaggaagaagcatgtcgaattctggtcgataatttgtgcgatatggaaatggtgaacaaagtggggcagactgccttcgatgtagccgatgaagacatcctggggtaccttgaggagctgcagaagaagcagaatttactccatagcgagaaaagagataagaagagccccttaatagagtccactgcaaatatggacaataaccagtcacagaaaacatttaagaacaaggagaccctcatcattgaacccgaaaaaaatgcgtcgcggatcgagagcctggaacaggaaaaagtggacgaagaggaagaaggaaagaaagatgagagctcctgtagcagcgaagaggatgaagaggatgactcagagtcagaagccgagactgacaaaacaaaacccctcgcctcagtgacgaacgcaaatacctcatccacacaggccgcgccagttgctgtgacaacccccacagtctccagcggacaggccacacctacgtcgccaataaaaaaattcccgaccaccgcgaccaagatatcgcccaaggaagaggaacggaaggacgaaagtcctgccacatggcgcctcggacttagaaaaaccggatcatacggggccttagccgagataacagcatcaaaggaagggcagaaggagaaagacaccgctggcgtgacaaggtccgcaagttccccacgcctttcttcctccttggacaataaggagaaggagaaagactccaaggggacccgtctcgcctacgtcgcgcctacgattcctcggcggctggccagcaccagcgacattgaggagaaggagaatcgggacagttcttccctcagaactagctcctcttacacaaggaggaaatgggaggacgatctgaagaaaaacagttccgtgaacgagggctccacataccacaagtccacaagcaaccggctgtgggctgaagactcgaccgagaaagaaaaagatagtgtccccactgctgttaccattccagtggcccctacagtggtgaatgccgcagcttcaaccaccacactgacaaccacaactgccgggaccgtgagtagcaccacggaggtgagggagaggaggaggagctacctgactcctgtgagggacgaagagtctgaatcccaacgaaaggcgagatctcggcaggcccgacagtctcgtagatctacacaaggtgtgactctcactgatttgcaggaagctgagaagactataggacggtcaagatccacacgaacgcgggagcaggagaatgaggaaaaagaaaaagaggagaaagagaaacaagacaaagaaaaacaagaagagaagaaagagtctgaaacgtctcgtgaggatgagtacaaacagaagtattcacggacctatgatgagacataccagagataccgtccagtgtccacatcctcctccacaaccccctccagcagcctgtcaacgatgtctagttcactctacgcgagctcccagctcaaccgccccaactcactggtcgggatcacgtcagcatattcgagaggcattacaaaagaaaatgaacgcgagggtgagaagcgcgaggaagaaaaggagggggaagataagtctcagcccaaatccattagggagagaaggagaccgcgggagaagcgaaggtcaacaggggtcagcttctggactcaggatagcgatgagaatgagcaggaacagcagtccgacacggaagaaggaagtaacaaaaaggagactcaaaccgactccatttcacgatatgaaaccagctcaacctccgctggtgaccgctacgactcccttttgggccgctccggaagctatagctacctggaggaacgaaaaccttacagctcacgcttggaaaaagatgacagcaccgatttcaaaaagctatatgagcagatcctggccgaaaatgagaagctgaaggcccagttgcacgatacaaatatggagctgacggatttaaaactgcaattggagaaggccactcaaagacaagaacggtttgctgaccgatctctgctcgaaatggaaaagcgagaaaggagggccctggagcggaggatatcagaaatggaagaggagctgaagatgttgcccgatctgaaggctgataatcagcgcctgaaggacgagaacggcgcactgatcagggtaatttccaagctttcaaagtag

SEQ ID NO: 201500 - DNA, 2949 bp, Artificial Sequence
  Description of Artificial Sequence: Synthetic coding sequence
atggccgagctggagcacctgggcggcaagcgggccgagagcgcccgcatgagaagagcagagcaactgcggagatggcgagggagcctgaccgagcaggagcccgcagagcggagaggcgctggtcgacagcccctcacacgccgaggtagtcctagggtccgctttgaagatggcgcggtttttctggctgcttgcagtagtggggataccgatgaggttcggaaactgctggctcggggagcggatattaacactgttaacgtagacgggttaactgcccttcaccaggcctgtatcgatgaaaacttagacatggttaagttccttgttgagaatcgcgccaatgttaatcagcaggacaatgagggctggaccccacttcatgctgcggctagctgtgggtatttgaatattgcagaatattttattaaccatggggccagcgtggggatcgtgaacagtgaaggagaagtaccctctgatctggccgaggagcccgctatgaaggacctgctgctggaacaggtcaagaaacaaggagttgacctcgaacagtcccggaaggaggaagagcagcagatgctgcaggatgcacggcagtggctgaattccgggaaaattgaagacgtccgccaggcaaggtccggagcaacagccctgcacgtagccgcagccaaaggatattcagaggtcctccgtctcctgattcaggccggttatgagcttaacgtgcaggattatgacggatggactcccctccatgccgctgcacattggggagttaaggaggcatgtagcatcctcgcagaggcactgtgcgacatggatatccggaacaaacttggccagacgccctttgatgtggcagacgagggacttgtagagcacctcgagctgctacagaaaaagcagaacgttctgaggtccgaaaaagagaccagaaataagttaattgaaagtgacctgaacagtaagatacagtccggtttcttcaagaataaagaaaaaatgctctatgaagaggaaacccccaaatcgcaggaaatggaagaggaaaataaggaatcatcttcaagctcttctgaagaggaagaaggggaggatgaggcctcagaaagtgaaacggaaaaagaggcagataagaagcctgaggcattcgtgaatcattccaatagtgaaagcaaaagcagcattactgagcagattccagctcccgctcaaaataccttttctgcctcttcagctaggaggttctcttcagggctttttaataagcccgaagagccaaaagatgagtccccgtcaagctggcggctcgggctgcgcaaaacgggatcccataacatgctcagcgaagtggcaaatagcagagaaccgatcagagatcgaggttcttcaatttatcgaagctccagctccccgaggatcagtgctctgctcgacaacaaggataaggaaagggagaacaagagctatatttcatcactcgctccacggaaactgaattcgactagtgatatcgaagaaaaggagaacagggagtcagcagtgaacctcgttcgttcagggagctacacgcggcagctctggcgggacgaagccaaaggtaacgaaattccgcaaaccatagcaccttccacatacgtcagcacatatttgaagaggacaccgcacaagagccaggctgacactaccgccgagaagaccgccgacaacgtgagcagctccacacccctgtgtgtgataaccaacaggcctctgccctccaccgccaatggggtgaccgcgactcccgtcctgagtatcaccgggactgattcctccgtagaagcccgggagaaaaggcgtagctatctgacacccgtgagagacgaggaggccgagtctcttcgaaaggctcgctctaggcaagcacgacaaaccagacgttctactcaaggagtgaccctgacagacctccaggaggccgagcgaacgttttcacgctccagggcggagcgtcaggctcaggagcaaccccgggagaagcccactgacacagaaggcctagagggctcccccgagaagcacgagccttccgcagtccccgcgaccgaggcaggtgagggtcaacagccatggggacggtctcttgacgaagagcccatctgtcaccggctgcgctgcccagcccagccagataagccaactacaccggcgtcgccttcaacatcccggccctctctgtatacctcgtctcaccttctgtggacgaacagattttctgtccctgactccgagtccagtgaaaccacaacgaacacgactaccgctaaagagatggacaaaaacgaaaatgaagaggccgatctggatgaacagagctctaaaaggctgtcaatccgggagcgcagacgccctaaggagagaaggcggggcactggcattaacttctggaccaaagacgaggatgagaccgacgggagtgaggaagttaaagagacatgggccgaaaggctcaagcgtttggagtcaggcggttccaatccaaccactagtgacagctatggcgatcgcgcctcggccagggctcgacgggaagcccgcgaggcacggttggccaccctgacttccagggtggaggaagacagcaacagggactacaaaaaattgtacgaaagcgcactgaccgaaaaccagaagctaaagactaagctgcaggaagcacaactggagctggccgatatcaagagcaaactggaaaaggtcgcccagcagaagcaggaaaaaacctcggataggtctagcgttttagaaatggaaaagagggagagaagggcactagaaaggaaaatgtcggagatggaagaggaaatgaaggttcttaccgagctgaagtccgacaatcagcgattgaaggacgagaatggtgcccttatccgggtgatctcaaagttgagcaaatag

SEQ ID NO: 201501 - DNA, 1161 bp, Artificial Sequence
  Description of Artificial Sequence: Synthetic coding sequence
atggccgagctggagcacctgggcggcaagcgggccgagagcgcccgtatgcgccgcgccgagcaactccggaggtggcgagggagcttaacagagcaggagcctgccgagaggcgaggggcaggcaggcagccacttacgaggcgcgggtcaccaagagtgcggttcgaagatggggctgtgttcctggcagcttgctcaagcggtgacactgatgaagttcgtaaactgctcgcccgcggcgcagatattaatacagtcaatgttgatgggctgacagcacttcaccaggcctgtattgacgagaatttggatatggtcaaattcctcgtggaaaatcgggctaatgtcaaccagcaggataatgagggttggactcctttgcatgctgctgcaagctgcggttacctgaatattgcggaatactttatcaatcacggcgcctctgtgggcatcgtgaattctgaaggagaagttccaagcgaccttgcggaagagcctgcaatgaaagatctcctcttggaacaggtcaagaaacagggagtggacctggaacagtcccggaaagaagaagaacagcagatgctgcaggatgccaggcagtggcttaacagtgggaaaatagaggacgtgcggcaagcccgatccggcgcgactgccctgcacgttgccgcggcaaaaggctacagtgaggtgctgcggcttctcattcaagccgggtatgaactgaacgtgcaggactatgatgggtggactccactccacgccgctgcccattggggcgtgaaagaggcctgttccatcctggccgaggctttatgtgatatggacatccgaaataaacttggacagactccattcgacgtggccgacgaagggctggttgaacatcttgagcttttgcaaaagaagcaaaacgtgcttagaagcgaaaaagagacccgaaataaactcatcgagagcgacctcaatagtaagatccagtcaggattcttcaagaataaagagaagatgctgtacgaggaagaaactcctaaatcacaggaaatggaagaagagaataaagaaagttcctcatctagttctgaggaggaagagggtgaagacgaggcctcagaatctgagacagagaaggaagcagtccttttctggcccttctag

SEQ ID NO: 201502 - DNA, 675 bp, Artificial Sequence
  Description of Artificial Sequence: Synthetic coding sequence
atggacaagaacgagaacgaggaggccgacctggacgagcagagcagcaagaggctgtccattagagagaggcgtcgcccaaaggagcggagaaggggaacagggatcaatttctggaccaaagatgaggacgagactgacggctccgaagaagtgaaggaaacctggcatgagcgactaagccgcctggagtccggcgggagcaatcccacgacttccgattcctatggcgacagggctagcgccagggcaagaagagaagccagggaggcccggctggccaccctcacaagcagggtagaagaggatagcaatagggattacaagaagctctatgaatcagcattaactgagaaccaaaaactgaagacaaaattacaggaggcccagttggagctggccgacattaaatctaaattagagaaggtcgcccagcaaaaacaggagaagacgtctgaccgttcgtcggttctggagatggagaagagggagcggagggcccttgaacgcaagatgtctgagatggaagaagaaatgaagaatctgcatcagctcaaacagattcagacgctcaagcaaatgaacgagcagttgcaagccgagaaccgcgcgcttacaagagtggtggctaggctgtcagaaagcatcgagagttctgatacacaagaattgtag

SEQ ID NO: 201503 - DNA, 627 bp, Artificial Sequence
  Description of Artificial Sequence: Synthetic coding sequence
atggacaagaacgagaacgaggaggccgacctggacgagcagagcagcaaacggctgagtatacgggagcgccgtaggcctaaggagaggcggcgcgggacaggcattaatttctggacaaaggatgaggacgagactgatggatccgaggaggtcaaagagacatggcacgaaaggttaagcagacttgaaagcggcgggtcaaaccctaccaccagcgacagctacggagacagagcttcagccagggcccgcagagaggcgcgagaggcgagactagctactcttacatctcgagtcgaagaggatagcaatagggactacaagaagctctacgaatccgccttaactgagaaccagaaactgaaaacaaaactccaggaagcccagcttgagctggctgacataaaatcaaagctggaaaaggtggctcagcagaagcaggaaaaaacaagtgaccgtagctctgtgctggaaatggagaagagggagaggagagcactggaaaggaaaatgtccgagatggaggaggagatgaaggtgctcaccgagctgaagtcagacaaccagcggttaaaggatgaaaatggcgccctgattcgcgtgatctcgaagctgagtaaatag

SEQ ID NO: 201504 - DNA, 2949 bp, Artificial Sequence
  Description of Artificial Sequence: Synthetic coding sequence
atggccgagctggagcacctgggcggcaagcgggccgagagcgcccggatgcgcagggctgaacagttgcgcagatggcgagggtctctcaccgagcaggaacccgcagagagacggggagcgggcaggcagcctcttacgcgcaggggcagtccccgagtccgtttcgaggacggcgctgtgtttctcgccgcttgttcctctggagacacagatgaggtgcgcaaactgctcgcgcggggtgctgacataaacacggtcaacgtggacggccttactgcgctccaccaagcttgtatcgacgagaacctggacatggtcaaattccttgtggagaaccgggcaaatgtgaatcagcaggataacgaaggttggacacccctccatgctgccgcgtcatgtgggtatctcaatatagcagaatacttcatcaaccatggcgccagtgtgggcatcgtcaattctgaaggtgaggtgccttccgacctggccgaagagcctgctatgaaagacctactattggaacaggtgaagaagcagggcgtggacctggaacagtctcggaaggaggaagaacagcaaatgctgcaggatgcacgccagtggctgaacagcggaaagattgaagacgtgcgacaagctagaagcggagcgacagctctgcacgtggccgcagctaaagggtactcagaagtccttaggctgcttatccaagccggttacgagttgaacgtccaggactacgacggttggacccccctgcacgccgcagcacactggggagtaaaggaagcctgttctatactggctgaggcactctgcgacatggacattcgtaataagctgggtcagacaccctttgacgtcgctgacgagggactcgttgaacatctcgaactgcttcagaagaagcagaacgtgctgcggtctgaaaaagagaccaggaacaagctgatcgaatctgacctgaactcaaagatccaatccggatttttcaaaaataaggagaagatgctgtatgaagaagagaccccaaagtcacaggaaatggaggaggagaacaaggaaagctcatcctcttcttcagaggaggaggaaggagaggacgaggccagcgaaagcgagacagagaaggaagctgacaagaaaccagaggctttcgtcaaccatagcaactctgagtcgaagagtagtattaccgaacagattcctgcgcccgcccagaataccttctctgcttcctcggcacggcgtttttcatccggactgtttaacaagcctgaagaaccaaaggatgagtccccatccagctggcggctggggctcagaaagactggatctcacaacatgctttccgaggtggctaactcgcgcgagcctatcagagatagagggtcctcaatttacaggagctccagtagtcctcggatctctgcacttcttgataacaaagacaaggagcgggagaacaagtcctacatttcgtctctggcgccgcggaaacttaactctacttctgatattgaggagaaggagaaccgtgagtcagctgtaaatctcgttagaagtggctcttacaccaggcagctctggcgcgacgaggcgaagggaaatgagattcctcaaactatcgcaccaagtacctacgtgtcaacctacctgaaacgtacacctcacaagagccaggcagatacgactgctgaaaaaacagcggacaatgtcagtagtagtacccccttgtgcgtgatcaccaaccgaccgctccccagtaccgctaacggcgtcaccgccaccccggtactgtcgattaccgggacagacagcagcgtggaggccagagaaaagagaaggtcctatttgactcctgtccgtgacgaggaagccgaatctctgcgcaaggcgcggagcaggcaggcccgacagacgagacggagcacgcaaggcgtgactctaacagacctccaggaggccgagagaacctttagccggtctagagctgagaggcaagctcaggaacagcccagggagaaacctacggataccgaaggcctggagggaagccccgagaaacatgaaccgtcagctgtaccagcaacggaggccggcgagggacagcagccttggggcaggagcttggatgaagagccaatctgtcaccggttacggtgtcctgcccagcccgataaacccacgacacctgcctctcccagcaccagccgtcctagtctgtacacctcatcccatcttttgtggacaaatcggttttctgtacctgacagcgagtcatccgaaactacaacgaacacaaccacagctaaggagatggacaagaatgagaacgaggaagccgatctggacgagcagagctcaaagcggctatccatccgtgaaaggcgcagacctaaggaacggaggcgaggcacgggcataaatttctggacaaaggacgaggatgaaacagacggaagcgaggaggtgaaggagacatggcatgagaggctgtcccgacttgaatcaggcggctccaatcccactaccagtgactcttacggcgaccgcgccagcgcgcgggctcgtagggaagctagagaagcccgcctggctacattaactagcagagtcgaagaggattctaaccgggattacaaaaaactgtatgagtccgctctgaccgaaaatcagaaacttaagacaaaactgcaagaggcacagcttgagcttgccgatatcaaaagcaagctagagaaggttgctcaacagaagcaggagaaaacatctgaccggtcgtccgtcttggaaatggagaaacgtgagaggagggccctagaacgcaaaatgtcagagatggaggaggaaatgaaggttcttaccgagctgaagagtgacaatcagagactgaaggacgaaaatggcgcactgatccgcgtgatctctaagctctctaaatag

SEQ ID NO: 201505 - DNA, 2349 bp, Artificial Sequence
  Description of Artificial Sequence: Synthetic coding sequence
atgagcggcgaggacggccccgccgccggccccggcgccgccgccgcggctgctcgggagcgtcggcgtgagcagctccgccagtggggggcgagagcgggggcagaacccggcccaggtgaacgaagggcccgcacagtacgtttcgagagagctgccgaattcctcgcagcttgcgcaggcggcgatctggacgaagcccggctgatgctgcgggctgcagacccagggccaggcgccgagttagatcccgcagcccccccccctgctcgcgcagtgttagattctacgaatgccgacgggatatcggcccttcatcaggcctgcattgacgagaacttggaggtggtcagattcttggtcgagcaaggcgccaccgtcaaccaagccgataacgagggctggacgccactgcacgtggccgcgagttgcggctatctggatatcgcccggtatctgctgtcccacggggcgaacatcgcagctgtcaactccgacggggatttgcccctggacctggccgaatcagacgcaatggaaggtctgctcaaagctgagatcgcgaggagaggcgtagatgtggaggccgctaaaagagccgaggaggaactgcttctgcacgatactcgctgttggctaaatggaggggcgatgcctgaggcccggcaccctcgcactggggcaagcgccctgcacgtggctgcagccaaaggatacatcgaggtgatgcgtttgctgctgcaggccggctatgacccagagctgcgagatggagatggctggacccctctgcatgcagcagctcactggggcgtagaagatgcttgtcgtcttctggcagaacatggtggcggcatggatagcctgacccacgcaggtcagcgcccgtgcgatctggctgatgaggaggtactgagcctgctcgaagagcttgcccgaaagcaggaggatttgcggaatcagaaagaggctagccaaagtcgaggccaggagccacaagctcccagctcatctaagcataggagaagcagtgtgtgccgtttgtcttcgagagagaagatttctttacaggatcttagtaaagagcgccggcccgggggcgcaggcgggcccccaatacaagacgaggacgaaggagaagaagggcccaccgagccgccccctgccgagcctagaactctgaacggagtctcaagtcccccacacccgagcccgaagtctcctgtgcaactggaggaggctccgttttcaagacgattcggtctccttaaaacgggatcatcgggcgctctgggcccaccggagcgcaggaccgccgagggcgccccaggcgcgggcttacagcgcagcgcttcgtcctcatggctcgaaggcacatctacgcaagcgaaggagctccgcctggctaggatcacccctacgccatcccccaagcttcccgagccgagcgtgctgtcagaggtcactaaacctcctccatgtctggagaacagttcaccaccctcccgaatccctgagcctgagagcccagcaaagcccaacgtcccaactgcaagcacggcccctcctgcggatagcagggaccgcaggagatcataccaaatgccggtgcgcgatgaagagagcgaatcccagagaaaggccaggtctcgcctgatgagacaatctcggagatctacccaaggagtcaccttgacggatctgaaggaggccgagaaagccgccggtaaagccccggaaagcgagaagccagctcagagtctcgacccaagccggaggccaagggtgcctggagtcgagaacagcgacagccctgctcagagggccgaggcccccgatgggcaggggccagggcctcaggcagcacgcgagcatagaaaagtgggaaaagagtggaggggccctgccgaaggcgaggaggctgaaccagccgataggagccaggagtccagcacactggaagggggcccatctgcaagacgccagcggtggcagagggacctgaaccctgagccagaacccgagtccgaagagcccgatggtggctttaggacactgtatgccgagctgcggcgggagaacgaacgcctccgggaagccctgactgagaccaccctaaggttggctcagctgaaggtggagctggagcgtgctacccagcgccaggagagattcgcagaacggcctgcgctgctcgaacttgaacggtttgagcgacgagcacttgaacgaaaagccgcagaactcgaagaagaactgaaagccttgtccgacttacgcgctgataaccaacgcctcaaagacgaaaacgcagcattgattagggtcattagtaaactgtcgaaatag

SEQ ID NO: 201506 - DNA, 2160 bp, Artificial Sequence
  Description of Artificial Sequence: Synthetic coding sequence
atgagcggcgaggacggccccgccgccggccccggcgccgccgccgcggccgccagagagcggcggagggagcagctgagacagtggggagcccgtgcaggggctgagcccggtcccggggagcggagggcccgtacggtgagattcgagagggcggctgagttccttgcggcctgtgctggcggagacctggacgaggctagactgatgctgagagcagccgaccccggccctggagctgagcttgacccagccgctcccccccctgcaagagccgtgctcgactccacaaatgctgatgggatttccgccctacatcaggcctgtattgacgagaatctggaggtggtccgcttcctggttgagcagggagccacagtgaatcaggccgacaatgaaggctggactcctctgcacgtcgctgcctcttgtggttaccttgatatcgcccgctatttgttaagccacggtgcaaatatcgccgcagttaattccgatggtgaccttcctctggatctcgcagagtcagatgccatggagggcctgctgaaagccgagattgcccgcagaggggtggacgttgaggcggccaaacgggcagaagaggagctcctcttgcacgacactcggtgctggctgaatggcggggccatgccagaggcgagacaccctagaactggcgccagtgccctccatgttgccgccgctaagggatatatagaggtgatgcgtctcctactgcaagcaggttatgacccagagttgcgggacggagatggctggacgcccctccatgcagcggctcattggggagtcgaggacgcatgccgcctacttgcagagcacggcgggggaatggatagcctcacacatgctgggcaacggccttgcgacctcgctgacgaagaagttctgtccctgctcgaggagctggcgagaaaacaggaggacttacgaaatcagaaggaagcgtctcagagcaggggacaagagccacaagcgccatcttcatcaaagcatagaaggtccagcgtgtgcagactgtcctcaagggaaaaaatttctttgcaagacctaagtaaagaacgtcgacccggcggcgctggtggcccgcccattcaggacgaagacgaaggtgaagaaggtcctaccgagcctccacccgcggagccccgcacgctcaatggtgtgtccagccccccccacccatcacccaagtcacccgtacaactggaagaagcacctttttcccgccggttcggactactaaaaacaggaagcagcggcgccctggggcccccagagagaaggacagccgaaggagcccctggcgccggtctgcaaagaagcgcatcctcatcctggctagaaggtacctccacacaggcaaaagaactgaggctcgctcgcatcacccccacgccatcccccaagctccccgaaccctccgtgctctccgaagttacaaagccaccaccctgtctggagaactccagccccccatctaggataccagagcccgagtctcccgcaaagccgaacgtgcctacagcctctactgcccccccagcagacagcagggataggcggcgcagttaccaaatgccagttagggatgaggaatctgaatcccaaaggaaggccaggtctcgcttgatgcggcagtcgcgacgcagcacccaaggcgtgacgctaacagatttgaaagaggcagagaaggctggcgaggaagcagagcctgctgatagaagccaggaatctagtaccttagagggaggcccatcagcccgccggcagcggtggcaacgggatttaaaccctgaacctgaacccgagtctgaagagcctgatggtggcttcaggacactgtatgcagagctgcgcagagaaaacgagcgacttcgcgaagctctcaccgagactactcttagacttgctcagctgaaagtggaactggaaagggccactcaacgccaggaaaggtttgcggagcgtccagcactgctcgagttggaaagatttgagcgccgcgccctggagcgcaaagccgccgagctcgaggaagaattaaaggccttatctgacctgagagctgataatcaacggttgaaagatgaaaacgcagccctgatccgtgtgatttctaaactctctaaatag

SEQ ID NO: 201507 - DNA, 2124 bp, Artificial Sequence
  Description of Artificial Sequence: Synthetic coding sequence
atgcggaacggcggcccctgccagcccctggccgccggcccccgggccgaaggtgccagtgtgaactggtccgtgacggcttgggggcccggaacacaagcctgcatcgatgagaacctggaagttgttcggttcttggtggagcaaggcgcaacagtgaaccaggcggataatgaaggttggacaccactccacgtcgctgcttcctgcgggtacctcgacattgcccgttaccttctgtcgcacggagcgaatatcgccgcagtgaactccgacggagatctgcccttggatctggcagagtccgatgccatggagggcctgctgaaagcagaaattgcaagacgtggcgttgacgtcgaggctgcgaagagagccgaagaagagttactgctccatgacacccgctgctggctgaacggcggagccatgcccgaggcccgtcacccacgcactggcgcttccgcccttcacgttgctgcagctaagggctacatcgaggtgatgcggctgcttcttcaggcaggttatgatccagagctgagagacggcgatggatggaccccgttgcacgctgctgctcattggggagtggaagatgcctgtagacttctcgcagaacacggaggcgggatggactccctcactcacgccggacagaggccgtgcgatttggctgacgaagaagtgctaagtctccttgaggaactcgccaggaaacaggaagacttacggaaccaaaaagaagcctctcagagcagggggcaggagccccaggcaccctcaagctccaagcaccgcaggtcctctgtatgtagactctcttcccgcgagaaaatctcactacaggatctcagtaaagagcgtcggccgggcggcgccggtggcccacctatacaggatgaggatgagggtgaggaaggccctaccgaaccacctcccgcagagccgagaacattgaacggcgtgagctctcctccgcacccatcgcctaagtccccggtgcagctcgaggaagctccattttctagacgattcggactactgaagaccggatcttcaggcgctctgggcccgcccgagcgccggactgctgagggggcacctggagcaggactgcagagaagcgctagtagctcctggctagaggggacctctactcaggcaaaagagcttaggttggcccggataacaccaactccctcccctaaattgcccgagcctagcgtattgtcagaggtaactaaaccccctccttgcctagagaactcctcgccccctagcaggatccctgagcccgaatccccagcaaaacctaatgtacccaccgccagtactgccccccccgccgactccagagatagaaggagaagctatcagatgccagttcgggatgaggaatcagagagtcagagaaaggcacggagtagactcatgcgccagagcaggcgcagcacccaaggcgtcaccctgacagacctgaaggaggccgaaaaggcagccgggaaggctcccgaatctgaaaagcccgcacagagtctggacccttcgcgcaggcctagggtacccggggtcgagaattctgactctccagcacagagagaagctcctgatgggcaaggccccggacctcaggccgcacgggagcaccgcaaggtcgggaaggaatggagagggcccgcggaaggcgaggaggcagagcccgcagacaggagccaggagtccagcacccttgaaggaggcccttcggcgcgtcgacagcggtggcagagagaccttaaccctgagcccgaacctgagtctgaagaaccagacggtggtttccgtactctgtatgccgagctgcgccgagaaaatgagcgcctaagggaggcccttacggagaccactctccggctggcacagctgaaggtcgagttggaaagagcgacacagcggcaggaaagatttgccgagcgcccagcattgttagagctggaaagatttgagcggagagcgttggagcggaaagccgcagagctcgaggaggaactgaaggcactgtctgaccttagggcagataatcagcgcttaaaggacgagaatgccgccttgatccgagtaatctcaaaactatccaagtag

SEQ ID NO: 201508 - DNA, 2142 bp, Artificial Sequence
  Description of Artificial Sequence: Synthetic coding sequence
atggagcccggcaccggcggcagccggaagcggctgggcccccgggcaggattccggttctggcctcccttcttccctaggcgctcacaggctggaagctccaagttcccaacccccctcgggcctgaaaattcagggaaccccacgctcctgtcgagcgcccaaccagagacgcgggtcagctattggacaaaactgttatcccagcttctggctccacttccaggcctgctacaaaaagtacttatttggtcccagctgttcgggggaatgtttccgactcggtggctggactttgctggggtctactctgctctcagggctttaaaagggagggagaagccagcggcccccaccgctcagaagagtctgagctcactgcagctggattcatccgacccttcagtgacgtccccactggactggctggaggagggcatccactggcagtactctccacctgatctgaagctcgaactgaaagccaaggggtccgctcttgatccagcggcacaggccttcctgttggagcagcagttgtggggggtcgaattactccccagtagcctccagagcagactgtactcaaatcgggagttgggttccagcccgagcggcccactcaatattcaaagaattgataactttagcgttgtctcttacttgctaaatccctcatacctggactgtttcccacggctagaggtctcttatcagaattcagacggtaactctgaggtggtagggttccagaccctgaccccagagtcatcgtgtctgcgggaggaccactgccatcctcaacccctgagcgctgaacttatcccggcctcctggcaagggtgcccgcctctgtccaccgaaggactccctgaaatccaccatctcagaatgaagcgcctggagttcctccagcaggctaacaaaggccaggatctccccacacctgatcaggacaatggataccattcacttgaagaggagcatagcttgctgcgcatggacccaaaacactgtagggataacccgacccagtttgtgcccgcagcgggagatattcctgggaatactcaggagtctactgaagaaaagatcgagttgctgacgactgaggtgcccctcgccttggaagaagaatctcctagcgagggctgtcccagctctgaaattccaatggagaaggaaccgggtgaggggcgcatctcagtggttgattattcctatctggagggggacctgccaatctctgcgcggcctgcctgctcaaataaactgatagattatattctcggcggagcttccagcgacctggaaaccagcagcgatcccgaaggcgaggactgggatgaggaagctgaagacgacggattcgattctgattcatctctgagcgattccgacctggagcaggaccccgaaggactgcacctctggaactccttctgcagcgtagatccttacaatccacaaaactttacagccaccatccaaacggcagcacgaattgtgccagaagaacctagcgactccgagaaggacctctccggcaaaagcgatctggagaattcatcccaatccggttcattaccagagacccccgagcactcctctggggaagaagatgactgggagtctagcgcggatgaagcagaaagtctgaagctgtggaatagtttctgcaacagtgacgatccctacaacccactcaactttaaagcaccattccagacctctggtgaaaatgaaaagggttgcagggacagcaaaactccttccgagtccatagttgccattagcgaatgccacacactgctaagttgtaaagtccagctgttggggagtcaggagagcgagtgccccgatagtgttcagagggatgtgctatccggtggcagacacacacatgtcaagaggaagaaagtgaccttcttggaggaggtcacagaatactatataagtggggacgaggaccgcaaagggccatgggaggagtttgcacgtgacggttgtaggttccagaaaagaatacaagagacagaagacgccataggctactgcttgacctttgagcaccgcgaacgaatgtttaataggctgcaaggaacttgcttcaaaggtcttaacgtgcttaaacaatgctag

SEQ ID NO: 201509 - DNA, 1872 bp, Artificial Sequence
  Description of Artificial Sequence: Synthetic coding sequence
atgttccccacccggtggctggacttcgccggcgtgtacagcgccctgcgcgccctgaaaggccgcgagaagccggccgcaccaaccgctcagaagtccttgtcatctttgcaattggacagctcggatccctctgtaacaagtcccctcgactggctggaagagggtatacattggcagtacagcccgcccgatctgaagctggagctaaaagctaaaggttccgcgttggatccagctgcccaggccttcttgcttgagcaacagctttggggcgtcgagctactgccatcgtcacttcagagcaggttatactcgaacagagagcttggatcttcgccatcaggacccctgaacatccagagaatcgataactttagcgtcgtgtcctacttactgaatccctcctatctggactgcttccctaggcttgaagttagctatcaaaactccgacggtaactccgaggtagtgggctttcaaaccctgacgcccgaaagcagctgccttagggaggatcattgtcaccctcagcccctgagcgccgagctcatcccagccagctggcagggctgccctcccttgagcaccgaagggctgccggagatacatcacctgcgaatgaagcgcctggaattcctgcaacaagcaaacaagggacaagacctgcccactcccgaccaggataacggctaccatagccttgaagaggagcactcactgctgcgaatggatcctaaacattgcagagacaaccctactcagttcgtgcccgccgctggagatatcccaggcaatacccaggaaagtacggaggagaaaatcgaactgctgacaactgaagtccccctggccctggaggaagagtctccctcggaaggctgtcccagcagcgagatacccatggagaaggaacctggagaagggagaataagtgtggttgactattcttacctggagggtgatcttccaatcagcgctagacccgcctgttctaataagttgattgattacattcttgggggagcaagtagtgacctggaaacatccagtgatcccgaaggcgaagattgggatgaagaggcagaggatgacgggttcgacagcgacagcagcctgagtgatagcgatttagaacaggaccctgagggcttgcatctatggaactccttctgctccgttgacccttacaatccccagaacttcactgcaacgatacagaccgcagcccgtatcgttcccgaagagccttcagattcagaaaaggatctgagtggtaagtccgacctggaaaattcatcgcagtccggcagcttacccgagaccccggaacacagcagcggggaggaagacgactgggagagctctgctgacgaggccgagtccctcaagctgtggaattctttctgtaacagcgacgacccttataatcccctcaactttaaggcgcctttccagacctctggagagaacgagaaaggatgtagagattctaagacacctagcgagagcatcgtggcaatctcagagtgtcacacactgcttagctgtaaggtgcagctgctggggtcccaggagtccgagtgccctgatagtgtgcagcgcgatgtactgagcggaggacgccatacacatgtcaaacggaagaaggtgacatttttggaggaagttactgagtattacattagtggggatgaagataggaaaggtccttgggaggagttcgcgagggatggctgtcgctttcagaaacgtatccaggagactgaagatgccattggatattgcctgacctttgaacatagagaaaggatgtttaatcgcttgcaaggcacctgcttcaaggggttgaatgtacttaagcagtgctag

SEQ ID NO: 201510 - DNA, 1704 bp, Artificial Sequence
  Description of Artificial Sequence: Synthetic coding sequence
atggccagccacgtggacctgctgaccgagctgcagctgctggagaaggtgcccactctcgaacgcttgcgtgctgctcaaaagcgtagggcccagcagttgaagaagtgggcccagtatgaacaggacttgcagcaccgcaaaaggaaacacgaaagaaagcggagtactggcgggcggcgaaagaaagtgtcattcgaagcctccgtggctctcctggaagcgagcctgcggaacgatgccgaggaggtccggtactttctgaagaacaaggtcagtccggatctctgtaatgaagatggactgacagctctacaccagtgctgtatcgacaattttgaagagatcgtcaagctgctgttaagtcatggagcaaatgtgaatgccaaagataatgaactgtggacccccctccacgctgcagcaacctgcggccacattaacttggttaagattttagtccagtatggggcagatctcttagccgtgaactctgatgggaacatgccttacgatctttgcgaagatgaaccaacactggacgttattgagacatgcatggcatatcaaggaatcacgcaagagaaaatcaatgagatgagggtcgcgcccgagcaacagatgattgccgacattcattgtatgatcgcagcgggacaggacctggattggatcgacgcccagggcgcaacattgttgcacattgcaggcgctaacggttatttacgagcggcagaactgcttctggatcatggagtgcgggtggatgtgaaggactgggatggttgggaacccctgcatgccgcagcgttctggggccagatgcagatggcggagttgctcgtctcccacggtgcctctctttctgcccgtacaagcatggacgaaatgcctatcgacctgtgcgaagaggaggagttcaaagtgcttcttctggagctcaaacataagcacgacgtcatcatgaagtctcaactacgccacaaatccagtttgtcgagacgcacaagcagcgctgggtctagaggaaaagtcgtgcgccgggcgagtctgtctgaccgaactaacctctaccgcaaggagtacgaaggcgaggcaatcctttggcagagatccgccgctgaggatcagcgaactagcacatacaatggcgatatcagagagacacgaacagatcaggagaataaggatcccaaccctagactggagaaaccagtgctgcttagtgagttccctactaaaatccccagaggagagctcgacatgccagtcgagaacgggctcagagcaccagtatctgcataccagtacgctctagctaatggcgacgtgtggaaagttcacgaagtgcccgactattctatggcatacggcaatcccggtgtggccgacgccacaccaccctggtcatcatataaagaacagagtccgcagacactgctcgagttgaaaaggcagagggccgccgccaaactgctctctcacccattccttagcacacatcttgggtctagtatggcccggactggggaaagctccagcgaaggcaaagctcctctcattgggggccggacaagcccatatagctccaacgggacctccgtatattacaccgttacaagcggagacccaccgttgctgaagttcaaggctccaattgaagaaatggaggagaaggtccacggatgctgcagaatctcctag

SEQ ID NO: 201511 - DNA, 1578 bp, Artificial Sequence
  Description of Artificial Sequence: Synthetic coding sequence
atggccagccacgtggacctgctgaccgagctgcagctgctggagaaggtccccactctggagcgactgagagctgctcagaagaggcgcgcccagcagctcaagaagtgggctcagtatgaacaagatttacaacacagaaaaagaaagcatgagcggaagaggtcgaccgggggccgtagaaagaaagttagctttgaggcaagcgtggctctacttgaagcttccctgcggaacgacgcagaggaggtgcgatatttcctcaaaaataaggtttctcctgatctttgcaatgaggacggtctgaccgctctgcatcagtgctgcattgacaattttgaggagatcgttaagctgctgctgtcccacggggcaaacgtgaatgcgaaggataacgagctttggacccctctacatgctgccgctacttgcgggcacatcaacttagtcaagatcttggtccagtatggtgcagacctcctggccgttaattcggacggcaatatgccctatgacctgtgcgaggacgagcctaccctggatgtgatagaaacttgcatggcctaccagggcatcacccaggagaaaatcaacgagatgcgggtcgctcccgaacaacaaatgatcgcggacattcactgcatgatagccgctggccaggacctggactggattgatgctcaaggcgcaaccttgatgcagatggctgagttactggtgagccacggcgccagcctttcagcccgcacttccatggatgagatgccgattgatctgtgcgaagaagaagagtttaaagtgcttctgctcgaactgaagcacaagcatgatgtcattatgaaatctcaactacgacataaaagcagccttagcagacggactagctcagccgggtctcggggcaaagtggtgcgcagagccagtttaagcgacaggaccaatctctaccggaaagaatatgagggcgaagctattctgtggcagaggagcgccgcggaagaccagcgcaccagcacatataacggcgatattagagagacgagaacagatcaggaaaataaggaccccaatccaaggttggagaaacctgtgctgctctctgagttccctacaaaaatcccacgcggtgaactggatatgcctgtagagaacggcctcagagcccccgtctccgcctatcagtatgctctcgctaatggagatgtgtggaaggtgcatgaagtgcctgactattccatggcttatggcaacccaggcgtagctgacgcaactcccccgtggagcagttacaaggaacagtcaccacaaactctcttggaattgaagcggcagagggctgcagctaagctgttgtcacacccgtttttgtccacgcatctgggatcgagcatggcccggactggagagagttccagcgaggggaaagcgcccctgataggcggtagaacgtccccgtattcatcaaacggcacttcagtatattatacggtgacgtctggagatcccccgttgttaaaatttaaagccccaattgaggaaatggaagagaaagttcatggctgctgtaggatatcttag

SEQ ID NO: 201512 - DNA, 3369 bp, Artificial Sequence
  Description of Artificial Sequence: Synthetic coding sequence
atggagcccagcgaggtgcccagccagatcagcaaggacaacttcctcgaggtgcccaacctctccgattccctgtgcgaagatgaagaagtgacgttccaacccggattcagcccccaaccatcacggagggggtccgactcaagcgaagacatctacctcgatacgccctcgtccggcacacgcagggtgtctttcgctgactcttttggctttaatttagtgtcagttaaggaattcgattgttgggagttgccatcagcaagcacaaccttcgatttgggcacggacatctttcatacggaagaatacgtgctcgccccactgttcgatcttccctcaagtaaggaagacctgatgcagcagcttcagattcagaaagccatccttgaatctactgagtccttgctgggatccacgagcatcaagggtatcatccgggtcctgaatgtgagtttcgagaaactcgtgtacgtgcgtatgtccctcgatgactggcaaacccattatgacatcttagcagaatatgtcccgaactcctgcgatggagaaactgatcagtttagcttcaagatcgttttggttcccccataccagaaagatggatcaaaggtggagttttgcattaggtatgagacctccgtggggactttctggtctaacaacaacgggaccaactacacattcatttgccagaagaaggaacaggagccagaaccggtgaaaccttggaaggaagttcccaatcgccagataaaaggttgtctcaaggttaaatccagtaaggaggagtctagcgtcacttccgaggagaacaatttcgaaaacccgaaaaacaccgacacctacatacctactattatatgctctcacgaggacaaggaagatttggaggcttccaaccggaacgtgaaagatgtgaaccgggagcatgacgaacacaatgaaaaagagcttgagcttatgatcaatcagcacttaatcaggactagaagtaccgcttcccgagatgagagaaatacttttagtaccgatcctgtgaacttccccaacaaggctgagggcctggaaaagaagcagatccacggcgagatatgcactgatctcttccaacgttctctgtctccgagctcatctgcagagtcctcagtaaaaggtgacttttattgcaatgagaagtacagctctggagacgattgcacccatcagccttccgaagagaccactagcaatatgggtgaaattaaaccctctcttggcgataccagtagtgacgaactcgtgcagttacataccggctccaaagaggtgctcgatgataatgccaatcctgcacacggaaatgggaccgtccagatcccctgcccctccagcgatcaattgatggctgggaaccttaacaaaaagcacgaaggtggagcaaaaaacatcgaggtgaaggatctaggatgcctgcgccgtgactttcacagcgacacgtctgcttgtttaaaggaaagcacagaggaaggctcttccaaggaagactactatgggaacggcaaggacgacgaggaacaaaggatttacctgggagtcaatgagaagcaacgcaaaaactttcagacgattctgcacgatcaggagcgaaagatgggaaatcctaagataagtgtggctgggattggggctagcaatcgcgatctcgccacactcctaagcgaacacaccgcaatccccacccgcgcaataacggcagacgtgtcacatagtccacggacaaatctgtcctgggaagaggcggtccttacgccagaacaccaccacttgacgtccgaaggttctgctttaggtggtattacaggtcaggtttgctcctcccgaaccggtaatgtcctgcggaatgactatctgttccaggtagaggagaaaagcgggggcatcaacagtgaggaccaagacaattctccccagcacaagcagagctggaacgtgttggaatcccagggcaaaagccgggagaacaagacaaacataaccgagcatatcaaaggacagacagattgtgaggatgtatggggtaagcgggacaataccagatctcttaaagcaacaactgaggagctttttacatgccaagagacagtttgttgcgagctgtccagtctggcggatcatggcatcactgaaaaagccgaagcagggacagcctacataattaaaaccacttcggaatccacccccgagtccatgtcagcccgagagaaggccattatcgcgaaactgccgcaggaaacagccaggagtgatagaccaatagaagttaaagagactgcgttcgatccacacgagggccgtaatgatgattcgcactatacattgtgtcagagagacacggttggagtaatctatgataacgatttcgaaaaagaaagcaggctcggcatctgcaacgtgagggtggatgaaatggaaaaggaggagacgatgtcgatgtacaaccccaggaaaacgcatgacagagagaagtgcggcacaggcaacatcacatcagtggaggagtcctcatgggtaatcaccgaatatcagaaggctacctccaagcttgaccttcagctaggaatgctaccaaccgacaaaaccgttttcagtgaaaaccgtgacctgcggcaagttcaagagttaagcaaaaaaaccgattctgacgcgatcgtgcactctgcgttcaattcagataccaatagagctccacagaactcatcccccttcagcaagcatcacacagaaatctcggtttctacgaacgaacaggctattgcggttgaaaatgctgttaccactatggccagtcagcctatttccaccaagagcgagaatatttgcaactcaaccagggagatccaggggattgagaaacacccgtatcctgaatctaaacctgaagaggtatccagatcctccgggatcgtcacatctggctcacgcaaggagaggtgtatcggccagatttttcagacagaagagtattccgtggaaaagagtttgggccccatgattctgattaacaaacccctggaaaatatggaggaggctagacacgaaaacgaaggcctggtgagctctggccagagcctgtatacaagtggcgaaaaggaatctgacagctctgcttcgactagtctcccagtggaggaatcccaggcccagggtaatgaatcccttttttccaagtatactaacagcaaaataccctattttcttcttttcctgatatttcttatcactgtgtaccactacgatctgatgattggactcacattttatgtgctgtcactatcctggctgtcatgggaagaaggccggcaaaaggaaagtgtgaagaagaaatag

SEQ ID NO: 201513 - DNA, 954 bp, Artificial Sequence
  Description of Artificial Sequence: Synthetic coding sequence
atgagctgcacccggatgatccaggtgctggacccccggcccctgaccagcagcgtgatgccagtggacgtagcaatgcggctatgtctggctcactcaccccccgttaagagttttctgggaccatatgatgagtttcagagaagacattttgtcaacaagttaaagccactcaagtcttgcctcaacattaagcataaagccaaaagccagaatgattggaagtgctcccacaaccaggctaaaaaaagagtagtgttcgccgatagtaaggggttatcactgacagccatacacgttttcagcgacctgccggaggagcccgcgtgggatttacagtttgacttactggatttgaacgacatttcgtctgccctgaaacaccatgaggaaaaaaatttgatcctggacttcccacagccatctacggactatctaagcttccgtagccacttccagaaaaatttcgtgtgtctcgagaattgtagcctgcaggaacgaacagtgactggtacagtcaaagtgaagaacgtgtcctttgagaagaaggtgcaaattcggattacgtttgatagttggaagaattacaccgatgtggactgcgtatacatgaagaatgtgtacggaggtactgatagcgacactttttcattcgctattgatttacccccagtgattccaaccgaacagaagatcgagttctgcatcagctaccacgccaatgggcaggtgttttgggataataatgacggacagaattaccgtatcgtccacgttcagtggaagcccgacggcgtgcagactcaaatggcaccccaggattgcgccttccaccagacttcgccaaaaactgagctcgagtcaaccatcttcggatcacccaggcttgcttctgggctgtttcctgagtggcagtcctggggtcgcatggagaatctggcctcgtacaggtag

SEQ ID NO: 201514 - DNA, 894 bp, Artificial Sequence
  Description of Artificial Sequence: Synthetic coding sequence
atgagctgcacccggatgatccaggtgctggacccccggcccctgacgagcagcgtcatgcctgtcgacgtcgccatgcggttgtgcctagcccactctcctccagtgaagtcatttctcggaccctatgatgaattccagaggaggcacttcgtcaataagctaaaacctctgaagtcgtgcctgaacatcaaacacaaagcaaaaagtcagaacgactggaaatgctcccataatcaagctaagaaacgagtggtctttgctgacagtaaaggtctcagtcttaccgccatccacgtttttagtgacttgcccgaggaacccgcgtgggacctccagttcgaccttctcgacctaaacgacattagctccgccctgagcttccggtcccactttcagaagaactttgtttgcttggaaaactgttctctgcaggagcggacagttactggaacagtgaaggtcaagaatgtgtccttcgagaaaaaggtgcaaatacgcattacttttgacagctggaagaactacacggacgttgactgtgtgtacatgaaaaacgtatacggcggaactgatagtgacacattttcatttgccattgatcttccaccagtcatcccgacagagcagaagatcgagttttgcattagctaccatgccaacggtcaggtattctgggataacaatgatggccagaactaccgtattgtgcacgttcaatggaaacctgatggggtacagactcagatggctccgcaagactgcgcctttcaccaaacttcacctaaaacagaactggagtcaactatttttggtagtccccggctggcttcgggattgttccctgaatggcagtcttggggaagaatggagaaccttgcctcctaccggtag

SEQ ID NO: 201515 - DNA, 600 bp, Artificial Sequence
  Description of Artificial Sequence: Synthetic coding sequence
atgagcagccccaccagccccctgaagcaccacgaggagaagaaccttatactggactttccacagccatcgaccgattacctgagcttccgcagccattttcagaagaactttgtctgcctggaaaactgttcattgcaggaacgaacggtcactggcaccgtgaaggtgaaaaacgtgtcatttgagaaaaaggtgcagatccggatcactttcgattcatggaagaattacaccgacgtcgattgcgtgtatatgaaaaacgtgtatggtggcacggactctgataccttcagttttgcgatcgacttgcctcccgtaattccaaccgagcagaaaatcgagttctgcatcagttatcatgccaacggtcaggttttttgggataacaacgatggccaaaactacaggatcgtacacgtgcagtggaagccagacggagtccagactcagatggccccacaggattgtgcttttcaccagaccagccctaaaacagagctggagtctaccatcttcggctcccctcgactggcctcaggcctcttccccgaatggcagtcatggggccgaatggaaaacttggcaagctatcggtag

SEQ ID NO: 201516 - DNA, 900 bp, Artificial Sequence
  Description of Artificial Sequence: Synthetic coding sequence
atgagccggggccccagcagcgccgtgctgcccagcgccctgggctcccggaaattaggacctcgttctctcagttgtctatcagacttggacggtggcgtggcactggaaccgagagcatgccggccaccaggatcacccgggcgcgcccctcctccaactcccgcaccaagcgggtgtgatcctaggctcaggcccattattctgcgacgagcacggtctctccccagcagccctgaaagacgccagaaagctgctggggcccccggagccgcctgtcgccctgggtgtagccagaagctcagagtaaggttcgcggatgcgctcgggctggagcttgcccaggtgaaggtgttcaacgctggggatgacccctcagtgcccctgcacgttctgtcaaggctagcaataaatagcgacctatgctgctccagtcaggacctggaattcaccctccactgtttagtccctgatttccctcccccagttgaggcggccgacttcggggagaggctgcagagacaactggtgtgcctggagcgggtgacctgttcggacctgggtatctcagggaccgttcgagtatgcaatgtggccttcgagaagcaagttgccgtgcgttataccttcagcggttggaggtccactcatgaggcggtagcccgctggcggggccccgccggcccagaaggcacggaggacgtatttacgtttgggttccccgtacccccatttctcttggagttaggctctagggtgcacttcgccgtgaggtatcaggtagctggtgctgaatactgggataataacgatcacagggattattctctgacatgtaggaatcacgctcttcacatgccacggggcgaatgtgaggagagttggatccattttatctag

SEQ ID NO: 201517 - DNA, 756 bp, Artificial Sequence
  Description of Artificial Sequence: Synthetic coding sequence
atgacccggctgaccgtgctggccctgctggccggcctgctggccagctccagggcaggaagctcacctctgctagatatcgtcggaggcagaaaggcccggcccagacagtttccgttcttagctagcatccagaatcagggtagacatttctgtggcggagccctaattcacgcacgcttcgtgatgactgccgcctcttgctttcaatctcagaatcctggcgtgagcacggtcgtactgggtgcatatgatctcaggcggagggagcgacaaagcaggcagacatttagcatttcctctatgtctgagaatggctacgacccgcaacagaacctaaatgacctcatgctccttcaactcgacagggaagcgaacctgacttcctctgttacgatcctgcctctccctctgcagaacgccaccgtggaggccggcacacgatgccaggttgccggatgggggtctcaaaggagtgggggccggttaagccgattccccaggttcgttaacgtgaccgtgacaccagaggatcagtgtcgtccaaataacgtgtgtaccggggtccttactcgtcggggaggtatctgcaatggcgacgggggtactcccctggtgtgcgaagggctcgctcatggggtcgcctcctttagcctgggtccctgcggacgcgggccagactttttcacacgagtggcgttattccgtgattggatagacggagtgctcaataatcccggacccggacctgcctag

SEQ ID NO: 201518 - DNA, 954 bp, Artificial Sequence
  Description of Artificial Sequence: Synthetic coding sequence
atggccgccgagcggggcgccggccagcagcagagccaggagatgatggaagaggaacacgaactccccgtggacatggagaccatcaatttggacagagacgccgaggacgttgatttaaaccattaccgtatcggaaagatcgaagggttcgaggtactcaagaaagtcaaaactctgtgtctgaggcaaaatttaatcaagtgcatcgagaacctcgaggaactgcagtccctcagggaactggatctttacgataatcaaatcaagaaaatcgagaacctggaggccctgactgagttagagattctggatatatctttcaatcttttgcgaaacatcgaaggggtagataaacttacacgactgaaaaaactgttccttgtcaataataagatctctaagatagagaatctgagcaacctgcaccagttgcagatgcttgagttgggttccaatcgcatccgcgccatcgagaatattgatacattaaccaacttagaatccctgttcctcgggaagaataagatcactaaattgcagaacttggacgcactgaccaaccttactgttctgagtatgcagagtaaccgactgacgaaaatcgaagggctccagaaccttgtgaacctgagagagctctacctcagccacaacggtatagaggtaatcgagggcctggaaaataacaacaagctgacgatgctagacattgccagcaatcgcatcaagaaaatcgagaacatttcgcacctaacggaactccaagagttctggatgaatgataatctgctagagagttggtctgacctggatgagttgaagggcgctaggagtctcgaaacagtgtatctggagcgcaatcctctgcagaaagacccacaatatagacggaaagttatgctggctctgccttccgtccggcagatcgacgccactttcgttcggttctag

SEQ ID NO: 201519 - DNA, 714 bp, Artificial Sequence
  Description of Artificial Sequence: Synthetic coding sequence
atggccgccgagcggggcgccggccagcagcagagccaggagatgatggaggaagaacacgagttgcctgtggatatggaaaccataaatctggatcgcgatgccgaagatgtggatctcaatcactaccggatcgggaaaattgaaggcttcgaagtgcttaaaaaggttaaaacattgtgcttgaggcagaacttgattaagtgcatcgagaatctggaggagctgcagagtctccgcgaactggatctttatgataatcagataaagaaaattgagaaccttgaagctctgaccgagctcgaaatcttagacataagtttcaatctcctccggaacatcgagggtgtcgataaacttacgcggctgaaaaagctgtttttggttaataacaaaattagtaagattgaaaatctgagtaacctccaccagctgcagatgctggaactaggctccaatagaatcagagctatcgaaaacatagacacgcttacaaatctggagagtctatttttggggaaaaataagatcactaagctgcagaatctggacgcgttgacgaatcttactgtgctcagcatgcagtcgaaccggctgactaaaatcgagggccttcagaatctcgtcaacctgagggaactctatctgtcacataatgggattgaggtgattgaagggctggagaacaacgtccaggatagtttgacttattag

SEQ ID NO: 201520 - DNA, 843 bp, Artificial Sequence
  Description of Artificial Sequence: Synthetic coding sequence
atggccgccgagcggggcgccggccagcagcagagccaggagatgatggaggttgacagacgggtcgagagtgaagagagcggcgatgaggaggggaaaaaacacagcagtggcatcgttgcagacctcagtgaacagtcattgaaggatggggaagagaggggtgaagaagaccctgaggaagaacacgagctgcctgttgatatggagacaattaacctggatcgggatgcagaggacgttgacctcaaccactacagaataggtaagatcgaagggttcgaagtgctgaagaaagttaagactctctgtctgcgtcagaatcttattaagtgcatcgaaaatctcgaggaattgcagtccctgcgggaacttgacctgtacgataatcagataaagaagattgagaacctggaagccctgacagaacttgagatcctcgatatcagctttaacctgctccggaatattgaaggcgtggacaaactgacccgccttaaaaagctctttctcgttaataataaaatctccaagatcgagaatcttagcaatctacatcagctacagatgttggaactgggctcgaaccgcatccgggcaatagagaacatcgacacccttactaacctcgagtctctgtttctcggaaaaaataagattactaagctgcagaatctcgacgcactcaccaacctcaccgtgctgagtatgcagtcaaacaggcttacaaagattgagggactgcagaacctggtgaatttaagggagctgtatctatcccacaatgggattgaggtcattgagggtctcgaaaataatgtccaggatagcttgacatattag

SEQ ID NO: 201521 - DNA, 1083 bp, Artificial Sequence
  Description of Artificial Sequence: Synthetic coding sequence
atggccgccgagcggggcgccggccagcagcagagccaggagatgatggaggtggatagaagagtggaatcagaggagtctggggacgaagagggcaagaaacattcctcaggtatcgtcgccgacctttctgaacagagtctgaaagacggcgaagaacgaggagaggaggaccccgaggaggagcacgaactgcctgttgatatggagacaatcaatctggaccgcgatgcggaagacgtggatttaaatcactaccggattgggaagattgaaggcttcgaggtccttaagaaggttaagaccttatgcttgagacaaaatctcattaaatgtatcgaaaacctggaggagctccaaagtcttagggagttggacctttacgataaccaaattaagaagatagagaatctcgaggcactaacagagctcgagattctggacataagcttcaatctgctgagaaatatagaaggagtggataagcttacccggcttaagaagttgttcctcgtgaacaataaaatctccaaaattgaaaatctgtccaatctgcaccagcttcagatgctggagctcgggtccaatcggatcagagcaatcgaaaacatcgacaccctcacaaatttggagagtctgtttctgggaaagaacaagattacaaagttacagaacttggacgccctgactaatctgacagttctcagcatgcagagcaataggttgaccaaaattgaaggactgcagaatctcgtcaacttgcgggaactgtacctctcacacaacggtatcgaggtcatcgagggacttgagaacaataataaacttacaatgctcgacatcgcatccaaccggattaaaaagatcgaaaacatcagtcacctgacagagcttcaggagttctggatgaatgataatctattagagagctggtccgatctggacgagctgaagggcgctcgcagcctggaaactgtgtacctcgagaggaacccactccagaaggatccccagtatcgccggaaagtgatgttggctctgccctccgtcagacagatcgacgcaacgttcgtcagattctag

SEQ ID NO: 201522 - DNA, 384 bp, Artificial Sequence
  Description of Artificial Sequence: Synthetic coding sequence
atggtgcagaccgccgtggtgcccgtgaagaagaagcgggtggaggggcccggatcattaggccttgaagaatctgggtcaagaaggatgcagaacttcgctttttcgggaggactgtatggcgggttaccgcctacacatagcgaggctggttctcagccacacggcatccatggtactgccctaattggagggttgcctatgccctacccaaatctggcccccgatgtagacctgaccccagttgtgccatctgccgtgaatatgaacccagcccccaacccggccgtgtacaatccagaagcagtcaacgaacccaagaagaaaaagtatgcaaaagaagcctggccaggtaaaaagccaacgccttccttacttatttag

SEQ ID NO: 201523 - DNA, 1056 bp, Artificial Sequence
  Description of Artificial Sequence: Synthetic coding sequence
atggccgccgccgccaacagcggcagcagcctgcccctgttcgactgtccgacgtgggctgggaagccccctcccggcctccatttggacgtggtgaagggagacaagctaatcgagaagttaatcattgacgagaaaaagtactacctgttcggacggaatcccgatctctgcgatttcacaatcgatcaccagtcctgcagccgagtccatgccgccctagtataccacaagcatctcaagagagtctttctcatagatcttaactcaacccacggcactttcctggggcatattcgcctagagcctcacaaacctcaacagatcccaattgactctactgtctcgttcggtgcctcaacaagggcctacaccctgagggagaaaccacagactctcccaagcgcagtcaagggagatgagaaaatgggcggtgaggatgatgagttgaaaggcctgcttggtctccccgaagaggagaccgagcttgataatctgacagagttcaatactgcacacaacaaacgcatatctacactgactatagaggagggaaacttagatattcaaagaccaaagagaaaaagaaagaactctcgagtaaccttttcagaagacgacgaaattattaatcctgaggatgtcgatccgagcgtgggacgttttcgcaacatggtccagacagctgtagtgccagtcaaaaaaaagagggtggagggaccagggtcccttgggctggaggaatccgggagcagaaggatgcaaaattttgctttctccgggggcctgtacggcggccttccaccaacacactctgaggctggctcgcagccccacggtatccacggcaccgctctcattggcggcctgcccatgccttacccaaacctggcccctgatgttgacctaacccccgtggttcccagtgctgtcaatatgaacccagccccaaacccagccgtttacaaccctgaggctgtgaatgagcctaagaagaagaaatacgctaaagaggcttggccgggaaagaagcccactcctagcctcctgatttag

SEQ ID NO: 201524 - DNA, 630 bp, Artificial Sequence
  Description of Artificial Sequence: Synthetic coding sequence
atgggcggcgaggacgacgagctgaagggcctgctgggcctgcccgaagaggaaacggagctcgacaacctcactgagtttaacaccgcccacaataagcgcattagcaccttgacgatagaagaaggcaatctggatatccagagacctaagaggaaaaggaagaattcacgcgttaccttttcagaggatgacgaaattattaatcctgaggatgtggacccctcagtgggacggtttcggaacatggtgcagacggctgttgtgccagtgaagaagaagcgcgtggaaggacctgggagtctggggctggaagagtccgggtcgagaaggatgcagaacttcgccttctctggagggctatacggtggattgcctcctacgcatagcgaggcggggtcccagccccacgggatacacggaaccgctcttataggcggtctgccgatgccctaccccaacctcgcccctgacgtggatttgacacccgtggtgccgtctgccgtaaacatgaatcctgctcccaacccggcagtttataaccccgaagctgtcaacgagcctaaaaaaaaaaagtatgctaaggaagcctggccgggtaagaagcccacccctagcttgttgatatag

SEQ ID NO: 201525 - DNA, 711 bp, Artificial Sequence
  Description of Artificial Sequence: Synthetic coding sequence
atgggcggcgaggacgacgagctgaagggcctgctgggcctgcccgaagaggaaacggaattggataacctaacggaattcaacaccgcacacaataaaaggattagtactctgacaatcgaggagggcaaccttgatatacaaaggcctaaaaggaagcgtaaaaattcacgcgttacgttttctgaggacgacgagattataaaccctgaagacgttgaccccagcgtgggtaggttccggaatatggtgcagacggctgtggtccccgtgaagaaaaaaagagtggaggggccggggtctcttggcctggaagagtccgggagcaggcgcatgcagaactttgccttctcgggtggactctacggaggcctgcccccgacgcatagcgaggccgggtctcaacctcacggcattcatggcacagcgctcattggagggctccctatgccctaccccaatctcgcaccggatgtcgatctgactccagtggttccttctgctgttaacatgaatccggcacccaacccagccgtgtacaatccagaggctgtgaatgagcccaagaaaaagaagtacgccaaggaggcttggccagggtgtgaattcgtgagtcagagcttgatcgctacggccatctggaagtgtctgctgaaggcccagagtctgggcctggggggaaatgccccctcacctctgtattataaatag

SEQ ID NO: 201526 - DNA, 618 bp, Artificial Sequence
  Description of Artificial Sequence: Synthetic coding sequence
atgggcggcgaggacgacgagctgaagggcctgctgggcctgcccgaggaggagaccgagctcgataatctgaccgagttcaacaccgctcataataaaaggatttcaactttgactatagaggagggaaatctggacatacaacgcccgaagcggaaaaggaagaattctcgagttacattcagcgaagacgacgagattattaaccctgaagacgttgacccttccgtcggccggtttaggaatatggtgcagaccgcggttgtgccggtgaagaagaagagagtggaggggccaggtagcctcggcctcgaggagtcagggagcaggcgcatgcagaatttcgcgttttccggtggcctgtacggtgggctccctcctacccattcggaggccggcagccagccccacggaattcacgggactgccctgattggaggactcccaatgccgtaccctaacctggcgcccgacgtcgatttgacaccagtggtcccatctgcggtgaacatgaatcccgcgccaaatcctgcggtctataacccggaggccgtgaacgaaccaaaaaagaagaagtacgccaaagaagcctggcctggcaagaagcccactccatag

SEQ ID NO: 201527 - DNA, 600 bp, Artificial Sequence
  Description of Artificial Sequence: Synthetic coding sequence
atggccgccgccgccaacagcggcagcagcctgcccctgttcgactgcccaacctgggcgggcaagccacctcccgggcttcatctcgacgtggtcaagggggacaaactgatcgagaaactgatcattgatgaaaagaagtactacctgtttgggcgcaatccggatctctgcgactttactattgatcatcaatcgtgcagtagagtacacgctgctctcgtgtatcataagcacctgaaaagggtgtttttgattgaccttaactccacccacggcacattcctgggccacatcaggctggagccccacaagccacagcaaataccaatcgactccacagtgtccttcggagccagcacccgcgcctatacactgcgagaaaagccccaaaccctgccctctgcggtgaaaggggatgagaaaatgggcggcgaagatgacgaacttaagggcctacttggcctcccagaagaggagacagaattggataatttaactgagttcaatacagcccataatcacatggcttcaatgggacaacactcttctgtagcatgcccttgccacacacagacgcttcccctgatgtggacttag

SEQ ID NO: 201528 - DNA, 3891 bp, Artificial Sequence
  Description of Artificial Sequence: Synthetic coding sequence
atgctgaagaccgagagcagcggcgagcggaccaccctgcggagcgcctccccccaccggaacgcttatcgaactgagtttcaggcgctgaagagtacttttgataaacctaaaagtgacggagaacagaagactaaggaaggtgagggatctcaacaaagtcggggcaggaaatatgggtccaatgtgaaccgcattaagaacttattcatgcagatggggatggaaccgaacgaaaatgccgctgttattgctaagacccggggtaaaggagggcacagctcacctcagagaaggatgaagccaaaggaattcctggaaaagactgatggaagcgtggttaagctggagagctccgtctccgagcgtatctctaggtttgacaccatgtatgatggaccaagttatagcaagtttacagaaaccaggaagatgtttgagcggtccgttcacgaaagtgggcagaacaatcggtactcccccaagaaggagaaggcaggcgggagcgaacctcaggacgaatggggcggcagcaagagcaaccgtggctcaaccgattctctggacagcctctccagtcgcacagaagctgtgtctcccaccgtgagccagctcagcgccgtcttcgagaacactgacagcccttcagccatcattagcgaaaaagctgaaaacaatgaatattctgtgactggccactatcccctgaatctacccagtgttaccgttaccaacctggacacttttgggcatctgaaggactctaattcctggccccccagcaataaacgcggggtcgatacggaagatgcccacaagtccaacgcaacccctgtgcccgaggtcgcatccaaatccactagtttggcctccatacccggagaagagatccagcagagcaaagaaccagaggatagtacgtctaaccaacaaactcccgacagcatcgataaggatggccccgaggagccctgtgctgagtcaaaggccatgccaaagtccgaaattcctagcccacagtcccaacttctcgaagatgccgaagcgaacctggtcggcagagaggctgcaaaacagcagcggaaggagctcgcgggcggcgacttcacaagtccagatgcatcggccagttcgtgtggaaaggaagtgccagaagactctaataactttgacgggtctcacgtgtatatgcactcagattacaacgtctatcgagttcgtagccggtataatagcgactggggcgaaacaggcactgagcaggacgaggaagaggacagcgatgaaaactcctactatcagccagacatggagtatagcgaaatagttggtttgcctgaggaagaagagatccccgccaacagaaagattaagtttagctcagcccccattaaagtttttaacacatacagtaatgaggactacgatcggcggaatgatgaagtcgatccagtggccgcatctgccgagtacgaactcgaaaagagggttgagaaactggaactttttcctgtcgagctggaaaaggacgaagatggactgggcatcagcattatcggtatgggagtgggtgccgacgcgggactcgagaagctgggcatttttgtcaaaacagtaaccgaaggaggcgcagcacagagggatggccgtattcaggtgaatgatcagatcgttgaagtggacgggatatctctggtcggggtaactcagaatttcgcggccaccgtgctgcgcaatactaagggtaatgtgaggttcgtgatcggccgcgagaagcctggccaagtgtccgaggttgcccagctgatttcccagactctcgaacaggaacggagacagcgcgagttgctggagcagcactacgcacagtatgatgctgatgacgatgagaccggtgagtacgcaactgatgaggaggaggacgaagtcggccctgttctgccggggagcgacatggcaatagaagttttcgaactgcctgagaacgaagatatgttcagcccttcagaactggacacttcaaagctttcacataaattcaaagagctgcagatcaaacatgccgttacggaggctgagatccagaagttgaagacaaaactgcaggcagctgagaatgagaaagttaggtgggagctggagaagacccagttacagcaaaacatcgaggagaacaaggaacgtatgctgaaactggaaagctactggattgaagcacagacgctctgccatacagttaacgagcacctgaaggagacccagtcccagtaccaagccctcgagaaaaaatacaataaagccaaaaagctgatcaaggatttccagcagaaagaactcgatttcatcaaacggcaggaagccgaaagaaaaaagatcgaggacctggagaaagcacacctcgtcgaggttcagggtctgcaggtacgcatccgtgacctggaagctgaagtttttcgtctcctgaaacaaaatggcacccaggtgaataataacaataacatctttgagcggaggacatctctcggcgaggtgtctaaaggcgacacaatggagaatctagatggtaagcaaaccagttgtcaggacggcctgtctcaggacctcaatgaggctgtgccggagacagagcggctcgactctaaagctctgaagacaagagctcagttgtccgtcaagaataggagacagcgtccctctcggactcgcctctacgacagcgtcagcagcaccgacggtgaagactccctggagcgcaagggcctcaggacctcctccccggaaagcgatagtggcgtgcctccgctgaccccagtcgatagtaatgtgcctttctctagcgatcacattgcagagttccaggaagagcccctggaccccgaaatggggccgctctcctctatgtggggagacacctccctgttctctacaagcaagtcggaccacgatgttgaggagagtccatgccatcatcagacgaccaacaaaaagattttaagggaaaaggacgatgcgaaagatcccaaaagcctcagggcctctagctccctggctgtacaggggggaaagatcaagcgaaaatttgtagatctgggcgccccgctgcgacggaattcatctaaggggaaaaagtggaaagagaaagagaaagaagctagtcgattttctgcaggatcacgcatatttaggggacggttagagaattggacaccaaagccttgcagcaccgcccagactagcacacgcagcccatgtatgcctttcagctggtttaacgacagcaggaaagggtcctacagctttagaaacctccctgccccgaccagcagccttcagccatctcctgagactttgatttccgacaaaaagggctcgaagaacttcacgtttaacgacgatttcagcccctcctccacaagtagtgcagaccttagtggattgggcgccgaacccaaaacccccgggctcagtcagtctctcgctttaagttccgacgagattcttgacgatggacagtcccctaagcattcccagtgtcagaacagagccgtgcaggaatggtcggtgcaacaggtctctcattggttaatgagcctgaacttagagcaatatgtgtccgagttttctgctcagaatatcaccggcgagcagctgctacaactggacggtaataagctcaaggctctggggatgacggcttcccaagacagagcggtggtcaaaaagaaactgaaggaaatgaagatgtctcttgagaaggcccgtaaggctcaggagaaaatggagaaacagagagaaaaacttcgtcgaaaagaacaagagcaaatgcagaggaagtccaaaaagaccgagaaaatgaccagcactactgcggagggggcaggagagcagtag

SEQ ID NO: 201529 - DNA, 3297 bp, Artificial Sequence
  Description of Artificial Sequence: Synthetic coding sequence
atgctgaagaccgagagcagcggcgagcggaccaccctgcggagcgcatcacctcacagaaatgcatatcgaaccgaatttcaggccctcaaatctacctttgataaaccaaaatcagacggcgagcagaagactaaagagggggaaggctctcagcagtctcgcggacggaagtacggctccaacgtcaatagaatcaaaaacctgttcatgcagatgggcatggaacccaacgagaatgcagccgtgatcgctaagacgcgaggcaaaggcggccacagcagcccgcaaagacggatgaaaccaaaggaattcctggagaagaccgatggttcagtagtaaagcttgaatcatccgtgagcgagaggatctcaaggtttgacaccatgtacgacggccccagttatagcaagtttacggagacaaggaaaatgtttgaacgcagcgtgcacgagagcggccagaacaatcggtattctcctaagaaagaaaaagcagggggctccgagccccaggatgaatggggaggaagcaagagcaaccgtggttccacggactctctggacagtctgagcagtaggaccgaggccgtcagcccaactgtgtcccagctctcagccgtgtttgagaacaccgattctccctccgccatcatctcagagaaggctgaaaataacgagtattctgtcactgggcactatcctttgaatctccccagtgtgaccgtgacgaatctggacactttcgggcatctcaaagactcgaactcatggccgcctagcaacaagcgcggggtcgacactgaggacgcccataagtctaacgccacgccagtcccagaggtcgccagtaagtcaaccagtctcgctagtattcctggagaagagatacagcaatccaaggagccggaggatagcacgtctaaccaacagacaccagactccatcgataaggatgggccagaggagccttgtgctgagtccaaggccatgcccaagagcgaaattccgtcaccacaatcccaactgctcgaggatgccgaagctaatttggtgggtagagaagctgcaaagcagcagcgtaaggagctggctggtggtgattttacttccccagacgctagcgcctcatcgtgcggaaaagaagtgcctgaagactccaataactttgatgggtcccatgtttatatgcattccgactataacgtctatcgagtcagatcacgatacaattcggactggggcgagaccgggacagagcaagacgaagaggaagattccgacgaaaattcctactatcagccagacatggaatattctgagatagtcgggctacctgaggaggaggagattccagcgaacaggaagataaagttctcaagtgcccctatcaaggtctttaatacctactcaaatgaagattatgataggcgaaacgacgaggtcgaccccgttgctgcctccgccgagtacgagctggaaaaacgtgtggaaaagctcgagttgtttcctgtcgaactcgaaaaagatgaagatggccttggaatttcaatcattgggatgggggtcggagcagatgccgggctggagaaactaggcatctttgtgaagaccgtgacagagggtggcgcagctcaaagggacggccggatccaagttaatgaccagatcgttgaggtggatggaatctcattggtcggagtaacccagaatttcgcagcaaccgtcttgcggaacactaaaggtaacgtacggtttgtcatcggaagagaaaaacccggacaggttagcgaggttgcccagctgatctcacagactttagaacaggagaggcgtcaaagggaactgcttgagcagcactacgcccagtacgacgcggatgatgacgaaaccggtgaatacgccactgatgaagaggaggatgaagtcgggcctgtgctgcctggaagcgatatggcaattgaggtgtttgaattgcccgagaacgaagatatgttcagcccctccgaacttgatactagcaagctgtctcacaagtttaaagaactgcagataaagcatgccgtgacagaggctgagattcagaagcttaagacaaaactgcaggccgccgagaacgagaaagttcgctgggaactggaaaagacgcaactgcagcaaaatatcgaggagaacaaagagaggatgctgaagctcgaatcttactggatcgaagcccagaccctgtgccacacggtgaacgagcacctcaaggagacccagagccaataccaggccctggagaaaaaatacaataaagctaagaaattgataaaagatttccagcagaaagagctcgatttcatcaagcgtcaggaggccgaacgcaaaaagattgaagacctggagaaggcccacctggtggaggtgcaaggactgcaggtgagaatcagggaccttgaggccgaagtctttagactgctgaaacagaatgggacccaggttaataacaataataacattttcgaacggcgcacttccctgggtgaggtgtccaaaggagacaccatggagaacttggatggtaagcagacttcttgccaggatggtctctcccaggacctgaacgaggccgtacccgagacagagcgactcgattctaaagcgctcaagactcgagcccaactgagcgtgaaaaatcgcaggcaacgacctagccgaacccgcctatacgattctgtgtcttctaccgacggggaagactccctggagcgcaaaaacttcactttcaatgacgatttctcaccatcttcaacgtcttctgctgatctgtccggcctgggagctgaaccaaaaactcctggcctttcacagtccctagccctgtccagcgacgaatccctggatatgatcgatgatgagattctggacgatggacaaagtcctaaacactcgcagtgccagaacagagccgtgcaagaatggtcagtacagcaggtgtctcactggcttatgtccttgaatctagagcagtatgtctcagaattcagtgcccagaatatcactggcgaacagctgctgcagctggatggaaacaagctcaaagctctcgggatgacagcttctcaagacagagcagtcgtaaagaagaagctcaaagagatgaagatgtctctggagaaagcaaggaaagcgcaggaaaagatggaaaaacagcgagaaaaactgcggcgcaaagagcaggagcaaatgcaacgaaaaagtaagaagaccgagaagatgaccagcacaacagccgaaggagccggggaacagtag

SEQ ID NO: 201530 - DNA, 222 bp, Artificial Sequence
  Description of Artificial Sequence: Synthetic coding sequence
atgctgaagaccgagagcagcggcgagcggaccaccctgcggagcgcgtcaccgcacagaaatgcgtataggacagaatttcaggccctgaaatctaccttcgacaagccaaagtctgacggggagcaaaagactaaagagggggaaggatcccagcagtcgcggggacgaaagtatggaagcaacgtgaaccgcatcaaaaacttgttcatgcagatgtag

SEQ ID NO: 201531 - DNA, 126 bp, Artificial Sequence
  Description of Artificial Sequence: Synthetic coding sequence
atgctgaagaccgagagcagcggcgagcggaccaccctgcggagcgcctcgccccatcgcaacgcatatcgcaccgagtttcaggcactgaaaagtaccttcgacaagcctaagagtgacggatag

SEQ ID NO: 201532 - DNA, 3297 bp, Artificial Sequence
  Description of Artificial Sequence: Synthetic coding sequence
atgctgaagaccgagagcagcggcgagcggaccaccctgcggagcgctagccctcacaggaacgcctatagaactgaattccaagcactgaaatcaacgtttgataaacctaaaagcgacggggagcagaagaccaaggagggcgagggtagtcagcagtccagaggacgaaagtacgggagcaatgtgaatcgcattaaaaacctctttatgcagatggggatggaaccaaatgagaacgcagctgttatcgccaaaacccgggggaagggtgggcactcttcaccacagcgcagaatgaagcctaaggaattcctggagaagaccgatggttccgtcgtaaagctggagagcagtgtatccgagcggatttcccgattcgatactatgtacgacggacctagctacagtaagtttaccgagacccgcaagatgttcgaacggtccgtccatgagagcggtcagaataaccgctactctcctaagaaagagaaggcagggggatccgaaccacaggacgagtggggcggcagtaagagcaaccgcgggagcacggactccttggatagtctcagcagccgtacggaggcagtatcaccgacagtctcacagctctcggctgttttcgaaaacacagacagcccttctgctatcatttcagagaaagccgagaacaacgagtactctgtgactggccattatcctctgaacctcccaagcgtgaccgtgaccaacctcgatacgttcggccacttgaaagacagcaatagctggccgcccagcaacaaacgcggtgtagacaccgaggacgcccacaaatccaacgctactcctgtccccgaagttgcttcaaagagtactagcttagcctccatccccggcgaagaaatccaacagtcaaaagagcctgaggacagtactagtaatcaacagacacctgatagtattgataaggatggcccagaagagccctgtgcggagtcaaaggctatgcccaagtctgaaatcccgagtccccaatcccaactgttggaggacgccgaagctaacctggtaggacgcgaggcggcaaagcagcagaggaaagaactggcagggggggatttcacgagcccagacgcctccgcatccagctgcggtaaagaagtcccagaggacagcaataactttgacggcagtcatgtgtacatgcactccgactataacgtgtaccgcgtgcgaagtaggtataacagcgactggggcgagacaggaaccgaacaagacgaggaggaagactccgacgaaaattcctactatcagcctgatatggaatattcagaaattgttgggttgcccgaagaagaggagatcccagcaaaccggaaaattaaatttagctctgcacccataaaggtgtttaatacctattctaatgaggattatgacaggcgaaacgacgaggtggatcccgtcgcagcaagcgccgaatacgagctcgagaagagagttgagaagctggagctgtttcctgtcgaactcgaaaaggatgaagacggcctgggcatctctattatcgggatgggcgtcggtgccgatgctgggctcgagaagctaggaattttcgtgaagactgtgactgaaggcggggccgcacagcgggacggccggatccaggtgaatgaccagatcgtggaggttgatggtatttcgctggtaggcgttacacagaactttgccgcaaccgttttacgaaatacaaagggaaatgtgcggtttgttattggacgggaaaagcccgggcaggtgtcagaggtagcccagcttatcagccagacgctggaacaggagcgtaggcagcgcgagctactcgagcaacattacgcccagtacgatgcagatgacgacgaaaccggagagtacgctaccgatgaggaggaagacgaggtcggacccgtgctgcccgggtccgatatggcgatcgaagtgttcgaactacctgagaacgaagacatgtttagtccttcagaactcgacaccagcaaactgagccataaatttaaggaactccagatcaagcacgcagtgaccgaggccgagatccagaagctgaaaaccaaactccaggctgctgaaaatgaaaaggttcggtgggagctggaaaaaactcagttgcagcagaacattgaggaaaacaaggagaggatgctcaagctcgagtcctactggattgaagctcaaacactgtgccataccgtcaatgagcacctgaaggagactcagagccaatatcaggcactcgaaaaaaagtacaacaaggcaaaaaaactcatcaaagactttcagcaaaaggagctggattttatcaagagacaggaggctgaaagaaaaaagatagaagacctggaaaaggctcacctggtcgaagtgcagggactacaggttagaatacgcgacctggaagctgaagtattccgccttctgaagcagaacggcacacaggtgaacaacaataataacatattcgagagacgcacatctctgggtgaggtatcaaaaggggacaccatggagaatctcgacggcaagcagacctcctgtcaggatggtctgtcacaggatctcaacgaagcggtacctgaaacggagagactcgattcaaaggcgctgaaaactcgggctcagctgtcggtcaagaatcgccgtcagagaccatcacggactagactgtatgactcagtaagtagcacagacggcgaggattccctggaacggaagaatttcacttttaacgatgatttcagccccagtagcacctcttcagcagacctatccggactgggagcagagccaaaaacaccaggtctgtctcagagcttggccctgtccagcgatgagtctttagatatgattgatgatgagattctggacgacggtcagagcccaaagcatagtcagtgccagaacagagctgtgcaggagtggtctgtgcaacaagtgtcccattggctgatgtcccttaatctcgagcagtacgtaagcgaattttccgcccaaaatatcaccggcgagcagctgctccagcttgacgggaacaagctcaaagcactgggcatgactgcgtcccaggatcgggctgtagtgaaaaagaagctcaaggaaatgaagatgagcctggaaaaggctcgcaaagcccaagaaaagatggagaaacagcgggaaaaactgcgaaggaaagaacaggaacagatgcaaagaaagtcaaagaagaccgaaaaaatgacgtccactacagctgagggcgcgggcgagcagtag

SEQ ID NO: 201533 - DNA, 3762 bp, Artificial Sequence
  Description of Artificial Sequence: Synthetic coding sequence
atgctgaagaccgagagcagcggcgagcggaccaccctgcggagcgcgtcaccacatcgcaacgcgtatagaaccgagtttcaagcgctgaagtccacgtttgataagcctaagagcgatggtgaacagaaaaccaaagaaggcgaagggagccagcagagtagaggccggaagtatggctcaaacgtaaaccgcattaagaatttgtttatgcagatggggatggaacctaacgagaatgccgcggtgatagcgaaaacaaggggaaaaggaggccactctagcccacagcgccgcatgaagcctaaagaatttttggaaaaaaccgacgggtcagtggtgaaattggagtccagcgtgagcgaaaggatttcacgctttgacacgatgtatgacggccctagctattctaaatttactgagaccagaaaaatgtttgaaaggagtgtacacgagagtgggcagaataaccgatatagtcccaaaaaggaaaaggccggaggcagcgagccacaagatgaatggggtgggtctaaatccaatcgagggtccacggattctcttgactctctttccagcaggaccgaagccgtgtctccaaccgtgagccagctgtctgcggtgtttgagaacacagattcaccctctgcgataatctccgagaaggccgagaacaatgagtacagcgtcactggtcattatcccctcaacctccctagtgttacagtgaccaacttagacactttcgggcacctgaaagactcaaactcctggcccccctccaataagaggggggttgataccgaggatgcccacaaaagtaatgctacgcccgtgccggaagtagccagtaagtctacctccctcgcaagcatccccggagaagagatacagcaaagtaaggaaccagaagacagcacaagcaatcagcagacccctgattccattgacaaggatgggcctgaggagccatgtgcagagagcaaggccatgcctaaaagcgaaataccctcacctcaatcacaattgttggaggacgccgaggcaaatttggtgggcagggaagcggcaaagcaacagcgaaaggagttggccggaggtgatttcacctcaccggatgcctcagcatcatcatgtggaaaggaagtacccgaagatagcaacaatttcgatgggagccacgtatatatgcacagcgactacaatgtgtacagagtcagatcccgttataactcagattggggggagacagggaccgaacaggacgaagaagaggacagcgatgaaaattcatactaccaaccggacatggagtatagcgagattgtgggcttacccgaggaggaggaaattccggcgaacagaaaaattaaattcagcagcgcgcccataaaggtgttcaatacttattcgaatgaagactatgaccgaaggaatgatgaggtagatccagtggcggcttcagcagaatatgaactggaaaaaagggtcgaaaagttggaactgttccctgtggaacttgagaaagacgaagatgggttgggcatctccatcatcggaatgggggttggagctgacgctggcctggagaagctggggatcttcgttaagactgtgacggaaggcggagccgcccagcgcgacggacgtatccaggtaaatgatcagattgtagaggtggacggtataagcctcgtcggggtgactcaaaacttcgcagcgaccgtgctccggaatacaaagggtaatgtgcgctttgtgatcggccgggaaaaacccggccaggtgtctgaagtggctcagctgatatctcagaccttggaacaggaacgcaggcagcgcgagttacttgagcagcactatgcccagtatgacgccgacgacgatgagaccggcgagtatgccaccgatgaagaagaagacgaggttggtcctgtgctcccaggctccgatatggccatcgaggtgtttgagctgccagaaaatgaagatatgttcagtccctcggagttagatacgtctaaattatctcataagttcaaggaactgcagattaagcacgccgtcacagaggctgaaattcagaagttaaaaactaagttgcaggccgctgaaaacgagaaggttcgctgggaactcgaaaagacacagctccagcagaacatcgaggagaacaaagaaagaatgctgaagttggaatcatactggattgaggcccagaccctttgccataccgtaaatgagcatctgaaagaaacacagtcgcaatatcaagcacttgagaagaagtacaacaaggcgaaaaaactgattaaagatttccagcagaaagaactggacttcattaaacggcaagaggccgagagaaagaaaatcgaagacctcgagaaagctcatctggtggaagtgcaaggcctgcaggtacgcattcgggatctggaggccgaagtgtttaggctacttaagcagaatggaacacaggtaaataacaataacaatatctttgaacgccgcacatccttaggtgaggtgagtaagggcgacacaatggagaacctcgacggtaagcagactagctgtcaagatggactgtcgcaggatctgaacgaggccgtccccgagacagagcgactggattccaaggccctgaagacacgagcacagctatcagtgaaaaatcggaggcaacgaccttcaagaacccggctgtacgatagcgtttccagcacagatggcgaggattctctagagcgtaaaccatcaaacagtttctataaccacatgcacatcaccaaactgctgcctcccaaagggctgcgaacttcctctccggagagtgattctggcgtgcctcccttgacgcctgtggacagcaacgtgccattcagttccgatcatatcgcggaatttcaagaggagcccttagatcctgagatgggccccttgtcttccatgtggggggatacctcattgttttccactagcaagtctgatcacgacgtggaagaaagcccctgtcatcatcagactaccaataaaaagatccttcgcgagaaagacgatgctaaagatccgaaatctctgagggccagctcttctttggcagtacaggggggcaaaatcaaacgcaaatttgttgatttaggagcgcctctacgcaggaactcttctaaaggcaagaagtggaaagagaaggagaaggaggcctccaggttctccgcggggagcaggatcttccggggtcgccttgagaactggacccccaagccatgctccacagctcagacttcaacacggtctccatgcatgcccttctcttggttcaatgacagtagaaagggttcttattcatttagaaatctgcccgcacctaccagctctctgcagccctcccctgagactttaatttccgacaagaagggctctaagaattttactttcaatgatgatttttcacctagcagcacgtcctccgcagacctgtctggcctgggagccgagcccaaaacacctgggctcagtcagagtctcgctctgagcagtgatgaagcactcgggatgacggccagccaagatcgggccgtggtcaagaagaagctgaaagaaatgaagatgtcccttgaaaaggctcgcaaggctcaagaaaagatggagaagcaaagggagaagttgcggaggaaagagcaagaacagatgcaaagaaaatctaagaagaccgagaaaatgacctccacaaccgcagagggagcgggcgagcagtag

SEQ ID NO: 201534 - DNA, 930 bp, Artificial Sequence
  Description of Artificial Sequence: Synthetic coding sequence
atggacgagaaggtgttcaccaaggagctggaccagtggatcgagcagttgaacgaatgcaagcaactgagtgaaagccaggtcaaaagtctgtgcgaaaaggcaaaggaaattctgaccaaggagtcgaacgtgcaggaggtacgatgccctgtgaccgtatgtggggacgtccatggacaattccacgacttgatggagctatttaggatcggcggcaaaagcccagacacaaattacctgttcatgggcgactacgttgacagagggtactactcagtggagacagtgaccctgttagtggcactcaaggtgcggtatcgtgagcgcataacaatacttaggggcaatcacgaatccagacagatcacccaggtgtacgggttctacgatgagtgtctgcgtaaatacggcaatgcaaatgtctggaaatattttaccgatctgttcgactatctccccctgacggccctggtggacgggcaaatcttttgtctgcacgggggtctgtccccgtctattgataccctggaccacattcgagctctggatcgattacaggaagtccctcatgaagggccaatgtgcgacttgttgtggtcagaccctgatgacagaggcggttggggtatttctccccgcggtgccggatacacattcggccaagatatctctgaaacttttaaccatgcaaatggcctgacacttgtgtcccgcgctcatcagttagtgatggagggctacaattggtgccatgaccgtaatgtggtgactatattctccgcacccaattactgttacaggtgcgggaatcaggccgctattatggagctcgacgatacactcaagtatagcttcctgcaatttgacccagcccctcgccggggcgagcctcatgtcacccgccgcaccccagactattttctttag

SEQ ID NO: 201535 - DNA, 1407 bp, Artificial Sequence
  Description of Artificial Sequence: Synthetic coding sequence
atggcccccccccccgcccgggtgcacctgggcgccttcctggccgtaacacccaacccgggcagcgctgccagcggcacagaagccgccgccgccactccatccaaggtttggggatcttctgcaggtcgtattgagccccggggtggtggacgcggtgccttgcccacatccatggggcagcacggtccaagcgctcgtgcccgcgcaggccgagcccctggcccccgcccagctagagaggcttccccgaggctgagagtccacaagacatttaagttcgtggtggtgggagtgcttctgcaagtcgtgccgagctcagccgcaaccataaaactgcacgaccagagcatcgggacccagcagtgggagcattcaccactaggagagctgtgtcctccaggcagccatcgctctgagcacccaggggcttgtaatcggtgtaccgaaggggtgggttacaccaacgcctccaacaatctctttgcatgtcttccatgtacagcatgcaagtctgatgaagaggaaaggagtccatgtactaccacaagaaatacagcttgccagtgtaagcctgggacatttcgtaatgataacagcgccgagatgtgccggaaatgttcacggggatgcccacgcgggatggtgaaggtgaaagactgcactccctggagtgacatagagtgcgtgcataaggagagtggcaacggccataacatctgggttatccttgtggttactctcgttgtgccgctcctcctggtcgcggtcctgattgtgtgctgctgcattggctctggatgcgggggcgacccgaagtgcatggaccgagtttgcttttggcgactgggtctcctgagaggacccggcgcggaagataacgcccataatgagatattgagcaatgcggacagcctctccactttcgtgtccgagcagcagatggagagtcaggaacccgccgatctaacgggagtaacagtacagagccctggcgaagcacagtgcttgctgggcccagctgaagctgagggatcacaaaggcgaaggctgctggtccctgcaaacggtgcagatcctaccgagacgctgatgctctttttcgataagttcgcgaacattgtaccgtttgattcctgggaccagcttatgaggcagcttgatttgacgaaaaatgagattgacgtggtgcgagcaggcacggccggtccaggtgatgccctgtacgcgatgttgatgaaatgggtcaataagaccggaaggaacgcaagtatccacaccttactcgacgccttggaacggatggaagagcgccacgcccgggaaaagatccaggacctgttggtggatagtggtaagttcatctatctggaagatgggacaggctcagccgtcagtttggaatag

SEQ ID NO: 201536 - DNA, 930 bp, Artificial Sequence
  Description of Artificial Sequence: Synthetic coding sequence
atggacgacaaggccttcaccaaggagctggaccagtgggtggagcagttaaacgagtgtaagcagctaaatgaaaaccaggtgcgtacactgtgcgaaaaagcgaaggagatactcaccaaagagagcaatgtacaggaagtacgctgcccggtgaccgtctgtggggatgtgcacgggcagttccacgacctcatggagctgtttcgaattgggggcaaatctccagataccaattatctgtttatgggggactacgtcgaccgcggctattattccgtggaaacagtaactctgctcgttgctctcaaggtgcgctatccagagaggattactatcctgcgcggcaaccacgagagtcgccaaatcacccaggtttatggcttctacgacgagtgtcttcggaaatacggaaacgcaaacgtatggaagtactttactgacctattcgactacctcccactcaccgctcttgtcgacggccagattttctgcctccatggcggtttgtctccttccatcgacacactggatcatatccgggcactggacaggctgcaagaggtgcctcacgagggaccgatgtgtgacctgctttggagcgatcccgatgacagaggcgggtggggaataagtccccgcggtgctggctatacattcggccaggacatctctgaaaccttcaatcatgctaacggtctgacattagtcagcagggcgcatcagcttgttatggagggatataattggtgtcacgacaggaacgttgtcaccatttttagcgctcctaactattgttacaggtgcggaaaccaggctgcaatcatggaactagacgatactttgaaatatagcttcctacagttcgatcccgccccgcggcggggggaaccacacgtgaccaggcggacaccagactacttcctgtag

SEQ ID NO: 201537 - DNA, 1461 bp, Artificial Sequence
  Description of Artificial Sequence: Synthetic coding sequence
atgagcagcagcagcccccccgccggcgccgccagcgccgccatctccgcctccgaaaaggtagacggatttaccaggaagagcgtgaggaaggcccaacgacagaagaggagtcaaggctcatctcagttccggtcccagggtagccaggctgaactgcatcctctgccccagctcaaagacgctacaagcaatgaacagcaggagttgttctgtcagaaactgcaacagtgttgtatcctgtttgattttatggactctgtatctgacttgaaatcaaaagagataaaacgggccaccctcaacgagctcgtggaatacgtgtccactaatagaggtgtcattgtggaaagtgcttacagcgatatcgttaagatgattagcgcgaatattttcagaaccctcccaccttctgacaaccctgactttgatccagaagaagacgagcccacactcgaggcttcttggcctcatattcagctagtctacgaatttttccttagatttttagagagtccagatttccagcccagtatagctaagagatatatcgatcaaaaattcgtgcagcagctgcttgagttgtttgattcagaggacccccgggagcgagatttcttgaaaacggtcctccaccggatttacggaaagtttctcggcctgcgggccttcatcaggaagcagatcaacaacatctttcttcgcttcatctacgaaacagagcatttcaatggagtcgccgaactcttagagattttgggcagcattatcaatggctttgcactgcccctcaaagccgaacataagcagtttctgatgaaggttcttatccctatgcacacagccaaaggattggctttatttcatgcgcaattagcatattgcgtggtccagttcctggaaaaggacactacactcacagaaccggtcatccgcggactgctaaaattctggccaaagacgtgctcccagaaggaggtgatgtttctcggagagattgaggagattttagacgtgatcgagcctacacaattcaagaagatcgaagaaccgctgttcaagcaaatttccaagtgcgtgagctcatcacatttccaggttgccgaacgggcactgtacttctggaacaacgaatacatactgtcattgattgaagagaatatagacaaaatccttccaataatgttcgccagtctctataagatttcaaaagaacattggaaccctacaatcgtagctttagtatacaacgtgctaaagacgttgatggaaatgaacgggaagctcttcgacgatttgacgagtagttacaaggctgagagacaaagagaaaaaaaaaaagagctcgaaagagaagaattatggaagaaactggaggagctaaagctgaaaaaggccctggagaagcagaacagtgcctacaatatgcactctattctcagtaataccagtgcggagtag

SEQ ID NO: 201538 - DNA, 1290 bp, Artificial Sequence
  Description of Artificial Sequence: Synthetic coding sequence
atgatcatgaacgccaccagcaacgagcagcaggagctgttctgccagaagctgcagcagtgttgtatcctcttcgacttcatggactccgtgtcagatctgaagagtaaggagattaaaagggcaaccctgaacgagcttgtcgaatacgtctccacaaatcgtggcgtgatcgtggagtcggcgtacagcgacattgtcaagatgatttccgcaaacatatttcggaccctgccaccctcagacaacccggactttgaccccgaagaagatgagccaacattagaagccagctggccacatattcagttagtctatgaatttttcttaagattcctcgagagtcccgattttcagccttccatcgccaagcggtatattgaccagaagtttgtgcagcagctgctggagctgttcgacagcgaggatcctcgggagcgagattttctgaaaaccgtactgcataggatttatggcaaatttctgggccttagggccttcatcaggaaacagataaacaacattttcctcaggtttatctatgagactgagcacttcaatggagtcgcggagctgttggagattctgggaagcatcattaacgggttcgccttaccactgaaagccgagcataaacagttcctgatgaaagtcctgatccccatgcatacggcaaaaggtctggccctctttcatgcacaattggcctactgcgtggtgcaatttctcgagaaagacacaactctgacggaacctgtgatcaggggactcctgaagttttggcctaagacatgttcacagaaagaagtgatgttcctcggcgaaatcgaggagatcttagatgtcatcgagcctactcagttcaagaaaattgaggagcctttgttcaagcagatttcgaaatgtgtgtccagctcccatttccaagtcgcagagagagctttatatttctggaacaacgaatatatactgtcacttattgaggaaaatatagacaaaattctgcctattatgttcgctagtctgtacaagatttcaaaggaacattggaaccccacaatcgtggctcttgtgtacaatgtgctgaaaacacttatggaaatgaacggcaagctgttcgacgatcttacttcctcatacaaagcagagcggcagcgagagaagaagaaagagctggaacgtgaggagctctggaaaaaacttgaagaactgaaactcaagaaggcattggagaaacagaatagtgcttacaatatgcattccatcctctccaataccagtgcagagtag

SEQ ID NO: 201539 - DNA, 1461 bp, Artificial Sequence
  Description of Artificial Sequence: Synthetic coding sequence
atgagcagcagcagcccccccgccggcgccgccagcgccgccatctccgcttccgagaaagtggacggattcactcgaaagagcgtccggaaggcccaaaggcagaagcggtcacagggatcaagccagtttagatcccagggcagccaggcagagctgcaccccttgccacagcttaaagacgcaacctccaatgagcagcaggagctattctgtcagaaactccaacagtgctgtattctttttgattttatggattccgtgtccgatctcaaaagtaaagaaatcaagcgcgccacgctgaacgaactggtggaatacgtgagtacaaatagaggcgtaattgtcgaatccgcttactccgacattgtgaagatgatcagtgccaacatctttaggaccctcccgccctctgacaatcctgatttcgacccagaagaggatgagcctaccctggaggcgagttggccacacattcagctggtgtacgaattcttcttaaggttccttgagagtcccgacttccagccttcaattgctaagcgatacattgaccagaagttcgtccagcagcttttggaattgttcgattccgaggatccaagagagcgtgacttcctcaagaccgttctgcataggatctatggcaaattcttgggactcagggcctttataaggaaacagattaataatatatttctgaggtttatctatgaaactgaacatttcaacggggtggcagaactgcttgaaatacttggttccataattaacggttttgccctgcctctgaaagccgaacataagcagttcctcatgaaggttctcattcctatgcacaccgctaaaggtctggccttatttcatgctcagttagcatattgcgtggtccagttcctagagaaagacacaaccctcacagagcccgtgatccgcggcttgctgaagttctggcccaagacctgtagccaaaaggaggtgatgtttctgggggagattgaggagatactagatgtgatcgaaccgacacaatttaagaagatcgaagaaccgctattcaaacagatttcaaagtgtgtctccagttcacacttccaggtcgcggagcgagctctctatttctggaataatgaatacatccttagcctgattgaggaaaatattgacaagattctgcccataatgttcgccagcctatataaaatctcaaaggaacattggaatcccacaatagtggccttggtctataatgtcctgaagacgctgatggagatgaacgggaaactttttgacgatcttacctcaagttacaaggccgaaagacaacgggagaaaaaaaaggagctcgaacgtgaggagctatggaaaaagctcgaggaactgaaactgaagaaggccctggaaaaacagaacagcgcctataacatgcactctattcttagcaacacttctgccgagtag

SEQ ID NO: 201540 - DNA, 1341 bp, Artificial Sequence
  Description of Artificial Sequence: Synthetic coding sequence
atgaagtgcttcagccggtacctgccctacatcttccggccccccaataccattctgtccagcagttgccatactgaagctgatatcatctctaccgtggagtttaatcatacaggcgaactcctagcaacaggggataaagggggtcgtgtagtcatctttcaaagagaacaggagagtaagaaccaggtccaccgcaggggggagtacaatgtgtacagcacatttcagagtcacgagcctgagttcgattatttaaaatccctggaaattgaggagaaaatcaacaagatacgctggctgcctcagcagaacgccgcttatttcttgctaagcacaaatgataagaccgtgaaactgtggaaagtgtcagagagagataaacgcccagaaggatataatctcaaggatgaagaagggcggctgagggacccggccaccatcactacactacgagttccagtcttacgcccgatggacctaatggtagaggcaacccccagacgagttttcgctaacgcacacacatatcacattaacagcatctctgttaattcagattacgagacctacatgtcagctgacgacctgaggattaacctgtggaactttgagataaccaaccagtctttcaacatcgtggatattaaacctgccaacatggaggagctgacagaggtaattacagcagccgagtttcatccccaccattgcaataccttcgtgtatagtagtagtaagggcaccattcgactgtgcgacatgagggccagtgctctctgcgataggcatacgaagttctttgaggagcccgaggatcccagcaatcgatctttcttctccgaaattatctcatcgatttcagacgtaaagtttagccacagcgggaggtacatcatgacaagggactacctgaccgtgaaggtctgggacctcaacatggaaaaccgccccatagagacataccaggtgcacgactacctccgctcgaaactctgctcattgtacgagaatgattgcattttcgataagtttgaatgcgtatggaacgggagcgactccgtgataatgactggtagttacaataacttcttccgtatgttcgaccggaacacgaaacgtgatgtaactctcgaggcaagtcgtgagaatagcaagccacgcgccatcttgaaacccaggaaggtgtgcgtgggcgggaagcgtaggaaagatgaaatatcggtagactccctcgacttcagtaaaaagatcctgcacacggcctggcatcctagtgagaatatcatcgcagttgccgctactaacaatctgtacatctttcaggataaagtcaattag

SEQ ID NO: 201541 - DNA, 1332 bp, Artificial Sequence
  Description of Artificial Sequence: Synthetic coding sequence
atggaggaggacatcgacacccggaagatcaacaacagcttcctgagagaccattcttatgctacagaggccgacataatctcaactgtggagtttaatcacacaggtgaactcctggcgacgggtgataagggcggaagggttgttatttttcagcgcgaacaggaaagtaagaaccaggtgcacaggaggggagagtacaatgtgtactctacattccagtcacacgagccagagttcgattaccttaagtctttggagattgaagaaaaaattaacaagatcaggtggttaccacagcagaacgcggcatattttctcctgtctactaatgacaagaccgtgaagctctggaaagtatcagagagagacaagagaccagagggctataacctgaaggatgaagagggaaggctgcgtgaccccgctacaatcacaacactacgagtccccgtgcttcgcccgatggatctgatggttgaagcaacgccacgtcgcgtttttgccaatgctcacacctaccacattaacagcatctctgtaaattcggactacgaaacctacatgtctgccgacgatctgaggatcaacctatggaacttcgaaatcaccaaccagtcatttaacatagtggatatcaaacccgcaaacatggaggagttgacggaagtcatcaccgcagcggagtttcacccccaccattgcaatacgtttgtgtattcatcatccaagggcacgatacggctttgcgacatgagagccagcgccctgtgcgaccgtcacactaaattctttgaagagccagaagatccaagcaaccggtccttcttcagtgagataataagctctatctccgatgtaaagttcagtcactcgggccggtatattatgacacgggactacctgactgttaaggtgtgggacctaaacatggagaatcgcccaatcgaaacttatcaagttcatgattatttgagatcaaaactgtgttcactctacgagaatgactgtatcttcgataaattcgaatgcgtgtggaacggctccgatagcgtcatcatgacggggagttataacaattttttccggatgtttgacaggaacacaaaacgagacgttaccctggaggccagccgtgaaaatagcaagccccgggcaatcctgaagccccgaaaggtgtgtgtgggaggcaaaaggaggaaggacgaaatctctgttgatagcttggacttttccaaaaagattttacacactgcatggcatccaagtgagaacatcattgccgtagccgcaactaacaacctatatattttccaggataaggtgaactag

SEQ ID NO: 201542 - DNA, 1506 bp, Artificial Sequence
  Description of Artificial Sequence: Synthetic coding sequence
atggtgctgcagcccagcgagcggcactaccgggactggaaccaccgaaggctcgggccctggtgttcgcccacgggctccccagccccgctgagctgtgaaacaggatgcggagagggctcctggattctcgtgtgcagactgcttgttcctacacaggtgagtctgctgtccatggaagaggacattgacacgagaaaaattaacaactccttcctcagggaccactcttatgcaaccgaggctgacatcatcagtaccgtggagtttaaccacaccggggagttgttggcaacgggagataagggaggccgggttgttattttccagcgtgagcaagagtccaagaaccaagtgcacagaagaggcgaatataacgtctactccacatttcagtcccatgagcccgagtttgattaccttaaaagtctggaaatcgaggagaagatcaacaaaattcggtggttgccccagcagaatgcagcatattttttgctgagcacaaacgacaagacggtcaagctgtggaaagtgtcggagagagataagagaccagaggggtataacctgaaggacgaagaaggccgtctaagagacccggccactatcaccacattgagggtgcccgtgctgcggcctatggacctgatggtagaggccactcctcgccgcgtcttcgcaaacgcacacacctaccatattaattccattagtgtgaatagtgattatgagacttatatgtctgccgatgatctccgcattaacctctggaacttcgaaatcactaaccagtccttcaacattgtggatatcaagccggcgaacatggaggagctgactgaagttataaccgccgccgagtttcatccacaccactgtaacaccttcgtctactcgtcctctaagggtaccatacggctctgtgacatgcgggcttcagcgctgtgcgaccgtcacactaagttttttgaggaaccagaggaccctagcaaccgaagttttttttctgaaatcatctcaagtatttcagacgtcaagttcagccatagcgggaggtatattatgacgagggactacctgaccgtaaaggtctgggatttgaatatggagaatcgcccaatcgagacataccaggtccacgattacctcagatccaagctctgtagcctctacgaaaacgactgtatcttcgataagtttgaatgcgtttggaacggatcggattctgttatcatgactgggagttacaataactttttccgcatgttcgataggaataccaagcgggatgtgactttggaggccagtagagaaaactctaagccaagagccatcctgaaacctagaaaagtgtgtgtcggaggaaaacggcgtaaagatgaaatttccgtggacagtctggacttttcgaaaaaaatcttgcataccgcgtggcatccctcggaaaatatcattgctgtggctgccacaaataacttatatatttttcaggacaaagtgaactag

SEQ ID NO: 201543 - DNA, 1299 bp, Artificial Sequence
  Description of Artificial Sequence: Synthetic coding sequence
atgaactaccccgacgagaacacctacggcaacaaggccgacatcatttctactgtggaattcaaccacactggagagttgctcgctaccggagataaggggggacgggtcgtcatctttcagcgagaacaggaaagcaagaaccaggttcatcgccggggggaatacaatgtgtactccaccttccaaagccacgaacccgagttcgactacctcaagtcactggaaatcgaggagaaaatcaacaagattagatggcttccacagcagaatgccgcctatttcctgctctcaaccaacgacaaaaccgtgaagttatggaaagtctcagagcgcgataaaaggccggagggatataatctcaaagacgaggaggggcggttgagggatcctgccaccatcacaaccctcagagtgcccgttctccggcccatggacctgatggtggaagcaacaccccgtcgagttttcgctaacgcccacacatatcatattaatagcatctccgtcaacagtgattatgaaacctacatgtccgcggacgatcttagaattaacctgtggaacttcgagatcaccaatcagagcttcaacatcgtggacatcaaacccgcaaacatggaggaactcactgaggtgattactgcagcagagtttcatccccatcattgtaataccttcgtatactcatcgtcaaagggaactattcggctgtgcgacatgcgcgcgagcgccctgtgtgaccgccacactaaattctttgaagagccggaggatcctagtaaccggtccttcttcagtgaaataatttcgtccatcagcgacgtgaaatttagccatagtggacgctacataatgaccagggattatcttaccgtgaaggtttgggacttgaacatggaaaataggcccattgaaacatatcaggtgcacgactatctgagatctaagctatgctctctttacgaaaatgattgtatatttgataagtttgaatgcgtttggaatggctctgactcagtcatcatgacaggcagctacaataatttttttcgcatgttcgaccgcaacacaaagagggatgtcacactcgaagcgtccagggaaaatagcaagcccagggctattcttaaaccccggaaggtatgcgtgggggggaagcgtagaaaggatgagatttcggtcgacagtttggatttctcaaaaaaaattctacacacagcgtggcacccatcagaaaacattattgccgtggcagcgaccaacaacctgtacattttccaggataaggtgaactag

SEQ ID NO: 201544 - DNA, 1332 bp, Artificial Sequence
  Description of Artificial Sequence: Synthetic coding sequence
atggaggaggacatcgacacccggaagatcaacaacagcttcctgagagatcactcctacgctacagaagctgacattatctccacagtagaattcaatcacaccggggaactgttagctacaggtgacaaaggggggcgcgtggtcatatttcagcgagaacaagaatctaaaaaccaggtgcatcgccgaggggaatacaacgtgtattccacattccaatcccatgaacctgagttcgactatcttaaaagcctggagattgaggaaaaaattaataaaatccggtggctcccgcagcagaacgctgcctacttcctactgagtacaaacgataagactgtcaaactctggaaggtctccgagagagacaagaggcccgagggctacaatcttaaggatgaggaggggcgcctgagggatcctgccactattacaacacttagagtgcctgtgcttcggccaatggacctaatggttgaggctacaccacggagggtgttcgctaatgcacatacatatcatatcaacagcatctctgttaactccgactacgagacatacatgagtgccgatgacctacgtataaacctgtggaatttcgagatcacaaaccagagctttaatatagtggatatcaagcccgccaacatggaggagctgaccgaggtgattacagcagccgaattccatccccatcactgcaatacatttgtatattccagctccaaggggacaattaggttgtgtgatatgagggcttctgctttgtgcgatcgtcatacgaaattcttcgaagaaccagaggatccctctaaccggtctttttttagcgaaatcatcagctccatttccgacgtgaaattttctcatagcggtcgttacattatgacaagagattacctaactgtgaaagtctgggatctgaatatggagaataggcctattgaaacttatcaagtccatgactacctcaggtccaagctatgctcactgtacgaaaacgattgtatatttgataagttcgaatgcgtgtggaatggctcagacagcgtgattatgacaggatcatataataatttttttaggatgtttgaccgaaacactaagcgcgacgtgactctcgaggcatctcgcgagaatagcaaaccccgggcaatccttaagccacgcaaagtgtgtgtcggggggaaaagacgcaaggacgagatctccgtagacagcctggactttagcaaaaagatactccatacagcgtggcacccaagcgagaatatcatcgccgtggccgccaccaataacctgtatattttccaggacaaggtgaactag

SEQ ID NO: 201545 - DNA, 1332 bp, Artificial Sequence
  Description of Artificial Sequence: Synthetic coding sequence
atggaggaggacatcgacacccggaagatcaacaacagcttcctgcgcgaccattcctacgccaccgaagccgatatcatctcaacagtcgagtttaaccacactggcgaactgctggccaccggtgacaagggaggccgcgttgtgatatttcagcgggaacaggaatccaaaaatcaggtgcatcgaagaggcgagtacaacgtgtattctacattccaatcccatgagccagagtttgattatctgaaatcgctcgaaatcgaagagaagattaataaaattagatggctcccacagcagaatgctgcatatttcttgctgagtactaacgacaagaccgtgaaactgtggaaggtttcagagcgcgacaaaaggcccgagggatacaacctgaaggacgaggagggaagattacgggatccagctacaattactactttgagggtgccggtgctccgccctatggatctgatggtcgaagccacacctagacgtgtttttgccaacgcccacacataccatattaattctattagtgttaatagtgattatgaaacctatatgagtgcggacgacctgcgcatcaacctctggaacttcgagattacaaatcagagcttcaacattgtggacattaaacccgccaacatggaagagctgaccgaggtcatcacagccgccgagttccatcctcaccattgcaatacattcgtgtactcatccagtaagggaacaattcggctctgcgacatgcgggcatccgcactctgcgacagacacacgaagttcttcgaggaaccagaagatccttctaaccgcagtttcttctcagagatcatttcctccatcagcgatgtgaaattctcccactcagggaggtacattatgactagagattaccttactgtgaaggtctgggatcttaacatggagaatcggcccatagagacgtatcaggtacacgactacctgcgatccaaattgtgtagtctttatgagaacgactgcattttcgacaagtttgagtgcgtgtggaatggcagcgatagcgtcattatgacaggctcctacaataattttttccgaatgttcgataggaataccaagcgcgacgtcacgctggaggcctctcgagaaaattccaagcctcgagctattttgaaaccccggaaggtttgtgtgggaggtaaaagaagaaaggacgaaatctcggtcgacagcttagacttctctaaaaagatactgcacacagcctggcacccaagcgagaacatcattgcggtggctgccactaacaatctatacattttccaggacaaagttaactag

SEQ ID NO: 201546 - DNA, 1530 bp, Artificial Sequence
  Description of Artificial Sequence: Synthetic coding sequence
atgctgctgagcctgcccgccctgcacctgcagaccagcgagcaccacccattcttccagctccctcatcggagactgggcccttggtgctcccccacaggctcaccagcccctctatcatgcgagactggctgcggagagggttcctggatcctggtgtgcagacttctggtgcccactcaggtgtccctgctgtccatggaagaggacatcgataccagaaagatcaataacagcttcttgagagaccactcgtacgcaactgaggcagatatcataagcaccgtggaatttaatcataccggtgaattactggccacgggggacaagggtgggcgcgtggttatcttccaacgcgaacaggaatcaaaaaaccaggtgcatcgccgcggggagtacaatgtgtattcaacatttcagtcacatgaaccagagtttgactatctgaagtccctcgagattgaggaaaaaatcaataagatacgctggcttcctcaacaaaatgccgcctactttctgctgagtaccaacgacaagactgtgaaactctggaaggtgtccgagcgcgacaaaagaccggagggatataatttgaaagacgaagaaggaaggctgcgcgatccagccaccatcactaccctgcgggtgcctgtgctgcgccctatggacctgatggtcgaagccaccccccgaagagtatttgccaacgctcatacataccatatcaatagtatctctgtaaattccgactacgagacttatatgtccgctgacgacttgcggattaacttgtggaacttcgagattaccaaccaatcgttcaacatcgtagacataaagcctgcgaatatggaggagctgaccgaagtcattacggctgccgagtttcacccacatcactgcaatacatttgtgtacagctccagtaaggggaccatccgcctctgcgacatgagagcttctgcgctttgtgatagacacaccaaattttttgaagaacccgaagatccaagtaataggtctttcttctctgagattatctcaagcatatccgatgtcaagtttagtcactcgggaaggtatattatgacgagggactatctgaccgttaaagtctgggacctgaatatggagaatcgcccgattgaaacttatcaagtgcatgactatctccgatctaagctgtgctcattgtacgaaaatgactgcattttcgacaagtttgaatgcgtatggaatggttccgactctgtcataatgactggttcatacaacaactttttccgcatgttcgaccgaaatacaaagcgggatgtgactctcgaagccagtcgcgaaaattccaagcccagggctattctcaagccacgtaaggtctgtgttgggggaaagagaaggaaagacgagatatctgtcgatagccttgatttcagtaagaaaatcctacacaccgcctggcatccctcggaaaatattattgcagtcgcagctaccaataacctgtacattttccaggacaaggttaactag

SEQ ID NO: 201547 - DNA, 1332 bp, Artificial Sequence
  Description of Artificial Sequence: Synthetic coding sequence
atggaggaggacatcgacacccggaagatcaacaacagcttcctgcgtgaccattcatacgcaactgaagccgatatcatttctaccgtcgagttcaatcacacgggagagctgctggccaccggtgataaaggcgggagggtggtgatatttcagagggaacaagagagtaagaatcaggtccaccgtcgaggagagtacaacgtgtacagtacattccagagccatgagcccgagtttgactatctaaaaagtttggagattgaggagaagatcaataagattcgctggctgccccagcaaaatgccgcatatttcctgctctcaacgaatgacaagactgtgaagctctggaaggtcagtgagcgcgacaaacgacctgagggatataacctaaaagacgaggagggccgcctgagagatcctgccaccataactaccctgcgggtgccagtgttaaggcctatggaccttatggtggaggccacgccccgacgtgtattcgcaaacgcacacacatatcacataaactcgatctctgtgaatagtgactatgaaacgtacatgtccgctgatgatctgcggataaacctctggaatttcgagatcactaaccagagctttaatatagtggatataaaacccgccaatatggaagagctgaccgaagttatcaccgcagcagagttccatccacaccattgtaacactttcgtatactctagttcaaaaggcacaattcggctttgtgatatgcgggccagtgcactctgtgatcgccacactaaattttttgaggagccagaggatcctagtaaccggtccttctttagtgagattatatctagtataagtgatgttaagttctcccacagcggaagatacatcatgactcgtgactatctgaccgtaaaggtttgggacctgaatatggaaaatcgccctatcgaaacttaccaggttcatgattaccttagatcaaagctatgctctctgtacgaaaatgactgcatatttgataaatttgagtgcgtgtggaacggaagcgacagcgtaatcatgaccgggtcgtataacaacttcttcaggatgttcgacaggaataccaaaagagacgtgactttggaagcatccagggaaaattcaaaacccagagcaatcctcaagcctcggaaagtctgcgttggggggaagagacgcaaggatgaaattagcgtggactcccttgattttagcaaaaaaatcttgcatacggcctggcacccgagtgagaacatcattgccgtggcggctactaacaacctctatattttccaggataaggtcaactag

SEQ ID NO: 201548 - DNA, 1350 bp, Artificial Sequence
  Description of Artificial Sequence: Synthetic coding sequence
atgatccccggcatcggcaccctgacccaggacaccctgtggtgcttctctcaagtgaagggtactatcgagatcggcaccactgaagccgacataatcagcactgtggagttcaatcacacaggtgaacttctggctacaggagacaaggggggtagggtggtgatcttccaaagggagcaagagtccaagaatcaggtccaccgccgcggggagtacaacgtttactcaacgttccaaagccatgagccggaattcgactatttaaaatccttagagattgaagagaagatcaataaaattcggtggttgcctcaacagaacgccgcttattttcttctcagcaccaacgacaaaacagttaagctttggaaagtgtcagagcgagacaagcggcctgagggatacaacctcaaagatgaggaaggcaggttgagagaccccgccacaattactactttacgagtgcccgttctgcgtcccatggacctgatggtcgaggctactccccgcagagttttcgccaatgcccatacatatcacataaactctatttctgtcaatagtgattatgagacttacatgtccgcggacgatctgagaatcaacctttggaattttgaaatcacaaatcagagtttcaacatcgttgacatcaagcctgcaaatatggaggagctcacagaagtcattaccgccgccgaattccacccccaccactgtaacacgtttgtttatagcagctccaagggcaccatcagattgtgcgacatgagagcatcggccctgtgtgatcgacacactaagtttttcgaggaaccagaggacccctccaatcggagttttttcagtgaaataatctcatccatctcagacgtcaagttttcccacagcggacgctatatcatgactcgggattacctcaccgtaaaagtgtgggaccttaatatggagaaccggccgattgagacatatcaggtccacgattatctgcgaagcaaattgtgtagcttatacgaaaacgattgcatcttcgataagtttgagtgtgtgtggaatggttcagactcagtcataatgacagggtcatacaacaactttttccgcatgttcgaccggaacactaagagagacgtgacactggaggcaagtcgagagaactccaagccccgggcaatcctcaagcccagaaaagtctgcgtagggggcaagagacgcaaagacgaaatcagcgtggatagcctggatttctctaaaaagatcctccacacagcctggcatcccagcgaaaatataattgccgtcgccgccaccaacaacctctacatctttcaggacaaggtaaattag

SEQ ID NO: 201549 - DNA, 1299 bp, Artificial Sequence
  Description of Artificial Sequence: Synthetic coding sequence
atgaactaccccgacgagaacacctacggcaacaaggccgacatcatctccacagtcgagtttaatcatactggcgagctcttggctaccggagataagggaggtcgtgtggtgatatttcagagagaacaagagtctaagaaccaggtacaccgtcgcggggagtataatgtgtatagtacgttccagtcacatgagcccgaattcgactacctgaaatccctggaaatcgaggagaagattaataaaattcgctggcttccccagcagaatgcggcgtattttctgctatctactaacgacaagacggtcaaactttggaaagtgagtgaaagagacaagagacctgaaggctacaaccttaaagacgaagagggaaggctacgcgacccagcaactattacaacactgagggtgccagtcctcaggccaatggacctcatggtggaggccactcccaggcgggtgtttgccaacgctcacacgtaccacattaatagcataagcgtgaattctgattacgaaacctacatgtctgctgacgatttaagaataaacctgtggaattttgagattactaatcagtcattcaacattgtggacatcaaacccgcgaacatggaagaactgactgaagtcataactgccgcggagtttcaccctcaccactgcaacacgttcgtttattctagttcaaagggcactataaggctgtgtgatatgcgcgccagcgcactctgcgatcggcataccaagttttttgaggagcctgaggatccttccaaccggtcgttctttagcgagattattagctccatttctgacgtcaagttttcacacagtgggcggtatattatgacgcgggactacttgaccgtcaaggtgtgggacctcaacatggagaataggccgatagagacttatcaagtccacgactacttgagaagtaagctctgttctttgtatgagaatgactgtattttcgacaagttcgaatgtgtgtggaatgggagcgactctgtgataatgacgggttcatacaacaacttttttcgcatgtttgaccgcaataccaagagggatgtgaccctggaggcttctcgtgaaaatagcaaacctcgtgcgattctcaagccaaggaaggtctgtgtggggggtaaacgcagaaaggatgagatctcagttgacagcctcgatttctccaagaagattctgcatacggcatggcatcccagcgaaaacatcatcgccgtggctgccactaataatctctacatattccaggacaaagtgaactag

SEQ ID NO: 201550 - DNA, 1494 bp, Artificial Sequence
  Description of Artificial Sequence: Synthetic coding sequence
atggagaccaagctgccccccgccagcacccccaccagccccagctcccctggactcagccctgtcccaccacccgacaaggttgatggcttctcacgtcgctcactgcggcgagctaggccgaggagatctcattccagctcgcagtttcgttatcagtcaaatcagcaggagctgacacccttgccattgctaaaggacgtgccagcatccgaactccacgaactactctcacgtaagctcgcacagtgcggcgttatgtttgactttctcgactgtgttgcagatctgaagggaaaggaggtaaagagggccgccctgaatgaactggtggaatgcgttggctccactagaggagttctgatcgaacctgtttacccagatatcattagaatgatctctgtgaatatcttcagaacactgcctccgtcggaaaatcccgaattcgaccctgaggaggacgaacccaacctggaacccagctggccacacctgcagctggtttatgagttcttcttgagattcctggagtcccccgatttccaacccagtgtcgctaagagatatgtggaccagaaattcgtccttatgcttttggaactgttcgactcagaggacccccgagaacgggagtacctgaagacaatactgcatcgggtttatggaaaattcctcggtctgcgcgcctacatcaggaaacagtgcaatcacatatttttgagattcatctacgagtttgagcacttcaatggggttgccgagttgctggaaattctcggtagcatcattaatggatttgccttgcctctcaaaacagagcacaagcagtttctagtccgggttctcatccccctccactctgtgaagtcgctatctgtgttccacgcgcaactcgcgtactgtgtggtgcagttcttggagaaagatgctaccctgaccgagcatgtcatcagagggctccttaagtattggcccaagacctgcacccagaaagaagtgatgttcttaggggaaatggaagaaatcctagatgttatcgagccatcacagtttgtcaaaatccaggagcctctgtttaagcaggtggctcgctgcgtgagcagccctcattttcaggtggccgagagagccctgtacttctggaataacgagtatattctgtcattgattgaggataactgccacaccgttctgccagccgtgtttggcaccctgtaccaggtgagcaaagagcactggaatcagaccatagtgtctctgatatacaacgtcctgaagacatttatggagatgaacgggaagctttttgacgaactcacggcctcttacaaactcgagaaacagcaggaacaacaaaaggcgcaggagcggcaggaactatggcaggggctggaagaactcagactaaggaggctgcagggaacacagggcgctaaggaggctccgctccaacgtctcaccccacaagtggccgcttccggcggacaaagttag

SEQ ID NO: 201551 - DNA, 1107 bp, Artificial Sequence
  Description of Artificial Sequence: Synthetic coding sequence
agcgtgcagagccaccccgcccccccccggccccgggagaacccccgcgggagcgagagcctaccctgccgtctgactgctatggagaccaaactgccgccagcaagcacccctacaagcccgtccagcccaggactctcaccagttcccccaccggataaagtggatggcttttcacgcaggtctctaagacgggcacgccctcgccggtcacacagcagctcccagttcagatatcaatccaatcaacaagaactaacacctctgcccctcttgaaagacgtgccggcctctgagctccacgaattactctcacgcaagctcgctcaatgtggcgtcatgttcgatttcctggattgcgtagctgacctgaaaggaaaagaggtcaagcgtgcagctctcaacgagcttgtggagtgtgtaggaagtactcgcggcgtgctaattgagcctgtttatccagatatcataaggatgatcagtgtgaacatcttcaggacactgccaccatccgaaaaccccgagtttgacccagaagaagatgaaccaaacctcgaaccttcctggccccacctgcaactggtatatgagttcttccttaggttcctggagtcacctgactttcagccaagcgtcgctaaacgctatgtagaccagaagttcgttctcatgcttctggaactgtttgactctgaggaccctagagagcgagagtacctgaagaccattctgcatagagtatatggcaaatttctcgggttgagggcatacatacgaaaacagtgcaaccacattttcctgaggtttatttacgagttcgaacactttaacggagtggccgagctcctcgagatcctcggctcaatcataaacggcttcgcactcccgctgaaaaccgaacataaaccaggcagcagacctgacccacctgccttgtgccaagtcgctgtctgcctgccctgtccggctggtatactgtgtggcgccgtgcccggtgaaggctgccacagtgatagagcccgggatcccggtgctgctcaaatacttgccaaaaatctgcaccccgaggggggagacgtgtcaggtggcgacggaagagactcgtag

SEQ ID NO: 201552 - DNA, 582 bp, Artificial Sequence
  Description of Artificial Sequence: Synthetic coding sequence
atggagaccaagctgccccccgccagcacccccaccagccccagctcgccaggattaagccccgtgccacccccagataaagtagatggcttttctcggcggagcctccgtcgagcccggccacgtcgctcccatagttcaagtcagttcaggtaccagtcaaatcagcaggagctcactcctctccctcttctgaaagatgtcccagccagtgagctgcatgagctgttatccaggaagcttgcccagtgcggcgtgatgttcgatttcctggactgtgtcgccgatctgaaaggaaaagaggtgaagcgagccgctctcaatgagctggtggaatgcgtaggctcaacaagaggtgtcctcattgagcctgtgtatccagatattatacggatgatctccgtcaacatttttaggaccctgccgcccagcgagaaccctgaattcgatccagaggaagacgagcctaacttggaaccatcctggccacatctccagctcgtctatgagttttttttgagatttctggaatccccggactttcagccgtccgtcgcgaagcggtacgtggatcagaagtag

SEQ ID NO: 201553 - DNA, 1494 bp, Artificial Sequence
  Description of Artificial Sequence: Synthetic coding sequence
atggagaccaagctgccccccgccagcacccccaccagccccagctcacctggcctgtccccggtgcctccgcccgacaaagtggacggcttctctcggcgcagcctgcgtcgagcccggccacggcggtctcactctagtagtcagtttcgataccagtccaatcagcaggagctaacccctttgcctctgttaaaagacgtgcccgcttccgaactgcacgagctactgagccggaagctcgcccagtgtggcgttatgttcgacttcctcgattgcgtcgctgatttgaaagggaaggaagtaaaaagagcagctctgaatgaattggtcgaatgcgtcggcagcactaggggcgtgctgattgagccagtgtaccccgacataattaggatgataagcgtaaatatcttccgaaccctgcccccttcagagaacccagaattcgaccccgaggaagatgaaccaaatctagagccaagttggccccacctgcagctcgtgtatgaatttttcctgaggttcttagaatcccctgactttcagcctagcgtggccaagcggtatgttgaccaaaagttcgtcttaatgttactggagctctttgattctgaagatccgagagagcgggaatatctgaagaccatactgcatcgggtgtacggaaagttccttggcctgcgcgcttacatccgcaaacagtgcaaccacatctttcttcgctttatatacgaattcgaacatttcaatggggttgccgaactcctcgaaatattaggctctataataaacggattcgcattgccactgaagaccgagcataagcaatttctcgttagggtgttgattccactgcattctgtgaaatctctgtccgtctttcatgcacagcttgcttactgcgtggtccagttcctggagaaggatgccactctaacagagcatgtgatcagggggctgctgaagtattggccaaagacctgtactcagaaggaggtcatgtttctaggagagatggaagaaatactggacgtgatagaaccctcacagtttgtaaaaattcaagagccactctttaaacaggtggctcgctgcgtctcatccccccactttcaggtcgcagagcgcgccctttatttttggaacaatgagtatatactaagcctcatcgaggacaattgccacacggtgctgcctgccgtctttggaacattgtatcaagtgtcaaaagaacattggaatcagacaattgtatcattgatctataacgttctgaagaccttcatggagatgaacggaaagctctttgacgagttgactgcctcatacaaactggaaaagcaacaggaacaacaaaaggcccaagagagacaagagctgtggcagggtctggaagagttacgactgagacgcttacagggtacgcagggcgctaaagaggctccactgcagaggttgacgccgcaggtcgccgccagtggaggccaatcttag

SEQ ID NO: 201554 - DNA, 408 bp, Artificial Sequence
  Description of Artificial Sequence: Synthetic coding sequence
atggaggagctgaccgaggtgatcaccgccgccgagttccacccccaccagtgtaatgtgtttgtctactcatctagcaaggggacaatacgtctgtgtgacatgcgaagcagcgccctttgcgacagacatagtaaatttttcgaagaacctgaggacccgtcttcccgcagttttttctcagaaattatatcgtccatcagtgacgttaagttctcccacagcggacgttatatgatgactcgggatccagtgggcgagggtgtgggtccccaacaccgcgctggaaggtggcgccccactcggagtacctccacatgtgccgcgtcttctgctctgtcaatgcgaacaacagcctcgctcacctcgctgtccgtagcgggcacggtcagaatcgcccctagctag

SEQ ID NO: 201555 - DNA, 1269 bp, Artificial Sequence
  Description of Artificial Sequence: Synthetic coding sequence
ctgaccgccgacatcatcagcaccgtggagttcaactacagcggcgacttgctcgccactggtgacaaaggcggccgggtagtcatatttcaacgggaacaggagaacaagagtcgcccacactcccggggtgaatataatgtctatagtacatttcagagccacgagcccgagtttgattatctaaaatccctggagatcgaggaaaaaataaataagattagatggttaccacagcagaacgccgcccatttcctgctcagcacaaatgataagactatcaagctgtggaagatctcagaaagggataagcgggccgagggttacaacctaaaagacgaggacggcagactgcgcgatccctttcggattacggctctgcgagtgccaatccttaaacccatggacctcatggtagaggccagtccccggcggatttttgctaacgctcacacataccatataaattccattagtgtgaatagcgaccacgaaacctatttgtcagccgacgatctgagaattaacctgtggcacctagagattaccgacagatcattcaatatcgtcgacattaagcctgccaatatggaagagctcactgaagtgattaccgccgcggagttccatccccaccagtgcaacgtgttcgtctattcttcttccaaaggaacaatccgactgtgcgacatgcgaagttctgccctctgtgacagacactcaaaatttttcgaggagcctgaagacccaagttcaagatccttcttctctgaaataatcagttcaatttctgacgttaagtttagccacagtggtcggtacatgatgacccgagattacctgagtgttaaagtgtgggacctcaatatggaatcccgtccagtggagactcatcaggtacatgaatacctcagatcaaaactgtgctctctgtatgaaaatgactgcatttttgataagtttgagtgttgctggaatggtagtgatagcgctataatgaccggttcttataataactttttccgcatgttcgatcgggataccaggcgggatgtaacactggaggcttcaagagagagcagcaaacctagagccagcttgaaacccaggaaggtgtgcactggcggtaaaagacggaaggatgagatctccgtggattctttggatttcaacaagaaaattctgcacaccgcttggcaccccgttgataacgtcatagcagttgccgccacaaataatctgtacatctttcaggataaaataaactag

SEQ ID NO: 201556 - DNA, 1713 bp, Artificial Sequence
  Description of Artificial Sequence: Synthetic coding sequence
atgccctacaagctgaagaaggagaaggagccccccaaggtggccaaatgcacggccaagccttcatccagtggaaaagacggcggcggggaaaataccgaggaagcccagccccagccccagccccaaccacaaccccaggcacagtctcaaccacctagctctaacaagcgacccagcaattccaccccaccgcctactcagctgtctaagataaaatattccgggggaccacagatcgtcaagaaggagctgtttatacagaagctccggcagtgctgcgtgttgtttgattttgtctcagatcccttgtccgacctgaaatttaaagaggtgaagcgggcagggcttaacgagatggtggagtacatcacccattcgcgggacgtcgtcactgaggctatctatcctgaagccgtgaccatgttcagtgtgaacttatttcgcaccctgcctcctagctccaacccaaccggagccgaattcgaccctgaagaggatgaaccgacactggaagctgcgtggcctcaccttcagctggtgtacgaatttttcctccggtttttggaaagccccgactttcagccgaacatcgctaagaagtacattgaccagaaatttgtgctagccttgctggatttgttcgacagcgaagatccccgggagagggactttctaaagaccatactgcaccgtatatatggcaaatttttgggcttgagagcatatatcagaaggcagatcaatcatatcttttatcgtttcatctacgagaccgagcatcataatggcatcgccgagctgctggagatcctgggcagcatcatcaacggctttgcccttccactcaaagaggagcataagatgtttcttattcgagtgttactgccactgcataaagttaagtccttaagtgtctaccaccctcagctggcctattgcgtggtgcagttcctggaaaaggaatcaagccttacagagcctgtgattgtgggactgctgaagttttggccaaaaacccattctcctaaagaagtcatgtttctgaacgagctcgaagaaatacttgacgtaattgaacccagcgagttttctaaggtaatggaacctctcttcagacaactcgccaaatgtgtcagctcgccacattttcaggtggccgagcgagcactgtactactggaacaacgagtacataatgtccctcatctcagataatgccgcacgggtcctgccgataatgttccccgccttgtatcggaattcaaaatcgcattggaataagacaatccacggcctgatctacaacgcactgaagctgtttatggaaatgaaccagaagttgttcgatgattgtactcaacagtataaggccgaaaagcagaagggaaggttccggatgaaggagagggaggaaatgtggcaaaaaattgaggagctggctcgcctgaaccctcagtatcctatgtttagggccccacctcctcttcctccagtgtactccatggagaccgagacccccacagccgaagatattcagctgctcaagcgaaccgtggaaaccgaggctgtccaaatgttaaaggacatcaagaaggaaaaggtcctgctccgccggaagtctgagctcccccaggatgtgtacactatcaaggccctcgaggcacacaagagggctgaggagttcctgaccgcttcacaggaggccctgtag

SEQ ID NO: 201557 - DNA, 1491 bp, Artificial Sequence
  Description of Artificial Sequence: Synthetic coding sequence
atgccctacaagctgaagaaggagaaggagctgttcatccagaagttgagacagtgctgtgtgctgtttgattttgtgtctgacccactgtcagatctgaagtttaaggaggtcaagagggcagggttgaacgaaatggtggagtacatcactcatagccgcgatgtggtgacagaagcaatctatcccgaagccgtaaccatgttttcagttaatctgttcagaacactaccgcccagttccaatcccacaggagcagagttcgaccctgaggaagatgaaccaacgctggaagcagcatggccccatcttcagctggtgtatgagttttttctgagatttctcgagagtccggatttccagcctaatatcgcaaagaagtacattgatcagaaattcgtattagctctgctggacctgttcgattccgaggaccctcgagaacgagactttttaaagacgatcttacatcgcatttacgggaaattcctgggcttgcgagcctacataagacggcagatcaaccatatattctacagattcatctatgagaccgaacaccacaacggtatcgctgaactgcttgagatcctagggagtatcataaatggtttcgccctccctctcaaagaagagcacaagatgttcttaattcgggtgctgctgccgcttcataaagtgaagtccttaagcgtgtaccaccctcagttggcctattgtgtcgtgcaatttttagaaaaggagagctctcttacagagccagtcatcgtggggctgctgaaattttggcccaagacccatagtcccaaagaagtgatgtttttgaatgagcttgaggagattcttgacgtaatcgaaccatccgaattcagcaaggtgatggaacctctgtttaggcaactggccaaatgtgtctcctcacctcactttcaggtggcagagagggccttatactattggaacaatgaatatattatgagtctgatttccgacaacgccgctagagtgttacccattatgtttccggcactgtaccgcaatagcaagagtcattggaacaaaactatccacggtctcatatataacgcactcaagcttttcatggagatgaatcaaaaactgtttgatgactgcactcagcaatacaaagcagagaaacagaagggccgctttaggatgaaagagagggaggaaatgtggcaaaaaatcgaagagttagctcgcctgaatccgcagtaccccatgtttcgcgcccctcccccattgcctccggtgtacagtatggagaccgagactcctacagcagaggatattcagcttctcaagagaactgtggagaccgaagcagtgcaaatgctgaaggacatcaagaaagagaaagtgctccttaggcgcaagagcgagctgccccaggacgtttatactatcaaagccctggaagcccacaagagggctgaggagttcttaacagcaagtcaagaagccttatag

SEQ ID NO: 201558 - DNA, 1515 bp, Artificial Sequence
  Description of Artificial Sequence: Synthetic coding sequence
tgaaagaaggagcggcggcagagcagcagccggttcaacctgagcaagaaccgggaattgcagaaactccctgcattaaaggattcacctacgcaggaaagagaggagctttttatacagaagctgcgacagtgttgcgtgctatttgacttcgtttccgatccactgtctgacttaaagtttaaggaagtcaagagagcaggcctgaacgagatggtggagtacattacccacagccgcgacgtggtgactgaggcaatttaccccgaggccgtgaccatgttctctgtgaatctcttcagaacattgcccccttcatcgaaccctacgggagcggagttcgatccagaagaggatgaaccaaccctcgaagctgcgtggcctcaccttcagctggtatatgagtttttcctccgattcctggagagccctgattttcagccaaacatcgcaaagaagtacattgaccagaagtttgtgctggcactactggatctgtttgacagcgaggatccccgggaaagggattttcttaaaacaatcttacaccggatatatggtaagttcctcggcctgagggcttatatcagacggcaaatcaaccatatcttctaccgcttcatttacgaaactgagcaccacaacggcattgctgagcttctggagatcctaggatcaattatcaacggttttgccttgcctcttaaggaggagcacaagatgtttctgattcgcgttctgctacctctccataaggtcaagtcactgagcgtctaccacccacaagtgattgtcggcctcttgaaattctggccaaagacgcacagtcccaaagaggtcatgtttctcaacgaactggaggagatccttgacgtcattgagccctcagaattcagtaaggtgatggaacccctcttcaggcaactggctaaatgcgtatcgagtccccacttccaggttgcagaaagagctctgtattactggaataatgaatatatcatgtcactgatctcagacaatgcagccagggtgttgccaattatgtttccagctctgtaccggaactccaagagccattggaataagacaattcacgggttaatctataacgccttgaagctgtttatggaaatgaaccagaagctttttgacgattgtacacaacagtacaaggctgagaagcagaaaggacgatttagaatgaaagagagagaagagatgtggcagaagatcgaagaactggctcgcctaaaccctcagtatccaatgtttcgggccccgccacccctaccaccagtgtactctatggagaccgaaacacccacggctgaggatatccagttgctcaaaaggacggtagagaccgaggctgtgcagatgctcaaggacatcaaaaaagagaaagtgctcctgagaagaaaaagcgagctcccccaggatgtgtatacaattaaggctctggaagctcacaagcgggctgaagagttcctgaccgcatcccaagaggcactctag

SEQ ID NO: 201559 - DNA, 1809 bp, Artificial Sequence
  Description of Artificial Sequence: Synthetic coding sequence
atgccctacaagctgaagaaggagaaggagccccccaaggtggccaaatgcaccgccaaacctagcagcagcggtaaggatggaggtggcgaaaatacagaagaggcccaaccccagcctcagccccagccacagcctcaggcccaatctcagcctcctagtagcaataaaagacctagcaacagtaccccaccgcctacccagttgtccaagatcaagtacagtggcggtccacaaattgtcaagaaagaaagaagacagtcttcttcaaggttcaatctttccaagaaccgggagctgcagaaactgcccgctctaaaggacagtcctacacaggagcgcgaggaactctttatccagaagctaagacaatgctgcgtcttattcgacttcgtgtcggacccgcttagcgatttgaagttcaaagaagtcaagagggccggcttaaacgagatggttgagtatatcacacactcgcgggacgtagtgaccgaggccatctaccccgaagcggtaaccatgttctctgtgaacctttttcgcacccttccaccaagctcaaatcccactggagctgagttcgatcccgaagaggatgagcctaccctggaggcggcctggccacaccttcagttggtctatgagttcttcctacgattcctggagtccccagatttccagcctaacatcgccaagaagtatatagaccaaaagtttgtattggctctgcttgatctcttcgactctgaggatccgagagaaagggatttcttgaagactatccttcaccggatatatggcaagttcttgggcctgcgggcctacatccggcgccagatcaaccatatattctatcggttcatttatgaaaccgagcatcacaacggaattgcagagcttctcgaaatcttggggagcatcatcaacggcttcgcccttccgctcaaggaggaacacaagatgttcctgatccgtgttcttctgccactgcataaagtgaaaagcctgagcgtgtatcaccctcagctggcttattgtgtggtacagttccttgaaaaggaatcatccctgacagagcccgtgatcgtggggttgcttaagttctggccaaagacacatagccctaaggaggttatgttcctgaatgagctcgaggagattctggatgtgatcgagccatctgaattcagtaaggttatggagcctctgtttcggcagctggccaagtgcgtctcatcaccccattttcaggtagctgaacgtgcgctctattattggaataacgagtacatcatgtcattaatctccgacaatgctgcacgtgtgctgccaatcatgttccctgcgctgtatcgcaactccaagagccattggaacaagacaatacacgggctaatttacaatgcattaaaactgttcatggagatgaatcagaagctgtttgatgattgtacgcagcagtacaaagcagagaagcaaaagggacgtttccgaatgaaggaaagggaagaaatgtggcagaagattgaggaactagcgcgtctgaacccccaataccctatgtttcgcgcccctccccctctacccccagtctacagcatggaaacggagaccccaacggccgaggatatccagctgctgaaacggaccgtggagaccgaagccgtgcagatgctcaaagacataaaaaaggagaaggtgctcctgaggagaaagtctgaactgccacaggacgtctacactattaaagcccttgaagcacacaagagggccgaggaatttttgacagcatcccaagaggctttatag

SEQ ID NO: 201560 - DNA, 1755 bp, Artificial Sequence
  Description of Artificial Sequence: Synthetic coding sequence
atgccctacaagctgaagaaggagaaggagccccccaaggtggccaagtgcactgctaagccatcatcttccggaaaggacggtggcggagaaaatacagaagaagctcaacctcaaccccagcctcaaccgcagccgcaggcacaaagccagccgccaagctcgaacaaaaggccctccaattcaacacccccgccgacacagctgagcaaaatcaagtacagcggtgggccccagattgtcaaaaaggagcggcgccaaagttcttcccgtttcaacctgtcaaagaacagagaattgcagaaactccctgctctgaaggactcccccactcaagagcgcgaagagttattcattcagaagctccggcagtgttgcgtactgtttgacttcgtatccgaccccctgtctgaccttaagttcaaagaggtaaaaagagctgggttgaacgaaatggtggaatacatcactcatagccgtgatgttgtgacagaggccatttacccagaggctgtcacaatgtttagcgtaaatctctttcgaaccctgcctccgtcatccaacccaacaggggccgagtttgaccctgaggaggacgagcccaccctcgaagccgcctggccccacctccaactagtctacgagtttttcctgagatttctcgagtcccccgattttcagccaaatatcgcaaaaaaatatatcgaccaaaaattcgtgttggccctgttagacctttttgattctgaggaccctcgcgagcgcgattttctcaaaactatcctgcaccggatatatggtaagttcctgggacttagggcatacatcagacgacaaataaaccatatcttctataggtttatatacgagacagaacaccacaatggcatagctgaactcctagaaattttgggctccatcataaatggctttgcacttccacttaaggaggagcataaaatgtttcttatccgggtgctgctgcccctgcacaaagtcaagtcgctgtccgtatatcacccacaagtgattgtcggtttgctgaaattttggccaaagacccactcacccaaagaagttatgttcctgaatgagcttgaagaaattctggacgtgatcgaaccttccgaattcagcaaggtcatggaaccgcttttccgccagctggcaaaatgtgtttcatctccacacttccaggtggctgagagggcattgtactactggaataacgagtacatcatgtcccttattagcgacaatgccgctagagtcttgcccatcatgttcccagctctctatagaaattcaaaatcgcattggaataagaccatccatggcctgatatataacgcacttaaactcttcatggaaatgaaccagaaactattcgacgattgtacccagcaatataaagccgagaagcagaaaggccggtttcgcatgaaggagcgcgaggaaatgtggcaaaagatcgaagagcttgctcggttaaatccccagtatcctatgtttcgagcccctcccccgctgcctcctgtctactccatggaaacggaaacgccaacagctgaagatattcagctgctcaagcggacggtcgaaactgaggccgtacagatgcttaaggatattaagaaagagaaggttctactgcgaaggaagtcagaactgccccaggacgtctatactattaaagcactggaagctcataagcgtgctgaagagttcttaacagcatcacaggaagccctgtag

SEQ ID NO: 201561 - DNA, 1404 bp, Artificial Sequence
  Description of Artificial Sequence: Synthetic coding sequence
atgagcagcgcccccaccaccccccccagcgtggacaaggtggacggattctctaggaagtctgttagaaaagcccgccagaaaagaagccagtcttcatcacaattccggagccaaggtaaaccaatcgagcttacccccttaccgcttctgaaggacgtcccaagttctgagcagcctgaactgttcctaaagaagctccaacaatgctgtgtcatcttcgatttcatggacacgctctccgacctgaaaatgaaagagtacaagagatctaccctgaatgagttagtggactacattaccatcagccgcggctgcttgacagagcaaacatatccagaggtcgtccgtatggtatcatgcaatatctttcggactctacccccgagcgacagtaacgagtttgaccctgaagaggacgagccaaccctcgaggcctcatggccacacctgcagctggtctacgaattcttcatacggtttctggaaagccaggagttccaaccttccattgccaagaaatatatcgatcagaagttcgtccttcagctcttagagctgtttgattctgaggacccacgggagcgagattatctcaagacagtgctgcacagaatttatgggaagtttcttggcctcagggccttcataagaaaacaaattaataacatttttctcaggtttgtgtatgaaaccgagcactttaatggagtagctgagttacttgaaatcctgggatccatcattaatggctttgctctgcctcttaaggcggaacataaacagtttctggttaaagtgctcatcccacttcatactgtgcgttcactttcactgtttcatgctcagctggcgtactgtatcgtgcaattcctcgagaaggatccttcactgacagagccagtcatcaggggccttatgaagttctggccaaagacttgctcgcagaaagaggttatgttcttgggagagcttgaagagattctagacgtgatcgaaccctcacagttcgtaaagatccaggagccattgtttaaacagatcgccaaatgtgtctcatcccctcacttccaagtggcggagcgagctctgtactactggaacaacgagtacatcatgtctttgattgaggaaaactctaatgtgatccttcccatcatgttctcctctctctatagaatatcaaaagaacactggaatccagccatagtggcactagtgtataatgtcctgaaagccttcatggagatgaactctacaatgttcgacgaactgaccgccacctacaagtctgaccggcaacgtgagaaaaaaaaagagaaagaaagagaagaactctggaagaaactggaggacctggaactgaaaaggggcctgcgccgtgacggaatcattcctacttag

SEQ ID NO: 201562 - DNA, 1176 bp, Artificial Sequence
  Description of Artificial Sequence: Synthetic coding sequence
atggacaccctgagcgacctgaagatgaaggagtacaagcggagcacactgaatgagctggttgattatatcacaattagtagaggctgcctgaccgaacagacataccccgaggtggtgaggatggtctcctgcaatattttccggactcttccacccagcgactcaaatgaattcgaccccgaagaggacgagccaacactcgaggccagttggccccaccttcagctggtgtatgagttcttcattagattcctggaatcacaggagtttcagccctctattgctaaaaaatatatcgaccagaaatttgtgctgcaactgctggagctcttcgatagtgaggatcctcgtgaacgcgattacctgaagaccgtgttgcatcgcatttatggaaagtttctcggccttcgagcatttatccggaagcaaataaataatatctttctccgcttcgtgtacgagaccgaacacttcaacggtgtggctgaactgttggaaatattgggcagcatcatcaacggtttcgctctgcctttaaaagcagagcacaaacaatttctggttaaggtcttgatcccactgcacaccgtacgatccttatccctgtttcacgcccaattagcctattgtattgttcagtttctggaaaaggatcctagtttgacagagcctgtgattcggggtctgatgaaattctggcccaagacatgttctcagaaagaggtgatgttcctgggggaattggaggaaattctggacgtgattgagcccagccaatttgtcaagatccaggaaccgctgttcaagcagatcgctaaatgcgtgagctccccacattttcaggtcgctgaaagagcgctctattactggaacaatgaatacatcatgagcctaattgaggaaaacagtaacgtgatcctaccaataatgtttagttccctgtacagaatttccaaggaacactggaaccctgccatagtcgctttggtctataatgtgctcaaagcctttatggagatgaacagcaccatgttcgacgagctgaccgctacctataagtccgatcggcaacgtgagaagaagaaagaaaaggaacgagaagagctctggaagaagctcgaggacctggagctcaagcgcggacttaggcgagatggaatcatccccacctag

SEQ ID NO: 201563 - DNA, 1389 bp, Artificial Sequence
  Description of Artificial Sequence: Synthetic coding sequence
atgagcagcgcccccaccaccccccccagcgtggacaaggtggacggcttctccaggaaatctgttcggaaagcccggcagaaacgttcccagtcctctagccagttccgctcacagggtaaacccattgagctgacacccctgcctttattgaaggatgtcccgtccagcgagcagccagaattgtttctgaaaaaacttcagcagtgctgtgtgatcttcgactttatggacacactgtcagatcttaagatgaaggaatacaagcggagtacactcaatgaactcgtagactacattacaatcagcagaggctgtttgacggagcagacttaccccgaggtcgtccgaatggttagctgcaacatctttaggactctccctccgtcagacagcaacgaatttgaccccgaagaagatgaacctacattagaggccagttggccacacctgcagttagtgtacgagttctttatccgcttcctcgaatcacaggagtttcagccatccatcgcaaagaaatatattgatcagaagtttgtgttgcagttgttggaactgttcgattcagaggacccgcgcgagagggattacctcaagacggtgttgcaccgcatttatggaaagttcttaggcctgcgcgcttttatccgaaagcagatcaataatatttttcttagattcgtttatgagactgaacattttaacggtgtggcagagctcctcgagatcctcggcagcatcatcaatgggttcgctctgccactgaaggcagagcacaaacagtttctggttaaggtcctgatcccccttcacacagtacgaagcctatcgctgtttcacgctcagttagcctactgcattgtacaatttctagaaaaagacccctctctaactgaacccgtgatccgcggcctgatgaaattctggcctaagacctgttctcaaaaggaggtaatgttccttggcgagctcgaggaaatcctagacgttatagagccatcccagttcgtgaagatacaagagcccttgttcaaacagatcgcaaaatgcgtgagtagtcctcatttccaggtagccgagcgagccctgtattattggaataacgaatatataatgtccctgattgaagagaatagcaatgtgatcctgcccattatgttctcatccctgtacagaatctcaaaagaacactggaatcctgccatcgtggcactcgtgtataatgtactaaaagctttcatggagatgaacagtaccatgtttgatgaactgacagcaacatataacgagaaaaagaaagagaaagagcgtgaggagctttggaaaaagctggaagatctagagctaaagcgcgggcttcgacgtgatggtatcatcccaacctag

SEQ ID NO: 201564 - DNA, 1344 bp, Artificial Sequence
  Description of Artificial Sequence: Synthetic coding sequence
atgggcctgagcttcttcagcaagcacctgcccatccaggagggccaaccatgggccttgaagacaccagcggacatcatcagcacagtggagttcaatcacaccggagagctgctggccacgggagacaagggcggaagggttgtgatatttcagagagaacccgaatcaaaaaacgctccccacagtcaaggggagtatgatgtttattctacgttccagtcacatgagcccgagtttgattacctgaagtcgcttgagattgaggagaaaattaacaaaataaagtggctgccccaacagaatgcagctcattctttgctgagcacaaacgacaaaaccatcaagctttggaagattaccgaacgggataagagacctgagggatataacttaaaagacgaggaaggaaagctcaaggacctttcaacagtaaccagtctgcaggttccggtgcttaaacccatggacctgatggttgaggtgagcccaaggcgcatatttgctaatggacatacctatcacatcaactcaatctctgttaactcggactgcgaaacgtatatgtcagcagatgatctgagaatcaatctctggcatctggccatcaccgacagatcctttaacattgttgacataaaacccgctaacatggaggacctgactgaagtgattaccgcctctgagttccatccccaccactgcaatctgttcgtgtacagttcgagtaagggctccctcagactctgcgatatgagggccgccgccttgtgcgataagcactccaaactctttgaagagccagaggacccctcaaaccggagtttctttagtgagatcatcagttcagtaagtgacgtcaagttctctcattcgggacggtacatgctcacgagagactatctcacggtgaaggtttgggacctgaacatggaagctaggccaatagaaacctatcaggtccacgactaccttcgcagtaagttgtgctcactatacgaaaatgactgcattttcgacaaattcgaatgcgcatggaatggatctgatagtgtaataatgacaggtgcttataataacttttttagaatgttcgatcgcaacactaagagagacgtcacattggaggcctcaagagagagcagcaagcccagagctgtgctgaagccgcgcagggtctgtgttggagggaaacggaggagggacgacatctccgtggacagcctggacttcacaaagaagatcctccatacagcctggcaccccgcggagaatattatcgctatcgctgctactaacaacctctacatattccaggataaggtgaactccgacatgcactag

SEQ ID NO: 201565 - DNA, 1344 bp, Artificial Sequence
  Description of Artificial Sequence: Synthetic coding sequence
atgggcgaggacaccgacacccggaagatcaaccacagcttcctgagagatcacagctatgtcacagaagcagatattatatctaccgtagagttcaaccacaccggcgagctccttgcgaccggtgacaagggcggccgagtggtcatctttcagcgagagccggaaagcaaaaatgccccccacagccagggtgagtacgatgtgtacagcacatttcagtcccacgagccagagtttgactacttaaagtctctggaaatcgaggaaaagatcaataagatcaaatggctgccccagcagaatgcagctcactccctcctctcaaccaatgataagactattaaactctggaagatcaccgagcgcgacaagagacccgaggggtacaatttaaaggacgaggaagggaagttgaaggacttaagtactgtaacatccctgcaggttccggtcttaaaacctatggatctgatggtcgaagtgtctcccagacggatattcgccaacggacacacataccacattaactcaatctccgtgaacagcgattgtgagacctacatgagcgctgatgacctccgcattaacctctggcacttagctatcactgaccgctccttcaacattgtcgacataaagcccgctaacatggaggacctgactgaagtgatcactgcaagtgagtttcatccacaccactgcaacctcttcgtctacagctcctctaaagggtcactcagattgtgtgacatgagagctgcagcgctctgcgataaacacagcaaactattcgaggagcctgaagatccctcgaatcggagtttttttagcgagatcatatcatcagtaagcgatgtgaagttctctcatagcggtaggtacatgctgaccagggactatctgactgttaaagtctgggatcttaatatggaagcccgaccgatcgagacgtatcaggtgcatgactacctgcgatccaagctatgctccctgtatgaaaatgactgtatctttgacaagttcgagtgcgcatggaatgggagcgattccgtgattatgacgggtgcttacaacaacttctttcgaatgtttgatcgtaataccaagcgagacgtgaccttggaagccagccgcgaaagcagcaaaccccgagctgtcctgaaaccacgacgcgtatgcgtgggaggaaaacgtaggagagatgatattagcgtcgattctctggactttactaaaaagattctgcataccgcttggcatcctgctgaaaatatcatcgctattgcagccacgaataacctctatattttccaagacaaggtgaattcagacatgcattag

SEQ ID NO: 201566 - DNA, 1323 bp, Artificial Sequence
  Description of Artificial Sequence: Synthetic coding sequence
atgcgggaggccgacaccctgcggcccccccagctgatggaggtgagtgcggacattatttcgactgtcgaattcaaccacaccggcgagctgttagccaccggtgacaaagggggtcgggtagtgatattccagagagagcctgagagcaaaaatgccccccacagccagggcgaatacgacgtgtactcaacattccagtcacatgaaccagaatttgattacttaaaaagcttggagatagaagagaaaatcaacaagatcaaatggctgccacagcagaatgccgctcacagcttgctgagcacaaacgataaaaccataaagttgtggaagattaccgaaagggataagcgacctgaaggctataacttgaaagacgaggaaggaaagctaaaggatttatcaacggtcactagcttgcaggtgcccgtgctcaaaccaatggatctgatggtagaagtgagcccccgtagaatctttgctaacggccatacataccacatcaacagtatcagcgtcaattccgattgtgagacctacatgtccgccgatgatctgagaattaatctctggcatctggccatcactgaccggagctttaatatcgttgacatcaaacccgccaacatggaagacctgaccgaagtcattaccgcctctgaatttcatccccaccactgtaatctgtttgtgtacagtagcagtaaaggatctcttaggttgtgcgacatgcgcgccgcggccctgtgtgataaacactccaaactgttcgaggagcccgaggatcccagcaaccggagtttcttcagcgaaattataagcagtgtttctgacgtcaaattttctcactcaggacggtacatgctaaccagggactatctcactgtcaaggtctgggatttgaatatggaggcacgccctattgagacctatcaagtccacgattatctgaggtccaagctgtgcagcttgtatgaaaacgactgtatatttgacaaattcgaatgcgcctggaacgggagtgactccgtaattatgactggagcttataataactttttccgcatgtttgatcgaaacacaaaaagggatgtgaccttggaggctagcagagagtccagcaagccccgtgccgtattgaaaccgcgccgagtatgtgttggcggcaagcggcggagagacgacattagtgtcgacagcctcgattttacgaagaaaatcctccatactgcatggcatcctgccgagaatattattgcaattgctgccaccaacaacctgtacatttttcaagacaaggtgaattccgacatgcactag

SEQ ID NO: 201567 - DNA, 1323 bp, Artificial Sequence
  Description of Artificial Sequence: Synthetic coding sequence
atgcgggaggccgacaccctgcggcccccccagctgatggaggtgagcgctgatattatctctaccgtggaatttaatcatacaggagagcttttagcaacaggggacaagggagggcgggtggtgatctttcaacgcgagccagaatctaagaacgctccacactcgcagggcgaatacgacgtctactccacattccaaagccacgagcctgagtttgattaccttaaaagccttgagattgaggaaaagatcaacaagataaaatggttgccacagcagaatgccgcccacagcttgctctccactaacgataagactataaagctgtggaaaattacagagcgtgataaacgccccgaagggtacaatctgaaggacgaagaaggcaagctgaaggacctgtctaccgtcaccagcctgcaggtgcctgtgctgaagccgatggatctcatggtcgaagtcagcccacgccgcattttcgctaacggccatacttaccatatcaatagtatatcagttaattcggattgtgaaacatatatgtccgctgatgacttgaggatcaacctgtggcatctggcaatcaccgataggagttttaatatcgtggacatcaaacccgccaacatggaagacctcacagaggttattaccgcatctgagttccacccccatcattgcaatctctttgtttattcgtcctcaaaaggatcacttagactttgcgacatgagggctgccgctctctgtgataagcactccaagttgttcgaagagccggaggaccctagcaataggtcctttttcagcgagattataagtagcgtttccgatgtgaagttcagccactccgggcggtatatgctgacccgcgactacctgacggtcaaagtgtgggacctgaatatggaggcacgaccaatcgaaacttaccaggtgcacgattacttgaggagtaaactgtgctctctgtatgagaacgactgtatttttgataagttcgagtgcgcatggaatgggtcggacagcgtgattatgaccggcgcatacaataacttttttcggatgtttgaccggaatacaaagagggatgtgactctggaagcaagccgcgagtcaagcaagcccagagccgtgctcaaaccacggagagtttgtgttgggggaaaacgaaggcgtgatgatatatctgtggattctctggatttcacgaaaaaaatactccacacagcctggcatcccgccgaaaatattatcgccatcgctgcaactaacaacctgtacatctttcaggataaagttaactccgatatgcattag

SEQ ID NO: 201568 - DNA, 1293 bp, Artificial Sequence
  Description of Artificial Sequence: Synthetic coding sequence
atgggcaagcgggacaccgccgacatcatcagcaccgtggagttcaaccacactggtgagctgctcgccactggggacaaaggggggcgagtggtcattttccaacgcgagcccgagagcaagaatgccccacactcccaaggagagtatgacgtctacagtactttccagtctcacgaacccgaattcgactaccttaaaagcctcgaaatcgaggagaagatcaacaaaatcaaatggctgccccagcagaacgctgcccactcgcttctgtcgacaaatgacaagaccatcaagctctggaaaattaccgaacgtgataagcgacctgagggctataacctgaaggacgaggagggtaagctgaaggatctgtcaactgtcacatccctgcaagtgcccgtactgaagccaatggatctgatggtagaagtcagcccccgtagaatttttgctaacgggcacacctatcacattaattctatctccgtgaattccgactgcgaaacctacatgtctgccgacgatctgcgtattaacctttggcatttggctatcaccgatcggagcttcaatattgtggatatcaagcccgccaacatggaagaccttaccgaggttatcacagcatccgaattccaccctcatcattgtaacctgtttgtctactcttcaagcaaaggctcgttacgcctgtgcgatatgagagccgcagctctgtgtgacaagcatagtaagttgtttgaagagcccgaggatcccagtaatagatcttttttcagcgagattataagttcagtctcagacgttaagtttagtcattctggccgatacatgctaacccgagattacttgaccgtcaaagtctgggaccttaacatggaggcacgtcctatcgagacctaccaagttcacgattatctgcggtcaaagttgtgtagcctgtatgagaacgactgtatctttgataaatttgagtgcgcctggaacggctcagattctgtcataatgaccggagcatataacaactttttccgaatgtttgaccggaacacaaagagggatgttactctcgaggccagccgcgagagcagcaaacccagggccgtcctgaagccaaggcgagtttgtgttggggggaaaaggaggcgcgacgatattagtgtcgatagtctcgactttacaaagaagatcctgcacactgcgtggcaccccgctgaaaatattatagccatcgcggcaactaacaatctatatatttttcaggacaaggtaaatagcgatatgcattag

SEQ ID NO: 201569 - DNA, 1623 bp, Artificial Sequence
  Description of Artificial Sequence: Synthetic coding sequence
atgcccaacaagaacaagaaggagaaggagagccccaaggccggcaaaagtggtaagtccagcaaggagggccaggacactgtcgagtccgaacagataagcgtccgcaaaaattcactcgtggcagttcccagcacagtgagcgctaagattaaggtaccagttagccagccgattgtgaaaaaggacaaaagacagaatagcagccggttctccgcaagcaacaatagggagctccagaagttgccctccctgaaagacgtcccaccagccgatcaggagaagctgtttatacaaaagctgcgacagtgttgcgtgctctttgacttcgtgagcgaccctctcagcgatctgaagtggaaggaggtcaaaagagccgccttatctgagatggtcgagtacatcactcacaaccggaacgttatcactgagcctatttatcccgaggtagtgcacatgttcgcagtgaacatgttcaggacgctgcctccttccagtaatcccaccggcgcggagtttgatcccgaagaagacgaaccaacactggaagcagcctggccccatctgcaactcgtatacgagttttttttgcgatttttggaaagccccgactttcagcctaatattgcaaagaagtacattgaccagaaatttgtgttacagctgctggagctgtttgattctgaggatccccgcgaacgagacttcctgaaaaccaccttacatagaatttatggtaagttcctgggacttagggcatatatcaggaaacagattaacaatatcttctacaggttcatctatgaaacagagcaccacaacgggatcgctgagctgctggagattcttgggtccatcattaacggctttgctttgccgctaaaggaggagcacaagattttcctccttaaggtgttgctgcccctgcacaaagttaagtccctttctgtttaccacccgcagttagcatattgtgttgtccagttcctggaaaaggatagcacactcacagaacccgtggtaatggcgctgctgaagtactggcctaaaactcactctcccaaggaagttatgtttttgaacgagctggaagagatcctggatgtaatcgagccttcagagtttgtgaaaattatggaacctttattccgacagttagccaaatgcgtgtctagcccccattttcaggtcgcagaacgcgcactttactactggaacaatgaatacataatgagcctaattagtgacaacgcagccaagattctgcctataatgttcccttccttgtatcgcaactctaagactcactggaataagaccatacacggcttaatctacaatgcactgaagctgtttatggagatgaaccagaaactcttcgatgattgcacacaacagttcaaggcggagaaactgaaagagaaactgaaaatgaaggagagagaggaagcttgggtgaagatcgagaatctggccaaagcaaatccccaggctcaaaaagacccaaagaaggacaggcccctggccagacggaaatctgagcttcctcaggatccccatactaaaaaagcattggaagcacactgcagagcagatgagttggcctcccaggacggcagatag

SEQ ID NO: 201570 - DNA, 1575 bp, Artificial Sequence
  Description of Artificial Sequence: Synthetic coding sequence
atgctgacctgcaacaaggccggcagccggatggtggtggacgccgctaatagcaatgggcccttccagccagtggttctgcttcacattagggacgtgccacccgcagatcaggagaagctgttcatccagaaactgaggcagtgctgcgttctgttcgattttgtgtcagatccgctttcggacctgaaatggaaagaggtgaagcgcgccgccctttccgagatggtggagtatattacgcacaacaggaacgttattaccgaaccgatttaccctgaggtggttcatatgttcgccgtcaacatgtttagaacattaccaccctctagcaacccaactggagctgaatttgatccagaggaggacgaacctaccctagaagccgcctggcctcacctccagttggtgtatgagttcttcctgaggttcctagaatcaccggacttccagcctaacatagctaagaagtatatagatcagaagtttgtacttcaactgctggaactcttcgattcagaggatcccagagaacgcgacttcctcaagacaacactgcatcgcatttacggaaaattcttggggctgcgcgcttatatcagaaagcagattaacaatatcttctacagatttatatacgaaacagaacatcataatggcattgctgagctgctggaaatacttggctctattatcaatggattcgctctgcctctcaaagaggagcacaaaatctttttgctcaaagttctcctgcctctgcataaagtgaaatctctgtcagtgtaccaccctcagttggcctattgcgtcgttcaatttctcgaaaaggactccacactcacagagccagtggttatggccctgctgaaatattggcccaagacccactcccctaaggaagtaatgttccttaatgagctcgaggagatcctagacgtaatcgaacctagcgagttcgttaaaatcatggagcctcttttcagacagctcgcaaagtgcgtcagcagtccacactttcaggttgcagagagggctctttattactggaataatgagtacatcatgagcctgattagcgacaacgcagccaagatcctgccaatcatgttcccttccctgtatcgtaacagtaagactcactggaacaaaacaatacatggcctgatctataacgcgctcaagttgtttatggagatgaaccagaagctgttcgacgattgtacccagcagtttaaggccgaaaagctcaaagaaaagctaaagatgaaggagagggaggaggcctgggtgaaaattgagaatctggccaaggcaaatccgcaatataccgtgtactcccaggcctcaacaatgtccattccagtcgctatggagaccgacggaccactgttcgaggacgtccaaatgctgcgcaaaaccgtaaaggacgaggctcaccaagcacagaaagatccaaaaaaagataggcccctggcgaggcgcaaatcggagttgccacaagatccacataccaagaaagcgctggaagcgcattgccgggctgacgaacttgccagccaggatggtcggtag

SEQ ID NO: 201571 - DNA, 783 bp, Artificial Sequence
  Description of Artificial Sequence: Synthetic coding sequence
atgttccggaccctgccccccagcagcaaccccaccggcgccgagttcgaccccgaagaagatgagcctaccctggaagccgcctggccccaccttcagttagtttacgagttcttcctgagattcctagagtctcctgattttcagccgaacattgctaagaaatatattgatcaaaagttcgtcctccaattactggagctcttcgacagcgaggaccctagagagcgggactttttgaaaaccaccctccaccggatctacggcaaattccttggcttgcgcgcctatattaggaaacaaatcaacaacattttctaccggtttatctatgaaacagagcatcataacggtattgctgaactgttggaaattttgggtagcatcattaacggctttgcactcccacttaaagaggaacacaagatctttctgctaaaggtcttactgcctctccataaggttaagtcgctgagtgtttatcacccccagctcgcctattgcgtcgtacagttcttggagaaggattctaccctgacggaacctgtagtcatggcattgctgaagtactggcctaagacccacagtccgaaagaggttatgtttttgaacgagctggaggaaatactggacgttattgagccaagtgagttcgtcaagattatggagcccctgttccgtcagctggctaaatgtgtatcctctccgcactttcaggataacacttggctggacattcagaggcctgaagccctgcacggggacgagcctaaagcgatttag

SEQ ID NO: 201572 - DNA, 1458 bp, Artificial Sequence
  Description of Artificial Sequence: Synthetic coding sequence
atgctgacctgcaacaaggccggcagccggatggtggtggacgccgccaattcaaacgggccatttcagccggtggtcttactgcacattagggatgtacccccagcggatcaggagaaactgttcatccagaaactgagacagtgttgcgtactctttgacttcgtgtccgacccactgtctgacttgaagtggaaggaggtgaagcgcgctgctctgagcgaaatggttgaatacattacacacaaccgtaatgtgattaccgagcctatctatcctgaagttgtgcacatgttcgcagtcaacatgtttagaaccctgccgccgtccagtaaccctaccggcgccgaatttgaccctgaggaggatgagcccacattggaggccgcttggccacacttgcagctggtctatgagttcttccttcggtttctggaaagccccgactttcaacctaacatcgctaaaaagtatatcgaccagaagttcgttctgcagttactggaacttttcgactcagaggacccacgggagagagacttcttgaaaactaccctacacagaatatatggcaagtttcttggactcagggcctacatccgcaagcagattaacaacatcttctataggttcatttatgaaacagagcaccataatggcatcgccgagctgcttgaaatcctcggctctataattaacggttttgccctgcccctgaaggaagaacataagatttttctcctcaaagtgctgctccctctgcacaaggtgaagagcctgtccgtgtatcatccacaacttgcttactgtgtagtgcagtttctggagaaggactccactttgaccgaacccgtggttatggcactccttaagtattggcctaagacccatagtccaaaagaggtgatgttccttaatgaactggaggagatcctggacgttatcgaaccctccgagttcgtcaagataatggaaccattgtttagacaactggccaagtgcgtttcatccccgcacttccaggtcgccgagcgcgccttatactactggaataatgagtatatcatgagcctgattagcgacaatgccgcaaagattctccctattatgttccctagtttataccgaaattcgaaaacccattggaataagacaattcacggactcatctataacgctctgaagctgtttatggaaatgaatcaaaaattattcgacgactgcacccagcagtttaaggcagagaaactaaaggaaaaactcaagatgaaggagcgcgaggaggcatgggtgaagatcgaaaacctcgcgaaggcgaaccctcaggcacagaaagatcccaagaaggatagacccttagctaggaggaagtcagagcttcctcaggatcctcacactaagaaggccttagaggcacattgccgcgcagacgaattggcctcccaggatggcagatag

SEQ ID NO: 201573 - DNA, 1668 bp, Artificial Sequence
  Description of Artificial Sequence: Synthetic coding sequence
atgcccaacaagaacaagaaggagaaggagagccccaaggccggcaagtccggtaaatcaagtaaagaggggcaggatactgtcgaatctgagggcacaagccccgaggagccctcctcgcccaaagtgccaccacctctgctcccagaactgcttgtcctgatctttggcggactgcagggccgcgacgtgccacccgccgatcaagagaaactgtttatccagaagcttcggcagtgctgcgttctgtttgattttgtgagcgaccccctcagtgatctgaaatggaaggaggtgaaacgggcggcactgagtgagatggtggagtatatcacacataatcgaaatgtaattacagaaccgatttatcctgaggttgtgcacatgtttgcggtgaatatgttccgaaccctgcccccgtccagcaaccccaccggtgccgagttcgatccagaggaggacgagccaactctcgaagcagcatggccccacttgcagctggtgtatgagttttttctccgctttctggaatccccagatttccagccgaatattgcaaagaagtacattgaccagaaatttgtgttacaactgttggagcttttcgatagcgaggatccacgcgaacgggattttctcaagactacgctccatcggatctacggaaagttccttggcttgcgcgcctacatcagaaaacagatcaataacatcttctacagatttatttatgaaacagaacatcacaacggtattgctgaacttctggaaatcttgggttctattatcaatggctttgctttgcctctgaaggaagagcacaagatatttctgctgaaagtgctgctgcctttgcacaaagtgaaatctctttccgtgtaccatccacaactggcctactgtgttgtgcagtttctcgaaaaggactccacactcactgaaccagtggtcatggcactgttgaaatactggccaaagacacactcccccaaggaggtaatgttccttaatgagctcgaagaaatcctggatgtaatcgagccctccgaattcgtgaaaattatggaacccctgtttcggcagcttgccaagtgcgtttccagcccacacttccaagtggcagagcgggctttatactactggaacaacgagtacattatgtccctgatcagtgacaatgccgcaaaaatcttgcccatcatgtttcccagtctgtatcgtaatagtaagacacactggaacaaaacaattcacggactcatatataacgccctcaagctcttcatggagatgaaccagaaattatttgacgattgcactcagcagtttaaagcggaaaaactaaaggagaaactgaaaatgaaggaacgcgaagaagcctgggtgaaaatcgaaaacctggcaaaagccaatccgcagtacaccgtttactcacaggcaagtactatgagtatcccagttgcgatggagacggatggtccgctgttcgaggacgttcaaatgttaagaaagacggtcaaggatgaggcccatcaggctcagaaggatcctaaaaaagaccggcctttggcccgccgaaagtcagagctgcctcaggacccacacaccaagaaggcactcgaggcacattgccgagctgacgaactggctagccaggatggacgctag

SEQ ID NO: 201574 - DNA, 1350 bp, Artificial Sequence
  Description of Artificial Sequence: Synthetic coding sequence
atgctgacctgcaacaaggccggcagccggatggtggtggacgccgccaactcaaatggcccgttccagcccgtcgtattactccacattcgcgacgtcccacccgccgatcaagagaaactttttattcaaaaacttagacaatgctgtgttctgttcgatttcgtgagcgacccactgtccgaccttaagtggaaagaggtgaaaagggcggccctttcagaaatggtggagtacatcacccacaataggaatgttatcacggagcccatctatcctgaagtggtccatatgtttgctgtcaacatgtttcgtaccctgccacccagctccaacccaactggcgccgagttcgatcctgaggaggatgagcctacgctggaagccgcttggccacacctgcagctcgtgtatgagttctttctcaggtttctggaatcaccagacttccagcctaacatcgcaaagaaatatatcgatcagaaatttgtgctacagcttttggaattatttgatagcgaggacccacgtgagcgcgattttctcaaaacgacacttcacagaatttacggaaaattcctgggcctgcgtgcttatattcggaagcagatcaataacatattttatcgtttcatctacgagaccgagcaccacaacggaatcgccgaactgctggagatcctagggtctattatcaacggttttgctctgcctctgaaggaagagcacaaaatattcctcctgaaagtgctgttacctctgcataaggtaaagagcctgagtgtctaccacccacagctggcttactgcgtcgtgcagtttctcgaaaaagactccaccttgacagagcctgtggtgatggccctcctaaaatactggcctaaaacacacagccccaaagaggtgatgttcctcaacgaactggaagaaattctggacgtgattgaaccttccgagtttgttaagatcatggaaccactctttagacagcttgcaaagtgtgtctcttctccccattttcaggtggctgagcgggcactgtactactggaacaatgagtacatcatgagcctcatttcagataatgccgccaagatcctgcctatcatgttcccctccctgtatcggaatagcaagacccactggaacaagactatccacggactcatttataacgcacttaagctgttcatggagatgaaccaaaagcttttcgacgattgcactcagcaattcaaagctgagaaactaaaggagaagctgaagatgaaagagcgggaggaggcatgggtaaagatagagaacctcgcaaaggccaatccccaagtgctgaaaaaaagaattacatag

SEQ ID NO: 201575 - DNA, 1155 bp, Artificial Sequence
  Description of Artificial Sequence: Synthetic coding sequence
atgctgacctgcaacaaggccggcagccggatggtggtggacgccgctaacagcaatggcccattccagccagtcgtcctgctgcatatcagggacgtaccgcccgcagaccaggaaaaattgttcatccagaaactgcgacagtgttgcgtgctattcgacttcgtttccgatcccctgagtgatctgaaatggaaagaggtaaagcgagcggcgttgagtgagatggtagagtatataacacacaaccgcaacgttataaccgaacctatttacccagaagttgtgcacatgttcgcagtgaacatgttccgcactctccctccgtcatccaacccaactggggctgagttcgatccagaggaagacgaaccgactttggaagcggcatggccacatctccagctggtttacgagttcttcttaaggttcctggagagtccagacttccagcccaatatcgcaaaaaaatacattgaccaaaagtttgtgttacagctacttgaactgtttgattccgaggatcccagggaacgcgacttcctgaaaaccaccctccatcggatctacggcaagtttctcgggcttcgagcgtatatacgcaagcagatcaacaacatcttctaccgttttatatatgagacagagcatcacaatgggattgctgaattgctcgagattttaggcagcattataaacgggtttgctctcccactaaaggaggaacataagatattcctgctaaaggtgctcctccccctgcataaggtgaagagcctctccgtttatcatccccagcttgcgtactgcgtagtacagttcctcgagaaagatagtactctgactgaaccagtcgtcatggcactcctgaagtactggccgaagactcacagtcctaaggaagtcatgttcttgaacgaactggaagaaatcctggacgtcatcgagccatcagaatttgtgaagataatggaacctttattccgacagctagcaaagtgcgttagctccccacacttccaagtcgcggaacgcgccctgtattactggaacaatgaatacatcatgtcacttatatccgataatgcagccaagatcctgccaataatgttcccttccctgtacagaaactccaagactcattggaacaagtag

SEQ ID NO: 201576 - DNA, 1662 bp, Artificial Sequence
  Description of Artificial Sequence: Synthetic coding sequence
aacaagaacaagaaggagaaggagagccccaaggccggcaagagcggtaaatcctcaaaggagggccaggacaccgtagaaagcgaaggcacctcccctgaagagccaagttctccaaaagttcctcctcctttgctgcctgagctgctggtcctgattttcggcggacttcagggtcgtgatgttccacccgccgatcaggagaagctattcatccagaagctgaggcagtgctgcgttctctttgacttcgtctccgatccactaagtgatctcaaatggaaggaagtgaagagagcagccctgagcgaaatggtggagtacattactcacaatagaaacgtcatcacggagcccatctatcccgaagtggttcacatgttcgccgtgaatatgttccgcacccttcctccttcatccaaccccacaggagccgagttcgatccagaagaggatgaacccaccctggaggctgcttggcctcacctgcagctggtatacgaattcttcttgcgcttcctggaaagtcccgattttcagccaaacattgcgaagaagtacatcgaccagaagttcgtgctccagttgttggaactcttcgatagtgaagaccccagggagagagacttcctgaaaaccaccctccatcgaatttatgggaagttccttggtctccgcgcatacattaggaagcagattaacaacattttttatcggttcatttacgaaacagaacatcacaatggtatcgccgagctcctcgagatcctgggaagtattatcaatggcttcgcccttcctttaaaagaggaacacaaaatcttcctgctcaaagtgctcctccctctgcataaggtaaagtccctaagtgtgtaccatccgcaactggcttactgcgtggtccagttcctggagaaggatagcacgctcacagagccagtggtgatggctttgttgaagtactggccgaaaacacattctcctaaagaggtcatgttccttaacgaacttgaggagatcctagatgtgattgaaccatcggagttcgtaaaaataatggagccactctttaggcagttggctaagtgcgtgtcctcaccgcattttcaggtcgctgaacgagcgctgtattattggaacaatgaatacatcatgagtcttatctctgataatgcagccaagatcctccctataatgttccctagcctgtatcgcaatagcaagacacattggaacaaaactatccacggcctcatatacaatgccctgaaactgttcatggaaatgaatcagaagctgttcgacgactgcacccagcagtttaaggctgagaagctcaaggagaagctgaaaatgaaggagagggaagaagcgtgggtgaagatcgagaatctcgctaaagcgaatccccagtacactgtatattcccaggccagtactatgagcattccagtagctatggaaacagacgggccactttttgaagatgtgcagatgttgagaaagaccgtaaaggacgaagcacaccaagcgcagaaggatcccaagaaggacaggcctctggctcgcagaaagagtgaactacctcaggatccacacaccaagaaggcattagaggctcactgtcgtgccgacgagctcgcaagtcaggatggccgctag

SEQ ID NO: 201577 - DNA, 1077 bp, Artificial Sequence
  Description of Artificial Sequence: Synthetic coding sequence
atggccgagggcgagcggcagcccccccccgacagcagcgaggaggcacccccagcgactcaaaattttatcatcccaaaaaaggagatccataccgtccctgacatgggaaaatggaaacgatctcaggcttacgcagactacatcggcttcatcctgaccctgaatgaaggagtgaaggggaaaaaactgacattcgagtacagagtgtcagagatgtggaacgaagtacatgaagaaaaagagcaggctgccaagcagtcagtgtcatgcgatgaatgtatcccactcccgcgggcggggcattgcgccccatctgaagccatagagaagctggtcgctctcttaaatactctggatagatggatcgacgagaccccccctgtggatcagccatctcgttttggaaataaggcctacaggacctggtatgctaagctggacgaggaagccgaaaacctcgtggccactgtcgttcctacacacttggccgctgccgtgccagaggtggctgtatacctgaaggaaagcgtcgggaattctactcgcatagactacggaaccggacacgaagccgcattcgccgctttcttatgttgcctgtgcaaaataggagtgctaagagtggatgaccagatcgcaattgtgttcaaggtgttcaaccgctatctggaggtgatgcgcaaattacaaaaaacataccggatggaacccgctggaagccagggcgtctggggtctcgatgattttcagttcttgccttttatctggggcagctctcagctcatagaccatccctatttagaaccaagacattttgtcgacgagaaggctgtgaacgagaatcacaaagattacatgttcctggagtgcatcttattcattactgaaatgaaaacaggcccattcgcggaacattctaatcagctctggaacataagcgcggttccctcatggagcaaggttaaccaagggcttatcagaatgtacaaagctgaatgtctggaaaagttcccagtgatccaacacttcaagtttgggtctttgctccctatccaccccgtcacatcaggttag

SEQ ID NO: 201578 - DNA, 990 bp, Artificial Sequence
  Description of Artificial Sequence: Synthetic coding sequence
atggccgagggcgagcggcagcccccccccgacagcagcgaggaggctccacctgctactcagaactttataatccctaaaaaagagattcacacggttcccgacatgggcaagtggaagcgaagccaggtgccatttgggaccgtggcctatgctgactatatcggctttatcctgactctgaacgagggggtaaaaggtaagaagttaacctttgagtatagagtgagtgaagccatcgagaagttggtagccctcttaaacacgttggaccgttggatcgatgagacaccccccgtcgatcagcctagcaggtttggcaacaaggcttatcgaacttggtatgccaagctcgacgaagaggctgagaatttggtggctacggttgtcccgacccacctagcagcagcggtaccagaagttgctgtgtaccttaaggaaagtgtgggtaactcaactagaatcgattatggcaccggccatgaggccgccttcgccgccttcctctgttgcctttgtaagattggagttttaagagtggacgatcagatcgccattgtttttaaggtctttaaccggtatctggaggtgatgagaaagctacagaagacatacagaatggaacccgcaggctcccagggggtatggggcttggatgatttccagttcttgccctttatctggggatctagtcagctaatcgatcatccttatctagaaccgcggcattttgtagacgagaaagctgtcaacgaaaaccataaagattacatgtttcttgagtgtatcctgtttattacagagatgaagacgggtccttttgccgaacacagcaaccagctttggaacatttctgccgtgccctcctggagtaaagtgaaccaggggctgatcaggatgtataaggctgagtgtcttgaaaaatttcctgtcattcagcactttaagtttggttccctgctgcctatacacccagtcactagcggatag

SEQ ID NO: 201579 - DNA, 846 bp, Artificial Sequence
  Description of Artificial Sequence: Synthetic coding sequence
atggccgagggcgagcggcagcccccccccgacagcagcgaggaggcccctcccgccacacagaatttcattatccccaagaaggagattcacactgtgcctgacatggggaaatggaagcgctcccaggcctacgccgattacattgggtttatccttaccctcaacgagggcgtgaaagggaagaaactcaccttcgagtatagggtgagtgaagaggcagagaacctggtggcaaccgtcgtccccactcatctggctgccgccgtccctgaggtcgctgtgtacctgaaggagtccgtcgggaattccacacgcatcgactacgggactggacacgaagccgccttcgcagcctttctctgttgcttatgcaaaatcggggtgctgcgcgtcgacgatcagatagctatcgtcttcaaggtcttcaaccgatacctcgaagtcatgcgcaaactgcagaagacatatcggatggagccggcgggcagtcaaggcgtatggggactggacgactttcagttcttaccatttatttggggctcgtcccagttgatagatcacccctacctcgagcctcgtcattttgtagatgagaaggccgtgaatgagaaccacaaggactacatgtttctcgaatgcatccttttcattaccgaaatgaagaccggcccctttgcagaacattcgaatcagctctggaacatctccgccgtcccgagctggtcaaaagtgaatcagggtttaattcggatgtataaggctgaatgccttgagaaattccctgttattcagcactttaagttcggcagtctcctccccattcaccctgtcaccagcggttag

SEQ ID NO: 201580 - DNA, 885 bp, Artificial Sequence
  Description of Artificial Sequence: Synthetic coding sequence
atggccgagggcgagcggcagcccccccccgacagcagcgaggaggctcctccagccacccagaatttcattatacctaagaaagagattcacactgtgcccgacatgggaaagtggaagcggtctcaagctatcgaaaaacttgtcgctctgttgaatacgttggataggtggatagacgagaccccacccgtggatcagcctagtcggttcggcaataaagcttataggacatggtatgccaagttagatgaagaagccgagaatttagtcgccaccgttgtccctacccatctcgccgccgccgtgcccgaggtcgcggtgtacctgaaagagagcgtgggaaattctactaggattgactacggcaccgggcatgaagctgccttcgccgccttcctctgttgcttatgcaaaattggcgtcttgagggttgatgaccagattgcgattgtgttcaaggttttcaacaggtacctggaagtgatgcgaaaactgcagaaaacctacaggatggaaccagcaggtagccaaggcgtgtgggggttagatgacttccagtttctgccctttatctggggttcctctcaattgatagatcacccctatttagagccccggcacttcgtagatgagaaggcagtgaacgaaaatcacaaagattacatgtttctggaatgcatcctctttatcaccgagatgaagacaggtccatttgccgagcactcgaatcaactctggaacatatctgctgtgccttcatggagtaaggtaaaccagggcctgatcaggatgtataaggccgaatgtctggaaaagtttccagtgattcagcacttcaagtttggtagcctgttgcctatccacccagtaacatctgggtag

SEQ ID NO: 201581 - DNA, 972 bp, Artificial Sequence
  Description of Artificial Sequence: Synthetic coding sequence
atggccgagggcgagcggcagcccccccccgacagcagcgaggaggcacctccagccacccaaaacttcatcataccaaagaaggagattcacaccgtgcccgatatggggaagtggaagcgctcccaagcctacgccgactacatcggtttcattctcacgctcaacgagggagtgaaagggaaaaaacttacctttgaatatcgcgtgtcagaggcaattgagaagctggtggcgctactgaacaccctggacaggtggattgacgagactcctcctgttgaccagccctcacggtttggaaacaaggcttaccgaacctggtacgccaaattggacgaggaagctgaaaacctcgtagccacggtggtcccgacccatctggcggccgctgtacccgaagttgcagtgtatctcaaagagtccgtcggcaacagcacacggattgattacggcacagggcatgaggccgcattcgccgctttcctgtgttgcttgtgtaaaatcggggtcttacgcgtggacgaccagattgctatagtttttaaagtgttcaaccggtatttagaagtgatgaggaagctgcaaaagacctatcggatggagcccgcggggagccagggggtctggggccttgatgacttccagttcttacccttcatttggggcagctctcaacttattgatcatccttacctggagcctcgtcactttgtggatgaaaaggccgtcaatgagaatcataaggactatatgttcctcgagtgtatcctgtttattactgagatgaagactggcccattcgctgagcacagtaatcagctgtggaacatctctgctgtgccttcctggagtaaggtaaaccagggtctgattaggatgtataaagcagaatgtttagaaaagtttccagtgatccagcatttcaaatttgggagtctgttaccaattcacccggtcacaagcggttag

SEQ ID NO: 201582 - DNA, 972 bp, Artificial Sequence
  Description of Artificial Sequence: Synthetic coding sequence
atggccgagggcgagcggcagcccccccccgacagcagcgaggaggctcccccagcaacccagaactttattatccccaagaaagagattcacactgtcccagacatggggaaatggaaaaggtctcaagcttatgctgactatatcggtttcatcctcactctgaacgagggagtcaaggggaaaaaacttacattcgagtacagggttagcgaggctatcgagaagctggtcgctctgctgaatacgctcgataggtggatcgatgagaccccaccggttgatcaaccaagccgcttcggcaacaaggcttacaggacatggtatgcgaaactggacgaggaggccgaaaatctcgtcgctactgtggttccaacccaccttgcagccgcagtgccagaggtcgcagtgtatctgaaggagtcagtgggaaactctacccgaattgattatgggaccggacacgaagctgctttcgccgccttcctgtgctgcctctgcaagataggcgtcctccgggtggacgaccagatcgccatcgtgtttaaggtgtttaaccggtacctcgaggtgatgcgcaagctacagaagacctacagaatggaaccggctggcagtcagggagtgtggggcctggacgacttccagtttctccccttcatctggggatcatcccagctcattgaccacccatatctggaacctaggcatttcgtggatgagaaagcagtgaacgagaaccacaaggactatatgttcctggagtgcattctcttcatcacagagatgaagaccggaccgtttgccgagcattcaaaccagttatggaacattagcgcagtgccttcctggtctaaggtgaatcaaggcctcatcaggatgtataaggccgagtgtttggagaaatttcctgtcatccagcattttaagtttggaagtctgcttccgatacacccagtgacgtccggatag

SEQ ID NO: 201583 - DNA, 792 bp, Artificial Sequence
  Description of Artificial Sequence: Synthetic coding sequence
atgggcaagtggaagcggagccaggcctacgccgactacatcggcttcatcctcaccctgaatgagggggtcaaaggcaaaaagttaacattcgagtatcgcgtgtcagaggccatagagaaattagtcgcccttctgaacaccctggatagatggatcgatgagacccctcccgtagaccagcccagccgctttggtaacaaggcataccgaacctggtacgcgaagctggacgaggaggcggagaacttggttgccaccgtggttcccacgcacctggccgcagccgtacccgaggtggccgtttacttaaaggagtccgtgggaaattctacaaggatcgattatggaaccggacacgaagcggcattcgccgcattcttgtgctgcctgtgcaagataggcgtgctgcgggtcgatgatcaaatcgctatcgttttcaaggtcttcaatcgctatctagaggtgatgcgcaaattgcagaaaacatacagaatggagcccgcaggctcccagggagtgtggggcttagacgattttcagttcctgccttttatatggggatcctcacaactgattgatcacccatatcttgaaccccggcatttcgtggatgagaaagcggtgaatgaaaatcacaaagactacatgtttctggagtgcatcctgttcattactgaaatgaagaccggcccatttgccgaacactccaatcagctctggaacatttccgcggtacctagttggagcaaggtaaaccagggattgatcaggatgtacaaggccgagtag

SEQ ID NO: 201584 - DNA, 1125 bp, Artificial Sequence
  Description of Artificial Sequence: Synthetic coding sequence
atggccgagggcgagcggcagcccccccccgacagcagcgaggaggccccccccgccacccaaaacttcatcatccccaaaaaagagatccacactgtgcccgacatgggtaagtggaagcgtagccaggcctatgccgactacattggtttcatcctgacacttaacgagggggtcaaagggaaaaaattgacctttgagtatagagtgagtgaaatgtggaacgaggtccatgaggagaaagagcaggcagctaagcagtcagtgtcctgtgatgagtgcattccccttccgcgcgcaggacattgcgcgccatctgaggccatagagaaactggttgccctgcttaatactctggaccgctggatcgatgaaaccccaccagtggatcagccgtcgcgttttggaaataaagcctatcggacttggtatgccaaacttgatgaagaggcggaaaacctagtcgccactgtggtgcctactcacctggccgctgccgtgccagaggtggccgtgtacttaaaagagagcgtcggcaattcaaccaggattgattatggaacaggccacgaggccgccttcgccgcttttttgtgttgcctgtgcaagattggggtgctgcgagtagacgatcagatcgccattgtcttcaaagtctttaatagatatctcgaagtcatgcgtaagctgcagaaaacatatcgtatggagcctgctggctcccagggggtatggggcttggatgactttcagtttcttccctttatctggggatctagtcagctcatcgaccatccatatctggaacctagacatttcgtggatgaaaaagcagtgaatgagaaccacaaggactatatgttcctggaatgcatcctcttcatcactgagatgaagaccgggccctttgcagaacactcaaatcagttgtggaacatctccgcagtcccaagttggagcaaagtcaatcagggccttataaggatgtataaagctgaagctagtccttccgatacctggggtttggggatcagccacctcgggcacggacagtccgagaaacaccagccgccacagccccgcaaggccgctgtccagctttgccctgatgaacttggcgggtag

SEQ ID NO: 201585 - DNA, 456 bp, Artificial Sequence
  Description of Artificial Sequence: Synthetic coding sequence
atgaagaccggccccttcgccgagcacagcaaccagctgtggaacatttctgcggtaccaagctggagcaaggttaatcagggcctgattaggatgtacaaagccgaggtctcaggaggatggcccgtctgtccctcccttttacctcacttagtcctgggctgggggcaaagcaaacgctgcggcacttgggggagctgcttcctattgcctcattgctttgccttgaacctgaggcccgctccactgaccctgggagcaagcgagtcccccatatggggtatgggctcccaacgcagtacatctcacccgagccccgaaaaactgcaatcatcatccgtactaatgtcgctcgaggctgaggctagaacctgctgtatgggatccgggggggatggtgggctaccatccccattgagttctggacagaggctattgaaagcgagagccgtgtag

SEQ ID NO: 201586 - DNA, 2802 bp, Artificial Sequence
  Description of Artificial Sequence: Synthetic coding sequence
atggccgacctgagcctgctgcaggaggacctgcaggaggacgccgatggcagtctcgatttcgtttcccaggacgaaatgttgacccctctcgggagattggataaatacgcagcctccgaaaatatcttcaatcgccagatggttgcccggagcctcctcgacactttgagggaagtatgtgacgacgagagagactgtatcgcagtgttggagaggatctcgaggttggccgacgacagcgagcccacggttcgggccgaactcatggagcaagtaccacatattgcactgttttgtcaggagaataggccgtctatcccttacgcattttccaagtttctgttacctatcgtcgtgcgctacctggccgaccagaacaaccaggtccgaaaaacctctcaagcggcgctactggccctgttggagcaggaactgatcgagcggtttgacgtggaaacaaaagtatgccccgtgctcatagagcttacagcacccgattctaatgatgatgttaaaactgaagctgttgcaataatgtgtaagatggctcctatggtcggcaaggacattacagagagactgattctgccacgtttttgtgaaatgtgttgcgattgccgcatgttccacgtgcgcaaggtgtgtgcagctaacttcggggacatttgctcagtcgtgggacagcaggctaccgaggagatgctgctgccacgattttttcagctgtgtagcgataatgtgtggggtgtgcgaaaagcctgcgctgaatgcttcatggccgtcagttgcgccacctgtcaagagatacgtcgcacaaagctgtctgctctgttcatcaacttgatctcagatccctctcgctgggtgcgacaggctgcttttcagagcctggggccttttattagcaccttcgctaatccatcctcctccgggcagtatttcaaggaggagtcaaaatccagcgaggagatgagcgtcgaaaataaaaaccgcactagggatcaggaggctccggaggacgttcaagtaagacctgaggacactcctagcgacctgtcggtttctaattccagtgtaattctggaaaatacgatggaggatcacgcagccgaggcttcaggaaaacccctgggcgagatcagcgtgcctctggattcatctctcttgtgtactctaagctcagagagccaccaggaggctgctagcaacgagaatgacaagaaaccaggaaattataagtccatgttacggcctgaagtcgggacaacttcacaggactcagcactcctcgaccaggagctgtataacagctttcatttctggaggaccccactccctgagatagatctggacatcgagctggagcagaattctggcggaaaaccatccccagaaggtcctgaggaagagtcagagggacctgtgcctagctctccaaatattaccatggccaccagaaaggagctcgaggagatgatcgagaatctcgaaccacacatcgatgatcctgacgtcaaggcccaggtcgaagtgttaagtgctgctctgcgagccagtagtctcgatgcacacgaggagaccattagcattgagaaaaggtccgacctccaggacgaactagacatcaacgagctgccaaactgtaaaattaaccaagaagactctgtgcctctcatcagcgacgccgtcgaaaatatggacagcaccctccattacatacactcggattctgatctgtcaaataacagttctttttctcccgatgaggaacgccggacaaaggtgcaggacgtggtgcctcaggctctgctcgaccagtatctgtctatgactgacccaagtagggcccaaacagtcgataccgagatcgccaagcattgtgcctatagcctccctggcgtggcactgaccctcggcagacagaattggcattgtctaagggaaacttacgagacactggccagtgatatgcaatggaaagtgcggcgtaccttagcgttctccatccatgagttagcagtcatcctgggagaccaactcaccgcagcagatctggtgcccatattcaacggttttctgaaggacctggacgaggttagaattggcgtgctgaagcatctccacgactttctaaaactgctgcacattgacaaacgacgtgagtacctgtaccagctgcaggagttcctggtgacggataactcccgaaactggcgcttccgcgccgaacttgctgagcaactcattctcctcctggaattgtatagcccaagagatgtgtacgactatctccggcctatagctttgaatctatgtgcagacaaggtttcttctgtgagatggatctcttataagttagtcagcgagatggtcaaaaaactccatgctgccaccccgcccaccttcggggtggatctgataaatgagctggtggagaactttggtaggtgcccaaagtggtcgggtcgtcaagccttcgtgtttgtatgccagaccgtaattgaggatgattgtctccctatggatcagttcgctgtgcatcttatgccacatcttctgactctagctaatgatcgggtcccaaatgtgagagttctactggccaagacacttaggcagaccctcttggaaaaagattactttctcgcctccgcaagctgccaccaggaagccgtggaacagaccattatggcacttcaaatggacagggatagtgatgtgaaatacttcgccagcatccacccagcaagtacaaagatttccgaggacgccatgagcacagcgagtagcacctattag

SEQ ID NO: 201587 - DNA, 924 bp, Artificial Sequence
  Description of Artificial Sequence: Synthetic coding sequence
atggccgagatcagcgacctggaccggcagatcgagcagctgcggcgatgcgaactgataaaagagtcagaggtcaaggctttatgtgcaaaagcaagggagatactggtggaggagagtaatgtgcagagagtggattctcccgttaccgtgtgtggagatatccacggacaattttatgacttaaaagaattatttagagtgggcggggacgtgccggagactaattatctgtttatgggtgactttgtggatagaggcttttatagcgttgagacattcttactgttgctggccctgaaggtgcgctaccccgataggattacacttattaggggcaaccacgagagccggcagattacccaggtgtacgggttttatgacgagtgcctgcggaaatacggaagcgtgaccgtctggcgctactgtaccgaaatttttgactatttaagcctgtcagctattattgacgggaagattttctgcgtacacggtgggctgtctccttcgattcaaacactggaccagatacgcactattgatcggaaacaggaagtgccacacgacggacctatgtgcgatctgctctggagcgatcccgaggataccacagggtggggggtttctccgcgtggcgccggctacttgttcggaagtgatgtggtcgcacagttcaatgctgctaacgacatcgatatgatctgcagggcccaccagctagtgatggagggatacaagtggcacttcaatgaaaccgtgctcactgtgtggagtgctcccaattattgttatcgctgcggcaatgttgcagcgattctggagctggatgaacacctgcagaaggacttcattatctttgaagcggctccccaggagacacggggtattccctccaagaaacccgtggcagactacttcctctag

SEQ ID NO: 201588 - DNA, 1413 bp, Artificial Sequence
  Description of Artificial Sequence: Synthetic coding sequence
atgctgcaggtgcggacctacctgaccgagcccaccgtgcgggccgagttgatggaacaagtgccacacatagctctgttctgtcaagagaaccgccccagcattccctatgcattctcgaagttcctgcttccaatagtcgtgagatacctcgcagaccagaataatcaggttcgcaaaacttctcaggccgcactgctggccttgctcgagcaggagctgatcgagcggttcgatgtcgagacaaaggtttgtcccgtgttaattgagttgactgccccagacagtaatgatgacgtgaaaaccgaggccgttgccatcatgtgcaaaatggcaccaatggtggggaaggatatcaccgaacggctaatcctacctcgtttctgcgagatgtgttgcgactgccggatgttccacgtgcgcaaagtatgtgccgctaattttggggatatttgctctgtcgtagggcagcaggccacagaggaaatgctgcttcccagattcttccagttatgctcagacaatgtatggggcgtccgaaaagcctgcgctgaatgctttatggctgtctcctgcgcgacctgccaggaaatccgccggaccaagctttccgctctcttcatcaacctcatttctgacccttctagatgggtaagacaggctgcctttcaatcactggggccgttcataagtaccttcgctaacccatccagctccggacagtatttcaaagaagagtctaagagctctgaagagatgtcagtggagaataaaaaccgcacccgtgatcaagaagcaccagaggatgtgcaggtgagacccgaagacacccccagcgacctttccgtctctaacagcagcgttattttggagaacactatggaagatcacgctgctgaggcaagcgggaagcccctgggtgaaataagcgtgccactggactcttcactcctgtgtactctgagttctgagagccatcaggaagcggcctccaacgagaacgacaaaaaacccgggaattataaaagtatgctgaggcccgaggtaggaaccacatcacaagattccgctctgctcgaccaggagttatataatagctttcatttctggcgcacccccctgcccgaaatagacttggatatcgagctggagcagaacagtggcggcaaaccatcacctgagggacccgaagaggagtcagagggcccggttcccagctcaccaaatattacaatggccacgcggaaagaattagaggagatgattgaaaatctggaaccccatatcgatgatcctgacgttaaggcacaggtggaggtgctgtccgctgccctcagagcaagctcattggatgcacacgaggaaacaatctccattaaacgtgaagtcatttgcaagatgaattggatttag

SEQ ID NO: 201589 - DNA, 2853 bp, Artificial Sequence
  Description of Artificial Sequence: Synthetic coding sequence
atggccgacctgagcctgctgcaggaggacctgcaggaggacgccgatgggtttggggtcgacgattattcgtcggagtctgatgtcatcatcattccaagcgctctggacttcgtctcccaggacgaaatgctgactccccttggccggcttgacaagtacgctgcgagcgagaatatcttcaacaggcagatggtggctaggagcctgctggacaccctgcgagaggtgtgcgacgatgagagggattgcatcgccgtgctggagcgcattagtcgtttagccgacgactctgagccaacggtgagggccgagctgatggagcaggtgccccacatcgccctgttttgccaggaaaatagacccagtattccttatgctttttccaaatttttgctcccaatagtcgtgcggtatttggccgatcagaataaccaggtgagaaagaccagccaagctgcactgctcgcactgttggaacaggagctgattgagcgcttcgatgtggagaccaaggtctgccctgtgctgatcgagttgactgcccccgactccaatgatgacgtaaagaccgaggccgtggccatcatgtgcaagatggctccaatggtcggcaaggacattactgaacgcctgattcttccgcgcttttgtgagatgtgttgcgattgtcggatgttccacgttcgcaaagtctgcgccgctaactttggtgatatctgttcagtagtgggacagcaggctaccgaggaaatgttgttgcctaggttctttcagctgtgttctgacaatgtatggggtgtgagaaaggcctgcgctgagtgctttatggccgtgagctgtgcaacatgccaggagataagacgaaccaaactgagtgccctctttatcaacctgatctcagacccatcaaggtgggtacgccaggctgcgtttcagtcactggggcccttcatcagcactttcgccaatccaagttcgtccggccagtacttcaaagaagagtcgaaaagtagcgaagagatgtccgtggaaaataagaatcggacccgagatcaggaagcacccgaagacgttcaggttaggcccgaggatactccgtcggacctatcagtatctaatagttcagtgatcttggaaaacaccatggaggatcatgcggccgaagcttcaggtaagccactgggagaaatttccgttcctctggactcatctctcctttgcaccctttccagcgagagccaccaagaggccgcctcgaacgagaatgacaaaaagccagggaactataagtccatgctgaggcccgaagtggggaccacgagccaggattctgcgcttctcgatcaggagttgtataattcctttcacttctggagaacccccctgcccgaaatcgatctggacatcgaactcgagcagaacagcggaggcaagccttcccccgaagggcccgaggaggagagcgaaggccctgtgccttcctcgcccaacatcaccatggcgaccagaaaggaacttgaggaaatgatcgagaatctggagccacatatcgacgacccagatgttaaggctcaagtggaggtgttatcagcagccctgcgcgcttcgagtcttgatgctcacgaggagaccattagtatcgagaagaggtctgatctgcaggacgagctagacatcaatgaactgcctaactgcaaaattaaccaagaggatagtgttcccctcatatccgatgctgtcgaaaatatggatagtacactgcattatatccatagcgattccgatctgtcgaacaactcctccttcagccctgatgaagaacggagaacaaaggtacaggatgttgtgccacaggctctccttgaccaatacttgtcaatgacagaccccagtcgcgctcagacagtcgataccgagatcgctaaacactgcgcatattccctgccaggggttgccctgactctaggacggcagaattggcactgtctgcgcgaaacatatgagaccctggcatcagatatgcagtggaaggtacgacggaccttagcattcagcattcatgaactggcagtgatacttggggaccaacttactgccgccgaccttgtgcctattttcaatgggtttttaaaggatctggatgaggtgcgcattggtgtgttgaagcatcttcacgatttcttgaaactcctccacattgataagcggcgagagtacctttatcagttgcaggaatttcttgttaccgacaactcaagaaattggcggttcagggctgagctggcagaacagctcattctactcctggagctatattctcccagagacgtctatgactacctgagacccatagcactgaacctatgcgcagacaaggtgagcagcgttcgttggatcagttataagctagtgagcgagatggtcaagaaattacatgcagcgacccctccaacctttggcgtagatctgattaacgagctagtagaaaactttggccggtgccctaagtggtccggccgccaggctttcgttttcgtctgccagacggtgattgaagacgattgcctgcctatggatcagtttgctgtgcacctaatgcctcatctgctgacactggccaacgatcgagtgccaaacgtaagggtactgctggctaagaccctgcggcaaactttactggaaaaagattacttcctggcgtcggcaagctgccaccaggaagccgtagaacagacaatcatggctctccagatggaccgagacagtgacgttaagtactttgccagtattcacccagcctcaacaaaaatctcagaggacgctatgagcactgcttcctcaacctactag

SEQ ID NO: 201590 - DNA, 1086 bp, Artificial Sequence
  Description of Artificial Sequence: Synthetic coding sequence
atggacgacttccggaccagcgcccccgagccccggggcccccccaaccccaacgtggagtatattccattcgacgagatgaaggaacgtatactgaaaatagtcacagggttcaacggaatacccttcaccatccaacggttatgtgagctactgaccgaccctagaaggaactacacaggtacagacaagttcctcaggggcgtagagaaaaatgtcatggtggtgagctgcgtgtatccttccagtgaaaaaaacaattctaatagcttaaatcggatgaatggcgtgatgttccctgggaattcccctagttacaccgaacgaagtaatatcaacggcccaggaacccctcgccccctgaatagacccaaggtttctctctctgcccccatgaccactaatggcctacccgagtccaccgatagcaaggaagcaaacctgcagcagaatgaagaaaaaaaccattccgactcctcaacgtctgaaagtgaggttagctcagtgtcccctttgaagaacaagcacccagacgaggatgccgtggaggccgaggggcacgaggtgaagagactccgttttgacaaagagggagaagtgagggagacagcgagccaaaccacttcgtccgaaattagctccgtgatggtcggggagaccgaggcgtcaagtagttcgcaggataaggacaaggattccaggtgtactcgccaacactgtacggaggaggatgaagaggaggatgaggaggaagaggaggaaagcttcatgaccagtagggaaatgataccagagcgaaagaaccaggagaaggagagcgacgatgcccttaccgtgaacgaagagacatccgaggagaataaccagatggaggaatcagacgttagtcaggctgagaaggacctccttcactccgagggatccgaaaacgaagggccggtgtcaagctcttcatccgattgtagggagacagaggagcttgtgggctcaaattcttccaagactggcgagattttaagtgagagttctatggagaacgatgacgaggccactgaggtcacagacgaacccatggagcaggactag

SEQ ID NO: 201591 - DNA, 1254 bp, Artificial Sequence
  Description of Artificial Sequence: Synthetic coding sequence
atggacgtggagcggctgcaggaggccctgaaggacttcgagaagcgcggaaagaaggaagtgtgccctgtattggatcagtttttgtgtcatgttgccaagacaggggagaccatgattcagtggagtcaattcaagggctacttcatcttcaagctcgaaaaagtgatggatgatttcaggactagcgcacctgaaccccgagggcctcctaatccaaatgtggaatacatcccctttgacgaaatgaaagaaaggatcctcaagatcgtaaccgggttcaatggaataccatttaccatacagcgcttgtgcgagctcctgacggatccccgccgaaattacacgggcaccgataagttcttacgtggcgtcgaaaagaatgtcatggttgtaagttgtgtgtatccctcaagcgaaaaaaacaatagcaacagcctgaaccggatgaatggggtcatgttccccggtaatagcccttcatatactgaaaggagtaatatcaacggacccggcactccgcggcctctaaatcgcccaaaggtgtccttgtccgctccaatgactactaacgggttacctgagtccactgactccaaagaggccaacctgcaacaaaacgaagaaaaaaatcattctgactcatctacaagtgagtccgaggtgtcatccgtcagtccgcttaagaataagcatcccgatgaagatgccgtggaggcggagggccacgaagtgaaaaggcttaggtttgataaggagggtgaggtgagggagactgcctcccagacaacttcatccgagatctctagcgtgatggtcggcgaaaccgaagcctcatcatcttcccaggacaaggacaaagatagtagatgcaccagacagcactgtacagaggaggatgaagaggaagatgaggaagaagaggaggagagcttcatgaccagtcgggagatgatccctgagcgaaaaaaccaagagaaagagtccgatgacgctctgacagtgaatgaggagacgagcgaggaaaacaaccagatggaagaaagtgatgtatcgcaagctgagaaggatctgcttcactccgaaggcagtgagaatgaaggtcccgttagttcctcatcttccgattgtagagagaccgaggagttggtgggtagtaactcttcaaaaactggggaaatattaagcgagtccagtatggaaaatgatgacgaggccactgaagtcacagacgaacctatggaacaagattag

SEQ ID NO: 201592 - DNA, 1083 bp, Artificial Sequence
  Description of Artificial Sequence: Synthetic coding sequence
atggacgtggagcggctgcaggaggccctgaaggacttcgagaagagggggaagaaggaagtgtgtcctgtgttggatcagtttttgtgtcatgttgcgaaaacaggcgagaccattataccattcactatacagagactctgcgaattactcaccgatccaaggcgcaactacactggtaccgataaattcctcaggggcgttgaaaaaaatgtgatggttgtgagctgcgtatacccatcctccgagaagaacaattccaatagtttaaaccggatgaacggggtaatgtttccaggaaactcacccagttacacagagcgctccaatatcaacggtcccggtacgccaaggcctttaaatcgcccaaaagtgagcctaagtgcccccatgacgacaaatgggttgcctgaatcaacagactccaaagaggcaaatctgcagcagaacgaggagaaaaaccattccgattctagcacgtctgaatctgaggtgagctccgttagcccccttaagaacaaacaccccgacgaagacgccgtcgaggccgaaggtcacgaagttaaacgactgagattcgacaaagaaggggaggtgagagaaacagcatcccagaccacgtcatctgagatatcaagtgtcatggtgggggagaccgaggcaagctcctctagccaggataaagacaaggactctaggtgtacacggcaacactgcactgaagaggacgaggaggaggacgaagaagaggaggaggaaagcttcatgacctcgagggagatgataccagagagaaaaaaccaagagaaggagtccgacgacgcgttgaccgtgaacgaggagacaagtgaggagaataaccaaatggaggagtccgatgtgtctcaagctgaaaaggaccttctgcattcagaaggaagcgaaaatgaaggcccagtaagcagctcatccagcgattgccgagagaccgaagagctcgtcggcagcaactctagtaaaacaggagagatcctctctgaatcgagtatggagaatgatgatgaagcaacggaagtgaccgatgaaccaatggagcaggattag

SEQ ID NO: 201593 - DNA, 1116 bp, Artificial Sequence
  Description of Artificial Sequence: Synthetic coding sequence
atggccctgggcaagttccgggccgccctgcgggactacgagaccgtggtaaaagttaagccacacgataaggatgctaagatgaagtatcaagagtgtaataagatcgtcaagcaaaaggctttcgaaagggccatcgctggagacgagcataaacgatcagtggtagacagcctggatatcgagtccatgacaattgaagacgagtattccggccccaagttagaagatggcaaagtcaccatttcatttatgaaggagctgatgcaatggtacaaggaccagaagaagttgcataggaagtgtgcctatcagactgaaaaaattactgtttgtggagatacacatgggcaattttacgacctgctcaatattttcgagctcaatgggcttccatccgagactaatccatatatatttaacggggatttcgttgatcgcggctccttctctgtggaagtgatcctcacattgtttggcttcaaactgctgtatcctgaccatttccacctcctgcgcggaaaccacgagaccgataacatgaaccagatttatggcttcgaaggggaagtaaaagccaagtataccgctcaaatgtatgagctattcagcgaagtgttcgagtggctcccgctggcacagtgcattaatggcaaagtgttgatcatgcatggaggactcttttcagaggacggagtgactctggacgacatacgcaaaatcgagcggaacaggcagccccccgatagtgggccaatgtgcgacttgctatggtccgacccccagccacagaacggaaggagcatttctaagagaggtgttagttgccagtttggccccgacgttaccaaagcctttctagaagagaacaatctggactacatcattagatcacacgaagtcaaggcagaaggatacgaagttgcccatggcgggaggtgtgtaacagtgtttagtgcccccaactactgcgaccagatgggcaacaaggcttcttacatacacctccaggggtcggatctgagaccacagtttcaccaatttaccgccgtcccgcacccgaatgtcaaacctatggcttacgcgaatactttattgcaactgggcatgatgtag

SEQ ID NO: 201594 - DNA, 1500 bp, Artificial Sequence
  Description of Artificial Sequence: Synthetic coding sequence
atggccatggccgagggcgagcggaccgagtgcgccgagcccccccgggacgagccccccgccgacggggctctgaaacgtgccgaagagctgaaaacccaggcaaacgactacttcaaagctaaggattacgaaaacgccatcaaattttattcccaggcaatagagctcaatccatctaacgccatctattacggcaacaggtcattagcttacctgcgcacggagtgttatggttatgcactcggagacgccacccgggccattgagctagacaaaaaatacattaagggctactaccggcgagccgcatcaaatatggcactcgggaaattccgggcagctctcagggattatgaaacggtcgtgaaggttaaaccgcatgataaggacgcaaagatgaaatatcaggagtgtaacaaaatcgtgaagcagaaggcattcgaacgagccattgcaggggacgagcataaaaggtccgtggtggactcactcgatattgagtcaatgaccattgaggacgagtatagcgggcctaagctagaggacggcaaggtaacaatctccttcatgaaagagctgatgcaatggtacaaagaccagaagaagctgcaccgtaaatgtgcatatcagattctagtccaggtcaaagaggtgctcagtaagctgtctaccctggtggagacaactttgaaggagacagaaaagatcacagtgtgcggggatacgcacggacagttctacgacctgctgaacattttcgagctgaatggtctgccaagtgagactaatccgtacattttcaacggggattttgtggataggggcagcttcagcgttgaagtaattctcacactttttggattcaagctcttgtatccggaccacttccatctactgcgcggtaatcatgagaccgacaacatgaaccagatttacgggtttgaaggtgaagtcaaggccaaatatacagcccagatgtatgagcttttttcggaagtctttgagtggctgcccctggcccagtgtataaatggcaaagtactgattatgcacggcggcttatttagtgaagacggggtaacactagacgacatccgcaaaatcgagaggaatcgccagcctcctgacagcggacccatgtgtgatctgctgtggtcagatcctcagccacaaaatggcagaagcatcagcaaaagaggggtgagttgtcagttcggtcccgacgtaacaaaggcattcctcgaggagaataatctggattatatcatcaggtctcatgaggtgaaggccgagggctatgaggtagcacatgggggcagatgtgtcactgtcttttcagcccccaactactgtgatcagatgggtaataaggcttcctacattcatctacagggaagtgatttaagaccacagtttcaccagtttacggcggtgcctcacccaaacgtaaaaccaatggcctatgcaaataccctgcttcagctgggcatgatgtag

SEQ ID NO: 201595 - DNA, 1461 bp, Artificial Sequence
  Description of Artificial Sequence: Synthetic coding sequence
atggccatggccgagggcgagcggaccgagtgcgccgagccccccagagacgaaccgcctgctgatggggccctgaaaagagccgaagagctgaaaacacaggcaaacgattacttcaaggctaaggactatgaaaacgcgatcaaattctatagccaggctattgaactgaatccgagcaacgctatatactatgggtacgcactgggagatgcaacacgggcaatcgagctagataagaagtatatcaaggggtattaccgacgggcagcatcaaacatggccctggggaagtttcgcgccgccctcagagattacgagacagtggttaaggttaaaccccacgataaggatgccaaaatgaaataccaagagtgcaataagattgtgaagcagaaggcattcgaaagggccattgccggcgatgagcataagcgaagcgtcgttgacagcctggatatcgagtccatgacgatcgaggacgagtactcagggcccaagctggaagatggaaaagtaaccattagcttcatgaaggaactgatgcagtggtataaggaccaaaaaaaactccaccggaaatgcgcctatcagattctggtgcaagttaaagaggtgctgtccaaattatcaactctggtcgaaacaacattgaaagaaacagaaaaaattactgtgtgcggcgacacccatggccagttctatgatctgttgaatatctttgagctgaatggcctgccctcggaaactaacccatatattttcaacggcgacttcgtcgacaggggatcattctctgtcgaagtgatcctcactctgttcgggttcaaactgctgtaccccgaccactttcatctgctcagagggaatcatgagaccgataacatgaaccagatctacggatttgagggagaagtcaaggccaaatacactgctcagatgtatgaacttttctccgaggtgtttgagtggcttccactggcccagtgtatcaatggtaaagtattgatcatgcatggaggcctgtttagcgaagacggcgtaacactggatgatattaggaagattgaaagaaatcgccagccacctgatagcggcccgatgtgcgacctattatggagcgatcctcagccacagaacggacgatctatctcaaagcggggggtctcctgccaatttggtcccgatgtcacgaaagcttttctggaagagaataatttggactatatcatacggagtcatgaagtcaaggctgaggggtacgaggtggcacacggtgggcggtgtgtaaccgtatttagtgcgcccaactattgtgatcagatgggaaacaaagcaagttacatccatctgcagggctcagacctgcgccctcagtttcatcagtttacagcagtcccacacccaaatgtcaagcccatggcctacgccaacactctcctacagctcgggatgatgtag

SEQ ID NO: 201596 - DNA, 1458 bp, Artificial Sequence
  Description of Artificial Sequence: Synthetic coding sequence
tgaatggccgagggcgagcggaccgagtgcgccgagcccccccgggatgaaccacctgctgacggggcattgaagagggccgaggaactcaaaacacaagcgaatgactactttaaagccaaagactatgagaatgctataaagttttacagccaggccattgaactaaatcctagtaacgctatctactacggaaacagatccctggcctacctccgcacagaatgttatggctatgccctgggggacgcgacaagggccatcgaactggacaagaagtacatcaaaggttactacaggagagcagccagcaatatggctctgggcaagtttcgcgcagcactgcgtgattatgaaacggtcgtgaaagtaaaacctcatgacaaggatgcaaagatgaagtatcaggagtgcaacaagatcgtgaagcagaaggcttttgaaagagcaatcgcaggcgatgaacacaaacgctctgtggtggactcactggatatagagtctatgaccattgaggatgaatactccgggcccaagctggaggatggcaaagtgaccatcagcttcatgaaagaactgatgcagtggtacaaagaccagaagaaactgcatcgcaagtgtgcataccaaattctggttcaggtgaaggaagtgttgtctaagctaagtactctcgtggagactaccctcaaagaaacagaaaagattaccgtgtgtggtgatacgcacgggcagttctatgacctgcttaacatctttgagttgaacgggctgccttccgagactaacccatacatttttaacggagattttgtcgatcgcggtagcttctccgtggaggtgattttaacactgttcggattcaagctgctctatcctgatcactttcatttgttgcggggaaatcatgaaaccgacaatatgaatcaaatctatggatttgaaggtgaagtgaaagccaagtatacagcacagatgtacgaactctttagcgaagtgttcgagtggctgcccctggctcagtgtattaatggcaaggtcctcatcatgcacggcggcctcttttcagaggacggagtgacactggatgatatccgtaagatcgagcggaatagacaaccaccagactctggcccgatgtgcgaccttctgtggtccgaccctcagccacagaacggaagatccattagcaaacggggggtaagctgtcaatttggcccagatgtcacaaaggcatttctggaggaaaataaccttgactacataatccgcagccatgaggtgaaggcggagggctacgaggtcgctcatggggggcgatgcgttactgtgtttagcgctccaaattactgtgatcagatggggaataaggcgagctatatccacctccaggggagcgacctccggccacagtttcaccagtttacagcagttggacgcccttcaagcggatcttag

SEQ ID NO: 201597 - DNA, 477 bp, Artificial Sequence
  Description of Artificial Sequence: Synthetic coding sequence
atgctgaccgtggccgccctgatcgacgagcagatcctgtgcgtgcacgggggtctcagccctgatattaagactctggatcagataagaaccatcgagagaaaccaggagataccgcataaaggtgccttctgtgacctggtctggtccgaccctgaggatgtggatacttgggccattagccctagaggggccgggtggctgttcggtgccaaggtgacgaacgaatttgtgcacatcaataaccttaaactgatttgccgggctcaccagctggttcatgagggatataagttcatgtttgatgagaaactggtgaccgtgtggagtgcaccaaactattgctacaggtgcggaaatatagcctctatcatggtcttcaaagatgtaaacacgcgcgaaccaaagctcttccgcgcagtgcctgattctgagcgagtaattcccccaagaactaccacaccctactttctgtag

SEQ ID NO: 201598 - DNA, 918 bp, Artificial Sequence
  Description of Artificial Sequence: Synthetic coding sequence
atggcccccctggacctggacaagtacgtggagatcgcccggctgtgcaagtacctcccagagaatgatctgaaacgactgtgcgactacgtttgcgatctcctgctggaagagtccaatgtacagcctgtgtccacacctgtgactgtgtgcggagacattcatggccaattttatgatctttgcgaactcttccgtacaggaggtcaagtgcctgacacgaattacatttttatgggcgacttcgttgatcgcgggtattatagcttggagacctttacctacctgctggccctaaaagcaaaatggcccgatcgaattaccctactgcggggcaatcacgagtctcggcagattacccaggtgtatggcttctatgatgaatgccagactaaatatggcaacgcgaacgcctggaggtattgcacgaaggtgtttgacatgcttaccgtcgccgctcttatcgacgagcaaatcctgtgtgtccacggcgggttgtcgcccgatatcaaaaccctggaccagatcagaactatagaacggaaccaggagataccccataagggggccttctgcgatttggtgtggtctgatcctgaagatgtcgatacctgggctatctcaccaaggggagcaggatggctgtttggagctaaggtcactaatgaattcgtgcatatcaataatcttaagcttatctgccgagcacatcagcttgtccatgagggatataagttcatgtttgacgagaagctagtaacagtctggtcagcccccaattactgttatagatgcggaaacattgcatccattatggttttcaaggatgtgaacactcgcgagccaaagctttttcgtgccgtgccagattccgaaagagttatccctccccgcacaacaaccccctatttcctatag

SEQ ID NO: 201599 - DNA, 852 bp, Artificial Sequence
  Description of Artificial Sequence: Synthetic coding sequence
atggcccccctggacctggacaagtacgtggagatcgcccggctgtgtaagtatctgcccgaaaacgatctgaaacgcttatgcgactacgtgtgcgatctgctactggaggagagcaatgtacagcctgttagcaccccagtaaccgtgtgcggcgacatccacgggcaaggggacttcgtcgatcgcgggtattactcccttgaaaccttcacctacctattggctctgaaagccaaatggcccgaccggataactctgttacgggggaatcatgagagcagacagattactcaagtttatggcttttatgacgagtgccaaaccaaatatgggaatgctaatgcctggaggtactgtacaaaagttttcgatatgttaaccgttgctgctttgattgacgaacagattctttgcgtacatggcggactatcccctgatattaaaacactggaccaaattcggacaattgaacggaatcaggaaattccacataagggagccttttgtgatttggtgtggtccgaccccgaagatgtggatacctgggcaattagtccccgtggggccgggtggctgtttggcgctaaggtgacaaacgaattcgttcatatcaacaacttgaagctgatttgccgcgctcatcagttagtgcatgaaggatataaattcatgtttgacgagaagctcgtaacagtttggtccgcaccaaattactgctataggtgtgggaatattgcttctattatggtctttaaggatgtaaacacgcgggagccgaaactattcagagcggtcccagactcagagcgcgtcattcctccaagaactacaacaccatattttttgtag

SEQ ID NO: 201600 - DNA, 1029 bp, Artificial Sequence
  Description of Artificial Sequence: Synthetic coding sequence
atggcccccctggacctggacaagtacgtggagatcgcccggctgtgcaagtatttgcccgaaaatgatctcaaggtctcacccatatgcggattagcaccaagtggttgtggagcccctgcaggtcggcctttcctatcacctggaccaccgccagtgttccatttccttaggttcctgaaggagcgcctgtgcgattatgtctgcgacttactgctggaagaaagtaatgtgcaaccggttagtacacccgtaacagtgtgcggagacattcatggacagttttacgacctgtgcgaacttttcaggacgggcggccaagtcccagataccaattacatttttatgggcgatttcgtggaccggggctactattccctggaaacatttacctatctactggccctgaaagcaaaatggcctgatcggattaccctccttcggggaaaccatgaaagccgacagattacccaggtttacggattttacgatgagtgccagactaagtacggcaacgccaatgcatggcgttactgtacgaaagtgttcgacatgctcacggtggctgccctgatcgatgaacagatactgtgcgtgcacggcggactgagcccagacattaagacactggaccagatccgcacgattgagaggaaccaggaaatccctcacaaaggcgccttttgcgacttggtgtggtctgacccagaggatgtggacacgtgggcgatttcccccaggggcgccggctggctgttcggggctaaggttaccaacgaatttgttcacatcaacaatctgaagctgatttgccgagcacatcagcttgtgcatgagggctacaaattcatgttcgatgaaaaactggtgacagtgtggagtgcgccaaattattgctaccggtgcggcaatatcgctagcattatggtcttcaaggacgtcaatacccgcgaacccaagctgttccgggccgtgccggactccgagagggtcattcctccaagaactaccacgccttatttcctctag

SEQ ID NO: 201601 - DNA, 378 bp, Artificial Sequence
  Description of Artificial Sequence: Synthetic coding sequence
atgttcctgctgccccggctgcagctgctgggccagatgcggctgtgcgattacgtgtgcgatctgctactcgaagagtccaacgtccagccagtgtccacacctgtcactgtttgtggggatattcatggccagttttacgacctgtgtgaacttttccgtaccggtgggcaggtcccggatacgaactatattttcatgggcgattttgtcgacagggggtactactccctggaaacttttacttacttactggcactgaaagccaaatggccagatcgtatcactctgctcagaggcaatcatgagagcaggcagatcactcaggtctatggattttatgatgagtgccagactaagtacgggaatgctaattag

SEQ ID NO: 201602 - DNA, 1161 bp, Artificial Sequence
  Description of Artificial Sequence: Synthetic coding sequence
atgagcgccctggagaagagcatgcacctgggccggctgcccagcaggccacctctgccagggagtggcggatctcagagcggcgcgaaaatgcgaatgggccctggacgcaagagagatttcagcccggtgccatggagccagtactttgaatccatggaggacgtagaagtggagaatgaaactggaaaggatacttttagggtttacaagtctggatcggaaggccccgtgctgttactccttcacggcggtggacacagcgcactgtcatgggccgtgtttaccgccgctatcatctcccgggtccaatgtcgaatcgtggccctggatctccgaagccacggcgaaacaaaagttaagaacccagaggacctgtcagccgagacaatggccaaagacgtagggaatgtggtagaggctatgtatggagatttgcccccgcccataatgctaatcgggcatagcatggggggcgccatagcagttcacacagccagcagcaacctggtaccctcccttctcggcctttgcatgattgacgtcgtagaagggacagccatggatgcactgaattccatgcagaacttcctgcggggccggcccaaaacctttaaaagtcttgagaatgcaatcgaatggagtgtgaagtccggtcagatccgcaacctggagtctgctcgcgtgtcaatggtgggccaggtgaagcaatgtgaaggtataaccagcccagaggggagtaagtccatcgttgaaggaatcattgaagaggaagaggaagatgaggaggggagtgagtctatcagtaagcgcaagaaggaggatgacatggagactaagaaagaccatccctatacctggcgcattgaattagccaaaactgagaaatattgggacggttggtttcgtggattaagtaacctgttcttgagctgccctataccgaagttgctccttctggctggcgtggacaggctggataaggatctgaccatcgggcagatgcaaggcaagttccagatgcaggtactgccccagtgcggccatgcagtgcacgaagatgctccggacaaggtggcggaggccgtggctacttttctcatccgacatagatttgccgagcccatcggcggcttccagtgcgtttttccaggatgttag

SEQ ID NO: 201603 - DNA, 600 bp, Artificial Sequence
  Description of Artificial Sequence: Synthetic coding sequence
atggacgccctgaacagcatgcagaacttcctgcggggccggcccaaaacatttaagagcctggaaaacgcaatagagtggagtgtgaaaagcggacagattcgaaatctcgaaagtgcccgagtgtcgatggttggccaagtgaaacaatgtgagggcatcacatctccagaggggtctaaatccatcgtggaaggcattatcgaagaagaggaggaagacgaagaggggtcggagtccataagcaagagaaaaaaggaagacgacatggagactaagaaagaccatccttacacgtggcggatcgagctggcgaaaacagagaaatactgggacggatggttccggggtcttagcaatctgttcttgagttgcccaattccaaaacttttgctgctggcgggagtggataggctggacaaggatctgaccataggacagatgcagggcaaatttcaaatgcaagtgctgccacagtgcgggcatgccgttcatgaggatgcccccgacaaggtagccgaagctgtggctacctttcttataaggcaccgctttgccgagccaattggcggcttccagtgcgtctttcctggatgctag

SEQ ID NO: 201604 - DNA, 1203 bp, Artificial Sequence
  Description of Artificial Sequence: Synthetic coding sequence
atgagcgccctggagaagagcatgcacctgggccggctgcccagccgccctcccctccctggctcaggcggatctcaatctggggctaaaatgaggatggggcccggccgcaaacgcgacttctcccctgtcccctggtcacagtatttcgagtccatggaggacgtggaagtggagaacgaaactggcaaagatactttccgggtgtacaaaagtggttctgagggaccggtcctacttctccttcacgggggtgggcacagcgccctgtcttgggctgttttcactgccgctatcatctctcgcgttcagtgtcgcattgtggcattagacctgagatctcatggcgagactaaagtaaaaaatccagaagatttgtcagctgagacaatggcaaaggacgtgggcaacgtggtggaggcgatgtacggcgatcttccccctccaataatgctgataggacactcaatggggggtgccattgcagtgcacaccgcctcctctaacttggttcctagccttttaggtctatgcatgattgacgtggtagaaggcacggcaatggatgcacttaatagcatgcaaaatttcttgcgtggcagacccaagacattcaagagcctggaaaatgcaattgagtggtccgtaaaaagcggccagatccggaacctggaatcggcacgagtatctatggtcgggcaagtgaaacagtgcgagggcattacaagccctgaagggagcaaatctattgtagaaggtattatcgaggaggaggaagaggatgaggaaggttctgaaagcatctctaagaggaagaaagaggacgacatggaaggccttcccagtgagacacagaatcttttgctttttctgcagaccaagaaggatcacccctacacatggagaatagagttggcgaaaactgagaagtattgggacggatggttccggggcctgagtaatttatttctaagctgccctataccgaaactgttgctgctggcaggcgtggaccgcctggacaaagatctgaccattggccagatgcaaggtaaattccaaatgcaggttctgcctcagtgtggccacgccgtgcacgaagacgccccagacaaggtggccgaagcggtggctacttttctcatacggcaccgatttgccgagccaataggtggctttcagtgcgtgtttcccgggtgttag

SEQ ID NO: 201605 - DNA, 1776 bp, Artificial Sequence
  Description of Artificial Sequence: Synthetic coding sequence
atgggctgcagcagcagcagcaccaagacccggcggagcgacaccagcctgcgcgccgcgcttataattcagaattggtaccgaggctataaggccagactaaaggcgcgccagcactacgccttgacaatatttcagagcatcgaatacgccgacgaacagggtcaaatgcagctgtctacattcttttccttcatgcttgagaactatacccacatacacaaagaagaactggagctaaggaaccagtccctggaatctgaacaagacatgagggaccgctgggactacgttgacagcattgatgtacctgattcttacaatggccctcggctccagttccctctgacttgtacagatatagacctgctcttggaagctttcaaagaacagcaaatcctacacgcccactacgtcctcgaggtgctgtttgagacgaaaaaagtgcttaaacagatgcctaatttcactcatatccaaacatccccttcaaaggaggtgaccatttgcggagacttacacggaaaactcgatgatctctttctcattttctacaagaatggtctgcccagcgagagaaacccttatgtgtttaacggcgatttcgtggatcgaggtaagaattctatcgagatcctaatgatactttgcgtgagctttttggtttacccaaacgacttgcacctaaacagaggaaaccatgaggactttatgatgaacctacgatacggcttcacgaaggaaattctgcacaagtataaactgcatgggaagcgcattctgcagatcctggaggagttctacgcatggcttcctatcggcacaatcgtggacaatgaaatactggtgatccacggcgggatttcagagacaactgacctaaatctgctgcacagagtcgaacgcaataagatgaagagtgtattgatccctcctaccgagacgaaccgtgaccacgacacagatagtaaacacaacaaggttggggtcacatttaatgcacacgggcgaattaaaacgaacggcagtccgacagagcacttgactgagcacgaatgggagcaggttgttactatcttctctgcctctaactattatgaggaggggtccaaccggggagcctacattaaactttgcagcggtacaacgcctcgcttttttcagtatcaggtgaccaaagctacctgctttcagcctctgcgtcagcgcgtggatacaatggagaattccgctatcaaaatcttaagagaacgagtcatcagccgaaaaagtgatctcactagggccttccaactccaagatcaccgaaagtccggtaaactatccgtgtcgcagtgggctttctgtatggagaacattctcggtctgaacttgccatggcgctctctatcctccaacctcgttaatatcgaccagaacggcaatgtggagtatatgtcctcgttccaaaacattcgaatcgagaaacccgtgcaggaagcccactcaacactagtggaaactctgtacaggtaccgttccgatttagagataattttcaacgccatcgacactgatcattcaggcctgataagtgtcgaagaattcagggcaatgtggaaactgtttagttcgcactacaacgtccacatagacgactcccaggtcaacaaactcgcaaatatcatggatctgaacaaggacggaagtatcgattttaacgagtttcttaaagccttttatgtggtacacagatacgaagacctgatgaagcccgacgtgacaaacctgggttag

SEQ ID NO: 201606 - DNA, 1803 bp, Artificial Sequence
  Description of Artificial Sequence: Synthetic coding sequence
atgggctgcagcagcagcagcaccaagacccggcggagcgacacctcacttcgcgccgccttgattatccagaactggtacagaggatacaaggcacggctgaaggcacgccaacactatgccctcacaattttccagtccatagaatacgcagatgaacagggacagatgcaactgtctacatttttctcctttatgctcgaaaactatacccacattcataaggaggagctcgaaattcttcacgcacattacgttctggaagttttattcgagaccaagaaagttctgaagcaaatgcctaacttcactcatatccaaacctccccatctaaagaagtcacaatttgcggcgacttgcatggcaagctggatgatctcttccttattttttacaaaaacgggcttccctccgaaaggaacccatatgtctttaatggcgacttcgtggacagaggcaaaaacagcatcgagattttgatgatcctatgcgtttcttttctggtctatccaaacgatctgcacctcaaccgtggcaaccacgaggacttcatgatgaacctacgatatggtttcaccaaggagatcctgcataagtataagttacacggaaagagaattcttcagatccttgaagagttctatgcctggctaccaataggtacaatagtcgacaatgaaattttagtaattcacggtgggattagcgagactactgatctgaacctactgcacagggtcgagcgcaacaagatgaagagcgtcctgatccctcctacagagaccaaccgcgatcacgataccgactctaaacacaacaaggtgggcgtgacgttcaacgcgcacggcagaataaagacaaatgggagtcccactgaacacctgacggagcacgaatgggagcagataatcgacattctgtggagtgacccccgaggtaagaacggctgcttcccgaacacgtgtcgcggcgggggatgctactttggtccagacgtaacctccaagattctgaacaagtaccagcttaaaatgcttatacgttcacatgaatgtaagcctgaagggtacgagatctgccacgacgggaaggtggtgaccattttctctgcatcaaactattatgaggaagggtccaaccggggcgcgtatattaaactgtgctcaggtactacacctcgattcttccagtatcaggtgaccaaggccacctgcttccagcccctccgacagcgagttgacactatggagaatagcgccattaaaatccttcgcgagcgcgttattagcaggaagtcagacctgactagggcttttcaactacaggatcataggaagagcggcaagctatcagtgagccagtgggctttctgtatggagaatatcttagggctaaatctcccttggagatctctttcatctaatctcgtcaacatcgaccaaaacggtaatgtcgagtacatgtcatcttttcagaacattcgcattgaaaagcccgttcaggaagcgcatagcactctagtggaaactttatatcggtacagatcagatttggagattattttcaacgctattgacactgatcactctggtctgatcagcgtggaggagttccgggcgatgtggaagctgttctccagccactataatgtgcacatagatgacagccaagtgaataagcttgctaatataatggacctgaacaaagatggttccatcgattttaacgagtttttgaaagccttttacgtggtgcaccggtacgaggatctgatgaagcctgacgtgacgaatctcgggtag

SEQ ID NO: 201607 - DNA, 1962 bp, Artificial Sequence
  Description of Artificial Sequence: Synthetic coding sequence
atgggctgcagcagcagcagcaccaagacccggcggagcgacaccagcctaagggctgcccttattatccaaaattggtaccggggctataaggcaaggttgaaagccagacaacactacgcattgacaatctttcagagcatagagtatgccgacgagcagggccagatgcagctttcaacctttttctctttcatgctcgaaaactatacccacattcacaaggaagaactagagttgagaaatcaaagcctggagtcagaacaggacatgcgagaccggtgggactatgtagactcaatcgatgtccccgacagttataacggacctcgcttgcagtttcccttgacctgcaccgacatagacctgctgttagaggccttcaaagagcagcaaatcctccacgctcattacgtgttggaggtacttttcgaaacaaagaaagttttgaagcagatgcctaacttcactcatattcagacatctccatcaaaggaggttactatctgtggggacctgcacggaaagcttgatgatcttttcctgatattttataaaaacggcctgccctcagaaagaaatccatacgtctttaacggtgacttcgttgaccgcggcaaaaatagcattgagatcctgatgattctctgcgtgtcatttctggtgtaccccaatgacctacacctaaaccggggaaaccatgaagacttcatgatgaatttgagatatggctttactaaggaaatcctccacaagtataaactgcatggtaaacgcattctgcaaattcttgaggagttctacgcgtggttgcctatcgggaccatagtggacaacgaaatacttgtcatccacggaggcatcagcgagaccaccgacctgaatctgctgcatcgcgtcgagaggaataagatgaaatctgtgttgatccccccaacagaaacaaaccgcgatcacgataccgactccaaacacaataaggtcggagtgacatttaacgcccacggtcgcataaagacgaatgggagccccaccgagcacctgacggaacatgaatgggagcagattatcgacatactctggagtgaccctcgaggcaagaacggatgcttccctaacacctgtaggggcggaggctgttactttggtccggatgtcacctcaaagatcttaaataagtaccagttgaagatgctcattcgcagtcacgagtgcaagcctgagggttatgaaatttgccacgacggcaaagtggtaactatctttagcgcatccaattattatgaagaggggtccaatagaggagcatacatcaagttatgctccggaaccaccccccggtttttccagtatcaggtgaccaaggccacttgctttcaaccattacgccagcgggtcgacactatggaaaactccgccattaagatactgcgggagagagtcatttctcgcaagtccgatctcactcgggccttccagctgcaggaccacaggaaatctggtaaacttagtgtgagccagtgggccttttgcatggagaacattctgggcctgaatctaccttggcgttctctgtcgtcaaatctggtgaatatcgatcagaacggcaacgttgaatatatgtcctccttccaaaatatccggattgaaaaaccagtgcaagaggctcatagcacgctggtcgagactttatacagatatagaagcgatttagagattatctttaatgcgatagataccgaccactccggattgatttcggtcgaagaattccgagctatgtggaaactgttctcatctcactataacgtacatattgatgatagtcaggtcaacaagctggcaaacattatggatttaaacaaagatggctccattgacttcaacgaattcctgaaagccttctatgtggtacataggtacgaggatctgatgaagccagatgtaaccaacttgggatag

SEQ ID NO: 201608 - DNA, 1131 bp, Artificial Sequence
  Description of Artificial Sequence: Synthetic coding sequence
atgggctgcagcagcagcagcaccaagacccggcggagcgacaccagccttcgggcagctctcatcattcaaaattggtatagagggtacaaggcgagactgaaagcacgacagcactacgctcttacaattttccagtcaattgaatacgccgatgaacagggccagatgcagctatccacttttttctctttcatgctggagaattatacgcacatacacaaggaggaattggagctgcggaaccaatcacttgagtccgaacaggatatgcgagatcgctgggattacgtcgactccatcgatgtccccgattcatataacgggcccagactacagttccccttgacatgtacagatattgatttgctcctggaggcattcaaagagcagcaaatcttgcatgcgcattatgtcttggaggtcctcttcgaaacaaagaaggtcttaaagcagatgcccaatttcactcacatacagacctccccatccaaggaagtgaccatctgtggagatcttcacgggaaattagacgatctgttccttatattctataaaaatggcttgccatccgagaggaatccttacgtatttaatggcgacttcgtggacagaggaaagaactccatagaaattttaatgatactgtgtgtatccttcttggtgtacccaaacgacctgcatctcaaccggggaaaccatgaagattttatgatgaatctgaggtatgggttcactaaagagattcttcacaaatacaaactccacgggaaacgcatcctgcagatccttgaggaattctacgcctggctgcctattggaacaatagtggacaatgaaattctggtgattcatggaggtatctcagagacaacagacctgaatctgctgcacagagtcgaacggaataaaatgaagtcagtgctgatccctcctactgagacaaatcgtgaccacgacactgacagtaaacataataaagtgggagtgactttcaacgcccatggaagaatcaagaccaacggatcccccacagagcacctgaccgaacatgaatgggaacagtccggctactacgggaagcaacgacaccaggatatcaagagggaatccgactttaccaagaagtag

SEQ ID NO: 201609 - DNA, 1767 bp, Artificial Sequence
  Description of Artificial Sequence: Synthetic coding sequence
atgctggagaactacacccacatccacaaggaggagctggagctgcgaaaccagtctctcgagagtgaacaggacatgagggacagatgggattatgtcgactctatagacgtccccgacagctataatgggccacgcctgcagtttcccctgacatgtacggatatcgaccttctgctggaggccttcaaagaacagcagatacttcatgcccactatgtgctcgaagtgctgttcgagacaaaaaaagttcttaagcaaatgcccaattttacccatattcagacttctccaagcaaggaggtgactatctgcggcgatctccatggcaaactcgatgatctgttcttgatcttttacaagaatggattacctagcgagcggaacccatatgtgtttaacggcgactttgtcgaccgtggcaagaactccatcgagatcttgatgattttgtgtgtaagcttccttgtctaccccaacgatttgcatcttaatcgcggtaatcacgaggactttatgatgaaccttaggtacggatttactaaggaaattctgcataaatataagttacatggcaagaggattttgcagattttggaggaattctatgcctggttgccaatcgggaccattgtcgacaatgagattctggttattcatggcggcatatcagaaaccactgaccttaacctgctccacagagtcgagagaaacaaaatgaaatccgttctgatacccccaaccgagaccaaccgggatcacgacaccgacagcaaacataataaggtaggtgttacattcaacgcccacgggagaattaaaactaacggatctcccactgagcatcttaccgaacatgagtgggagcaaattatcgatatcctgtggtctgatcctaggggtaagaacggatgttttcccaacacatgtaggggcggaggctgctactttgggccagatgttacttcaaagatactgaacaaataccaactaaagatgctgatcaggtctcatgagtgtaaacctgaaggttacgagatttgccacgatggcaaagtcgtcacaatattttctgcttcaaactattatgaggagggtagcaacaggggcgcctacataaaactgtgtagtggaacaacacccagattcttccagtatcaggtaaccaaagccacctgttttcaaccactacgacagcgggttgatacgatggagaatagcgcgataaagatcctgagggagcgggttatcagtcgcaaatctgaccttacacgagcattccagctgcaagatcaccgcaagtcaggtaaactgagcgtctcccagtgggccttttgcatggagaacatcttagggctgaacttgccatggaggtctctgagctccaacttggtgaatattgatcagaacggcaacgtcgagtacatgtccagtttccagaatatcagaattgaaaaacccgtacaggaagcccattctactctggttgagaccctgtacaggtataggtccgatctggagatcatctttaatgctatcgatactgaccacagcgggctgatctctgtcgaggagtttcgagctatgtggaagctgttttccagtcactataatgtgcacattgatgattcacaagtaaacaagctggcaaacattatggacctcaataaagacgggagcatcgattttaacgagttcctcaaggccttttacgttgtgcatcggtatgaagacctgatgaagcctgacgtaaccaacttgggatag

SEQ ID NO: 201610 - DNA, 2262 bp, Artificial Sequence
  Description of Artificial Sequence: Synthetic coding sequence
atgggcagcggcaccagcacccagcaccacttcgccttccagaacgctgagagagcgtttaaagctgccgccctgatccaacggtggtataggaggtatgttgcccggctagagatgcgtagacgttgtacttggtccattttccaatcgattgagtatgccggtcagcaagaccaagttaaactgcatgattttttctcttatctcatggatcacttcattccgtcatcccataacgacagagattttttgacccgcatttttaccgaagacagatttgctcaggattcggaaatgaaaaaatgctctgattacgagtccatcgaagtgccggatagctataccggacctagactctccttccccctgctacctgaccatgccactgcccttgtggaggccttcagactgaaacagcagctgcacgcacgatatgtgctaaatcttttgtatgagaccaagaaacacctggtgcaattgccaaatataaatagagtgagtacctgctacagcgaggagatcactgtttgcggggatttacatggacagctcgatgatctgatttttattttctacaaaaacgggctgccaagcccagagagatcatacgtcttcaacggagatttcgtcgacagaggtaaggatagtgtggagatactgatgatcttgttcgctttcatgctcgtctatcctaaagagttccacttgaatcgcggcaaccacgaagaccacatggtgaacttgcggtacgggtttaccaaggaggtaatgaataagtacaaagtacatggcaaggaaatcctgcggactctccaggacgtcttttgctggttgcctctcgcgaccttgatagatgagaaagtgctgatccttcatgggggtgtgagcgatattacagatttggagctacttgacaagatagaaagatctaaaatcgtgtctacaatgcggtgtaagaccaggcaaaagagtgaaaaacaaatggaggagaaacgcagagctaatcagaagagcagcgcccagggccctattccttggtttctacctgagtctcgttcactcccatcttctccattgaggttgggcagctataaagcgcagaaaactagccgctcctcctctataccgtgcagtggtagccttgacggacgggagctgagcaggcaggtgaggagctccgtggagttggaacttgaacgatgccgccagcaagcagggctcctggtcacaggcgagaaagaggaaccgtctcggtccgcctcagaagcagatagtgaggcgggggaactgcgtaagcctacacaagaagagtggcgccaggtcgtggacatactgtggtctgatcccatggcccaggagggctgtaaggccaataccatcagaggcggaggttgttattttgggccagatgtaacccagcagctcttgcagaaatacaacatgcagttcctgataaggagccacgagtgcaagcccgaaggctatgagttctgccataaccggaaagtgttaaccatcttctccgcaagcaattactacgaagtgggctcaaatcgcggggcatatgttaaactgggaccagcccttacaccgcacattgtgcagtaccaggcgaataaagtcacccacactttgacaatgcgacaacgaatcagtagggttgaggaaagtgctctgagagcacttcgggaaaaactgttcgcccacagcagcgatctactttccgagtttaaaaagcacgatgcagacaaggtgggcttgatcaccctgagcgattgggctgcagcagtggagtctgtcctgcacctaggcctgccttggagaatgctgcgtccccagctggtgaactcttctgccgacaacatgttggagtacaaatcatggcttaagaacctggccaaggagcagctgtcaagggaaaatatccagtcaagtctattagagacgctctacaggaaccggagcaatctcgagacaatatttcgaatcatcgacagcgaccattctgggttcatctcactggacgaattcaggcagacttggaaactcttcagctcacacatgaacattgatattacagacgattgcatctgtgacctagctagaagtatcgattttaacaaagacggacacattgacataaatgagttcttagaagccttcagattggtggagaagagttgccccgaaggagacgcaagtgaatgcccccaggccaccaacgctaaggactccggctgtagctctccaggggcacattag

SEQ ID NO: 201611 - DNA, 1797 bp, Artificial Sequence
  Description of Artificial Sequence: Synthetic coding sequence
atgggcagcggcaccagcacccagcaccacttcgccttccagaacgcggagagagcctttaaagccgccgcgctgattcaacggtggtatcgcagatacgtcgcccggctggaaatgcggaggcggtgcacgtggagcatcttccagagtatcgagtacgccggccaacaggaccaggtcaaactccacgatttttttagctacctgatggaccatttcatcccatcatcacataatgaccgggattttcttacacgtatcttcaccgaggataggttcgcccaggactcggaaatgaagaagtgctccgactatgagtccattgaggtccccgactcttatacaggacccagactttcttttccgctgttacctgaccacgcaaccgccttggttgaggcctttcgtctgaagcagcagctacatgctcggtacgtgctcaatctgctatatgagacaaagaagcacctggtgcagcttcccaacataaacagagtgagcacatgttattcagaggagatcaccgtttgcggtgatctgcatgggcagctcgatgacctcattttcattttttataagaatgggctgccgtcccctgaacggagctatgtgtttaacggcgacttcgtggacagaggtaaagactcagttgagattttaatgattctcttcgcgtttatgctggtctatcccaaggagttccacctgaatcgcggaaatcatgaggaccatatggtcaacctgcggtacggtttcaccaaagaggtgatgaataaatacaaggttcatggtaaggagattctgagaacgctgcaggacgtcttttgctggctgcccctggctacattgatagatgagaaagtgttgatcctgcatggaggggtgtccgacatcaccgatctcgaactgctcgacaagatagaaaggagcaaaattgtctctacgatgcgttgtaagacacggcagaagtcagaaaagcagatggaggaaaaaaggagggcaaatcagaagtcatccgctcaggggcccataccctggttcttgcccgagagtcgcagcctgccttcaagcccactcagactgggcagctacaaagctcagaagacttcccgcagcagctcgatcccttgtagtggaagcttggatggtagagaactaagtcgtcaggtgcggtctagcgtggagttggagctcgagagatgccggcagcaggccgggctgctcgtgaccggagagaaagaggaaccatctcggagtgccagtgaggctgacagcgaggccggcgaacttaggaagcctactcaggaagaatggcggcaggtcgttgatatcctctggtctgacccgatggctcaggaagggtgcaaagcaaacacaatccgcgggggcgggtgctactttggccccgatgtcacgcagcaactattgcagaaatacaacatgcagtttctaatcagatcacatgaatgcaaaccagaaggctatgaattttgccacaacagaaaagtccttacaatttttagcgcttctaactattacgaagtgggctcaaatagaggagcttacgttaaactcggcccagcgctgacaccccatatcgtacagtatcaggccaataaggtgactcacactctcaccatgagacagagaatttcgcgagtggaggagtccgccctgcgcgctctccgggagaagctatttgcacatagttcagatctgctgtcagaattcaagaagcatgacgcagacaaagtgggccttgcaagctcccaactatgttactatcagcagaagtag

SEQ ID NO: 201612 - DNA, 1440 bp, Artificial Sequence
  Description of Artificial Sequence: Synthetic coding sequence
atgggcgccttcctggacaagcccaagaccgagaagcacaacgcccacggggccggaaatggcctgcggtacggtttaagttcaatgcaggggtggcgagttgagatggaggacgcccatactgctgtggtgggaattcctcatgggctggaagactggagcttctttgccgtgtatgatgggcacgctggctcaagagtcgcaaattactgctctacacacctcctggaacacattaccactaacgaggattttcgtgcagcgggaaaatcaggttcggctcttgaactgagcgttgagaatgtgaagaacggcatccggaccgggtttttgaaaatagacgagtatatgaggaacttcagtgacctacggaatgggatggatagaagcgggtccaccgctgtgggggttatgatctctcccaaacatatctacttcatcaattgtggagactctcgcgccgtgctgtaccgaaatggccaggtgtgttttagtacccaggaccacaagccctgtaatccaagagagaaagagcggattcaaaatgccgggggctctgtgatgatccagagagtcaatggctctctggcagtatcccgcgccttaggagattacgactacaaatgcgtggacgggaagggtcccactgagcagcttgtgagccctgaacccgaagtttacgaaattctccgggcagaggaagacgaattcatcatactggcttgtgacggcatctgggacgtgatgtcaaacgaggaactgtgcgaatacgttaagagcaggctcgaagtgagcgatgatctggaaaacgtgtgcaactgggtggtggatacatgcctccataagggctctagagataacatgtccattgtgctggtctgcttcagcaatgcccctaaggtcagcgacgaagcagtgaaaaaagacagcgagctggacaagcatttagaatctcgcgtggaggagatcatggagaagagtggtgaagaggggatgcccgacctggcccacgtgatgcgaattttatcagcagagaacattccaaatttgccccctggcggcggtctggccggaaaacggaatgttattgaggccgtgtattcgcgtctaaacccccatcgcgagagcgacggggcaagtgatgaagccgaggaatccggatcccaaggcaaactcgtggaggcattaaggcagatgcgcattaaccatcgaggaaactaccgtcagctgctggaagaaatgctgacctcctaccgcctggccaaagtcgagggggaggagtcaccagccgagccggcggccactgctacatcctcaaacagcgacgccgggaaccccgtgaccatgcaagagtcccatactgagtcagaaagcggcctggcagaactggacagcagtaacgaagacgccggcactaagatgagtggagagaaaatttag

SEQ ID NO: 201613 - DNA, 579 bp, Artificial Sequence
  Description of Artificial Sequence: Synthetic coding sequence
atgagcatcgtgctggtgtgcttcagcaacgcccccaaggtgagcgatgaagccgtcaaaaaggacagcgaactggataaacacctggagtctagagtggaggaaattatggagaagtctggcgaagaaggcatgcccgacctggcacacgtcatgaggatcctgagcgccgaaaacattcccaatttacctcccggcggcgggctggccggcaagagaaacgtgattgaagctgtttactcgcgtcttaatccccatcgtgagtcggacggcgcaagcgacgaagccgaggaaagcggatctcaggggaagcttgtagaagccctgcgccagatgcggatcaatcatcggggcaactaccggcagttgctggaagagatgctcaccagttacaggctggctaaggtcgagggagaagagtcccctgcagagcctgctgcaactgctacctcttcaaactccgacgctgggaatcctgtaacgatgcaagagtcacacacagaatctgagtccggcttggccgagctggactcaagcaatgaagacgcggggacaaagatgtccggcgagaagatttag

SEQ ID NO: 201614 - DNA, 1164 bp, Artificial Sequence
  Description of Artificial Sequence: Synthetic coding sequence
atgggcgccttcctggacaagcccaagaccgagaagcacaacgcccatggggctgggaatggtctccggtatgggctatcatctatgcagggatggagagtggagatggaagacgcacatacagccgttgtggggataccccacggcctggaggactggtcctttttcgccgtctacgacgggcatgctggttctcgggtggccaactactgctccacacatctgttggagcatattacaacaaatgaagattttcgggctgctggaaagtccgggtctgccctcgagctgtcagttgagaacgtgaagaacggaatccggacaggttttctcaagatcgacgaatacatgcgaaacttctcggatttgagaaacggtatggatcgttccgggtcaaccgccgtgggggtgatgatctcaccaaagcatatatacttcatcaactgcggagacagccgcgccgtactgtatcggaacggccaggtctgttttagcacacaggatcacaaaccctgtaatccgcgtgaaaaagagcgcatccaaaacgcgggaggctcagtgatgatccagcgggttaacgggagtcttgcggtgtctcgggcattaggtgactacgattacaaatgcgtagacgggaagggccctacagagcagcttgtttcacctgagccagaggtgtatgagattctccgcgccgaagaggacgagtttatcattttagcttgtgacgggatatgggatgtgatgagcaatgaggaactctgcgaatatgtgaaaagcagactggaagtttctgacgatttggaaaacgtgtgtaactgggttgttgatacttgcctgcataaggggagtagggataatatgagtatcgttctggtatgcttttcaaacgcccccaaagtgtcagacgaggccgtcaaaaaagactccgaactagataaacatctcgaaagccgtgtagaggagatcatggaaaaatctggagaggagggcatgcctgacctggctcacgtcatgcggatcctgagtgccgagaatatcccgaatctccctcctggcgggggacttgccgggaaacgaaatgtgattgaagcagtatattcacggttaaatccccaccgagagtcagatgggggggccggcgacttggaggacccctggtag

SEQ ID NO: 201615 - DNA, 1143 bp, Artificial Sequence
  Description of Artificial Sequence: Synthetic coding sequence
atgggcgccttcctggacaagcccaagaccgagaagcacaacgcccacggggccggcaacggtctcaggtatggcctatcctccatgcaaggctggcgagtagagatggaggacgcacatactgcagtggttggcattccacacggactggaggattggtctttctttgcagtatacgacgggcacgccgggtctcgagtggctaattactgttctacacacttactggaacacattacaacgaacgaggactttagagctgccggcaaaagtgggagtgctctggaacttagtgttgaaaacgtgaaaaacggaattcgcaccggctttttaaagatcgacgagtatatgcggaacttctctgacctgcgcaatggtatggacagatctggtagtactgctgttggtgtcatgatctctcccaagcacatttactttattaactgcggggattctagggctgtcctctaccggaacggacaagtgtgcttttcgactcaagaccacaagccttgcaacccacgggaaaaggagcggattcagaatgcagggggcagtgtcatgatccaaagggttaatgggtctcttgctgtctcacgcgcattaggcgactacgactacaagtgcgttgatgggaaggggcctaccgagcagctggtttcccctgaacccgaagtctacgagattttacgggctgaggaggacgaattcattatcttggcttgtgacggcatttgggatgtgatgtctaacgaagaactgtgtgagtacgtgaagagccggttagaagtgtctgatgatctcgagaatgtgtgtaattgggttgttgatacctgtctgcacaaaggttcacgcgataacatgagcattgtcttggtttgcttttccaacgcaccaaaagtgagcgatgaggcagtgaagaaggattccgagttggataaacatctggaatccagggtcgaagagattatggagaaatcaggtgaggaaggtatgcccgatctagctcacgtgatgagaattctgagcgcagaaaatattcccaacctacccccgggtggaggcctggcaggaaaacgcaacgtaattgaagcggtatattcccgtctgaatccccaccgcgagagcgacgggcagaaatag

SEQ ID NO: 201616 - DNA, 984 bp, Artificial Sequence
  Description of Artificial Sequence: Synthetic coding sequence
atgggcgccttcctggacaagcccaagaccgagaagcacaacgcccatggagcgggaaatgggctcagatatggactgagctctatgcagggttggagggtggaaatggaggatgctcacacagcagtggttggcatcccccacgggctggaggactggagttttttcgccgtgtacgacggccatgccggcagtcgcgttgctaattactgtagcacgcatctgctggagcatattactaccaatgaggattttcgcgccgccggcaaatccgggagcgctctggagctctcagtagaaaatgtcaagaatggtatacgaactggcttcttgaaaatcgatgagtacatgaggaattttagcgatctgaggaatggaatggatcgatccggttctactgcagtcggtgtgatgatctctcctaaacacatctactttatcaactgcggggattcccgcgccgtgctctataggaatggacaggtgtgtttcagcacccaggaccacaaaccatgtaacccccgcgagaaggaaaggatccaaaacgccggaggcagtgttatgatacagcgtgtcaatgggagtctcgccgtcagtagggctctgggtgactacgactacaaatgcgtggatggcaaggggcctacagaacagctcgtgtcgcccgaaccggaggtgtacgaaatcctgcgcgcagaagaggatgagtttatcatactggcctgtgacgggatctgggatgtgatgagcaatgaggagctctgtgaatatgtcaaaagccggctcgaagtgtccgatgacctagagaacgtgtgtaattgggtcgtagacacatgcctgcacaagggaagcagagataacatgtccatcgtcttggtatgtttctccaatgcccccaaagtaagcgacgaggccgtcaagaaagatagtgagttggataagcatctggagtcacgtgtcgagggtaagacaaatgccttctag

SEQ ID NO: 201617 - DNA, 1137 bp, Artificial Sequence
  Description of Artificial Sequence: Synthetic coding sequence
atgggcgccttcctggacaagcccaagaccgagaagcacaacgcccacggcgctggcaacggactgcggtacggcctgtccagcatgcagggctggcgcgttgagatggaggacgcgcatactgcggtagtggggatcccccacggcctggaggattggagtttttttgctgtctacgatggccacgcaggttctcgggttgcaaattattgttccacccacttacttgagcacatcacgaccaacgaggacttcagggcggcgggcaaaagtgggtccgctctggaactgagtgtcgagaacgtcaagaatgggatccggacaggatttctcaagattgacgaatatatgcgcaactttagcgatcttaggaacggaatggaccgttccggtagcactgccgtcggggtgatgataagccccaaacacatctactttatcaactgcggagacagccgtgccgtgttgtacaggaacgggcaggtatgtttcagtactcaagaccacaagccctgtaatcctcgggagaaggaaagaattcagaacgccggagggtcggtcatgatccagcgagtaaacgggtccttagcggtgtcaagagctctgggtgactatgactataaatgcgtcgatgggaaaggacctacagaacaactcgtgagccctgaaccggaggtatatgaaatcctgcgtgcagaagaggatgagtttatcatcctagcttgtgacggaatctgggacgtaatgtctaatgaggagctctgcgaatatgttaagtcgcgtctggaagtcagcgacgatcttgaaaacgtgtgcaattgggtcgtagacacctgcttgcataaaggcagccgcgataacatgtcaattgtgctggtctgcttcagcaacgccccgaaggtttcagacgaagccgtgaaaaaggattccgagctagataaacacctagagtcccgagtcgaagaaatcatggagaagtccggggaggaaggcatgcctgacctggctcacgtgatgagaattttatccgcagaaaatatccccaatctaccaccaggcggcgggctggctggaaagaggaacgtcatcgaggcggtatattcccgacttaacccccaccgggagtccgatggatag

SEQ ID NO: 201618 - DNA, 1518 bp, Artificial Sequence
  Description of Artificial Sequence: Synthetic coding sequence
atgctgaaccgggtgcggagcgccgtggcccacctggtgagcagcggcggggcacccccccctcgtccaaaatctcctgacctcccgaatgcagcgagtgcaccaccagccgctgcgcctgaggctcctaggtccccacccgctaaggccggcagcggctctgctactcctgctaaagcagtagaagcccgcgcatcgttttcgcgacctacctttctccaactctcccctggaggtctgcgacgagccgacgaccatgctggccgcgccgttcagagcccccccgacactggaaggagactgccttggagcacaggctacgccgaggttatcaacgcaggtaaaagtcgacataacgaggaccaggcctgctgcgaagtcgtgtatgttgaaggacgtcggagtgtgaccggcgtaccccgcgagccctcccggggacagggcctttgcttttactactggggtctgttcgacggtcacgctggtggaggggcggccgagatggcgagcagacttctccatagacacattcgcgagcaattgaaggatcttgtggaaatcctccaggacccctctccacccccgctgtgtctgcctacaacacctggaacccctgacagcagcgacccttcccacctacttggtccccagagttgttggtcctctcagaaagaggtttcccacgaatccctcgtcgttggtgcagtggaaaatgctttccaattgatggatgaacagatggcaagggaacgacgcggtcatcaagtggagggagggtgctgtgccttggtcgtgatctacctgctgggcaaagtttacgtggcaaacgccggcgacagccgcgctataattgtgaggaacggcgagatcatcccaatgagccgagagttcacccctgaaactgaacgtcagcggcttcagctcctgggctttctaaagcccgaactgctgggcagtgagttcacacatttggaattccccaggcgtgtgttacccaaggagttgggccagcggatgctttaccgggatcagaacatgaccgggtgggcatataagaagatagagctggaggatttgagattccctctggtatgtggggagggcaaaaaagcgcgcgtcatggcaaccattggcgtgacacgcggtctcggagatcactcgttgaaggtgtgtagcagcacactcccaatcaagcccttcttgtcgtgtttccctgaggtgagagtttacgacctgacgcagtatgagcactgccctgatgacgtgttggtacttggcactgatggactttgggatgttaccaccgactgcgaggtcgccgcaacggtggaccgggtattgagtgcctacgaacccaacgatcattcacggtacacggcgctggcacaggcactcgtcttaggagctagggggactccgcgcgatagaggctggcggctgcccaacaacaagctgggaagcggagatgacatcagtgtgttcgttatcccactaggcggccctggttcctatagttag

SEQ ID NO: 201619 - DNA, 900 bp, Artificial Sequence
  Description of Artificial Sequence: Synthetic coding sequence
atggccagccggctgctgcaccggcacatccgggagcagctgaaggatctcaaggaggtttctcacgaaagtctggtggtcggggccgttgaaaatgcgttccagctgatggatgagcaaatggccagggagcgaaggggacatcaggtggaaggcggatgctgcgcccttgtggttatctatctgctggggaaggtctatgtagcaaatgccggggactcgagagcaatcatagtccgaaatggtgagattatacccatgtccagagagttcactcctgagactgagcgccagcgacttcagcttctgggatttctgaagcctgagcttctggggtctgagttcacacatctggaattccctaggagagttcttccgaaggaactcgggcaaaggatgttgtacagggaccagaacatgaccgggtgggcctataagaaaatcgagcttgaggacctccggtttccacttgtgtgcggagagggaaagaaggcccgggtgatggccacaatcggggtgactaggggcctcggtgaccatagcctgaaggtttgctcatcgaccttgcctattaagccattcctctcttgctttcccgaggtgagagtttacgacctgacacaatatgagcattgccctgacgacgtcctcgtcttaggcaccgatggtctgtgggatgtcaccacagactgcgaggtggctgctactgtcgacagggtgctaagcgcttatgaaccaaacgatcacagcagatacaccgctctggcgcaggccttggtactcggtgcacgggggactcccagagatcgtgggtggaggctgcccaacaacaagcttgggagcggagatgacatctccgtgttcgtcattccactgggcgggccgggctcatattcatag

SEQ ID NO: 201620 - DNA, 1119 bp, Artificial Sequence
  Description of Artificial Sequence: Synthetic coding sequence
atgagcaccgccgccctgatcaccctggtgcggagcggcggcaaccaggtgcgcagaagggttctcctatctagccgcttgctgcaggatgatcgccgagtcaccccgacatgtcacagttctaccagtgagccaagatgctcccgcttcgatcctgatggttcaggaagtcccgccacctgggacaacttcggaatttgggataaccgaattgacgaaccaatcctgcttcctccctcaatcaaatacggtaagcctattcccaaaatttctctggagaacgtgggatgtgcaagccaaataggcaaacggaaggaaaacgaggacagattcgactttgcccagctgaccgacgaagtgttatacttcgcagtatacgacggtcacggtggtcccgctgctgctgacttttgccatacacatatggaaaaatgcatcatggatctgctgcccaaggaaaagaatctggagactctgctgacactggctttcctggagattgacaaggcattcagctctcatgcaaggttgtctgccgatgccacactactgacgtcaggcactacggcaaccgtcgctctgctgcgagacggcattgagctggttgtcgcttctgtaggagacagtcgtgccatcttatgccgaaaagggaagcctatgaagctgacgattgaccatacgccagagcgcaaggacgagaaagaacgcataaagaagtgtggtggcttcgtcgcatggaacagcttaggccagccgcatgtaaacgggagactggcaatgacccggtccatcggtgatctggaccttaagacctccggtgtgatagcagaaccggaaacaaaacggataaagctgcaccacgcagacgatagttttctcgtgctcacaacggatggtatcaatttcatggtgaattcccaggaaatctgcgatttcgtaaaccaatgccacgaccctaacgaagcagcacatgccgtcacagagcaggcgattcaatacggaacggaggacaatagtacagcggtggtcgtgccattcggtgcttgggggaagtacaagaactctgagattaacttctcattcagccgtagtttcgcaagttccggacgatgggcttag

SEQ ID NO: 201621 - DNA, 702 bp, Artificial Sequence
  Description of Artificial Sequence: Synthetic coding sequence
atgagcaccgccgccctgatcaccctggtgcggagcggcggcaaccaagtaagacggagggtcctgctgtctagcaggctgctgcaagacgatcgccgcgtgacaccaacatgtcactcctcgacatcagagccccggtgctcacgattcgaccctgatggctccggatctccagctacctgggacaacttcggaatctgggacaaccggattgatgagcccatacttctgccgccaagtattaagtacgggaaacctatccctaagatttctctggaaaacgttggatgcgcttcacagatcgggaaaaggaaggaaaatgaagaccgctttgatttcgcccagctgaccgacgaggtgctgtacttcgcagtctacgacggtcacggaggccctgccgcagccgacttttgccacacacacatggagaaatgcattatggatctgttacctaaagagaaaaatcttgaaacgttgctcaccctggcttttctggagattgataaagcattctcctcgcacgcgcggctaagtgccgatgagaattgcgcctggtcagccgcactcgacctcgagcctgttgataccatctgtggtgcgagtgtggaaagagaaatttgtctaattctgagccaagtcaaagagtcttcagggtcctaccccggactgagagagggaagtcatatcagtctatcccattag

SEQ ID NO: 201622 - DNA, 702 bp, Artificial Sequence
  Description of Artificial Sequence: Synthetic coding sequence
atgagcaccgccgccctgatcaccctggtgcggagcggcggcaaccaggtgaggcgtagagttctcctgagctctcgtctcctgcaggacgatcgacgggtcactcccacttgccactctagtaccagcgaacctcgatgttcccggttcgaccctgacgggtccggcagtccggccacttgggataacttcgggatctgggataataggattgacgagccaatcttgttgcccccttccattaagtatggcaagcctatccccaagatctcgctggaaaatgttggatgtgcttcccagattggaaaacgaaaggagaacgaggataggtttgacttcgctcaactaacggacgaagttttatatttcgccgtatatgacggccatgggggccctgctgcggccgacttctgccacactcacatggaaaagtgtattatggatctccttccgaaggaaaagaacctggaaaccctcctgaccctggctttccttgaaatcgataaggcgttttcaagtcacgcaaggctgtcagccgatgagaactgcgcatggtccgccgcgctcgacctcgagccagttgacaccatttgtggtgcgtcggttgagagagaaatttgcctgatcctctcacaggtcaaagagtctagcggaagttacccggggttacgtgagggcagccacatctccttgagtcattag

SEQ ID NO: 201623 - DNA, 585 bp, Artificial Sequence
  Description of Artificial Sequence: Synthetic coding sequence
atgatcgaggacaccatgaccctgctgagcctgctgggccggatcatgcggtactttctgttaaggcccgaaaccttattccttctgtgtatctccttggccctgtggagctactttttccatacggacgaggtaaagacaatcgtgaaaagctccagagatgctgtgaagatggtgaaagggaaggtggcagagattatgcaaaatgaccgcctcggcggcctagatgttctggaggctgaattctcaaaaacgtgggagttcaagaatcataatgtagccgtctactcaattcagggacgcagagaccatatggaagatcgatttgaagtattgacagatttagctaacaaaacccaccctagtatctttggaatttttgatgggcatggtggagaaactgcagccgagtatgtaaaaagtagactgcctgaagccctcaaacagcacctccaggactacgaaaaggataaagaaaactcggttctgagttaccagactatcctcgagcagcaaattctcagtatcgaccgtgagatgctcgaaaagctaacagtgtcatatgacgaagccgttacattctag

SEQ ID NO: 201624 - DNA, 1083 bp, Artificial Sequence
  Description of Artificial Sequence: Synthetic coding sequence
atgatcgaggacaccatgaccctgctgagcctgctgggccggatcatgaggtacttcctcttgagaccagaaacactgttcctgctttgcatatcactggccctgtggtcttatttttttcacactgacgaagtgaaaactatcgttaagagctcccgcgatgccgttaaaatggtgaagggcaaggtagccgaaatcatgcagaatgatcgcctaggggggctcgatgtgctggaagctgagttttccaaaacatgggagttcaagaatcacaacgtcgctgtgtattcaattcagggcagacgagatcatatggaggatcgcttcgaggtcttaacagatttggctaataagacccatccttccatctttggaatcttcgatggtcatggtggagaaactgctgcagaatacgtgaagtcaagattgcccgaagcgctgaagcagcatcttcaagactacgagaaggataaagaaaatagcgtcctgtcgtaccagaccatccttgagcaacagatcttgtcaatcgatagagaaatgctggagaaactgaccgtgagctatgacgaggctggtaccacttgtctgattgccctactctccgacaaagacctcactgtggcgaatgtgggagacagtcgtggagtgctgtgcgataaggacggaaacgccatccctttatcccatgatcataagccttatcaattaaaggagagaaaacgaatcaagagggccggtggttttatttccttcaatggttcatggcgggtacaagggatactggctatgagcagaagtttaggcgactatcccctgaaaaacctaaacgtcgttatccctgatccggacatcttgaccttcgacctggacaaattgcagccagagttcatgatactggcgtccgacggtttgtgggatgccttctcaaacgaagaggcagttcgatttattaaagaacggctggacgagccacatttcggtgccaagagtattgtgttacagagcttttacaggggatgcccagataacatcacagtcatggtggtgaagttcaggaacagctcgaagacagaggaacagtag

SEQ ID NO: 201625 - DNA, 813 bp, Artificial Sequence
  Description of Artificial Sequence: Synthetic coding sequence
atgcacctgaacggccggtgcatctgccccagcgacccccagttcgtggaggagaagggtattcgcgctgaggacctggtgatcggtgccctggagtccgcatttcaggaatgcgacgaggtgatcggaagggaattggaggctagcggacagatggggggctgtaccgctcttgttgcggtgtcactgcagggaaagctgtacatggccaacgctggtgacagccgggccattttggtgcgcagggacgagatcaggcctttgtcattcgagttcacgccagaaaccgaacgccaaagaatccagcagctggcgttcgtgtaccccgaattgctggccggagaatttacacgactggagtttccgcgaaggctgaaaggggacgacttgggtcagaaggtgctattcagagatcatcatatgtccggttggagctataagagggtggagaagtccgatttaaaataccccctgattcatggtcagggcagacaggcaagactgctgggtacactcgcggtgagccgaggcttgggtgatcatcagctgagagtcctggatactaacatccagctgaagcccttcctgctaagcgtgccgcaagttaccgtgctggatgttgaccaattagaactgcaggaagatgatgtggtggtgatggccaccgacggcttgtgggacgtgctctcaaatgagcaagtcgcgtggctagtgcgctctttccttcccggaaatcaggaggaccctcaccgctactgtagctgctggggaccagcctgggcatgggtgggagcttcttccaagcctaagtag

SEQ ID NO: 201626 - DNA, 897 bp, Artificial Sequence
  Description of Artificial Sequence: Synthetic coding sequence
atgcacctgaacggccggtgcatctgccccagcgacccccagttcgtggaggagaaaggcataagagccgaggatcttgtgataggagccctcgagtctgctttccaggaatgcgacgaggtgattggcagggagctcgaggcctcaggccagatgggtgggtgtaccgccctggtagcagtgtccttacaaggtaagttgtatatggcaaatgcaggggatagtcgcgcaattctggtcagacgggacgagattcgcccccttagcttcgagttcacccccgaaaccgaaaggcagagaatccagcaactcgcctttgtctatccagaactactggcgggtgagtttacccgcctggaatttccacgacgcttaaagggtgatgatctgggccagaaggtcctgtttagggaccaccacatgagcggatggtcatataaacgagtggaaaagagcgatcttaagtatccacttattcacggccagggacggcaggcacgcctgctgggtacattggcggtctccagaggactgggcgaccaccagcttagggtgttagatacaaatattcagctcaaacctttcctgctgtctgtgccccaagtcaccgtgctggacgtcgaccaactcgaactgcaagaagacgatgtcgtggtgatggccacagacgggttgtgggatgttttaagtaacgaacaggttgcttggctagtgagatcattcctgcctgggaaccaggaagatcctcaccgattctcgaagctagctcagatgttgattcactcaacccagggaaaagaagacagtttgaccgaggagggtcaggtctcatacgatgacgtgtctgtcttcgttatccctttgcacagccaaggccaggagtcaagcgaccattag

SEQ ID NO: 201627 - DNA, 744 bp, Artificial Sequence
  Description of Artificial Sequence: Synthetic coding sequence
atgggcggctgcaccgccctggtggccgtgagcctgcagggcaagttgtacatggcaaacgccggcgactcacgagcaatcctggttagacgcgatgaaatcaggccccttagttttgaattcacaccagagacagagcggcagaggatccaacagcttgcatttgtctatcctgagttgctggccggggaatttacccgcctggagtttcctcgcagactgaaaggcgacgatctgggacagaaagtgctcttccgtgatcatcacatgtcgggctggagttataaaagagtggagaagagtgaccttaaatatcctctgattcatgggcaaggacgtcaggcacgtctcctcggaactctagccgtctctagggggctgggggatcatcaattacgcgttctggataccaacatacaactcaagccatttctgttatcggtccctcaggtgaccgtcttggacgtggatcagctggagctgcaggaagacgacgtagtagtgatggccaccgacggcttgtgggacgtcctcagtaacgagcaggttgcctggcttgtgcgctcattcctacctggtaatcaggaggacccacatcgcttcagtaagctggcacaaatgctgattcatagtactcaagggaaagaggattctctcacggaggaagggcaggtctcttacgacgatgtttccgttttcgttatccctctgcactcccagggtcaggaaagcagcgatcactag

SEQ ID NO: 201628 - DNA, 1380 bp, Artificial Sequence
  Description of Artificial Sequence: Synthetic coding sequence
atgagcgccggctggttccggcggcggttcctgcccggcgagcccttgcccgcgccacgaccaccaggccctcacgcgtcccccgtaccctacaggcgcccacggtttctccgaggaagcagtagcagcccaggcgccgccgacgcttcccgacgaccagatagcagacccgtgcgatcgcccgcgcgcgggagaaccctgccctggaacgcagggtacgccgaaatcatcaacgcagaaaagtccgaatttaatgaggatcaggcagcttgcggcaaactctgcataagacggtgcgagttcggagccgaagaagaatggctcaccctgtgtccagaggaatttctcaccggccattattgggctctgttcgatggtcacggtgggcccgccgccgcgatcctcgccgccaacaccctccatagttgtttgcgccgccagcttgaagccgtggtggaggggttagtcgctacccaaccacccatgcatctcaatggccggtgcatctgtccttcagacccccagttcgtggaagaaaaagggattcgagccgaagacttagtgataggcgcactggagtccgcttttcaggagtgtgacgaggtgattggccgcgaactggaggcgagcggacagatggggggttgtactgcgttggtggcagtaagcttgcaggggaagctatacatggccaatgctggggacagccgagccatcctggtgcggcgtgatgaaattcgaccgctgtccttcgaattcacccccgagactgagcggcaaaggatccaacaactggcctttgtgtacccggagctgctggccggggagttcacccgcctggagtttcctagaaggctgaagggtgatgacctgggtcaaaaggtcctctttagagatcaccatatgagcggctggtcatataagcgggtcgagaagtccgacttaaagtacccactcattcacgggcaaggtcgacaggcccgtctactcggcacactggccgtgagtcgcggcctgggtgaccaccaactacgagtgttggatacaaatattcaactgaagccctttttgttgtcagtccctcaggtgacagttctggacgttgatcagttagaactccaggaagatgatgtcgttgtgatggctactgatgggttatgggatgtcctgagtaacgaacaggtagcatggttagtgcggtccttcctccccggcaaccaggaggatccccatcgattctctaagctagctcaaatgttgatccattcaactcagggcaaagaggatagccttaccgaagaggggcaggtgtcttacgacgacgtcagtgtgttcgttatacccctacattcgcagggacaagaaagcagcgaccattag

SEQ ID NO: 201629 - DNA, 1821 bp, Artificial Sequence
  Description of Artificial Sequence: Synthetic coding sequence
atgcggcggagcgaggtgctggccgaggagagcatcgtgtgcctgcagaaggccctcaatcacctacgggaaatttgggaactgattgggattcctgaggaccaaagattgcaacggaccgaggtagttaagaagcacataaaagagttgctggatatgatgattgctgaggaagagtccctgaaggaacggcttataaaatcaatcagcgtgtgtcagaaagaacttaacaccctgtgcagtgagttgcacgtcgaacccttccaggaagaaggcgagacaactatcctgcaattagagaaagatctgaggacgcaagtggagcttatgaggaaacaaaagaaagagcgcaaacaggagctgaagctcctgcaagagcaggatcaggagctgtgtgaaattctctgtatgccacactacgacatcgatagcgctagtgtgccatcactggaggaattgaaccagtttcgccagcacgtcactacgctacgtgaaactaaagcctcgaggagagaagagttcgtgagtataaagagacagatcatcttgtgcatggaggcccttgaccacacgccagatactagctttgagagagacgttgtgtgcgaagatgaagacgctttctgtctgtctctggaaaacatcgcaacactgcaaaagctgctgcgacaacttgaaatgcagaaaagtcagaatgaagccgtgtgtgaggggttgcgcacacagattagggagctatgggatcggcttcagatcccagaggaggagagagaagctgtggccaccataatgtccgggagcaaggctaaagttagaaaggctctgcagctcgaagtcgataggcttgaggagttgaagatgcagaatatgaaaaaggtaattgaggcaatccgcgtcgaactcgtacagtactgggatcagtgtttttattctcaagaacagaggcaagccttcgctccattctgtgctgaagactacactgagtcgctgctccaactgcatgacgcagagatagtgcgcctcaagaactactatgaggttcataaggaattattcgagggggtccagaagtgggaggagacttggcgactatttctggaattcgagagaaaggcaagtgatcccaaccggttcaccaaccgcggcggtaatctcttgaaagaagagaagcagcgagccaaactgcagaagatgttgcccaagctggaggaagaattgaaggctagaatcgaactgtgggagcaggagcactcaaaagctttcatggtgaatgggcaaaagtttatggagtatgtagccgagcagtgggagatgcacagactggagaaagagagagcaaaacaggaacgacaattgaagaacaagaaacagacggagaccgagatgctttatggctctgcacccaggaccccatccaagaggcgcggccttgcccccaacacacccggcaaagcgaggaaactgaacactacaacaatgagcaacgcaacggccaacagttcaattcgccccattttcggcggaactgtctaccacagcccagtgtcccgcctgccaccctccggaagtaagcccgtcgcagcctctacatgttctgggaagaagactccacggaccggacgccatggtgcaaacaaggaaaacctggagctgaacggcagtatcctgtctggtggatatcccggtagcgccccactccagcggaatttcagcatcaattcggtggccagtacgtatagtgagttcgcccgagagctgagtaaggcttcaaagagcgatgccacgtccggcattttaaattccaccaacatccagagttag

SEQ ID NO: 201630 - DNA, 1701 bp, Artificial Sequence
  Description of Artificial Sequence: Synthetic coding sequence
atgcggcggagcgaggtgctggccgaggagagcatcgtgtgcctgcaaaaggcacttaatcacttaagagaaatctgggaactcattgggatccccgaagaccagcgtctgcagcgaacagaagttgttaagaagcacatcaaggagctccttgatatgatgatcgctgaagaggagtccttgaaggagcgcttaattaagagtatcagcgtgtgccagaaggaacttaatacgctgtgcagcgaacttcacgtggagccttttcaggaagagggcgagactacaattctccagctggaaaaggacttaagaactcaggttgagctgatgagaaagcagaaaaaagagaggaaacaggagctcaaactcctccaggaacaggaccaagagctgtgcgagatcttatgcatgccacactacgatattgactcggcttcagttcccagcctggaggaactgaaccagtttcgtcagcatgtaacgacccttagggaaaccaaagcatccaggcgggaggagttcgtgagcataaagaggcagattattctatgcatggaagccctcgatcacacccccgacacctctttcgagcgggatgtagtgtgtgaggacgaagacgctttttgcttatctctggagaacattgctacactgcagaagctgctgcggcagctcgagatgcaaaaatcacaaaacgaggccgtgtgtgaagggttacgtacacagatcagagaactgtgggataggctgcaaatccccgaagaggaaagggaggctgtagccactatcatgtccggcagtaaagccaaggtccggaaggcgctgcagctggaggtggaccgtcttgaagagttaaagatgcagaatatgaaaaaggtgattgaagctatccgcgtggaattggtgcagtactgggatcaatgcttctacagtcaggagcagagacaggcctttgcccctttttgtgccgaggactataccgaatcattgttgcagctgcacgatgcagagattgtccgcttgaagaattactacgaagtccacaaagagcttttcgaaggtgtgcagaagtgggaggagacctggaggctcttcctcgagttcgagcggaaggcaagcgatcctaaccgctttacaaacagggggggaaatctcctaaaggaagagaaacagagggcaaagctgcagaagatgctccccaagttggaggaggagctgaaagccaggattgagctgtgggagcaggaacattctaaagcttttatggtgaacggtcaaaagttcatggaatatgtggctgagcagtgggagatgcatcgactggagaaagagagggccaagcaggagagacagctgaagaataaaaagcagaccgagacagaaatgctctatggttctgcccccagaacacccagtaaaaggagaggtctcgctcctaatacccccggtaaggcacggaagttgaacacaactactatgagcaatgcaacggcgaattcttccattcggcctatttttgggggcactgtgtatcatagccccgtctctcggcttcccccgagcggatcgaagcccgtggcagcatcaacgtgctccgggaagaagacacctcgcacgggaagacacggcgcaaacaaagagaaccttgaactgaacggcagcatcttaagtgctagaacctttaagggctttcaaatttag

SEQ ID NO: 201631 - DNA, 1863 bp, Artificial Sequence
  Description of Artificial Sequence: Synthetic coding sequence
atgcggcggagcgaggtgctggccgaggagagcatcgtgtgcctgcaaaaggctctcaatcatcttagagaaatctgggagttgataggaattcccgaggatcagcggctgcaaagaacagaggttgtgaagaagcatattaaggagctgctggatatgatgatcgcagaggaagaatctcttaaggagcgtttgattaagtccatttccgtttgtcagaaagagctgaacaccttgtgctcagagctgcatgttgaaccttttcaggaggagggagagactaccatcctacagctggaaaaagacctgagaacacaggtcgagctcatgcgcaagcaaaagaaagagagaaaacaggagctaaaacttctccaggaacaggatcaggagctgtgcgagatcctgtgcatgccccactatgatattgattcggccagcgttcctagtctggaggagttaaaccagttccggcagcatgtgaccaccctgagagagacgaaggccagtcggcgcgaggaatttgtctcaattaaacgccagattatcctgtgcatggaagccctggaccacacaccagatacttctttcgagcgggatgtggtctgtgaagacgaggacgctttttgtcttagtttggaaaatatcgccaccctccagaagttgttgagacagcttgaaatgcaaaagtcccagaacgaggccgtgtgtgagggactccgaacccaaatcagagagttgtgggataggttgcagattcctgaggaagagcgggaagcagtggccactattatgtccggctccaaggccaaggtaagaaaagcgcttcaattggaggtagatcgacttgaggagttgaaaatgcagaatatgaaaaaagttattgaggcaattagggtcgaactagtacagtattgggaccaatgcttctatagccaggaacaaagacaggcattcgctcctttctgtgccgaagattatacggagtctctgttacagttacacgatgccgagattgtgcggttaaaaaactactatgaggttcataaagagctttttgagggagttcagaaatgggaggaaacatggcgattatttctggaattcgagcgaaaagcctccgaccctaaccgattcaccaaccgcggcggcaacttgctgaaagaagagaagcagcgcgccaagcttcaaaagatgctccctaaactcgaggaggaacttaaagcacgcattgagctgtgggagcaggagcactctaaggcatttatggtcaatgggcagaaattcatggagtatgtcgcagagcaatgggagatgcacagactggaaaaggaaagggccaaacaagagaggcagttaaagaacaagaagcaaactgagactgagatgctttatggaagcgcaccaaggacaccgtccaagaggaggggtcttgcccctaacacccccggaaaggccagaaagttgaacacaaccaccatgtctaacgctacagctaacagctcaatccggcccatctttggaggcactgtgtatcattcccccgtctctcggctccccccgagcggcagtaagcccgtcgccgcgagcacctgctccgggaagaagacacccaggactggacgacacggagccaacaaagagaatttggaactgaatggatccatcttgtccggagggtatccagggtcagccccgcttcagaggaattttagtataaacagcgtggcctccacttactccgaatttgccaaggaccctagcctgagtgactcttctaccgtgggtcttcagcgcgagttaagcaaggccagtaagagcgatgctacctctggaatcctgaatagcactaatattcaaagttag

SEQ ID NO: 201632 - DNA, 1578 bp, Artificial Sequence
  Description of Artificial Sequence: Synthetic coding sequence
atgcggcggagcgaggtgctggccgaggagagcatcgtgtgcctgcagaaggcacttaaccacctgcgagaaatctgggaacttatcggcatccccgaggaccagcgcttacagcgcacagaagtcgtgaagaagcacatcaaggaggagggcgagaccaccatacttcagttggaaaaggacctgagaacacaggttgagttaatgagaaaacagaagaaggagagaaagcaagagctgaaactgctgcaggaacaagaccaagaactctgtgaaattctctgtatgcctcactatgacattgactcagcctccgtgccctccctcgaggaattgaatcagttcaggcagcatgttactacattaagagaaaccaaggcaagccgcagagaggagttcgtcagcatcaagagacaaatcattctgtgcatggaggctcttgatcatacacccgatacaagctttgaacgagacgtcgtgtgcgaagatgaagatgctttctgtctgagtctcgagaatatagccacactgcagaaattgctgcggcagttggagatgcaaaagagccagaatgaggccgtatgtgagggcttacggactcagattcgggagctgtgggatcggctgcagattcccgaggaggagagagaagccgtagcaacgattatgtcagggtccaaggctaaagtgcggaaggccctgcagctggaggttgacagactggaggagctgaagatgcagaacatgaagaaggtgatcgaggccatacgggtggagttagtccagtattgggatcaatgtttttattcgcaagaacagcgtcaagccttcgcacccttttgcgcagaggattataccgagtcccttcttcagctccatgacgctgagatcgtgcgcctgaaaaattactacgaagtacataaggaactgtttgagggagtgcaaaagtgggaggaaacctggcggctgttcctggagtttgaaaggaaagcctccgacccaaacagattcacgaaccgcgggggcaacctgctgaaagaggagaaacagcgcgccaaactgcagaagatgctacccaagttggaggaagagctgaaggctagaatagagctgtgggaacaggaacacagcaaggcctttatggtcaacggtcagaaatttatggagtatgtagccgaacaatgggaaatgcaccgtcttgaaaaggaaagggctaagcaagagcggcagttgaagaataaaaaacagaccgaaacagagatgctgtacggatcggctccgaggacgcccagcaaaagacggggtctggcacctaacaccccaggcaaagccaggaagctcaatacaactaccatgagcaatgccaccgccaatagcagtataagacctatttttggcggtacagtgtatcactcccccgtctctcgcctgccaccgagcggttcgaagccagttgcagcttccacttgctccggaaagaagactcccagaacagggcgtcacggagccaacaaggagaacctcgagttgaatggcagcatcctcagcgctagaacatttaaaggcttccagatctag

SEQ ID NO: 201633 - DNA, 696 bp, Artificial Sequence
  Description of Artificial Sequence: Synthetic coding sequence
atgcgggtgctgggcggccggtgcggcgccctgctggcctgcctgttgctcgtgctgcccgtaagcgaggccaacttttgtctctactttaggaacgatttcatatacaacagagcgtgcatttctgttctcgtggggctgtccgggtgcaattttttctactctatttgttttctttctaagcagcaagcctcacaagttctggtcagaaagcgccgtgccaattctctgctcgaggagactaaacagggcaatctggagagagaatgtatcgaagagctatgcaataaagaggaagcccgggaagtatttgaaaacgacccagagacagactatttctatccaaagtacttggtgtgtcttcgtagctttcagactggtctgttcaccgccgccaggcagtccaccaatgcctatcccgacctgcgctcctgtgtaaacgccattcctgatcaatgttcaccccttccgtgtaacgaggacggctacatgagctgtaaagacggcaaggcctcctttacatgcacatgcaagccgggatggcagggggaaaagtgcgagttcgatattaatgagtgcaaggatccctctaacatcaatggcggctgcagtcagatatgtgacaacacgccaggctcttaccattgttcctgcaaaaatggatttgtgatgctgtccaataagaaggattgctag

SEQ ID NO: 201634 - DNA, 2031 bp, Artificial Sequence
  Description of Artificial Sequence: Synthetic coding sequence
atgcgggtgctgggcggccggtgcggcgccctgctggcctgcctgctcctggtcttgcctgtctccgaggctaacttcctttctaagcagcaggcttcgcaggtcctggtccggaagcgcagagccaactccctgctagaagaaaccaaacaggggaatctcgaaagggaatgtatagaggaactttgcaataaggaggaggcaagggaggtgtttgagaacgaccccgagacagactatttttacccgaaatatttagtgtgcctgcggtcgtttcagacggggctcttcaccgctgccagacagagcacaaatgcatacccagaccttcgcagctgcgtgaatgccattccagaccagtgcagtcccttgccttgcaatgaagatgggtatatgagctgcaaggatggcaaagcgtcctttacttgcacttgcaaaccaggctggcaaggagagaaatgtgagtttgatataaacgaatgcaaggatcctagcaatattaatggcggatgttcacagatttgtgataacaccccaggctcttatcactgctcctgtaaaaacggttttgtgatgctctctaacaaaaaggattgtaaggacgtcgacgaatgcagccttaaacctagtatttgcgggacagccgtctgtaaaaatatcccaggtgattttgagtgtgaatgccctgaaggctaccgctataatttgaagtccaagtcctgcgaagacatcgacgagtgctctgaaaatatgtgcgcgcagctctgcgtgaattatcccggaggctacacctgctactgcgacggaaaaaaaggatttaaactagctcaagaccagaaaagctgtgaggttgtctctgtgtgcctccctcttaacttggacacaaagtacgaattactctatctagctgagcagttcgcaggtgtagtcctctatctcaaattcagactgcctgaaatcagtaggttcagtgccgaattcgatttcagaacttacgactcagagggagtgattctgtatgccgagtccatcgatcactcagcatggctgctgatcgctcttaggggcggcaaaatcgaggtccagttaaagaatgagcacacgtccaagatcactaccggcggagacgttattaacaacggcctgtggaacatggtgtccgtggaggaactcgagcatagtatttcaatcaagatcgctaaggaagctgttatggacattaataagccaggcccactcttcaagccggagaatggactgctggagaccaaagtgtatttcgcaggctttccccgcaaggtggaatcagagctgattaagcctatcaatccccgattggacgggtgtattcggtcttggaatctgatgaagcaaggcgcttctggcatcaaggagattattcaggagaaacagaacaagcattgccttgtcacagtcgagaagggctcttattacccaggcagcggaatcgctcagttccacattgattacaataatgtctccagcgcggaggggtggcacgtgaatgtcacccttaatatcaggcccagcacaggtactggcgtgatgctggctttagtcagtggtaacaatacagtccctttcgcagttagcctcgtggactctacctccgaaaagtctcaggacatactcctgagtgtggaaaataccgtaatttaccgaatacaggcccttagcctatgttcagatcaacaaagtcacctcgaattccgagttaaccgcaataacctggagctgtcgacccctctcaaaatagagaccatttctcacgaggacctgcagagacagctggcggtactggacaaggcgatgaaagcaaaagtggcgacctatctgggtggcctccctgacgtgccattctctgccactccagtgaacgccttttataatgggtgtatggaggttaacataaacggcgtgcagctcgacctggatgaagcgattagcaagcataatgacattcgcgctcactcctgcccatccgtgtggaaaaagacaaaaaactcatag

SEQ ID NO: 201635 - DNA, 1275 bp, Artificial Sequence
  Description of Artificial Sequence: Synthetic coding sequence
atgggctgcggcaccagcaaggtgctgcccgagccccccaaggacgtccaactcgatctggttaaaaaggtagagcctttctctggaaccaagtcagatgtttacaaacatttcatcaccgaggttgactcggtgggaccagtgaaggccggattccccgctgcctcacagtatgcccacccttgcccgggcccacccacagcggggcataccgaaccgcccagtgagccccctcgcagggcccgcgtggccaaataccgggctaaattcgatccccgggtgactgcaaaatacgacatcaaggccctaattggtaggggaagcttttcaagagtcgtgagagtggaacatcgagccacccgtcagccctacgctatcaagatgatcgaaaccaaataccgcgagggaagagaggtgtgcgagtcagagttgcgcgtccttcgaagagtgcggcacgcgaatattatacagctagttgaggtgtttgagacccaggaacgcgtatacatggtaatggagctggccacgggaggcgaattgtttgatagaattatcgcaaaaggcagcttcaccgagcgggacgccacccgggtactgcagatggtccttgacggcgtgagatatctgcacgcattaggcatcacacacagggatctgaaacctgagaacctgctctactatcatccaggaacagatagcaaaattattattactgacttcggccttgcctcggccagaaagaaaggcgacgattgtttgatgaagaccacttgtgggacccctgagtatattgctcctgaggttttggtgaggaagccttatactaatagtgtggacatgtgggccttaggcgtcatcgcatacattcttcttagcggtaccatgccatttgaggatgataataggacaaggctctatcggcagatcctaaggggtaagtacagctacagcggcgagccctggccatctgtgtccaatcttgccaaagattttatcgatcgtttgcttaccgttgaccctggagcaaggatgaccgccctccaggcactgcgccatccctgggtggtttccatggccgcatcatcttctatgaagaacctacacaggagcatctcgcagaatctgttgaaacgggccagtagtaggtgtcagtccacaaagtcagcccagagtactcgatctagcaggtcaacccgatctaataaatctaggcgagtgagggaaagggaacttcgcgagctgaacctcaggtatcagcagcagtacaacggttag

SEQ ID NO: 201636 - DNA, 1953 bp, Artificial Sequence
  Description of Artificial Sequence: Synthetic coding sequence
atggcctgccgggagttcgagatgggccggaagaagtgcgagcggtattggcctttatatggcgaagatcctattaccttcgccccttttaagatctcttgtgaggatgagcaggcccgcacagattattttataagaactctcttgttagaattccagaacgaaagtcgacgcctttaccagtttcactacgtaaattggccagaccacgacgtccccagctcttttgacagcatactagatatgatctcactgatgcgcaagtaccaggaacacgaagacgtgcccatttgtatacactgctcagctggctgtggaagaactggcgcgatatgcgccatcgattatacctggaacttgctaaaggccggaaaaattccagaagagttcaatgtgttcaacctgatccaggaaatgcgcacccagaggcattccgccgtacaaactaaggagcagtatgagctggtgcacagagctattgcccagcttttcgaaaagcaactccagctatacgaaatccatggggctcaaaaaattgctgatggagtcaacgaaattaatactgaaaatatggtgagctctattgaaccggagaagcaggactcccctcctcccaaaccccccagaacccgatcctgcctggtggaaggagatgccaaggaggaaatattgcaaccacctgagccccacccagtgcccccaatactcaccccgagccccccatcagcttttccgaccgtgacaactgtgtggcaggacaatgatagataccaccccaagcccgtcttacatatggtgagtagtgaacagcattccgcagacctaaacaggaattactcaaaaagtacagagcttccgggcaagaacgagtcaacaatcgaacagattgacaagaaactggagaggaatctgtccttcgagattaagaaggtcccactgcaggaaggacccaaatctttcgatggaaacactctgctgaatcgcggccacgcaattaaaatcaaatctgctagtccatgcattgccgataagattagtaagcctcaggaactctctagcgacctgaatgtgggggatacctcccaaaactcttgtgtggattgctccgtaacccagtctaataaggtgtctgtcacacccccagaggaatcacagaactcagatacccccccgcggcctgaccgtctcccattggatgagaagggccatgtcacctggtcttttcacggacctgagaatgccatacctatccctgatctgtctgaaggcaattcctccgatataaattatcagacaagaaaaaccgtatctctcacaccttctcccacaacacaggtggagacccccgacctcgtcgaccacgataatactagcccccttttccggacccctctgtcatttactaatcctctacacagcgatgatagtgatagtgacgagcgaaacagcgatggggctgtgacccagaataagaccaacattagcacagcgagcgcaacagtctctgcagctacctcgactgagtctatttccacccgaaaggtcctgccaatgtccattgcaagacataatatcgcaggcaccacccactcaggcgccgagaaggatgttgacgtctctgaagactcgccaccccccctgcctgagcggacccccgagtcattcgtgctggctagcgagcacaatacccccgtgagatccgagtggtcagaattacagagccaggaacgaagcgagcagaagaagagcgagggcctcatcacatctgagaatgaaaagtgtgaccaccctgccggtggtatccattacgagatgtgcattgagtgcccaccgacattttctgacaagagagagcagatcagcgagaatcccaccgaggcaaccgacatcggttttgggaacagatgcggcaagcctaagggacctagagacccccctagtgaatggacatag

SEQ ID NO: 201637 - DNA, 1062 bp, Artificial Sequence
  Description of Artificial Sequence: Synthetic coding sequence
atgagccggagcctggacagcgcccggagcttcctggagcggctggaagctaggggtggtcgggagggggccgtacttgccggagagttcagcaagcggtgcgagcgctactgggcccaggagcaagaaccattgcagacaggactgttctgcattaccctgatcaaagaaaaatggttgaatgaggacataatgctccggacccttaaggttacatttcagaaagagtctagatctgtttaccaactgcagtacatgagctggcctgaccgtggagttccaagctctcctgaccacatgctggcgatggtcgaggaggcaagacgactgcagggcagcggccctgaacccctttgtgtacattgcagcgctggatgtggacggacaggcgtcttatgcactgtcgattatgtcaggcagttgctgttaacacagatgattccacccgactttagcttgtttgacgtggtgcttaagatgcggaagcagcggcccgccgccgtgcagactgaggagcagtacaggtttctctaccacaccgtcgcacagatgttttgctctaccctgcagaacgccagcccccattatcagaacatcaaagagaactgcgctcctctatatgacgacgcattgtttctgcgcaccccccaggcccttcttgccatcccacgcccaccaggcggggtgctgcgctcgatctccgtgcctggcagcccagggcacgctatggctgatacgtacgccgttgtacaaaagcggggcgccccagccggagctgggagcggtacgcagacaggaacagggacaggcactggcgccaggtcagctgaagaggccccgctgtattcgaaggtaacaccccgcgcccaacggcccggagcccacgctgaagatgccaggggaacccttcccgggcgggttcccgcagatcagtctccggctgggtccggagcctatgaggacgtcgctggtggcgcacagaccgggggactgggcttcaacctccggattgggagaccaaaagggccccgcgaccccccagccgagtggacacgggtgtag

SEQ ID NO: 201638 - DNA, 1233 bp, Artificial Sequence
  Description of Artificial Sequence: Synthetic coding sequence
atgcccaccaccatcgagcgggagttcgaggagctggacacccagcgaaggtggcagcccctgtacttggagattaggaatgagtcgcacgattacccccaccgtgtggctaagttcccagagaatagaaataggaataggtaccgagacgtgtctccatatgaccattcgagagtgaagcttcagaatgcagaaaatgactacattaacgccagcctcgtcgatatagaggaagcccagagaagttacatcttaacccaggggccattgcccaatacctgctgccacttctggctgatggtgtggcaacagaagacaaaggcggttgtgatgcttaacaggatcgtggaaaaggagtctgtgaagtgcgcgcagtattggccaaccgatgaccaggagatgctgtttaaagaaaccggtttcagtgtgaagcttctgtcagaggacgttaagtcttactacaccgtgcaccttctgcaactggaaaatatcaattacatcgaaaacctgtggatcactctctacttgaagttgctgatgctcgacgtcaaacgcagcctcaagtctggagaaactcggaccatttcacatttccactatacaacctggcctgattttggggtgcccgagagtcccgcctcctttctgaatttcttgtttaaagtgcgggagagcggatctctaaatccggaccacgggccggctgttattcattgttccgccggtatcggccgcagtgggaccttcagcctagtggatacctgccttgtgttaatggagaaaggtgacgatatcaacatcaaacaagtccttttaaatatgcggaagtatcggatgggattaatacagacaccagaccaattgaggttcagctatatggccattattgaaggggctaagtgcatcaaaggagacagcagcatacagaaacgttggaaagagttgagcaaggaagacctgagcccagcattcgatcactccccaaacaaaattatgaccgaaaaatacaacgggaataggattggtttagaggaggagaagctcacgggtgatagatgtaccggactaagctccaaaatgcaggatactatggaggagaattctgaatcagctctccgcaagcggattcgcgaagatagaaaggccaccactgcacagaaagtgcagcagatgaaacagcgattgaacgagaacgagaggaagaggaaacggccccgcctgaccgacacatag

SEQ ID NO: 201639 - DNA, 2259 bp, Artificial Sequence
  Description of Artificial Sequence: Synthetic coding sequence
atggaccagcgggagatcctgcagaagttcctggacgaggcccagtcgaagaagataaccaaggaagagtttgccaatgagttcctcaaactgaaacgacagagtactaagtataaggctgacaagacgtatcctacaactgtggctgagaaaccaaaaaacatcaagaaaaatcggtacaaagacattctgccgtacgattacagccgggttgagctctcccttattacatctgatgaggactcatcctatatcaatgccaatttcattaaaggcgtgtacgggccaaaggcctatattgccactcagggccccctgagcactacactgctggacttttggcgcatgatatgggaatacagtgtactgatcattgtaatggcctgcatggagtacgaaatgggaaaaaaaaagtgtgaaagatattgggctgagcccggtgagatgcaactcgagttcggcccattttcggtgagctgcgaggccgagaaaagaaaaagcgattatatcattcgcacccttaaagtgaagttcaattccgaaactcgcactatctaccagttccactataaaaattggcccgaccacgacgtaccctcttctatcgaccccattctggagctcatttgggatgttagatgctatcaggaagatgactcggtccctatctgcatacactgctcagcgggctgtggcagaacaggtgtcatctgcgcaatcgactatacctggatgttactgaaggatggatcccaggccaaacattgcatccctgagaagaatcacactctgcaggctgacagctactcacctaatctacctaaatccactaccaaagctgctaagatgatgaatcagcaaagaacgaaaatggagataaaggagtcttctagcttcgattttaggactagtgagatctccgccaaggaggaactggtgcttcacccggccaaatctagtacgtcttttgactttctggagctcaactacagttttgacaaaaatgccgacaccactatgaaatggcagaccaaagcgtttcctatcgtgggggaaccactgcagaagcatcagtcacttgaccttggatcactgctttttgaggggtgttcaaactccaagccagtgaacgctgccgggagatatttcaacagcaaggtgcccattactaggactaagtctacaccttttgagctgattcagcagcgcgaaacaaaagaggtggatagtaaagaaaatttctcttatctggaatcacagcctcatgactcttgcttcgtggaaatgcaggcacagaaggtgatgcacgtcagttccgccgagctcaattattcacttccctatgattctaaacaccagattaggaacgcatccaacgtcaagcatcacgactcttccgcgctgggcgtgtactcatatatccccctcgtggagaacccctacttcagctcctggccccccagcggcaccagttccaagatgagtctggacctccccgagaagcaggacgggactgttttcccttcctcactcctccccacctcatccaccagtttgttctcttattacaacagccatgatagcctcagtcttaactccccgaccaatatctccagtctgctgaaccaggagtctgctgtgcttgcaaccgctcctagaatcgatgatgagattcccccacccctacccgtgtggacccctgagtctttcatcgttgtggaggaggccggggagttctctccgaatgtgcctaaaagtctgtcctccgcagtgaaagtcaagatcgggaccagcctagagtggggagggaccagcgaaccgaagaagtttgacgattcagtgatcctaaggccttctaaaagtgttaaattgcgcagcccgaagtctgagctgcaccaggatagatctagtccgcctccgcccttgcccgagcgcactctggaatcatttttcctggcagacgaggactgtatgcaagcgcaatccatcgaaacatattcgacatcttaccctgatacaatggagaatagcacttccagcaagcagacgttgaaaacaccgggaaagagttttactcgctctaagtccctcaagatactgcgaaacatgaagaagagcatttgcaacagttgtccacccaacaagcctgctgagtcagtccagtcaaacaacagctcatccttcctgaactttggctttgccaaccggttcagtaagccaaaaggcccacgcaaccccccaccaacttggaacatatag

SEQ ID NO: 201640 - DNA, 5724 bp, Artificial Sequence
  Description of Artificial Sequence: Synthetic coding sequence
atgctgagccacggcgccggcctggccctgtggatcaccctgagcctgctacagaccggcctcgctgagccggagcgttgtaacttcactctggccgaatccaaggcctcgtcacatagcgtgtctatacagtggcgcatattggggtctccatgcaacttttccctgatctacagctctgacaccctcggtgctgcactgtgtcccaccttccgtattgacaacactacatacggatgtaaccttcaggacctgcaggcgggaaccatttacaatttcagaatcattagtcttgatgaagaacgcaccgtcgtactccaaactgaccccctcccacccgcgaggtttggcgtcagtaaagaaaaaaccacctctacatctctgcatgtgtggtggaccccatcctctggaaaggtgaccagctacgaggtccagctgttcgacgagaataaccagaagattcaaggggtccaaatccaggagtccacatcttggaacgaatacacttttttcaacctcactgccggatccaagtacaatattgcaataacggcggtctccggaggcaaaaggtccttctcagtctatactaacggctctaccgtcccctctccagtgaaggacatcggcatttccactaaggccaactctcttctcatctcttggagccatggttccggcaatgtggaacggtatcgtctgatgcttatggataaaggcattcttgtgcacggcggcgtggtggacaagcatgcgactagctatgccttccacggcctgacacctgggtatttgtacaatctcacagttatgactgaggctgccggattgcagaattaccggtggaagctggttcgcaccgcccccatggaagtgtctaacctgaaggtcaccaacgatgggtccttaacctccctcaaagtgaaatggcagaggcctccaggaaacgtggatagctataatataaccctgtcacacaagggcactatcaaggaaagccgagtgctggccccctggatcacagagactcacttcaaggagctagtccccgggcggctgtatcaggtcacagtctcctgcgtgtcaggcgaactgagtgcacagaaaatggccgtcgggagaacctttcccgataaggtggcaaatcttgaggctaacaacaacggcagaatgcggagtctcgtcgtatcatggtcaccccctgctggggactgggagcagtacagaattctgttgtttaacgattccgtcgtgctcctgaacattactgtgggcaaagaagagacgcagtacgtgatggatgacacgggcctcgtccctggtcgacaatatgaggtggaagtgatcgtcgaatccgggaacctgaaaaactccgaacgttgtcagggcagaacggtcccgcttgccgtccttcaattgcgtgttaaacacgccaatgaaacctcgctgagtatcatgtggcaaaccccagttgctgagtgggagaagtatatcatctccctcgccgatagagacttgctgctgattcacaagagcctgagcaaagacgctaaagagttcactttcacagacctggttcctggccgaaagtatatggccacagtaacatccatcagcggggatttgaagaactcgagctctgttaaaggtcgcaccgttccggcacaggtgaccgacctgcacgttgccaatcagggtatgactagctcacttttcaccaactggacgcaggctcagggagatgtggagttctaccaagtcctcttaatacatgaaaacgtcgtcatcaaaaacgagtctatctccagcgagacctcaaggtacagttttcattcactgaaatctggcagcctctactctgttgttgtaaccacagttagtggtggaataagctcacggcaagtggtggtggagggtagaacagtgccgagtagcgtgtccggcgtgaccgtcaataattcaggccggaacgattacctgtctgttagctggctcctggctcctggggacgttgacaattacgaagtgacactgtcacatgacggcaaagtggtgcaatccctagttatagcgaagtccgttagggagtgctcattttcttccttgacccctggacgtttgtatactgtgacaatcactactcgctccggaaaatatgagaatcactctttttctcaggagcgaacggtgccagataaggtgcagggagttagtgtcagtaactccgctagaagtgactatttgcgcgtgtcctgggtgcacgctactggtgacttcgatcactatgaggttacaatcaaaaacaagaataactttattcagactaagagtataccaaaatcagagaatgagtgcgtctttgtgcagttggtgcccggccggttgtattccgtgacagttactacaaagtcgggacagtacgaggcaaacgagcagggcaatggaagaaccataccggagccggtaaaagaccttacgttgcgaaacagatctaccgaagatctgcacgtgacctggtccggagccaatggagatgtcgaccaatatgaaatccagttgctctttaatgacatgaaggtgttcccgccatttcatttggtgaacaccgctactgagtatcgtttcacaagtctgacaccgggtcgacagtataaaatccttgttctcacaatctctggtgacgttcaacagtccgcttttatcgagggatttaccgttccaagtgctgtcaaaaacatccacataagtccaaacggagctacagactccctgaccgtgaattggacccccggagggggcgatgtcgactcctacaccgtgtcagcttttcggcatagccaaaaggttgacagccagacaatcccaaagcacgtgttcgagcatacgttccacaggctggaagctggggagcagtaccagattatgatcgcctcagtgtccgggtccctgaaaaaccagatcaacgtcgtgggacggacagttccagcagccgtgaccgacctcagaatcactgagaattctacacggcatttgtcgtttaggtggaccgcaagcgagggagagctctcgtggtataacattttcttatataaccccgacggcaacctgcaggagagagcacaggtggacccgttggtccagtcattcagcttccaaaacctgttacaggggcgtatgtacaaaatggttattgtcacgcacagcggagagcttagcaacgaaagctttatcttcggcagaacagtgcctgcctcggtcagccatctcagagggtcaaataggaatactacagatagtctgtggttcaactggagccctgcaagcggggatttcgatttctatgaactcatcctgtataatcctaacggaacaaagaaagagaactggaaagataaagacctgaccgagtggagattccagggattggtccccggacgcaagtacgtactctgggtagtaacccacagcggtgacctgtctaacaaggtgactgccgaatcgaggacggcaccgtccccgccaagtctgatgagttttgcagacatcgccaacacctccttggccatcacctggaaggggcctcctgactggactgactacaacgattttgagttacaatggctgccacgcgatgctcttacagtttttaatccatacaataatcggaagtccgaagggcgaatagtatatggcttgagacctggtcggtcctaccaatttaatgttaaaactgtttctggggacagttggaagacttactctaagcctatcttcggcagcgtcaggactaagcccgataagatccaaaatctccattgtcgtccacagaacagtactgccattgcctgcagttggatcccccccgatagtgactttgacggctactccatagagtgtcgcaaaatggacacccaggaggtggaattttcacgtaagctggaaaaggaaaagagccttctaaatataatgatgctcgtcccacataagcgctacctggtgtctattaaagtccaaagcgctggcatgacttcggaagtcgtggaagattctactataacaatgatcgatcgtccgcctcctccgcctccacatatacgggtcaacgagaaggatgtgctaatctcgaagtcaagtatcaactttacggttaattgttcctggtttagcgacactaacggtgctgtgaagtatttcactgtggtcgtgagagaggccgacggatctgatgagctgaagcctgagcagcaacaccctttgccatcctatcttgaatatcggcataacgctagcattagggtctatcaaaccaactacttcgcatctaaatgcgcagagaacccaaatagcaacagtaaatcatttaacattaagctgggagccgagatggagtcattgggtggcaagtgcgatcccacccagcagaagttctgtgatgggccactcaaaccccacacagcttacagaatttctattagagccttcactcagctctttgatgaagacttgaaagagttcactaagcctctctatagcgacacattcttctcgcttcctatcacgaccgaaagcgaacccctctttggagccattgagggcgtgtcagccggcctgttcctgattggtatgctggtggcagtggtcgcgttgctaatttgccgacaaaaagtctcccatgggagggaaaggccctccgcgcgcctgtcaatccgacgtgaccggccactgtccgtacacctcaatttaggtcaaaagggcaacaggaaaacgagttgcccgattaagatcaaccagtttgaagggcactttatgaagctgcaggctgattccaactatcttctcagtaaggagtacgaggaactcaaggacgtcggaaggaaccagagttgcgatatcgcccttctcccggaaaatagaggcaaaaatagatacaacaacatcttgccttacgacgcgactcgggtcaagttgtctaatgttgatgatgacccgtgttcagattacatcaacgcctcctacattcctgggaataatttcaggcgtgaatacatcgtcacgcagggtcccctcccaggcactaaagacgatttttggaaaatggtctgggagcaaaacgtgcataatatagtgatggtcacacagtgtgtggagaagggtagggttaagtgtgatcactactggccagcagatcaggattccctttattacggggacctgattcttcaaatgttgtcggaatcagttctgcccgagtggaccattagggaattcaagatctgtggggaggaacagttggatgcccatagactgatccggcacttccattatactgtctggcctgatcacggtgtccccgagacaacccagtccctgatccagttcgtccggaccgtgagggattatatcaatcgtagccccggggcgggtcccacagtagttcattgcagcgcaggcgtggggcgtaccggaacttttatagctctcgaccgcatccttcagcaactcgactctaaggactccgtggatatatacggagccgtgcacgatctacggctgcaccgggtccatatggtgcagaccgaatgccagtatgtctatcttcaccaatgcgtacgggatgtgttaagggcaaggaaacttcgcagcgaacaggaaaacccgctctttccaatttacgaaaacgtcaacccagagtatcatcgcgatcccgtctactcccggcactag

SEQ ID NO: 201641 - DNA, 4518 bp, Artificial Sequence
  Description of Artificial Sequence: Synthetic coding sequence
atggtgcacgtggcccggctgctgctgctgctgctgaccttcttccttaggacggatgctgagaccccaccacggtttactcgaaccccagtggaccaaaccggcgtcagcggtggggttgcaagtttcatttgtcaggccacaggggacccacgacctaaaatcgtgtggaacaagaagggaaaaaaagtctcaaatcagaggtttgaggtcatagagtttgatgatggatcaggttccgtcctccggatccagccacttcgcacaccccgtgatgaagccatctacgagtgtgtcgccagcaacaatgtgggcgagatctcagtcagcaccaggctaacggtgctgcgagaggatcagatcccacgcggatttcctacaatcgatatggggccacagctgaaggttgtagagaggacacgaaccgcaaccatgctgtgcgcggcgtcaggaaatccagaccccgaaatcacttggttcaaggacttcctgcctgtagacactagtaataacaatggcagaatcaaacagctcagatcggaaagtatcggtgcattgcagatcgagcagtcggaagagagcgatcaagggaaatacgagtgcgtggctaccaacagtgctggcacaaggtattccgctcctgccaacttgtatgtgagagtacgcagggtgccacccaggttttccatcccgccaaccaatcatgagataatgcctgggggtagcgtgaatataacctgtgtagccgtgggtagcccaatgccttatgttaaatggatgttgggtgctgaggatctgacacctgaggacgatatgcccatcggaaggaatgtgctcgagctgaacgatgtgcgtcagagtgctaattatacttgcgttgcaatgtcaactctcggcgtgatagaggcgatagctcagatcaccgtcaaagctcttcctaagccacctggcacccccgtagtcaccgagagtactgcaactagtattacgctgacctgggatagcggaaaccctgagccggtgagttactatattatccagcacaaaccaaagaacagcgaggagctctacaaggaaatagacggcgtcgccacaacacgctactcggttgccggcttgtcaccttacagtgattacgaattcagggtggtggctgtaaacaatattggccgggggccaccatctgagcccgtattgacccagacgtcagaacaggctccaagtagcgcacctagggacgttcaggcgaggatgctttcctctacgaccatcctggtgcagtggaaggaaccagaggagcccaatggccagattcaagggtacagagtgtactatacaatggacccaacacagcatgtaaataactggatgaaacataatgttgctgattctcagatcactactatcggcaacctagtaccacagaaaacctacagtgtcaaggtgctggcatttacgagcataggtgacgggcctctgtcatctgatatccaggtgatcacccagaccggtgtcccagggcaaccattgaacttcaaggcggagcccgagtccgagacttccatcctcctgtcctggacacctcctcgatccgatacaattgcaaactatgaactagtttataaagacggcgagcacggtgaggaacagagaatcaccattgaacccggcacttcctaccgtctgcagggtcttaagccaaactctctctattacttcaggctggcagccaggtcacctcagggactcggagccagcacagccgaaataagtgcacggactatgcagtcgatgttcgccaagaacttccatgtcaaggcagtgatgaaaacgtccgttcttctgtcttgggagatccccgagaattataacagtgccatgcccttcaaaatactgtatgacgatggtaagatggtggaggaagtggatggtagggccacccagaaacttattgtcaatttgaagcccgagaaatcctacagtttcgtcttgactaaccggggcaacagcgccgggggtctgcaacaccgcgtgacagccaagaccgctcctgacgttctgcggactaaacctgcctttatcggtaagaccaatctggacggaatgatcactgtgcaactcccagaagtgccagcaaacgaaaacatcaagggatactatataattattgtgcccctcaaaaagtccaggggaaaattcatcaagccctgggaaagccctgacgagatggagctggatgagctgctcaaggagatttcgcggaaacgccggtcaattagatatgggcgggaggtcgagttaaaaccatacatcgcagctcacttcgacgtgctgcctaccgagtttacactcggggatgataaacactatggcgggttcaccaataaacaactccagagtggccaggagtatgtgttctttgtgctggctgtgatggagcatgcagagtctaagatgtacgccacttccccctacagtgacccagtagtaagcatggatctagacccccagcctataaccgacgaggaggaaggcttaatttgggtggtcggcccggtactggctgtggtttttattatctgcattgtgatcgctatcctactctataagcggaaacgggccgagtctgatagtcggaaaagtagtattcctaataataaggagattccttcacaccaccccaccgaccccgtcgaactgaggcgcttaaacttccagacgcctgggtctgatgacagcggctaccccgggaatctccactcctcttccatggcatcccaccctcctatcccaattctcgaactagccgaccacatcgagcgccttaaggcgaatgacaacctgaaattcagtcaggaatacgagtctatcgatccgggacagcagtttacatgggaacactccaatctggaggtcaataaacccaagaaccgttacgccaacgtgatagcctatgaccacagtcgcgtgctgctctcggccatcgagggtatacccgggagtgactatgtcaacgccaactacatcgatggttaccggaagcagaatgcttacattgccacgcaggggagcctgcctgagactttcggagatttttggcggatgatctgggagcagaggtcagcaacagtagtcatgatgaccaaactggaggaacggtccagagtgaaatgcgaccagtattggccatcacgggggaccgaaactcatggtttggttcaggtcacacttctggatactgtggagctcgctacatactgtgtgcgaacgttcgctctgtacaagaatgggtcaagcgaaaagcgggaggtacgccagtttcagtttacagcatggcccgaccatggggtgccagagcatcccacacccttccttgccttcctacgacgagtaaagacctgtaacccccccgacgcagggcccatggtagtccattgcagcgcgggggtgggacggacgggttgctttatagtaatagatgctatgttagagaggattaaacacgaaaagaccgttgacatctacgggcacgtcactctcatgcgagcacagagaaattacatggtgcagacagaggaccagtacatcttcatccacgatgctctcttggaagctgtaacatgcggcaacaccgaggtgccagcccgtaacctgtatgcctacattcagaaacttacgcagatcgagacaggggagaacgtaacaggtatggaacttgagtttaaaaggctggcaagctccaaggctcatacctctagatttataagtgccaatctcccttgtaataagttcaagaatcgtctcgtaaatatcatgccatacgaaagtactcgagtgtgcttgcagccaatccggggagttgaaggaagtgattatattaacgcctcctttattgacggctatcgtcagcagaaagcctacatagccacccaaggtcccctggccgaaacgaccgaagacttctggcggatgctctgggaacataacagcaccattgttgtgatgctcactaaactccgagagatgggaagggaaaaatgccaccagtattggcccgcggagcgctccgcccggtaccagtatttcgtcgttgatcctatggctgagtacaatatgcctcagtacatcttaagagagttcaaagtgacagatgcgcgcgatggacagagcaggacagtgagacagttccagtttactgattggcccgaacagggcgtgcccaagagcggagaaggatttatagacttcatcggtcaagtgcacaagactaaagaacaattcgggcaagacggccctatctctgtgcattgttctgcaggagtgggccgcaccggtgtttttatcactctgtcaatcgttctggagagaatgcgctacgagggggttgtggatatctttcagacagtgaagatgttgagaacacagaggcccgcgatggtacagaccgaggaccagtatcaattctcatatcgcgctgctttggaatatctcggctcttttgatcattacgccacctag

SEQ ID NO: 201642 - DNA, 4398 bp, Artificial Sequence
  Description of Artificial Sequence: Synthetic coding sequence
atgcggggcctgggcacctgcctggccaccctggccggcctgctgctgacagctgctggcgagacattctccggcgggtgtctctttgatgaaccgtatagtacatgcggctattcacagtccgagggggacgactttaactgggagcaggtcaacaccctgacaaaaccaacatccgatccttggatgccttccggaagttttatgctcgtaaatgctagcggcagaccagagggtcagcgagctcacctgctcctcccacagctgaaagaaaacgacactcattgtatcgattttcattactttgtatcaagtaaatcgaactcacctccaggcctcttgaatgtctatgtgaaagtcaataatgggcctctgggcaacccaatctggaatatcagcggggatcccactcggacttggaatagggccgagctggctatttctaccttctggcctaacttctaccaggtgattttcgaagtcattacttccggacatcagggatatcttgccattgatgaagtcaaggtcctgggacatccatgtactcgcacaccccactttctccgcatccagaacgttgaggtcaacgctggtcaattcgctacattccagtgttcagccataggaagaacagtggccggagatcgcctgtggctacaaggaatcgacgtccgcgacgcccctttaaaagagataaaggttacaagcagcagaagatttattgccagttttaacgtggtgaatactactaagcgggacgctggaaagtaccgctgtatgattcggaccgaaggaggggtgggcatctcgaactatgctgagctagtggtcaaggagccacctgtgcccattgcccctccccagttggcgtctgtgggagccacatatctgtggatccagcttaatgccaatagcattaacggcgacgggccaattgtcgcaagggaggtggaatactgtaccgcctcagggtcttggaacgacagacaacctgtggattccacatcatacaagataggtcatcttgatccggacacagaatacgagattagcgtgttgttaacaaggccaggggaaggcgggaccgggtctcctggacctgctcttagaacgagaaccaaatgtgccgacccgatgcgcgggccgagaaagctcgaggtggtcgaggtcaagtctcgacaaatcacaattaggtgggagcccttcggctacaatgtgaccaggtgccactcttataatctaacagttcactattgctatcaagtgggtggacaggaacaggttagggaagaggtctcctgggataccgagaactcacaccctcagcataccatcactaacctatctccatacacaaatgtgagtgttaagttgatcctaatgaacccagagggccgcaaggagtcgcaggagctaattgtacagactgatgaagacttgcccggcgccgtcccaaccgagtccattcaggggtctactttcgaagaaaagatattccttcaatggcgagagcccacacagacatacggcgtgatcaccctgtacgaaattacatataaagctgtctctagctttgaccccgaaattgatctgtcaaaccagagtgggcgagtaagcaaactggggaatgaaacgcattttttgttctttggactctacccaggcaccacgtacagcttcacaatacgcgccagcacggccaaaggctttggacctcctgcgacgaatcagtttaccaccaagatcagcgcaccgtcaatgcccgcatacgagctggagacgccactcaaccagacagacaatactgtcacggtaatgctcaagccagctcattccaggggcgccccagtgtccgtctatcagattgttgtcgaagaagaacggcctcgtcggactaaaaaaactacagagattctcaagtgctaccctgtgcctatccactttcagaacgcctccctcctgaacagtcaatattattttgccgccgagtttcctgcagactccctccaggcggctcagccattcacgatcggggacaataagacgtataacggatattggaatacacctttgcttccatacaagtcataccgcatctactttcaggccgccagcagagccaatggagagacgaagattgattgcgtgcaggtcgccacgaagggggcagcgaccccaaagcctgtcccagagcctgaaaaacagacagaccataccgtcaaaattgcgggcgtaattgctgggatcttgctcttcgtgattatcttcctcggggtagtgcttgtaatgaaaaagagaaagctcgccaaaaagcgcaaggagacaatgtcatccacaagacaggaaatgacagtgatggtaaatagtatggacaaatcatatgcagagcaggggaccaactgcgatgaggcctttagtttcatggacactcacaatctgaatggtaggtccgtctcgtctccctcctcatttacaatgaagacaaatactctgtccacgagtgtccctaactcgtactaccccgacccctttgtgcccaccgctatcctggtcccaattaacgatgaaacacacacgatggcctcggacacatcatctctggtgcagtctcacacatataaaaagcgcgaacctgctgacgtgccctatcaaaccgggcagctacatcccgccatacgtgtggctgatctgctgcagcatatcactcagatgaagtgtgccgaaggttacggcttcaaggaagaatatgagtcatttttcgagggacaatccgctccctgggactcggccaaaaaggatgagaacagaatgaaaaatagatatggtaacatcatcgcctacgatcactcaagggtgcgactgcagacgatcgaaggagacactaattccgactacattaacggaaattatatcgatggataccatcgtcccaaccactatattgctacgcagggcccgatgcaggaaacgatttacgatttctggcggatggtgtggcacgaaaacacagcctccattatcatggtgactaatctggtcgaggtcggtcgtgtgaagtgttgtaagtactggcccgatgataccgaaatatataaggatatcaaagtgactctgattgaaaccgaactcttggcagagtacgtaatccggacgttcgcggtggagaaaaggggcgtgcatgaaatcagagagataagacagtttcatttcactgggtggcctgaccacggtgtgccctaccacgcaaccggcctactgggcttcgtaagacaggtcaagtctaaatctccccctagtgccggccctttggttgtccactgttcggctggcgcaggcagaacgggctgtttcatcgtgattgatataatgctcgatatggccgagagggagggagtggtcgatatttacaattgtgtgagggagcttcgaagccggagggtgaacatggtgcagaccgaggaacagtacgtgtttattcatgatgcaatcctagaggcttgtctctgtggcgacacctccgtccccgcaagtcaagttaggagcctgtactacgatatgaataagctcgaccctcaaaccaactcttctcaaatcaaagaggagttcagaactctcaacatggtgactcctacgcttcgcgtggaagattgcagcatcgcacttctgccaaggaaccacgagaagaaccgatgcatggatattctgccgcccgaccgctgtctaccttttctgattaccattgacggggagtcttcaaattatatcaatgccgctttgatggactcctataagcaaccttctgcctttatagtcacacagcaccctctgcccaacaccgtcaaggatttctggcgtcttgtgttggactaccactgcacatctgtcgtaatgctcaacgacgtggatcctgctcagctctgcccccagtattggcctgagaatggagtacaccgacacggtccaattcaagtggagtttgtgagtgctgaccttgaagaggacatcataagccggatctttcggatttataatgccgctagaccccaagatgggtacaggatggtgcagcagttccaatttctgggttggcctatgtacagagatacacctgtgtctaaaagaagcttcctgaaattgattaggcaggtcgacaagtggcaggaagaatacaatggtggcgagggcagaactgttgtacattgtcttaacggcggcggccgctcgggtacattctgtgcgattagcatcgtatgtgagatgcttagacatcagcgaacagtggacgttttccacgcagtgaaaacactgaggaacaataagccgaatatggtggacctccttgaccagtataagttttgttatgaggtcgccctggagtacctgaattctggttag

SEQ ID NO: 201643 - DNA, 4323 bp, Artificial Sequence
  Description of Artificial Sequence: Synthetic coding sequence
atggcccgggcccaggccctggtgctggccctgaccttccagctgtgcgcgccagagaccgaaacacccgctgccggatgtaccttcgaggaagccagtgatccagctgtgccttgtgaatatagccaggcacagtacgacgacttccagtgggaacaggtgcggatccatcccggtaccagggcacccgccgatctgcctcatggaagctatctgatggtgaataccagtcagcatgctccaggacagcgcgcacacgttatttttcagagcctatccgaaaacgatacccactgcgtccaattttcttattttttatacagcagggacggccatagccccggaaccttaggcgtttatgtacgagtaaatggaggccctctcggctcagccgtctggaacatgacaggaagtcatggtcgacagtggcaccaggcggagcttgccgtgagtacattctggcccaatgagtaccaggtgctgtttgaggctctgatcagcccagatcgccgtggctacatggggctggacgatatcttactcctgagctacccatgcgctaaggccccacacttttcacggctgggcgatgttgaagttaacgccgggcagaatgcctctttccagtgcatggctgccggacgagccgccgaggccgagcgcttcctcctgcaacgccagagtggagccctggtgcctgccgcaggggtgagacacatctcccatagacgattcttggccacgtttcccctggcagccgtaagccgggccgagcaagatctgtaccgttgcgtttcccaggcaccacgtggagccggcgtttctaatttcgcggagttaatcgtgaaagagcctccaacacccatagctccacctcaactcctgcgggctggccccacatatttgataattcaattgaacaccaattcaattattggtgacggccccatagtcaggaaagaaatcgaataccgcatggcacgcggaccatgggcagaagtgcacgctgtctccctgcagacatacaaactatggcacctggatcccgacaccgaatacgaaatcagcgtactacttacacggcccggtgacggtggtactggccgcccaggtccccccttaattagtcgtactaaatgcgcagagcctatgagagcacccaaaggattggccttcgccgaaattcaggccaggcagcttacactacagtgggagccgcttggctacaacgtgacacggtgtcacacctacactgtgtccctatgctatcattatacattgggttcttcccacaaccaaacgatccgcgaatgcgtgaagacagaacagggtgttagtcgttacaccataaagaatttacttccttatagaaacgtccatgtgcgattagtgctgacaaaccccgaggggaggaaggaagggaaagaagtgacgttccaaacagacgaggacgtcccttctggaatagccgcagagagtctcactttcacaccattggaagacatgattttcttgaagtgggaggaacctcaggaacccaatggtctgattacccaatatgaaatttcttatcagagtatcgagtcgagtgatcctgccgtgaatgtgcccggccccaggcgcaccattagcaagttgagaaacgaaacatatcacgtcttttctaacctgcatccgggaaccacatacttgttctcagtgcgggccaggacaggaaagggtttcggccaggcggccttgacagagattaccactaacatcagcgctcccagttttgattacgccgatatgccgtctccactcggcgagtcggaaaacacgattaccgtcctcctcaggcctgctcaggggagaggagcccccattagtgtgtatcaggttatcgtggaggaagaacgagccaggcgcttgcgccgcgagcctggcggtcaggactgttttcccgtgcccttgaccttcgaggccgctttggcacgaggtttggtacattatttcggggctgaattggccgcctcttctctgccagaggctatgccctttacagtgggcgacaaccaaacatacagagggttttggaatcctcccctggaaccccgaaaagcgtaccttatttacttccaggcagcaagccacctgaaaggcgagactcgtctgaattgtatccgaatagctaggaaggccgcgtgcaaagagagcaagagaccgctcgaggtctcacagaggtcagaggaaatggggctcatcctaggcatctgtgcaggagggttggccgtgctgatcttgttactcggtgccatcattgtaatcattcgtaaagggaaacctgttaacatgacaaaggccaccgtgaactaccgccaggagaagacccatatgatgtctgctgtcgacagaagctttactgaccaatccaccttgcaggaggatgagcgactggggctcagtttcatggacacccatggatattccacacgcggcgaccagcgttccggaggagtcaccgaggccagttccctcctcggcggttcaccccggagaccgtgcggtcgcaagggctccccataccatactggtcaactgcacccggctgtcagggtggccgacctgcttcagcacatcaaccagatgaaaactgcggaggggtatggatttaaacaagagtatgaatcctttttcgaggggtgggacgctacgaaaaagaaagacaaagtgaagggctcacgccaggagccaatgccagcttacgacaggcacagggtgaagctgcaccctatgcttggtgacccaaatgctgattatataaatgccaattatatcgacattcgaattaatcgggaaggctatcatcggtcaaaccacttcatcgcgacccagggaccaaagccggaaatggtgtatgatttttggcggatggtgtggcaagagcactgcagctcaatagtgatgatcacaaaattggtggaagtcggccgagttaagtgttcccgttactggcctgaggattctgatacttatggcgacatcaaaattatgttggtaaagacagagaccctggcagaatacgtggtcaggaccttcgctttagaacggcgcgggtactcagcacgccatgaggtacggcagtttcactttacggcatggcctgaacatggagttccttaccatgccacgggccttctggcgttcattcgcagggtcaaagcaagtactcctcccgacgctgggcctatcgttattcactgttccgccggcactggtcggactggctgctatatcgtcttagacgtaatgctggatatggccgagtgcgagggtgtcgtcgatatttataactgcgtgaagacactctgctccagacgcgtaaatatgattcagaccgaagaacagtacattttcatacatgacgctatcctggaagcctgcctttgcggcgagacgaccattccagtctccgaattcaaagctacctacaaagaaatgattcggatcgacccacagtcaaactcctcccagctcagagaagaatttcaaaccctcaattctgtcactcccccactcgacgttgaggaatgctctatcgctctgctgcctcgcaatcgagataaaaataggagcatggacgtgcttccccccgacaggtgtctgcctttcctcatctctaccgatggtgacagcaacaattacatcaatgcggccctcactgactcctatactaggtccgcggccttcatcgtgactctgcatccgctgcaaagtacaacgcctgacttttggaggctagtgtatgactacgggtgcaccagtattgtgatgcttaaccagttgaaccagtctaattccgcctggccctgcctacagtactggcctgagcctggaaggcaacagtacggattgatggaagtcgagtttatgagcggaactgcagatgaggacttagtagctagggtgtttcgggtccaaaacatttccagagaaggtcaccttctagtgcgccatttccaatttctcaggtggagcgcgtatagagatacacccgatagcaagaaggcctttctgcatctgctcgccgaagttgacaagtggcaggccgagtccggcgatggacgtacgatcgtacactgtctgaacggcggaggccggtcagggaccttctgtgcctgtgccaccgtgttggaaatgatcaggtgccataacttagtggacgtgttttttgccgctaagacactgcggaattataagcctaatatggtggaaactatggaccagtatcatttttgctatgacgtcgccctggagtatctggagggtctcgagtctcgctag

SEQ ID NO: 201644 - DNA, 4347 bp, Artificial Sequence
  Description of Artificial Sequence: Synthetic coding sequence
atgcggatcctgaagcggttcctggcctgcatccagctgctgtgcgtttgccgtctggactgggccaatggctattaccggcagcagcgaaaactcgtggaagagattggctggagctataccggcgccctaaaccagaaaaattggggtaaaaagtaccccacctgcaacagcccgaaacagtcccctatcaatattgacgaggatttgacccaggttaacgtcaacctcaaaaagctgaagttccagggatgggataagacgtcactggaaaacacgttcattcacaatactggaaagacagtggaaatcaacctcacaaacgattaccgcgtgtccggcggagtttcggaaatggttttcaaggcctctaaaatcaccttccactgggggaagtgcaatatgtcgtcagacggctccgagcactcccttgaggggcagaagtttccactcgagatgcagatctactgcttcgatgcagaccgattcagttcctttgaggaagctgtgaagggcaaggggaaacttcgggcactgtccatcctatttgaagtgggcacggaggaaaaccttgacttcaaggccatcatcgacggagtagagtccgtgtcacggttcggcaaacaggcagcacttgacccctttatcctactcaatctgttgcccaactccactgacaaatactacatctacaatggttctctgactagtcctccttgcacagatacagtcgactggatcgtttttaaagacacagtgagcatttcggaatcccagctagcggttttttgtgaagttcttactatgcaacagtctgggtacgtaatgttaatggattacctccagaataattttagagagcagcagtacaagttctctaggcaggtgttcagctcctacaccggtaaggaggaaattcacgaagccgtttgttcaagcgagcccgagaatgtgcaggcagatccagaaaactatactagtctgttggttacttgggagcggccccgggtcgtatacgatactatgatcgaaaagttcgccgtgctctatcagcagctggatggggaagatcaaactaaacacgagtttcttacagatgggtaccaagatttaggcgccatcctcaacaacctacttccaaacatgagctatgtgctccaaatagttgcaatatgtaccaatggcctctacggaaagtatagcgaccagttgatagtcgatatgccgaccgacaatccggagctggatctatttcccgagctcataggtacagaggagatcatcaaggaagaggaagaaggcaaagacattgaggaaggggccattgtgaacccagggcgggacagtgcaaccaaccagattcggaaaaaggagccgcaaatctccaccacaacccattataacagaataggtactaaatataacgaggccaagacaaaccgaagccctacccggggcagtgaattttccgggaaaggggatgtcccaaacacttctttaaatagcacttcacaacctgtaactaagttagctacagagaaggacattagcctgacatcacagaccgtcacagagctccccccacacaccgtggaggggacctccgccagcctcaatgatggatcaaagactgttcttagaagcccccatatgaatctgagtgggaccgcagaaagcctcaataccgtgtccattaccgaatacgaggaagagtccttactgacatcgtttaagttggatacaggcgccgaggactcctcaggctcaagccctgcaacctccgccatcccgttcatctctgaaaacattagtcaggggtatatcttctcatcagagaaccctgagacgatcacatatgacgttctgatcccggaatcagctcgaaacgctagcgaagactctacctcttctggttcagaagaaagtttaaaggatccctccatggaaggaaatgtgtggttcccgtcatcaaccgatatcacagcgcaacctgacgtcggatccggtcgcgagagcttcctccagacaaactacacagagattcgggtagacgaatccgagaagactacaaagagcttcagcgcagggccggttatgtcccaaggcccctccgtgactgacttggagatgccacattattctaccttcgcttactttccaaccgaagttacaccccatgcatttactcccagctccagacagcaggatctggtgagcacagtaaatgtcgtgtatagccaaaccacacagcctgtgtacaatgaagccagcaattcatcgcacgaaagtcggatcggactggccgagggcttagagtctgagaaaaaagcggttatcccactggtgattgtcagcgccctgaccttcatctgtctggtggtcctggtcggaatcctgatttactggaggaagtgtttccaaactgcacatttctatttagaggactccacctcaccaagggtaatcagcacccctcccactcccatctttccaatcagtgatgacgtgggagcgattcccatcaaacactttcccaaacatgtcgcagatttgcacgcatcatccggctttaccgaggagttcgaagaagtgcagtcttgcaccgtcgacctgggcattaccgccgatagcagcaatcatccggacaacaagcacaaaaatagatacattaacatcgtcgcctacgatcattcccgcgtgaagcttgctcagctggcagaaaaagatggcaagcttaccgactatatcaatgccaactacgtggatggctataacaggccgaaagcctatatcgcagcccaggggccactgaaaagcactgcagaggatttttggcgtatgatttgggagcataacgtggaggtgatcgtgatgatcactaatttggttgagaaggggaggcgcaagtgcgaccagtactggcctgctgatggcagcgaagaatatggcaatttcctcgtgacccaaaagtctgtgcaggtgctggcgtactatacagtgagaaactttaccttgcgtaatactaaaatcaagaaaggatctcagaaagggcgccccagcggtcgagtcgtcacccagtaccactacacacaatggcctgacatgggcgtcccggagtatagcctgccagtgctgacgttcgtcagaaaggccgcttacgctaagagacatgctgtagggccagtggttgtgcactgttcagctggtgttgggcggacgggtacctacattgttctggattccatgctgcagcaaatccagcacgaaggcaccgtcaacatctttggctttcttaaacacatccgatcccagcggaattacctggtacagacggaagaacagtatgtgttcatccacgacactctggtagaagctattctgtccaaagagaccgaagtcttggacagccacatccatgcatacgtcaacgctttactgattcctggtccagccggcaaaacgaagcttgaaaaacagtttcaactgctctctcagtcaaatattcagcaatctgactactcggccgcattgaagcagtgtaaccgcgaaaagaataggaccagtagtattatccctgtggaaagatcacgcgtgggtatcagtagtttgagtggagagggtactgactacatcaatgcaagttacatcatggggtattaccagtctaatgaattcatcatcacacagcacccccttctccacacgatcaaagacttttggagaatgatttgggaccacaacgctcagctggtggtgatgattcctgatggccagaacatggccgaggatgagttcgtctattggcctaacaaagacgagcctatcaactgtgaatcttttaaggtaacattgatggcggaggagcacaagtgcctctcgaacgaggaaaagctgatcatccaagacttcatactcgaggcgactcaggacgactacgtgttggaggttcgccatttccagtgcccaaaatggcctaaccctgacagcccaatctctaagacatttgaactgattagtgtgatcaaagaggaagccgcaaacagggacgggccaatgatcgttcacgatgaacacggaggagtgactgccggaacgttctgcgcgctaacaacgctgatgcaccagctcgagaaggagaatagcgtcgatgtttatcaggtggcaaagatgattaaccttatgcgacccggtgtgttcgccgacatcgaacagtatcagttcctgtacaaagtgattctgtcgcttgtctcgaccagacaggaagagaatccgtcaactagccttgattcgaatggcgctgcgctcccagacggcaacattgccgagtccttagaaagtctggtttag

SEQ ID NO: 201645 - DNA, 504 bp, Artificial Sequence
  Description of Artificial Sequence: Synthetic coding sequence
atgaaccggcccgcccccgtggagatcagctacgagaacatgcggttcttgatcacacacaatcccaccaacgctactttaaacaagttcacagaggaattgaagaaatacggtgtgaccaccctcgtcagagtgtgcgacgccacttacgacaaagcccccgtggaaaaagagggaatccacgtgttagactggccctttgacgacggggccccccccccaaatcagatcgtggatgactggctcaacctcttaaagacgaagttccgcgaggagcctggctgctgcgtggccgtgcactgtgtagccggcctgggcagagcccccgtcctggtcgctctggctcttatcgagtgtggcatgaagtacgaggacgctgtgcagttcatccggcaaaagaggcgcggagcatttaatagcaaacagttgctttacctcgagaagtacaggcccaagatgagactgcgattccgagacaccaacgggcactgttgcgtgcaatag

SEQ ID NO: 201646 - DNA, 249 bp, Artificial Sequence
  Description of Artificial Sequence: Synthetic coding sequence
atgaaccggcccgcccccgtggagatcagctacgagaacatgcggtttctcattacccataatcctactaatgccacccttaataagttcacagaagaactaaagaaatatggggtcaccacattagttagggtttgcgacgccacctatgataaggcgcctgtcgaaaaggaaggcatccatgtgttaaaaaagaagggtagtgtccagtttcagacagccgccctttttggagaaatcccgacctag

SEQ ID NO: 201647 - DNA, 411 bp, Artificial Sequence
  Description of Artificial Sequence: Synthetic coding sequence
atgaaccggcccgcccccgtggagatcagctacgagaacatgcggttcctgataacccataatccaaccaatgcaaccctgaacaaattcactgaggattggccgttcgatgacggggcaccccctcctaaccagattgtggatgattggctgaacttgctgaagaccaaatttagagaggaaccagggtgttgtgttgctgtgcactgcgtcgccggcttgggccgcgccccagtgctagtggccctggctttgatagagtgtggtatgaaatacgaggatgctgtgcagtttattcggcagaaacgccggggggcttttaacagcaagcagctgctttacctggaaaaataccggccaaagatgcgcctgcgctttagagacacaaacggccattgttgtgtgcagtag

SEQ ID NO: 201648 - DNA, 192 bp, Artificial Sequence
  Description of Artificial Sequence: Synthetic coding sequence
atgaaccggcccgcccccgtggagatcagctacgagaacatgcggtttctcattacccataaccctacaaacgcgacactcaataagttcaccgaagaacttaagaagtacggcgtgactacattagttcgtgtctgtgacgcaacctacgataaggctccagtagaaaaggagggcatacacgtcctctag

SEQ ID NO: 201649 - DNA, 69 bp, Artificial Sequence
  Description of Artificial Sequence: Synthetic coding sequence
atgaaccggcccgcccccgtggagatcagctacgagaacatgcggttcctgattacccacaatccctag

SEQ ID NO: 201650 - DNA, 522 bp, Artificial Sequence
  Description of Artificial Sequence: Synthetic coding sequence
atggcccggatgaaccggcccgcccccgtggaggtgagctacaagcacatgagattcttgatcactcacaaccctacaaatgccaccctgagcacctttattgaggatctgaaaaaatacggcgctaccacagttgtcagagtttgcgaagtaacctacgacaagacaccactagagaaagacggtataacagtggtagactggccttttgacgatggagccccgccacctgggaaagttgtggaggactggttgtcacttgtgaaagccaagttctgtgaagccccagggtcttgcgttgcggtgcactgcgtcgcggggctaggcagagcccctgtcctcgtggccctggcacttatcgaaagcggaatgaagtacgaagatgcgatccagtttatacggcagaagcgaaggggagccatcaacagcaaacagctgacatacctggaaaagtacaggccaaaacagcgtctcaggttcaaggaccctcacacacacaagacccgatgttgcgtaatgtag

SEQ ID NO: 201651 - DNA, 447 bp, Artificial Sequence
  Description of Artificial Sequence: Synthetic coding sequence
atggcccggatgaaccggcccgcccccgtggaggtgagctacaagcacatgaggttcctgattacccataaccctacgaatgcaactctctccacatttattgaggatctgaagaaatacggtgccacaacagtggtgcgcgtatgtgaagttacttacgacaaaacacccctggagaaagacggaattacggtagtggactggccattcgatgatggcgcgcccccgccgggcaaagtcgtcgaagattggctgtcacttgtgaaggctaagttttgtgaggcacccggctcatgtgtggcagttcactgtgtcgcagggcttggccgaaagcggagaggcgcaatcaattccaaacagttgacatatctcgagaaataccgccctaaacagagactgcgcttcaaagacccccatacccacaagactagatgttgcgtaatgtag

SEQ ID NO: 201652 - DNA, 447 bp, Artificial Sequence
  Description of Artificial Sequence: Synthetic coding sequence
atggcccggatgaaccggcccgcccccgtggaggtgagctacaagcacatgcgtttcctgatcacccataacccgacgaacgcaaccttaagcacctttatcgaagacctcaaaaaatacggagctacaactgtggtgcgcgtgtgtgaagttacttatgataagaccccacttgaaaaagacggcatcactgtggtggattggcccttcgatgatggggcgccccctccaggcaaggtggttgaagactggctgtccctggtgaaagcgaagttttgcgaggcccccggaagttgtgttgccgttcattgcgtggccggtttgggccgcaaaagaaggggcgctattaactccaaacagcttacatatttagaaaagtatagacccaagcagcgtctcagattcaaggaccctcatacacataagactcggtgttgtgtcatgtag

SEQ ID NO: 201653 - DNA, 522 bp, Artificial Sequence
  Description of Artificial Sequence: Synthetic coding sequence
atggcccggatgaaccggcccgcccccgtggaggtgagctacaagcacatgcgattccttatcacccacaatccaactaacgccacactgtcaacatttattgaggatcttaagaaatatggtgcaactacagtcgtgcgcgtttgcgaagtaacctacgataaaaccccactggagaaagacggcatcacagtggtagattggccctttgacgatggtgcccctcctcccggcaaggtggtagaagactggctgagcttagtcaaagccaagttctgtgaggcaccaggatcctgtgttgcggtgcattgcgttgcaggtctaggccgtgcgcctgtactggtggcacttgctctaattgagtctgggatgaagtatgaggatgctatccagtttatcagacagaagcggcggggcgccatcaactccaagcagctgacatacctggagaagtacagacccaagcaaaggctgcgctttaaggacccccacacccacaaaacgaggtgctgcgttatgtag

SEQ ID NO: 201654 - DNA, 213 bp, Artificial Sequence
  Description of Artificial Sequence: Synthetic coding sequence
atggcccggatgaaccggcccgcccccgtggaggtgagctacaagcacatgagattcctgatcacacacaaccccaccaatgccacgctgtccaccttcatcgaagatctgaagaaatatggagctacaaccgtggtgcgtgtgtgtgaagtaacctacgataagacaccgctcgaaaaggacggtattacagtggtggactggccgttctag

SEQ ID NO: 201655 - DNA, 2343 bp, Artificial Sequence
  Description of Artificial Sequence: Synthetic coding sequence
atggagcaggtggagatcctgcggaagttcatccagcgggtgcaggcaatgaaaagtcctgaccacaatggggaggataatttcgcaagagacttcatgcggctccgccggctgtccaccaaatataggaccgagaaaatctatcccactgcaaccggcgagaaggaggaaaacgttaaaaaaaaccgttataaggatatcctgcccttcgaccatagcagggtaaagttgacattgaagaccccttcgcaggactctgattacatcaacgcaaacttcatcaaaggcgtatacgggcctaaggcctacgtggcaacccagggcccgcttgctaacaccgtaattgacttttggaggatgatctgggaatacaatgtagtcatcattgtaatggcttgtcgtgagttcgagatgggacggaagaagtgtgaaagatactggcccctctatggggaggacccaattaccttcgctccgtttaaaatcagctgcgaggatgaacaggcacggacagactatttcatccgtaccctcctgctggaatttcagaatgaaagccgcaggctttatcagttccattatgtgaattggcctgaccacgatgtccccagctcttttgacagtatccttgacatgatctcactgatgcggaagtaccaggagcacgaagatgtaccaatttgcatccactgttcagcaggctgcggcaggaccggggcgatttgtgcaatagactatacttggaacctgctcaaggctggaaagattcccgaggaattcaacgttttcaacctgatccaagaaatgagaacacaacgccactcagccgtgcagacgaaggaacagtatgagctggtacacagggccatcgcccagctctttgaaaaacaactgcagctgtatgaaatccatggtgctcagaaaattgctgacggggtgaacgagattaacactgagaacatggtgtcctcaattgagccagagaaacaggatagtccaccaccgaagcctccccgcacgcgatcttgtttggtggagggagatgccaaggaagagatcctgcaaccgccagaacctcatcctgttccgccaatcctgacccctagcccaccgagtgcattcccgacggtgacaaccgtctggcaggacaacgatcggtaccatcctaagccggttctccacatggtttcatcggagcagcattccgccgatttgaaccgtaattattctaaatccaccgaattaccagggaaaaacgaatctactatcgaacagatcgacaaaaagctggagcgtaatctctcatttgaaatcaagaaagtccctcttcaagaggggccgaagagcttcgacggcaacaccctgctgaacaggggccatgccattaagatcaaaagcgcatcgccctgtatcgcagataaaatttctaaaccacaagaactcagttctgacttgaatgtcggtgatacatcccagaactcctgcgtagactgttctgtaacccaaagcaacaaggtgtcagtcaccccccccgaggaatctcagaactccgacacaccgccgagacccgacaggttgccactcgacgagaaaggccatgtgacatggagcttccatgggcctgagaatgccatacccattcccgacctctccgaaggcaattcttctgacataaactaccagacacgtaagactgtatctcttaccccatctccaactacacaggtggagacccctgacctggtggaccatgataatacaagccccctgtttagaacaccactgagtttcactaatcctctacactcagacgatagcgacagcgacgagcgcaatagcgacggagcggtaacccagaacaagaccaatatcagcactgcttcagccacggtgtcggcagcgactagcacggagagtatcagcacaaggaaggttctgcccatgtcgatcgcccgccacaatatagcaggcactactcacagcggcgccgagaaggacgtagatgtgtctgaggacagtcctcctccactccccgagaggacccccgaatcgtttgtgctagcttctgaacacaacacccccgtgagatctgaatggagtgaactccagtcacaggagcggtccgagcaaaaaaaaagtgaaggactgattacatccgagaacgagaaatgcgatcatcccgctggcggaattcactacgaaatgtgtatagaatgtcctccaaccttcagcgacaagagggagcaaatttctgagaatcctacggaggcgacggatattggatttggcaatagatgcggtaagccaaaaggaccccgagatccccctagtgagtggacgtag

SEQ ID NO: 201656 - DNA, 1986 bp, Artificial Sequence
  Description of Artificial Sequence: Synthetic coding sequence
atgatctgggagtacaacgtggtgatcatcgtgatggcctgccgggaattcgagatgggacggaaaaagtgcgagcgatactggcccctttacggagaggatccaatcacatttgcccctttcaaaatttcatgtgaggacgaacaagcccggacggactattttattagaacgttactcttggagtttcaaaatgagagccgtaggctgtaccaattccactacgtaaactggccggaccacgatgtgccttcttcttttgactccattctggatatgattagccttatgcggaagtaccaggagcatgaggatgtgcctatatgcatacattgttcggctgggtgtggcaggaccggcgccatctgcgccatcgattacacatggaacctcctgaaggccggcaagattcccgaagaatttaacgtgttcaacctgattcaggaaatgcggacccagaggcactctgcagtccagacaaaggaacaatatgagctggtgcaccgggccatcgcgcagctgtttgagaaacagctgcaactttatgaaatacatggggctcagaaaatcgccgatggagtgaatgaaatcaacacggagaacatggtcagcagcattgaaccagaaaagcaggactctcccccgcctaagcctccaaggacgaggtcatgcctagttgagggagacgctaaagaggagatacttcagccccccgaaccgcaccccgtgccgccgatcctcactccatccccccccagcgccttccctactgtcaccacagtgtggcaggacaatgaccgttaccatccgaagccagtccttcatatggtgtccagcgagcagcatagcgcagatctcaatcgaaattattctaagagtaccgagttgcctggcaaaaatgagtctacgattgaacaaattgacaaaaagcttgagaggaatttatcattcgaaattaaaaaggtgcccctccaggaaggcccgaagtctttcgatggaaataccctgctgaatcgcggccatgcgataaagatcaagagtgcctccccatgcattgccgacaagatatctaaaccacaagagctttcctccgaccttaatgtgggggacaccagtcagaattcctgtgtcgattgctctgtcactcaatcaaacaaagtatccgtgacgcctcccgaggagagccaaaattccgatacccctccacggccggatagactgcccttggacgagaaagggcacgtgacttggtcttttcacggtcccgaaaacgctattccaatcccagacctgtctgagggtaattcatctgacataaactatcagacgagaaagaccgtgagtctgaccccatcacccacaacacaagtggaaacgccggatctggttgaccacgataatacaagtcccctctttcgcactccccttagtttcacaaaccccctacactcggacgattctgattccgatgaaaggaactctgatggcgcagtcacccagaataagactaatatttcaaccgcgtctgccacggtttcagcagcaacgtccactgaaagcatatccaccaggaaagttttgcctatgagcatcgctagacataatattgccggaacaacccacagtggtgctgagaaggacgtagatgtgagcgaagactccccaccaccgctgcccgagaggacacccgagtcctttgtcttggcaagtgagcacaatactcctgtacgcagcgagtggtctgagcttcaaagccaggagaggagcgagcaaaagaagtccgagggcctgattacaagtgaaaatgagaaatgcgatcatccagctgggggcatccactatgaaatgtgcattgagtgccctcccacgttttccgacaagcgggagcagatctccgaaaaccccactgaagcgacagacatcgggtttgggaatcggtgcggcaagcccaagggccccagggatccaccatcggagtggacatag

SEQ ID NO: 201657 - DNA, 1632 bp, Artificial Sequence
  Description of Artificial Sequence: Synthetic coding sequence
atgatctgggagtacaacgtggtgatcatcgtgatggcctgccgggaatttgaaatgggtagaaaaaaatgtgagagatactggcctctgtatggagaggacccaataactttcgctcccttcaaaattagttgcgaagatgagcaagcaagaactgactattttattagaacactgttgctggagttccagaatgaatcccgtcggctttaccagttccactacgtcaactggcccgaccatgatgtgccaagttcattcgacagtatcctcgatatgatttctctgatgagaaagtaccaagaacacgaggacgtccctatctgtattcattgctctgccggttgtggcaggaccggagcgatatgcgccatcgattacacatggaatcttctgaaagccggaaagataccggaggaatttaacgtattcaacctgatccaagaaatgcggacccagcggcacagcgccgttcaaactaaggagcagtatgaactggttcaccgcgccatcgctcaactctttgagaagcagcttcagctctatgaaatacatggcgcacaaaaaatcgctgatggtgtcaatgagattaacactgagaacatggtctcatctattgaacctgaaaagcaggattccccaccaccaaagccgccccggacacgttcatgtttggtagaaggggacgctaaagaggagatcctccaacccccagagccccaccccgttcccccaattttgacacccagcccaccttcagcatttcccacagttacaacagtctggcaagacaatgatagatatcaccccaaacccgtgctgcacatggtgtcctcagagcagcactctgctgacttgaatagaaattactccaagtcaaccgagcttccgggcaagaacgaatcaaccattgaacagatagacaaaaagctggagagaaacctgagttttgaaatcaagaaagttccgttgcaggaaggaccgaagagtttcgatggcaataccctgttaaataggggacacgcaatcaagatcaaatctgcatccccatgtattgcagataaaatcagtaaacctcaagaactttcttcagacctcaacgttggagacacatcccaaaattcttgtgtggactgctcagtgactcagagcaataaggtgtccgtaactcctcccgaggagtcacagaacagtgacaccccacccagacccgataggctaccattagatgagaaaggacatgtgacctggagttttcacggacctgaaaacgctattcccatcccagacttaagtgaaggcaattcgtccgacatcaactatcagaccaggaaaactgtgagtctcactccctcacctactacgcaggttgagactcctgacctggttgatcatgataacacatcgccccttttccggacccccctttcattcacaaaccccctgcattctgacgattcggatagcgatgagcgaaattcagatggtgccgtcacacaaaacaaaacaaatatttccacagcgagtgctacagtatccgccgcaacatcaactgaatctatttccacaagaaaagttttaccaatgagcattgcccgtcataactcgcgcaacaatacttttaggtgctag

SEQ ID NO: 201658 - DNA, 6885 bp, Artificial Sequence
  Description of Artificial Sequence: Synthetic coding sequence
atgcacgtgagcctggccgaggccctggaggtgcggggcggccccctccaggaggaggagatttgggccgtcctgaaccaatccgctgagagtttacaggaacttttcagaaaggtgtcgctcgcagacccggccgcactaggattcatcatttcgccatggagtcttttgctactccctagcgggtccgtgagtttcaccgacgagaacatctccaaccaggatctcagggccttcactgcccccgaggtgctgcagaatcagtccctcacctccctttctgacgtggaaaagatacatatttattcccttgggatgaccctgtactggggcgctgattacgaggtgcctcaatcccagccgatcaaactgggggatcacctcaactctatcctgcttggaatgtgcgaagacgtcatctatgcaagagttagtgtccgaacggttttggacgcatgttcggcccacattaggaactccaattgcgccccttctttttcctatgtcaaacacctagtgaaactggtcctgggcaatctgtccggtaccgaccagctgtcctgtaattccgaacaaaagcccgaccgaagtcaggcaatacgcgatagactgaggggaaaaggccttcctaccggaaggtcttctacatcggatgtcttggacatccaaaagccccccctatcccaccagacgttcctgaataaaggactgtcaaagtctatggggtttctgtcaattaaagatacccaagacgaaaattatttcaaggatatcctgagtgataatagcgggagggaggattctgagaatactttctcgccatatcagtttaaaacgtcaggtcctgagaagaagcccataccagggatcgatgttctgtccaaaaaaaagatttgggcttcttcaatggatctgttgtgtactgccgaccgcgatttcagctccggcgaaaccgctacttaccgaagatgccatcctgaggcggttactgttaggacctccacaacccctagaaaaaaggaggcgcggtactcagacgggtcgatcgccctggatatttttggcccccagaaaatggatccaatttaccacacaagagaactgcctacctctagcgctatctctagcgccttagatcggatcagagagagacagaagaagctccaagtgctgcgagaagctatgaatgtggaagagcccgtgagacggtataaaacgtatcacggtgatgtattcagcacctctagcgagtctcccagtatcatctcctctgaatctgattttagacaggtcagacgctcagaggcgtccaagcggtttgagagctcatccggactgcccggggtggacgagactctctcccagggccagagccaacgccccagtcgtcagtacgagacgccctttgaggggaatctaatcaaccaggaaattatgctgaagagacaggaagaagaacttatgcagttgcaggcaaaaatggcgttgcgccagagtaggttatcactctaccccggagataccatcaaggcctcaatgctggacataaccagggaccccctcagggaaatagccctggaaactgccatgacgcagcggaagctgcggaacttcttcggtcctgagtttgtgaagatgacaattgagccgtttattagtctggacctccccagatcgatcctaaccaagaagggcaaaaacgaagacaatcggaggaaggtcaatataatgttattaaatggccagcggcttgaattaacctgcgacaccaagaccatttgtaaagatgtctttgacatggtggtagcccatatcggtttggtagaacatcatctcttcgccctcgccaccctcaaggacaacgaatacttttttgtcgaccccgatttaaagctcaccaaggtggccccagaggggtggaaggaggaacccaaaaaaaagactaaggcgaccgtgaatttcactcttttctttagaattaagtttttcatggatgatgtcagcctgatacagcatactctgacttgccatcagtactacttacagctacgaaaagatatcctggaggagcgcatgcactgtgacgatgagacatcgttgcttctggcttctctggctttgcaagccgaatatggtgattatcaacccgaggtgcacggagtcagctacttcagaatggagcactacctccccgctagggtgatggaaaagctggatctctcttacatcaaggaggagttgcctaagcttcataacacatatgtcggggctagtgagaaggagacagagctggaatttctgaaagtgtgccagcgcctgacagagtacggtgtgcactttcaccgggtgcacccagaaaaaaagtcacagacaggcattctgctcggagtctgcagcaagggtgtgctcgtgttcgaagtccacaacggggtgcgtaccctggtgctaagattcccctggagagagacaaaaaaaattagtttttctaaaaagaaaattaccctccaaaataccagtgatggaattaaacacggcttccagactgataattcaaaaatctgtcagtacctccttcacctctgttcctaccagcacaaattccagctacaaatgcgcgcacgacagagcaaccaggacgctcaggacatcgacgtgctacataaacgctggagcatcgtgtcctctcccgaaagggagatcactctggtgaacctcaaaaaggacgctaagtacggacttgggtttcagattattggtggggagaaaatgggcagactcgacttgggaatcttcatttcctctgtggctccgggagggcccgctgatctggacggctgtctgaagccaggtgatcgcttaattagtgtaaacagtgtcagcctggaaggagtatcacatcatgctgcgatcgagatcctccagaatgcaccagaggacgtgacattagtgatcagccagccaaaggaaaagatttcaaaggtgccctctacaccggtgcatttaactaatgaaatgaaaaactacatgaagaagagcagctatatgcaggattcggcaatcgacagcagttccaaagatcaccattggtctaggggcactctgcgccacatctccgaaaactcattcggccccagcggcgggctgagggagggaagcctttcttcccaggactccaggacggagtccgcatcattgtcccaatcccaagttaatggattcttcgccagccacctgggcgaccagacctggcaggagtcccaacacggcagccccagtccatcagtgatctctaaggcaaccgaaaaggagacctttacagacagcaatcagtctaaaacgaaaaagcctggcatcagcgacgttaccgattacagcgacaggggcgattcagatatggacgaagccacttactcatcctctcaggaccatcagacgcctaaacaggagagcagttcttctgtcaacacaagcaataaaatgaacttcaaaactttcagttcgtccccacctaaacccggagacatttttgaagttgagcttgcgaagaacgacaatagcttaggcatttcagtgaccggcggagtgaacacctcagtgcgccatggcggtatttatgtgaaggcagtcattccacagggagccgccgaatctgacgggcgcattcacaaaggcgaccgggttttagctgtgaatggcgtgagcctagaaggagccacccataaacaggccgtcgagacgctgaggaataccggacaggtggtgcatttgttgttagaaaagggccagtccccaacaagcaaagagcacgttcccgtgaccccccagtgcaccctgtcagatcagaacgcccagggccaaggcccagaaaaagtgaaaaaaacaacacaggtgaaagactattcattcgtgactgaggagaacacattcgaagtcaaattgttcaagaattccagcggcctcggcttctcattctcgagagaagataatttaatccctgagcagataaatgcctctatcgtacgtgtcaaaaagctctttcccggccagccagcagccgaatctggtaagattgacgtaggcgacgtcatcctgaaagttaatggagccagccttaaaggtctgagccagcaagaggtgatcagtgctttacgaggcaccgcaccagaggttttcttgcttctgtgtaggcccccccctggggtgctccccgagattgacacggcactgctgaccccactgcagtcacccgcccaggtgttacccaactcgagcaaggactcttcccaacccagctgtgtcgaacaatctacaagctcagacgagaacgagatgtcagataaatccaaaaaacagtgtaaatctccctcacggcgcgacagctacagcgattcttcgggaagcggcgaagatgaccttgtgactgctccagctaacatttccaatagcacctggtcttctgctctgcatcagaccctgagcaatatggtgtctcaggctcaatcccatcacgaagcaccaaagagccaggaagacacaatctgtacgatgttctactatcctcagaagattcccaataaacccgagttcgaggactctaatccatctcctttgccacccgacatggctcctggacagtcttaccaaccacagagtgagagcgcctcgtcaagtagtatggataaataccatatccatcacatttcagaaccaacgcggcaagagaattggactcctctcaagaacgacctggagaatcatcttgaggattttgagttagaggtcgagctcctcatcactctgatcaaaagtgagaaaggctccctgggtttcactgttaccaagggaaaccagcggattgggtgctatgtacatgatgtcatccaagacccggctaaatcagacggacggctcaagcctggcgaccgcctgatcaaggttaacgataccgatgtaacaaacatgacccataccgacgccgtgaatctcctccgcgccgctagtaagaccgtaaggctggtgatcggccgcgttctggaactcccacggattcccatgctgccccatcttttgccggatatcacccttacttgtaataaggaggagctgggcttcagtctgtgcggcgggcatgactctctgtaccaagtcgtttatatcagcgacattaaccctaggagtgtcgccgccatagaggggaacctgcagctcctagatgtgatccactacgtgaacggcgttagcacacaggggatgaccctcgaggaagtcaatagagcccttgacatgagccttccatccctagtcctgaaggcaactaggaatgaccttcctgtggttccatctagcaagcgctccgccgtcagtgccccgaaaagtactaagggaaacggatcatactcagtcgggagttgctcccaaccagccttaacgccaaatgacagcttttcaactgtcgcaggggaagagattaacgaaatcagctaccccaagggaaagtgctctacctatcagatcaagggaagtcccaatctgaccttacccaaggagagctatattcaagaggacgatatctacgacgactctcaggaagccgaggtgatccaatcactgctggacgttgtagatgaagaagcccaaaatctcctgaacgagaataacgctgcaggttatagttgtggacccggtacgttgaaaatgaatgggaaattgtcagaagaacggaccgaagataccgactgtgatgggtctcctctgccggaatacttcacagaagccaccaagatgaacggatgtgaagagtactgcgaggagaaggttaaatcggaatccctgattcaaaagccgcaggaaaaaaagaccgatgacgacgagattacatggggtaacgacgagcttcctatcgagcgcaccaatcatgaggacagtgataaggatcattcattcttgacgaacgatgaattggccgtgcttcccgtggtcaaagttctccctagtggaaagtacaccggagctaacctgaagtccgttattagggtgctgcgggggctgttggaccagggaataccctccaaagaactggaaaacctacaagagctgaagcccctggaccagtgcctaattggacagactaaagaaaacaggagaaaaaacagatataaaaacatcttgccctatgacgccacacgggtgccacttggagacgaaggaggatacattaacgcaagttttatcaagattcccgtggggaaagaagagtttgtctacatagcctgtcaaggccccctgcccactactgtgggagatttttggcagatgatttgggagcagaaatccactgtgatcgccatgatgacccaagaggtggagggagagaagatcaagtgtcagcgctattggccaaacattctaggtaagactactatggtgagcaatcgtctcagattagcactggttagaatgcagcagctcaaagggtttgtagttagggctatgactctagaagatatccagacacgtgaggttagacacatttctcaccttaatttcactgcatggccagaccatgatactccctcacaacccgacgacctgctgacctttatctcgtacatgaggcacattcatagaagtggtcctattatcacgcactgcagtgcggggatcggcaggtccggtactctgatttgcattgacgttgtgctaggcctgatcagtcaggatctggacttcgacatctcagacttagtgcgatgcatgagacttcagcgccatggtatggtccagacagaggatcaatacatattttgctatcaagtgatcctgtacgtcctcactcgcctacaggcagaggaggagcagaagcagcaaccacagctgttaaagtag

SEQ ID NO: 201659 - DNA, 7305 bp, Artificial Sequence
  Description of Artificial Sequence: Synthetic coding sequence
cagttcctgttcaccaaggtgagcctggccgaccccgccgccctggggttcattatatccccctggtctctcctgctgctcccctcagggagtgtgtccttcaccgatgaaaatatctctaatcaagatttgagggcttttacggccccagaggtgttacagaatcagtccttgaccagtctgtccgacgttgaaaaaattcatatatatagtctgggcatgacactgtattggggcgccgattacgaagtaccgcagtcccaacccattaagctaggcgatcatctcaacagtatactcctcgggatgtgtgaggatgtgatttatgcaagggtctctgtgcgcaccgtgctggacgcctgctctgcacacattagaaactccaactgcgctccttcgttcagctacgttaagcatctggtcaagctcgtgctaggcaatctgagtgggaccgatcaactctcctgcaattcggagcaaaaacctgaccgctcccaggctattagggataggttacggggcaaaggattacctacagggagaagctccacctccgatgtgctggacattcagaagccccccttaagccatcagacttttcttaataagggtctatctaaatcaatggggttcctctcaataaaggacacacaagatgagaattacttcaaggatattcttagcgacaattcaggtagagaggactcagagaacaccttttcaccttaccagtttaagacgagcgggccagagaaaaagccaatcccgggaatagatgtgctgtcaaaaaagaaaatctgggccagcagcatggacctcctgtgtacagccgatcgcgattttagcagtggcgaaaccgccacctaccgccggtgtcatcccgaggctgttacagtgcgcacgtccaccactcctaggaagaaggaggctcggtactccgacggttctatcgcccttgacatcttcggtccgcagaagatggatccaatctaccatacccgtgagctccctacatcaagtgccataagcagcgccctggaccgaattcgggagcgccagaaaaagcttcaagtattgagggaagcaatgaacgtggaggaacctgtgagacgttataagacctaccacggggacgtgttttccacaagtagtgaatcaccgtccataatctcaagcgagtccgactttagacaggttaggaggagcgaagcctccaagcggttcgagtcttcaagcggcctccccggagttgatgaaactctgagccagggtcagtcacagaggccatcacgacagtacgaaacccctttcgagggaaaccttatcaaccaggagatcatgttgaagcgacaggaggaagagctgatgcagctccaggcaaagatggcactccggcagagtcgcctgtcgctgtatccgggagatactatcaaggcctcaatgctagatataacccgggatcccctgagagaaatcgctctggagacggcgatgacacagcgcaagttaaggaatttctttggacccgagtttgtaaagatgaccattgaaccctttatctccttggatttgcctcgctctatcctgaccaaaaaagggaagaatgaagacaacagacggaaagtaaacatcatgctgctcaacggacaaagactggagctcacctgtgacaccaagaccatttgcaaagatgtgttcgatatggtagtagcccacataggcttggtggaacaccacctcttcgccttagcgaccctcaaggataatgaatatttcttcgtggatcctgacttaaagctgacaaaggttgcaccagaggggtggaaggaagagcctaaaaagaagacaaaggctaccgtcaattttacgttgttttttcgcattaaatttttcatggacgatgtgtccctgattcaacacaccctcacatgccaccagtattaccttcaactgagaaaagacattctcgaggaacggatgcattgcgatgacgaaacatccctgttgttggcctcgctggccctgcaggccgaatatggtgactatcaacctgaggtgcacggcgtctcttatttccggatggagcactatctgcctgccagagtgatggaaaaactggacctgtcctacatcaaagaagaattgcccaaactacacaacacctatgtgggggcatcagaaaaggagaccgagttggagttcttgaaggtttgtcagaggctgaccgaatacggcgttcattttcacagggtgcaccctgaaaaaaagagccagacaggaattctgttgggggtgtgcagcaagggcgtgctggttttcgaagtacataacggtgtgagaaccttggttctgcgctttccttggcgggaaactaagaaaatctccttttctaaaaagaaaattacgctccagaataccagcgatggcataaaacacggcttccagactgacaactcaaagatctgccagtatctactgcatttgtgtagctatcagcataagtttcaactgcaaatgcgtgcacggcagtcgaaccaggacgcacaggacattgagcgcgcaagtttccgtagcttgaacttacaggccgaatctgtccgtgggtttaacatgggaagagccatcagcactgggtcgttggccagttcaaccctgaacaaactggctgtcagacccctcagtgttcaagcggagatactgaagaggttgtcatgctccgaactctctctgtatcagccactacaaaatagcagcaaggagaagaatgacaaagcaagttgggaggagaagcctagagagatgagcaagagctaccatgatctgtcacaagcatccctgtatcctcacagaaagaacgtcatcgtgaacatggagccaccacctcagaccgtggccgaactcgtcgggaagccctctcaccagatgtcccgttcagatgcagaaagtctcgccggggtcactaagctgaacaattccaaatccgtggcttcactgaaccggtcaccggaacgccgcaagcacgagtctgatagctctagtatcgaggaccccgggcaggcctacgtcctggatgtccttcataagcgatggtccattgtttcctcacctgaaagagaaatcaccttggtgaacttgaagaaagatgcaaaatatgggctcggcttccagatcattggcggagagaaaatgggccgcctggatcttggcatttttattagttctgtggctcccggcgggccagcagacctcgatggatgtctgaagcctggcgataggttgatctcagtcaactctgtctcgctggagggtgtatcacaccacgccgccattgagattcttcagaacgcacctgaggacgtaactttggtcatatcccagcctaaggaaaagatttccaaagttccatctactcctgtccacctaacaaacgaaatgaagaactacatgaaaaagtcttcctatatgcaagacagtgcgatagactcctccagtaaggaccaccattggtctagaggcacccttcggcatatctcagagaactccttcggcccttccgggggcctgagggaaggatcactgagctctcaagattctcggaccgaaagcgcctccctttctcagtctcaggtgaatggattctttgcttcgcacctgggagatcagacctggcaagaaagtcagcacggcagtccctctccgtccgtgatctctaaggcaaccgaaaaggaaaccttcaccgacagtaatcaaagcaaaaccaaaaaaccgggcattagcgacgtaacggattactccgatcggggggatagtgacatggacgaggctacatattcttcatcccaggaccatcaaacccctaaacaagagtcttccagcagcgttaatacttctaacaaaatgaattttaagacatttagtagcagtcctcctaagccgggagacattttcgaagtggaactggccaagaacgataactctttgggcatttccgtgaccggtggcgtgaatacctctgtccgacacggcggtatctacgtcaaggccgtgatccctcagggtgccgctgagtctgacggacgaattcacaaaggggatcgcgtgcttgccgtgaatggagtgtcactggaaggggccacccacaagcaggctgtggagactttgaggaatactgggcaggttgttcatttgctgcttgagaaaggacagtcaccaacatcaaaggaacacgtgcccgtgacgccccagtgcaccctgagcgatcagaatgctcagggtcagggacctgagaaggttaaaaaaacaacccaggtgaaggactatagtttcgtaaccgaggagaatacatttgaggtgaagctgttcaagaatagctctggtctaggcttcagcttctcccgggaggacaatctcattccagaacagatcaatgcttcgattgtgcgagttaagaagctgttccccgggcagccggctgccgagagcggcaagattgacgtcggggatgtgattctcaaggttaatggggcaagccttaaggggcttagtcagcaagaagtgatatccgctttgcggggaactgcccccgaggtcttcttattgctctgtaggccccctccaggcgtcctgccagaaatcgatacagcgctgctgacgcccctgcagagtcctgcgcaggtgctgccaaactctagcaaagactcctcgcagccctcatgcgttgagcagtccacatcctccgacgaaaatgagatgagtgacaaatctaaaaagcagtgcaagtccccgtcccgacgggacagctactctgacagctccggatcaggcgaagatgatcttgtcactgccccagccaacatctctaactccacttggtcctcagcgctgcaccagacactgagcaatatggtatctcaggcacagtcccaccatgaggcccctaagtcccaggaagacaccatctgcactatgttttattatcctcagaaaatcccaaacaagcctgagtttgaggacagcaatccatctcccctcccacccgacatggcgcctggtcagtcttaccagcctcagtcagaaagcgcctccagttcttcaatggacaagtaccacatacaccatataagtgagcccacacgtcaagagaactggaccccgttgaagaatgatctggaaaaccatctggaagattttgaactcgaagtcgagttactcatcacactgataaaaagcgaaaagggatccctgggcttcactgtgactaaaggtaatcagcgaattggctgttatgttcacgacgtcatccaggatcccgctaaatcggatggcaggctgaagcctggcgatcggctcatcaaggtcaatgatacggatgttaccaatatgactcacaccgatgctgttaatttgctgagagccgcaagtaaaacagtccgcctggtaattggaagggtcctggaactcccccgcatccccatgctgcctcacctgttgcctgacataacattaacttgtaacaaagaggaactgggcttcagcctgtgcggcggacacgattcactctaccaggttgtgtatatctctgacatcaatcctcgctccgtggcagcaatcgagggcaatctgcagttgctggacgttatacattacgtaaacggggtgtccacccagggcatgacgctggaagaggtgaatcgggccttggatatgtccctaccaagtcttgtcttgaaagctacgcgcaacgacctgccggtggtgcccagttcaaaaaggtctgcagtttcggccccgaaaagtacaaagggtaatggttcttacagcgtcggatcttgctcgcagccagccctcacacctaacgattctttcagcactgtggcgggcgaggagataaacgaaatatcctatcccaagggcaagtgctccacctaccagattaaaggtagtccgaatctcacactgccaaaggagagttatattcaggaggatgatatttatgacgacagccaggaggctgaagtcatacagtctcttcttgacgtggtagatgaagaagctcagaacctccttaacgaaaataatgccgccggctactcttgcggcccaggaactctgaagatgaatggaaagttatcagaagagcggaccgaggacaccgactgcgacggtagtccgctgcccgagtacttcacggaagccaccaaaatgaacggatgcgaagaatactgtgaagagaaggtgaagagcgagagcctcatacagaagccacaagagaagaagaccgacgacgacgagattacctggggaaacgacgagctccccatcgaaagaacgaaccatgaggacagcgataaagaccacagcttcttgactaatgacgagctcgccgtacttccagtcgtaaaggtgcttccaagcggtaaatacactggggcaaacttgaagtctgtgattcgcgtactgagaggtctgctggatcagggaattcccagcaaggaactcgagaatctgcaggagctaaagccactggaccaatgtctgatcggacagaccaaagaaaataggcggaaaaatcgctataagaacatcctgccttacgatgctaccagagtaccattaggcgacgaagggggttatattaatgcaagctttatcaaaattccagtaggcaaggaagagttcgtttacatcgcttgtcaaggacctctgcccactacggtcggagacttctggcagatgatctgggagcagaagtcaacagtgatcgcaatgatgacccaggaggtggagggtgaaaagatcaaatgtcaacgatactggcctaatattctaggcaaaacaactatggtctctaaccggctgagattggccctggttcggatgcagcagctgaagggattcgttgttagggcaatgaccctggaggatatccagaccagagaggtgaggcacatctcgcatctgaattttacagcgtggcctgaccatgataccccaagtcagccggacgatctgctaacttttatctcgtacatgcggcacatccatcgctcagggcccatcatcactcactgtagtgctggcataggccgatctgggactttgatctgcattgacgttgtgttaggcctgattagtcaggacttagactttgacatttccgacctggttcggtgcatgcgcttgcagcgtcacggcatggtccagacagaggaccagtacatcttctgctaccaagtcatcttgtatgtgctcactcggctacaggccgaagaagaacaaaagcagcagccccagttgctcaagtag

SEQ ID NO: 201660 - DNA, 7458 bp, Artificial Sequence
  Description of Artificial Sequence: Synthetic coding sequence
atgcacgtgagcctggccgaggccctggaggtgcggggcggccccttgcaggaggaggaaatttgggctgttctcaatcaatccgccgagtccctgcaggagctgtttcgtaaggtgtctctggcagatccggcggccctggggttcatcatcagcccatggagcttactgcttctgccttccggcagtgtgtcttttacagatgaaaatatcagtaatcaagacttgcgcgcctttaccgcccctgaggtcttacagaatcagagtttaacctctctaagcgacgtggagaaaatacatatctacagtctggggatgacactgtactggggagccgactacgaagttcctcaatcccagcctataaagcttggcgaccacctgaattccatcctgctgggtatgtgcgaggacgtgatatatgcccgggtctccgtgcggaccgtgctagatgcctgctcggcccatatcagaaactccaactgtgcacccagtttctcctacgtaaaacacctggtgaagctggtgctaggaaatctaagcggaactgatcagctctcctgtaacagcgagcagaagcctgaccgctcgcaagccattcgtgatcggttgcggggcaaaggtctaccgacgggaaggtcaagtacaagcgatgtgttggacatccagaaaccacctcttagtcaccaaactttcttgaataagggactctcaaagagcatgggcttcctttccatcaaggacacccaggacgaaaactatttcaaggacatcctgagcgataactccgggagagaagattccgaaaataccttctctccttaccagttcaaaacatcaggccctgagaaaaaacccatcccaggtattgacgttctttccaaaaaaaagatttgggcgtccagcatggatctcctgtgcacagcagatcgtgacttctcaagtggggaaacagctacataccgtcggtgccatcctgaggccgtgactgtccggacttccactacccccagaaaaaaagaggctcgctattccgacgggagcatcgcattagacatcttcggaccacagaagatggaccctatttatcacaccagggaattgcctacaagcagcgctatcagtagtgcgcttgacaggattcgggagcgacagaaaaagctgcaagtcttacgcgaagccatgaacgtcgaagagccggtcagaaggtataagacttaccacggggacgtgttttccacaagttccgaatctccctccatcatctccagtgagagtgacttcagacaggttcgacgcagcgaggcttctaagcggtttgagtcgtcttcgggcttgcctggcgtggacgagacccttagtcagggccagtcgcagagaccgagccggcagtacgaaacgccatttgagggcaatctgataaaccaggagatcatgcttaaaaggcaggaggaggaactcatgcagctgcaagctaagatggcactcagacaatcccggctgtccctatacccaggagacactatcaaagcaagtatgcttgatattactcgcgaccctctccgcgaaatcgcgttggaaactgcaatgacccagcgaaaattgagaaactttttcggtcctgagttcgtcaaaatgactatagaaccatttatttcactcgatctgcctaggtctattctgacaaagaagggaaagaacgaggataacagacgcaaggtgaatattatgctgctgaatggccagcgcttggagttgacttgcgataccaaaactatctgtaaggacgtgtttgatatggtggtggctcatattggcttggtagagcaccacctgtttgcactcgccacattgaaagataatgaatatttttttgtagacccagatttgaaactcacgaaggtagccccagaaggttggaaggaagagccgaagaaaaagaccaaagccacagtcaacttcacactgttctttcgaatcaaattctttatggatgacgtgagcctcatccagcataccttgacttgtcaccagtattacttacaactgagaaaagatattcttgaggaaagaatgcactgcgatgatgaaacaagtttgctgcttgcctctttggccctccaggccgagtacggagattaccagccagaagtgcatggggtcagctattttcggatggagcattacctcccagctagagtcatggagaagctcgacctcagctatatcaaggaagagctgccaaagctgcacaacacttatgtgggcgcatccgaaaaggaaactgaactggagttcctgaaagtttgtcagagactcaccgaatacggggtacatttccacagggtgcatcccgaaaagaagtcccagacgggcatcctgctgggcgtctgctcaaaaggggtgttagtttttgaagtccacaacggcgttcgaactctagtgctaaggtttccatggcgagagacaaaaaagatctcatttagtaagaaaaaaatcacgttgcagaacacatctgatggcatcaagcacggattccagacagataatagcaaaatctgccagtatctgctgcacctctgctcttaccaacacaaatttcagctgcagatgcgggcacggcaaagcaaccaggatgcccaggatatagagagggcctcgtttcgatctttaaatctccaggctgagtctgtgagaggattcaatatgggccgtgcgattagcaccggatctctcgctagcagtaccttgaacaaattggccgtgcgacccttgtccgtgcaggccgaaatcctgaaacgattatcatgctccgaactctccctttaccaacccctgcagaattcttctaaagaaaaaaacgataaggccagttgggaagagaagccccgggagatgtcaaagtcttaccacgacttgagccaggcttcgctgtatccccacaggaagaatgtgatcgtcaatatggaaccgcccccacagacagtcgctgaactggtgggaaaacctagccaccagatgagtagaagcgacgcggaatccttagccggagtgacaaagctgaataatagtaaatctgttgcctctctcaacagaagccctgagaggcgaaagcacgagagtgatagctcgtctatagaagaccccgggcaagcctacgtactcggcatgacaatgcactcctctggcaactccagctcgcaggtgcccttgaaagaaaatgacgtgttgcacaaacggtggtcaattgtgtcttcaccggagcgggagattactcttgtcaaccttaagaaagatgccaagtatgggcttggatttcaaattatcggcggcgagaaaatggggcggctagacttgggcatctttatctctagcgtggcccccggaggtcccgcggatctagatgggtgcctcaagcctggcgaccggctgatttctgtaaactctgtctcccttgaaggcgtgtcccatcacgcggccatcgaaatcctgcagaatgcccccgaggacgtaacactggtgattagccagcctaaggaaaaaatttcaaaggtgccttccacacctgtgcatctaaccaatgagatgaagaattacatgaaaaagagcagctatatgcaggactccgccatcgattcctcttcaaaggaccaccactggtcacgcgggactctccggcacatttcagagaactcttttggacctagcgggggactgagagaggggtcgctctcctcacaggactctcgtacagagagtgcaagtctcagtcaaagccaggtcaacggctttttcgcaagtcatctgggagaccagacatggcaggagtctcaacacggaagtccaagcccttcagtcatttctaaggcgacagaaaaggagacatttactgactccaaccagtccaagactaagaagccggggatttcggacgttactgattacagtgaccggggcgactctgatatggacgaggcaacctattcaagttcccaggaccatcagacgcctaagcaggagtccagttccagcgtgaatacctctaataaaatgaattttaaaacattcagctcttcacccccgaagccgggagacatttttgaggttgagctcgctaagaacgacaactccttaggtattagcgtgacaggcggagttaacacaagcgttagacacggcggcatttatgtcaaagccgtgattccacagggggcagcggaatcagacggaaggatccacaagggtgacagggtgctggcggtcaatggcgtatcacttgaaggggccactcacaaacaggcagtcgaaacactgaggaataccggccaggtggtgcacttattattggaaaaagggcagtcgccaaccagcaaagagcacgtgccggtcacgccacaatgcacactgtccgaccagaatgcgcagggacaaggtcccgagaaggtcaagaagacaacacaggtgaaggactattccttcgttactgaagagaacacgtttgaggtgaaactgttcaaaaattccagcggactgggtttctctttttcacgcgaagacaaccttatccctgagcagatcaacgcttctattgtgagggtcaaaaagcttttcccaggccagcctgccgccgagtctggcaaaattgatgttggagacgtgattctgaaggtgaatggtgcctcattgaagggtctgtcccaacaggaggttatctctgcactccggggtactgcccctgaggtgttcctgctgctttgcaggccacctcccggcgtcctcccagaaatagacactgctctactgactccactgcagtctcctgcccaggtcctgcctaactctagcaaggatagctcacagccttcctgtgttgagcagagtacctccagcgatgagaacgaaatgagtgacaagtccaagaaacaatgcaaatctccctctagaagggattcctacagtgacagctccggtagcggcgaagatgatctggtgactgccccggcgaacatctccaatagtacctggtcctccgcactccaccagactctgtctaatatggtcagccaggcccagtctcaccacgaagcacccaaatcacaggaggacactatttgcaccatgttttactacccccagaaaatccctaacaagcccgagtttgaggattccaacccatcccccttgccccccgatatggcgcccggacagagctaccagccacagagcgagtcggcaagcagctctagtatggacaagtatcacattcatcatattagcgagcctacacgccaagaaaactggaccccattgaagaacgatctggagaatcatctggaggacttcgagctcgaagtggaattgctgatcaccctgatcaaatctgaaaaaggatccctgggctttactgtgacgaaaggcaaccagcgcatcggctgctatgtgcacgatgtaatacaggatccagccaagtctgacggccggctaaaacctggcgataggctcatcaaggtcaatgataccgatgtcacaaatatgacgcacaccgacgcagtaaacctcctgcgtgcggcatccaaaactgtcagactggtgattgggcgagtacttgagctcccgaggatccccatgcttccccatctcttaccagacataacgcttacttgcaacaaggaggaactcggattcagcctgtgcggaggccacgatagcctttaccaagtggtctatatctccgacattaacccacgatccgtggcagctatcgaaggcaatttgcagctgctggatgtgatccattacgtaaatggagtaagcacccaagggatgacactggaggaggtaaatagagcattagatatgtctctccccagccttgtccttaaagctacccgcaacgaccttccggtggtccctagttctaagcggtccgctgtgagtgcccctaagagcacaaagggcaacgggagttactccgttggtagctgcagccagcctgctttgacacctaacgattcgttctccactgttgccggtgaagagataaatgaaatcagttatcctaaaggcaagtgcagcacctaccaaatcaagggctcaccaaacctgactctgcccaaggaatcttatattcaggaggacgatatctatgacgactcccaagaggccgaagtcatacaaagcctactcgacgttgttgatgaggaggcccaaaatctgctcaatgaaaataatgcagccggttatagttgcggcccagggactttgaagatgaatgggaagctttctgaagaaaggactgaagatacagactgcgatggctctcctcttcccgagtactttaccgaggctaccaagatgaatggctgcgaagagtactgtgaggagaaggtcaagtctgaaagtctgattcagaagccccaggaaaagaaaacggacgatgacgagattacatgggggaatgacgagctgccaatcgagcggaccaatcacgaggatagtgataaagaccacagctttctgacaaacgatgaactggcagtgctccccgtggttaaggtccttcctagtgggaagtatactggagcaaatttgaagtccgtaatccgggtccttagggggctgctagatcagggtataccctcaaaagaactggaaaacttacaagaactaaagcccctagaccagtgtctcattggtcagacaaaggagaatagacggaagaacagatataaaaatatcttgccctacgatgcaacccgcgttcctctaggagatgagggcggctatatcaatgcgagcttcattaaaattcctgtgggaaaggaggagtttgtgtacatcgcatgtcagggtccgctccccacaaccgtgggggacttttggcagatgatttgggagcagaagtctacggtgatcgctatgatgacgcaagaggtggagggggaaaagatcaagtgtcagcgctactggcccaacatacttggaaaaacaacaatggtgtccaataggctgagactggccctggtgcgaatgcagcagctgaagggctttgtcgtccgcgccatgactctggaagatattcagacgcgggaggtccgacacatctcacacctcaactttaccgcttggcccgatcatgacacccccagtcagccagatgatctgttgactttcatttcttatatgagacatatccatcggtccggacctattatcacccattgctccgctggaatcggccgttctggaactttaatctgtatagacgtggttctcggcctgatcagtcaggacctcgactttgatatctccgacctggttagatgcatgcggcttcagcgccacgggatggttcagaccgaggaccagtacatattctgctatcaggtcatattgtacgtgctcactcgccttcaagcagaggaagagcagaaacagcagccccagctgctgaaatag

SEQ ID NO: 201661 - DNA, 7401 bp, Artificial Sequence
  Description of Artificial Sequence: Synthetic coding sequence
atgcacgtgagcctggccgaggccctggaggtgcggggcggccccttgcaggaggaagagatctgggctgttcttaatcaatcggccgagtcactgcaggaactattcaggaaggtgtctctagctgaccctgctgcattggggttcattatcagtccttggagtctcctcttgctccctagcggtagcgtgagcttcaccgacgagaacatttctaaccaggacctgagagcctttactgctccagaagtactccagaaccagagcctaacgtcactatccgatgtagaaaaaatccatatttatagtttgggcatgactctgtactggggcgcggattatgaggtgccacagtcccaaccaatcaagttaggagaccatttgaattcaatccttctgggtatgtgcgaagacgtgatttatgcccgcgtctcagtacgcaccgtcctcgatgcctgctccgcacatattagaaattctaactgcgctcccagtttcagctacgtgaaacacctcgtcaagctggtgctcggaaatcttagtggaacagatcagctcagctgcaacagcgagcagaagccagaccgcagtcaggcaataagggatcgcctgcgcgggaaagggttaccaaccggaagaagctcgacttccgacgtgctcgatattcagaaacctccactaagtcaccagacattcctgaataaaggactcagcaagagcatgggtttcctgtctatcaaagatactcaggacgaaaattacttcaaggatattctcagtgacaatagcggcagagaagactcagagaacacctttagcccctatcaattcaaaacaagcggccccgagaagaagcccattcccggaatcgacgtgttatctaaaaaaaagatctgggccagcagcatggacctcctgtgcactgctgacagagacttttcatcaggggagaccgccacataccggcgttgtcaccccgaggcagtgaccgtgaggacctccaccacaccccgaaagaaagaggctaggtacagcgatggctctatcgcactagacatctttggcccacaaaagatggatccaatctaccacacccgggagttacctacttcttccgctatttctagtgccctggaccgaatccgcgaaagacagaagaaactacaggttcttcgggaggccatgaatgtggaagagcctgttcgtcggtacaaaacctaccatggagacgtattctccacttcgagtgagtctccctctattatctcgagcgagagtgactttagacaagtaagacgctcagaagcctcgaaaaggtttgagagctcctctggtctgcccggggtggatgagacactaagccagggacagagccaaaggccctcaagacagtacgagacccctttcgaaggtaatctcattaatcaggaaatcatgttaaaaaggcaggaagaagagttgatgcaactgcaggcgaagatggctttacggcaatcccggctatctctttacccgggggatacgatcaaggcatccatgcttgacattacgcgggaccctctgcgtgagattgccttggaaactgcgatgacccaacgtaaattacgcaattttttcgggcccgagttcgtaaaaatgactatcgagccctttatctcgctggacctgcccagatctattctgaccaaaaagggtaaaaacgaggacaatcggagaaaggtgaatatcatgctactgaatggacaacgcttagagctgacatgcgataccaaaacaatctgtaaggacgtattcgatatggtggttgcccacattggattagtggaacatcacttgttcgcacttgccacacttaaagataatgaatacttcttcgtggatccagatctgaagctcaccaaggtcgctccagagggctggaaggaagagcctaagaaaaagacgaaggcaacagtcaactttaccttgttcttcaggatcaaattctttatggacgacgtgtccctgattcagcacaccctgacctgtcaccaatactatctgcagttgcggaaggatattttagaggaacgcatgcattgcgatgacgagacttctttgctgctcgcctcactggctctccaagccgagtatggggactaccaaccagaagttcatggtgtctcgtatttcagaatggagcactatctgcctgcacgagtgatggagaaactggacctttcatacatcaaggaggagctacccaaattacataacacatatgtgggtgcttcagaaaaggagacagaactcgagttcctgaaggtttgccaaagattgactgagtacggagttcacttccaccgggttcatccggaaaagaaatcgcaaaccgggatcctgctgggggtctgctcgaaaggcgtgcttgtcttcgaagtgcacaacggagtgaggacattggtcctgaggttcccgtggcgcgagaccaaaaaaatttctttcagtaagaaaaaaatcacactgcaaaacacaagtgatggcattaagcatggcttccagacagataacagtaaaatatgccagtatctcctgcatctctgcagctaccagcataagttccagctccagatgagagctcgccagagtaaccaggacgcccaagatatcgagagagccagttttaggtctctgaatctccaggctgaatccgtgaggggctttaacatgggacgcgccataagcacaggcagcctggccagcagcacattgaacaagcttgccgtgcgtccactctctgtacaagcagaaatacttaagcgccttagctgctccgaactcagcttgtaccagcctctgcagaattcaagtaaggagaagaacgataaagcctcctgggaggagaaaccccgggaaatgtcgaagagctatcacgacctgtcccaagcttcactctatcctcatagaaaaaacgtaatagttaacatggagccaccacctcagaccgtggccgagctggtcggcaagcccagtcatcagatgtccagaagcgatgccgagagtctggccggcgtcaccaagttaaataattcaaaatccgtggcaagtctcaatcggagccctgagagaaggaagcacgagtccgatagctctagtattgaagaccctgggcaggcttacgtgttggatgtgttgcacaaacggtggtccatagtaagcagccctgaaagggagataacactggtaaacctaaagaaggacgccaagtacgggcttggctttcagataattggcggagagaagatggggcgcttggatttaggtattttcatcagctccgtggcccccggtgggccggccgatttggatggctgtctgaaacctggggatcgactgattagtgtaaactcagtgtccctggaaggtgtctctcatcatgctgccatcgagattctccaaaatgctcccgaggacgtgaccctcgtgatatcacagccaaaggagaagatttctaaggtcccatccactccagtgcatctgaccaacgaaatgaagaactacatgaaaaagtcctcctatatgcaggactctgctatcgattcctccagtaaagaccatcactggtcaagggggacactccgccacatatccgaaaacagcttcgggccctccggcggtctgcgtgagggcagcctgtcaagtcaggactcacgcacggaatcggcaagtcttagccagagccaggtgaacggattcttcgcctctcatctcggcgatcagacgtggcaggaaagtcagcacgggtcgcctagtccatcagtgatcagcaaggcaaccgagaaggagacattcacagattccaatcagtctaaaacaaaaaagcctggaatttccgatgtgaccgactacagcgaccggggggactccgacatggatgaggcaacctattcatcatctcaagatcaccagacaccaaagcaagaaagcagttcctcagtgaatacctctaacaaaatgaatttcaagactttttcgtcatccccacctaagcctggagatatatttgaagttgaacttgctaaaaacgataattctctgggtatctctgtaaccgggggcgtgaacacctccgtccgacatggcgggatctacgtgaaggctgtcatcccccagggcgcagctgaatccgatgggcgcatccataaaggggaccgggttttagcggtcaacggagtgtcgctagagggagccacacacaagcaggccgtagaaacccttcgcaacaccggtcaggtggtccacttactccttgagaaagggcagtcccccacctccaaggaacacgtgcctgttacaccgcagtgcacactgagcgatcaaaatgcccagggccaaggtcctgagaaggtgaaaaagactacccaggtgaaagactactcatttgtgaccgaagagaacacatttgaggtgaaactgttcaaaaactcatcaggtctgggcttcagcttttctagagaggacaatctgattcctgagcagattaatgcatcaatcgtgagagtgaagaaactgttcccaggccagccagctgcagaaagtgggaagatagacgtcggcgatgtgatccttaaggtgaatggggcaagccttaagggactcagccagcaggaagtaatttctgcactgcgcggcactgccccagaggtgtttctcctgctgtgcagacctccgcccggcgtcctgcccgaaatcgataccgcactactcacacctctgcagagccccgctcaggtgctgccaaatagtagcaaagatagcagccagccctcttgtgtggagcagtcaacctccagtgacgagaatgaaatgagcgataagtcaaaaaaacagtgcaaaagtccaagccggagggactcttactccgatagctcaggtagtggagaggacgatctcgtgacggcccccgccaacatctcgaattctacgtggagtagcgccctgcatcagacactcagcaatatggtcagccaggcccagagccaccacgaggctcccaagagtcaagaggatacaatttgtactatgttttactatccgcagaagatccccaataaaccggagtttgaagatagtaacccaagcccgcttcctccagacatggctccaggtcagagttatcagccccagtcagagtctgcgagttcatccagtatggacaagtatcacatccatcacatttcagaaccaacacggcaagaaaattggaccccactcaaaaacgatctggagaatcacctagaggatttcgagctggaggtcgagctcctgatcacccttatcaagtccgaaaaaggctccttagggttcacggtgacaaagggcaaccagagaatcggctgttacgtgcacgacgtcattcaggatcccgccaagagcgacggaagactgaaacccggtgaccggttgatcaaagtgaacgacactgacgtcactaacatgactcatactgatgcagtcaatctgctccgagctgccagcaagacagtgcgacttgtcattgggagagtgttggaactgccccgcatccctatgcttccccacttactccctgatataaccctcacatgcaataaggaggaactaggattctctctgtgcgggggtcacgatagtttataccaggtcgtttacatttctgacataaatcccaggagcgtcgctgccatagaaggtaatcttcagctgctcgacgtgatccactatgtgaacggcgtgagcacgcagggaatgacactcgaggaggtgaatagagccctggacatgtctctgccatcactggtgctgaaagccacaaggaacgaccttcccgtcgtaccgtccagcaaacggtccgcagtttcagcacccaagtccacaaagggaaatggcagctattctgttggtagctgttcccagcctgcactgacccccaatgacagtttttcgacggtggctggggaagagatcaatgagatctcttatcccaagggtaagtgttcaacatatcagattaaaggatcaccaaacctgactcttccaaaggagtcctatatacaggaggacgatatatacgacgactctcaggaagcggaggtgatccagtccctgctggacgtagttgatgaggaagcacagaacctgctgaatgaaaacaatgctgcagggtacagttgcggcccaggcaccttaaaaatgaatgggaagctgagcgaggagcgtacagaagacactgattgcgacggatccccactgcctgagtacttcacagaggcgactaaaatgaatggctgcgaagaatattgtgaagagaaggttaagtcagagagcctgatacagaagccacaggagaagaaaacggatgacgacgagattacctgggggaacgacgaactccctatcgaacgaaccaatcatgaggattccgacaaggaccacagctttcttacaaacgatgagctggccgtgctgcctgttgtgaaggttctcccatcaggaaagtatacaggagcaaaccttaagtcagtaattagggtgttgagggggctgcttgaccaaggaattccttcaaaggaactggaaaatttgcaggagcttaagccccttgaccagtgcctgatcgggcagacaaaggaaaaccgtcgaaaaaatcgatacaaaaacatactcccgtacgatgcaacccgggttcctttgggggatgagggtggctacatcaatgcatcatttattaagatacctgtaggcaaggaagagtttgtatatattgcatgccagggtccgctacccacaaccgtcggggacttttggcaaatgatctgggagcagaaatctactgtcatagcaatgatgactcaagaagttgaaggcgagaaaatcaagtgtcagcgctactggcccaatattctgggaaagactacaatggtttcaaatcggctgcggctggcattagtccggatgcagcagctgaagggttttgtggtccgggctatgaccttggaggatattcagacaagagaggtcaggcacatctcccatctaaacttcacagcttggcctgatcatgacaccccatctcagccagatgacctactgacttttattagttacatgaggcacatccatcgctcgggacccattattacccattgcagtgccgggattggtcggagcggcaccctaatctgtattgacgtagttcttggccttatctcccaagacctggacttcgacatttcagatctggtgcggtgcatgcggctccagaggcatggaatggtacagactgaggatcaatacattttttgctaccaggtgattctttatgtcttaacccgtttgcaagcagaggaggaacagaagcaacaaccacaactgctcaagtag

SEQ ID NO: 201662 - DNA, 7473 bp, Artificial Sequence
  Description of Artificial Sequence: Synthetic coding sequence
atgcacgtgagcctggccgaggccctggaggtgcggggcggccccttgcaggaggaagagatttgggctgtgctgaaccagtccgcagagtcactgcaggaattgttccgaaaggtgtccctggcagaccctgccgccttgggcttcataattagcccatggagccttttgctgctcccctctggctctgtctcctttaccgatgaaaatatctccaatcaggacttgagagcctttaccgcgccggaggttctgcaaaaccaatcgctaacaagcctttcagatgtggaaaaaatacacatttattctcttggcatgactttatactggggagctgactatgaagtgcctcaatcccaacccatcaaattaggtgaccaccttaactctatcttactgggcatgtgtgaggacgtgatctatgcacgtgtctccgtgcgtaccgttctcgatgcatgtagcgcccatatccgcaatagtaattgcgctcctagcttttcctacgtgaagcatctcgtcaagctggtcctggggaacctgagcggaacggaccagttatcctgcaactctgaacagaaacctgaccgatcgcaggctattcgggaccgcttacggggaaaaggtctgcccacaggcagatccagtacatccgatgttctcgatatacaaaagcccccgctctcacaccagacgttcttgaacaagggacttagcaaatccatgggcttcctctccatcaaggatacgcaggacgaaaactatttcaaagacatactgtcagataattctgggcgcgaggactctgagaatacttttagtccttatcaattcaagacaagtgggcctgaaaaaaagcccattcctggcattgacgtgctgtctaagaaaaagatctgggcctcaagcatggacctgctctgcacggctgatcgggatttcagctctggggaaaccgccacgtaccgtcggtgtcatcccgaggccgtgaccgtccgaactagcactactccccgaaaaaaggaggctcgctattctgacggaagcatagctctggatatctttggcccccaaaaaatggaccctatttaccatactagggagctgccaacctccagcgcgatctcctctgccctagatcggatccgggagcgtcaaaaaaagctgcaggtgctgcgggaagccatgaacgtggaagaaccggtgcggcgctataagacataccacggtgatgtgttttccacttcctcggagtctccatccatcatttcttccgagagcgattttcggcaggtccgcaggtctgaagcatctaaacgttttgaatccagcagcggtttgcccggtgtggatgaaactctcagtcagggacagagccaaagaccctctaggcaatatgaaactcctttcgaaggaaatctcatcaaccaggaaatcatgttgaaaaggcaggaagaggagcttatgcagttacaggcaaaaatggctctgaggcagagccgcctgagcttgtaccccggcgacaccattaaggcttctatgctggatataactagggatcccctgcgcgagatcgcacttgaaaccgctatgacacagaggaaacttcggaacttttttggccctgagtttgtaaagatgacgattgagcctttcatctcattagatctgcccagatctatactcactaagaaggggaagaatgaagacaaccggcggaaggttaacattatgctcctgaatgggcagaggttggagctcacttgtgacactaagactatatgtaaagatgtgtttgacatggtcgtggctcacataggactggtggagcaccacctcttcgcacttgccaccctgaaggataatgagtatttctttgtcgatccagacctgaaacttactaaggtcgcaccggaggggtggaaggaagagccaaagaaaaaaacaaaggccactgtcaatttcaccctgttctttcgaatcaagttcttcatggatgatgtctctctgattcagcacactctgacatgccaccaatattatctgcaactgcgaaaggacatcctagaggaacggatgcactgcgatgacgagacaagcctgttgctggcatcgcttgccttacaggcggagtacggcgattaccagcctgaggtccatggggtgagctacttcaggatggagcactacttgcctgcccgggttatggagaaactcgatttgagctacatcaaggaagaacttcctaagctccacaatacctacgtgggagcctctgagaaggaaacagagctcgagtttctcaaggtttgccagaggctcactgagtatggagtgcatttccatcgggttcaccccgaaaagaagtcgcagacaggcattctgctcggagtttgttccaagggagtgctggtgttcgaggttcacaacggagtgagaaccctggttcttaggtttccctggagagagacaaagaagatctccttctcaaaaaagaagataaccctgcagaacacctccgatggaataaagcacggatttcagaccgataatagcaaaatttgccagtacctcttacatctttgctcttaccagcataagtttcagctgcagatgcgggccagacagtccaaccaggatgctcaagatatagaacgggcctcatttcggtcactgaacctccaggcagagtcagtccgcggatttaacatgggccgagccataagtaccggatctctcgcgtcatcaaccctgaacaaactggctgttaggcctttgagtgtgcaagcggagattcttaagaggctgtcttgctccgagctcagtctgtaccagcctctgcagaacagtagcaaagaaaagaatgacaaggcctcgtgggaagagaaacctcgcgaaatgagcaagtcttaccatgatcttagccaggcctctttgtacccgcatcgcaagaatgtgatcgttaatatggaacctcctccacagactgtggcagagctggtgggaaagccgagccaccaaatgtctcgctccgatgctgaatcactggcaggtgtaaccaagctgaataatagtaagagcgttgcttccctgaacagatctccagaaagaagaaaacatgagtccgattcatcctctattgaggacccggggcaggcctatgttctcgggatgaccatgcactcctcaggtaattctagttctcaggtccctctaaaggagaatgacgtactccacaagcgctggtccatcgttagttctcccgagcgggagattacactggtcaacctgaaaaaggacgccaaatacgggctgggctttcagattatcggaggagagaagatgggacgtttagatcttggcatcttcatatcctctgtggcccctgggggccctgcagatctggatgggtgtctgaagccgggggacagactgataagtgtcaactccgttagcttggagggggtgagccatcacgccgctatcgagatcctacagaatgctcccgaggacgtgacactagtcataagccaaccaaaggagaagatctccaaggtgcctagtacacctgtacacctcaccaatgagatgaaaaattacatgaagaaatcttcgtatatgcaggattcagccatcgactcctcttctaaagaccaccattggagccgaggtacattgagacatatttccgagaactcatttggaccgtctgggggcctgagggaagggtcactttcctctcaggattctcgaaccgagagcgccagcctttcccagagccaagtgaatgggttttttgcatcccacctgggagaccaaacctggcaggagtcacagcacggatcgccctcaccgtctgttatatcaaaggctacagagaaggaaaccttcaccgatagtaatcagagcaaaacaaagaagcccggaatctcggacgttacagactattccgataggggtgattccgatatggacgaagccacatattccagctcccaggaccaccaaacacctaagcaagaatcgtcgtcaagcgtgaacacctccaataaaatgaatttcaagacgttcagctcatcccctccaaaacctggggacatttttgaggtggagttagccaagaacgataactctcttggcatctctgtgacagtgctgttcgataagggcggggttaatacctcggtgcggcacgggggcatctacgtcaaggccgtgatcccacaaggcgccgctgagtccgatgggcggatccataaaggggatcgagtacttgccgtaaacggtgtgtctcttgaaggagccacacacaaacaggccgtcgaaacgctgagaaatactggccaagttgttcacctactgctggaaaagggtcagtcccccaccagtaaagaacatgttcccgtaaccccccagtgtacgcttagcgaccagaacgcccaggggcaaggtccggagaaagtaaagaagacgacccaggtgaaagattacagttttgtgacggaagagaatacctttgaggttaagctcttcaaaaactcgtccgggctgggattctccttctcccgagaggacaacctgatccccgagcagattaacgcctctatcgtgagggttaagaagcttttcccagggcagccagccgcagagtctggtaaaatagacgtgggggacgtgatactaaaagttaatggcgcctcactgaagggattgagccagcaggaggtcatatccgccctgcgcggtacagctccagaagtatttctgttactgtgcaggccaccgcccggggtgctgcccgaaattgatacggcattgcttacacccctgcaatcccctgctcaggtcctcccaaacagttcaaaagactcaagccagcccagttgcgttgaacagtctactagctccgacgaaaacgagatgagcgacaaatccaagaaacagtgcaagagtccaagcaggcgcgacagttactctgattcgtctggaagcggcgaggacgacttagtcactgcccctgcgaacatcagcaattccacgtggagcagtgccctccaccagactctgagtaatatggtgtctcaggcccagagtcatcatgaggcgcctaagagtcaggaagatacaatctgcactatgttttactatccgcaaaaaatcccaaataagcctgagtttgaggacagtaatccaagtcccctcccaccagatatggctcctggacagagctaccagcctcagagtgaatcagcctccagctcatccatggacaagtaccatattcatcatatttcagagcccactcgacaggagaattggacgcccctgaagaacgatctcgagaatcacctggaggactttgagctggaggtggaactgctgattactctaataaaaagtgagaagggatctctgggcttcaccgtgactaaaggaaatcaacgaatcggatgctatgtgcacgatgtaatccaagaccccgccaaatcagatgggcggttaaaacctggcgatagattaattaaagtgaatgacactgacgtgaccaacatgacacacaccgatgcagtcaaccttttgagggctgcatctaaaacggttcgactggtgattggtcgggtgctggagcttccacggattcctatgctgcctcacttgctgcctgatataaccctgacctgtaacaaggaggagttgggattctctttatgcggggggcacgactctctctaccaggtcgtctacatttccgatattaaccctaggagtgtggccgcaatcgaaggtaacttacagcttctcgatgtgatccactatgtcaacggggtctctactcagggtatgaccctggaggaggttaatcgggcgctggacatgtcactaccaagcctcgtcctgaaggcaacgcgcaatgatctccccgtcgtcccaagttctaagcgatcggccgtgtcagcccctaaatccaccaaggggaatggaagctactcagtggggagctgtagccagcctgccctcacccctaatgatagtttttctactgtggcgggggaagaaatcaatgagattagttatcctaaaggaaagtgcagtacataccagataaaagggagtcccaacctgacactgccaaaagaatcttatatacaagaggacgacatatacgatgattcccaggaggcagaggtgatacagagtctgcttgacgtcgtcgacgaagaggcccagaacctcttgaacgaaaacaatgccgccggatacagctgcggaccagggactttaaagatgaatggaaaattgtcagaagagaggactgaagatactgactgtgacgggagtcctctgcctgagtacttcaccgaggccacaaagatgaatggatgtgaggagtactgtgaggagaaagtgaagtccgaatccctgatccagaaaccacaagagaaaaagacagatgatgatgaaattacatggggaaacgacgagctgcctatcgaaaggacgaatcacgaggactctgacaaagaccattcattcttgactaatgacgagctggctgtacttccagtggtgaaagtgctcccttccggaaagtacacaggcgccaatcttaaatcggtgattagggtcttgcgaggcttgttggatcaaggaatcccctccaaggaactggagaatctgcaggaattaaagcctctggaccaatgtttaatcgggcagaccaaggaaaatcggaggaagaatcgatacaaaaacatcctcccatacgacgcaacccgtgttcccctgggtgatgaaggaggatacattaacgcttctttcatcaagattcctgtcggaaaagaagagtttgtctacattgcttgccaggggccactccctacaaccgtcggggatttttggcagatgatctgggaacaaaaaagcacagtgatcgcaatgatgacccaagaagtagagggagagaaaatcaagtgccagcggtactggccaaacatccttggcaagaccacgatggtcagtaaccgtctaagactggcactggtgcggatgcagcagctgaaaggtttcgtggtaagagcaatgactctggaggatatacaaaccagggaggtgcggcacatcagccatcttaatttcacagcttggcccgatcacgacacaccaagtcaacctgacgacttactgacattcatcagctatatgagacacatacacaggtccggaccaatcataacccactgttccgctggcatcggcagaagcggtaccctaatctgtattgacgttgtgttaggattaatctcacaggatctggacttcgatatctctgacttggtgcgctgtatgagacttcagagacacggaatggtccagaccgaagatcagtacattttttgctatcaggtgatcctatacgtcctgacacgcctgcaggccgaagaggagcagaaacaacagcctcagctgctgaaatag

SEQ ID NO: 201663 - DNA, 420 bp, Artificial Sequence
  Description of Artificial Sequence: Synthetic coding sequence
atgcacgtgagcctggccgaggccctggaggtgcggggcggccccctgcaagaggaagagatctgggccgtgctgaaccagtctgcagaaagcctccaagaactgtttcggaaggttagtttggctgatcctgccgccctgggctttatcatttccccctggtccctgttgctccttccgagcgggtcagtgtcttttactgacgaaaacatctctaaccaggatttacgcgcgttcaccgccccagaagtgcttcagaatcaatcgctgacaagcctcagtgatgttgaaaagatccatatctacagtctcggaatgaccctttactggggcgctgactacgaagtgccacagagccaaccaataaagttgggagatcatttaaacagtattctgctcgggatgtgtgaagacgtatag

SEQ ID NO: 201664 - DNA, 7473 bp, Artificial Sequence
  Description of Artificial Sequence: Synthetic coding sequence
atgcacgtgagcctggccgaggccctggaggtgcggggcggccccctgcaggaagaagaaatctgggctgttctcaatcagagcgctgagtccctccaggaactttttcgtaaggtctcccttgcagatccagctgcactaggcttcatcataagtccctggagtctcctcttgctgcccagcggtagcgtctcttttacggacgagaatattagtaatcaagacctgcgggcctttacggctcccgaggtgttacaaaatcagtccctcactagtctttctgatgtcgagaaaatacacatctacagtttaggcatgaccctgtactggggggcagactatgaggtcccacagagccagccaataaaacttggggatcatctgaactctatcctgctggggatgtgtgaggacgtcatctatgcgagagtaagcgtgcgaaccgtgctcgacgcatgcagcgcccacattagaaacagtaattgtgctccatctttctcttacgtgaaacacttagttaaactcgtcttgggcaatttaagcggcactgaccagctttcttgtaatagcgaacaaaagcctgatagaagccaggctatcagggaccgcctcaggggaaaaggactaccaacaggcaggagcagcacttccgacgtgcttgacatccaaaaacctcccctgtcccatcagacatttctgaataagggcttgtctaaatcaatgggttttttatccattaaagatacacaggacgagaactattttaaggatatactgagtgataactctggccgggaggatagtgagaatacgttctctccatatcaattcaagaccagtgggcctgagaagaaaccaatccctggcatcgatgtgctgtctaagaaaaagatatgggccagctccatggaccttctgtgcaccgccgatcgtgatttctcttccggggagaccgctacatatcgaaggtgccatcccgaagcagtcactgtgcggacgtccacaacccctcggaagaaggaggccaggtatagcgatggtagcattgccctcgacatctttggaccgcagaagatggatcccatctaccatacgcgggagctgccaacttcctcagctataagctccgcactcgatcgtattagagagaggcaaaagaaattacaggttcttagggaagcgatgaatgtcgaggagccagtccggcgatacaaaacttatcacggcgatgtcttctctacgagtagcgaatcacctagcatcataagttctgagtcggatttcagacaggttcggcggagcgaggcctccaagcgcttcgaatcaagcagcggcctgcctggcgttgacgagacgctgagccaaggccagagtcaaagaccttcccgccagtacgagaccccattcgagggcaacctcatcaaccaggagatcatgctgaagcgccaggaggaagaactgatgcagctccaggcaaaaatggccttgagacagagtcggctgtctctgtaccctggcgatactataaaggccagcatgctggatattaccagggacccactcagggaaattgccttggagacagcaatgacacagagaaagctgcgcaacttcttcgggcccgagttcgtgaaaatgacaattgaacctttcatctcgcttgatctgccgcgctctattcttactaaaaagggcaagaatgaggataacaggcggaaggtaaatataatgctgctcaacggtcaaaggctggaactgacctgtgacaccaagacaatttgcaaggacgtcttcgatatggtggtcgcccatatcggcctggtcgaacaccatctgttcgccctggcaaccctgaaagacaatgagtacttttttgttgatccagacctcaagcttactaaggtcgcgccagaagggtggaaggaggagcctaaaaagaagactaaggccactgtaaactttaccctcttcttccgaatcaagttctttatggacgacgtgtcactgatccaacatacccttacctgccatcagtactacttgcagctccgtaaggacatcctcgaggagagaatgcattgcgatgatgagacttccctgctgcttgccagtcttgccttgcaagccgagtacggggactatcagcccgaagtgcatggggtgagttatttcagaatggagcattatttaccagcaagggtaatggaaaaacttgatcttagctacattaaagaggaactccccaagctgcacaatacatatgtgggagcttctgaaaaggaaaccgaactcgaattcctcaaagtctgccagcgactaacagaatatggtgtgcacttccatcgcgtgcaccccgaaaagaaaagccagacagggatcctgcttggcgtttgttccaagggtgttctggtctttgaggttcacaacggcgttaggactctcgtcctgcgttttccctggagggaaacaaaaaagatcagttttagcaaaaagaaaattacacttcagaataccagtgatggtattaaacacggattccagactgataattctaagatctgccagtacctgctgcatctgtgttcgtatcaacacaaatttcagcttcagatgagggcccgccagagtaatcaggacgctcaagacatcgaacgcgcatcattccgaagtctgaacctccaggcagaatccgtccggggcttcaacatggggagggccatctccacggggtccctcgccagctccactctgaacaagctagcagtgcgccccctgtctgtgcaggcagagatcctgaagcgactgtcctgtagcgagctgtccttgtatcagcccctgcagaattcttcaaaggaaaagaacgataaggccagctgggaggaaaaacctcgtgaaatgtctaagagctaccatgatttgagccaggcctccctgtaccctcaccgtaaaaacgtgatcgtcaatatggagcccccccctcaaaccgtggccgaattagtcggtaagcccagtcaccagatgtcacggagcgatgccgagtctttggcaggagtcacgaaactgaataacagtaagagcgtggcaagcctgaatcgctccccagagagaagaaagcacgaatccgatagttcatctattgaagacccaggccaggcttatgtgctgggcatgacaatgcattcctccgggaactcttcctcacaggtcccactcaaagagaacgatgtgctacacaaaaggtggtcaatagtttcatcccccgagagggaaattaccttagtcaacttgaaaaaagacgcgaaatacgggctgggcttccagataatcggaggggaaaagatgggtagacttgatctcggaatcttcataagctccgttgccccaggaggaccagcggatctggacgggtgcctgaagcctggggacaggcttattagtgttaattctgtgagcctcgagggggtttctcatcatgccgcaattgagattctacagaacgcacccgaggatgtcacactcgttattagccagcctaaagagaagatatctaaggtgccgtctaccccagtgcatttgaccaacgagatgaagaactacatgaaaaaaagtagttatatgcaggattcagccatcgacagctcgtccaaggaccaccactggtctcgaggaactctgcggcacatctccgagaatagcttcggaccttctggtgggctcagggagggatctttaagttcccaggactcacgaaccgagtctgctagcctgtcccagtcacaggtcaatgggtttttcgcttcacacctgggggaccagacatggcaagagtcacagcatggaagtccaagcccatccgtgataagcaaagccacagaaaaagaaacatttacagactccaatcagagcaagacaaagaagccgggaatctctgatgtaactgactatagtgatcgcggggatagcgacatggacgaagcaacatattcgtcgtcacaggatcaccagacaccgaaacaggagagctcttcttctgttaatacctccaacaagatgaactttaaaactttttccagcagcccacctaagccaggtgacatttttgaagtggagctcgccaaaaacgacaactcactgggaatttcggtaactgtgctttttgacaagggcggagtcaacacctcagtgcgccacggggggatatacgtcaaagcagttatcccacagggtgccgctgagagcgatggaaggatccacaagggagatcgagtgcttgcagtcaacggcgtcagtctggaaggtgccactcacaagcaggccgtcgagacacttcgcaatacagggcaagttgtccatttgcttctagaaaaggggcagtcgcctaccagtaaggagcacgtccccgtgactccacagtgtactttgtctgaccagaacgcacagggtcagggaccagaaaaggtgaagaagaccactcaggttaaagactattcattcgttaccgaagagaacacatttgaagtgaagctcttcaagaattcttccggtctggggtttagcttctctagggaggataatctgattcccgaacagatcaatgctagtatcgtgagggtgaagaaactctttccaggacaacccgcagccgaatccgggaaaattgacgtcggagacgtcatactcaaagtcaacggagcgtccctgaaggggctaagtcagcaagaggttatcagcgctctgcgcggaaccgcaccggaggtgtttctgctgctgtgtagacctcctcccggggtcctgccagagattgacaccgccctattgacccctctgcagtcacccgcgcaagttcttcccaactcgtcaaaagattccagccagcctagctgtgtggaacagtcaacgtcctctgacgagaacgagatgagcgacaaatcaaagaagcaatgtaagagcccctcacgaagggactcatattccgattcttctggcagtggggaagatgatctggtgacggcgccggccaacatctcaaatagcacctggagcagcgctcttcatcagactctgtctaatatggttagtcaagcgcagtctcatcatgaagcacctaaaagccaagaagacaccatctgtactatgttttattacccccagaaaattccgaacaagcctgagtttgaagacagcaatcctagccccttgccgccagatatggctccagggcagagttaccaacctcagagtgagagcgcatccagtagctccatggataaataccacatacatcacattagcgagccaacgcggcaggaaaattggactcccctgaagaatgacctagagaaccacctggaggattttgaattagaggtcgaacttcttattaccctgatcaaatccgagaaaggatccctcgggttcacggtgaccaaagggaaccagagaatcgggtgctatgtccatgacgtgatccaagatcccgccaaaagcgacggccgattaaagccaggggatcgtttgattaaagtcaatgacaccgacgtaacaaacatgactcacacggacgccgtgaatctgctccgcgcggcctcaaaaacagttagactggttatcggccgagttcttgaattgccaaggatcccaatgctgccccacctcctcccagacatcaccttgacctgtaataaggaggagctggggttctctctatgtggagggcatgattctctttaccaggtggtttatattagcgatatcaatcctagatcagtagcagctattgaaggaaatcttcaacttctggatgtgatacactacgtcaacggggtctctactcagggaatgacgctagaggaagtaaatcgcgctctcgacatgagcctaccatctctggttctaaaggcaaccaggaacgaccttccggtggtgccctccagcaagaggtctgcagtgtctgccccgaagagcacaaaaggaaatggctcttatagtgtagggtcctgcagtcagcccgcgttgacaccgaatgacagcttttccacagtggcaggcgaagaaatcaacgaaatcagttatccaaagggcaaatgctcgacatatcagatcaagggcagccctaacttgaccttaccgaaggagtcctatatccaggaggacgatatctacgacgacagtcaggaggccgaggttattcagagcctcctggatgtcgtggatgaggaagctcagaatctcctgaacgaaaacaatgcagccgggtacagctgtggtcctggaacactgaagatgaacggtaaactgtccgaggagcgcacagaggataccgattgcgacggaagtcctcttcccgagtatttcactgaagcgacaaagatgaacggttgcgaagaatactgcgaggagaaggtgaagagtgaaagcctgatacagaagcctcaggagaagaaaacagacgacgacgaaataacgtggggcaacgacgaactgcccatcgagcgcactaatcatgaagatagcgacaaggaccatagcttcttaacaaacgatgaattagccgtgctgccggtggtgaaggtcctcccatcgggaaaatacaccggagctaacttgaaaagtgtcatcagggtgttgcgcggcctgttagaccagggcataccaagtaaggaactcgagaacctacaggagttgaaacctcttgaccagtgcctcattggccaaacgaaggaaaacaggaggaaaaaccggtacaaaaatatactgccatacgacgcgaccagggtcccactgggagacgaaggtggatatataaatgcttcctttattaagatacccgtgggcaaggaggaatttgtgtacattgcttgtcagggaccactgcctacgaccgtcggcgatttttggcagatgatctgggagcagaaatctaccgtgattgccatgatgacacaggaggtggaaggcgaaaagatcaaatgccagaggtattggccgaatattctcggaaagacaacaatggtgtccaatagacttcgtttggctctagtcagaatgcagcaattaaaagggtttgtggtgcgggcaatgaccctggaagacatacagacccgagaggtgagacacatcagccatctaaacttcaccgcttggcctgatcacgacaccccctctcaaccggatgatctgctaacattcatcagttacatgcggcatatccaccgttccggacctatcatcacacactgctctgccgggatcggtagatccggcactctgatttgcattgacgtggtgctcggactcatctcccaggatctggacttcgatatttccgatctcgtgcgttgcatgcggctgcaaagacacggcatggtgcagaccgaggatcagtacatattttgctaccaggtgatactgtacgtgctcacgcgcctgcaagcagaagaagagcagaaacaacaaccacaactgctgaagtag

SEQ ID NO: 201665 - DNA, 3564 bp, Artificial Sequence
  Description of Artificial Sequence: Synthetic coding sequence
atgcccttcggcctgaagctgcggcggacccggcggtacaacgtgctttcaaaaaactgtttcgtaacccgcataagactactcgatagcaatgttatcgagtgtaccctgtcagtcgagagcacagggcaagagtgcctcgaagccgtagctcagaggctggagttgcgggagacacattactttgggttgtggtttcttagtaagagccagcaggccagatgggttgagttggagaagccactgaagaagcacctcgacaaattcgctaacgagcctctgttgttctttggcgtgatgttctatgtccctaatgtgagctggctacaacaggaagcaactcgctaccagtattacctgcaggtgaagaaagatgttctggaaggccgcttgaggtgtaccctggatcaggttatacggctcgcagggctggccgtgcaggcagattttggcgactacaatcagttcgactcacaagattttctgcgagaatacgtgctgtttcctatggacctggctctggaagaagctgtactagaagagttgacccaaaaggtcgcgcaggaacataaagcccactccgggatattgcctgcggaagccgagctcatgtacattaacgaagtcgaacggctggacggctttggacaagaaatcttccccgtgaaagacaatcatggaaactgcgtgcatctgggtatcttcttcatgggaatatttgtgcgtaaccggatagggcgccaggcagtaatatatcgctggaatgacatgggcaacatcacccacaataaatctacaatcttggttgagttaattaataaggaggagactgccctcttccacaccgacgacatcgaaaacgccaagtatatttccaggttgtttgctacacggcataagttttataaacagaacaagatttgtaccgaacagtcgaactctccgccgccaattcgaaggcaacctacgtggtcacgaagctccttgcctcggcaacagccttatatcctccctcccgttcatgtgcaatgtggagaacattattccgaaacccatacatctcaagacagtatttttcacggcaacgaggaagccctttactgtaactctcataacagcctggacttgaattatctgaacggaaccgtgacaaacggttcagtgtgtagtgtccactccgttaattcccttaactgcagccagagtttcatccaagcctcacccgtgtcttcaaacctctcaattccaggtagcgacattatgcgcgccgactacatcccaagtcaccgccacagcgccatcatcgttccttcctaccggcccacccccgactatgagaccgtcatgaggcagatgaaaagaggcatcctgcatactgattcgcaatcgcagagtctccggaaccttaatattataaatacacacgcctataatcagcccgaagatttggtgtattcacagcctgaaatgcgcgagcgtcacccatatactgtgccgtacggtccacagggagtctattcaaataaactggtcagtccaagtgaccagcgaaacccgaagaacaatgtcgtgccctctaaacccggcgctagcgccatctcacacactgtgtcaacgcctgagttggcaaacatgcaactgcaaggaagtcacaattatagtaccgcccacatgcttaagaactatctgttcaggccccccccaccgtatccccgtccacggcctgctaccagtacacccgatttggctagccatcgccataaatatgtgagcggtagctctcctgaccttgtcacaaggaaagttcagctcagtgtcaaaacatttcaggaggactccagccctgttgtgcaccagtcacttcaggaggtttccgagccattaacggcaaccaagcaccatggaactgtgaataagagacactcacttgaagtaatgaacagcatggtacgagggatggaggctatgaccctgaaaagcctgcacttgccaatggctaggaggaacaccttacgagagcaggggccacctgaggaaggtagtggatctcacgaggtgccccagctcccccagtatcaccacaagaagaccttttccgacgctaccatgttaatccactcttcagaatctgaggaggaggaggaggaagccccagagtcagtgccacagattccaatgttaagggagaagatggaatattctgcccagcttcaggctgctctcgctagaatccccaacaaaccccctcctgagtaccccggaccccgaaaaagcgtctccaacggtgctctgcgtcaggatcaggcatctctcccacccgcaatggcaagggcccgagtactgcgccacgggcccgctaaagcaattagtatgtctagaaccgatccccccgccgtcaacggcgcaagtttgggcccttctatttctgaaccagatttgacttccgtgaaggaacgcgtcaaaaaagagcccgtgaaagagaggccagtcagtgagatgtttagtctcgaagactctatcattgagcgcgagatgatgattagaaatcttgagaagcagaaaatggcaggattagaggcacagaagaggcctttgatgctggcggccctgaacgggttatctgtagcccgagtgtctggcagggaggagaaccgcgtcgacgcaacccgtgtgcctatggatgagagatttcggactctcaaaaaaaaactggaggagggaatggtgttcactgaatatgaacagatccccaagaagaaagcaaacgggatattttctaccgccgcactgcccgagaacgccgaacggagccggattagagaagtcgtgccatacgaggaaaacagagtagagttgattccaacaaaggagaacaacacaggttatattaatgcctctcatattaaggtcgtggtgggaggggccgagtggcattacatagcgacccaggggcccctgccacacacatgccacgacttttggcaaatggtctgggaacaaggagtcaacgtgattgcaatggttaccgcagaagaagaaggcggtagaactaagagtcaccggtactggcccaaactgggcagcaagcactcatctgcaacatacgggaagttcaaggttacaacgaagtttcgcaccgactcggtgtgctatgccaccacaggacttaaagtcaagcatctcctctctgggcaagagcgaaccgtctggcacctccagtatacggattggcccgaccacgggtgtcccgaggacgtgcagggtttcttatcttatctggaggaaattcaatcagtcaggcgacacacgaattcaatgcttgagggcacaaagaatcgtcatcctcctatcgtggtccactgcagcgctggcgtaggccgcaccggtgtcttgattctgagcgaattgatgatttactgtctcgagcacaatgagaaagtggaggtccctatgatgttaaggttattaagggagcagcggatgtttatgattcaaacgatcgctcagtataaatttgtgtatcaggtgctgattcagttcctccagaactcaagactgatctag

SEQ ID NO: 201666 - DNA, 636 bp, Artificial Sequence
  Description of Artificial Sequence: Synthetic coding sequence
atgcccttcggcctgaagctgcggcggacccggcggtacaacgtgttaagcaagaactgtttcgtgacgcgaatacggctacttgactccaatgtgatagagtgcactttgagcgtggaatcaactggacaggagtgtctggaggcagtggctcagaggctcgagctgagagagactcactactttggtctatggtttttgagtaagtctcagcaggcgcgctgggtcgaactggaaaagccactcaagaaacacctggataagtttgctaacgagccactgcttttctttggcgtcatgttctacgtgcccaacgtgtcatggcttcagcaagaagctactaggtaccagtactatttgcaggtgaagaaagatgtgttggaggggagactaaggtgcactctcgatcaggtgataagactcgcaggactggccgtccaggctgactttggggattataatcagtttgactcccaagacttcctcagggagtatgtcctatttcccatggaccttgccctggaggaagccgtattagaggaattgacccagaaagtagcccaagaacacaaggctcatcgtaccatcatggaaacggtctatacactggcgttctccttgtgggggttctcctag

SEQ ID NO: 201667 - DNA, 1383 bp, Artificial Sequence
  Description of Artificial Sequence: Synthetic coding sequence
atgagccggagcctggacagcgcccggagcttcctggagcggctggaagcccgaggggggagagaaggcgctgtgttggccggggaatttagtgacatccaggcatgttccgctgcatggaaagcggacggagtgtgctctaccgttgctggctcccgaccagagaacgtccggaaaaacagatacaaggatgtcctgccgtatgatcagactagggtgatcctgagtcttcttcaggaggaaggtcactcagactacattaatggaaattttatcaggggtgtggacggctctctcgcctacatcgcaacacagggacctctgcctcataccttgcttgacttctggaggctggtgtgggagtttggcgtgaaagtcatacttatggcttgccgagagatcgaaaacggacgtaagagatgtgagagatattgggctcaagaacaggaaccattgcagactggcctcttctgtatcaccctcattaaagaaaaatggctgaacgaggacatcatgctgcggactctgaaggtgactttccagaaggagtctcgctccgtttaccagctacagtacatgtcgtggccggatagaggcgtgccaagctccccagatcacatgctggccatggtggaggaggctcggagactgcagggctccggtcccgaaccgttgtgtgtccattgctccgccgggtgcggacgcactggagtgctgtgcaccgtggattatgttcggcaattactcttaacacagatgattccacccgacttcagtttatttgatgttgtgctcaagatgagaaaacagagacctgcagccgtgcagacagaagaacagtatcggttcctgtaccatacggtggctcagatgttttgctccactcttcagaatgcaagcccacactaccagaacatcaaagagaattgcgcacccttgtacgatgacgcactgttcctgcggaccccacaggcccttctggcaatccccagacctcccggtggagtccttagatctatttcggtcccgggctctcctgggcatgcaatggcagacacttacgcggtagtgcagaagcggggagccccagctggcgccggcagcggcactcagacaggcacagggactggcaccggggcccgttctgccgaggaggctcctctgtacagtaaggtgacccccagagcccagcgcccaggggcacacgccgaggacgcccgcggcactctcccaggccgtgtgcctgccgaccagtctccggctggttcgggcgcctacgaggacgtggcggggggggcacaaactggaggacttggatttaatttgcggattggccgtccaaagggcccgagggaccctcccgcagaatggactagagtttag

SEQ ID NO: 201668 - DNA, 1248 bp, Artificial Sequence
  Description of Artificial Sequence: Synthetic coding sequence
atgcccaccaccatcgagcgggagttcgaggagctggacacccagagacgctggcagcccctctatcttgagattaggaacgaatcgcatgattacccccatagggtcgccaagtttccagagaataggaaccggaaccgctaccgtgacgtgagcccctacgatcactcccgggtgaaattgcaaaacgcggagaacgactacatcaatgcgtcccttgtggacatcgaggaggctcaaagatcatacatactaacccagggaccattaccaaatacctgctgtcacttttggctgatggtgtggcaacaaaagaccaaagccgttgtgatgctcaaccgcatcgttgagaaggaatctgttaaatgtgcacagtactggcctacagacgatcaggaaatgcttttcaaagagacaggcttctctgtaaaacttttatctgaagatgtgaagagctactacactgtgcacctcctgcaactcgagaacattaatagtggcgagacccggacaatatctcactttcattacaccacctggcccgatttcggagtgccagagtcacccgcctcattcttaaactttctgtttaaggtccgagagtcagggtcgctgaacccagaccatgggcccgccgtgattcactgcagtgcaggaataggaagaagtggcacctttagtctggtggatacttgcctcgtgctgatggaaaaaggcgacgatattaatattaaacaggttctgcttaacatgcggaagtatcgaatgggcttgatacagacacccgaccaattacgattctcttacatggctatcatcgaaggagcaaaatgtatcaaaggcgactccagtattcagaagcgctggaaggagctctccaaggaagatttgtctccagcttttgaccacagccccaacaaaattatgacggaaaaatacaatggcaacaggatcggcctcgaggaggagaaactgaccggagaccgctgcaccggtcttagctccaaaatgcaggataccatggaagaaaatagcgagagcgctctgagaaagcggataagggaggaccgcaaggccaccacagcacagaaggtgcaacagatgaaacagcggttgaacgaaaatgagagaaaacgcaagagatggctctactggcagcccatcctgactaagatgggattcatgtctgtgatccttgtaggagcttttgtcgggtggaccctcttcttccagcaaaacgctctatag

SEQ ID NO: 201669 - DNA, 1164 bp, Artificial Sequence
  Description of Artificial Sequence: Synthetic coding sequence
atgcccaccaccatcgagcgggagttcgaggagctggacacccagagacggtggcagccgttgtatctggagatcagaaatgaaagtcacgactacccccacagggtagccaaatttcctgagaaccgcaatagaaataggtacagagacgtgtcaccctatgaccactctcgcgtgaagctccagaacgctgagaacgactacatcaacgcctctttagtggacatcgaggaggcccaaagatcttacattctgactcaggggccactgcctaatacatgctgtcacttctggttaatggtgtggcagcagaagacaaaagcagtggtcatgctcaaccgaatagtggaaaaggaatcggtcaaatgcgcgcagtactggccaaccgatgatcaagagatgttatttaaggagactggcttctccgtcaaactgttgagtgaagacgttaagtcttattacactgtacatctgttgcagcttgaaaatatcaatagcggggaaacccggacaatttcacattttcactataccacgtggcctgattttggcgtcccagagtcacctgcttcattcctcaactttctattcaaggtgagggagtcaggctctctgaatccggatcacggacctgccgttatacattgttccgctggcatcggcaggtccgggactttctctctagtcgatacctgtctggtgttgatggaaaagggggacgacatcaacattaagcaggtgcttctcaatatgcggaaataccgcatgggactgattcagactccggaccagctgagattttcttatatggctatcattgagggggccaagtgcattaagggtgactctagcattcaaaaacgctggaaggagctgagcaaggaggacttatcccccgcattcgatcactctcccaataaaattatgaccgagaagtataacggcaatagaatcggtcttgaggaagagaagttaactggcgatcggtgcaccggactgagttctaaaatgcaggatacgatggaggagaatagcgagagcgccctgcggaagagaatacgggaggatcgtaaagcaactaccgctcagaaggtacagcaaatgaagcaacggctcaacgaaaatgaacgcaagcgcaaacgaccacgtcttacagacacttag

SEQ ID NO: 201670 - DNA, 1179 bp, Artificial Sequence
  Description of Artificial Sequence: Synthetic coding sequence
tgccagcaggagttccggatgtacggcaaggacggcaagggcaccaattggatggaccagggcgatatggaatgtcgcatgcaagagatagatgaccatagccgggttaagttgcagaacgccgaaaatgactatataaatgcaagcctcgtcgatatcgaagaagctcagagatcctacatcctgactcagggccctctgccgaacacctgttgccacttctggttaatggtgtggcaacagaaaacaaaagcagtggtcatgctcaataggatcgttgagaaggaatcagttaaatgtgcccagtattggcctacagatgatcaggagatgttgttcaaagaaacaggcttctcagtgaaactgctatccgaggacgtaaagagttactacactgtgcatctgctccaattagagaacatcaatagcggcgagactcgtactattagccactttcattacacaacgtggccagattttggggtgcccgagtctccagcttcttttttgaacttcctattcaaagtaagggaaagcggttctcttaaccctgaccacggcccggcggttatacattgctcagcaggaatcggaagatcgggtacgttcagcctggtggacacatgcctcgtgctgatggagaaaggggatgatatcaacataaaacaggttctcttgaacatgaggaaatacaggatgggcttaatccagaccccagatcagttaaggttttcctacatggccatcatcgaaggagctaaatgtatcaagggcgatagttcaatccaaaaaagatggaaggagctcagcaaggaggacctcagtcccgcatttgaccactccccgaacaagataatgacagaaaagtataacgggaaccgtatcgggctcgaggaagagaaactgaccggtgaccgctgtaccggcttgtcttctaaaatgcaggacaccatggaagagaactctgagtccgccctgaggaaaagaattcgcgaggaccgaaaagccacaacggcacagaaggtgcagcagatgaagcaacgcttgaatgaaaacgaacgcaagcgcaagagatggctgtattggcagcctatcttgacgaaaatgggctttatgtccgtgatcctggtgggagccttcgtcggctggaccctgttctttcagcagaacgcattgtag

SEQ ID NO: 201671 - DNA, 1062 bp, Artificial Sequence
  Description of Artificial Sequence: Synthetic coding sequence
atgcccaccaccatcgagcgggagttcgaggagctggacacccagcggagatggcaacctctctacctggaaattaggaacgaatcacacgactacccacaccgcgtcgccaaatttccagaaaaccgcaatagaaatcggtaccgagatgtatccccttatgatcacagccgggtgaaattacagaacgccgagaatgactacatcaacgcctctctggtggatatcgaggaggcacagagaagctacattctgacccaggggccactgccaaatacgtgttgtcacttctggcttatggtgtggcagcagaagaccaaggccgtggttatgctcaaccgtatcgtggaaaaagaatctgttaagtgtgctcagtactggcccaccgacgaccaggaaatgttattcaaagaaaccggcttcagcgtgaagcttctgtccgaagacgtgaaaagctactacacagtccatctgttgcagctggagaatatcaatagcggagagacaagaactatatcccatttccattatacaacatggcccgattttggagtgcctgaatctcccgcctcattcctgaactttttattcaaagttcgagagagcgggtctctgaaccccgatcacgggccagccgtaattcattgctctgcgggtatcgggagatccgggaccttctccctggtagacacttgcttggtgctgatggagaagggcgacgatataaacatcaagcaggttctgcttaatatgcggaagtatcgcatgggcttaatccaaactccagatcagctgcgtttcagttatatggccattatcgaaggtgctaagtgtattaagggtgactccagcatacagaagcggtggaaagagctttcaaaggaggatctgtccccagcgttcgaccactcacctaataagattatgacagaaaagtataacggtaacaggattggactcgaggaggagaagttaacaggagaccggtgcactggcctctcttccaaaatgcaggatactatggaagagaactccgagcggcccaggctgactgatacttag

SEQ ID NO: 201672 - DNA, 2424 bp, Artificial Sequence
  Description of Artificial Sequence: Synthetic coding sequence
atggaccagcgggagatcctgcagaagttcctggacgaggcccagagcaagaaaataacaaaagaggagtttgccaacgagtttctgaagctgaagcgccagtcaaccaagtacaaggcagacaagacatatccgactaccgtggcagagaaacctaaaaacattaagaagaacaggtataaggacatcctgccctacgactacagtcgagtagagttatccctgattacatcagatgaggactcttcatacataaacgctaatttcattaagggcgtctatgggcctaaggcatatatcgcgacccagggacctctgtctactacgctccttgacttctggcgcatgatatgggagtattcagtgcttattatcgtgatggcttgcatggagtatgaaatgggcaagaaaaaatgtgagaggtactgggctgagccaggggagatgcagttagaattcggcccattctcggtcagctgcgaggctgaaaagagaaagtcagactacattatcaggaccctgaaagtcaaattcaattctgaaactcgcacaatctatcagttccactacaaaaattggcccgaccacgatgtgccatcatcgatcgaccccatcctcgagctcatctgggacgtccggtgctaccaggaggatgactccgtccccatctgtattcactgctccgccgggtgcgggcgaaccggagttatttgcgccatcgattacacttggatgctcctgaaggatggaatcatcccagaaaactttagcgtattttctctcatccgggaaatgcgaacgcagcgtccaagtttggttcaaacacaagagcagtatgagttggtttacaacgcagtcctggaactattcaagaggcaaatggatgtcattcgtgataagcactccggcactgagagccaggccaagcactgcattcccgagaagaaccatacccttcaggcagacagctatagtcccaatctgcctaaaagcaccacaaaagcggcgaagatgatgaaccagcagagaacaaaaatggagatcaaggagtcaagcagctttgacttccgaacatccgagatctccgccaaggaagagctggttctgcatcccgcgaagtcttccacaagtttcgacttccttgaattaaactacagtttcgataagaacgccgacacaaccatgaagtggcagacaaaggcatttcctatcgtaggtgagcccctgcagaagcaccagtcccttgacttagggtcactgctcttcgaagggtgctctaactctaagccagtaaacgcagcaggccggtactttaactctaaggtgcctatcacccggacaaagtctacgccatttgaactaatccagcagcgcgagaccaaggaagtcgatagcaaggagaacttctcctaccttgagtcccagccccacgactcctgttttgtagagatgcaggcccagaaggtgatgcacgttagcagcgccgaattgaattattctctgccatacgattctaagcaccagatcaggaatgcctctaacgtgaaacaccacgactcctctgccctaggagtctattcctatatacccctggtcgagaatccttatttttccagctggccgccctctggcacttcatccaagatgtccctggaccttcccgagaagcaggacgggaccgtgtttcccagctccttgttaccaacaagctctacctccctcttctcctattacaactcgcacgacagcctgagcttgaactctccaacgaacatttcatccttgctgaaccaggagtctgctgttctggctaccgccccccggattgatgatgagatcccacctccactgccagtctggacacccgaaagcttcatagtggtggaggaggccggggaatttagccctaacgtgcccaaaagcctctcttcagccgttaaagttaagatcgggactagcctcgagtggggcggtactagcgagcccaagaaattcgatgattcggtgatactgaggccaagcaaaagcgttaaacttcggagcccaaaatctgagctccaccaagatcggagtagcccacctcccccattaccagagaggacacttgagagcttcttcctggcggacgaggactgcatgcaggcccagagcatcgagacatactcgacaagttatcccgatactatggaaaacagcacatcaagtaagcaaacattgaaaacacctggaaaatcattcacccgatccaagagcctaaagatcctgcgcaacatgaaaaaatcaatatgtaacagttgcccccccaacaaaccggccgagtccgtacaatccaataattcttcatcatttcttaatttcgggttcgccaaccggttcagtaagccaaaagggcccaggaatccaccaccaacctggaatatctag

SEQ ID NO: 201673 - DNA, 1692 bp, Artificial Sequence
  Description of Artificial Sequence: Synthetic coding sequence
atgctgctgaaggacggcatcatccccgagaacttcagcgtgttctcactcatccgcgaaatgagaacacagagacccagcctggtgcaaacccaggagcagtatgaactggtgtataatgccgtgctcgagctgttcaagagacagatggacgttataagagacaagcatagcggcactgaaagtcaggccaagcactgtataccagagaagaatcacaccctgcaggcagactcctacagccctaacttacctaaaagtaccactaaggcagcaaaaatgatgaaccagcagcggacaaagatggagattaaagagtcctcctcctttgacttccgaacatcagagatcagtgcaaaagaggaactggtgctgcatcctgcaaaatctagtaccagctttgatttcttggaactgaattactctttcgacaaaaacgctgacactacaatgaaatggcagactaaagccttccctatcgtgggggaacccctccagaagcatcagtccttagacctaggcagtctccttttcgaaggatgctcaaatagcaagcctgtgaacgccgctggacggtattttaacagcaaagtcccaatcacacgaacaaagtccacccccttcgaattgattcagcaacgggagacaaaagaagtggatagtaaggagaactttagctatcttgaatctcagcctcacgacagctgtttcgtggagatgcaggctcagaaggtgatgcatgtgtcctccgccgaattgaactacagtttgccctatgattccaagcaccagattcgcaatgcttctaacgtgaagcaccacgactcttctgccctgggcgtctacagttacattcccttggtggagaatccttatttcagcagttggcccccttcaggaacttcctccaaaatgtccctcgacctacctgagaagcaggatggcaccgttttcccctcatccctattaccaacatcgtctacaagcctatttagctactataatagccacgatagcctaagcctgaatagtcccacgaacattagttcgctgctcaatcaggagtccgcagtcctggctactgccccaaggattgacgacgagatccctcccccactccctgtgtggactcccgagtctttcattgtcgtagaagaagcaggggaattttccccaaatgtgccgaaatccctctctagtgccgtgaaagtcaagataggtacatctctggagtggggaggaacatccgaaccaaagaaatttgacgactcggtgattctccgcccttcaaagtcagtgaaattgcggtccccaaaatcggaactccatcaggatcggtcaagtcctccacctccacttccggagaggacactggagagcttctttctggcagatgaagactgcatgcaagctcagtccatagagacctacagtacgtcttatcccgacaccatggaaaacagcacaagcagcaagcagaccctcaagacacctggaaagtcctttacaaggtccaaatctttgaagatcctgcgcaacatgaaaaagtcaatctgtaactcgtgccctccgaacaaacccgctgagtcagtgcagtccaacaatagttcatcgttcctgaattttggctttgcaaatcgtttctctaagcccaaggggcccaggaacccaccccccacctggaatatctag

SEQ ID NO: 201674 - DNA, 4911 bp, Artificial Sequence
  Description of Artificial Sequence: Synthetic coding sequence
atggaggccgtgccccggatgcccatgatctggctggacctgaaggaggcgggcgacttccactttcagccagccgtcaagaaatttgtgttaaagaactacggcgagaatcccgaggcctacaatgaggagctcaaaaagttggagttgctgcgccagaatgctgtcagagtaccgagggatttcgagggttgtagtgttctcaggaaatacctcggacaactccattacctgcaatcccgggtccctatgggctccggacaggaagcagccgtgcctgtcacgtggacagagattttctctgggaagagcgtagctcacgaagacatcaagtacgaacaggcatgtatcctgtacaacctaggtgcgctccacagcatgctgggcgccatggataagcgcgttagtgaggaaggcatgaaggtcagttgcacgcatttccagtgtgccgccggcgccttcgcttatctgcgagagcactttcctcaggcgtattccgtggatatgagcagacaaatactaacgctcaacgtaaatttgatgctgggacaggcccaggagtgcctgcttgaaaagtcaatgctagacaataggaagagtttcctcgtggctcggatttcagcccaggtggttgactactacaaggaggcctgtcgggcgctcgaaaaccccgacaccgcttctctcctggggaggatccagaaggattggaagaaactggttcagatgaagatatattacttcgccgctgtcgcgcatctccacatgggaaaacaagccgaggagcagcaaaagttcggtgagagagttgcctattttcaaagtgccctggacaagctgaacgaggccatcaagctcgccaagggacagcctgacaccgtgcaggatgcccttcgatttacgatggacgtcattggcggaaagtataatagtgctaagaaggacaatgactttatctaccatgaggctgtacccgcattggacacattgcagcctgtaaaaggcgccccactggtgaagccattgccagtcaatccaactgatccggccgtcaccgggcccgacattttcgctaaactggtgcccatggctgcccacgaagcttcaagcctgtactcggaggagaaagccaaattgctgcgcgaaatgatggccaagatagaggataagaatgaggtgctggatcagtttatggattccatgcagcttgacccagagacagtggataatcttgatgcttactcacatatccccccacaactgatggagaagtgtgcagcacttagtgtgcgtccagacaccgttcgcaatctggtgcagtcaatgcaggtacttagtggcgtgttcaccgacgttgaggcaagtctgaaggatataagagatctgttggaagaagacgagctgttagagcagaagtttcaggaggcagtgggccaggctggggcaatctctatcacttctaaagctgaattagcagaagtccgtagggagtgggcaaagtacatggaagtgcacgagaaagcatcatttacgaattcagaactgcaccgcgcgatgaatcttcatgtaggtaatctgaggctgctgtccggacccttagatcaagtgcgcgctgccctgcctactccggcgctgtctcccgaagacaaggccgtcctgcagaatctaaaaagaatccttgccaaggtgcaagagatgagagaccaacgcgtttccctggagcagcagttgagagagctgattcagaaggacgatatcactgccagtttggtgactaccgaccacagcgaaatgaaaaagttgtttgaggaacagctcaaaaaatatgatcaacttaaggtctaccttgaacagaacctggcggctcaggacagggtcctatgtgctcttaccgaagcgaacgttcagtatgccgcagtgaggagggtcctttcggatctggatcagaaatggaactctactctgcagaccttggtggctagctacgaggcttatgaggatctgatgaagaagagccaggagggtcgagacttttacgctgatctcgaatcaaaagtggccgccctgttagaaagaacccagtcaacctgccaagcaagagaggctgctcgacagcagctgttagacagagaacttaagaaaaaaccaccgcccaggccaacagcacccaagccacttcttccacgccgcgaggaaagtgaagccgtggaggccggggacccacctgaggagctgcgcagcttgcccccagacatggtcgccgggcctcgccttccagatacatttctgggcagcgccactccccttcacttccccccctcacccttccctagttccacggggccgggcccacattatctttcaggacccctgccacccggaacttactcagggcctacccaactgatccagccgagggcccccggtccacacgcaatgcccgtcgcccctggtcccgcactgtatccggctcctgcctacaccccagaattgggacttgtgcctagatcttcgccccagcacggcgtggtgtcaagtccatatgtgggtgtaggacccgccccccctgtggccggtctgcccagcgctcctcctcctcagttttctggcccagaactcgctatggcagtaaggcctgccaccacgacagtggattccatccaggccccaataccctctcacacagcgccacgaccaaacccgaccccagcccccccccccccctgcttcccagtgcctcccccccaaccacttcccactccgtacacctatcccgcgggagccaaacaacccatccccgctcaacatcacttctctagtggcatcccagctggtttcccggcgccccgaattggaccacagccacagcctcatccccaacctcatccttcccaggccttcggacctcagcctccccagcagccactgcctctacagcacccacacctgttccctccccaggctcctgggctgctgcccccccagtcaccttatccctacgccccccagcccggagtgctgggccagcctccccccccgctgcacacccagttatacccaggccctgctcaggaccccttgcccgctcactcgggtgcattgccctttccttcaccaggtcccccccagcctccccatccaccactggcatatggcccagcaccaagcacccgcccgatgggacctcaagccgctccacttacgatcaggggaccgagctctgccggccagtccaccccttccccacatctagtaccttcccccgccccatcaccgggccccggccccgttccgccgagaccgcctgcagccgaacctccaccctgtcttcgccggggcgccgctgccgccgacttgctgtcttcaagccctgaatcacagcacgggggtacccagagcccaggcggcggacagccactcctgcagccaactaaagtcgatgctgctgaaggcagaaggccccaggcgctccgcctcatcgaacgcgacccatatgagcacccagaacgcctcagacaacttcagcaggagttagaggcctttagggggcaacttggggacgtgggggcattggacacggtgtggcgagaattacaggacgctcaggaacatgatgcccgcggacgaagtatcgccattgcacgctgttattcgttgaaaaataggcatcaggacgtgatgccctacgactccaaccgtgttgtgctgaggagcggcaaggatgattatatcaacgcctcgtgcgtggaggggctttcaccctactgcccgcctctcgtggctacacaggcacccctgcctggaaccgccgccgacttctggctgatggttcatgaacaaaaggtttcagtgattgtgatgctagtctcggaggccgagatggaaaaacaaaaggtcgccaggtatttcccaaccgagagaggccagccaatggttcatggggccctgagcctggccctgagtagcgtgcggagtacagaaacccacgtggagcgagtcctgagtctacagtttagggatcagtctctgaagcggtctctggtccatttacacttccccacctggcccgaactcgggctgcccgacagtccttccaatttactcaggtttatccaggaggtccacgcccattaccttcaccagcgccctttacacacccccattattgtccactgcagtagcggtgtgggcagaactggagcttttgcactgctttacgccgctgtgcaggaggtggaagctggaaacggcatacctgaactgccacagctggtcagaaggatgcgacagcaacggaagcacatgctacaggaaaaacttcaccttcggttctgctacgaagccgttgttagacacgtggaacaagtgctccaacgacacggcgtccctcccccatgtaagcctctcgcctcagcctccatttctcagaaaaatcatcttccccaggatagccaagacttagtccttggtggagatgtcccaatctcaagtatccaagccacaattgccaagctgtctattagaccaccagggggcctcgagtctcccgtggcgagcctcccaggaccagctgaacccccaggccttccacccgcttctctcccagagtccactccgatcccatccagttcacccccgcccctgagctctcctttacctgaagcaccacagccgaaggaagagccccccgtgcccgaagctccttcaagtggtcctccctcttcttcactggagcttctggccagtcttacccctgaagccttctcgcttgactcttcccttaggggcaagcaaaggatgagcaagcataattttctgcaagctcacaatggccaggggcttcgcgccacccggcccagtgatgaccccctttctttgctcgacccgttgtggacattgaataagacatag

SEQ ID NO: 201675 - DNA, 2739 bp, Artificial Sequence
  Description of Artificial Sequence: Synthetic coding sequence
atggaggccgtgccccggatgcccatgatctggctggacctgaaggaagctggagacttccactttcaacccgccgtaaagaagaatgccgtacgcgttccccgcgattttgaaggctgttccgtgcttcggaagtacctgggacaattacattacctccagtctcgtgttcctatggggtcgggacaggaggcagcagtaccagtgacttggaccgagatatttagtggaaagtcagttgcgcacgaggatatcaagtacgaacaggcttgcattctgtataacctaggcgctttgcactccatgctcggtgcaatggacaaaagggtctctgaagaatgcgctgccggtgcatttgcatacctcagagagcactttccacaggcttattcggtcgacatgagtcgtcagattctgaccctaaacgtgaatcttatgctgggccaggcccaggaatgtttgctcgagaaaagcatgctagataaccgtaaatcattcctggtggcgagaatctctgcgcaggtggtagactactataaagaggcatgtagagccttggaaaatcctgacaccgccagtctgctgggtaggatacagaaagactggaagaaactagtgcaaatgaagatttactactttgccgctgtggcccacctgcacatgggaaaacaagcagaggaacagcaaaaatttggcgagagagtcgcctactttcagtctgctcttgataagttgaatgaagcaataaagctggccaaaggtcaaccggataccgtgcaggacgcacttaggttcacaatggatgtgattggcggcaagtataacagtgctaaaaaagacaacgacttcatatatcacgaggccgtacccgccctggataccctgcaacctgtgaagggggcccctcttgtcaagccccttcctgtgaacccaactgatccggccgtgaccggccctgatatcttcgccaagctggtgcccatggcagctcacgaggcaagttctttatatagcgaggaaaaagcaaaactgctgcgggagatgatggctaagattgaagataagaacgaggttctggaccaattcatggactccatgcagttggatcccgagactgtggacaacttagacgcctacagccatatccccccacagctgatggaaaaatgcgcagccctcagcgtcagacccgacactgtacgaaatttagtgcagagtatgcaagtactgagcggggtgttcactgacgtggaggcgagcctcaaggatattcgagacctcctcgaggaggatgagctcctggagcagaaatttcaggaggccgttggacaggccggggcgatttcaatcacttcaaaggcagaactcgctgaggtgagaagagagtgggccaagtatatggaagtacacgaaaaagcgtccttcaccaactcggagctacaccgagccatgaacttgcacgtcggaaacctgcgtcttctaagtggtcccctcgaccaagtacgagcagctttgcccacacctgcccttagcccagaagataaagccgtgctccagaacctgaagcgcatcctcgccaaggtgcaggaaatgagagaccagagggttagtctcgaacagcagctgcgagagctgatccagaaagacgatataactgcttccctcgtcacgaccgaccatagcgagatgaagaagctgttcgaggaacaactgaagaagtacgaccaactgaaagtttaccttgagcagaatcttgccgcccaagacagggtgctctgtgcgctcaccgaggcgaacgtgcagtacgctgccgttagaagagtactctctgacctcgaccagaagtggaacagcaccctgcagaccctcgtggctagttacgaggcttacgaggatctgatgaagaagtctcaagaagggagggatttttacgcggatttggagtccaaagtggcagccctgctggaacgcacccaaagcacttgccaggcccgcgaagcagcgcgtcagcaacttttggatagagagctcaaaaagaagccacccccgcgcccgactgcccccaagcctctactgccccgcagagaggaaagtgaagctgtggaggccggggatcctcccgaggagcttcgctccctgcctccagatatggtggccggaccaagattgccggatacgtttcttggctctgccacaccactgcacttcccccccagcccgtttcctagttccactgggccaggcccacactacttaagtggcccactgccccccgggacctactcaggtcctacacagttaattcagcctagggcacctggtccccacgctatgcccgttgctccagggcccgctctgtaccccgccccatcctctgcccccagctttacatctgtatgggcttcagctccgaccgccgccccttctacccctgcctccacaagtttaccaacccccggcccacgaacccctacccccactattcccctacctctttgcccttccgcatggggcccaggggctgctgccaccccgccaacgcaccctgcgctgcccaggtccaggtctcgtccttccgcctcccccctgaggggatccgcctttccccagccttgggctccttccgcctcaccttcccctaccggtatctggtcttgtcctttttaccagacacatggcccacctggcagccctagctaccactcccgcgcactcgtgtgttggcccgtccacccctag

SEQ ID NO: 201676 - DNA, 1698 bp, Artificial Sequence
  Description of Artificial Sequence: Synthetic coding sequence
atgaactacgagggcgcccggagcgagcgggagaaccacgccgccgacgactcagaggggggcgccctagacatgtgctgttctgagcgacttcctggcctaccacagcctatcgtaatggaggcactcgatgaagccgaaggactccaagattcccaaagggaaatgcctccaccccctcctccaagtcccccgtcagatcctgcacaaaagccgccaccccgaggcgctggcagccattccctaacggtcagaagctccttatgtctgtttgcggcgtcacagtttctcctggcatgtggtgtgttgtggtttagcggatatggccatatctggtcacagaacgctaccaacttggtgagctctcttctgactctcctaaaacagctcgagcctaccgcctggctggacagtggaacctggggcgtcccgagccttctcctggtgttcctgtcagttggtctcgtcctggtaacgacactggtttggcacctcctaagaacccctcccgagcctcctacaccactccctcctgaagaccgtcgccagtccgtctctaggcagccttcctttacctacagcgagtggatggaagagaaaattgaggacgactttttagacctcgaccccgttcccgagacaccggtttttgattgcgttatggacattaagcctgaggccgacccgacgtcgcttaccgtgaagtctatgggtttacaagagagacgcgggtccaacgtgtccctcactctggatatgtgtaccccaggttgcaatgaggagggctttggatatcttatgtcaccccgcgaggaatccgcgagggagtacttgctgagtgccagccgcgttctgcaggccgaggagctccatgagaaggcgcttgatccattcctactccaggccgagttcttcgaaattcctatgaatttcgtcgacccaaaggaatacgacatcccgggtctggtaaggaaaaatagatacaagacgattctgccaaaccctcatagtagggtgtgtctcaccagccccgaccccgacgacccactgtcaagttacattaacgctaactacatcaggggatacgggggtgaagagaaggtttatattgccacacagggacctatcgtgagtacagtggccgatttttggcgcatggtctggcaggagcataccccaatcatagtgatgattaccaatattgaagaaatgaatgaaaagtgtacggagtactggcccgaggagcaggtcgcctacgacggcgtcgagatcaccgtgcagaaggttatccatacagaggactacaggttgagactgatttccctcaagtcagggaccgaggagaggggactcaagcactattggtttacatcttggcccgatcaaaaaactccggacagagctccacctctcctacatctggtgcgcgaagtggaggaagccgcgcagcaggagggaccgcactgtgcgccaatcatcgtgcattgttctgcgggaatcggtagaaccgggtgtttcattgcaacgtccatttgctgtcagcagttacgtcaagaaggtgtggttgacatcctcaagacgacatgtcagctgcgccaggaccgcgggggaatgattcaaacctgcgagcaatatcagttcgtccaccacgtcatgagcctttacgaaaaacagctttctcaccaatctcccgaatag

SEQ ID NO: 201677 - DNA, 1602 bp, Artificial Sequence
  Description of Artificial Sequence: Synthetic coding sequence
atgaactacgagggcgcccggagcgagcgggagaaccacgccgccgatgattcagaaggaggggctctcgacatgtgctgttccgagcggctgccagggctcccacagcccattgtcatggaagcactcgatgaagcggagggtctacaggattcccagcgggagatgcctccacctccccccccgtctcctccaagcgatcctgcacagaaaccaccaccacgtggcgccggctcccacagcctcactgtccgctcttcattatgtctgttcgccgcgtcccagttccttttggagcccaccgcatggctggattctggcacttggggagtgccctccttacttttggtttttctgagcgtcggactggttctcgtaactaccctggtttggcatctgctcagaactccacccgaaccaccaacacctctgcctcccgaagataggaggcaatctgtatcccggcagcctagcttcacttatagtgagtggatggaggagaagatcgaagatgatttcctggatttagatcccgtgcccgagacacccgttttcgactgtgtgatggatatcaagcctgaggctgaccccaccagcctgaccgtgaagtctatgggcttgcaggaacgtaggggctcaaacgtctcactgaccctggatatgtgtaccccaggctgcaacgaggagggttttggatatctcatgagtccacgcgaggagtctgcccgcgagtatcttctgtcggcaagccgtgtcctgcaggctgaggaattgcacgagaaggctctggatccttttttgctccaggcagagttttttgagatccccatgaattttgtcgatcctaaagagtacgatatcccaggattagtcagaaagaatcgatacaagacgatcttgccaaacccccacagtcgcgtctgtctgacctccccagaccccgacgaccccctctcaagctacataaacgccaactacataagaggttacggcggtgaggagaaggtgtacattgctactcaggggccaattgtctctaccgttgcagacttctggaggatggtctggcaagagcacacccccattatcgtcatgattactaacatagaggagatgaatgaaaagtgcaccgaatactggcccgaagaacaggtcgcttatgatggcgtggaaatcactgtgcagaaggtgattcacactgaggattatagactgcggctcattagcttgaaatccggcactgaagagcgcggcctaaagcattactggtttacaagctggcctgatcagaagactccggatcgcgcaccccctcttctccatcttgttcgggaagtggaggaagcagcccagcaggagggacctcactgcgccccaattatcgttcattgttcggcaggaatcgggagaaccgggtgctttatagccaccagcatttgttgtcagcagctgcggcaggaaggcgtggtagatatcctgaaaaccacatgccagctgcggcaggaccggggcggcatgatacaaacttgtgagcagtatcagttcgtccatcacgtgatgagcttgtatgagaagcagctctcccaccagtcacccgagtag

SEQ ID NO: 201678 - DNA, 1698 bp, Artificial Sequence
  Description of Artificial Sequence: Synthetic coding sequence
atgaactacgagggcgcccggagcgagcgggagaaccacgccgccgatgactccgagggcggagccctggacatgtgttgcagtgagcgcctccccggtctgccccagcccattgtgatggaggcattagacgaggccgaaggcttacaagactcccagcgagagatgccaccaccaccccctcccagcccaccaagcgaccctgcccagaagcccccaccccggggggcaggaagccacagtctgactgtgagaagcagcctgtgtttattcgcggcatcgcagttcctgctagcctgcggagttctctggttttccggatatggacatatttggagccagaacgcaacgaatctggtgtcttccttactgactctgctcaaacagctggaacccacagcttggttggacagcggcacatggggtgtgccgtccttactactggtgttcctctctgtcggcctagtgctggttactacacttgtgtggcacttgcttcgaacccctcccgaaccgcctacgcccctcccaccagaagaccggaggcaaagcgtctccagacagcctagtttcacttattcggagtggatggaagagaaaattgaggatgattttctggacctggatcccgtacctgagacgccggtgtttgattgcgtcatggacataaaaccggaagctgatccaacatcattgaccgtaaaatctatgggactccaagagagacgtgggtcaaatgtgtccctgaccctggacatgtgtacacctggctgcaacgaggaaggatttggatatctgatgtctcctagggaggaatccgccagagagtacctactgtccgccagtagagtgctgcaggcagaggagcttcacgagaaagcccttgaccccttcctcctgcaggccgaattcttcgaaattccaatgaatttcgtcgaccccaaggagtatgatattccaggcttagtgcggaaaaatcgctacaaaaccatccttcctaacccacattctcgcgtgtgtctgacgtctcctgaccctgacgatcccctttcttcatacataaacgcaaattacatcaggggatacggtggtgaggagaaggtgtacatagccacccagggtcccatcgtgagcacagtagcagatttttggagaatggtctggcaggaacatacacctataatcgtgatgatcactaatatcgaagagatgaacgagaagtgcactgaatactggccagaggagcaggttgcttacgatggggtcgagattaccgtccaaaaggtgattcacacggaggattatagactgaggttaatttccttgaagtcaggcactgaggaaagaggtttgaaacactactggtttacatcatggcccgatcaaaagacgccggatcgggctcccccactgctccacctggtccgggaagtggaagaagccgcccagcaggagggtcctcattgcgctcccattatagtgcattgcagcgctggcataggacgcacgggctgttttatcgcaaccagtatatgttgccagcagctgagacaggagggagtggtcgacatattgaaaaccacatgccagctgcggcaggataggggcggtatgatccagacatgtgagcaatatcagttcgttcaccatgtaatgagcctgtatgagaaacaattatcacaccagtccccagaatag

SEQ ID NO: 201679 - DNA, 1788 bp, Artificial Sequence
  Description of Artificial Sequence: Synthetic coding sequence
atggtgcggtggttccaccgggacctgagcggcctggacgccgagacacttcttaaggggcgaggcgtccacgggagctttctggcgagaccctcccgcaagaaccagggagattttagcctgagcgtccgggtcggcgaccaggtcacccatattaggatccagaactctggagatttttacgatctttatgggggggagaaatttgcaacacttacagagctcgtcgaatattatacccagcaacaaggggtcctgcaggaccgggacggcactattatccatctgaaatatcctttaaattgttccgatccaaccagtgagcgttggtatcatggtcatatgagcggtgggcaggcggaaaccctgttgcaagcaaagggagaaccgtggacctttctcgtgagggagtctctgagtcagcccggagatttcgtattgtcagtcctgagcgatcagcccaaagccggaccaggatcaccactgcgggtgactcacatcaaagtgatgtgcgaaggagggagatacacagttggaggcctcgagactttcgattcccttactgacctggtggagcatttcaagaagaccgggatcgaagaagcatccggcgctttcgtttatctgcgacagccatattatgccacccgcgtgaacgcagcagatattgagaatagggtgttggaactcaataaaaagcaagagtctgaggacaccgcgaaagccggtttttgggaagagtttgagtcactccaaaagcaggaagtaaagaatctgcatcagaggctggagggacaacgccccgaaaacaaggggaaaaacaggtataaaaatatcttacccttcgatcattctcgggtgatcctccagggcagagattctaacattccgggtagcgactacatcaacgctaattacatcaagaaccagctactggggcccgatgaaaacgctaagacttacattgctagtcaaggctgcctggaggccacggtgaacgacttctggcagatggcctggcaggagaattcacgggtgatcgtcatgacaacccgcgaggtggaaaaggggcggaataaatgtgtgccctactggccagaggtgggcatgcagagagcctatgggccatacagtgtgactaactgcggtgaacacgacaccacagagtataagctgcgtacactgcaggtgtctccgctagacaatggggacctgatccgggagatctggcactatcaatacctttcatggcccgatcacggggttccaagcgaaccgggaggtgtgctgtcttttctggaccagatcaatcagcggcaagagtccctgccccacgcaggaccaattattgtgcactgctccgccggtataggtcgcaccgggacgatcatcgtcatagacatgctgatggaaaacatctccactaagggattggactgcgatatcgatatacagaagaccatccagatggtcagggcacaacggtcaggaatggtccagaccgaggcccagtacaagtttatctatgtcgccatcgctcagttcatcgagaccacaaagaagaagctggaagtgctgcagtcccagaagggccaggaaagtgagtacggcaacattacctatcctccagcaatgaaaaatgctcatgcgaaagcaagtcggacatctagtaaacacaaggaggatgtgtatgagaatttgcatactaaaaacaagagagaggagaaggtcaaaaagcagcgatctgcagacaaagagaagtcaaaaggaagcctgaagcggaagtag

SEQ ID NO: 201680 - DNA, 1794 bp, Artificial Sequence
  Description of Artificial Sequence: Synthetic coding sequence
atgctgagccggggctggttccaccgggacctgagcggcctggacgccgagaccctcctgaaaggccgtggagtccatggcagcttcttggcacggcccagccgcaagaatcagggagacttctccctgtccgttagagtgggagatcaggtgacccatataaggatacaaaactctggcgatttttatgacctgtacggaggggagaagtttgccaccctaacggaattagtggaatattatactcagcaacagggagttcttcaggaccgggatggcaccattatccacttaaaatacccgctcaactgtagcgatcccactagcgaacgatggtaccatgggcatatgtctggcgggcaggccgagaccctgctccaggcaaaaggagagccatggaccttcctggtgagggagagcctgtcacaaccaggggatttcgtcctctcggtcctaagtgaccagccgaaagcaggtcctggttccccacttagggttactcatattaaagttatgtgcgaggggggtcggtacactgtggggggtctggagacattcgatagcctcaccgatcttgtagaacatttcaagaaaactggtatcgaagaagcttcaggagcctttgtttatctgcgacaaccttattacgctacacgggtgaatgccgctgatatcgagaaccgggttctggaactgaataagaagcaagagagcgaggatactgccaaggctggattttgggaagagttcgagagtctgcagaaacaagaggtgaagaacctccatcaaagacttgaggggcagagacccgagaacaaaggtaagaataggtacaaaaatattctacctttcgaccattctcgtgttatccttcagggacgagacagcaacatccctggaagtgactatattaacgccaactacattaagaaccaactactggggcctgatgaaaacgccaagacttacattgcaagccagggatgtctggaggcaacggttaatgatttctggcagatggcatggcaagaaaattcccgggtaattgttatgaccactagggaagtggagaaggggcggaataaatgcgtgccttactggcctgaggttggtatgcagcgcgcctacgggccctacagtgtgaccaattgcggagaacatgacaccacggaatacaagctgagaaccctgcaggtgtcaccattggacaacggtgatctcattcgggaaatttggcattatcagtacctctcctggcccgatcacggcgttccctctgaaccgggaggcgtgctttcgttcctagatcaaatcaatcaacgccaggaaagcctaccacacgcaggccccatcatcgtacactgctcggctggaattggacgaaccggaactatcattgtaattgatatgttgatggagaacatctcaactaagggattggactgtgacattgatattcagaagacaatccagatggttagggcccagagatcaggaatggtgcaaacggaagctcaatataagttcatttatgtagcaattgcccagtttatcgagactactaagaaaaagctcgaagtattacagagtcagaaggggcaagaaagcgagtacgggaatatcacctaccctcccgcaatgaagaacgcccacgccaaggcatccaggacttcaagcaagcataaggaagatgtatatgagaacctccatactaagaataagcgggaggagaaggtcaagaagcagaggtctgctgacaaggaaaagtccaagggatccctgaagagaaaatag

SEQ ID NO: 201681 - DNA, 1671 bp, Artificial Sequence
  Description of Artificial Sequence: Synthetic coding sequence
atgctgagccggggcgtgggcgaccaggtgacccacatccggatccagaattccggagatttctacgacctgtacggtggtgagaagttcgcaactctgactgagctggtcgaatattatacccagcagcagggtgtactccaggaccgggacggcacaattattcatttgaagtaccccctgaattgtagcgatcccacatcagagcgctggtaccacggtcatatgtctggcgggcaagccgagacgctactgcaggctaagggcgaaccttggacctttctggtgcgggagagcctgagtcagcccggagactttgtcctgtctgtgctctctgaccagcctaaggccggtcctggtagccccctgcgagtcacacatataaaggtgatgtgcgaggggggcagatacacagttggaggcctcgagaccttcgactctctgacagacctcgttgaacatttcaagaagactggcatcgaggaggcaagcggcgcctttgtatatctcagacaaccctactatgccacccgggtgaacgctgccgacatcgagaaccgcgtcctcgagctgaacaagaaacaggaatctgaagacacagccaaggcaggattttgggaagaatttgagagcctgcagaagcaggaggttaaaaatctgcatcagcgcctggaaggtcagcgtcccgaaaacaagggaaagaatagatacaagaatatcctacccttcgatcattcacgtgttattctgcagggacgggactctaacatccctggttctgactacataaacgcaaactacattaaaaaccagctgctgggcccagacgagaacgcaaaaacttatatagcatcccaagggtgtctcgaggccactgttaatgacttctggcaaatggcctggcaggagaatagtcgggtgattgttatgactaccagagaggttgagaagggccggaataaatgtgtaccgtattggccagaagtggggatgcaacgggcatatggtccatactctgtgaccaattgcggcgagcacgacacgacagaatacaagttgagaactctccaggtgtccccgctcgataacggagacctgattagggagatctggcactatcagtatctcagctggcctgaccatggcgtcccaagcgagcccggcggggtgctgtctttcctggatcagattaaccagcgtcaggaaagtctgccccatgctgggccaataatcgtacactgcagcgcagggatcggaagaaccgggacgattattgtgatcgatatgctcatggagaacatctccaccaaaggactggactgcgatatagacattcagaagacaatccagatggtcagggcacagcgctctggaatggttcagaccgaagcacaatataaattcatctatgtcgcaatcgctcagttcattgaaaccaccaaaaaaaaactagaggtattgcagtctcagaaaggccaggaaagtgaatatggaaacatcacatacccacccgccatgaagaacgctcacgctaaggcgagtcggacatccagcaaacacaaagaagacgtgtacgagaatcttcatactaaaaacaaacgtgaggaaaaagtcaagaaacagcgctctgccgataaggaaaagtccaagggtagtcttaagaggaagtag

SEQ ID NO: 201682 - DNA, 1875 bp, Artificial Sequence
  Description of Artificial Sequence: Synthetic coding sequence
atggtgcggtggttccaccgggacctgagcggcctggacgccgagactttgctgaaggggcgtggcgtgcacggtagcttcctcgccagaccgtccagaaagaatcagggcgacttttcactctccgtccgggtgggggaccaggttacacacattcggatccagaacagcggcgatttctatgacctctacggcggagaaaagtttgctacactgacggaactagtggaatactacacacagcagcagggggtgttacaggatcgtgacggaaccatcattcatttaaagtatccgctcaattgcagcgatcctactagcgagcggtggtatcatggccacatgagcggtggtcaggctgaaactctgttgcaggccaaaggcgaaccttggacgtttctggtacgcgaaagcttgtcccaacccggtgactttgtgcttagtgtgctgtccgatcagcccaaggccggtccaggcagccctctgagggtcactcatatcaaggtaatgtgtgaaggcggcaggtacaccgtggggggcctagagactttcgactctctgaccgatctggtcgagcacttcaagaaaaccggtatcgaagaagcatcgggcgctttcgtgtacttgaggcagccatattacgcaacacgcgtaaatgccgcagatattgaaaatcgcgtgcttgaactcaacaagaagcaggagagtgaagataccgcaaaagccggattctgggaggagtttgagagcctgcaaaaacaagaggttaagaacctgcaccagcggttagaagggcagaggccagagaacaagggcaaaaacagatacaagaatatactgccttttgaccactctcgggtaattctacagggccgtgactccaacattcccggcagcgactatatcaatgcaaactacataaaaaaccagcttctgggacctgatgaaaatgcaaaaacatatatcgcctcccaaggatgcctcgaggcgacggttaatgacttctggcagatggcttggcaggaaaactcccgtgtgattgtaatgaccacccgagaagttgaaaagggcaggaataaatgcgtcccctattggcctgaggtaggaatgcagcgggcctacggcccatacagcgtgactaattgcggagaacacgataccacggagtataagcttaggactttgcaagtaagtcccttagacaacggcgacttaatcagggagatttggcattatcagtacctctcttggccagaccacggggtgcctagcgaacctgggggggtactcagctttctcgatcaaatcaaccaacgccaggagtccctgccccatgccggtccgataatcgtgcattgttctgccggtattgggagaactgggacgataatcgttattgatatgttgatggaaaacatctcaaccaaaggcctggactgtgatatcgatatacagaagacaatccagatggtgcgagcgcagaggtcgggaatggttcagaccgaagcccaatacaaatttatctatgttgctattgcccagtttatagagaccaccaaaaaaaaactcgaggtcttgcagtctcagaaagggcaggagtccgagtacggcaacatcacttatccccctgccatgaagaatgcccacgcaaaggcctcacggacgtcttctaaatcactggagagctctgctggcaccgtcgcagcgtctcctgtgcgaagaggaggacagcgcggactccccgtacctgggcctccagtcctgagcccagacctgcatcagctgccagtgctcgcccccctccaccctgcagcagacacgcgtcgcatgtgcatgagaacgtgcaccttgcggactcgcggtcggcggaagtag

SEQ ID NO: 201683 - DNA, 1083 bp, Artificial Sequence
  Description of Artificial Sequence: Synthetic coding sequence
atggtgcaggcccacggcggccggagccgggcccagcccctgaccttgtctttaggggcggcaatgactcaacccccaccagagaagactcccgccaagaaacacgttcggttacaagagaggcgcggaagcaacgtagcgctgatgctagacgtacgctctctgggcgccgttgagcctatctgttccgtgaacacaccgagagaagttaccctgcattttctgcgcaccgccggccaccctcttactcgctgggccctgcaaaggcagccgccatcccctaaacagttggaggaggagtttctaaagattccatcaaatttcgtgtcacccgaagatctggatatacccgggcatgcaagcaaggatcgctacaagacgattttacccaatccccagtcaagggtatgtcttggccgggctcaatcccaggaggatggagactatataaacgccaactacattaggggatacgatgggaaggagaaggtgtacatcgctacgcaggggcctatgcctaacacagtttctgatttctgggagatggtgtggcaagaggaagttagtctcatcgtgatgctcacccagctaagagaaggtaaggaaaagtgtgtgcactattggccaaccgaggaggaaacctacggcccctttcaaattagaatccaagacatgaaggagtgccctgagtacaccgtgcggcagttgacaatccaataccaggaagagcgaagaagcgtaaagcacattttattctctgcctggcccgatcatcaaaccccagaaagcgccggcccactgctcagactagtcgccgaagttgaggagtcccctgaaactgccgcccacccaggccccatcgtagtgcattgttctgccggcattggtcggacaggatgttttatcgccacaagaatcggctgtcagcaacttaaggccaggggagaggtggacatactcggaattgtctgccagctgaggctcgacagaggagggatgattcaaacggcggagcagtatcagttcttgcaccacaccctggcactatatgctggccagcttcctgaggagccatctccgtag

SEQ ID NO: 201684 - DNA, 1398 bp, Artificial Sequence
  Description of Artificial Sequence: Synthetic coding sequence
atggtgggcaaggcctggcccctgacccacagccagggcaccggcccgtgggccccagaaggccatcggcgagaagccgcggatccatggtggcagaggcaacaggcacaagagggccgtatgcaattgggctgcgcctgggtggctgcaagacgggggggaggacggaaactggcatcctggtcactattatccccccagaggcagaccgaccgacagaccgatagttggcaggaggctgcttggggcccacagcttctccagcagacatcctggctcagtgagcccccattggggcccgcaccgcatctcagcatggtgcaggcccatggtgggcgtagcagagctcaaccgctcactctttccctcggagctgctatgacacaaccccctcccgagaagacaccggccaagaagcacgtaaggctgcaggagcggcggggctcaaatgtggcccttatgctggacgttagaagcttaggcgcagtagaaccaatatgctcagtgaatacacctagggaagtcaccttgcactttctgagaacagccggtcacccccttacgcgctgggcactacaacggcagcctcccagccctaagcagctggaggaggaattcctgaagattccttctaacttcgtgtctcctgaggacctcgatatccccggtcatgctagcaaggatagatataaaaccattctgcccaatccgcagtcacgtgtttgcctggggagagcccaatcccaggaagacggggattacattaatgcgaactatatccggggctatgatggcaaagaaaaggtctacatcgctactcaaggtccgatgccaaataccgtatcggacttctgggagatggtttggcaggaagaggtgagcctgatcgtgatgctgacacagctgagggagggaaaagagaagtgcgtgcattactggcccaccgaagaagaaacttacggaccattccagataagaattcaagacatgaaagagtgcccagagtacacagtccgtcaactgaccatccagtatcaggaagagagacggagcgtgaagcatatcttgttcagtgcatggccagaccaccagacaccagaaagtgcaggccctctgcttcgcctggtcgccgaggttgaggagtcacccgagaccgccgcccaccccggcccaattgtcgtccattgtagtgctggcatcggacgaactggatgctttatagccacaaggatcggatgccagcaactgaaggcccggggggaggtcgacatattaggaatcgtgtgccaactccgcctcgatcgtggcggcatgattcaaacagctgagcaatatcagttcctgcaccacaccctggctctgtacgccggccagctccccgaagagccctcaccctag

SEQ ID NO: 201685 - DNA, 1200 bp, Artificial Sequence
  Description of Artificial Sequence: Synthetic coding sequence
atgggcgccagcttctggcccatccggcaggcccgggagcagcagcggagggccttgagtttccggcagaccagctggctgtccgagcccccccttggccctgctccacatctgtccatggtgcaggcgcacggcggtaggtcccgcgcgcagcctctgacactgagcctgggagcggccatgactcaaccaccacccgaaaaaacccctgcaaagaagcatgtgagattgcaggagcgtcggggcagtaatgttgccctgatgctggacgtgagaagccttggtgctgtcgagcctatttgcagcgtgaacacaccgagggaagtgacactgcattttctgcgtaccgcaggtcaccccctgacacgctgggccctgcagcgtcaaccacctagtccaaaacagctcgaagaggagtttttgaagatcccaagcaactttgtgagccccgaggatttggacattccaggacacgccagcaaggatcgctacaaaactatactccctaacccccagagtcgcgtctgcctgggaagggctcaatcacaggaagatggcgactacatcaatgccaactatatccgcgggtacgacggtaaagaaaaagtttatatcgctacccagggccctatgcccaacaccgtgtcagatttttgggagatggtgtggcaggaagaagtgtcacttattgtcatgttgactcagttaagagagggcaaggagaagtgcgttcactattggcctacagaggaggagacttacgggccattccagatccgaattcaagacatgaaggagtgccctgagtatacggtcagacagctcacaatccagtaccaagaagagagacgcagcgttaaacacattctgttctccgcttggccagaccaccagacgccggagtccgcgggtccactactcaggttagtggccgaagtggaagagtcacctgaaacagccgctcacccaggtcccatcgttgtacactgcagcgccgggataggtcgcacaggctgttttatcgctacacgcattggatgtcagcaactcaaagctcggggggaggtggatattttgggcatcgtatgccagctgcgtctcgatagaggaggcatgatccagactgctgaacaataccaattccttcatcatactctggccctgtatgcggggcagcttccagaggagcccagcccttag

SEQ ID NO: 201686 - DNA, 465 bp, Artificial Sequence
  Description of Artificial Sequence: Synthetic coding sequence
atggtgcaggcccacggcggccggagccgggcccagcccctgaccctctcactcggtgccgccatgacccagccaccacctgaaaagacacccgctaaaaaacatgtgaggctacaggaaagacgaggcagtaacgtggctctgatgctggatgtgcggagcctcggtgcggtagaacctatatgcagcgtgaacacacccagggaagtgacactccattttcttagaacagccggccaccccctgactaggtgggctctacagaggcagcccccatctcctaagcagcttgaggaggagttcttgaagatcccttctaatttcgtgtcacccgaggacctagatattccgggtcacgctagtaaagaccgctacaagacaatcctgccaaacccccagtccagggtgtgtctggggagggcccagtcccaggaggacggtgactacatcaatgctaactactag

SEQ ID NO: 201687 - DNA, 1326 bp, Artificial Sequence
  Description of Artificial Sequence: Synthetic coding sequence
aagcggcggcgggccgccagcatgaaccggctgggctgctggcccgccagatcacttccccgaagcggcagaggtagcgggcagcgctctctgggtttaggtggccatccgtctggacctcgacacccaggcacacccgctgcaaaacggacatgggagagcccaggcgtgcgcgctcgagactgcccactgtctacttcatggctgtctgagccccccctcgggccggccccccacctgtccatggtccaagcacacggtggccgcagtagagcccaacccctcaccctgtctctgggcgccgccatgactcaaccaccccccgaaaagaccccagcaaagaaacatgtccggctgcaggagcggagagggtccaatgtggcgttgatgttggatgtacgaagtttaggtgctgtggagcccatctgttccgtgaatacccctcgagaggtgaccctgcactttctgcgcacagctgggcaccctctgacaagatgggccctgcagcgacagccaccaagcccgaaacagttggaagaggaatttctaaaaatcccctctaattttgtgtcccccgaagatttagacatcccaggtcacgcaagtaaggaccggtacaaaacgattctgccaaacccacagagccgtgtgtgcctgggcagggcccagtcccaggaggacggcgattacattaacgccaattacatccgcgggtacgacggcaaagagaaggtgtacatcgccacgcaagggcccatgcccaataccgtgtcggatttttgggagatggtatggcaagaggaggtttcattaattgttatgttgacacaacttcgagagggtaaggagaaatgcgtgcactactggcctacagaggaggagacttacgggcccttccagatccgcatccaggatatgaaagagtgcccagagtacacagtgaggcagttgacaatccagtatcaggaggagagaaggtcagtgaaacacatcctcttcagtgcgtggccagatcaccagaccccagaatccgccggccccctcttgcggcttgttgctgaggtggaggagtcaccagagacagctgcccatcctggccccattgttgtgcactgctcagccggaataggccgaacaggatgttttattgctacgaggatcggatgtcaacagcttaaagcccgcggagaagtcgacatcctggggatcgtgtgtcagctgcgcctggatcggggcgggatgattcagacggcggagcagtaccagttccttcatcacaccctcgccttgtatgccggccagcttcccgaagaaccttccccttag

SEQ ID NO: 201688 - DNA, 423 bp, Artificial Sequence
  Description of Artificial Sequence: Synthetic coding sequence
atggtgcaggcccacggcggccggagccgggcccagcccctgaccttgtcactgggagcagcgatgacccagcctccgcccgaaaaaacgcccgccaagaagcatgtcagactgcaagagcgccgtgggtctaacgtagctttaatgctggatgtacgctccctgggggcagtcgaaccaatctgcagtgtgaacacgcctcgcgaagtcacactccacttcctgcgtaccgctggccaccccctaacaaggtgggccctacaacgacaacccccttccccaaagcagctggaggaggagtttctcaagataccctccaatttcgtaagtccggaagacctcgatatccctggccacgcctctaaagatcgatacaagactatcctgccaaatccccagtcacgggtctgtctggggcgatag

SEQ ID NO: 201689 - DNA, 1083 bp, Artificial Sequence
  Description of Artificial Sequence: Synthetic coding sequence
atggtgcaggcccacggcggccggagccgggcccagcccctgaccctcagtctcggcgcagccatgacacagcccccacccgagaagacaccagccaaaaaacacgtgagacttcaggagcggaggggctctaatgtggctttgatgctggatgtgcggtcattgggtgctgtggaaccgatttgttcggtgaacactcctcgtgaagtgaccttgcattttcttagaaccgctggccatcccctgacacggtgggctcttcagagacaacccccctcccccaagcagctggaagaagaatttctcaaaatcccaagcaacttcgtgtctccggaagacctggacatcccggggcacgcgtcaaaagaccggtacaagactatattgcctaaccctcagagtcgcgtctgcctgggaagggctcagtcccaagaagatggtgattatattaacgcaaactatatcagaggctatgacggtaaagaaaaagtgtacatcgctacacaggggcctatgccgaacaccgtaagcgacttttgggagatggtgtggcaggaagaggtcagcctcatagtgatgctgacacagctccgcgaaggaaaggaaaaatgtgtacactattggcctacagaagaggaaacatatggcccattccaaatccggattcaagatatgaaggagtgccctgagtataccgtgcggcagctgacaattcaatatcaggaggaaagacgctccgtgaaacatatacttttttccgcctggccagatcaccagactccagagagcgcagggcccttactgcgtctagtggcggaggtcgaagagtctccggaaactgcagcccatcccggccctatcgtagtgcactgtagcgccggaataggacgcactgggtgtttcattgctacccgcatcggatgccagcagttgaaggcccgcggagaggtggacattctgggaatagtttgtcagttgcgactggatcggggcggcatgatccaaaccgcagagcagtaccagtttctccaccatacgttggccctctacgctggacagcttccagaagagccttcaccgtag

SEQ ID NO: 201690 - DNA, 570 bp, Artificial Sequence
  Description of Artificial Sequence: Synthetic coding sequence
atgcccaacaccgtgagcgacttctgggagatggtgtggcaggaggaagtgtcgctcatcgtcatgttgacccaactgagagaaggcaaggaaaagtgtgtacattattggccaaccgaggaggagacctacggtccgttccagattcgcattcaggatatgaaggaatgtcctgaatacacagtcaggcagttgacgattcaatatcaggaggaacgcagaagcgtaaagcacatactcttctctgcctggccggaccaccagactccagaatcagcagggccattactcaggctcgtggctgaggtggaggaatcacccgagactgcggcgcacccaggccccattgtagttcactgtagtgcaggaataggccggactggctgttttattgccacccggataggctgtcagcagcttaaagctcggggcgaggtggacattctcggcattgtttgccagcttcggctagaccgaggtgggatgattcaaactgcagagcagtaccagttcctacatcataccttagcgctctatgccggacaactgcccgaggagccatcaccttag

SEQ ID NO: 201691 - DNA, 411 bp, Artificial Sequence
  Description of Artificial Sequence: Synthetic coding sequence
atgaaggagtgccccgagtacaccgtgcggcagctgaccatccagtatcaggaagaacgccgcagtgtgaaacacatactattcagcgcctggccagaccatcagactcccgagtctgctggacccctgctacggctcgtggccgaggtggaggaaagcccggagactgccgctcacccggggcctatcgtggtgcattgctctgccgggatcgggaggacagggtgcttcatcgctaccagaattgggtgtcaacagctgaaggcccgcggagaagtggacatcctgggcatcgtctgccagttgaggctggatcgtggaggcatgattcagaccgcagagcagtaccaatttctccatcacacattggctttgtatgccggccagctgcccgaagaaccatcaccatag

SEQ ID NO: 201692 - DNA, 1545 bp, Artificial Sequence
  Description of Artificial Sequence: Synthetic coding sequence
atgagcagccccatcagcaagagccggagcctggccgccttcctgcagcagttacgctcacctcgccaacctccccggttggtcacatccacggcctacaccagtccacagccacgggaggtccctgtgtgccctcttaccgctggaggtgagactcaaaacgccgccgccttgccgggccctacttcctggccgctgctcggctccctattgcaaatcctgtggaaaggtggactgaaaaaacaacatgacaccttagtcgagtatcacaagaaatacggcaaaatcttccgtatgaaactcgggagttttgagtctgtgcacctcgggtctccctgcctgctcgaggccctttatcgaaccgaatcagcctatccacagcgtctcgaaataaaaccttggaaggcttatcgcgactaccgaaaagagggctatggccttctcattttggagggcgaagattggcaaagagtgcggtcagcctttcagaagaagctcatgaagcccggcgaggtaatgaaactggataacaagattaatgaggttcttgctgatttcatgggacggatcgacgaactatgcgacgagagagggcacgttgaggacttatacagtgaactgaacaagtggtccttcgagtccatctgcctagttttgtacgagaagcggtttggcctgctgcagaaaaacgcgggcgatgaagcagtgaactttatcatggcaattaagacaatgatgagtactttcggacgcatgatggtgacacccgtggaattacacaagtcattgaacactaaggtttggcaggaccacacactcgcctgggacactatcttcaagagcgtaaaagcctgcatcgataacagactggaaaaatactcccaacaacctagcgctgactttctgtgcgacatctaccaccagaatcgcctttccaaaaaggagctttatgcagctgtcaccgagttacagttggctgctgttgaaaccaccgcgaactctctcatgtggatcctctacaatcttagtaggaacccgcaagtccagcagaagctgctgaaagaaatacaaagtgtgttgccagagaatcaggtccccagggccgaagacctcaggaacatgccctacctaaaagcgtgtctgaaagagtctatgagattgaccccttcggtgccctttactacgcggaccctcgacaaagccactgttctgggcgagtacgcactgccgaagggtacagttctcatgcttaacacacaagtgctggggagctctgaagataattttgaggattccagtcagtttaggcccgagcggtggctgcaggagaaagaaaagatcaacccttttgctcacttaccctttggcgtgggcaaaagaatgtgcatcgggagacggctcgccgaactgcagctccacctggctctctgctggattgtgagaaaatacgatattcaggcaactgacaacgaacccgtggagatgttgcacagtgggactctggttccctcacgggagctgcccatcgccttctgccaaaggtag

SEQ ID NO: 201693 - DNA, 2382 bp, Artificial Sequence
  Description of Artificial Sequence: Synthetic coding sequence
atggacagctggttcatcctggtgctgctgggcagcggcctgatctgtgtgtcagcaaacaacgccacgactgtagcgccatccgtgggcatcacacgcctaatcaactcatctaccgctgaacccgtgaaggaagaggcaaaaacatccaatcccacctctagtctaaccagcctgtcagtggctccgacattctcaccaaacatcactctgggccctacgtacctgacaaccgtgaatagttcagacagcgataatgggacgacccggaccgcatccacgaatagtattggtattacgattagccctaatggaacatggttgccagataatcaattcacagatgcccggacggagccatgggaaggcaactcctccaccgccgccacaacgcctgagaccttccctccttctgatgagacccccattattgcagtcatggtcgcgttgagttctcttcttgtgatcgttttcattatcattgtgttatacatgctcaggttcaagaaatataagcaagctggatcgcactctaattctttccgtttgtcgaatggacgcacagaggatgttgagcctcagtccgtgcctcttttagccaggtcccccagtacaaaccgcaaatacccaccactcccagttgacaagcttgaggaggagattaacagacgcatggcggacgataacaagctctttcgagaggagttcaatgcactgcctgcatgtccaatccaggcgacctgcgaggctgcctccaaggaagaaaataaggagaagaaccgatacgttaatatcctgccatacgaccacagcagagttcaccttaccccagttgagggggtgcctgacagcgactacatcaacgcttcctttataaacgggtatcaggagaagaataaattcatcgccgcacaggggcctaaagaggaaactgtgaacgatttttggcgtatgatttgggagcagaacacggcaacaattgtcatggtcacaaacttgaaggagcggaaagagtgtaagtgcgcccaatactggcctgaccaaggatgctggacctatggcaatattcgggttagcgtggaagatgtgactgtactggtggattatactgtaaggaagttctgtattcaacaggtgggtgatatgacgaaccgtaaaccgcagcggcttattacccagttccattttacaagctggcctgacttcggagtacccttcacaccgatcggcatgctaaagttccttaaaaaggtaaaagcctgcaatccccagtacgccggagccatagtcgtgcactgcagtgcgggcgttggccggaccggaacatttgtagtaatcgacgctatgctggacatgatgcataccgagcgtaaggtggacgtatacggattcgtgtcccgtatccgggcccagcggtgtcagatggtgcagaccgatatgcagtacgtcttcatttatcaggctttgctggaacactatctgtacggcgatacagaactcgaagtcacaagcttggagacacacttgcagaagatttacaacaaaataccagggacatccaataatgggctggaggaggaattcaaaaagctgacctctattaagatccaaaatgataagatgcgaactgggaacctgcccgccaatatgaagaagaacagggtgctgcagattataccttacgaatttaacagagtcatcatcccagttaaacgaggcgaggagaacactgactacgtgaatgcctcgtttatcgacggctaccgccagaaagactcctatatagcgagccagggtcccttgttacacaccattgaagacttttggcgcatgatctgggagtggaagtcctgctcaatcgtgatgctgaccgagctagaggagagaggacaggagaagtgcgctcagtattggccaagcgacggattggtttcctatggcgacatcaccgtggaactgaaaaaagaagaggagtgtgagagctacactgtgcgtgatctcttagttacaaataccagggagaataaatcaaggcagatcaggcaatttcatttccacggttggcctgaggttggaattccatccgatggtaaaggtatgatatccattattgcagccgtgcaaaagcagcagcagcagtcaggaaaccatcccatcaccgttcattgttccgccggagccggacgcaccggaacattttgtgccctttccaccgtccttgagcgagtgaaagcagagggcatcctagatgttttccagacggtgaaatccctgcgtctacagaggccccacatggtgcagacactggaacagtatgaattttgctacaaagtggtacaggaatatattgacgccttcagtgactatgcaaacttcaaatag

SEQ ID NO: 201694 - DNA, 2382 bp, Artificial Sequence
  Description of Artificial Sequence: Synthetic coding sequence
atggacagctggttcatcctggtgctgctgggcagcggcctgatctgtgtgagtgcaaataatgcaaccactgttgcaccctccgtgggcattactcgtcttattaacagttctacggctgaacccgtcaaggaagaggctaagaccagcaatccaacctcatcccttacttcactgagcgtggcccccactttctccccaaacatcacgctgggtcctacatacttgaccaccgttaattcctccgatagtgacaacgggacaacaaggacggcttctacaaatagcatcggtatcacaatcagccctaacggcacctggctgcccgataaccagtttactgacgcccggacagagccctgggagggaaactcttctactgccgcgacaacgccggagaccttcccccctagcgacgaaacgcccatcattgctgtcatggtggctctaagttcccttctagtaatagtgtttattattattgtgctgtacatgttgcgatttaagaagtataagcaagcagggtcacatagtaattccttccggctgtcgaacggaaggactgaggacgtcgagcctcagagtgttcccttactggcccgaagtccgtctacaaatcggaaatacccacccttgccggtcgataaactggaggaagagatcaataggagaatggcggacgataataaactattccgtgaggagttcaacgctctgcccgcatgtccgatccaggcaacttgtgaggccgccagcaaggaggaaaacaaagagaaaaacagatatgtcaacatcctgccgtatgaccactctcgggtgcacttgactccagtggaaggcgttcccgactctgattatataaacgcctccttcattaatggataccaggagaaaaacaagtttatcgccgcccagggcccaaaagaagagaccgtgaacgacttttggcgaatgatctgggagcagaacaccgctactatcgtgatggtaaccaatttgaaggaaaggaaggaatgtaagtgcgcccagtactggcccgatcagggatgttggacttacggcaacattcgggtgtccgtggaagatgtcacggttctcgtcgattataccgtccggaaattctgtattcagcaggtgggcgacatgactaaccgcaaaccccagcgcttgatcacgcagttccactttacttcctggcctgatttcggcgttccatttacacccattggcatgctgaaattcttgaagaaagtgaaagcttgcaaccctcagtacgcgggcgcaattgtcgtgcactgtagtgccggcgtgggacgcactggtacatttgttgtcatagatgccatgttagatatgatgcacacagagcggaaggttgacgtgtatgggttcgtgtctcgcatccgggctcagcgatgtcagatggtccagaccgacatgcagtacgtgtttatttatcaagcccttcttgagcattatttgtatggggatacagagttggaagtcacatctctcgaaacacatctgcagaaaatctacaataagatccctgggaccagcaacaacggactggaggaggaattcaaaaagctaacatcaatcaaaattcagaacgacaagatgcgcacagggaacctacccgctaatatgaagaaaaaccgtgttctgcagatcattccatacgaattcaatcgggttataatacccgtcaagcgcggcgaggagaacaccgattatgtaaacgccagtttcatcgacggctacagacagaaggacagctatattgcttctcagggccccctgctgcacaccatcgaggacttttggagaatgatatgggagtggaagtcttgctctattgtaatgctaaccgaactggaggaacgcggacaggaaaagtgcgcccaatattggccttcggatggcctagtctcctatggcgatatcaccgtagagcttaagaaagaggaagaatgtgagtcttataccgtaagggatctgctggtaactaatactagggaaaacaaaagcagacagatccggcagttccactttcacggttggcccgaggtggggatccctagcgacggaaagggtatgattagtatcatcgctgctgtgcagaaacaacagcagcagtcagggaatcatccaattacggtccattgtagtgcgggtgctggtcgcacaggaacattctgcgcactctccactgtcttggagagagttaaggcagagggaatactggatgtattccagacagtgaagtcactgcgtcttcagcggcctcatatggttcagaccctagaacaatacgaattctgctacaaggttgtgcaggagtacattgatgcgttctcagactacgcaaatttcaaatag

SEQ ID NO: 201695 - DNA, 1977 bp, Artificial Sequence
  Description of Artificial Sequence: Synthetic coding sequence
atggtggccctgagcagcctgctggtgatcgtgttcatcatcatcgtgctatacatgctccgcagatttcggaaggcagagcttatgtccaggaatactgaaaagtacaaacaggccggctcgcactccaacagcttccggctgagcaatgggcgcactgaggatgtcgaaccacaatccgtgcctctgctggccagatccccgagtaccaaccggaaatatccccccttgccagtggataagttggaggaggagattaatcgaagaatggctgacgacaataaattgtttagagaagaattcaacgctcttcccgcctgtcccattcaggcaacctgcgaggccgcctccaaagaggaaaacaaagagaagaatcgctacgtaaatatcctgccatacgatcattcccgcgtgcatctcactcccgtggagggggtcccagattcagactacattaacgcatctttcatcaacggctaccaggagaaaaacaagttcatcgccgcccagggtcccaaagaggagacagttaatgacttttggcgaatgatttgggaacaaaacaccgctacaatagttatggtgacaaacctgaaggagaggaaggaatgtaagtgtgcccagtactggccagaccaaggctgctggacttatggcaatatccgggttagtgtagaagacgtgaccgtgctggtggactacacggtgcgcaagttctgcattcagcaggtgggcgacatgacaaataggaaaccccagcgccttattacacagtttcactttacttcctggccggattttggcgtccccttcacccccataggtatgctcaaattcctcaagaaggttaaagcatgtaacccccaatatgccggggcaatcgtagttcattgttccgctggagtcggccggaccggcaccttcgtcgtgatcgatgcaatgcttgatatgatgcatacagagcgcaaagtggacgtctatggctttgtatctaggatccgagcacagcgttgccaaatggttcagactgatatgcaatatgtcttcatttaccaggcgctgcttgaacactacctgtacggcgacactgaactggaagttactagtttagagacacacttgcagaagatttataacaaaattccaggcacttcaaataacggactggaagaggagttcaagaaactgacctccatcaagatccagaatgacaaaatgcgcaccgggaacttaccggccaacatgaaaaagaatagagtactgcagattatcccctacgagtttaatagagtcattatccccgtgaaacggggcgaggaaaatactgactacgttaacgctagcttcattgacgggtatagacagaaggactcttacatcgcctcacagggcccgttgcttcacaccatcgaggacttttggcgcatgatatgggagtggaagtcttgttctattgttatgctgaccgaacttgaggagagaggccaagaaaaatgcgcccaatattggccctccgatggacttgtaagttacggggacatcactgtggagctgaagaaggaggaagagtgcgagtcatacactgttcgcgacctgctggtgaccaatacaagagaaaataaatcaagacaaatccgccaattccacttccatggatggcccgaagtgggcatccccagtgatggtaaggggatgattagtattattgccgccgtccaaaagcaacagcaacaaagtggaaaccacccgatcactgtgcattgtagcgctggagccggacgcactggaactttttgcgctctgtcaacggtcctcgaacgcgtcaaagctgagggcatcttggacgtttttcagactgtgaagtcactccgcttacagcgcccgcacatggtgcagaccctcgagcagtacgaattctgctacaaggttgttcaggaatatatagacgctttctcagattacgcgaacttcaagtag

SEQ ID NO: 201696 - DNA, 2409 bp, Artificial Sequence
  Description of Artificial Sequence: Synthetic coding sequence
atggacagctggttcatcctggtgctgctgggcagcggcctgatctgcgtgtccgccaataatgctactacagttgccccaagtgtgggcattactagattgatcaattcaagtaccgccgagccagtcaaggaagaagcaaagacctctaacccaactagctcgctgaccagcctgtccgtggcacccacattcagccctaatattacactgggccccacctatctgactacggtgaactcatctgatagtgataatgggacgacgcgaaccgcctccaccaactccatcggaatcaccatctctcccaatggaacttggttgcctgacaatcaatttaccgacgcgcgcactgaaccttgggaggggaactcctctaccgcagctaccacccccgaaaccttcccgccaagtggcaatagcgactcgaaggatcgtagggatgagactcctattatcgccgtgatggtggctctatcaagcctgctagtgatcgtattcataattatcgtgttgtacatgctgcggttcaaaaagtacaaacaagctggatctcacagcaattccttccgtctcagtaatggtaggaccgaggatgtagaaccacagagcgtccctctcttggcccggtcacctagcaccaatcgaaaatacccccccctgccggtcgataaactcgaggaggagattaaccgcagaatggccgatgataacaaactttttcgagaagagttcaatgctctgccagcatgtccaatccaggccacttgcgaggctgctagtaaagaggagaataaggaaaaaaatagatacgtgaatattctaccatatgaccattctagagtacacctgacacctgtcgagggagtccctgattctgattacatcaatgcgtcattcatcaatggctatcaggagaaaaataagttcatcgccgcacagggacctaaagaagagacagttaacgacttctggaggatgatttgggagcagaataccgcgacaatcgtgatggtaaccaatttaaaagagaggaaggagtgtaagtgtgcacagtactggcctgaccaaggttgctggacatacgggaatatccgcgtcagcgtggaggacgtcacagtcctggtggattataccgtaagaaaattctgcatccagcaggtcggcgatatgactaatcgcaagccgcagcggcttataacacaatttcacttcacctcttggccagatttcggcgtcccgtttactcctataggaatgctaaagttcctgaagaaagttaaggcttgtaatcctcagtacgccggagctattgtggtgcattgtagtgccggggtgggtcgcacggggaccttcgttgttatcgacgccatgctggacatgatgcacaccgagcgcaaggtcgacgtctatggcttcgtctcccgaatccgtgcccaaagatgccagatggtgcagacagacatgcaatatgtttttatttatcaggctctgctggagcactacctgtacggagacacagagctggaggttactagcctggagacccacctacagaagatctacaacaaaatcccaggaacaagtaacaatggcctagaggaagaattcaaaaaactcacttcgattaaaatccagaatgacaaaatgcggacgggaaatttacccgctaacatgaagaagaatagggtcctgcagatcatcccctatgaattcaaccgcgtgatcatccctgttaaaaggggcgaggaaaatacggactatgtgaatgcatccttcatagacgggtatcgccagaaggattcttacatcgcctcccagggacctctccttcacaccattgaagacttctggcggatgatctgggaatggaaatcttgcagcattgttatgctgactgaactggaggagcgcgggcaagagaaatgtgcacagtactggcccagtgacggccttgtgagctacggtgatatcacagtggaattgaaaaaagaagaggaatgcgagagttataccgtgagagacctcctggttactaatacacgggaaaataagagccggcaaatccggcagttccatttccacggttggcctgaagttggcatcccttctgacggtaagggcatgatttcaataattgccgccgttcagaagcagcagcaacaatcaggcaaccatccaatcaccgtgcattgtagcgcaggagctggtcggacaggaacgttctgtgcgctgagtactgtcctcgagcgggtcaaagcggaaggaatactcgatgtcttccagaccgtcaagtctttgagactgcaacgaccccacatggtccaaacccttgagcagtatgagttctgctacaaggtggtacaggagtatatcgatgctttctctgattacgcaaatttcaagtag

SEQ ID NO: 201697 - DNA, 2409 bp, Artificial Sequence
  Description of Artificial Sequence: Synthetic coding sequence
atggacagctggttcatcctggtgctgctgggcagcggcctgatctgtgtgtccgctaacaacgctacaactgtcgccccgagtgttgggattacccgcttgatcaatagtagcaccgctgagcccgtcaaagaggaagccaaaacatctaatccgaccagtagcctcactagcctaagtgtcgcgccgaccttctcccctaatatcacccttggacctacctacctgaccacagtcaattcgagcgatagtgacaatggaaccaccagaacagccagcacaaactccattgggattaccatctcaccaaacggcacctggctgcccgacaatcagtttaccgacgcccgcaccgaaccttgggagggcaactcatccaccgctgctaccacccctgagacattccccccatcgggcaatagcgactccaaggaccggagagacgagacaccaatcattgcggtgatggtagctttgtcttccttactggttattgtgtttatcatcatcgttctctacatgttgagatttaagaagtataaacaggcgggaagtcactcaaacagctttcgcctgtctaacggacgcactgaggatgtagagccgcagtccgtgcctctgctggctcgctcaccgtcaactaacagaaaatacccgccactcccagttgataaacttgaagaggaaatcaacagaaggatggctgacgacaacaaactctttagagaagagtttaacgccttacccgcctgtcctatccaagccacctgcgaggcagccagcaaggaagaaaacaaggaaaaaaacaggtacgtgaatatacttccttatgaccattctagagttcatttgacgccggtcgaaggtgtgcctgactccgattacattaatgccagtttcataaatggctaccaggagaagaataagtttatcgcagcccagggtccaaaggaagagacagttaacgacttttggcgaatgatctgggaacagaatactgccacaatagttatggttactaatttgaaagagcgcaaggagtgtaaatgcgctcagtattggcccgatcagggctgctggacatatggcaatatccgagtaagcgttgaggatgtgaccgtccttgtggactatactgtgagaaaattttgcatccaacaggtgggagatatgaccaatcggaagccccagcgcctgatcacacagttccacttcactagctggccagattttggcgtgcctttcaccccaattggaatgttgaaattcttaaagaaagtgaaggcatgtaacccacagtacgccggggcaattgtagtccattgctccgcaggcgtgggccgcacaggcactttcgtcgtgatcgacgccatgctggatatgatgcatactgagaggaaagtcgacgtctatgggttcgtgtcacgtattcgtgcccaaaggtgccagatggtacagactgatatgcagtacgtgtttatctaccaggctctgctcgaacactacttgtacggcgacacagaacttgaggttacatctctggagacccatctacagaaaatctataataagattcccgggacatccaacaatgggctggaggaggagttcaagaaactgacatcaatcaagatccagaatgacaaaatgagaacgggaaacctacctgccaatatgaaaaaaaatcgggtgttgcagatcatcccatacgaattcaatcgagtgatcattccagtcaagcggggggaagaaaacaccgattatgtgaacgcctccttcatcgacggctacaggcagaaggacagctacatcgcatcccaggggccactgctgcacaccatagaggatttttggaggatgatttgggagtggaagtcttgttccatcgtaatgctaacagagctcgaagagaggggtcaggaaaagtgcgctcagtattggccctccgacggtcttgtgtcttacggcgacattactgtggaacttaagaaggaggaggaatgtgagtcgtacacagtaagagacctgttggtgactaatacgagagagaataaatcacgccagatccgacaatttcatttccatgggtggcccgaggtgggcattccctccgacggcaagggaatgatctctataatcgcggcagtgcagaaacagcagcagcagtctgggaaccacccaatcactgtgcattgtagcgccggtgccggaagaacagggacattctgcgccctgtctaccgtgttagagcgcgttaaggcagaggggatcctggatgtgttccaaacagtgaagtcccttagactccagcggccacatatggtacagactctcgaacagtatgagttttgctacaaggtagtgcaggagtatatcgacgcctttagcgattatgcaaactttaaatag

SEQ ID NO: 201698 - DNA, 603 bp, Artificial Sequence
  Description of Artificial Sequence: Synthetic coding sequence
atggacagctggttcatcctggtgctgctgggcagcggcctgatctgcgtgagcgccaacaatgcaaccactgtcgccccctctgtgggcataacaagactgattaactcttccaccgcggaacctgtgaaagaggaagccaagacatcaaatccaacttcatcattaacttcattatctgtcgcaccgaccttcagccccaacatcacactgggccccacatatctgaccaccgtgaattcatcagattctgataatggcaccacccgtacagccagcaccaacagcatcggtattactatttctcccaatggtacttggctgcccgataatcagttcaccgacgcaaggacggaaccatgggaaggcaatagctctactgccgctacaaccccagaaacgtttccacccagtgggaattccgacagcaaggaccggagagacgagacccctattatcgctgtgatggttgctctgtcgtctcttcttgtgatcgtgttcataattatagtgttgtatatgctgcgtttcaaaaagtataagcaggccgggtctcattcaaacagtttcagacttagcaacggccgaaccgaggatgtctag

SEQ ID NO: 201699 - DNA, 2442 bp, Artificial Sequence
  Description of Artificial Sequence: Synthetic coding sequence
atggacgacgccgtgcagatcaccaagatcagcatggacagctggttcattctggtattattggggtccggcttgatttgcgtgagcgccaacaatgccacaaccgtagctcccagcgtaggcatcacaaggctgatcaatagcagcactgccgaacctgtcaaggaagaggctaagacatccaacccgacctcatctctgacatctcttagcgtagctcctactttttcccccaatatcacactcggacccacatatttaacaactgttaacagctctgactccgacaacggcactacacgcactgcttccaccaattcgattggtatcacaataagcccaaatggaacctggctcccagataaccagttcaccgacgcacggaccgagccctgggaggggaactccagtacagccgcgaccacgcctgagacattccctcctagcggtaatagcgattctaaagaccgcagggacgaaactccgattatcgccgtaatggtggccttatcgtctctgctggtgattgtgtttattattatcgtgctctatatgctccggttcaagaaatataagcaggccggatctcattcaaacagcttccgcctatctaatggccggacggaggatgtcgagcctcagagcgtgccactgttggctaggagtccatccacaaataggaaatacccgccacttccagtggacaaactggaggaggagattaatcgccggatggccgacgataataaattattcagagaggagttcaacgctctgccagcatgcccgattcaggctacatgcgaggcagcctcgaaggaagagaacaaggagaaaaacaggtacgttaacatactgccttatgaccattccagggtacatctcaccccagtggaaggtgttccagattctgattatattaacgctagcttcataaacggatatcaagaaaaaaataaattcatcgccgcccagggaccgaaggaggaaaccgttaatgacttctggagaatgatttgggagcaaaataccgcaacaatcgttatggttaccaacctgaaggaacgcaaagaatgcaaatgtgctcagtactggccggaccagggatgttggacttacggcaacatacgcgtttcggtcgaggacgtgactgttctggtcgactacaccgtgcgcaaattctgcattcagcaggtgggggatatgacaaaccgaaaaccccaacggctgatcacccaattccacttcacgtcctggccggattttggtgtgcccttcacccctatcgggatgcttaagttcctgaagaaagtgaaggcctgtaatccacagtatgcgggggccatcgtagtccactgcagtgccggggtggggagaaccggcaccttcgtggtcatcgatgcaatgctggatatgatgcacaccgagcgcaaggtggacgtatatggattcgtttctcgaatccgtgctcaaagatgtcagatggtgcagactgatatgcagtatgtttttatatatcaagctttactggaacactatctgtatggagacacagagttggaagtgacttccctggagacccatcttcagaaaatctataacaaaattccagggaccagcaacaatggtttggaggaggagttcaagaaactgacctccatcaaaatccagaatgacaagatgcggacagggaatttgcccgcaaatatgaagaaaaaccgcgtgctccagattataccatatgagtttaacagggtcatcatcccagtgaagaggggtgaggaaaatactgattatgtgaatgcatcattcatagatggctaccgacagaaagattcttacattgcctctcaagggccgctcctgcacacgatcgaggatttctggagaatgatttgggagtggaagtcatgctccatcgtcatgcttactgaattggaagagagaggccaggaaaaatgcgcccagtattggccgtctgacggcttggtctcctatggagatatcaccgtagaattgaaaaaagaagaggagtgtgagtcgtatacagtgcgtgatttgctcgtgactaataccagagaaaacaagtcccgccagattcggcagtttcatttccatggatggcccgaagtgggcatcccttcagatgggaagggcatgatcagtatcatcgcggccgtgcagaagcagcagcagcaaagcgggaaccatcccatcacagtgcactgttccgcaggcgcagggagaacggggacattctgcgccttatccaccgtactcgagcgggtaaaagcagagggaattctggatgtctttcagaccgtaaagtctctccgcctgcagcgacctcacatggtgcagaccctcgagcagtatgaattttgctacaaagtagtgcaggaatatatcgatgccttcagcgactacgccaactttaagtag

SEQ ID NO: 201700 - DNA, 528 bp, Artificial Sequence
  Description of Artificial Sequence: Synthetic coding sequence
atggacagctggttcatcctggtgctgctgggcagcggcctgatctgcgtctcagccaataatgccaccacggtggccccatccgtcgggataacgcgcctgataaacagctccactgccgagccggtgaaggaagaggcaaagacttctaatcctacaagttcactgacatctctctctgtggcacccacattcagtcctaacattacactaggtccaacttacctgacgacagtcaactcaagcgactctgacaatgggacgactagaacagccagcacgaacagcatcgggattaccatttcccctaatggaacctggctgcccgataatcaatttacggatgcccgaaccgagccctgggaaggtaactcgtccactgccgcgactaccccagaaaccttccccccatctggcaattctgacagtaaggatcgtagagatgagactcctatcattgcagtcatggttgctctgagcagcctgttggtgatcgtgtttattattatcgtgttgtacatgctctag

SEQ ID NO: 201701 - DNA, 417 bp, Artificial Sequence
  Description of Artificial Sequence: Synthetic coding sequence
atggacagctggttcatcctggtgctgctgggcagcggcctgatctgcgtgtctgccaacaatgccacaaccgtggccccatctgtgggcataactcgactaatcaatagctccaccgcagaaccggtgaaagaggaagcaaaaacatctaaccccacttcgtccctgacttcactctcagtagcccccacattttcaccaaacatcacattggggccaacctaccttaccactgtgaactctagcgacagcgacaacggaaccaccaggaccgcatcaacaaattcaatcggcattaccatctcccctaacggtacatggttacctgacaaccaattcactgacgctaggacagagccttgggagggaaattcttcgacggccgctactacacctgagacgttcccccccagctag

SEQ ID NO: 201702 - DNA, 762 bp, Artificial Sequence
  Description of Artificial Sequence: Synthetic coding sequence
atggacagctggttcatcctggtgctgctgggcagcggcctgatctgcgttagtgcgaataacgcaactacagttgcgccaagtgttgggatcaccaggctaatcaattcatctaccgcggaaccagtcaaagaagaagccaagacctccaaccctacctcatcactaacctcactgagtgttgcacccacgttttctcccaatatcaccctgggccctacttatctaaccacggtcaattcgagtgacagcgataatggtacaacccggaccgcgagtactaactccataggaataaccatatcaccaaatggcacctggctgcctgataaccaatttaccgacgcaaggacggagccttgggaaggaaactcaagtacagcagcgaccacaccagagacatttcctccctcagacgagactcctataattgctgtgatggtggccctgtcttcactcttggtcatcgtgttcatcattatcgtcctctacatgttaagatttaaaaaatacaaacaggccgggagccatagcaactccttcaggctcagcaatggaagaaccgaagacgtggagccacaatcagttcctctgcttgcccgtagcccatcaaccaatcggaaatatccaccattgcctgtagacaagctggaggaagagattaaccgaaggatggctgatgacaacaaattgttccgggaggaattcaatgccctccctgcctgtcctatccaggcaacctgcgaagctgccagtaagtag

SEQ ID NO: 201703 - DNA, 1239 bp, Artificial Sequence
  Description of Artificial Sequence: Synthetic coding sequence
atgaccaaccggaagccccagcggctgatcacccagttccacttcactagctggccagattttggcgtgcccttcactccgatcggaatgctgaagtttctcaaaaaagtcaaagcatgcaacccgcagtacgcaggggccatcgttgtccactgctctgccggggtgggtcgcactggaacgttcgtggttattgacgcaatgctggacatgatgcatactgaacggaaagttgatgtatacggcttcgtgtcacgtattagggcccagcgctgccagatggtgcaaaccgatatgcagtacgtgtttatctatcaggctcttctggaacactacctttacggggatactgaactggaggtgacaagcctggaaacacacttacagaaaatctataataagattcctggcacgtccaacaacgggctggaggaagagtttaagaagttgaccagcataaaaattcagaatgataaaatgcgcacaggcaacctgcccgcaaacatgaaaaagaacagggtgcttcagatcataccctacgagttcaaccgtgtgattatccccgtgaagagaggtgaggagaacacagactacgtcaacgcctcgttcattgacggatacagacagaaggacagctatatcgcttcccaaggcccccttctgcatacgatagaggatttttggaggatgatttgggagtggaagtcttgttccatagtgatgctcaccgagctggaggaaaggggccaagaaaaatgcgcccagtattggcctagtgatgggttggtctcatacggcgatatcacagtggaacttaagaaggaagaagagtgcgagtcgtacaccgtgcgggacctgttagtcacaaacacaagggaaaacaaaagcaggcagatccgccaattccacttccatggatggcctgaagttggcatcccaagtgatggaaaaggcatgataagcattattgctgccgtacaaaagcagcaacagcagtccggcaatcaccctatcacagtgcattgtagcgctggcgccggacgcaccgggacattctgcgccctgtcaactgtcctggagcgggtgaaggctgaaggaattctggacgtgttccaaacagtgaagtccctgaggctgcagagacctcatatggtgcaaacactcgagcaatacgaattttgttataaggtcgtacaagagtacatcgatgcttttagcgattatgccaatttcaagtag

SEQ ID NO: 201704 - DNA, 5994 bp, Artificial Sequence
  Description of Artificial Sequence: Synthetic coding sequence
atgctgagccacggcgccggcctggccctgtggatcaccctgagcctgttgcagaccgggctcgccgagcccgagcgctgcaattttactctcgccgagagcaaagcctcgtcacactcagtgtccatacaatggcgcatcttgggaagcccttgcaacttttcgcttatatactcttctgacaccctgggggctgcgctctgcccaacgtttcgcattgataacactacttacggctgtaatctccaagacctacaggctggcactatctataacttcagaattatcagcctcgatgaagaacgcacggtagtgctgcagactgaccctctgcctccggcacgctttggcgtgtcgaaggagaagaccacgagtacctctcttcacgtctggtggacaccaagcagcggaaaggtaacaagttatgaggtccagctgttcgatgaaaacaaccaaaagatccagggcgtgcaaattcaggagagcaccagctggaatgagtatacattttttaacctgacggccggctccaaatacaacatcgccataacagctgtaagtggtgggaaaagatccttcagcgtctacacaaatggtagcaccgttccatctccagtgaaggacataggaatttctacaaaagctaactctctgctcatttcgtggagccacggaagcgggaacgtggagcgctaccgacttatgctgatggataaagggatcctagtccacggcggcgtcgtggataagcatgctaccagctacgcctttcacggtctcactcccgggtacctatataacctgaccgtaatgaccgaggcagctggattacagaattatagatggaagctcgtgcggacagcgcctatggaagtctcaaatttgaaggtcacaaacgacggttcacttacaagcttaaaagtgaaatggcagcgaccgccagggaacgtggactcttataatataaccttatctcataagggtaccatcaaggagagcagggttttggcaccatggattacagagacacattttaaagagttggtgcccggacggctctaccaagtaacagtgagctgtgtcagtggggaactcagcgctcagaagatggctgttggacggacatttccagataaggtcgctaatctcgaggccaataataacgggcggatgcgatcattagtggtcagctggagcccccctgcgggggattgggaacagtaccggatcctgctgtttaacgacagcgttgtgctgttgaacattacggtgggcaaagaggagacacaatacgtaatggatgatactggccttgttcccggccgacagtatgaggtggaggttatcgtggaaagcgggaacttaaaaaactcagaacgttgccagggaagaacagttccgctcgcagtgcttcaattgcgggtgaaacacgccaatgagacttctttgtctattatgtggcaaacccctgttgcagaatgggagaaatatatcatttccctggccgatagggacctgttgctcatccacaagtccctctccaaagacgccaaagaattcacttttacagacctggtgccgggacggaagtacatggctaccgtgaccagtatatccggcgatcttaagaattccagttccgtaaaaggccggacagtgccagcccaggtgacagatctgcacgtagctaatcaaggaatgacttccagtctcttcactaattggactcaagcccagggggacgtggagttttaccaggtgctcctcatccacgaaaacgtggtcattaagaatgagtcaatttcctctgaaacatccaggtactcattccattctctcaagagtgggtccctttactccgtcgtggtgactacagtatctgggggcatcagctcgcgtcaggttgtcgtggaggggcgcacagtgcctagctcggtgagcggcgtaactgtgaataatagtggcagaaatgactatctgagtgtgtcctggctgctcgcccctggcgatgtggataactatgaagtcaccttgagccatgacggaaaagtggtccagtcgctggtgatagcgaagtctgtccgagagtgctccttttcatcactcacgcccggccgattgtatacagttaccataaccactcggagtggcaagtacgagaaccacagcttctctcaggagagaactgtacctgacaaggtgcaaggagttagcgtctcgaactccgcacgcagtgactacttgcgcgtttcctgggtccatgccactggcgatttcgatcactacgaggtgaccattaaaaataaaaataactttatacagaccaaatccatacccaaaagcgagaatgaatgcgtgttcgttcagcttgtgcctggtagactgtacagcgtcacagtcaccacaaagtctgggcagtacgaagctaacgaacaaggaaacggcagaaccataccggaacccgtgaaagaccttacactcagaaatcgaagcacagaggacctgcacgtgacttggtctggcgctaacggcgacgtggaccagtatgaaattcagttactcttcaacgacatgaaggtcttccctccgttccatctcgttaatacagcaactgagtaccgcttcacgtctcttactcccggacggcagtataaaattcttgtcctgactatctccggtgatgtgcagcaatcagcattcatcgaaggcttcaccgtcccgtccgccgtgaaaaatatccacatttcacctaacggagcaacggactctttaaccgttaattggacacccggggggggggatgtcgattcttacaccgtgtctgctttccgacactcacaaaaggtggattctcagacaattccaaagcatgtgttcgaacataccttccatcgcctcgaggccggcgaacagtatcagattatgatagcctctgtatccggtagcctaaaaaaccaaatcaatgtagtcggacgtaccgtgcctgcttccgtgcagggggtgatcgctgacaatgcctattccagctactccttaattgtgagttggcagaaggcagcaggagttgccgaacgctacgatattcttcttctcactgaaaacggcatcctactgagaaacaccagcgagcccgcgacaactaagcagcacaagtttgaggatctcacgcccggtaaaaagtataagatacaaattctgacggtaagtggcggcctattttcaaaggaagcccagacagaaggtcgaacagtgccggcagctgtcaccgacctgaggatcaccgaaaattcaacaagacatttatcttttcggtggacagcatccgagggggaactgtcctggtacaatatctttctgtacaatcccgacggaaatttgcaagagcgcgctcaagtggaccctttggtccagagttttagctttcaaaacctcctgcaaggtaggatgtataagatggtcatcgttactcattcgggcgagttgagcaatgagagcttcattttcggcagaactgtgcctgctagtgtttctcatctccgggggagtaaccgcaatacaacggattcactgtggtttaactggagtcctgcttcaggggactttgacttctatgaactgatcctgtacaaccccaatggtacgaagaaggagaactggaaggacaaggacctcactgagtggcggttccaaggtctggtgcctgggagaaaatatgtgctttgggtggtcacccacagtggcgatctcagtaacaaagtgaccgctgaatctcgcactgctccgtcaccaccgtcccttatgtccttcgccgatattgccaatacttcgctggccatcacatggaaaggcccgcctgattggaccgactacaacgattttgaactacagtggctgccccgagatgcactgacagttttcaatccttataataaccgaaagagcgagggccggattgtctacggattaagaccagggagaagttatcagtttaatgtcaaaacggtctcaggagattcatggaagacctattccaaacccatctttggctccgtcagaaccaaacctgataagatccagaaccttcactgccgcccgcagaattccaccgcaatcgcttgtagctggataccccccgactcggatttcgatggatactcaattgagtgtcgcaagatggacactcaagaggtggaattcagcagaaaattagaaaaggagaagagtctgctcaacatcatgatgctggtgccccataaaaggtacctggtatcaattaaagttcagagtgcaggcatgacatctgaggtcgtcgaagacagtaccatcactatgatcgatagaccgccccccccacctccccatatccgagttaacgagaaggacgtgctcattagcaagtcgtccatcaacttcaccgtgaattgctcctggttttctgatacaaatggcgctgtgaagtatttcaccgtcgtagtgcgggaggccgacgggtctgacgagctgaagcctgagcagcagcacccgctgcccagctacctggagtatcgccacaacgcttccattcgggtttaccaaactaactattttgcctcaaaatgtgcggaaaatcctaatagtaacagtaagagctttaacatcaagctcggggcagaaatggaatctctgggtggcaaatgcgatccaactcagcagaagttttgtgatgggcctctaaagccccataccgcatacagaattagtatccgtgccttcactcagctctttgacgaagacctgaaggaattcacaaagcccctctattccgacacttttttttccctgcccatcaccaccgaatccgaacccttattcggagcaatcgagggggttagtgctgggttattcctgatcggaatgcttgtcgcagttgtggctctgcttatatgcaggcagaaggtttcacatgggcgcgagagaccatctgccaggctgtccatccggcgggataggccactgtcggtacatctcaacctgggacaaaaggggaatcgaaagaccagctgtcccatcaaaatcaaccagttcgagggccactttatgaagctgcaggctgactccaactatctgttgtcaaaggagtatgaggaactcaaggacgtgggacgtaatcagagctgcgacatcgctctactgcccgagaaccggggcaaaaatcgatataacaacattctgccctacgatgcgacccgcgtgaaattatcaaacgtagacgatgatccatgcagcgactatattaatgcctcgtacattccaggcaataactttcgacgagaatacattgtgacgcaggggccactaccaggaacaaaggacgatttttggaaaatggtctgggaacagaatgtacacaatattgtgatggtcacccagtgcgtcgagaagggaagagtgaaatgcgaccactactggcccgctgaccaggacagcctctactatggggacttgatcctgcaaatgctatccgagtcagtcctcccagagtggaccatccgtgagtttaaaatctgtggggaggagcaattagacgctcaccgactgattcggcactttcactataccgtctggcccgaccacggggtcccggagacaactcaatcactcattcagttcgtgcgaacggtccgagattatattaatcgctctcccggagccggcccgacagtggtgcattgctctgcaggcgtgggacgtacaggcacttttattgccctcgacagaatattgcagcagcttgattccaaagattctgtcgatatctacggtgcagtgcacgatctgaggcttcacagggtacacatggtgcagactgagtgccagtatgtctatctacaccaatgtgtacgggacgtgctgagagcgagaaagttaaggagcgagcaagagaatcctctgtttcctatttacgagaatgtcaatccagagtatcaccgggatccagtctattcccggcattag

SEQ ID NO: 201705 - DNA, 6648 bp, Artificial Sequence
  Description of Artificial Sequence: Synthetic coding sequence
atggaggccgagttctacatggtgatcctgacctgcctgatcttccgcaacagtgagggcttccagatcgtgcacgttcagaagcagcagtgcttgtttaagaatgaaaaggtggtggtgggctcttgcaataggacaattcaaaatcagcagtggatgtggacagaggatgaaaagctgttacacgttaagtcagccctttgtctcgccatctctaactcatcgcgaggcccgtctcgctcagcgatccttgacagatgcagtcaggctccgaggtggacttgctatgatcaggaggggttcctggaagtcgaaaatgcctcactgttcctgcagaagcagggatcgcgtgtcgttgtaaaaaaagcacgaaaatatttacactcctggatgaaaatagacgtaaataaggaaggaaagttagtgaacgaatccctgtgcctgcaaaaggcaggtttgggagctgaagtttcagtgcggagcacacggaatacagctcctccgcagatccttacaacttttaatgcggtgccggacggcctggtcttcctgatccggaataccacagaagcttttatccggaatgccgccgagaattactcacagaactcctctgagcgacagcaccccaacttacatatgactggaattaccgatacctcttgggtccttagtaccactcagccattttctagcacgacagaggaaacaggtcttgctgaacccgagcggtgtaatttcactctcgccgagtccaaagcaagtagtcacagcgtatctatccaatggaggatattgggctctccatgcaattttagtttgatctactccagcgatacattgggtgccgctctttgccctactttcagaattgacaacacaacttatggctgcaatctccaagatctgcaagctggaacaatatacaattttcggataatttccctggatgaagaacgtacagtcgtactgcaaactgatcctctgccgcccgccagatttggagtgtcaaaagagaaaacaactagcaccagcctacacgtgtggtggacgccctcgtcagggaaggttacttcatacgaggttcagctgttcgatgagaataaccaaaaaatccagggagtgcaaattcaggaaagtaccagctggaacgaatacacgttcttcaacttgacagcaggcagtaagtacaatatcgcaattacagctgtgagtggtgggaaacgctcattcagcgtctacactaatgggtctaccgtaccctcacctgtcaaagatattgggatttccacaaaggccaatagcttgctgattagctggtcgcacggcagcgggaacgttgagagatatcgcctaatgttgatggataaagggatcctggttcacggcggagtcgtggacaagcatgcaacttcatatgccttccacggccttactccgggctacctctacaacctgactgtcatgacagaggctgctggtctgcagaactaccgttggaagctcgtccggactgcccctatggaggtgtcgaacctgaaggtcactaatgatgggtccttgacaagtctcaaggtgaaatggcaacggccccctggcaatgtcgacagctacaacattaccctttctcataaggggaccatcaaagaatctcgtgtgctggcaccatggattacagagactcactttaaggaactggtcccaggacgcctctatcaggtgacagtgtcatgtgtctctggagaattatcggctcagaagatggcagtggggagaaccttccctgacaaggtcgcaaacttggaggcaaacaataatgggcgtatgcggtcactcgtggtcagctggtcccctcccgctggggactgggaacagtatagaatcctgttgtttaacgatagcgtagttttgctgaatattactgtcggaaaggaggagactcagtatgtgatggacgatacggggctggttcctggacggcagtatgaagtagaggtgattgtcgaatccgggaatttaaagaattctgagcgttgccagggccgcaccgttcccctggccgtgctccagcttcgggtgaagcacgccaacgaaacctccctctctattatgtggcagactcctgtggctgaatgggaaaaatacattattagtttggctgaccgcgacctgctgttgattcacaagtcactttccaaggacgccaaagaattcactttcacggacctggtgcccggtagaaaatatatggcaactgtgacaagcatctctggcgatctgaaaaatagtagttccgtcaagggtcggaccgtaccagcacaagtaacagacctgcacgtagccaaccagggcatgacgtccagcctgtttactaactggacgcaggcccaaggtgacgtcgagttctaccaggttcttcttattcatgaaaacgtggtaattaaaaatgaatcaattagttcggaaacgtcgagatacagtttccattccctgaagagcggctcactttactccgtcgtggtcactaccgtctcagggggtatcagttcacgacaggtggttgtagaagggaggactgtgccttctagtgtatctggggtcacagtgaataactccggccgaaacgattacttgtctgtgagctggcttctggcccccggcgatgtggataattacgaagtcacactttcgcatgatggcaaagtggtgcaatcactggtgattgctaagtctgtgagagagtgcagtttttccagcctgacgccaggccgattgtacacagtcacgattaccactcggtctggaaagtacgaaaaccactccttctctcaggaaaggaccgtgcccgacaaggtgcagggtgttagcgttagtaattccgcaaggtccgattatctgagggtttcctgggttcacgctaccggggactttgaccactatgaagtgacaattaaaaacaagaacaattttatccaaaccaaatctatccctaagagcgagaacgaatgcgttttcgtgcagctggtgcctggtaggctgtactcagtaaccgtcacgacgaagtcagggcagtacgaggccaatgaacaggggaatgggaggacaatcccagagccagtgaaagacctgaccctgagaaaccgctcgactgaagacctgcatgtgacgtggtcaggggctaacggggacgtagatcagtacgagatccagcttcttttcaatgacatgaaggtcttccctccgtttcacctcgttaataccgccactgagtaccggttcacatccttgaccccaggcaggcaatataagatactggtcctcactatctcaggcgatgtgcagcaatctgccttcatcgagggctttaccgtaccctccgccgtgaaaaacatccacatttcaccgaatggagcaaccgattccttgaccgtgaattggacccctggcggtggggacgttgattcttacaccgtaagcgcttttagacactcacaaaaagtagacagtcagactatccctaagcatgtcttcgagcacaccttccataggctagaagccggcgaacagtatcagattatgattgcatccgtcagtggctccctcaagaatcaaattaatgtggtcgggcggacagtccccgcctcagtccagggagtcatcgccgataatgcctattcgagttactccctgatagtaagctggcaaaaggctgctggggttgctgaacgttatgacatactcctgctcaccgagaacggaatactactacggaataccagtgaaccagcgaccactaagcagcacaagttcgaggatctgacacctggtaaaaagtacaagattcaaatcctgacggtgagcgggggcctattctctaaagaggcacaaacagagggcaggactgttcccgctgccgtgacggacctccggattactgaaaattccactagacatcttagtttcagatggaccgctagcgaaggagagctctcctggtacaatatcttcttgtataaccctgacgggaatcttcaggagagggcacaggtggatcccttagttcaatcgttttcctttcagaatctgctccagggaagaatgtacaagatggtgatcgttacacattctggtgagctctccaatgagagctttattttcggcaggaccgtacccgcctctgtgtcccatctccggggctcgaacagaaacactacggactccctctggtttaactggtctccggcgagcggcgactttgacttctacgagctcatcttgtataaccctaatggcaccaagaaggagaactggaaagacaaagatcttaccgaatggaggtttcaaggtctggtgcctggaaggaaatacgtgctatgggtagttactcatagcggggatctctccaacaaggtgaccgccgagagcagaacggccccatctccaccaagcctgatgtccttcgcagatatcgctaatacgagcctcgcaatcacgtggaaaggcccaccagactggacagactataacgatttcgagctgcagtggctgccacgtgatgctctgacggtgtttaatccatacaacaatcgaaagtcggaaggccggattgtgtatggactgcggccaggtcgatcttaccaattcaacgttaaaactgtctctggcgacagctggaaaacatattcaaaaccgatttttgggagtgtcagaactaagcccgataaaattcagaacttacactgccggccgcagaacagcacggcaatagcctgctcatggattccccccgactcagactttgacgggtatagcatagaatgtcgcaaaatggacactcaggaggtagagttctcgcgtaaacttgaaaaggaaaagagcttattgaacatcatgatgctggtgccccacaagagatatctcgttagtataaaggtgcagagcgcaggaatgacttccgaagtggtggaggactcgactatcacgatgatcgaccggcccccaccaccccccccgcacattagagtgaacgaaaaagacgtgttgataagtaaatcttcaataaattttacagtcaactgtagctggttctctgatacaaacggagccgtgaagtactttaccgtggtagtaagggaggctgatggttccgatgaactgaagcctgaacagcagcacccgctccctagctacctggagtacagacataacgcctccatccgtgtgtatcagactaattattttgctagtaaatgcgccgagaacccaaactccaactctaagtcttttaatatcaaactaggagccgagatggagagtctaggcggcaaatgtgatcccacccaacagaaattctgtgacgggcccctgaaacctcacactgcataccgtattagtatccgcgcattcactcagctgttcgatgaagatctgaaggaatttacgaaaccgctctattcggatacttttttcagcctcccgataacgacagagtcagaacctctttttggagctattgaaggagttagtgcaggtctgtttcttatcggcatgctggtggccgtcgtagcccttctcatatgccgccagaaggtttcgcacggccgagagaggccatccgcccgactgtctattcggcgcgaccgtcccttaagcgttcatctgaatttgggtcagaaggggaatcggaagacctcttgccccatcaagatcaaccaattcgagggacacttcatgaaactgcaggccgattcaaattaccttttatcgaaggagtatgaggagctcaaggacgtgggacgtaatcagtcctgcgatatcgcacttctgccagagaatcgtggaaaaaatcgctataacaacatcctgccttacgatgctactagggtgaagctgagcaacgtggacgatgacccctgcagtgattatattaatgcgtcttacattccaggtaataacttccggagggaatacattgtcactcaaggcccacttccaggtacaaaggatgacttctggaagatggtttgggaacagaacgtgcataatatcgtaatggtgactcaatgcgtggagaagggacgcgttaagtgtgatcactattggcccgccgatcaggacagtttgtactatggggatctgatactgcagatgttgtccgaaagcgtcttaccagagtggaccatccgggagtttaaaatctgtggtgaagaacagcttgacgctcacagactgattcggcacttccattacaccgtctggcctgatcatggggttcccgaaacaacacaaagccttattcaatttgtcagaacagtacgcgactacattaaccgctcccccggtgcagggccaaccgtggtccactgcagcgccggtgttggtaggactggtacattcatcgcccttgatcgcatcctccagcagctggacagcaaagactcggtggatatttacggcgccgtgcacgaccttcgactccacagggttcacatggtgcagacggaatgtcagtacgtgtacttgcatcagtgtgttcgagacgtgctgcgggccaggaaacttcggtcagagcaagagaaccccctatttccaatttacgaaaatgttaacccggaataccaccgggacccagtatatagtcggcactag

SEQ ID NO: 201706 - DNA, 5724 bp, Artificial Sequence
  Description of Artificial Sequence: Synthetic coding sequence
atgctgagccacggcgccggcctggccctgtggatcaccctgagccttctccagactggattggcggagccggagcgttgtaacttcacattagccgagagcaaagccagctctcattccgtctccatacagtggcgaatcctggggagcccatgcaatttcagtctaatctactcatctgacacactaggggcagctctgtgtccgacatttcgaattgacaacaccacttacggttgcaacttgcaggacttgcaagctggaaccatctacaacttccgcattatttcgcttgatgaggaaaggactgtggtcttgcagactgacccccttccccctgcgcggtttggggttagcaaagagaagaccacatctacatctctgcatgtgtggtggactccaagcagcggtaaagttacttcctacgaagtgcagctgttcgacgagaataaccagaagatccagggcgttcagatccaggaaagcacatcatggaacgaatatactttcttcaacctgacagcaggctctaaatataatattgcgataactgccgtgagcggtggtaaaagatctttctcagtgtacaccaacggctctacagtgccttcacccgtgaaagacatcggaattagtaccaaggccaacagcctgctgatatcatggagtcatggctcaggtaatgtggagcggtatagactcatgttaatggacaaagggatactcgtccacggcggggtggtggataaacacgccactagctacgcttttcatggactcacccccggctacctctacaatctgactgtgatgaccgaagctgcagggctgcagaactaccgttggaagttggtgcgcaccgctcctatggaggtatcaaacctgaaagtgacaaacgacggctctctgaccagtcttaaggttaagtggcagaggcctccaggaaatgtcgactcttacaatataactttatcccataagggcaccatcaaggagagtagagtcctcgcaccctggatcacagagacccatttcaaggagcttgtgcctggacgcctgtatcaggtgaccgtttcttgtgttagtggggagctgtccgctcagaagatggccgttgggcgaacctttccgctcgctgttctgcagctacgggtcaagcatgccaacgaaactagcttgagcataatgtggcaaacccctgtagctgagtgggaaaaatatatcatttcattggccgaccgcgaccttctgctgattcataagagcttatcaaaggacgcaaaggagtttacatttacagacctcgtgcctggacggaagtacatggctacggtgaccagtatcagtggcgatttgaagaactcaagcagcgttaagggccggacagtaccagctcaggtgacagatcttcatgtagcgaatcagggcatgacctcttctctgtttactaactggacccaagcccagggcgacgtagagttctatcaagtgctccttatccatgagaacgttgtcataaaaaatgaatcaatttccagtgagacaagcagatacagctttcattccctcaagtccggatcgctttactccgtcgtggtcactacagtctctgggggaatctcgtcccggcaggtggtggtggaggggcggacggttccaagcagcgtatcaggagtaacggtcaataatagcgggagaaacgactacttgagtgtgtcttggcttctggctcccggggacgtcgataattacgaagttaccctgagccacgacggcaaggtagtgcagtcgttagtaatcgccaagagcgttcgtgaatgtagcttcagctccctgacccccggacggctttacactgttaccataactacaaggagcggcaagtatgagaatcatagcttctcccaggagcgtaccgtgccagataaagtccaaggggttagtgtaagtaatagtgccagatctgattacctgcgggtgtcttgggttcatgccactggggattttgaccattacgaagtgaccattaaaaataaaaacaacttcattcagactaagtcaattcccaagagcgagaatgaatgtgtgtttgtccagttagtaccaggacgcctctatagtgtcaccgtgactaccaagtcaggccagtatgaggcaaatgagcaggggaacggacggactatccccgaacccgtcaaggatctgaccctgcggaaccggagcacagaggatctgcacgtcacctggtcgggagctaatggagatgttgaccagtacgaaattcagttgctattcaatgatatgaaggtcttccccccatttcacctggtgaacaccgcaaccgaataccgattcaccagtctgacgccgggccgccagtacaagatcctggtgctgacaatatcaggcgatgtgcaacagtcagcgtttatcgaaggattcaccgttccctccgctgtgaaaaacatacacatctctcccaatggggccactgactctctcacggtgaattggacaccaggcggaggcgacgttgattcatatacagtgtctgcgttcaggcactcccagaaggtggattcacagaccatccccaagcatgtctttgagcatacattccatagactcgaagccggggaacagtatcaaataatgatagcctctgtaagcggttcactgaaaaaccagattaatgtcgtcggaaggactgtccccgcctcagtgcaaggcgtgattgcagataacgcatactcttcttatagcctgatcgtgagctggcagaaagcagcaggtgttgcagaaagatacgatatcctgttgctgaccgagaacggaattctgctcagaaatactagcgaacctgcgaccacaaagcagcataaatttgaggacctcacccccgggaaaaagtacaagattcagattctgacagtgtcagggggtctattcagcaaagaagctcagaccgagggtaggacggtccccgcagccgtcaccgatttgagaattacagaaaacagcacgagacacctaagttttcgttggaccgcctctgaaggtgagttgagctggtacaacatcttcctgtataatcccgatggaaacttgcaggagagagctcaggttgatccactggttcagtcctttagtttccagaacctgctgcagggcagaatgtacaaaatggtgattgttacgcactccggcgagcttagtaacgaaagtttcatatttggccgcactgtgcccgcctctgtgagtcatctcaggggatccaatcgaaacaccacagacagtctgtggttcaactggtccccagcgagtggcgactttgatttctacgaacttatcctttataaccccaacggcactaaaaaggaaaactggaaggataaggatctgaccgagtggcgctttcaggggttagtgccaggccggaagtacgtcctgtgggttgtcactcattccggcgacttaagtaacaaagttactgccgagtcccggacagcgccgagtcccccttccctgatgtctttcgccgatatagccaacacgtcactggccattacttggaaggggccccctgactggacagattacaacgacttcgagttacagtggctacctagagatgcactaacagtgtttaatccctacaacaaccgaaagtcagaagggcggattgtatacggactccgtccaggaagaagttaccagttcaacgtcaaaaccgtttctggtgacagttggaagacttattccaaacccattttcgggagcgtacgaacgaaaccagataagattcagaacctgcactgccgtccccagaacagcactgccattgcatgctcctggatccctccagactcagactttgatggatatagcatagagtgtagaaagatggatacccaagaggtagaattcagtagaaaactggagaaagagaaaagtctcctcaacatcatgatgttagttccccataagcgatacctcgtgtctatcaaggtccagtctgccgggatgacatccgaggtggtggaggactccacaatcactatgatcgatcggcctccaccccccccaccacacattcgagtgaatgagaaggatgtattgatttcaaagagttccatcaactttacagtgaattgcagttggttcagcgacaccaacggagccgtgaagtactttacagtggttgtgcgcgaagccgatggcaatgatgaactaaaacctgaacagcagcatccacttcctagctacctggagtatcgccacaatgcgtctataagagtctatcagacaaattactttgccagcaagtgtgccgaaaatcccaactccaactctaagagctttaacataaagttaggagccgagatggagtctctgggaggaaaatgtgaccctacgcagcagaagttctgcgatggaccattgaaacctcatactgcctacagaatctccatcagagccttcacccagctgttcgacgaagaccttaaggaattcacgaagccactgtacagcgacaccttcttttcactgccaattaccaccgagtctgagccattgtttggcgccatcgagggagttagcgcgggactctttctcatcggaatgctggtcgcagtggtcgctctcctcatctgtagacagaaagtctctcacggtagagagaggccaagcgcccggctctccattcggagagatcggcctttgtcagtccatctcaatttaggccagaagggaaaccgcaagacaagctgtcccataaagatcaatcagttcgagggccattttatgaaattgcaggctgattctaactacttgctgtctaaggagtacgaagagctgaaggatgtgggacgaaaccagagctgcgatattgccctgctccccgaaaatcgaggcaagaataggtataacaacatcctcccatatgacgccaccagagtgaaactgagcaatgtagatgacgatccctgttccgactatattaacgcctcctatatacccgggaataactttaggcgagagtacattgtaacacagggacccctccccgggacaaaagacgacttttggaaaatggtgtgggagcagaacgtccataatatcgtgatggttacccagtgcgtcgagaagggcagggtgaagtgcgaccactattggcctgcggatcaggacagcctgtactacggagatctcattttgcaaatgttgtccgagagcgttcttcctgagtggacaatccgcgagtttaagatttgtggtgaggagcagttggacgcccatagattgattcggcactttcattacaccgtgtggcctgatcacggggttccagagacgactcagtccctgatccagtttgttagaaccgtcagagattatatcaatcggtctcccggcgccggccctacagtggtacactgctctgcaggagtggggcggactggcacattcattgcactcgataggattcttcagcagctggactctaaagactccgtcgatatttatggcgccgttcacgatcttaggctgcatcgggtccatatggtgcagaccgaatgtcagtacgtgtatctacatcaatgtgtccgggatgtgctccgagccagaaaattgaggtcggaacaagaaaatccactgttcccaatttatgagaacgttaatccagaatatcacagagatccagtttatagtagacattag

SEQ ID NO: 201707 - DNA, 2760 bp, Artificial Sequence
  Description of Artificial Sequence: Synthetic coding sequence
atggaggccgagttctacatggtgatcctgacctgcctgatcttccgcaacagcgagggatttcaaattgtgcacgtgcaaaaacaacagtgcctgtttaagaatgagaaggtcgttgtgggcagctgcaacagaacaatccagaaccagcaatggatgtggacagaggatgagaagttgctgcacgtgaaatccgcactatgtttagcgatttcgaatagtagcagaggccccagccgcagcgcgattttggataggtgcagccaggcgcctcggtggacctgttatgatcaggagggattcctcgaagttgagaatgccagcttgtttctccagaagcaggggtctcgcgtggtggtcaaaaaagctcggaaatacctgcattcttggatgaagattgatgttaacaaagagggcaaactggtgaacgagagtctgtgtttgcagaaagccggactgggggcggaggtgtccgtgcgctcaacccgcaataccgcgccaccgcagatcctcacaacttttaatgctgtacctgacggcctggtattcctgatacgcaacaccactgaggcttttattcggaacgccgccgagaactactcccagaatagttctgagcggcagcaccctaatctgcacatgaccggaattaccgatacatcttgggtgctgtcaactacacaacccttcagttcaacaacagaggaaaccggcctggccgaaccggaaagatgcaacttcacgctggccgaatctaaagcctccagccactcagtctctatacaatggcgcatcttgggatccccatgcaatttctccttaatttatagtagcgatacattgggagcggctctatgtcctacttttcgaattgacaatactacctacggatgcaaccttcaagacttgcaggctggcacaatttacaattttagaattatcagtctcgatgaagagcgcactgtagtgctgcagaccgatccattgccccccgcacgattcggcgtctccaaagagaaaaccacttccacatccctgcacgtgtggtggacccccagctcaggcaaagtgacctcgtacgaagtacagttgtttgatgagaataatcagaagattcagggggtccagatccaggaatcaaccagctggaacgaatataccttcttcaatttgacagcaggttcgaaatataatatagcgataacggctgtttctggagggaagagatccttttctgtctataccaacggcagcacggtcccctctcccgtgaaagacatcggcatcagtaccaaggctaactcacttctcatttcctggtcccacggaagcgggaatgtggaacgctataggctcatgttaatggataaaggaatcttggttcacggtggcgtggtggacaaacatgcaacctcctatgctttccatgggctgaccccaggctacctctataatctaaccgtgatgacagaagccgctgggctgcaaaattaccgatggaaattggtgcggacggcgcccatggaggtctcaaacctgaaggtcactaatgatggttcacttacaagcctgaaggtcaagtggcagcgacctcccggaaacgttgattcctacaatatcactctcagtcacaaagggaccattaaggagagcagagtactcgccccttggattaccgaaacacacttcaaagagctcgtgcccggccgcctctaccaggtcaccgtgagttgcgtgtccggagagttgtcagcccaaaaaatggcggtagggcgtaccttccctgacaaggtcgctaacctcgaggcaaataacaacggacggatgaggtccctggttgtttcctggtccccgccagctggcgactgggaacagtacaggatcctcctattcaacgactcagtggtgctgctcaacatcacagtgggaaaagaagaaactcaatacgttatggacgataccggactagtgcccggcagacaatatgaagtggaggtgatcgtcgaatcaggcaatctcaagaattccgaaagatgtcagggtcgtaccgtgccgctggcagttctccagctgagggtgaaacacgccaacgaaactagcttgagcattatgtggcagacgcccgtggctgaatgggaaaaatatatcattagcttagcagatcgtgacctgctccttatccataagagtttgtccaaggacgccaaagaatttacatttaccgatctggtaccaggaagaaagtacatggccactgtcacttcaatttccggcgacttaaagaatagctcaagcgtaaaaggacggacggtacccgcacaggtaacagatctgcatgtagcaaaccaagggatgacctccagtctttttacgaactggacccaggcccagggagatgtggagttttatcaggttctgcttatacacgaaaatgtggtgattaagaacgagtcaatctcatcagaaacatccagatactcatttcactccttaaaatcaggttcactgtattctgtggttgtcaccacagtatccggaggcatttcctccagacaagtggtcgtggagggaaggaccgttcccgacaaggtacaaggggtgagcgtttctaactccgcgagaagcgattacttacgggtgtcctgggttcatgccactggcgacttcgatcactatgaagtgacaattaagaataaaaacaatttcatccagactaaagctttccccagccagaaaactaatgtctatctgtttagctag

SEQ ID NO: 201708 - DNA, 5724 bp, Artificial Sequence
  Description of Artificial Sequence: Synthetic coding sequence
atgctgagccacggcgccggcctggccctgtggatcaccctgagcctgctccagactgggctagccgagccagaacggtgcaacttcacactggcagaaagcaaagccagctctcattcggtttcaattcagtggcgcattctcggctccccatgcaatttcagtttaatctacagctcagatacactgggggcagcgttatgtcctacctttcgcatcgacaacacaacgtacggttgtaatctgcaggacctacaagccgggacaatctataacttccgcattatttcccttgacgaggagcgcactgtagtgctacagaccgatcctctgccaccagcgcggttcggtgttagcaaagagaagacaacgtctactagccttcatgtgtggtggacaccctcctctggcaaggtaacgtcctatgaggtgcagctgtttgatgaaaacaaccagaaaattcagggtgtgcagatccaagagtccacaagctggaacgagtataccttttttaacttgacggctgggagcaaatacaacatcgctattacggccgttagcggtgggaaaagatcctttagtgtgtataccaacggatccaccgtcccttctcctgttaaagatataggtatctcaactaaggcgaattccctactcatcagttggtcccacgggagcggtaatgtggagagatataggctgatgcttatggacaagggcattctcgttcacggaggggtggtagataaacacgccacttcctacgcatttcacggtcttacgccagggtatctttacaatctgaccgtcatgacagaggctgccgggctgcagaattacaggtggaaactcgtccgtacagctccaatggaagttagtaacctcaaggttacaaacgatggcagtctgaccagcctaaaagtcaaatggcagcgaccgcccggcaatgtggactcttacaacatcaccctttcccataagggtaccattaaagaatctagggtcctggctccatggatcacggagactcattttaaggaacttgtgcccggaagactctaccaggtaaccgtgagttgtgtgtccggggagctctccgctcagaaaatggcagttgggagaactttcccccttgctgttttacagttaagagtcaaacatgctaatgaaaccagcctttcgataatgtggcagactcccgtagcagagtgggagaagtacatcataagcctggccgaccgagacctgctgctgatacacaaaagcttgagtaaggatgctaaagagttcacatttacggatctggttccggggaggaagtatatggccaccgtcaccagtataagcggcgatcttaagaacagcagtagtgttaaagggagaacggtcccggcgcaagtgactgacctgcacgtggctaatcaggggatgacttcgtctttgtttaccaactggacacaggcgcaaggtgacgtggagttttatcaagtgcttcttatacatgaaaacgtggtcatcaagaacgaatccatcagcagcgaaacctctcgttattccttccatagcttgaagtcaggaagtctctacagcgtcgtagtaacaactgttagcgggggaatctccagtcggcaggtggtagtggagggaagaactgtcccaagctctgtgagcggcgtgacggtgaacaatagcggccgcaatgactacctctcagtctcatggctgctggctccgggggacgtggacaactatgaagtgactctgagccacgatggcaaagtagtgcaatcactcgtcattgctaagagtgtcagagagtgcagctttagttcattgaccccagggcggctgtatacggtgaccattacgacaagaagcggtaaatacgagaaccattcctttagccaagagagaacagtgccggacaaagtacagggagtgtcagtgtccaacagcgccaggagtgattatctgcgggtcagctgggtacatgcgaccggcgatttcgaccactacgaagtgacaattaagaataagaataacttcatacagaccaagagtattcctaagtcagagaatgaatgcgtattcgtgcaactcgtcccaggaagactttattcagtcacagtgaccacaaaatctggacagtatgaggccaatgagcagggcaacgggagaactattccggaacctgtcaaagatctcaccctgcgcaaccggtccaccgaggacctccatgtgacttggtccggggcgaacggagatgtggaccaatacgagattcaactcctgttcaacgatatgaaagtgtttcctcctttccatttggtaaacacggctacagaataccggttcacttctcttacccctgggagacagtataaaatactggtcctcaccataagcggggacgtacaacagagcgcttttattgaagggttcaccgttcccagcgccgtgaagaatatacacatctcgccaaacggagccacggacagcctcacggtgaactggacgcccggcggtggggacgtggactcatatacagtcagcgcttttagacacagccaaaaagttgatagtcagactattcccaagcacgtcttcgaacataccttccataggctggaagccggtgaacagtatcagatcatgatcgctagtgtgtctggctctttgaagaatcagattaacgtcgtgggccgcacagtgcccgctagcgtgcagggtgtcattgctgacaatgcctactcgtcctactccctgatcgtctcttggcaaaaggcagccggggtagccgaaaggtatgatatcttgctgcttactgaaaacgggatcctgctgaggaacacttcagagccagctacaaccaagcagcacaagttcgaggacctgactcccggaaaaaagtataagatacaaattctcactgttagcggaggactcttttccaaagaggcccagactgaagggagaaccgtcccagcagctgtaactgatctgcgcatcaccgagaactccacgcgtcacctgagcttcaggtggactgccagcgaaggtgagctgtcgtggtacaacatctttctatataatccagacggcaacctgcaggagcgggctcaggttgatcccctggtccaatcatttagctttcagaatcttttacaggggagaatgtataaaatggttattgttacacactccggtgagctgagcaacgaatcgtttatctttggtagaacagtgcccgccagtgtcagccacctccggggaagtaatcggaacacaactgactccctttggttcaactggtcaccagccagtggtgacttcgatttctacgagctgatcctctacaatcccaacggtaccaaaaaggagaactggaaggataaagatctgactgaatggcgatttcagggccttgtgcccgggcgcaagtatgtgttgtgggtggttacacattcaggcgacctgagcaacaaagtaacggcagagtctaggaccgctccgtccccacctagcctcatgtcatttgccgacatagccaatacttctctcgctatcacctggaagggcccaccggattggaccgattataacgactttgagttacagtggcttcctagagacgcccttaccgtctttaacccctataataaccgaaagagtgagggccgcatcgtgtatggtcttcgtccaggtcgaagctaccagttcaatgtgaagacagtgagcggtgatagctggaaaacttactctaaaccgatctttggtagcgtgcgtaccaagccagacaagattcaaaacctgcattgtagaccacagaacagcactgcaatcgcctgctcctggataccaccagacagcgattttgacgggtacagcattgaatgtagaaagatggatacacaggaggttgaattctcaagaaaactggaaaaggaaaaatccttgctgaacataatgatgctcgtgcctcacaagcgatatctggtttcaatcaaagtgcagtccgcagggatgacttccgaggttgtcgaggacagtaccatcaccatgatcgaccgccctcccccacccccaccgcatatccgcgttaacgaaaaagacgttcttataagcaaaagctctattaacttcaccgtgaattgttcttggttctcggacactaacggtgccgtgaagtattttactgtagttgtccgtgaggcggatggctccgacgaactgaagcctgaacagcagcacccactgccctcataccttgagtaccggcacaatgcctctatcagggtgtaccagacaaactacttcgcctcaaaatgtgctgagaaccccaactctaatagtaagagcttcaacattaaattgggagccgaaatggagagtctgggagggaaatgcgatcctacacagcaaaagttctgtgatggaccattgaagccacacaccgcttatcgcatttcaatcagagccttcacccagctgtttgacgaggacctgaaagaatttaccaaacccttgtatagtgatacattcttttcgctgcccattaccacagagtccgagcccttgttcggcgcaattgaaggagtcagcgccggattgtttcttattggtatgctcgtggcagttgtggccttgttaatatgcagacagaaggtgagccacggcagggagcggccttccgcgagactctctatccgacgcgataggcctctgagcgtccacctcaacctggggcaaaagggtaatcggaaaactagctgccccattaagataaaccaattcgaaggtcatttcatgaaactgcaggcagatagtaactacctactcagtaaggaatacgaggaattgaaagatgtgggccgcaatcagtcttgcgacattgctcttctgcccgaaaaccgtggcaagaaccgatataataatatactgccatatgacgccacacgcgtaaagctgagcaacgtggatgatgatccatgtagcgattacatcaacgcctcgtatatcccaggcaacaatttccgtagggagtacatcgtcacccaggggccccttcctgggacaaaggatgatttctggaaaatggtctgggaacagaacgtgcacaatatagtcatggtaactcagtgtgtggagaagggtcgagtcaaatgcgaccattactggccagctgaccaggactctctctattatggcgacctcattttacagatgctatccgagagcgtgctcccagagtggaccattagggagttcaaaatttgcggagaggagcagctggacgcccatcgcctcatcagacattttcactacacagtgtggcccgatcatggtgtgcccgaaaccacccagtccctgatccagtttgtcagaacagtgagggactatatcaatagatctccgggagctggcccgacagtcgtgcattgcagcgccggagtgggtagaacaggtacgtttatcgctttagaccggatattgcaacagctcgattccaaggactccgtggatatttacggggccgtgcatgatctgaggcttcacagggtgcacatggtacagaccgagtgccagtacgtctacctccatcagtgcgtaagagacgtcctaagggcaagaaaactccgctccgagcaagaaaaccccctcttccctatatacgaaaatgttaaccccgagtaccacagggaccccgtgtactctagacattag

SEQ ID NO: 201709 - DNA, 621 bp, Artificial Sequence
  Description of Artificial Sequence: Synthetic coding sequence
atggccctgccctgcaccctgggcctgggcatgctgctggccctgcctggggccctaggctctgggggtagcgcggaggactctgtgggttcctccagcgtgactgtagtcctcctccttttactgttactcctcctggctaccggcttggctttggcctggaggaggctctcaagggactccgggggatactaccatcctgcacgcctgggggccgccctatggggaaggacaaggcggttgctgtgggcttctcctcccggaaggtggctgcaggccagggctgaactgggcagcacagacaacgatctcgaacgtcaggaagacgagcaggatacggactacgatcatgttgcggacggtggtctgcaagccgacccgggtgaaggagagcagcaatgcggcgaggcgagctcccccgagcaggtacccgtcagggccgaggaggccagagactctgacactgagggcgatttagttctgggttccccaggacccgccagtgctgggggatctgccgaggctctgctgtccgacctgcacgcctttgccggttccgctgcctgggacgacagtgcaagggctgccgggggccaaggccttcacgtcaccgccctgtag

SEQ ID NO: 201710 - DNA, 4152 bp, Artificial Sequence
  Description of Artificial Sequence: Synthetic coding sequence
atggtgcacgtggcccggctgctgctgctgctgctgaccttcttcctgcggacggacgctgagacccccccccgcttcaccaggaccccagttgaccagactggagtgagtggaggcgtggcttcattcatctgccaggctacaggtgacccgaggccgaaaatcgtatggaacaagaagggcaagaaggttagcaaccagaggttcgaagtgattgagttcgatgacggctctgggtccgtgctgcggattcagcccctccgcactcctagggatgaagccatctatgagtgcgttgctagcaacaatgtcggcgaaatctccgtctccaccaggttaaccgtcctgcgagaagatcagattccacgggggttccctaccatcgacatgggtccacaattaaaagtagttgagaggacacggacagcaacgatgttgtgcgctgcatccgggaacccagatcctgaaatcacatggttcaaggacttcttacccgtggacacatctaataacaatggaaggatcaaacagctgaggtccgtgtccgtgtgcgccacctaccacaccggggctctccaaatcgagcagtcagaggaatctgatcagggaaaatatgagtgcgtggcaactaactccgcgggtacgagatattccgccccagccaatctctatgtccgagtgaacaggaaggttagacgcgtgcctccgcgattctcaatcccgcctaccaaccacgaaattatgccaggtggtagcgtgaatattacctgtgtcgctgttggcagtccaatgccttatgtaaagtggatgctgggggctgaagatctgacccccgaggacgatatgccgattggtcggaacgtcttggagctgaacgatgtgcggcagtctgccaactatacatgtgttgctatgagcacactcggagtcatcgaggccattgcacagattaccgtcaaagcactccccaagccacctgggactcctgtagttactgaatctacagctaccagcatcaccctcacctgggacagtgggaatccagaacctgtgtcatattacattatccagcacaaaccgaagaacagtgaagagctgtacaaagagattgacggcgtcgctaccacccggtattctgttgccggcctgtcgccatactccgactacgaattccgtgtcgtggctgtcaacaacattggccgcggtcctcctagtgaacccgtgctgacccagacatctgaacaggcaccctcctctgccccccgcgatgtgcaagcccggatgctttcctccaccactattctcgtccagtggaaggagcccgaagagccaaatgggcaaattcaaggatatcgggtctattacacaatggatcctacccagcacgtaaataattggatgaagcataatgtcgcggattcccagattactaccatcggaaacctggtgccccagaaaacttacagtgtcaaggtgctggcatttacgagtattggtgacggacccctaagcagcgatatccaggtcatcacccagacaggggtacctggtcagccgcttaactttaaagccgagccagaatcagagacctctatactgctctcctggactcccccgcggtctgacacaattgcaaattacgagttggtctataaggacggtgagcacggagaagaacagcgcatcacgattgagcccgggacgtcgtatagactacaaggccttaagccaaactcactctactattttcggctggccgcccgttccccccagggcctcggggccagcacggccgaaatatcggcacgcacaatgcagtcctctaaagggtactacatcatcatcgtccccctgaagaaaagccgcgggaaatttattaagccttgggaaagcccagacgagatggaactagatgaactgttaaaagaaattagtcggaaaaggaggtccatccggtatggtcgggaagttgaactgaagccctacattgctgctcacttcgatgttcttcctacggagttcaccttgggcgatgacaagcactacgggggcttcacaaacaaacagctgcagagcgggcaggagtacgtgttttttgtccttgctgtgatggagcacgcagaatcaaaaatgtacgctacttccccctacagtgatccagttgtatccatggatctcgatccacagccaataactgatgaggaggagggtctgatatgggttgtcggccctgtattagcggtggtgtttataatttgcattgtgatcgccatcctcctgtataaaaggaaaagggcagaaagcgattccagaaagtccagtattccaaacaataaggaaattccaagtcatcatcctacagaccctgttgagttacgcagactgaattttcagactcccgggatggccagtcacccccccatccctatccttgaactggctgatcacattgagagactgaaagcaaatgataaccttaagttctctcaagagtatgaaagtattgaccctggtcaacagtttacatgggagcacagtaatctggaggtgaataagcccaagaatcgatatgctaacgtgattgcatacgaccatagtagagtgcttctaagcgccattgagggaataccaggctctgattatgtgaatgctaattacatcgacggttaccggaagcagaacgcatatatcgcaacacaaggttctctaccggagaccttcggcgacttctggaggatgatttgggaacagcgctccgctactgtggtcatgatgacaaagctggaggaacgcagtcgcgtgaaatgtgatcagtactggccaagccggggtaccgagactcatggtctggttcaagttactctactagacaccgtggaactagcgacttactgcgtgcgcacgttcgcactgtataagaacgggagctctgaaaagcgcgaagttagacaattccagtttaccgcttggcccgaccacggggttcccgaacaccctaccccttttctcgccttcctgcggagggtcaaaacgtgtaacccccccgatgcagggcccatggtggtgcactgttctgccggggtgggacgcaccggctgttttattgttatcgatgcaatgttggagcggatcaaacatgagaagacagtggatatatatggccacgtcacactgatgcgagcccagcggaattatatggtgcagactgaggaccagtacatttttatccatgatgccctcctggaggctgttacatgtggcaacaccgaggtcccagcccgcaatctgtatgcctatattcagaagctcacccagatcgaaacgggggagaacgtcaccgggatggagctagagtttaagaggctcgcctcctccaaggctcataccagccgttttatctcagccaatcttccctgcaataagttcaagaacaggttagtcaatattatgccttatgagagcacaagagtgtgtctgcagccaatcagaggggtggagggcagtgattacattaacgcttcctttatcgacggctatcggcaacaaaaggcctacatagccactcagggcccactggcagagaccacagaggacttctggcgtatgctatgggagcacaattcaacaattgtagttatgttgaccaagctcagagaaatggggcgggaaaagtgccaccaatattggccagccgagcgcagtgctagataccagtatttcgtggttgaccccatggccgagtacaacatgccccaatacatcctcagggagttcaaagttaccgatgcccgagatggtcagagtcgaactgttcgccagttccaattcacggattggccagagcaaggagtcccgaagtccggcgagggatttatagacttcatcgggcaggtgcataagaccaaagagcaattcggtcaagatggaccaattagtgttcattgctcagccggagtcggaaggactggagtctttatcacgttgtccatcgttctggaacgaatgcgctatgaaggcgtcgtcgatattttccagacggttaagatgctgcgcacgcaacgcccagctatggtccagacggaagatcagtatcagtttagctatcgggctgcccttgaatatctgggcagcttcgaccactatgccacctag

SEQ ID NO: 201711 - DNA, 4521 bp, Artificial Sequence
  Description of Artificial Sequence: Synthetic coding sequence
atggtgcacgtggcccggctgctgctgctgctgctgaccttcttccttcggacggacgccgaaacaccccccagattcacccgtacaccagtggatcaaaccggggtgtctggcggcgttgcatcattcatatgccaggccacaggagatcccaggcctaagatcgtgtggaacaagaagggtaaaaaagtgtctaatcagcggttcgaagtcattgaatttgatgacgggtctggctctgtgctgagaattcagccccttagaaccccacgcgacgaggctatctacgagtgcgtggctagtaataatgtgggtgaaataagcgtcagtacaagactgaccgttctgcgagaggatcagattccgagagggtttccgacaattgatatgggtcctcagcttaaagttgtggaaaggacgcgaacagcaacaatgctttgtgccgcttccggcaatccagatcctgagattacttggtttaaagatttcctgcctgtagataccagcaacaacaacggcagaattaaacagctgcgaagcgaaagtataggtggtacgccaatcagaggtgccctgcagatcgagcagagcgaggagtccgatcaggggaagtatgagtgtgtggccaccaactctgcaggaacaagatacagcgccccggcaaacctgtacgttagggaattacgagaggttagaagagttcctcccaggtttagcatccctccaacgaaccatgaaataatgccgggcggtagcgtcaacatcacctgtgtcgccgtgggctcccctatgccttacgtcaagtggatgctgggtgcagaagatctgacaccggaagatgatatgccaattggaagaaatgttcttgaacttaacgatgttagacaaagcgccaactatacctgtgtcgcaatgtccactttgggggtgattgaggcgatcgcacagattacagtgaaagcactacctaaaccccctggcacccccgtcgttactgagtccactgctacatctataacacttacatgggactctgggaatcccgagccagtgagttactacataattcaacacaaacctaaaaatagcgaggagctgtacaaggagatcgacggtgtagcaaccacaaggtacagtgtggccggcctgtctccatatagcgattatgagttcagggtggtggccgttaacaacatcggtcgaggccccccctctgaacctgtactgacccagacatctgaacaggccccgtcatctgcgcctcgggatgtgcaagctcggatgctctcctcaactaccatcctggtgcaatggaaagaacccgaggagccaaatgggcagatccagggataccgagtatactataccatggaccccacacagcacgtcaacaactggatgaaacacaacgttgctgacagccaaattacaacaatcggcaacttggtgccccaaaaaacctattctgtcaaagtcttggctttcacatctatcggcgacgggcctttgtcttctgacatacaggtaataacacagactggcgtacccggacaaccactgaattttaaagcagagccagagtcagaaacatccattttactgagctggaccccaccaaggtccgataccattgcaaactatgagctagtttataaggacggggagcacggggaagagcaacgaatcaccatagagcctgggacttcttaccggcttcagggtctcaaacctaattcactatactattttcgcttggcggcccgctcaccacagggcttaggcgcttctactgctgaaatatctgctagaactatgcagagcatgttcgccaagaacttccacgtcaaagcagtaatgaagacatccgttctcctttcatgggagattccggagaactataattcagccatgcccttcaaaatactgtatgatgatggaaagatggttgaagaggttgatggacgtgctactcaaaagctgattgttaatctgaagcccgaaaaaagctacagtttcgtacttacaaaccgaggcaactcagccgggggattgcagcatcgggtgacagccaagaccgcccctgatgtgttgcggactaaacccgccttcatcggaaaaaccaatctggacgggatgatcacagttcaacttccagaggtgcctgctaacgagaatatcaaagggtactatatcatcattgtcccacttaagaaatcacgaggtaaatttatcaaaccatgggagtcccctgacgagatggagctggatgaacttttgaaagaaatcagcaggaaacgcagatccattagatacgggcgcgaggtggagcttaagccctacattgccgcgcattttgacgttcttccaacagagtttactttaggagatgacaaacattacggcggtttcaccaacaaacagttgcagagcggccaagaatacgttttttttgtgctggccgtcatggagcacgccgaatccaaaatgtatgctacaagcccttacagcgaccctgtcgtgtccatggacttagacccccagcctattacagacgaagaggagggactgatctgggtggttggacctgtgttggcagttgtgttcattatctgcattgttatcgcaattttgctttacaagtcatctaaacccgatagaaaaagagctgaatcggacagcaggaagtcctcaatcccgaacaataaggagatcccaagccatcacccaacggacccagttgaactgcgcaggctcaacttccaaaccccaggaatggcttctcatccgccgattcccattctcgagttggccgatcacatcgagcggctgaaggctaatgacaatttaaagttttcccaggagtacgaatcgatcgacccaggacagcaattcacatgggaacattctaacctcgaagtgaataagcccaaaaatcgatatgcgaacgtgatagcatacgatcactcacgagtgctgctcagcgccatcgagggcatcccaggatcagattacgtgaatgccaattatatcgacggatatagaaagcagaatgcttatatcgctacacagggctccctgccagagaccttcggcgatttctggcgcatgatatgggaacagcggtccgcaacggtcgttatgatgacaaagctcgaagaacgatccagagtgaagtgcgatcagtactggccgagccggggcacagaaacccatggcctggtgcaggtcacacttctggatacagtagaattggcaacctattgtgtccgtaccttcgctctgtataagaatgggtcctcagaaaaacgggaagtccgacagtttcagtttaccgcatggccggatcacggagtcccagagcaccccactccgtttttggcatttttgcgaagggtgaagacttgtaaccccccagatgcggggcccatggttgtgcattgctctgcaggagttgggaggacaggctgtttcatcgtgatcgatgctatgctggaacgtataaagcacgagaaaaccgttgacatttatggccatgtcacgctgatgcgggcgcagcgcaactacatggtgcagacagaagatcagtacatctttatacatgatgccctgttggaagccgttacgtgtgggaatactgaggttcccgctagaaatctgtatgcatacatacagaagctgacccagattgaaacaggggaaaacgtcactggcatggagctcgagtttaaacgcttagcctcatcaaaagcccacacttcgaggtttatttccgctaatctgccctgtaacaagtttaaaaatcgtctagtcaacatcatgccctacgaatcaacacgggtttgtctgcagcccatacgcggggtggaaggatcagattacattaatgcttcttttatcgacggctatagacaacagaaagcctatatcgcaacccaggggccattagctgagacgactgaggatttctggcgaatgttatgggaacataattcaactatagtggtgatgctgaccaagctgagagagatgggacgggaaaaatgccatcagtactggcccgccgagcgctcagcccgttaccagtattttgtggtcgaccccatggcagaatacaacatgccacagtacattctgcgcgagtttaaggtgactgacgcacgagatggccagtcccggacagtccggcagtttcagttcaccgactggccggaacagggagtacctaaaagtggggaagggtttatcgactttatcggccaggtgcacaagactaaggagcagttcggtcaggatggccccatcagtgtgcactgcagcgctggggtaggaagaaccggcgtttttattaccctttccatcgtgctggaacggatgaggtacgagggtgttgtggacatattccagacagttaagatgcttagaacccagcgacccgccatggttcagaccgaagatcaatatcaattttcatatcgcgctgccctcgagtacttgggttcatttgatcattatgccacctag

SEQ ID NO: 201712 - DNA, 5739 bp, Artificial Sequence
  Description of Artificial Sequence: Synthetic coding sequence
atggtgcacgtggcccggctgctgctgctgctgctgaccttcttcctacgaaccgatgcggagactccacctcggttcaccagaacacccgtcgaccagaccggagtgtccgggggggttgcaagctttatttgccaggcaacaggggatccaagacctaagattgtgtggaataagaaagggaaaaaggtttccaatcagcggttcgaggtaatcgagtttgacgacggaagcgggtccgtactccggattcagcctctgaggaccccacgggacgaggctatttatgagtgcgtggccagtaataacgtcggggagatctctgtgagcaccaggcttaccgtgctgagggaggaccagatacctagagggtttcctaccattgacatgggccctcaactgaaagttgttgaacgtaccagaacagccactatgctgtgtgccgcatccggcaaccccgaccctgagataacttggtttaaagactttctgccagtggatacttctaataataatggacgaataaagcagttgagatccgaatcgatcggtggcacccctattcgcggagcactgcagatcgaacaatccgaagaaagtgatcaaggtaagtatgaatgtgttgccactaatagcgccggaacaagatacagcgcaccagcgaatttgtatgtgcgtgaactgcgcgaggttcgtagagtgcctccccgcttctcaatcccccccacaaaccacgaaatcatgccgggaggcagcgtcaacataacgtgcgtggccgtcgggagtccaatgccatatgttaagtggatgttgggggctgaagatctgacgccagaggacgacatgccgattgggcgcaatgttctcgagcttaacgacgtgaggcagtcagcaaactatacatgcgtcgctatgagcaccttgggtgtcatcgaagctatcgcccaaataacagtgaaagctctgccaaagccacccggcacccccgtcgttaccgagagtactgcaacctccataacacttacctgggacagtggaaaccccgaaccagtgtcatactatatcatacagcacaagcccaaaaattccgaagagctgtataaggagatcgatggagtcgcaactacccgttatagcgtggcaggattatctccttactccgattacgagtttagggtcgtggcggtgaacaacattggccgcgggcccccgagtgagcccgtgctgacccaaaccagtgaacaggcaccgagctccgccccgagagacgtgcaggccaggatgctctcttccactaccattctggtgcaatggaaggagcccgaagaaccgaacggtcagattcaaggctatcgggtatattacaccatggaccctactcagcatgtgaataattggatgaagcataacgtagccgactctcaaataaccactatcggaaacctggttcctcagaaaacatatagtgtgaaggtactagcctttacatcaataggggatggacccctcagctctgatatccaggttattacccagacaggggtaccaggacagcctcttaatttcaaggccgagcccgagagcgaaacatctatacttttatcctggaccccccctcggtctgatactatcgcaaactacgaactcgtgtacaaagacggcgagcacggggaggaacagcggatcaccatagagccgggaacatcctacaggctgcagggacttaagcctaattccctttattactttcggcttgcagcacggagtccacagggattgggtgcaagcacagccgagatttctgctaggaccatgcagtccaagcctagcgctccaccccaggacatatcctgcaccagtccgtcatcaaccagcattttagtatcgtggcaacctcctccagtcgaaaagcagaatggtatcatcactgagtacagcatcaaatacactgccgttgacggcgaagacgacaaacctcacgaaatcctgggaatcccctcggatacaactaagtacctgctggaacagctggagaaatggaccgagtaccgaattacagtgacagcccacaccgatgtgggccccggccccgaatcattatccgtcctcattcgaacgaacgaagacgtgcctagtggacctccccggaaggtggaggtggaagccgttaacagcacctcagttaaagtgtcgtggcgctcccccgttccaaataaacagcacggccagattcgcgggtatcaggtccattacgtacggatggagaatggcgaacccaagggtcagccaatgctgaaggatgtgatgctagcagacgctcagtgggagtttgacgatacaacagaacacgacatgataatctccggcttgcagccagaaacgtcctactccctgacagtgacagcatacaccacgaagggcgacggcgcaaggagtaaacccaagctcgtttctacaaccggggccgtcccagggaagccccgcctggtaattaatcatactcagatgaacactgccttgattcaatggcatccacctgtagacacctttgggccactccagggttatcgcctgaagttcggccggaaggacatggaaccgttaacaacattggaattttccgagaaggaagatcatttcaccgcaaccgatattcataagggggctagctacgtgtttaggctgtctgcaaggaacaaagtggggtttggtgaagagatggtgaaagaaattagtatccccgaggaagtcccaacaggatttccacaaaatctgcactcagagggaaccactagcacctcagttcagttgagctggcagcctcctgtcctcgccgaacggaatggtatcataacaaaatacaccctgctgtacagagatataaacataccactcctgcccatggagcagcttattgtgccagcggacacaactatgactctgaccggactgaaacccgataccacttatgacgtgaaggtccgtgcccataccagcaaggggcccggcccttatagccccagcgtccagttccgcaccttgcctgttgaccaagtgttcgccaaaaatttccacgtgaaggccgtgatgaagacctccgtcttattgtcgtgggaaatccctgagaactacaattccgccatgcctttcaaaatcctgtacgatgacggaaaaatggttgaagaagtggatggtagagctactcagaagttgattgttaacctgaaaccggagaagtcctactcttttgtgttaacgaacagagggaactctgcaggagggcttcagcaccgggtgaccgcgaagaccgcaccggacgtactaagaaccaagcccgctttcataggcaagacaaatcttgatgggatgattacagtgcaactcccagaagtgccggccaacgagaatattaaaggatattatatcatcattgtcccacttaagaagagccgcggcaagttcataaagccgtgggagtcccccgatgagatggagctcgatgaactcctaaaggagatctcacggaaacgcaggtctatccggtacgggagagaggtagaactgaaaccatacattgccgcccactttgatgttttgccaacggagtttactttgggtgacgacaagcactatggaggattcactaataagcagctccagagcggccaagaatacgtttttttcgtcttggctgtcatggagcatgctgagtcaaaaatgtacgctacatcaccttattccgacccggtggtgtcaatggatctcgatcctcaacccattacagatgaagaggagggcttgatttgggtggtgggtccagtgttagccgttgtgtttattatttgtatcgtgattgccatcctgctttataagcgcaagagggccgagtctgactctaggaagagtagcatcccaaataataaggagattcccagtcatcatccaactgaccctgtcgaactgcgcaggctgaactttcagacacctggaatggcctcgcatcctccgattccaatcctagagttggcagaccacattgagcgtctcaaagccaatgataacttaaagttctcacaggaatacgagtcgatcgatcctggccagcagtttacatgggagcacagcaatttggaggtcaacaaaccaaagaaccggtacgcaaacgtaattgcttatgatcactctcgcgtcctactgagcgccatcgaaggtataccgggatctgactacgtcaacgccaactacatcgacggctaccgcaagcaaaatgcatacatcgccacccagggatcactcccggagacatttggcgacttctggaggatgatctgggagcaacgctctgctaccgtggtgatgatgacaaagctggaggagcggtcccgggtgaaatgcgaccagtactggccctcgcgaggaacagagacgcacggcctcgttcaggttaccctcctggatactgtggagctggccacatattgcgtcaggaccttcgcgctctacaagaatggaagttctgagaaaagggaggtgcgccagtttcagttcaccgcttggcccgatcacggagtgcccgagcaccccacgcccttcttggctttcctgagaagagtcaaaacatgcaatcctccagatgctggcccgatggtcgtccactgcagcgcaggcgtgggcagaactggctgctttatagtgatagatgccatgctggagaggattaaacatgaaaaaactgttgacatttatggacatgtaaccctgatgagggctcagaggaattatatggtacaaactgaagaccagtatatttttatacatgatgctctccttgaagccgttacctgtgggaataccgaggttccagctaggaacctgtatgcctatatccaaaagttaacccaaatcgagacgggcgagaacgttacaggtatggagctggaatttaagcggctggccagtagtaaagcccatacctcgcggtttatctcagccaacctgccgtgtaacaagtttaaaaatagactcgtcaacataatgccatatgaatccaccagggtttgccttcagcccatcaggggagtcgaagggtctgattacattaatgcctccttcattgacggctaccgacagcagaaggcctacattgccacccagggacccctggctgaaactacagaggatttctggaggatgctttgggagcataactcgactattgtcgtcatgttgaccaaactgcgcgagatgggacgtgaaaagtgccaccagtactggcccgccgagaggtccgcgaggtaccagtacttcgtggtggaccccatggcggagtacaatatgcctcagtacattctgcgcgaatttaaggttactgacgctcgagacggacagagtaggacagtgcgccagtttcagtttacagattggcctgagcagggcgtccctaaatctggggagggcttcatcgactttattgggcaggttcacaaaaccaaggagcagttcggccaggacggccccatatccgttcattgttccgccggggtcgggcgaacaggagtctttattacactgtctatcgtactcgagcgcatgcggtatgagggagtggtggatatcttccagacagttaaaatgctgcgaacccaaaggccagctatggtgcaaaccgaggatcaatatcagttttcgtaccgcgccgcccttgaatatctgggcagtttcgaccactacgctacttag

SEQ ID NO: 201713 - DNA, 5673 bp, Artificial Sequence
  Description of Artificial Sequence: Synthetic coding sequence
atggtgcacgtggcccggctgctgctgctgctgctgaccttcttcttacgaactgacgctgaaacccctcctagatttacacggacacccgtggaccaaaccggtgtgtctggcggggtagcctcctttatttgccaggctactggggatccaaggcctaagattgtgtggaataaaaagggaaaaaaagtcagcaaccaacgattcgaggtgattgagtttgacgacgggagtgggagcgttttgaggattcagccgctgcggactccaagggacgaagcgatttacgagtgcgtcgccagcaacaatgtgggggagatatccgtgtctactcggcttaccgttctgcgggaagaccagataccacgaggatttcccactatcgacatgggccctcagctgaaagtggttgagagaacccgcactgcaactatgttgtgcgctgcatctggaaaccccgaccccgagatcacttggtttaaagactttctgccggtggacacttcaaataacaatggcaggataaagcagctgaggtcaggagctttacagatagagcagtcagaggagagcgatcaaggcaagtatgaatgtgtggccacaaatagcgctggcactcgctacagcgcccccgctaatctgtacgtgcgtgttcgacgagtgccgccacggttctcaatacctccgactaatcatgagatcatgccaggagggagtgtcaacattacgtgcgtcgctgtcgggtctccgatgccatatgtgaagtggatgctgggcgcggaagacctcacacctgaggacgatatgccgattgggaggaacgttctggaactaaatgacgttcgacagtccgccaattacacttgtgtcgcaatgagcactctcggagtcatagaagctatagcacagatcaccgtcaaggccctacctaagccccctggtactccggtcgtgaccgagtcaacggcaacatccattacccttacttgggactctgggaacccagagcccgtcagctattacatcatccagcataagccgaagaattcagaggaactgtacaaagaaatcgacggagtggccaccaccagatactcagtagctgggctctcgccatattccgactatgagtttcgagtggtcgccgtaaataatatagggaggggccctcctagtgagccggtactgactcagacgtctgagcaagctccctccagcgcgcccagagacgtgcaggcccggatgctttcctctacgaccattctggtacaatggaaggagccggaagaaccaaatggccagatccaggggtacagggtgtactataccatggacccaactcagcacgtcaataactggatgaagcataatgttgccgactcccagatcaccaccatcggcaatctcgttcctcaaaagacttattcagttaaggttcttgcttttaccagcattggagatggacccttatcctcagacatccaggtgataacacagactggggttcccgggcagccactcaatttcaaagctgagccagagtccgagaccagtatacttctgtcgtggaccccacccagatctgatacaatagccaattacgagctggtctataaggacggagagcatggcgaggaacagcggatcacaatcgagccgggcacctcttatcgcctacaaggactcaaacccaattctctttattatttcaggctagccgcccgctctccacaaggcctcggcgcctcaacagccgaaatctcagcgagaacgatgcagagcaaaccgagtgccccgccgcaagacatcagttgtacaagcccttcatctacaagcattctggtctcttggcagcctccaccagttgaaaagcagaacgggatcattaccgaatacagcatcaaatataccgctgtggatggagaggacgacaagccgcacgaaatactgggcattccctctgacacgactaagtatttgctggagcagttagagaaatggaccgagtacaggataacagtcaccgcacataccgacgtgggaccaggccctgagagcctttctgtcctgattcgtacaaatgaggacgtcccaagcggccctcccaggaaagtggaagtggaggccgttaactctacatctgtgaaagtaagctggcgcagtcccgtccccaacaaacagcatggccagatccgagggtaccaagtgcactacgttcgaatggagaacggcgaacctaaggggcaaccaatgctcaaagatgtcatgcttgctgatgctcaggacatgataatcagcggactgcagcccgagactagttattccctaaccgtgaccgcctacactacgaaaggagatggagcccggagtaaacctaagctggtgagtacgactggggcagtacctggaaagccccggctcgttatcaatcatacccagatgaatacggctttaatacagtggcatcccccagttgacacatttggacccctgcagggctacagactgaaattcggccggaaggatatggaacctctcacgactctggaattcagtgagaaggaagaccactttactgctacggatatccataagggggcgtcatacgtgtttcgactcagtgccaggaacaaggtcgggttcggagaagagatggttaaggaaatttctatccccgaagaagtgcctactggtttcccacagaatctccattcagaggggactacaagcacctcagtgcagttgagttggcagccaccagtgctggcagaaaggaatggcatcattactaagtacaccttgctatatcgggacattaacatcccgcttctacccatggagcaattgatcgtccctgcagacacaactatgaccctgaccggcctaaaacccgacactacatatgatgtgaaagtcagggctcatacgtcaaaaggccccggcccgtattctcccagcgtgcagttccgaactctgcccgtggatcaggtctttgccaagaatttccatgtaaaagctgtgatgaagacgtcagtacttctgagctgggaaatccccgagaactataactcagccatgccgtttaaaatactgtacgatgacggaaagatggtggaggaggtcgatggccgggcgacgcagaaattaatagttaatctgaagcctgaaaagtcttactcgtttgtcctgaccaacagggggaacagtgccggtggactgcaacacagggtgacagccaagacagcccctgacgtactgcgaaccaagccagccttcataggcaagacgaatttggatggaatgattacggtccaactgccagaagttccagcgaacgagaacataaaggggtattacataatcatcgttccactgaagaagagtagaggcaaatttatcaaaccctgggaatctccagacgagatggagcttgacgagctcctgaaggagataagtagaaagagacgtagcatccgctatggccgagaggttgagctgaagccctacatagcagcccattttgacgtgctgcccaccgaattcaccctgggagacgataaacattacggcgggttcacaaataaacagttgcaatctgggcaggaatacgttttcttcgtgctggcagtgatggaacacgcagagtccaaaatgtatgcaacctctccgtattctgatcctgtggtgagcatggacctggacccacagcctattaccgatgaagaggaaggtctgatttgggttgtggggcccgtgctcgccgtcgtgtttatcatttgcattgtgatcgctatactactgtacaaacgtaagagggcagaatcggattcaagaaagagtagcatccccaacaataaggagattccatcacatcatcccacagaccctgtagagctccggaggttgaatttccagactccaggaatggcgtcccaccctcctattccaatactcgaactggcagaccacattgaacggcttaaggccaatgacaatctcaaattttcccaggagtatgagtccatcgaccctggtcagcagttcacatgggaacatagcaaccttgaggtgaacaaacctaaaaataggtatgcgaacgtcatcgcctatgatcactcacgtgtattgttatccgcaattgaaggtatcccagggagcgattatgtgaacgccaattacatcgacggataccgcaaacagaatgcgtatatcgcaactcagggtagcctccccgagactttcggcgacttttggagaatgatatgggagcagaggtcagcaacagtggtcatgatgaccaaactggaagaacgttcaagggttaagtgtgaccagtactggccctctaggggcaccgagacgcatggcctagtgcaggttacccttctggacactgttgagcttgctacctactgtgtgcgtacattcgcactttataaaaatggatcgtctgaaaagcgagaggtccgtcaatttcagttcaccgcctggcccgatcacggagtgccagagcacccaacaccttttctggccttcctacgaagagtcaagacctgtaaccctcctgacgccggccccatggtcgtccactgctccgctggggtcgggcgaactgggtgctttatcgtcatagacgctatgctggagagaataaagcacgagaagaccgtggatatctacggtcatgtgacactcatgcgggctcaaagaaattacatggtgcagaccgaggaccagtacatcttcatccacgacgcactgcttgaggcagtgacctgtggaaacaccgaagtgccagcgcgaaacctgtacgcttacattcaaaaactcacacagattgaaacaggagaaaacgtgacaggaatggaattagaattcaaaagactggcctccagcaaggcacataccagcagatttatctccgctaacctgccttgcaacaagtttaagaatcggctggttaatatcatgccttacgaaagtacccgggtctgtctccagccgatcaggggagtggagggatcagattacattaacgcaagcttcattgatggataccgccagcagaaggcatacatcgctactcaagggccattggccgagacaacagaagatttttggcgaatgctgtgggagcacaacagtacaatagtggttatgttgacgaaactgagagagatgggccgggaaaaatgtcatcaatactggcctgccgagagaagcgcgaggtatcaatactttgtggtcgaccccatggcagagtacaatatgccacagtatatcctgagggagttcaaggtgaccgatgccagggatggtcagtcaagaacagtcaggcagttccagttcactgactggccggagcaaggagttccgaaatccggcgaagggttcatcgactttattggtcaggtccacaagaccaaagagcagtttggccaagacggtcctatctctgtgcattgttcagcaggcgttgggcgtacaggcgtctttattacattgtcaattgtccttgaaaggatgaggtacgaaggggtagtggacatcttccaaaccgtcaagatgctgcgcacccagcgccctgccatggtccaaaccgaggaccagtaccagttcagctaccgggccgcccttgaatacctcgggagtttcgaccactatgccacttag

SEQ ID NO: 201714 - DNA, 5700 bp, Artificial Sequence
  Description of Artificial Sequence: Synthetic coding sequence
atggtgcacgtggcccggctgctgctgctgctgctgaccttcttcctgcgaacagacgccgagactccaccccgatttacacgcacccccgtagatcagactggggttagcggtggcgtggctagcttcatatgtcaggcaacgggcgaccctagaccaaaaatcgtgtggaacaagaaaggcaaaaaagtttctaatcaaaggttcgaggtaattgagttcgatgatgggagcgggagcgtactccgcatccaaccactgagaaccccacgagatgaagccatttacgaatgcgtggcaagtaacaatgtgggggaaatcagtgtgtcaacgaggctaactgtgctgagggaggatcaaatcccaagaggctttccgactatcgatatggggcctcaactgaaagtagtcgaaagaacccggactgcaaccatgctgtgcgctgccagcgggaatccagaccccgagatcacttggttcaaggattttcttcccgtggatacgagcaacaacaatggaaggatcaagcagcttaggagtggcgcgcttcaaattgagcagagcgaagaaagcgatcagggtaagtacgagtgcgtggcgacaaacagcgcaggcacccggtattctgctcccgccaacctctatgtcagggtgaggcgagtgccacctagatttagtatacctccgacaaatcacgaaattatgcccggtgggtccgtaaatattacctgtgtggcagtcggctctccaatgccctacgtgaaatggatgctgggcgcggaggacctcaccccagaggatgatatgcctatcggacggaatgttctcgaattaaacgacgtgcgacagtccgccaactacacttgcgtggcaatgagcactctgggggtcatcgaggcgatagctcagattacggttaaagctctccccaagcctccaggcacaccggtggtgacagagagcactgccacctcaattacactgacatgggactcaggcaatcccgagcccgtgtcgtattacattatccagcataagcccaagaacagcgaagagctgtataaggaaatcgatggcgttgccaccacgcgctactccgtggccgggctctccccctactccgattacgaattcagagtcgtagccgtgaacaatattggtcgcggcccaccaagtgagcctgtgcttacccaaacgtcggagcaggccccctcttccgccccccgcgacgtgcaggcccggatgctgtcttcaacaacaatcctggtgcagtggaaagaaccagaggagcctaacggccagattcaaggctaccgcgtctactacactatggatccaacgcagcatgtaaacaactggatgaaacacaatgtcgcagattctcagatcacaactataggcaaccttgtgccgcagaaaacttacagcgtgaaagtcctggcctttacctcaattggggacggtcctctgtcttccgatatccaggtaatcactcagacaggggtgcctggacagcctctcaacttcaaagctgaacccgagagtgaaacttctattctgctgtcatggacacccccacgctctgacacaatcgcaaactacgagctcgtgtacaaggatggcgaacacggagaggagcagagaatcacaattgaaccaggcacgtcatataggctccagggcctgaagcctaacagcctgtactactttaggttagcggcccggtccccacaaggcctgggcgcttccacagccgaaatcagtgctcgtaccatgcaaagcaagccttctgcccctccccaggatatcagttgcacgagtcctagcagcacctctattttggtgtcatggcaacctccgccagttgaaaagcagaacggcatcataacagagtatagcatcaaatacactgctgtggacggcgaggacgacaagccacacgaaatcctcgggatcccatctgatactacgaagtaccttcttgaacagcttgagaagtggaccgaatataggattacagtgactgcccacactgatgtgggtcctggccccgagtccctgtcagtgctgatccgaacaaatgaagacgttcctagcgggccaccccgcaaggtggaggtggaagccgtcaattctaccagcgtgaaggtatcctggcgctcgcccgtccctaataagcagcacggccagattagaggttatcaggtgcattatgtgagaatggaaaacggggaaccgaagggacagcctatgttaaaagacgttatgttggctgatgcacagtgggagttcgacgacaccacagaacatgatatgatcattagcggactgcagcccgagacttcttatagtctcacagtgaccgcgtataccacaaaaggcgatggcgcaagatctaagccaaagctcgtgtccacaactggagctgtccctgggaaaccccggcttgttattaaccatacacagatgaataccgcccttatccagtggcatccccccgtggatacattcggccccctgcagggttatagattgaaattcggcaggaaagatatggagcccctgacaaccctcgagtttagcgaaaaggaggaccatttcactgctaccgacatccacaagggtgccagctacgtgttcaggttgagtgctcggaataaagtaggattcggggaggagatggtcaaggagatttccattcctgaagaagtgccgactggtttccctcagaatctgcactccgagggaaccaccagcacttctgtccagctgagctggcagcctcctgttctggcagagcggaacggaatcattaccaagtacacccttttataccgggacattaatatccctttgttgcccatggaacaactgatcgtgccggcagataccactatgaccctgacagggttgaagcccgatacaacttacgatgtaaaagtcagagcccatacaagcaaaggccccggaccatacagcccctctgtccaatttcgaacactgccagtggatcaagtgtttgctaagaatttccacgttaaggccgtcatgaaaacttcggtcctcctgtcatgggaaatacccgaaaattacaactccgcgatgcccttcaaaatactgtatgatgacggtaaaatggtcgaggaggtggacggcagggctacacagaagctcattgtcaatctaaaacctgagaaatcttacagtttcgttcttactaaccgggggaactccgccggtgggctgcagcatagagtcacggccaaaaccgcgcccgacgtgcttcggacgaaaccagctttcatcggaaaaaccaatctggatgggatgattacggtacagctgcccgaggtcccagctaatgaaaacataaaaggatattatattataatcgtacctctcaaaaagtcaagaggaaagtttatcaagccctgggagagccctgacgaaatggaactggacgagttgctaaaggagatttcccgaaagaggcgaagcattcggtacggtagagaggttgagttgaagccttacattgcagctcactttgatgtgttgcccacagaattcacgttaggagatgacaagcattacggtggatttactaataaacagctccagagtggtcaggagtacgtgttctttgtgttagccgtgatggagcatgcggaatcgaagatgtacgccacttccccctacagcgatcctgtggtgagcatggatttagacccacaaccaatcaccgacgaagaggagggattgatttgggtggtgggccccgtcctggccgtcgtgttcatcatctgtatcgttattgccattcttctgtacaaacgtaaaagagccgagtcagacagtcggaaatcctctattcctaataacaaggagattcctagccaccaccctacggatccggtggagctgcgccgtctcaacttccaaacacctggcatggctagccaccctcccattcctattctagaactggctgaccacatagagcggctcaaggcgaatgacaatctcaaattttcacaagaatacgaatccatagatccaggccagcagttcacctgggaacactctaatctcgaggtgaacaaaccaaaaaacaggtacgccaatgttatcgcatatgatcattctcgcgttctcttgtctgctattgaggggattccaggctcggattacgtgaatgcaaactacattgacggttatcggaaacagaacgcatacatcgccacccaaggatctttgccggagacctttggtgatttctggcggatgatttgggaacagcggtcagccaccgtggtcatgatgaccaagctcgaggaacgatccagagttaagtgtgatcagtactggccgtctaggggcaccgagacacatgggctggttcaggttaccctgctggatacagtggaactggccacctattgcgtgcggacgtttgcattgtacaagaacggatcctccgagaagagggaagtgcggcaattccagtttactgcttggccggatcacggggtgcctgaacaccccaccccgttcctggctttcctgcggagggtgaaaacctgcaatccaccagacgcaggcccaatggtggtgcactgctccgccggtgtgggaagaactggctgctttattgtgattgatgctatgcttgagaggatcaaacacgagaagacggttgacatttacggtcatgtgactctcatgcgagcgcagagaaattacatggttcagactgaggaccagtatatcttcatccacgatgctctgttggaagcagtgacctgtggtaacaccgaagtgcccgcacggaacctctatgcctatatacaaaaacttacacagattgagactggcgaaaacgtaactggcatggaattggagttcaagcgacttgcaagctcaaaggctcatacatccagatttatctccgccaacctcccttgcaacaaatttaaaaataggctggtaaacataatgccgtatgagtccacgcgagtctgtctccagcctatccggggagtcgaggggagtgactacatcaacgcgtccttcatcgatggctataggcaacagaaagcgtacatcgcaacgcaaggccctttggccgaaaccacggaggatttttggagaatgctctgggaacacaactccaccattgtggttatgctcactaaactgcgtgagatgggcagggaaaagtgccatcaatactggccagccgaacgatcagcccgctaccagtacttcgtcgtggacccaatggctgagtataatatgccccaatacatcctccgggagttcaaggtgaccgatgcccgggacggtcaaagtaggaccgtacgccaatttcaatttacggattggcccgaacagggggtccctaagtccggagagggttttatcgattttatcggacaggtgcacaagactaaggaacaattcggacaggacgggcccatcagcgtccactgcagcgcaggtgtcggccggaccggtgtcttcattaccctgagcattgtactcgagagaatgcgctatgagggggtcgttgacatttttcaaaccgtgaagatgttacgcacgcagagacccgctatggttcaaactgaagatcaataccaattttcttaccgggctgccctggagtatctgggatcctttgaccattatgccacttag

SEQ ID NO: 201715 - DNA, 5739 bp, Artificial Sequence
  Description of Artificial Sequence: Synthetic coding sequence
atggtgcacgtggcccggctgctgctgctgctgctgaccttcttcctgagaaccgacgccgagacaccccctagattcacccgcacaccagtggaccagacgggcgtcagtgggggtgtggcctctttcatctgtcaagcaacgggcgaccctcggcctaagatcgtgtggaacaaaaaaggaaagaaggtgtcgaatcagaggtttgaggtcatcgagtttgatgacggaagtggctcagttctgcgtatccagcccctgaggaccccacgcgacgaagccatatacgagtgtgtggcctccaataacgtgggggaaattagtgtgtctacccgcctgacagtgttgcgcgaagaccagataccaaggggtttccctacaattgacatgggtccgcagcttaaggtcgttgaacgaactaggactgccaccatgttgtgtgccgcgtccggcaacccggatcccgaaatcacatggttcaaggattttttgccggtggacacttcaaacaacaatggtcgcatcaaacagctcagatcagagtcaataggaggcactccaataagaggggcactccagattgaacaatccgaggagagtgatcaggggaagtatgagtgcgttgcgacgaattccgctggaacgcggtactcagcccccgccaacctctatgtgcgggaactccgagaggtccgccgggtgcctccacgtttcagcatccccccgaccaaccacgagattatgccaggaggatctgtaaatatcacttgtgtggctgttgggtcacccatgccctatgtgaaatggatgctcggagcagaggacctgaccccagaggatgatatgccaatcggaaggaacgttcttgagcttaatgatgtgcggcagtctgctaattacacttgtgtggccatgagcaccctgggggtgatagaggcaattgcccaaattactgtcaaggccttgcccaagcccccaggtacccctgttgttacggaaagcaccgccacgtcaatcacactgacatgggatagcggaaatcccgaaccagtttcctattacattatccagcacaagccaaaaaatagtgaggaactgtataaggagatagatggggttgctaccacaaggtattctgttgccgggctgtccccttactcggactatgagttcagggtcgtcgcggtgaataacataggacgggggcctccctccgaaccggtcctcactcaaacgtccgaacaggccccgtcatctgctcctcgcgacgtgcaggcccggatgctgagctcgacaaccatcctggtgcagtggaaggaaccagaggaacctaatgggcagattcagggatacagggtttactatacaatggatcctactcagcacgtgaacaactggatgaaacacaatgtggccgactcccagatcaccactatcggcaacttagtgccacaaaagacatattccgtgaaagtgcttgcatttacatctatcggcgatggtccactgtcttcagacatccaggttatcacacagacaggggtgcccggtcaacctctcaacttcaaagcagagcctgagtcagagactagcatcctcctttcttggacaccccctagatcggatactatagccaactatgagctcgtgtacaaggatggcgaacatggcgaggagcagcgcattactatcgaaccaggtacctcctacagactgcagggcctcaagcctaacagcctgtattacttccgcctggccgctagatccccccagggtctgggtgctagcactgccgaaataagcgcccgaaccatgcaatctaaaccatcagctcctcctcaagatatctcctgcacaagcccttcaagcacatctattttagtctcttggcagccacctcctgtggagaagcaaaatgggatcatcaccgaatattcaatcaaatacactgcagttgacggcgaggatgacaagcctcatgaaattttgggtatcccttctgacaccactaaatacctgctggaacaacttgagaaatggaccgagtatcggataactgtcacggctcatactgacgtgggtcctggtccagaatccctgagtgtgctcattcgcaccaatgaagacgtgccaagcgggcctccccgcaaggtggaggtggaggcagtgaactctacctcggtgaaagtttcctggagatcgcctgtccctaacaaacagcacggacagatcaggggctaccaggtgcattacgttcgcatggagaatggtgaacctaagggtcagcctatgctgaaagacgtgatgttggcagatgcacaatgggagttcgacgacacaaccgagcacgatatgataatcagcggactgcagccagagacatcctatagtctcacagtcactgcttataccaccaagggggatggtgctaggtccaaaccaaagcttgtgtcaactacgggggccgtcccaggcaagccccgtctggttattaaccacactcaaatgaacaccgcgcttattcaatggcacccaccagtagacacgttcggcccactgcagggctaccggctgaagttcggccggaaagacatggaacccctgactaccttggaattttcagagaaggaggatcacttcacagctaccgacattcacaagggcgcatcttacgtgttccggctaagtgcccggaataaggtggggtttggggaagaaatggtcaaggagattagtatcccagaggaggtgcccactggcttcccccagaatcttcacagtgaggggaccacgagcacttcggttcaactttcgtggcaacccccggtgttggccgagagaaatggtatcatcacaaagtatacgcttttatatagggatatcaacattccgttgttacccatggagcaactaattgtgcccgcagacaccactatgaccctgacaggtctcaagccagacaccacttatgatgtaaaagtaagggcacatacttccaaaggaccgggtccctattccccatccgtccagtttcgaactctccccgtggatcaagtattcgccaaaaatttccatgttaaggcggtgatgaaaacaagcgtcctgctcagttgggaaatcccggaaaactacaactcagctatgccgtttaagatactttatgacgacggcaagatggttgaagaagtcgatggacgcgctacccagaagctgatcgtgaatttgaaacccgagaaatcatacagtttcgtgctaaccaatcgaggcaactcggctggtggactgcaacaccgagtaacagccaaaaccgctccagacgtgctgcgaaccaagccagcattcatcgggaaaactaacctggatggaatgatcacagtgcagctgcccgaagtccccgctaacgagaatataaagggctactatatcatcattgtgcccctcaagaagtccaggggtaagttcattaagccatgggagagtcccgatgaaatggagttggacgagctgctgaaggagatttcacggaaacgaaggtctattagatatgggcgcgaagttgagctgaagccttacattgcggctcactttgacgtgctgcccaccgaattcacattgggagatgacaaacactatggaggcttcactaacaagcagcttcagagcgggcaagagtacgttttttttgtgctggccgtgatggaacacgcagagagcaagatgtatgccacttcaccttactcagaccccgtggtttctatggaccttgatccgcagcccatcactgatgaagaagaaggcctcatatgggtggtggggcccgtcctcgccgtcgtattcatcatatgcatcgtaatagccatactcctatataaacggaaaagagctgaaagcgactccaggaagtccagcattcccaacaataaagagatcccgagccaccaccctaccgatccggttgagctacggaggctgaattttcaaacacctggcatggcaagccacccacctatccccattctggagctggcagatcatatagaaagactgaaggcgaacgacaacctcaagtttagccaggagtatgaaagtattgatcccggtcagcagttcacgtgggagcactccaatctggaggtaaataagccaaaaaacagatacgcaaatgtgatcgcatatgaccattccagggtgctgctctctgctatcgagggaatccccggctcggactacgtgaatgccaattacatcgacgggtacaggaagcagaacgcgtacatcgcgacacagggttcgctgcctgagacatttggagacttctggaggatgatctgggagcagcgttctgccaccgttgtgatgatgaccaagctcgaggaacgaagccgggtaaagtgtgaccagtattggcctagcagaggcaccgagacccatgggctggtgcaggtcacgcttctcgataccgtcgagctcgcaacttactgcgttcgcacgtttgcactctataagaatgggagctcggagaaaagagaagtcagacagtttcagttcactgcatggccggatcacggcgtccctgagcaccctaccccatttttggcctttcttaggcgcgtcaaaacttgcaatcccccggatgcaggtcctatggtcgtgcattgttcagcaggagtgggacggaccggctgctttattgtaatagacgccatgcttgagcggataaagcatgagaagaccgtggacatttatgggcatgtcaccctgatgagggcacaaagaaattatatggtgcagaccgaggaccaatatatctttattcacgacgctctgctagaggcagtcacttgtggtaacactgaggtcccagcccgaaatttgtacgcttatattcagaagctgacccagattgagactggcgagaatgtgactggcatggagctggaatttaagagactggccagttcgaaggcccacacttcacgctttatctcagcaaaccttccctgcaataagtttaagaatcggctcgtgaacataatgccatatgagagcacgcgagtttgcttgcagcctatccgaggtgtcgaagggagcgactacatcaatgcctcttttattgatgggtatagacagcagaaggcatacatcgccacccaaggaccactcgccgaaacgaccgaggacttttggcgaatgctgtgggaacataattcaactattgtcgtgatgttgactaagcttcgtgagatgggaagggagaaatgccaccaatactggcctgcagagcgctcagcacggtatcagtattttgtggttgatcctatggcagagtataacatgccacagtatattctccgggagttcaaagttaccgacgccagggacggacagagccgaacggtccgacagtttcagttcacagactggccggaacagggggtaccaaagtcaggtgagggcttcatcgatttcatcggacaggtgcacaaaaccaaagagcagtttgggcaggatggcccaatatcagtccactgctccgctggagtggggcgcactggtgttttcataactttatctatcgtgctagagcgcatgaggtacgaaggcgtggtagacatctttcagacggtcaagatgctgcgaacccaaaggcccgctatggttcagacagaagaccagtaccagtttagctacagagctgccctcgaatatctcgggtcatttgaccactacgcgacgtag

SEQ ID NO: 201716 - DNA, 4509 bp, Artificial Sequence
  Description of Artificial Sequence: Synthetic coding sequence
atggtgcacgtggcccggctgctgctgctgctgctgaccttcttcctacgcacggacgctgaaacaccccctcggttcacgcgaacgccagtcgaccagaccggtgtcagcggcggcgtcgcctctttcatctgccaggctacaggcgatcctaggcccaaaatagtttggaataagaaaggcaaaaaggtcagtaatcagcgctttgaggtcattgagttcgatgatggtagtggttctgtcctccgcatccagcccctgcggacgccccgcgacgaagctatttatgaatgcgttgcgtctaacaacgtgggggagatcagtgtcagcactcgcctaacagttctgcgggaagatcagatacctcgagggttcccgactatagacatgggccctcaactaaaggtcgtagaacgtactcgcaccgcaaccatgctttgcgccgccagtggcaatccagacccagagataacctggttcaaggatttccttccagttgacacctctaacaataatgggaggatcaaacagctgcgcagcgggggaacacctatccgtggggctctgcagatcgaacagtccgaagaatcagatcagggcaaatacgaatgtgtggcaacaaattcggccggcacacgttacagcgcaccagcaaacttatatgtccgcgagctgcgcgaggtcaggcgagtaccccctcggttctccattccacccaccaatcacgaaattatgcctggaggctctgtgaacataacctgcgtagcagtgggatccccaatgccctatgtaaaatggatgctgggtgccgaggacctaaccccagaagacgatatgccaatcggacggaatgtgctggaacttaatgacgtacggcagtcagccaactacacgtgcgtagccatgtctactctgggcgtcattgaagccatcgctcagattactgtgaaagctcttccaaagcccccagggacaccggttgtgactgaaagtaccgctactagcatcacactgacctgggactctgggaaccctgagcccgtgtcctattatataatacaacataaaccaaagaattcggaagaactgtataaagaaatcgatggggtcgccacaaccagatactctgtagccgggttgagtccctacagcgattatgagtttcgggtcgtcgcagtgaacaacatcggaaggggtccccctagcgagccagttctgacccagacatcagagcaggcaccgtctagcgcccctcgggatgtccaggccaggatgctgagtagcaccaccattctcgtccaatggaaggaacccgaagagccaaatggccagatccagggctaccgcgtctactatactatggaccctacccagcatgtaaacaattggatgaaacataatgtcgctgactctcagataaccacaatcggaaaccttgtgccccagaaaacatactccgtcaaagtcctcgcttttactagcatcggagacggtccgctctcgagtgatatacaggtgatcacacagacaggtgtgcctggacagccactaaacttcaaggcagaacctgaaagtgaaacttctatactcctctcctggaccccgccaaggagtgacactatcgcaaattatgaattggtgtacaaggatggggagcacggcgaagagcaaagaatcactatcgaaccaggcaccagctacaggctgcaaggcctgaaaccaaattccctatattacttccggctagctgccagaagcccccagggcctcggggccagcacagctgaaatttccgctcgtactatgcaaagtatgttcgccaaaaattttcatgtgaaggcggttatgaaaacatctgtcctacttagctgggaaatccctgagaattacaactccgctatgccctttaaaatcttgtacgatgacggcaaaatggtggaagaagtggacggaagggccacacagaagcttattgttaacttgaagccagaaaaaagctacagctttgttctgacaaaccgcggtaatagtgcgggggggctgcagcaccgcgtgactgcgaaaacagcccccgatgtcctgcgcactaagcccgcatttataggcaagactaacctcgacgggatgataaccgtccagctgcccgaggtgccagcaaacgaaaacatcaaggggtactacattatcatcgtcccattgaagaaatctcggggcaaattcataaaaccgtgggaaagccctgatgaaatggagctggacgaactgttgaaagagatctccaggaaacggcgctccatccggtacggcagagaggtggaactgaaaccatatatcgctgctcattttgatgtgctgcctactgagttcacacttggcgacgataagcattacggaggatttaccaataagcagttgcaatccgggcaggaatacgttttttttgttctcgccgtgatggagcacgccgaaagcaagatgtacgctacaagtccctactcagacccggtcgtgtcaatggaccttgatccccaacccattaccgatgaggaggaaggacttatctgggttgtgggccccgtgctagcggtggtatttatcatatgtatcgtgatcgctatactactatacaagtctaagcctgaccgcaaacgcgcagagtccgactcacgaaagtcctcgattcctaacaataaagagattccatctcaccacccaacagaccctgtggagctgagacgtctcaacttccagactcccggtatggcctcgcaccctccgatcccgattctggagcttgccgaccacatcgagagattaaaggctaacgacaacctgaagttcagtcaggaatacgaaagtatcgatcccgggcaacagttcacatgggagcacagtaacttggaagtgaataagcccaaaaatcggtatgccaatgtgattgcatatgatcactctagggtgctgcttagcgcaattgaagggatacccggatccgactacgtaaatgccaattacatcgatgggtacaggaagcagaatgcctacatcgcaacgcagggatctcttccggaaacgttcggtgacttttggcggatgatctgggagcagaggagcgccaccgtggtgatgatgacaaaactggaagagcggagcagagtgaagtgcgatcaatactggcccagccgcgggactgagacccacgggttagtccaggtgacactgctggacacggttgaactggccacttattgcgtcagaaccttcgctttatacaaaaatgggagttctgaaaagagggaggtgcgacaattccagtttacagcctggccagatcacggagtacccgagcaccccacaccttttttagcattcctgagacgcgtcaagacctgcaatcctccggacgccggtcctatggtggtgcattgctccgccggcgtggggcggaccggctgcttcatcgtcatcgacgccatgctcgaaagaattaagcacgagaaaacagttgacatctatggccacgtcacactgatgagagcacagagaaattatatggtacaaactgaggatcagtacattttcatccacgatgctctcctggaggctgtgacctgtggaaacacggaggtgccagccagaaatttatacgcatacatccagaagctcacacagatcgagaccggcgaaaacgtgaccggcatggaactggagttcaagaggcttgcctcctcaaaagcgcacacctcccggttcattagcgcaaatctgccatgtaataagttcaagaatcgcctggtgaacataatgccgtacgaatctacgagggtttgtctgcaacctattagaggagttgaaggctctgactatatcaacgcttcgttcatcgatggataccggcaacagaaggcatatatcgccacccaggggcccctggcagagacaacagaagacttttggaggatgctctgggaacacaatagtacaattgttgtgatgctgactaaactccgggaaatgggacgcgagaagtgtcatcaatattggccagctgaacgctcagcccggtaccagtactttgtggtcgatcctatggctgaatacaatatgccacaatatatcctgcgcgagttcaaggtgacagatgctcgtgatggccagagccggacagtgcgccagtttcagtttacagactggcctgaacagggggtgccaaagtccggcgaggggttcatcgactttattggccaggtgcacaaaactaaggagcagttcggtcaggacggtcccatcagtgtgcattgtagtgcgggcgtagggagaacgggcgttttcatcactctgtccatagttcttgaaagaatgagatacgagggtgttgtggacatctttcagaccgtgaagatgctccgtacccaacgacccgcaatggttcaaactgaagatcagtaccagttctcataccgtgccgcactggaatatctaggcagcttcgatcattacgcaacttag

SEQ ID NO: 201717 - DNA, 4518 bp, Artificial Sequence
  Description of Artificial Sequence: Synthetic coding sequence
atggtgcacgtggcccggctgctgctgctgctgctgaccttcttcctgagaactgacgcggagaccccaccaaggttcacaagaacccccgtcgatcaaacaggtgtgtctgggggggtcgcttcttttatatgtcaggcgacaggcgatccccgacctaagatcgtttggaataaaaaaggaaaaaaggtgtcaaaccagaggttcgaggtgatcgagttcgacgatgggtccggctctgtactgcgcattcaacccctacggacaccccgggacgaggctatttatgagtgtgttgcatccaacaatgtgggagagatttccgtgagtacacggctgaccgtgttaagggaagaccaaatccctcgcggctttcccaccatcgatatgggcccccagttaaaagttgtagaacgaaccagaacagctaccatgctctgtgcagcaagtggaaacccagacccggagattacctggtttaaagacttcctccccgttgacacatccaacaataatggtcggataaagcagctacggtcagtatctatcggggcgctgcaaatcgaacagagcgaggagagtgatcagggcaagtacgagtgcgtagcaaccaactccgcaggaacacggtactcagccccagccaacttatatgtccgggttagacgcgtgcccccccgcttttccatcccacccacaaaccacgaaatcatgcccggcggcagcgtgaatatcacatgtgttgcagtggggtctcctatgccatatgtgaaatggatgcttggcgcggaggacctgactccggaagacgacatgcccattggtcggaacgttcttgaactcaatgacgtgaggcagtctgcgaactatacctgtgttgcaatgagtacgttgggggtcattgaagctattgcccagatcaccgtgaaagcactgcccaagccaccaggaacccccgtcgtcacggaatccacagctacatctatcacccttacctgggatagcgggaaccccgagcctgtgtcatattacattatccagcataaaccaaaaaactcagaagagctgtataaggagatcgatggtgttgccaccacccgatattccgtggccgggcttagcccatactctgattacgagttccgggtggtggccgtcaacaacatcgggagaggccctcccagcgaacccgttctgacccagacttctgagcaggcccccagttctgccccacgggacgtgcaggctcggatgctttcctccaccactatcttggtgcagtggaaggagccagaggagcctaacggccaaatccagggttatcgcgtttactacacaatggaccccacccagcacgtcaacaactggatgaagcacaatgtcgcagatagccagataaccacaattgggaatttggtgccgcagaaaacgtactccgtcaaggttctcgcatttaccagcatcggagatggtcctctgagttctgacatccaggtgattacccaaactggggtcccaggccagccacttaactttaaggccgagccagagtccgaaacaagcattctcttgtcttggacgcctccacgcagcgatacgattgctaactatgagctggtctacaaggacggagaacatggcgaggagcagaggattaccattgagcctggcacaagctatcgattgcagggcctgaagcctaactcattgtattatttcagactcgccgcccgcagcccacagggacttggcgcctccaccgccgaaattagtgcccggactatgcagtcgatgtttgccaaaaatttccatgtgaaggccgtgatgaagacctctgtactgctgtcatgggaaattccagaaaattataattctgccatgcctttcaagatcctgtatgacgacggcaagatggttgaggaggtggacggcagggctacccaaaaactcattgtgaatctcaaacccgaaaagtcatattcattcgtgctaaccaaccgagggaatagtgccggaggcttgcaacaccgggttacagccaagaccgccccggatgtgttgagaaccaagcctgcctttatcggcaagaccaatctggatgggatgattactgtgcagttgcccgaggtacccgctaatgagaatatcaaggggtattatattattatcgtgccgctaaaaaaatcgcgcggcaagtttattaaaccatgggagagtccagacgaaatggagctcgatgaactcttgaaagaaatttctagaaagcgcaggtctatcaggtacggcagagaggtggagttgaagccctatattgctgctcacttcgatgtcctgcctacagaattcacactgggcgatgataagcactatggaggcttcactaacaagcaacttcagtcaggccaagaatatgtgttctttgtactggcagtcatggaacacgcggaatcaaaaatgtacgctacgagcccttacagcgacccagtggtgagtatggatctggacccgcagccaataaccgacgaagaagagggtcttatctgggtcgtcggccccgtactcgccgtggtttttatcatttgcatcgtcattgctatcctcctgtacaagcgaaaacgcgctgaatcagattctcgcaaaagttcgatcccgaataataaggaaatacccagccatcacccaacagaccccgtagaactgcggagactgaactttcaaacacccgggtccgatgactccgggtacccaggaaacctgcattcttcatccatggcgtcacaccctccgatcccaatcctcgagctagcagatcacatcgagagactgaaagctaatgacaacctgaaatttagccaggagtatgagtcaatcgaccctggacagcaattcacgtgggagcactcaaatcttgaggtcaacaaaccaaaaaatcggtatgccaatgtcatcgcttacgaccattcgcgtgtcctcctgtcagcaatagaaggcataccagggtctgattatgtcaacgccaattacattgatggatatcgaaaacaaaatgcatatatagctactcaggggagtctgcccgagaccttcggcgatttttggcgaatgatttgggagcagaggagtgccactgttgtgatgatgaccaagctggaggagcgttcacgcgtcaagtgcgatcagtattggccgtcgcgggggaccgaaactcatggcttggttcaggttaccttgctggatacagtagagctagcaacctattgcgttagaaccttcgcactctataaaaatggcagcagcgaaaagcgcgaggtgcgtcagtttcagtttactgcctggccagaccacggcgtcccggagcacccaacgccatttctcgcgtttctccggcgggttaagacctgtaatccgccggacgctggtccaatggtggttcactgctccgcaggtgtggggagaaccggatgttttatcgttattgacgccatgctggagcggatcaagcacgagaagactgtggacatttacggccacgttactttaatgcgagcccaaaggaactacatggtacaaaccgaagaccaatatatctttatccacgacgctttgctcgaagccgttacttgcggcaatactgaggtacctgcacgcaatctgtatgcatacatccagaagctcacgcagatcgagacaggcgaaaatgtaactggcatggagcttgagtttaagaggctggcgagcagtaaggcacatacgagccgttttattagcgccaatcttccttgcaataagttcaagaacagactcgtgaacatcatgccttacgagagtaccagagtatgtttgcagcctattaggggggtggagggatcagattacatcaacgcctccttcattgatgggtaccgccaacagaaagcttacatagccactcagggccccctggccgaaaccaccgaagacttttggaggatgctgtgggagcacaactccaccattgtagtgatgctgacaaaactgcgcgaaatggggagagaaaagtgccaccagtactggccagcagagagaagtgctcgctatcagtacttcgtggttgacccaatggccgaatataatatgcctcaatatatactgcgagagttcaaggtcactgatgcccgggatggacagagccgcaccgtgagacagtttcaattcaccgactggccagaacaaggggtccctaagtctggtgaaggctttatcgactttatcggccaagtgcataaaaccaaggagcagttcggtcaggacggcccaatctctgtgcactgcagtgccggggtcggaaggaccggcgtattcatcacactaagcatcgttctggaacgcatgcgttatgaaggcgttgtggatatctttcagacagtcaagatgctgaggacccagaggccggccatggtccagactgaggatcaatatcagttctcctatagagctgcccttgaatacttggggagcttcgatcactacgcaacctag

SEQ ID NO: 201718 - DNA, 282 bp, Artificial Sequence
  Description of Artificial Sequence: Synthetic coding sequence
atggtgcacgtggcccggctgctgctgctgctgctgaccttcttcttgcgcaccgatgcagaaactcccccccggtttacccggaccccggtggaccagactggtgtatccggaggtgtggcttcgttcatctgtcaggccaccggcgatccacgaccaaagattgtttggaataagaaaggaaaaaaggttagtaaccagcgtttcgaggtcatcgaatttgatgacgggtctggcagcgttctgcggatccagcccttgcggacacccagagatgaatag

SEQ ID NO: 201719 - DNA, 4518 bp, Artificial Sequence
  Description of Artificial Sequence: Synthetic coding sequence
atggtgcacgtggcccggctgctgctgctgctgctgaccttcttccttaggacagacgctgagacacccccccgattcacaagaacccccgtagaccagacaggagtcagtgggggagtggctagtttcatatgtcaggctaccggggatcccagaccgaagatcgtctggaacaagaagggaaaaaaagtgagtaaccagcgcttcgaggtgatcgagttcgacgatggctccggatctgttctgagaattcagcccctccgcacccctcgggatgaagccatctacgaatgcgtcgctagtaataatgtcggagagattagcgtctccactcgcctaaccgtgctgcgcgaggaccagatccctcggggatttcccactattgatatgggccctcagttaaaggttgtcgaacggacacgcacagctactatgctatgcgccgcatccggaaatcctgaccctgaaattacctggttcaaggactttctgccggtggatacttctaataacaacgggaggataaaacagctccggtctgaaagcatcggaggcacacccattcggggcgcccttcagatcgagcaatcagaagaatcagatcaagggaaatacgagtgtgtcgcgactaatagcgcaggaactcggtatagtgcccctgctaatttgtacgtgcgagaactgagggaggtgcggagagtccctccccgctttagcattccccctactaaccacgagattatgcccgggggatccgtcaacatcacgtgcgtggccgttggatcgccaatgccttacgtgaaatggatgctgggggctgaagacctgactccagaggacgatatgcccatcggacgtaatgtgcttgaattgaatgacgtccgccaaagcgctaattacacctgcgtggctatgagtaccctgggagtgatcgaggcaatcgcgcaaattaccgtaaaagccctgcctaagccccctgggacccctgtggtgactgaaagtacagctacaagcattaccctgacatgggatagcggtaatcccgaaccggtgagttattacattatccagcataagccaaagaacagcgaggagctctataaagaaattgacggtgtagcgactaccagatactccgttgcaggattatcaccatacagtgactacgagttccgggtggtggccgttaataacatcggacgaggaccgccctccgagcccgtcctgacccaaacctctgagcaggctccatcttctgcccccagggacgtccaggcgcgcatgctgtctagcacaactatccttgtacaatggaaggagcccgaggaacccaatggacagattcaaggatatagagtgtattatacaatggacccaacccagcatgtgaataactggatgaagcataatgtggccgattcacagatcaccactatcggtaatctcgtgccccagaaaacatattctgtgaaggtgctggccttcacttccattggcgacgggccattgagcagcgacattcaggttattacccagacgggagtaccaggccagcctttgaacttcaaggccgaacctgagtccgagactagcatcttgctgagttggacccctccacgtagtgacaccatagccaactacgagcttgtatacaaggacggcgaacacggggaagaacagcggataaccatcgaacccgggacaagttatcggctacaaggcctgaagccaaactctttgtactatttccgattggcggcgaggtcaccacaagggctcggagctagcacggctgagatttcagcacggaccatgcagagtatgttcgccaagaattttcacgtaaaggctgtcatgaagacctcggtgctgctgtcctgggaaatccctgagaactataatagcgccatgcccttcaagattttgtacgacgacggcaagatggttgaggaggtcgatggaagggccacacagaagctgattgtgaacttaaaaccagagaagtcatactcgtttgtcctgaccaacagaggcaactcagctggtggcctccagcatcgggtgaccgccaagaccgctcctgatgttcttaggacaaaacccgcttttatcggcaaaacgaatcttgatggaatgatcaccgtgcagttacccgaggtgccagccaacgaaaacattaagggatactatatcattatcgtgcccctgaaaaaaagtagaggcaaatttattaagccctgggagtcccctgatgagatggagctcgatgaattgctgaaagaaataagtaggaaacggagatctatcagatacggcagggaggtggaattaaaaccgtatatcgctgcccacttcgatgtgctccccacagaatttactctcggagacgacaagcactacggtggcttcactaacaagcagctgcagagcggccaagagtacgtgttctttgtattggccgtcatggaacatgcagaatcaaagatgtatgctactagcccttacagtgaccccgtcgtctcaatggatcttgaccctcaaccgatcaccgatgaagaagaggggctgatctgggtcgtcgggcctgttctggcagttgtgttcatcatctgtatcgttatcgccatcctgctgtacaagagcaaacccgataggaaaagagctgaatctgattcacgcaaaagtagcattcctaataataaggagatcccatcccaccaccctaccgacccggtggaacttcgtcgtctcaattttcagacccccggcatggcttcacacccaccaatccctatcctggaactcgccgatcacatcgagcggctgaaggcaaacgataacttaaaatttagtcaggagtacgagtcgattgaccccggacaacaatttacttgggaacattccaacttggaggtcaataagccgaagaatcgctatgctaacgtgattgcatatgaccactcccgcgtcttgctatctgctatcgaggggatcccgggctccgactatgtgaatgctaattatatcgacggctaccgaaaacaaaacgcctacattgccactcaggggtctttgcccgagaccttcggggatttctggagaatgatctgggaacagaggagtgccaccgtggttatgatgactaaactggaagagagatctagggtgaagtgcgaccaatactggccaagccggggtaccgagacacacgggctagtccaagtgaccctgcttgacaccgtggagctcgcaacttactgcgtgcgcacctttgctctttacaagaacggatcttcggagaaaagggaggttaggcaattccaatttacagcttggcccgatcacggagtgccggagcatcccacaccgtttcttgcttttctgcggagagtcaaaacgtgcaacccaccagatgcaggaccaatggttgtgcactgctcggcaggtgtaggacgtaccggctgtttcatcgttatcgatgccatgttagagagaattaagcatgaaaagacggtggacatatatggacatgttaccctgatgcgcgcacagagaaactacatggtgcagactgaagatcagtatatatttatccatgacgccttactcgaagctgtcacatgcggaaatacagaggtaccggcaaggaacctgtatgcctacatccagaagctcactcaaatcgagactggtgagaacgtgacagggatggaattggagtttaaaagactggcctcaagtaaggcccacacttcccgcttcattagcgccaacctgccatgcaacaagttcaagaatagattggtaaacattatgccctatgagtccactcgcgtgtgcctgcaacctatccgaggtgtcgagggctccgactacattaacgccagttttattgatggttatagacagcagaaagcctatatcgccacacagggccctctcgccgagactacagaagatttttggagaatgctatgggagcataactccaccatcgtggtgatgctgaccaagttaagagagatgggaagggaaaaatgtcatcagtattggcccgccgagaggagcgctcgctatcaatattttgtggttgacccaatggctgaatacaatatgcctcagtacatcctccgcgagttcaaggttacagacgcgcgagatggacagtctaggacagtgcgccagttccaatttacagattggcccgagcagggtgtgccaaagtccggggaggggttcatcgacttcatcgggcaagtgcacaagacaaaagagcagttcgggcaggatggcccaatctctgtccactgctctgctggggtggggcgaaccggcgtttttattaccctgagtatagtgctcgagagaatgcggtacgaaggagtagtggacatcttccagacggtcaaaatgctgcggacacaacgacctgcaatggtgcagacggaagatcagtaccaattcagctatagagccgcactggaatatctgggcagtttcgatcattacgcaacatag

SEQ ID NO: 201720 - DNA, 4509 bp, Artificial Sequence
  Description of Artificial Sequence: Synthetic coding sequence
atggtgcacgtggcccggctgctgctgctgctgctgaccttcttcctgagaactgatgcagagactccacccagatttacacgcaccccagtcgaccagacaggagtgagtgggggcgttgcaagcttcatttgccaggcaaccggcgatcccagaccaaaaattgtgtggaataagaagggtaagaaggtctcaaatcaaaggtttgaggtaattgagtttgacgatggttctggatccgttctgcgcatccagccacttcgcacgccacgggacgaggcaatctacgagtgcgtggcttcaaataatgtgggggaaatctctgtgtctacgcgcctgaccgtgttgcgtgaagaccagattccccgaggtttcccaacgatcgacatgggcccgcagctcaaagtggtcgagcgaacacgtactgctaccatgttatgcgccgcatcaggcaatccagatccagagattacgtggtttaaggatttcctgcccgttgatacctcgaataataatggccggattaagcagctgcggtctggaagagtcttccacactggggcactgcagatcgagcagagtgaagaaagtgatcagggaaaatatgagtgcgtggctaccaattccgctgggacaagatattcagcacctgccaatttatatgtgcgggttaaccgcaaggtcaggagagtgcccccccgcttttcgattcctcccactaatcacgaaatcatgccagggggctcagtgaatatcacctgtgtagccgtgggttcacccatgccgtacgtgaagtggatgctgggcgctgaagatctcacaccagaggacgatatgccaataggaaggaatgttctggagctgaatgacgtccgccaatccgcaaattatacttgtgttgccatgtctacgctgggggtcatcgaggcgatcgcccaaattacagtcaaggccctgcccaaacctccaggcactcctgtggtaacggagtcaactgccacgagtataacgctaacatgggatagcgggaacccagagcctgtgtcttattatattatccaacataagcccaaaaattcagaagagctgtataaggagattgacggcgtcgcaaccacgcgttattcagtggcaggcctgtcgccatatagcgattatgagttccgcgtggtagccgtgaataacatcggccggggacctccgtcagaacccgtgcttacacaaacaagcgaacaagcacctagcagcgcccctagagatgtccaagcccggatgcttagctcaaccaccattctggttcagtggaaggaacctgaggagcccaacggtcagattcaaggatacagggtttattacacaatggaccccacccagcacgtgaataactggatgaaacataacgttgccgatagtcaaattacgactatcggtaacctcgtcccacaaaagacctacagcgttaaggtccttgcctttaccagcatcggagatggacctctctcttctgatattcaggttattactcagaccggagtacctggtcagccactgaacttcaaagcagagcccgagtccgagactagtattttactcagctggaccccaccacgtagtgatacaattgctaattatgagctggtttacaaagacggggagcacggtgaggagcagcggatcactattgaacccggcacttcatataggctgcaaggcctgaagcctaattcactttactattttagactggctgcccggtctccccagggccttggggcttccacggctgaaatcagtgctaggacaatgcagtctatgtttgctaagaatttccatgtaaaagccgtgatgaaaacatccgttttactgagttgggagatccccgagaactataatagtgcgatgcctttcaagattctttatgacgatggcaaaatggtggaggaagtcgatggtcgagcaactcagaagctgattgtgaacttgaaacccgagaagtcctattccttcgtactcactaatcggggtaacagcgctggaggactccagcatcgcgtgaccgctaagaccgcccccgacgtgctgaggaccaagccagcttttatcggcaaaactaacctcgatgggatgatcacagtgcagttacctgaggttcccgccaacgagaacatcaaaggatactacatcatcatcgtgcctctgaagaaatcccgaggcaaatttatcaagccctgggagagccctgatgagatggagctggatgagctgctcaaagagatctcaaggaaaaggaggagtatccgctacggccgcgaggtggagttaaagccttacattgcagctcacttcgacgtgctgccaactgagtttaccctgggcgacgataagcattacggcggcttcacaaacaagcagctgcagtccgggcaagaatatgtgttctttgtattggcagtaatggaacatgccgaaagcaagatgtacgcaacaagcccgtactccgatccagtcgtcagcatggatctggatccacagcccatcactgatgaggaagaggggcttatttgggtggtgggacccgtcctggcggttgtgttcatcatttgcatcgtgatagcaattctgctatataaacgcaagccgtaccgcaaacgtgctgagagtgatagcaggaaaagttcaattccaaataataaagagataccaagccaccaccctaccgatccggtcgagcttaggagactgaactttcagacacccgggatggcctcccaccccccaattcctattttagaactggcggaccacatcgaacgcctaaaagcgaacgataacctgaaatttagtcaagagtatgagtctatcgaccctgggcagcagtttacttgggaacactcaaatcttgaggttaacaaacctaagaatcggtatgccaacgttattgcctatgaccattccagagtcctgctgtctgccatcgaagggattccgggctctgattacgtgaatgccaactacattgacggatatcggaagcagaatgcctatatcgctactcaaggctccctgccggagacatttggcgacttttggcgcatgatttgggaacagcgctctgctactgtagtgatgatgacaaagctggaagagcgaagtagggttaaatgcgaccagtactggccatctcggggcactgaaactcacggtcttgtccaagtgacacttctagatacagtagagctggcgacatattgcgtgagaacattcgccctctacaaaaacgggtcctcagagaaaagggaagttcgtcaatttcagttcactgcgtggcctgatcacggggtgcccgagcaccctacgccattcctcgcgttcctcaggagggtaaagacttgcaacccaccagacgcgggtccaatggtggtccactgttcagccggggtgggtagaaccggctgctttatcgtgattgacgctatgctggaacgcatcaagcacgagaagaccgtggacatctatgggcacgtcacgctgatgcgcgcgcagaggaattacatggttcagactgaggatcaatatatctttatccacgacgccttactggaggccgtgacttgcggaaataccgaggtccccgcaagaaatctctatgcatacatccagaaactcacccagatagagacaggcgaaaatgtgaccgggatggagttggagttcaagagactcgcctccagcaaagcacacacctctcgcttcatcagcgctaacttgccctgcaacaaatttaagaatagactggtgaacattatgccctatgaaagcacgcgagtctgtctgcaaccaatcagaggggtggaagggagcgactatatcaacgcgtcattcatcgacggataccggcaacagaaggcctatatagctacccaggggcccctcgccgagaccacagaagatttctggaggatgttatgggaacataatagtactatcgtggtaatgctcactaaattgcgcgagatgggcagagagaaatgccatcagtattggcccgccgaacggtccgcacgctaccagtactttgtggtcgaccccatggccgagtataatatgccccagtatatattgcgcgaatttaaggtcacagacgccagagatggacagagtcgaaccgttcgtcagtttcagtttacagactggcccgagcaaggcgtgccaaaatcaggagaaggttttatcgatttcattggccaagtccacaaaaccaaggaacagtttggccaggacggacctatcagcgttcattgttccgctggagttggtagaaccggggtttttataaccctgagcatcgtgctggaaagaatgcgctatgagggagtagttgatatcttccagactgtgaagatgctgcgaacccagagacctgctatggttcagaccgaggaccagtatcagttcagttaccgggctgcgcttgaatacctcggaagctttgaccattacgcaacctag

SEQ ID NO: 201721 - DNA, 5739 bp, Artificial Sequence
  Description of Artificial Sequence: Synthetic coding sequence
atggtgcacgtggcccggctgctgctgctgctgctgaccttcttcctacgaacggatgccgaaaccccacctcgcttcactcgcactcctgtcgatcaaactggagtgtccggaggcgtagcgtccttcatatgtcaggctaccggcgatcctaggccaaagatagtgtggaataagaaaggtaaaaaggtttccaatcaacgctttgaggtgatcgaattcgacgatgggagcggcagcgtgctgaggatccagccactccggactccccgtgatgaggccatttacgagtgtgtggctagcaacaatgtgggagaaattagcgtttccacgaggctgactgtcctgagagaggaccagataccacgtggcttcccaaccatcgatatgggcccacaacttaaagtggtggaaaggacccgtacagctaccatgctgtgtgccgcgtcgggcaaccccgatcccgagatcacctggttcaaggactttcttccggtggatacttcaaataacaacggacgcattaagcagctgagatctgagtccatcggcggcactcccatcagaggtgccctccagattgaacagtctgaggagtccgatcagggtaaatatgagtgcgtcgctacaaattccgcaggaacacggtacagcgcgcccgccaacttatacgtgcgagagctaagggaagtgcgcagggtacctcctagattttctattcccccaaccaaccacgaaattatgcctgggggcagcgtgaacatcacgtgtgtggccgttggctctcctatgccctacgtgaaatggatgttgggagcagaagatctgactcccgaagacgacatgcccattgggcggaacgtacttgaactcaatgatgtgcgccagtcggccaactacacctgtgtggccatgagcaccctgggcgttatagaggcgatcgcccagataaccgtgaaggccctgcctaaaccccctgggaccccagtggtgactgaatctacagcgacttccattacactgacttgggactctggcaatcccgagccagtgtcctattacatcatacagcacaaaccaaaaaacagcgaagagctgtacaaggaaatcgatggagtggccacaacgcgctacagcgtggccggtctctccccatattccgattatgaattccgcgtggtggctgtcaacaacatagggcggggaccaccgagcgagcccgtgctgacccagacttctgagcaagccccctcctccgctccgcgcgacgtccaggctcgcatgctctcaagtactacaattcttgtacaatggaaggagcctgaggagcccaacggacaaatccaaggctaccgggtctactacactatggatcccactcagcacgttaataactggatgaagcacaatgtagccgattcccagatcaccaccataggaaacctggttccccagaagacttactctgtgaaggttctcgccttcacttcgatcggagatggaccactcagctctgacatccaggtgattacccaaaccggggttcctgggcaacctctgaactttaaggctgaaccagaaagcgagacatccatcttgctctcatggactccgccacgaagcgacaccatcgcgaattacgagttagtgtataaagatggtgaacacggcgaggagcagcggatcaccatcgaacccggaacctcttacagactgcaaggactcaaacccaacagcctgtattatttccgactggccgcacgctctccccagggacttggcgcttctactgctgagatttctgcaaggactatgcagagtaagccgtctgcccccccccaggacataagctgtacatctccttcatcgacgagcatcctcgtctcttggcagccccctccggttgaaaagcagaacggcatcattactgaatactctattaagtataccgccgttgacggcgaagacgataagccacacgagatcctcgggataccttctgacaccacaaaataccttttagagcaactggagaaatggaccgagtacaggatcacagttacggcccacactgacgtgggccctggccccgagtccctgtccgtcttgatcagaacgaatgaggatgttcctagtggaccacctcgcaaggttgaggttgaggcagtaaacagtacaagcgtcaaagtgtcgtggagaagccctgttccgaataaacagcacggtcagattcgggggtaccaggtgcactatgttcggatggagaacggtgaaccaaagggccaaccgatgctgaaggacgttatgctggccgacgcacaatgggagttcgacgacacaactgagcacgacatgattatcagtggccttcaaccggaaacttcatactcattgaccgtgacagcatatacgaccaaaggtgacggggctagatccaagcccaaactagtgtctactactggcgcagtgccaggcaaaccacgtctggttatcaaccacacccagatgaacacagctcttattcagtggcatcccccggtggacacatttggccccctccaagggtatcgactaaagttcgggcgaaaggatatggaacccttaactactctggaattctcggaaaaagaggatcacttcacagccaccgacatccacaagggagcctcttacgtcttcaggctttccgctcgtaacaaggttggcttcggcgaagaaatggtcaaagagatttcaattcctgaggaggtgcctacagggttcccgcagaacttacatagcgaaggcactacaagcacaagcgtacagctctcttggcagccccccgtgctcgccgaacggaacggcattattacgaagtacaccctattgtatcgggatatcaatatcccgcttctgcccatggaacagctcatcgttcccgctgacactactatgactttgactggactcaagcccgatactacgtacgatgtcaaggtcagggcccacacctcaaaaggccccggaccatattccccatcagtgcagtttcgtaccctgcctgttgatcaagtgttcgcaaagaactttcacgtcaaggccgtcatgaagactagcgttctcctctcttgggagatccccgagaactacaactcggccatgcccttcaagatcctgtacgacgacggtaaaatggtggaggaggtggacggccgagctacccaaaagctcattgtgaatctaaagcctgagaaaagctatagctttgtgttgactaatcgcggcaacagcgcaggtggactccaacatcgagtgaccgccaagactgcgcccgacgtgctccgcacgaagcctgccttcattggcaagaccaacctggatgggatgataacggtgcaattgccagaagtcccagccaacgagaatataaaagggtactatatcataattgtaccgcttaaaaaatctaggggcaaattcatcaagccctgggagagccccgatgaaatggaactagatgagctcctaaaagagattagtcggaaaagaagaagtatccgctacggtcgggaggttgaactcaaaccatatatcgcggcacattttgatgtgctacccaccgagttcaccctcggggacgataaacactatggaggcttcaccaacaagcagctgcaatcgggccaggaatacgtgtttttcgtgctcgccgtgatggaacacgcagagtcgaagatgtacgccacctctccttactccgatcccgtagtgtctatggacctcgacccccagccaataaccgacgaggaggagggcttaatatgggttgttgggccagtcctggccgtggtctttatcatttgtatcgtgattgctatcctgctgtacaagcggaaacgtgccgagtcagactcaagaaaaagttccatccccaataataaagagatccctagccaccatcccacagaccccgtggagctgcgtcgattaaacttccaaacccctggaatggcttcccatccgcctattccgatcttagaactggccgatcacatcgagagactgaaagccaatgataatttgaagttctcccaggaatatgagtcaatcgaccctggacagcagtttacctgggaacactcaaatcttgaggtgaacaaaccgaaaaaccggtatgctaacgttatagcttacgatcactccagagtgctcctgagcgccatcgaaggaatacctggaagcgactacgtgaatgctaactatatagacggatacaggaagcagaacgcgtatatcgcaacccaaggcagtttacctgagacatttggggatttttggagaatgatttgggaacagcggagcgccaccgtggtgatgatgaccaagctggaagagcgttccagagttaagtgtgaccaatattggccttcccggggaaccgaaacccatggcctggtgcaagtcaccctgctcgacacggtggagctggctacctattgcgttcgcacttttgctctgtacaagaatgggtcttccgagaaaagagaagtgagacaattccagtttactgcttggcccgatcacggcgtccctgaacacccaacccctttcctcgcctttctcagacgtgtgaagacatgtaacccgcccgatgctgggccaatggtggttcactgctctgccggggtggggcgcacggggtgttttatcgtcatcgatgccatgctggagagaataaagcacgagaagactgtggatatctatgggcatgtcactctgatgcgggcccaacgcaactatatggtccaaaccgaggatcagtatatttttatccatgacgctctgctcgaagccgttacatgcgggaacacagaagtgccagcacgcaatttgtatgcctacatccagaaactgacgcaaatcgaaaccggagagaacgtgacaggaatggagttagagttcaagaggctcgccagcagtaaggcacatacatccaggttcatttctgccaaccttccttgcaataagttcaagaaccgccttgtcaacataatgccttatgagtcaaccagagtgtgcctccagcctatcagaggagtggaggggtctgattatatcaatgcttccttcatcgatggttaccgccagcaaaaggcctatattgccactcagggacccctggctgaaacaaccgaggacttttggaggatgctgtgggaacataactcgactattgtggttatgctgaccaagctgcgggaaatgggcagagaaaaatgccatcagtactggcccgccgagcggtctgctaggtaccaatactttgttgtcgaccctatggccgagtacaacatgccccagtatattctccgggagtttaaggtgacagatgcccgcgatggtcagtcacggactgtacggcagttccaatttaccgattggccggagcagggggtccctaaatccggagaagggttcattgattttatcggccaggtacacaaaaccaaggagcaattcggtcaggatgggcccatttctgtgcactgctcagcaggggtcgggagaacaggggtgttcatcaccctttcaatcgtcttagagcggatgcgctacgagggcgtggtagatatctttcagaccgtcaaaatgctgcgtacacagcgccctgccatggtgcaaacagaggaccagtaccaattcagttacagggccgctcttgagtatctcgggtcatttgaccactacgccacctag

SEQ ID NO: 201722 - DNA, 2103 bp, Artificial Sequence
  Description of Artificial Sequence: Synthetic coding sequence
atggagcccctgtgccccctgctgctggtgggcttcagcctgcccttggcccgtgcccttcgcggcaatgaaaccacagccgactcaaatgagaccaccactacttcagggcctccggatccaggcgccagtcagcccctcttggcgtggctgctgctgccccttcttctactactactggtgctcttattggctgcctactttttcaggtttaggaaacagagaaaggcagtggtcagcacatccgacaagaagatgcctaacgggattctagaagaacaggagcagcagcgcgtgatgttgctttccagatcaccctcaggcccaaaaaaatacttcccgatccccgtggagcatttggaagaagagattaggatcagatccgctgatgactgcaagcagttcagagaagaattcaactctcttccctccggccacattcagggcacattcgagctggccaataaggaggagaacagagaaaaaaatcgctatcctaacatccttcctaatgaccactcacgagtcatcctgtcgcagctggacgggatcccatgctctgactacatcaatgcctcctacattgacggatacaaagagaagaacaaatttatagcggctcagggacctaagcaagagacagttaatgatttctggcggatggtgtgggagcagaaatcagcaactattgtgatgctgaccaacctcaaggagcgtaaggaagaaaaatgtcaccagtactggccggaccagggctgctggacatacggcaacattcgcgtgtgcgtcgaagattgcgttgtgctcgtggactacactatccgcaagttctgcatccagccccagctccctgacggctgcaaggctccacgcctcgtgagccagctgcacttcacaagttggcctgacttcggcgtcccttttaccccaatcggcatgctgaagtttctgaagaaggtgaaaacactaaatccagtccacgcaggaccaatcgtcgtgcattgtagtgccggcgtgggcaggacggggacctttatagtcatcgatgccatgatggccatgatgcacgccgagcaaaaggtggatgttttcgaattcgtcagccgcattcggaaccagcgaccccagatggtccaaactgatatgcagtatactttcatttaccaggcattgctcgaatattatttgtatggcgatactgagctggacgtgagttcactagagaaacaccttcagactatgcacggaaccaccacccatttcgataagattgggcttgaggaagagttccggaaattgacaaatgttcggatcatgaaagagaacatgcgtaccgggaatctaccagccaacatgaagaaagcacgagtgattcaaatcatcccctatgattttaatagggtgattctgagcatgaagcgggggcaggagtataccgattacattaacgcctccttcatcgatggttataggcagaaagattatttcatcgcgacccaaggacccctagcacatacagttgaggacttttggcgcatgatctgggagtggaagagccatacgattgtgatgctgaccgaagttcaggagcgcgaacaggataaatgttatcagtactggcccacagaaggcagtgtcacacatggcgagattacaattgaaatcaaaaatgatacactctccgaggctatttcaatcagggactttctggtcacgctaaatcagccccaggccagacaggaagagcaggtgagagtggtacgacagtttcatttccatggatggcccgaaatcggtatccctgctgagggaaaggggatgattgatctgattgccgctgtgcaaaaacagcaacagcagactggaaaccaccctattactgttcattgtagtgctggggccggcaggactggtacctttatagctctgagcaacatcctggagcgtgtgaaggctgaagggcttctggatgttttccaggcagtgaagagcttgagacttcagcgcccccatatggtccagaccctggagcagtacgaattttgttataaggtggtgcaggacttcattgacattttttcagactacgccaatttcaagtag

SEQ ID NO: 201723 - DNA, 1929 bp, Artificial Sequence
  Description of Artificial Sequence: Synthetic coding sequence
atgagcaaccggagcagcttcagccggctgacctggttccggaagcagcgcaaagcagttgtaagcactagtgacaaaaagatgcctaacggaatcctggaggagcaggagcagcagagagtgatgctgctcagcaggtctccgtctgggcctaaaaaatatttcccaattcccgtcgagcacctggaggaggagattcggataaggagtgcggacgattgcaaacagttcagagaagagttcaatagtctcccgtctggtcacatccaaggcacattcgagctggcgaacaaggaggaaaatcgggagaaaaatcgatatcctaatatccttcctaatgaccacagtagggttatcttgtctcaattggatggcattccatgtagcgactatatcaatgcaagctatatcgatggctataaggagaagaacaagtttatcgcggctcaagggcctaagcaagaaacagtgaacgacttttggcggatggtgtgggagcaaaagagcgcgaccattgtcatgttgacaaatctcaaggagagaaaggaggagaagtgccatcagtattggccagaccagggatgttggacctatgggaacatccgggtatgcgtagaggactgtgtagtcttagtggactacactattcgtaagttctgtatccagccacagctgcctgatggttgtaaggcgccacggctggtttcacagctccattttaccagctggcccgacttcggggtgcccttcacccctatcggcatgctgaagttccttaaaaaggtcaagaccctcaatccagtacatgccggacctattgtggtgcactgtagtgccggtgtgggaagaacaggcacattcatcgtgatagacgctatgatggctatgatgcacgccgaacagaaagtggacgtctttgagttcgtatcccggattaggaatcaacgtcctcagatggtacagacagatatgcagtacacatttatctaccaggcactgctcgagtactatttgtatggcgacaccgagttagacgtctccagcctggagaagcacctgcaaaccatgcacggcaccactactcattttgataagataggtctggaagaagagttccgaaagcttactaatgttcggatcatgaaagaaaacatgcgcacaggtaacctacccgctaatatgaagaaggcaagagtaattcagataatcccctacgactttaatcgtgtgattcttagcatgaagcgcggccaggaatacacagactatattaatgcgtccttcatcgatgggtatcgtcagaaggactatttcatcgccactcaaggacccctggcccacactgtggaggatttttggagaatgatctgggagtggaagagccacacgatcgttatgctcacagaagtccaagaacgggaacaagacaaatgttatcagtattggcccactgagggtagtgtaacacacggagagattacgattgagattaaaaatgacaccctttccgaggctatatctatcagggatttcctcgtgactctgaatcaaccccaggctcgacaggaagagcaagtcagagtcgtgcggcagtttcacttccacggttggcccgagataggaattcccgccgagggtaagggaatgatcgatttaatcgctgccgtgcaaaaacagcagcaacagaccggcaaccaccctatcactgttcactgttccgcaggcgccgggcgcactgggacattcatcgccctcagtaacatcctggaacgcgtgaaggcggaaggattgttggacgtttttcaggctgtgaaaagcttgcggctgcagaggccccatatggtccaaaccctggaacagtacgaattttgctataaagtggtacaggatttcattgacatcttctccgattatgccaactttaaatag

SEQ ID NO: 201724 - DNA, 2103 bp, Artificial Sequence
  Description of Artificial Sequence: Synthetic coding sequence
atggagcccctgtgccccctgctgctggtgggcttcagcctgcccctagcaagagcattaaggggcaacgaaacaaccgcagattctaatgagactacaacgacgtcagggccaccagatccaggtgcttcccaacctctgttagcctggttgctcctacctctgctgctgttgctgctcgtgctgttgctggccgcctacttctttcgcttccgaaaacagcgaaaggccgtagtatcaacatccgataagaaaatgccaaatggtatcctggaagagcaagaacaacagagggtgatgctgctttctcggtcaccctcaggccccaaaaaatatttcccaatccccgtagaacatctggaggaggagatccgcatccggtccgcggacgactgtaagcagttccgtgaagagttcaactccctcccatccggccatatccagggtacattcgagcttgccaataaggaagagaacagagagaaaaacagatatcctaatattttacctaatgaccactcccgggtaatactctcgcaattggatggcatcccctgctctgattacatcaatgcctcttacatcgacggatacaaagagaagaacaagttcatcgctgctcaagggccaaagcaagaaacagtgaatgatttctggcggatggtctgggaacaaaaaagcgcaactatcgtgatgctgactaatctcaaagagaggaaggaggaaaagtgccaccaatactggcctgaccaaggctgttggacatatggcaacattcgcgtctgtgtggaggactgcgtcgtacttgttgattacaccataagaaagttctgtattcagcctcaactgccggatggctgtaaagcccccaggctggtgagtcagctgcatttcacctcttggcccgattttggggtgccttttacacccatcgggatgcttaaattcctgaaaaaggtaaaaacactgaaccctgtgcatgccggaccaattgtggttcattgctcagccggtgtgggaagaactggcacgttcatcgtgatcgatgccatgatggcaatgatgcacgccgagcagaaggttgacgtattcgaatttgtctcacggattagaaaccaacgcccccagatggtgcagacggatatgcagtatacatttatctaccaagcactgctggaatattacctatatggcgatactgagttggatgtgtcgtcactggaaaaacacctacagactatgcacggtaccactacccactttgacaagatcggcctggaggaagagttccgcaagctgaccaatgttcggatcatgaaggagaacatgaggaccggtaatttacctgccaacatgaagaaggctcgtgtgattcaaatcataccttacgattttaacagggttattcttagtatgaagagaggacaggaatacaccgattatataaacgcctcattcatcgatggatatcgacaaaaagattactttatcgctacacagggccctctcgctcacactgtagaagacttttggcgtatgatctgggagtggaagagtcacaccattgtgatgctgacagaggttcaggagagggagcaggataagtgctaccagtattggccaaccgagggatctgtgacacacggcgagattaccattgagatcaaaaatgacacactgagcgaagccatttctatccgggatttcttggtgaccctgaatcagccgcaggcccggcaggaggaacaggtgcgggtcgtgaggcagtttcatttccatggatggccagaaattggcattcctgcggaaggtaaagggatgatcgacttgatcgccgcagtccaaaaacaacagcagcaaaccggcaaccaccccattacagtccactgttcagccggcgctggccgtacaggtactttcatcgctctgtcaaacattttagaacgagttaaagcggagggactgctcgatgtgttccaagctgttaaaagtctgagactgcagcgtcctcacatggtgcagacactggaacagtacgaattttgttacaaagtggtccaagactttatcgacatctttagcgattacgcaaatttcaagtag

SEQ ID NO: 201725 - DNA, 438 bp, Artificial Sequence
  Description of Artificial Sequence: Synthetic coding sequence
atggagcccctgtgccccctgctgctggtgggcttcagcctgccccttgccagggcgctgcggggtaacgagaccactgctgattcaaacgagacaaccaccacttccggacccccggatccgggggccagtcagccacttcttgcatggctcttgctccccctgctgctgctgctcctcgtcctactcttggccgcctatttttttcgattccggaaacagcgcaaggctgttgtgtcgacctccgacaagaagatgccaaacggcattctggaagagcaggagcagcagagggtgatgttgttgtcacggtccccttcgggcccgaagaagtacttccccattcctgtggagcacctcgaggaggagatccgaatacgatccgccgatgattgcaaacagttccgcgaagaatttaacatgacaatacttggttag

SEQ ID NO: 201726 - DNA, 2010 bp, Artificial Sequence
  Description of Artificial Sequence: Synthetic coding sequence
atggtgagccagcggctgccccggaagacccggggccccccctggagtccatgtgtgcattcctgctggtgggtgctcgcctgtcggtctcccggactgtctggtgcaactagacccctccccacagctacccggcagccaagaccgcaggcactccgtactagggcgcctccttcccgttgctggccaggctgttactgcagatgttgcagtagttctagctgtagtttttctccccctacatcctccggatcaggacctaaaaaatatttccccatcccagtggaacacctcgaagaggaaattcgtatcaggagcgccgacgactgcaagcagtttagggaggaatttaacagtttaccttctggacacatacaggggaccttcgagttggcgaacaaggaagaaaacagggaaaaaaaccgataccccaacattctacctaacgatcactctcgggtaattctgagccagctggatgggataccatgttcagattacatcaatgcgagctatattgacgggtacaaggagaaaaataagttcattgctgcacagggtcccaagcaggagaccgtgaatgacttctggaggatggtgtgggaacagaaatcagccactatcgttatgttgaccaaccttaaagagcgaaaagaggagaaatgtcaccagtattggccagatcaaggatgttggacgtacgggaacatccgggtctgcgtggaagactgtgtggtgctcgtagactacactattcgaaagttttgtatccagccgcaactccctgatggctgcaaggctccgcgactggtctctcagcttcacttcaccagctggcccgatttcggcgttccctttacaccgatcggaatgctgaaattcctaaagaaagttaagaccctcaaccccgtgcacgctggccctattgtggtccattgttcagccggagttggccgcaccggcacttttatcgtcatcgacgccatgatggccatgatgcatgctgagcagaaagttgacgttttcgagtttgtgtctcgcatccgtaatcagcggccgcaaatggtgcagacagacatgcagtataccttcatttaccaggcactgctggagtattacctgtacggtgacaccgagttagacgtctcaagcttagagaaacatctccagaccatgcatgggacaacgacccatttcgataaaatcggcctggaggaagagttcaggaaactaacgaatgtaaggattatgaaagaaaacatgcggaccggaaatctcccagccaatatgaaaaaagctagggtcattcagattattccttatgattttaaccgcgtaatcctcagtatgaaacgaggccaggaatataccgattacattaacgctagctttatagatgggtaccgccagaaggattattttatcgcaacccaaggccctctggcgcacaccgtggaggacttttggcggatgatttgggagtggaagagccatactatcgtgatgctgacagaggtccaagaaagggagcaggataagtgctaccagtattggcccaccgaggggagcgtaacacacggagaaattacaatcgagattaaaaatgatactctgtctgaggcaatttccattagagatttccttgtcactttgaatcagccacaggcaaggcaggaagaacaggtgagagtcgtgcgccagttccattttcacggatggcccgaaatcggaatccccgccgagggtaagggaatgatcgacctcattgccgcagtgcaaaaacaacagcaacaaacagggaatcacccgattactgtccactgtcgtaactccatgaacagtgccaccaagtggtacaagatactgctgatctatttcctgataatgctcatcagcaacgaggatagttgcctcaaaatattcttcaaccttatggaacagcggcgatcccactttccccaggatgctaggctgagccctccactctctgggaccgcttttgctctctag

SEQ ID NO: 201727 - DNA, 423 bp, Artificial Sequence
  Description of Artificial Sequence: Synthetic coding sequence
atggagcccctgtgccccctgctgctggtgggcttcagcctgcccctggctcgggctctgagaggcaacgaaacgacagccgattccaacgagacaactacaacatcgggccctcccgatccaggggcaagtcagcctttgctggcgtggctattgctccccctgttgctactgctcctagtcctacttctagctgcgtacttcttccggttcaggaagcagagaaaggcagttgtgagtacttcagacaagaaaatgccaaacggcatcttggaggaacaggaacagcagagagttatgctgctgtcgcgttctccatcaggcccaaagaaatatttccccatcccagtagaacacttagaggaagaaattaggattcggtcggcagatgactgcaagcagttcagagaagaatttaattag

SEQ ID NO: 201728 - DNA, 465 bp, Artificial Sequence
  Description of Artificial Sequence: Synthetic coding sequence
atggagcccctgtgccccctgctgctggtgggcttcagcctgcccctggcccgcgcgttgcggggaaacgaaacgacagcagactctaacgaaaccaccacaaccagcggcccccccgatcccggtgcatcacaacccctcctagcatggctgttgttacccctcttgctgttactcctagtactgttgctggctgcctacttcttcagattcagaaaacagcggaaggcagtcgtgagtacctccgataagaaaatgcctaatggcatactggaggagcaagaacagcagagagtcatgctgttgtccagaagccctagcggccctaagaagtacttcccaattcccgtggagcatctggaggaggagatcagaattaggtccgcggatgattgtaaacagtttcgcgaagagtttaacagcctgccaagcggccatatccagggtacctttgaactggcatag

SEQ ID NO: 201729 - DNA, 5724 bp, Artificial Sequence
  Description of Artificial Sequence: Synthetic coding sequence
atggcccccgagcccgcccccggccggaccatggtgcccctggtgcctgcactagtcatgctgggcttagttgccggagcacatggtgattccaagcccgtctttatcaaagtgcccgaggatcagacgggcctgtcaggtggagtggcgtcttttgtctgccaagcaactggggagcccaagccacggatcacatggatgaaaaaggggaagaaggtgtcctcccagcggttcgaagtcattgagtttgacgacggggcaggaagcgttctgagaattcaacctctgcgagtccagagggacgaggcaatctatgaatgtacggcaacgaattcactgggcgagatcaataccagcgccaagctctccgtgcttgaggaggaacagttgcccccgggctttccctcaatcgacatggggccccagttgaaagtggtcgaaaaagcaaggaccgccacaatgctgtgtgcggctggcggtaatcctgacccagagatctcgtggtttaaggatttcttgcccgttgatcctgccacatccaacggccgcatcaaacaactgagatccggggccttgcagattgaatccagcgaggagagcgaccagggaaaatacgagtgtgtggcgactaactcggccggaactcgttacagtgccccagcaaacttatacgtgagggtacgtagggtggccccccgattcagtatcccgccgtctagccaggaagtgatgccagggggatcggtaaacctgacatgcgtcgccgtgggagcacctatgccatacgttaagtggatgatgggtgccgaggagctaacaaaagaagacgagatgcccgtgggccgcaatgtcttggagctgtcaaacgttgtgaggagcgctaactacacttgcgtagccatctcatctcttggaatgattgaagccaccgcccaggtgaccgtgaaggctctgccaaaacctcccattgacttggttgtgacggagaccaccgccacctctgtgactctcacctgggatagcgggaacagcgaaccggtaacgtattatggaattcaatatagagcggctggtactgagggaccttttcaagaagttgatggggtggcaacgactcgctacagtatcggcgggctgtcccctttttctgagtacgccttccgtgtactggctgtgaattccatcggcaggggccccccgagcgaggcagtcagagcccgaaccggcgaacaggctccctcgtctccgccacgccgggttcaggccagaatgctctcagctagcacgatgctcgtgcaatgggaaccccccgaggaaccaaatggcctcgtccgtggttatagggtttactacacaccagacagtcggaggccacctaacgcatggcacaagcacaataccgacgccgggttgctgactacagtagggtccctgctgccaggaatcacctacagcctgcgggttctcgcgttcaccgcagtgggtgatggcccgccctccccaacgattcaagtgaagactcagcaaggcgtgccagcacagcccgccgattttcaggctgaggtggagagcgatacaagaatccaattgagctggcttctgccaccccaagagagaattataatgtacgaactcgtctactgggccgcagaggatgaggatcagcagcataaggtcacatttgaccccacatctagctacactcttgaagatctaaaacccgataccttgtaccgatttcagctggccgcccgcagcgacatgggcgtgggcgtctttacgccaactatcgaggctcgtacagcccagtctactcctagcgcccccccccaaaaggtaatgtgcgtgagtatgggtagtacaaccgtccgggtgagctgggtaccccctcctgccgacagcagaaatggagtgattacacaatattctgtcgcctatgaggccgtcgacggagaggaccgaggtaggcacgttgtcgacggaatctctagagagcacagctcttgggatctggtgggcctagagaaatggacagagtacagggtatgggtgagagcacacactgacgtcggacccggccccgaaagttccccagttctggtgcgcactgacgaagatgtgccgtccgggccgccaaggaaggtggaggtcgagcccttaaatagcacggctgtgcatgtgtattggaaattgccagtcccttctaagcagcatggccagatacgtggctatcaggtaacctatgtgaggcttgaaaacggggagccccgggggctaccaatcatacaggatgttatgctggccgaggcacagtggcgacccgaggaaagcgaggactatgaaaccactatcagtggtctcacaccggaaacgacctacagcgtcactgtcgctgcttacactacaaaaggagacggggctagaagcaagcctaaaatcgtaacaacaacgggcgccgtacccgggcgccccacaatgatgatttccaccacagccatgaacacagcgttgctccagtggcacccacctaaggagctgccgggagagctgctaggctatcgactgcagtattgtagggctgacgaggcccggcccaacactatcgacttcgggaaggacgatcaacattttactgtaaccggcctccataagggtacaacctacattttcaggttggccgctaagaacagggctggattaggcgaggaattcgagaaggagatccggactcccgaggaccttccaagcggttttccacagaacctacatgtcacgggccttactacttccaccactgagttagcttgggacccaccagtacttgccgagcgcaacggacgcattattagctacaccgtcgtcttccgcgacattaattctcaacaggagttgcaaaacattaccactgataccaggttcacactcaccggcttaaagccggatacgacctacgatattaaagtccgcgcgtggacctccaaggggtctggtcctctgagtccttctattcagtctaggacaatgcccgtggaacaggtttttgcaaagaacttccgagtggctgctgccatgaagacttctgtcctgttgtcttgggaggttcctgactcctataagagcgccgtcccattcaagatcctgtataatggtcagagcgtggaggttgacggacattctatgcgtaagctcatcgcagatttacagccaaatacagaatattcattcgtcctgatgaacagaggtagctcggccggaggattacagcacctggtgtctattagaacagccccggatctcttgccccacaaacctcttcccgccagtgcctacatcgaagacgggcggttcgacctgtctatgccccacgtccaagatccgtcattggttaggtggttttacatcgtggtggtgcctattgaccgagtaggaggaagcatgttgaccccccgttggtcaaccccagaagaactggagctggatgaactgctggaagctatcgagcagggaggagaagaacagaggagaagacggcgccaggccgagcgcctaaagccttatgtggccgctcagctggacgtgttgcctgaaaccttcaccctgggcgacaaaaagaactatcgcggcttttacaaccggcccctgagtcccgacctgtcctaccagtgtttcgtgctcgccagtcttaaagaacccatggatcagaaacgctatgcctccagcccatattctgacgaaattgtggtgcaagtcacacccgcacagcaacaggaggagccagagatgctgtgggtcacggggcctgtcctggccgtaatcctgatcatccttatcgtgatagcaatcctgctattcaagcgaaaacgaacccactctccaagtagtaaggatgaacagagcataggcctgaaagattctttgctcgcgcactcctcagatccagtcgagatgcgtcggttaaattatcaaactcctggaatgcgcgaccatcctccgattccaattaccgacttggccgataacatcgaaagactgaaggccaatgacggcctcaagttttcccaagagtatgaaagtatcgatccaggtcaacagtttacatgggagaactccaatctcgaggtgaacaaaccaaaaaatagatacgccaatgttatagcttatgaccactcccgggtgatccttacgtccattgacggggtgcctggatcagattacatcaacgctaattatatcgacggctatcggaagcagaatgcctacatcgccacccaggggcctctgcccgagactatgggggatttctggcgtatggtgtgggagcaaagaacagctaccgttgtgatgatgactagactcgaggagaagagtagagtcaaatgcgatcagtactggcccgcaaggggtaccgagacttgcgggttgatccaggtgactctgctggacacagtggaactcgcaacatatactgtcaggacttttgctctccacaaatccggcagttccgagaaaagggagttgcggcagttccaatttatggcctggcctgaccacggcgtgcctgaatatcccactcctattctggcatttttaagaagagttaaggcttgcaaccctctggatgcaggaccaatggtggtgcattgttctgcaggtgtcggacgtaccgggtgtttcatcgttatcgatgctatgctggagaggatgaagcacgaaaagacagtagacatttacggccatgtgacttgtatgcgctcccagcgcaactatatggttcaaaccgaagatcagtatgtgtttatccatgaggctctgctcgaggcagcgacctgtggacacaccgaggtgcctgccagaaacctctatgcacatatacaaaagcttggccaagtgccgcccggggaaagtgtaaccgctatggagctggagtttaagcttctggcttcatccaaagcccacacatcccggtttatttccgcaaacctgccctgcaataagttcaagaatcgactcgtgaatattatgccttatgagcttactcgcgtgtgtctccaaccaattcggggtgtcgaaggatccgattacatcaacgccagcttcttagatgggtatcgtcagcagaaggcctatatcgctacccagggccctcttgccgagtccacagaggacttttggcgcatgctttgggagcacaactccacaatcatcgtaatgttaacgaagcttagggagatgggcagagagaagtgccaccagtactggccagccgaacgaagcgcacgctatcagtattttgtggtggatccaatggcagagtacaacatgccccagtacatcctaagggagttcaaggtgacagatgcccgtgatgggcagagccggacaattagacaattccagttcacagattggcctgagcagggggtgcccaagactggagaggggtttatcgatttcataggccaggtgcataagaccaaggagcaatttgggcaggacggacccatcaccgtccactgttctgctggggttggccgcaccggagtatttatcaccctcagcatagtacttgagcgcatgcggtatgaaggggtcgtggacatgttccaaacagtcaagactctgaggacacagagaccggccatggtgcagacagaagatcagtaccagctctgctacagagcagcgttggagtatctgggttcattcgatcattacgccacgtag

SEQ ID NO: 201730 - DNA, 5697 bp, Artificial Sequence
  Description of Artificial Sequence: Synthetic coding sequence
atggcccccgagcccgcccccggccggaccatggtgcccctggtgcctgccttggtcatgctgggacttgtggctggtgcccatggagattccaagccagtattcatcaaggtacctgaggaccagaccgggttgtctggaggggtcgccagcttcgtatgccaggcaaccggagagcccaaaccgagaatcacatggatgaaaaaaggcaagaaggtgtcttcacagcgatttgaggtgatagagtttgacgatggggctgggtcagtgttgagaatccagcccttaagggtacagcgtgacgaggccatttacgagtgcacggccaccaatagcctgggtgagattaacacgagtgctaagttgagtgtgttggaggaggaacagctccctccaggtttcccctctattgacatgggaccgcagctcaaggtggtggaaaaggctcggacagctactatgttgtgcgctgctgggggaaaccctgatccagaaatctcttggttcaaggacttcctgcccgtggaccctgcaaccagtaatggaaggatcaagcaactgaggtcgggggcactgcaaatagagtcttctgaggaaagtgatcaaggaaaatacgaatgtgttgcaactaacagtgctggtacccgctattcagcaccggctaatctttatgttcgcgtcagacgtgtggctccccgcttcagcatacctccatctagccaggaagtaatgccaggagggtctgtgaatctcacgtgtgtggccgtgggcgctcccatgccttatgtaaagtggatgatgggggctgaagagcttacaaaggaggacgagatgcctgtgggccgcaatgtcctggagctgtccaatgtggtgaggagcgctaactacacttgcgttgccatatcttcgcttgggatgattgaggccaccgcccaggtgactgtgaaggccctcccaaagccccctatcgacttagttgtgacagagactacagccacctctgtgactcttacttgggactctggaaattctgagcccgtgacttactacgggatccagtatcgagccgcaggcacagagggcccatttcaggaggttgatggggtggccaccactcgatactctatcggcggtctttctcccttttcggagtacgcattccgcgtgctagcggtgaacagcatagggcgagggcccccttccgaagccgtgcgcgcccggactggcgagcaggctccgtctagtccaccaaggcgcgtgcaagctcgcatgctcagtgctagcacaatgttggtccagtgggagccacctgaagagcctaatggattggtgaggggctacagggtgtattacacaccagatagccgtcgcccacccaatgcttggcataaacataacacagacgcaggacttttaacaactgtggggagcctgctccccgggattacgtactccctccgcgtgttggccttcacagcagttggtgatgggcctccctcaccaacaattcaggtgaaaacccagcaaggcgtcccagcccagcctgcagactttcaggccgaggtggaaagtgatacccggatccagttgtcttggctcctgccacctcaggagaggatcataatgtacgagcttgtatactgggctgccgaagatgaggaccagcagcacaaggtgacctttgaccccactagcagttacaccttagaggacttaaagcctgacactctttacaggtttcaactcgcggcaagatctgacatgggcgtaggggtttttacaccgacaatcgaagctcgcacagcgcagtctacgccaagcgccccacctcagaaggttatgtgtgtctcaatgggaagcaccaccgttagagtatcgtgggtgcctccacccgctgacagccgaaacggagtgatcacccagtacagtgtggcctacgaagcggtggacggggaggaccggggacggcacgtcgtagacggtatttcacgggagcatagcagttgggatctggttggactggagaaatggacagagtacagggtgtgggtgcgggcccatactgacgtcgggcctggaccagaaagctcccctgtgctggtccgaaccgatgaagatgttccaagcggcccccctcgcaaagtggaagtggagcctctgaatagcacggcagtgcacgtgtactggaaactgcctgtacccagtaagcagcacggacagatcaggggttaccaagtgacgtacgtccgcctggagaatggggagccgcgcgggctcccgatcatccaggatgttatgttagctgaagcccaggaaacaaccatttccggtctcacacccgagaccacctattccgtgactgtggctgcgtacacaaccaagggagacggcgctaggtctaagccaaaaatcgtcacaactaccggagccgtgcccgggagacctacaatgatgatctctactactgctatgaacacagccctcctccagtggcacccacctaaggaactgcctggtgaactgttagggtatcgccttcagtactgcagggccgatgaggctcgaccaaataccatcgactttggaaaggacgaccagcactttaccgtcacaggtctgcacaagggcacaacatacattttccggctcgctgccaaaaatagggcaggactaggcgaggagtttgaaaaagagatcagaacgcctgaggatctgccttccgggtttcctcagaacctacacgtgactgggctgactaccagcaccactgagctcgcatgggatccaccagtcctggccgaacggaatggtcgcattatctcctataccgtggtgttcagagatataaactcccagcaggagctacagaacattaccactgatactagattcaccttgacaggtctgaaaccagacacgacttacgacattaaagttcgggcgtggactagcaaaggctctggcccactgtcaccctccatacagtcacggactatgccggtagaacaggtgtttgcaaaaaactttcgagttgcagctgccatgaagacctcagtgctgctgagctgggaagtcccagattcttacaagtcagccgtgccctttaagattttatataacggccagtctgtcgaagttgatgggcactcaatgcgcaaactgatagctgacctgcagcccaacaccgagtatagcttcgttcttatgaatagggggtccagcgccggtggattacagcatcttgtatctattagaacggcccccgacctgctgcctcataaacctcttccagctagtgcatatatcgaggatggccggtttgacttatccatgccacacgtgcaggacccctcactggtaaggtggttctacatcgtcgtggtgcctatagaccgcgttggggggtctatgctgactccccggtggtcaacacctgaggagctggaattggacgagctgctggaagcgattgagcagggtggtgaggagcagaggcgacgtcggaggcaggccgagcgcctgaagccttacgtcgccgcacagctggacgtactgcctgagacattcactctcggagataagaaaaattaccgcggattctataaccgtcctctgtctccagacctgagctaccaatgctttgtgctggcttccctcaaagagccaatggaccaaaagcgatatgcctccagtccatattcagatgagatcgtggttcaggtgacacctgcacaacagcaggaagaacctgagatgctctgggtgaccggtcccgtcctggcagtgattcttattatcttaattgtaattgctatactcttattcaagcgcaagaggacacatagtccgtcatccaaagatgagcagtccatagggctgaaagatagcttactggcccactcttccgatccggtcgaaatgcgacggctgaattaccagacccccggaatgcgcgatcacccgcctattccaataacagatctggccgataatattgaaagactgaaggctaacgacggactgaagttctctcaggaatacgagagtatagacccagggcaacaattcacttgggaaaattccaatcttgaagttaataagcccaaaaacagatatgccaacgtgatcgcttatgaccacagtagggtgattctgacttctatcgacggtgttcctggatccgactatattaatgcgaattacatcgacggctataggaagcaaaatgcatacatcgcaacccaaggcccgctgccggaaacgatgggcgacttttggcgcatggtgtgggaacagcgcaccgccaccgtcgtgatgatgaccaggctggaagagaagtcacgggttaagtgcgaccagtactggcccgccagaggaaccgagacatgcggcttaatacaggtgactcttcttgacactgttgaactcgcaacgtatactgtccgtacctttgctctccataagtccggcagttcagagaagcgcgagctgaggcagtttcagtttatggcatggcccgatcacggcgtcccagaatatcccacaccaatacttgcatttctaaggagggtgaaggcttgcaatcctttggacgccgggcccatggtggtccactgttccgccggtgtcggccggaccggttgcttcattgtgattgacgctatgttagagcgcatgaagcatgagaagacagtggatatttacggccatgttacatgtatgagatcccaaaggaactacatggttcagaccgaggatcagtacgtgttcatccatgaagcgctgctcgaggctgccacttgtgggcataccgaagttccagccaggaatttgtatgcacacatccaaaaactcgggcaggtgccacctggcgaatcagtgactgcgatggaattagaatttaagctgctcgcctcatctaaggcacatacgagtagattcatatcggccaacctcccttgtaataagttcaaaaaccgcctcgtgaacataatgccctacgaactgacaagagtgtgccttcagccaatccgcggggtcgagggcagtgactacatcaatgcaagctttcttgatggttatcgccaacagaaagcttatatcgcaacacagggcccattggccgaatccacagaggatttttggcgtatgttgtgggagcacaattccacaataatcgtgatgctaaccaagttaagagaaatggggagggagaaatgtcaccagtactggcccgcagagaggtccgcacgataccagtatttcgtagtggatccaatggccgaatacaatatgccccagtatattctgagagagtttaaggtcaccgatgcaagagatgggcagtcgagaaccatccgccaatttcagttcacagactggcccgagcagggcgtccccaagactggtgaggggtttatcgatttcataggccaggtccacaaaaccaaggaacagttcggacaggacggccccatcacggtccattgctctgccggagtgggaagaactggagtctttatcaccctgagcatcgtgttggagcggatgcgatacgagggagtggttgatatgttccagaccgtgaaaaccctgcgcactcagagacccgcgatggtccagacagaagaccaataccagctctgctacagggccgcacttgagtacctgggtagtttcgatcactatgctacttag

SEQ ID NO: 201731 - DNA, 5724 bp, Artificial Sequence
  Description of Artificial Sequence: Synthetic coding sequence
atggcccccgagcccgcccccggccggaccatggtgcccctggtgcccgccttggttatgctgggtctggtggcaggcgcccacggcgactccaagcctgtgtttatcaaggtgcctgaggatcagacagggctgtcagggggcgtggcgagctttgtatgtcaggccacaggggaacccaaaccgcgcatcacctggatgaagaaagggaaaaaagtcagttctcaacgtttcgaagttatcgagttcgatgatggggccggctcagtcctaaggattcagccacttcgagtccagagggacgaggccatatacgaatgtaccgctactaatagcctgggagaaataaatacgagcgccaaattatccgtattagaggaggagcagttgccaccagggttcccatcaatcgatatggggcctcagctgaaagtcgtggaaaaggctaggaccgctactatgctgtgcgccgccggcggaaaccctgatccagaaattagttggttcaaagatttcttgccagtagaccccgccaccagcaacgggcgaatcaagcaactgcggtcgggggccctgcaaattgagtcctctgaggaatccgaccagggaaaatacgagtgcgtcgccacaaatagtgccgggacccggtacagcgcccccgcaaacctgtatgttagagtgaggcgagtggcgccaagattttctatccccccatcatctcaggaggtgatgccaggaggatcggtaaatctcacctgtgtggctgttggcgcacccatgccttatgtgaagtggatgatgggcgccgaggaactgacaaaggaggacgaaatgcctgtcgggcgaaacgtactggagctgtccaacgtggtgaggagtgctaactacacctgtgttgcaattagctcgttgggtatgatcgaagccaccgctcaagtgaccgtgaaagcgctgcccaaaccccctattgatttagttgtgacggaaacgactgctaccagcgttaccttgacctgggatagtggtaattctgaacctgtgacctattacggtatccaatatagggccgctggcacagagggcccttttcaagaggtcgacggggtagccacaactcggtatagcatcggcggactgtcccccttctctgagtacgcatttagagtgctggccgtgaactcaattggtagaggccccccctccgaggcggttagagctcgaaccggtgaacaagccccgagcagcccaccacgacgggtgcaggcccggatgctgtcagcgagcaccatgttggttcagtgggaaccacccgaggaaccgaatgggctggtgcggggctacagggtttattacaccccagactccagacgtccacctaacgcctggcacaagcacaataccgatgctgggcttcttaccaccgtgggttcattactacccggaatcacatactctttaagagttctggctttcaccgctgtaggtgacggacctccatcacccacaattcaggtgaagacccagcaaggcgttccagcacaacctgctgattttcaggctgaagtggaatctgacacccgaatccagctctcatggcttctccctccccaggagcggatcatcatgtatgagcttgtttactgggctgcagaagatgaggatcagcaacataaagtgacatttgacccgacaagctcatacactctcgaggaccttaaacctgatacattataccggtttcagctggctgctcggtctgacatgggcgtgggcgttttcacccccacaatcgaagccaggacggcacaatcgactccttccgctcctcctcaaaaggtaatgtgcgtgtcaatgggctctacgactgtgagagtcagctgggttcccccccccgctgattcccgaaacggtgtgataacccagtactccgtggcctacgaggcagtcgacggagaagaccgggggaggcacgtggtggatggtataagtagggaacattctagctgggacctcgttgggctggagaagtggaccgagtaccgggtgtgggtgcgcgcacatacagatgtcggaccaggccctgaatcatcgccagtcttagttaggaccgacgaagacgtgcccagtggacccccaaggaaggttgaggtcgaaccactcaactctactgccgtccacgtttactggaaactgccagtcccttctaaacagcatgggcagatccggggctaccaggtgacatatgttaggcttgagaacggtgagcctcgtggactacctataatccaggacgttatgcttgctgaggcccagtggcgaccagaagagtccgaagattacgaaaccaccatctctggacttacccctgagaccacatattcggttactgtggcagcatacacaactaagggtgatggcgccaggagcaaacctaagatcgtgaccaccactggagccgtccccggacgtcccactatgatgatctccacaactgccatgaataccgcactgctacaatggcatccgcctaaagaactgccgggggagcttctgggatatagattgcagtactgccgggctgacgaggcacggccaaatacaattgatttcggaaaggatgatcaacatttcacagtgactggcctacacaagggcacaacctacatctttcgactggccgccaaaaaccgcgctggactgggagaggagttcgaaaaggagatccgtactccagaagacctgccctccggctttccacagaacctacacgtgacaggtttaaccacatccaccactgagctcgcctgggaccctccagttctggcggaacggaatggtaggatcatcagctacaccgtcgtattcagggacattaattcgcagcaggagctgcagaatatcaccaccgataccaggttcaccctcactggactcaaaccagatactacttacgacatcaaagtcagagcctggacctcaaagggctccggcccactcagtccatcgatccaatcccggacaatgcctgtcgagcaagtgttcgctaagaatttccgcgtggcggctgctatgaagaccagtgtgttattatcgtgggaagtgccagattcctacaagagcgcggtgccattcaagatcctgtacaacggtcagtcagtggaagtcgacggccatagcatgagaaaattgattgccgatctgcagccgaatacagagtatagcttcgtgctgatgaataggggtagctccgcaggcggcctacagcatttggtcagcattcgaaccgcccctgatcttttgccccataagcctctgcctgcctcggcctacatcgaggacggaagattcgatctcagtatgccccatgttcaggacccgagtttagtccgctggttttacatcgttgttgttccgatcgatagggtcggcgggagcatgcttaccccgaggtggtccacaccggaagagctggagttagatgagctgttggaggcaatagaacagggcggagaggaacaaaggcgtcggcggagacaggccgaacgcctgaagccttatgtggccgcccagctggatgtactgcctgagactttcactctgggggacaaaaaaaattacagaggattctacaatagacccctgagtcctgacttgtcataccagtgtttcgtccttgccagccttaaagagccaatggaccagaaacgatacgcctcttccccttactctgacgaaatagttgtacaggtgacacctgcacaacagcaggaggagccagagatgctgtgggttacaggccccgtgttggctgtgatcctaataatattgatcgtgatagctatcttgctcttcaagagaaaacgaacacactcaccgtccagcaaggatgaacagtctattgggctcaaggactccctgctcgcccattcgtctgaccccgtggaaatgcggaggcttaactaccagactccaggtatgagagatcatcccccaatcccaattacagatttagctgacaacatcgagagattgaaggctaatgacggacttaagtttagtcaggaatatgaatccatcgatcctggccagcaatttacttgggagaattctaacctggaggtcaataagccgaagaataggtacgctaacgtcatcgcgtacgaccattcacgcgttattttaacttccattgacggcgtgcccggttctgactacattaacgccaattacattgacgggtatcgaaagcaaaatgcgtatattgccactcaagggcctctgcccgaaaccatgggggatttctggcgcatggtctgggaacagagaactgcgaccgtcgtgatgatgacacgcctcgaggaaaaaagcagagtaaaatgtgatcaatactggcccgcccgcgggacagaaacctgtggcctgatccaagtcaccctcttagacactgtcgagctggctacttacaccgtgcggacatttgctctgcacaagtccggcagtagtgaaaagcgggaattaaggcagttccagtttatggcgtggccagatcacggcgtgccagagtatccgactccgattctagcttttttgcggcgtgttaaagcatgcaacccactcgacgctggcccaatggtggtgcattgttccgctggagtgggccggaccggttgcttcatagtgatagatgcaatgctcgaacgaatgaagcacgagaagaccgtggacatttacggccatgtcacctgtatgcgctcgcagcgaaactacatggtgcagaccgaagatcagtacgtttttatacacgaggctctcctagaagccgccacatgcggacacaccgaggtgcccgcacgcaacctgtacgctcacatccaaaaactggggcaggttccccctggggagtccgtcacagctatggaattagaattcaaattgctcgcttcttccaaagcacatacttcccgctttatttccgctaacctaccctgtaataagttcaaaaaccgactggtgaacatcatgccgtacgagcttacccgagtatgtctgcagcccattcgtggagtcgaaggctccgattatatcaacgcctcttttctcgatggttacaggcaacaaaaggcctatatcgccactcagggacctcttgccgaatccacagaagatttctggcgtatgctttgggagcacaacagcaccatcatcgttatgctcactaaactgcgcgagatgggacgcgaaaagtgtcatcagtattggcccgccgagcggagtgctagatatcagtactttgttgtggacccgatggccgaatataacatgccgcagtacatcctgcgagaatttaaggtgactgatgctagagatgggcagtcaaggactatcagacagttccaattcaccgattggccagagcagggtgtgccgaagaccggcgaaggctttatcgatttcattggacaagtgcacaaaactaaagaacagttcggccaggacgggcctatcactgtgcattgctcagccggtgtcggtagaacaggagtattcatcaccctgagtatcgttctggagcggatgagatatgaaggcgttgtcgacatgttccagacagtgaagaccctgagaactcagaggcctgcaatggtgcagacagaagatcaataccagctctgttaccgggcagcactcgagtatctcggctcttttgatcattatgccacatag

SEQ ID NO: 201732 - DNA, 3801 bp, Artificial Sequence
  Description of Artificial Sequence: Synthetic coding sequence
atgtacgagctggtgtactgggccgccgaggacgaggaccagcagcacaaagtgacattcgatcccacatcctcctataccctggaagatctgaaacctgataccttgtatagatttcagctggctgcaagatctgatatgggagtgggagtatttacacccactatcgaagcaagaaccgctcaaagcatgccgtccgggcccccgaggaaggttgaggtggagcccctgaattcaacagcagtgcacgtgtattggaagttgcctgtgcccagcaagcaacacgggcagattaggggataccaggtgacctacgtgagactggagaacggggaaccacggggactgccgattattcaggatgttatgcttgcagaagcccaggagacaactatttccggactgacacccgaaaccacctactcagtcaccgtggccgcctacacaactaaaggggatggtgcaaggagcaaacccaagatcgttacaaccaccggcgccgtgccgggtagacctactatgatgatctcaacaaccgctatgaacaccgcccttttgcagtggcacccccctaaggagctgcctggcgagctgctcggctaccggctgcagtactgtagagcagacgaagcccgccccaacactatcgattttggaaaggacgatcagcatttcacggtcactggactgcacaaaggaaccacctacattttccggctagccgccaaaaatcgcgccggcttgggtgaggagttcgagaaagaaattagaactcctgaggacctccctagcggttttcctcagaacctgcacgtgacgggacttacgacaagtacaactgaactggcatgggaccctccagtcctggcagagaggaatggaaggatcatctcttacacggtagtcttcagagacattaatagccaacaagagctccagaacataactaccgatactcgattcacactcacaggtctcaagcctgacaccacgtacgacatcaaagtgcgcgcctggactagcaaaggctctggtccactttctccaagtatccagtctcggactatgccggttgagcaggtgtttgcaaagaattttcgtgtagccgctgcaatgaaaacgagcgtgttgcttagttgggaagtgcccgacagctacaagagtgcagttccgttcaagatcctttataacggtcagtccgtggaggtggacggacatagtatgcggaagttaatcgctgatctgcagccgaatacagagtatagtttcgtgctgatgaaccgcggatcttcagctgggggcctacagcatctggtcagcatcagaacggcgccagatttattgccccacaagccactgccagcaagtgcatatattgaagatggtagattcgatctgtcgatgcctcatgtgcaggatccttcgttggttaggtggttttacatcgtagtggtgccaatcgatcgggtggggggcagcatgctgactccgcggtggtccacgccggaggaattagagctcgacgaactgctggaggctattgagcagggaggagaagagcagcggcgaagaaggcgtcaggccgaacggctgaagccttacgttgctgcccagctcgatgtgctcccggaaacttttacgctgggggataaaaagaattatcgcggattttacaaccggcccctatcccctgacctctcttatcagtgtttcgtgctagcaagcttaaaggagcctatggaccaaaagaggtatgcttcttccccctattcagacgagattgtggtgcaggtgacaccggcgcagcaacaggaggaaccggagatgctctgggtaaccggccccgtactggcggttatactgattatccttattgtcatagcaatcctcctgtttaagaggaaaaggacccatagcccatcatcgaaggacgaacagagcattggactgaaagatagccttctggcccatagctctgaccccgtggaaatgaggaggctgaattatcagacacctggctcttctgtgcccagttgccctaatacctcttcaatgcgagatcacccgcctatccctatcactgacctcgcggacaatattgagcgtttgaaggcaaacgatggactgaagttctcacaggagtatgaaagcatagacccaggccagcagttcacatgggagaatagcaatttggaggtgaacaaaccaaagaatcgctacgcaaacgtcatagcttatgaccatagcagagtgatcctcacctcaatagacggagttccaggttcagattacatcaatgcaaattatatcgatggatacagaaagcagaacgcctacattgccactcagggaccattgcctgaaacaatgggcgacttctggcgcatggtgtgggagcagcggactgccactgttgtaatgatgaccaggttagaagagaagtccagagtcaaatgcgaccaatactggcctgccaggggcactgagacctgtggtttgatccaggtaactctactggatacggtcgagctggcaacgtacactgtgcgtacttttgcacttcacaagtcaggcagctcggaaaagagagaactacgccagtttcaattcatggcatggcctgatcacggcgtccccgagtaccccacccccatccttgccttcctgcgaagagtcaaagcctgcaatcccctggacgcgggcccaatggtggtccattgctctgctggggtggggcggacagggtgttttattgtcatagatgccatgctcgaaaggatgaaacatgaaaagactgtagatatctatgggcatgtgacctgtatgagatcccaacgcaactacatggtccagactgaagaccagtacgtgtttatccacgaggcactcttggaggcagcaacctgtggccacactgaggtgcctgcccgtaacttgtacgctcatatccaaaagctcggccaggtcccacctggggaaagtgtgacggctatggaacttgagtttaaactactggcaagtagtaaagctcataccagtaggtttatctcagctaatctgccgtgtaataagttcaaaaatagactagtcaacatcatgccttatgaactaacaagagtgtgcctgcaaccaatccgaggcgtggaggggtcagactatattaatgcaagtttcctggatggatatagacagcagaaagcatatattgccacgcaggggcctcttgcagagtccaccgaggacttctggagaatgttgtgggaacacaactcaacaatcattgtgatgctcaccaaactacgcgagatgggacgtgagaagtgtcatcagtactggccagccgaacgctcagcccggtaccagtactttgtggttgatcccatggccgaatacaatatgcctcagtacattctgagggagtttaaagtaacagacgctcgggacggtcagagcaggaccattcgacaattccagtttaccgattggcccgaacagggtgtccctaaaacaggcgaggggttcatcgactttatcggccaggtccacaaaacaaaagaacaattcgggcaggacggccccataaccgtgcactgcagcgccggcgtagggcgcaccggcgtcttcattactctgagcattgtcctggagcgtatgcgctacgagggcgtggtggatatgttccagacagtgaaaactctgcggactcagcgaccggccatggtgcagacggaggaccagtaccagttgtgctaccgggctgccttggagtatttgggctcattcgatcactatgctacttag

SEQ ID NO: 201733 - DNA, 5697 bp, Artificial Sequence
  Description of Artificial Sequence: Synthetic coding sequence
atggcccccgagcccgcccccggccggaccatggtgcccctggtgccagctctcgtaatgctggggctggtggctggggcacacggcgattccaagccagtgttcatcaaagtgccagaagaccagacaggattgtccggaggcgtggcgtcctttgtctgtcaggctacaggcgaaccaaagccgcggatcacatggatgaagaagggcaagaaagtaagctctcaaaggtttgaagtgatcgagttcgacgacggtgccgggagcgtcctccgcattcaaccactgagagtccagcgcgatgaagctatctacgagtgcacagcaacaaattccctgggcgaaatcaatacatccgctaaactcagcgtgcttgaagaggaacagttgccacctggcttccccagtattgacatgggaccccaactgaaggtggtcgaaaaggcccgaactgctacaatgctgtgcgctgccggcggaaatccagacccagagatctcatggttcaaagattttttgcctgtggaccccgcaacgtcaaatgggcgaattaagcaacttaggagcggcgctctgcagatcgagagcagtgaggaaagtgatcaggggaaatatgaatgtgttgcaaccaatagcgccgggactagatatagcgctccagccaacttgtatgtgagggtgcggcgcgtggccccacggttctccatccctccctcgagtcaagaggttatgcctggaggcagtgtgaatctcacatgtgtagccgtcggagcaccaatgccttatgtgaaatggatgatgggcgctgaagagctcactaaggaggatgagatgcccgtgggccggaacgtccttgagctgtcaaatgtcgtgaggtccgccaactacacctgtgtcgctatttctagcttaggtatgattgaagctactgcgcaagtgactgttaaggcacttcctaagccgccaatcgatctcgtcgtcactgaaactactgctactagcgtgaccctcacttgggactccggtaactccgaaccagtgacctattacggaattcaatacagagctgcagggacagagggccctttccaggaagtggacggcgtggctaccacccgctactcaataggcggactgtctccgttctctgagtacgcctttcgagtgttggcagttaatagcatcgggcgcgggcccccaagtgaagctgtgcgggctcggaccggggaacaggctccttcttccccccctaggcgggttcaggcacggatgctgtcagcttctacgatgttggtgcaatgggagcctccggaggagcctaatggactcgtgcgcgggtacagagtttattatacccccgacagccgcaggcctcctaatgcatggcacaagcataacactgatgccggtttgctgaccactgtgggttctctcctgccagggatcacatatagtctgcgagtcctggcctttacggctgtgggggacgggccccccagccccacaatccaggtgaagacccagcagggagttccagcccagcctgctgattttcaagcagaagtcgaatccgatacccgtatccagctgtcatggttgctccccccccaggagagaatcatcatgtacgaactggtgtactgggccgctgaggatgaagatcagcagcataaggtcacctttgacccgacgtctagctatacgctagaagatttgaagcccgacacattatatcggtttcaactagcagcccgtagcgacatgggcgtgggggtattcacacccaccatagaggcgcggacagcccaatccacccctagcgcgcccccccaaaaagtaatgtgtgtctccatgggcagtactactgtgcgcgtgtcttgggttcccccacccgctgactccaggaatggcgtaataacacagtatagtgtcgcatatgaggccgtagacggggaggaccgcggccggcacgtggtcgacgggattagtagagaacattccagctgggatctcgtgggcctggagaagtggacggaatatagggtgtgggtgcgggcccataccgacgtgggacccggaccagagtcatcacctgtcctggtccgcactgatgaagatgtgccctccggaccccctagaaaggtcgaggtggagccacttaacagcaccgcggtgcacgtgtactggaagcttccggtacccagtaagcagcacggacaaattagagggtaccaagtgacttacgtccggctggagaacggtgagcctagagggcttcccattatccaagacgtaatgttagctgaggcccaagaaacaactatctccgggctaacaccagaaacaacctattctgttacggtggcagcctacacaacaaagggggacggggcgcggtcgaagccaaaaattgtgacaaccactggtgctgtacccggccgtcccaccatgatgataagtaccaccgcaatgaacacggccctgctgcagtggcatccgcctaaagagctccctggtgaactgctgggctaccgtttgcagtattgcagagcagacgaggcaaggcctaacaccatagatttcggcaaggatgatcagcactttacggtgacgggattacacaagggcacaacctacatatttagattggccgccaagaacagggcggggctgggagaggaatttgagaaagagattcgaacacccgaggacctaccctccggcttcccacaaaacctgcacgtgacaggtctcactacaagtacaacagagctggcctgggaccccccagtcctcgccgaacgtaacggacgtatcatttcatatactgtagtgtttagggatatcaacagccaacaagaacttcagaatatcaccaccgatacccgcttcaccctgactggcctgaagcctgacaccacatacgatataaaggtgcgagcgtggacctccaaggggtctggcccactgtcgccttcaatacagtctcgaactatgcctgttgaacaggtttttgccaagaattttagagttgccgccgccatgaaaacctctgtgttgcttagctgggaggtccctgactcatacaagtctgctgttccattcaagatcctctataacggccaatctgtggaagtggacggtcactccatgcgtaaactcatcgccgaccttcaacccaatacagagtactctttcgttcttatgaaccgaggatcttccgccggaggcctgcagcacttggtatctatcaggacagcccctgacttgctcccacataaaccactccctgcttccgcttacatagaggatggacggtttgacctgagcatgccacacgtacaagatcctagccttgtacgatggttctatatagtggtagtgccgatcgacagggtgggcggcagcatgttgacgcctaggtggtccactcctgaggaactcgagctggatgaattgttggaagcaatcgaacagggaggagaagagcaaagacggagacgccgtcaggcagagaggctcaaaccttacgtggccgcccagttagatgttctccccgaaacatttactctgggcgacaagaagaactaccgtggcttctataataggccactatcgcctgacctgagttaccagtgtttcgttctggcctcgttgaaggagcctatggaccagaagcgctacgcctcttccccctattcagatgaaatagtggtgcaagtgacacctgcccaacagcaggaggagcccgagatgctgtgggttacaggacccgtgctggccgttattctgatcatactcatagtaattgccatcctcctattcaagcgcaagagaacccactccccatcgagcaaggacgagcagtccatcgggttgaaagactctctcctcgctcactccagcgacccagtggagatgaggagactaaattaccagacccccgggatgcgcgaccacccaccaatcccaataaccgatcttgccgacaacatcgaacggctgaaagccaatgacggtctgaaattctcccaagaatatgaatctatcgaccctggtcagcagtttacctgggagaattctaatctggaagtgaacaaaccaaagaacagatacgcaaatgttatcgcctatgaccacagtcgggtaattctgaccagtattgatggcgtgcctggctccgactatatcaatgctaactacatcgatggatataggaaacagaacgcctacatcgctactcagggcccgctgcccgaaacaatgggagacttctggaggatggtgtgggagcagcgaacagcaaccgttgtgatgatgacacgtctggaggagaagagtagagtgaagtgtgaccagtattggcctgcgcgcggtacagagacatgcggcctgatccaggtgacactgctcgacacagtcgaactggccacgtacaccgtccggaccttcgctttgcacaaaagtgggtcctcagagaagcgggagctccgacagtttcaatttatggcttggcccgaccatggagtgcccgagtaccctacaccaatattagccttcctgcggcgtgtcaaggcatgcaatcctctggatgctggccccatggtggtccactgctctgccggagtgggtcgaactggttgctttatagtaattgacgccatgcttgagcgcatgaagcatgagaaaactgttgacatttacggtcacgtgacatgtatgcgctctcagcggaactatatggttcagactgaagaccaatacgtattcatacacgaggccctcctggaggccgcgacatgcggccacactgaagtgcctgcacgaaacctttatgctcacatacagaagttgggccaggtgccgcccggcgagtccgtcaccgctatggaattggaatttaagttgctcgcatcctccaaggctcatacctcccggtttatttctgccaacctgccttgcaacaagtttaaaaacagactcgtgaacataatgccatatgagttgacccgggtctgcctgcagccaatccggggcgtagaagggtctgactacattaacgctagctttcttgatggttacagacaacagaaggcctatatcgccacgcaaggaccgcttgctgagagcactgaggatttctggcgaatgctgtgggagcacaacagcacaatcatcgtcatgctgacaaagctcagagagatgggaagggagaagtgccaccagtattggccggcagaacggtctgcaagataccagtatttcgttgtcgatcccatggctgagtacaacatgccccagtacattctaagagagtttaaggttacagacgctcgtgacggccagtctcggacaatccgacagtttcagttcacggattggcccgagcaaggggtccccaagactggagaggggtttattgactttataggacaggtgcataagaccaaagagcagttcggccaggatggccccatcactgtgcactgcagcgccggagtgggtcgcacaggggtattcatcacgctgtctatagtgctggagcgaatgagatacgagggagtcgttgacatgttccagactgttaagaccctcagaactcagcgccccgccatggtccagacagaggatcaatatcagctgtgctacagggccgccctcgagtaccttggttccttcgatcactacgcgacatag

SEQ ID NO: 201734 - DNA, 3609 bp, Artificial Sequence
  Description of Artificial Sequence: Synthetic coding sequence
atgatgtgcgaggtgatgcccaccatcagcgaggccgagggcccccccgggggcgggggcggccacgggtccggctctccgtcccagccggatgcagatagccactttgagcagttgatggtgtctatgctggaggagagggataggctgcttgacacacttagagagactcaagagaccctggccctgacacaggggaagctgcatgaggtcggccatgagagggacagcctgcagcggcaactaaatacagccctgccacaggagttcgctgcactgaccaaggagctgaatgtgtgcagagagcagctgctagagagggaggaggagatcgccgagttgaaggccgaacggaataatacaagactcctccttgaacatctggaatgcctggtgtctcggcatgagcgcagtcttaggatgacagtcgtgaaaaggcaagcacagagtccagcgggtgtgagttctgaggtcgaagttctgaaagccctaaagagtctcttcgagcaccacaaggccctggatgaaaaggtaagggaacggcttagagtggccttggaacgatgcagcctcctcgaggaggagctcggagctacccataaagagttgatgattctcaaggagcagaacaaccaaaagaaaacccttaccgatggcgtcctggacattaatcatgagcaggagaatactccttcaacttcagggaaaagatcgagtgacggctctttgtcacatgaggaagatctggctaaagtcatcgaattacaagaaatcatcagtaagcagtctcgtgagcagagtcaaatgaaggagcgcctggcttctctttcttcccacgttacggagctggaggaggatcttgataccgccagaaaagacctgatcaagtccgaggaaatgaacacaaaattgcaacgagacgtgcgggaggcgatggcccagaaagaggatatggaggaacgcatcacaactctggagaaaagatatttggctgcacagcgtgaggccactagcgtgcacgacttgaatgataaacttgaaaacgaaatagcgaacaaagactccatgcatagacagaccgaagacaagaatagacaactccaggagcgtttagaactcgcagaacagaagctccaacagacgttgcggaaggcagaaacccttcctgaggtggaggccgagcttgcacagagagttgctgcactctcaaaggcagaagagaggcacggcaacatcgaggagcggcttagacagatggaggcccagctggaagaaaagaaccaggagttacagcgggccaggcagcgagagaagatgaatgaggagcataacaagcgtctatcagataccgttgacaagctgctctccgaatccaacgagcggctacagcttcacttaaaagaaagaatggccgctctcgaagacaagaattcgctgctgcgagaggttgagtcggcaaaaaagcagttagaggaaactcagcacgacaaagaccagctggtacttaacatagaggcactgcgggccgagctggaccacatgcgcctgcgcggggctagcctccaccacggtcgcccacacttaggctctgtaccggactttagattccctatggcagacggtcatacggacagttactccacatcagcagtgcttaggagacctcagaagggcagattggcagctttgcgcgatgaaccgtcaaaggtacagacactgaatgagcaggattgggagcgagctcagcaggctagtgtgctggccaatgtggcccaagcctttgaatctgacgctgatgttagtgatggggaggacgatcgtgacaccctcctgagctccgttgatctcctcagtccttccggacaggccgatgctcatacattggcaatgatgctacaggaacaactggatgctataaataaggagatccgcctcatacaagaagagaaagaaaatacggaacagcgggctgaggaaattgaatctcgggtgggatccggaagtctggacaatctgggaaggttccgatcgatgtcttctatacctccctacccagcttccagcttggccagcagctctccccccggatctggaagaagtacccccagacggataccccacagtccagcccgcgaagtagaccggctgggggtgatgacactgctccctcctagcagagaagaggtcagggacgataaaactaccatcaagtgtgagacctcgcccccaagtagcccccgcgccctccgattggacaggctgcacaaaggtgcgctgcacacagtctcacatgaagacatcagggacatccggaactcgacaggcagtcaggacggaccagtttctaaccctagttctagcaactcgtcccaggactctcttcataaggcccctaagaagaagggcatcaagtcttccattggtaggctgttcggtaagaaagagaaaggcaggcctgggcagaccgggaaggaagcactgggccaggccggcgtctccgagaccgacaacagctctcaggatgcactgggcctctcgaaactggggggtcaggctgagaaaaacagaaaattgcagaaaaagcatgagctcctggaagaagctagaagacagggcttgccgtttgcccagtgggacgggcccactgtggttgtctggctcgagctgtgggtgggtatgcccgcctggtatgtggccgcctgtagagccaacgtaaagtcaggagctatcatgtccgcattatccgatacagaaattcagagggagatcggtattagcaatccgctccacaggcttaaacttaggctagcaatacaagaaatcatgtccctgacgtccccgtccgccccgcctacgagccgcaccactttggcttacggggacatgaaccatgaatggatcggtaacgaatggctgccgagccttggtttgccacagtaccgatcatacttcatggagtgtttagtggatgcccgaatgctggatcacctgactaagaaggatctgcgcggacagcttaaaatggttgacagtttccaccgcaactcctttcagtgcggcattatgtgtctgaggcgactgaattacgaccgcaaagaactcgagcgaaagcgagaagagtcgcaaagtgaaatcaaagacgtgctggtgtggagtaacgaccgggtcatacgctggatcctctctatcggcctgaaggagtacgccaacaacctgattgagtctggggtgcacggtgccttgttagctctagatgagacctttgactttagtgcgctagcattgctactccaaatcccaactcagaacactcaggcccgagcagttctcgaaagggagttcaataacctgctggtaatgggcacagatcggagattcgacgaagatgatgacaagtcatttaggcgggctccctcctggcggaaaaaattcagacccaaggacatccgaggtctggctgctgggagcgctgaaacacttcccgctaacttccgggttaccagctcgatgtctagtccgtctatgcagcccaaaaagatgcagatggatggaaatgttagtggcacacagaggctggattcggccacagtgaggacatattcttgctag

SEQ ID NO: 201735 - DNA, 3558 bp, Artificial Sequence
  Description of Artificial Sequence: Synthetic coding sequence
atgatgtgcgaggtgatgcccaccatcagcgaggccgagggccccccaggaggaggcgggggacatggaagcgggtcaccgagtcagcccgatgctgactcccatttcgaacaactgatggtctccatgctagaggagagagatcggctgctggacacccttagagaaacacaggagacactggccctgacgcagggcaaacttcacgaagtgggccatgaacgcgacagcctccagcggcaactcaataccgctcttcctcaggagtttgccgccctcactaaagagctgaacgtttgtcgggagcagctcctggagcgcgaagaggagattgccgaactgaaagccgagaggaacaacacacgtcttttgcttgagcacttggagtgccttgtctctcggcatgagcgctccctgagaatgactgtcgtcaagagacaggcccaatccccagctggcgtaagctctgaggtggaagtcctgaaagctcttaaaagcctttttgaacatcataaggccctcgatgagaaagttcgtgagagactaagagtggcactggagagatgctcccttctcgaggaagaacttggcgctacacataaggaactgatgatcttgaaagaacagaataaccaaaaaaagacactgacagatggagtgcttgatattaatcacgaacaggaaaacacgcccagcacctctggcaaaaggtccagcgacggatccctgtctcatgaggaggatctggccaaggtgattgaactgcaggaaattatcagcaaacagagccgggagcaatcccaaatgaaagaaaggttggccagcctatcaagccatgtgacagagctggaggaagatctggatacagctaggaaggacctgatcaagtctgaggaaatgaacaccaaactgcaaagggatgtgcgcgaggctatggcacaaaaagaagatatggaagaaaggattacaacactggagaaacgttacctagcggctcaaagggaggcaacctccgtgcacgatttaaatgacaaactggagaatgagatcgcaaacaaagattctatgcacaggcaaaccgaagataaaaatcgccagttgcaggagcgattggagctggcagagcagaaactgcaacaaactctccgtaaggcggaaacactgccggaggtggaggccgaattagcccagagagtcgcggcattgtccaaggccgaagaacgacacggaaacatcgaggagcggttacggcagatggaggctcaactggaagagaagaatcaggagctgcagcgcgccagacagcgagagaaaatgaatgaggagcacaacaaaaggctttctgacaccgtggataagcttctttcggaaagcaatgagcggctgcagctgcaccttaaggagagaatggccgccctcgaggataagaactcactgctccgggaggtggaatcagcaaagaaacagttagaagagacacagcatgacaaagatcaactggtgctgaacattgaggcccttcgggccgaattagaccacatgcgcctccgtggagcatcactccatcatgggcggccccatctaggatctgtccctgactttcgtttcccaatggccgatggccatacagatagctactcgacctctgccgtcctgcggcgccctcagaagggacgacttgctgccctaagagacgagccatcaaaggttcagacacttaatgagcaggattgggagagagcacagcaggcttcagtgttggccaatgtcgcccaggccttcgagtccgacgctgatgttagcgatggagaagatgatagagataccttgctgtcttcagtggacctgttgagcccaagcggtcaggccgacgctcatactctggccatgatgttgcaggagcaactggatgcaattaacaaagaaatcaggctcatacaggaagagaaagaaaacaccgagcaacgagccgaggagatcgagagccgggttggctcagggagcctcgataatttgggcaggttccgatctatgagttcaatccccccatatcctgccagcagtcttgcctcttcatcgcctcctggatccggacgaagcacacccagaaggatcccacactcccctgcacgggaggtggatcgtttgggtgttatgacactgctcccccctagccgggaagaggtgcgagatgacaaaacgaccatcaaatgcgagacgagcccgccctctagcccaagagctcttagattggaccgactgcacaaaggggcactgcatactgtgtcacacgaggatatccgggacattagaaacagcaccggctcacaggacgggcccgtgtcaaacccttcctcatctaattcctcccaggacagcttgcataaggcccctaagaaaaagggcataaagagctcaatagggaggctatttggtaaaaaggaaaaaggcagaccggggcagaccgggaaagaagcactagggcaagcgggggtgagcgaaactgacaacagcagccaggatgcactgggcctcagtaaactgggcggccaggccgagaagaatagaaaattgcagaaaaagcatgaactactcgaggaggccaggcgccagggcttaccctttgcccagtgggacgggccgaccgtagtggtgtggctggagctgtgggtggggatgcctgcatggtatgtcgcagcttgcagagctaacgtcaagtccggggccatcatgtcagccctgtccgatactgaaattcagcgggagattggtattagcaacccactccatcgcctcaagttgaggctggctatacaggaaatcatgtctttaacctctccgtctgctccgcctacaagccgcacaaccctggcttatggcgacatgaatcatgagtggataggtaatgagtggctccccagcctgggcctgccccaataccggtcatattttatggagtgcctggtggatgctcggatgctcgaccatcttaccaaaaaagacctgcgggggcagctgaagatggttgactctttccaccgtaactccttccagtgcgggattatgtgtctaaggcggctcaactatgacaggaaggagctggagcggaaacgggaggagtcacaatctgagattaaggacgtcctggtgtggagcaacgacagagtgatccgctggatcctgtcgattggcttaaaggaatatgccaataacctgatcgaatctggggtacacggggccctgctggctcttgacgagacttttgatttcagtgcattagcactgctcctgcaaatccccacacagaacactcaagctagggcggtcctggaaagagagttcaataacttgttagtcatgggaaccgaccgtcggttcgacgaagacgacgataaatcatttagacgggcccccagctggcggaagaaattccgaccgaaggacatccgaggactcgccgcggggtcggcagaaactttgccagccaattttcgtgtgacctctagtatgtcttcaccgagcatgcagcccaaaaagatgcagatggacggcatgtag

SEQ ID NO: 201736 - DNA, 477 bp, Artificial Sequence
  Description of Artificial Sequence: Synthetic coding sequence
atgatgtgcgaggtgatgcccaccatcagcgaggccgagggccccccgggaggtgggggcggacatggcagcggcagtcctagccagcctgacgcagattctcacttcgagcagctgatggtgtcaatgctggaggaaagggaccgtttgttggatacgttgagggaaacacaggagacattggcgttgactcagggtaagctccacgaggtgggccacgaaagagatagtctgcagagacagctcaacacggctctgccccaggaattcgctgctctgactaaagagctgaacgtatgccgcgaacagctgctggagagggaagaggagatagctgagctaaaggccgagcggaacaacacgcggctattactcgagcacctggaatgtctcgtcagtcgccacgagcgctctctgcgcatgaccgtagttaagaggcaggctcagtcacccgccggagttagcagcgaggtttag

SEQ ID NO: 201737 - DNA, 300 bp, Artificial Sequence
  Description of Artificial Sequence: Synthetic coding sequence
atgatgtgcgaggtgatgcccaccatcagcgaggccgagggccccccaggcgggggtggcggacacggcagcgggtctccatctcagccagatgcggactctcatttcgagcaattaatggtctccatgcttgaagagcgggacagacttctggacacactccgtgagactcaggaaactttggcactcacacagggcaaactccacgaggttggacacgaacgggattcactgcagcggcagctcaacacagctctaccacaggagtttgccgcattaacaaaagagctgaacgtgtag

SEQ ID NO: 201738 - DNA, 2100 bp, Artificial Sequence
  Description of Artificial Sequence: Synthetic coding sequence
atgcggctgcggggcgccagcctgcaccacggccggccccacctggggagcgtccccgatttccgctttcctatggccgacggtcacacagactcttattcaaccagcgccgtcctgcgaagaccccagaagggcagactcgccgcacttcgcgacgagccaagtaaagtgcaaaccttgaacgagcaggactgggagagagcacagcaggccagcgtgctggctaacgtggcccaggctttcgaatccgacgctgacgtgtccgacggcgaagacgatcgtgacactttattaagttccgtggacctgctgagcccctcaggccaggctgacgcccataccctggccatgatgctccaggaacaactggacgccatcaataaggaaatccgccttattcaggaagaaaaggagaatacagagcagcgggcagaagaaattgaatccagggttggtagcggttccttggataatctggggaggtttcggagcatgtcatcaattccaccttaccctgcttcttcattagcctcttcttcacctcccggatcagggaggagcaccccacgccgcattccacattccccggctcgcgaggtggaccgcctcggggtcatgaccctgccttccgaccttagaaaacaccggcggaagttgcctccatccagggaagaagttcgcgatgacaagactaccatcaagtgcgagactagtcctccatcctctcccagggccctgcggctcgatcggctgcacaagggagccctgcacaccgtttcccatgaggatattagagatatccggaatagtacaggatcccaggacgggcctgtgtccaatccctcaagttccaacagttcccaagatagtctccacaaggctccaaaaaagaaaggaattaagtcaagcattggaagattgtttggtaaaaaggaaaaaggccggccaggacagacaggcaaagaggcacttgggcaggcaggagtctctgaaactgacaatagctcccaggatgcattggggttgtcgaaactcggcggtcaagcagagaaaaatcggaaactccagaaaaagcacgagctcttagaggaagctaggaggcaaggactcccatttgcgcagtgggatggacccactgtggtggtttggttggagctgtgggtcggcatgcctgcctggtacgtggccgcatgtcgggccaacgtgaaatctggggccattatgtcggctctgtccgacacagaaatccagcgcgaaattggcatctctaatcctttacatagactgaagctgcgccttgcgatacaggaaataatgagcctgacatccccgtccgccccacctacttccaggaccaccttggcttatggagatatgaatcatgaatggatcggcaacgagtggctgcccagcctgggtcttccccagtaccggtcatacttcatggaatgcctggtggacgcccgaatgcttgaccaccttacaaagaaagacctgcgtggacagctgaaaatggtggatagtttccacagaaattcttttcagtgtggtattatgtgcctgagacggctcaattatgacaggaaagaactggagcgtaaacgagaggaaagccagtctgagatcaaagatgtacttgtgtggagcaatgatagagtaataaggtggatactaagcattgggctaaaggaatacgccaataacctcatcgagtctggtgtgcatggtgccctgttagcccttgatgagaccttcgatttctctgctctggcgctccttctgcaaatcccaacacaaaacacccaggccagggcagtgcttgaacgcgagttcaataaccttctcgtcatgggcaccgacagacggtttgatgaggacgatgacaaatcttttaggcgcgcgcctagctggcggaagaaattcaggccgaaagacatccgaggccttgcagcgggctccgctgaaactctgcctgctaactttagggtgacgagctctatgtctagtccatccatgcaacccaaaaagatgcaaatggatggaaacgttagtggtactcaacgattagactcggccaccgtgaggacgtactcatgctag

SEQ ID NO: 201739 - DNA, 3585 bp, Artificial Sequence
  Description of Artificial Sequence: Synthetic coding sequence
atgatgtgcgaggtgatgcccaccatcagcgaggacggccggcgggggtccgcacttggccccgatgaggccggtggagagttagagagactgatggtcactatgctcactgaaagagaaagactacttgagaccttacgcgaggctcaggacggcctagccacggcccagctcaggctgagggagctgggacatgaaaaagacagcctgcagcggcagctttctattgctctgccgcaggaattcgcagctttaaccaaggaacttaacctctgtcgcgagcagctactcgagagggaagaagaaatagccgaactcaaggctgagagaaacaacacccgtctcttgctagaacacctcgaatgtttggtgtctcggcatgagcggagtttgcggatgaccgtggtgaaaagacaggctcagtcacccgggggcgtgtcttcggaagtggaagtgctgaaggccctgaaatccctgtttgagcatcataaggctctggacgaaaaagtgagagagcgccttcgtatggccttggagcgagttgccgttcttgaagaagaactagaactgtccaatcaggaaactctcaatcttcgggaacagctcagcagacggaggtcaggtctggaggagcccggcaaagatggggacggacagacccttgcaaatggcctgggacccggcggcgatagcaatcggcgcaccgcagaacttgaggaggccctggagcggcaacgggcagaagtctgccagttgcgcgaacgcctggctgtcttgtgcagacagatgagtcagctggaagaagaactcgggaccgctcatcgagaactcggcaaggccgaggaggcaaactctaagctgcagcgagacctcaaagaagcacttgcccagcgcgaagacatggaggaaaggattacgacactagaaaagcggtacctcagcgcacaaagggaagcaaccagtttgcacgatgctaacgataagctggagaacgagctcgcgtctaaggagagtctgtaccggcagtctgaggagaagtctagacagcttgcagagtggctggatgacgctaagcaaaaactgcagcagacactccagaaggctgagacattgcctgagattgaggcccagctcgcccaacgcgtagccgcgctgaacaaggcagaggaaagacatggcaattttgaagagcggctcagacagctggaagcccagttggaggagaagaaccaagaactccaacgagcgaggcagagggaaaagatgaatgacgaccataacaagcgtctgtccgaaaccgtggataaactactgtcggagtccaatgagaggctgcaattgcatctgaaggaacgcatgggagcactggaagagaaaaacagcctcagtgaggaaattgccaatatgaagaaactgcaagatgagctactgttaaataaggaacagttgttggccgaaatggagcgaatgcagatggaaattgatcaattacgaggacgtcccccttcaagctactcgagatctctgcctggaagtgccctggaactgcggtattcccaggcccccaccctgcccagcggtgcacacctggatccgtacgtcgctggcagcgggcgtgccgggaaacgcggaagatggtcaggtgtcaaggaggagcccagcaaggactgggagcgctcagcaccagccggctccataccaccccccttccctggtgagctggatgggtctgacgaggaagaggccgaaggcatgtttggagccgagctgctgagtccatcaggccaggccgacgtccagaccctggcgattatgctgcaggagcaattggaagccataaataaggagattaagctaattcaggaggaaaaagaaacgaccgaacagcgcgccgaggagctggaatcgcgggtgtccagcagcgggctggattcactcgggaggtatcggtcctcttgttcattgccacctagcctgaccaccagtactctcgcaagcccctccccacctagcagcggacacagcacccccagattggctccccccagccccgcaagagaagggactgataaagccaatcatgtcccaaaggaggaggcaggggcccctcgtggtgagggacccgcgatcccaggcgacacacctccccctacacctaggagcgcccgtctggagaggatgacgcaagccctcgcgttgcaggcagggtcgctggaggatgggggccctccgaggggcagcgaaggaaccccagactctctgcacaaggcccccaagaagaagtcaatcaaatcttctattggaaggctgttcggaaaaaaagaaaagggacgaatgggtccccctggaagggatagttcatccttagcaggaaccccttcagacgaaaccctggctaccgaccctttggggctggcgaaacttaccggccccggtgataaggaccgccgtaataagcgcaaacatgaactgctggaggaagcttgccggcaagggcttcccttcgccgcctgggacggccctacagtagtctcatggctcgagctctgggtgggcatgccggcatggtatgtagctgcttgtagagcaaacgtgaagagtggtgcaattatggccaatttgtctgatacagaaatccaacgggagataggaatctcaaatccccttcataggttgaaactgcggcttgccattcaggagatggtgtcactcaccagccccagcgcccccgcttcttcacgcactagcactggaaatgtgtggatgacgcacgaagaaatggagagcctgaccgcgaccaccaagccagagactaaagaaatatcttgggaacagattctggcctatggggatatgaaccacgaatgggtgggcaacgattggctgcctagcctcggccttccacagtatcgatcgtattttatggagagtttggtcgatgcccggatgctggaccacttaaacaagaaggagctccggggccagctgaagatggtggacagcttccacagagtctccctgcactacggaattatgtgtctcaagcgcctgaactacgacagaaaggacctggaaagacgcagggaagaatcacagacccagatcagagacgtgatggtttggagtaacgagcgcgttatgggttgggttagcggactcggcctgaaggaattcgccactaacctgactgagagtggcgttcatggggccctcctggccttggacgagaccttcgattatagtgatctcgcactgcttctacaaatccccacccagaatgctcaggctcgccagttgctggaaaaggaatttagtaatttgatctccttgggcacagataggagacttgatgaagactcagcgaagtcattttctcgcagcccgtcatggaggaagatgttcagggagaaagatctgcgtggcgtgaccccagacagtgccgaaatgctgccgcctaatttccggtccgccgccgccggggccctgggcagtccgggcctgcctctacggaaattacaacctgaggggcagacttccgggagctcaagagcggacggtgtgtcagtacggacatactcttgttag

SEQ ID NO: 201740 - DNA, 1731 bp, Artificial Sequence
  Description of Artificial Sequence: Synthetic coding sequence
atgagcggccaggagttcgccgccctgaccaaggagctgaacctgtgcagagagcagttgctggaacgcgaagaggaaatcgccgagctcaaggctgagcggaacaacaccagattgctgctcgagcatctggagtgcttggtctcacgccatgagcgcagcctgcggatgaccgtcgttaagcgccaggcccagagccccggaggtgtgtcctcggaggtggaggtgctgaaggctctgaaatccctgtttgaacaccataaggccctcgatgagaaagttcgcgagagactgcgcatggcactcgagcgcgtggcagtgctggaggaggaattggagctatctaaccaggagacattaaacttgcgggaacaattatctcgtcgtcgctctggcctcgaggagcccgggaaagacggcgatgggcagaccttggcaaacggcctgggccccggcggcgacagcaaccggcgcactgctgagctcgaggaggcactggagcggcaaagggctgaagtgtgccagctccgtgagcgtctcgcggttctgtgcaggcaaatgtcgcagttggaagaggaactcggtacagctcaccgcgaactgggcaaagcagaagaggccaatagtaagttgcagagggatctgaaggaggcacttgctcaacgcgaagacatggaggagcggatcacgaccctcgaaaaaaggtatttgtctgcccagagggaggctacctcactgcacgatgccaatgataagcttgaaaacgagttggcctctaaagagagcttatatagacaatcagaagagaagtccaggcagcttgcagagtggctggatgatgcgaaacaaaagctgcagcagaccctccagaaggccgagaccctacctgaaatcgaggcacagctggctcagcgggtggcagctctcaacaaggccgaagagaggcatggaaactttgaagaacggctcagacagcttgaggcccagctggaggagaagaatcaagaactccagagggcaaggcagagggagaaaatgaatgatgaccacaataaaaggttatctgagactgtggacaagctactgagcgaatcaaatgaaaggctccaacttcacctgaaagagcgcatgggtgcccttgaggagaagaattccctatccgaagagatcgccaatatgaagaagttgcaggacgagctcttacttaacaaggaacaattgctcgctgaaatggagcggatgcagatggagatagaccagctcaggggcaggcctccttcttcctatagccggagccttccggggagtgcactggagctgaggtacagccaggcccctacactgccaagcggcgcccacctcgacccttacgtggcaggatccggacgggcgggtaaaaggggaagatggagtggcgtgaaagaggaaccatctaaagattgggagcggtccgcaccagcaggatcgattccaccaccgtttccgggcgagctggatggaagtgacgaggaggaagcagaaggtatgtttggcgcagagctcttatctcctagtggacaggccgatgtgcaaactctggcaattatgttgcaagaacagttggaagcaatcaataaagagattaaaatcatgagccttcggagaaaactggaacttcatgagggtagaggtcgacctagtcaagagaccccacaccaccccctccccgccttgcccgtgctgagagaatag

SEQ ID NO: 201741 - DNA, 4338 bp, Artificial Sequence
  Description of Artificial Sequence: Synthetic coding sequence
atgcggcggctgctggagccctgctggtggatcctgttcctgaagattacatcgtctgtgttgcactacgtggtgtgctttcctgcactgacagagggttacgtcggtgccctgcacgaaaacagacacggcagtgcggtccagattagacgtaggaaggcctctggcgacccctattgggcctacagcggagcatatgggcctgagcattgggtgacaagctccgtctcctgcggaggacgccatcaatccccgatcgacattcttgaccagtatgcaagggtaggcgaagaataccaggaactgcagctggatggcttcgacaatgaatcatcaaacaagacctggatgaaaaatacagggaaaactgtggcaatcttgctcaaggatgactacttcgtatctggcgcaggactgccaggacggtttaaggccgagaaagtagaattccactggggccattccaacggcagtgctgggagtgagcactcaatcaacggacggcggtttcctgtggaaatgcagatcttcttctacaatccagacgatttcgactctttccagacagccatcagcgagaatagaattatcggtgccatggctatattttttcaggttagtcccagagataattcagcattggatccgatcatacacggtctgaagggagtggtgcatcacgagaaggaaacctttctggaccctttcgtccttcgcgatctgctgcctgcgtctctgggaagctactataggtacaccggttcactcactacccctccctgcagtgagatcgtagagtggatcgtctttcggagaccggtgcccattagctatcaccagttggaggccttttactcgatctttacgacagaacaacaagaccacgtcaagtctgttgaatatctgagaaataactttcggccacaacagaggctgcacgatcgcgtggtgtcgaaatcggctgtccgtgactcatggaatcacgacatgaccgactttctagagaacccactaggcacagaggcgtcaaaagtgtgtagttctcctcccatccatatgaaggtgcagccattgaaccaaaccgcattacaagttagctggtcccagccagagactatataccaccctcccatcatgaattatatgatatcctacagttggacaaaaaacgaggatgagaaggagaagacttttacgaaagactctgataaggatctcaaggctacaatttcacatgttagccctgattccctctatctgttccgtgtgcaggccgtctgtagaaacgacatgcgatccgatttttcacagaccatgctatttcaagcaaatacgacacgtatttttcaaggtacaaggattgttaaaacaggcgttcctactgcgagccctgccagttcggccgacatggcgcccatcagctctgggtcttccacctggactagctctggtatccctttctcctttgtgagtatggccacaggcatggggccttcgagtagcggttcgcaggcaactgtggcaagcgtcgtgacctccactctgttggctggtctgggattcggtggtggcgggattagcagttttccgtcgaccgtgtggccaactcgattacccaccgctgcctccgcctcaaaacaggcagccagacccgtcttagcaaccacagaagcactggcttcacctgggccagatggcgattcctccccgactaaggacggtgagggcacagaggaaggcgagaaggatgaaaaatccgaatcggaagatggggagcgggagcatgaagaagacggcgagaaggattccgagaaaaaagagaagagcggagtaacccatgccgcagaagaacgtaaccaaactgaaccgagccctacacccagcagccctaatagaacagccgagggaggccaccagaccatcccaggccacgaacaggaccatactgcagtgccaacagatcagaccgggggacgtcgcgatgccggccccggtcttgaccctgatatggtcacctccactcaggtgccccctacagccaccgaagagcagtacgccggcagcgatcccaaaaggcctgagatgccctcaaaaaaacctatgagcagaggtgaccgtttctcggaagactcgcgattcatcaccgtcaaccccgccgaaaagaacacttcggggatgatttctcggccagctcctggaagaatggagtggatcatcccactcattgtcgtctccgcactcaccttcgtgtgcttgatcctgctgattgcagttctggtatactggcgcggctgcaataagatcaagagcaagggatttccgcggagatttcgcgaagttccatcgtctggagagagaggggagaagggcagccggaaatgctttcagacagcccatttttacgttgaggacagctcgagtcccagagtagtgccaaacgaatcaattccaattatacccataccagacgatatggaggcgatcccagttaaacagttcgttaagcacatcggcgagctctacagtaataaccaacatgggtttagcgaggatttcgaagaagtccagcggtgtacagcggacatgaatatcactgccgaacacagcaaccatccagagaacaagcacaagaacagatacataaatatcctggcctacgaccatagccgggtgaaacttcgcccgctcccggggaaagacagcaaacatagcgactacattaacgctaattatgttgacggatacaacaaagcgaaagcttacatcgccacccaaggtcctcttaagagcacattcgaagatttttggcgcatgatctgggaacagaataccggtataatcgtcatgatcacaaatttggtcgagaaaggacgaagaaagtgcgaccagtactggcctacggagaattccgaggagtacggtaatataatcgtgacactgaagtccacaaagatacatgcgtgctataccgtccgaagatttagcatccggaatacaaaagtcaaaaaaggacaaaaaggaaatcctaagggtaggcagaatgagcgggtggttatccagtatcattacacccaatggcctgatatgggggtacccgagtatgccctgcccgttctcacatttgtgaggcggagcagcgctgccagaatgccagaaacagggccggtactggtccactgctcagcgggcgttggacggaccggaacgtacatcgtcatcgactcaatgctgcagcaaatcaaagataagtctaccgttaatgttttgggctttctaaaacatatcagaacacaaaggaattatctggttcagaccgaggaacaatatattttcatccacgacgccctgttagaagctattctgggcaaggagactgaggtgagcagcaaccagcttcacagttacgtgaatagtatccttatccctggcgtggggggaaaaacccgcctcgagaaacagtttaagctggtgactcagtgcaacgccaaatatgtcgagtgtttttcagctcagaaggagtgcaataaggaaaaaaacagaaactcttctgtggtgccttctgagcgggccagggtgggtctggcgcctttacccgggatgaaaggcactgattacataaacgcatcatacatcatgggctactacaggtcaaatgaatttataattactcagcaccccctgcctcacaccactaaagacttttggagaatgatatgggatcacaacgctcagattatcgttatgttgcctgataatcagtccctcgctgaagatgagttcgtctactggcccagcagggaagagtcaatgaattgtgaggcttttaccgtgactctgatttctaaggaccgtctttgcctctcaaacgaagaacagatcatcattcacgacttcatactcgaggccacccaggatgactatgttctcgaagttaggcacttccaatgtcctaagtggcctaatccggatgccccaatctcaagcacatttgagttaattaatgtgattaaggaagaggccttaacacgagatggcccaactatcgtgcacgacgagtacggagccgtgtccgccggcatgctgtgcgcgctgaccaccctcagccagcaattggagaatgaaaatgccgtcgacgtttttcaagtcgccaagatgataaacttgatgcgccccggcgtgttcactgacatcgagcagtatcagtttatatacaaagcaatgctctctctcgtaagtactaaggaaaatggcaacggtccaatgaccgtggataagaacggcgccgtgctcatagctgatgaatcagacccggcagagagtatggaatcactggtatag

SEQ ID NO: 201742 - DNA, 309 bp, Artificial Sequence
  Description of Artificial Sequence: Synthetic coding sequence
atgcggcggctgctggagccctgctggtggatcctgttcctgaagatcacaagcagcgttcttcactatgtcgtgtgttttcctgcactgactgaagggtatgtaggcgctttgcacgaaaacaggcacggcagcgctgtgcagatcaggaggcgcaaagcaagcggagatccatattgggcttactccgggaagtccagttgctcaaatggagaccataccggacagctgacctcacattctactcatctgaaggctcactttgagtccttgttgtgtttaagctctgtgtgcagcaatttatcctag

SEQ ID NO: 201743 - DNA, 2814 bp, Artificial Sequence
  Description of Artificial Sequence: Synthetic coding sequence
atggccggcgccggcggcggcctgggcgtgtggggcaacctggtgcttcttgggctttgttcttggactggcgcccgtgcacctgcgcctaacccaggcaggaatttgacagtcgagacgcagacaacctcttctatctccctcagctgggaagtacccgacggactggactctcagaattccaattattgggtgcagtgcaccggtgacggaggaacaacagagactagaaacacgactgctactaacgttaccgtcgatggactcggcccgggcagcctatacacatgttccgtctgggtagagaaggacggcgtgaattcaagtgtgggcaccgtcaccaccgccaccgcacctaatcccgtgcggaatttaactgtcgaagctcagacaaatagctcaattgctctgacctgggaagttcctgacggaccggatccccagaatagtacatatggggtagagtacactggcgatggaggtagggcaggtactcgcagtacggcacataccaacatcaccgtggatcgtcttgagccaggatgcctgtacgtgttctccgtgtgggtcggcaagaacggtattaattccagccgcgaaacacggaatgccacaaccgcacccaatcctgtgcgaaaccttcatatggagacccagactaattcctccattgcactgtgctgggaggtgccggacggaccctacccccaagattatacttactgggttgaatatactggggatgggggcggaacagaaactcggaacacaacaaatactagcgttactgccgaacggctggagcccgggaccttatatacgttcagcgtctgggcagagaaaaacggtgcaagaggtagtagacagaacgtctctatctcgaccgtgccaaacgccgtcacatctcttagcaagcaggactggacaaactcgacaatagccttgagatggactgcgcctcagggacccggacagagctcttattcctattgggtttcctgggttagagagggaatgaccgatcctagaactcagtccacgtctggcaccgacatcacgctgaaagaacttgaagcgggctccctttaccatcttactgtatgggcggagcgcaatgaagttagggggtataattccactcttactgccgcaaccgcaccaaacgaggttaccgacctccaaaatgagacacaaaccaagaattccgtaatgctgtggtggaaagcccccggcgatccacactcacagctgtacgtctattgggtgcaatgggcctcaaaagggcaccccagaaggggacaggatcctcaggccaattgggtgaaccagacctctcggacaaacgaaacctggtacaaagtcgaagcgctcgagcccgggacactctataacttcaccgtgtgggcggaaagaaatgacgtggcctctagcacacagtccttatgtgctagtacatatccagatacggtgacaatcacatcttgtgtttctacatctgcgggctatggagtcaacctgatatggtcctgccctcaaggaggatatgaagcctttgaacttgaagtcgggggccaacggggatcccaggacagaagctcgtgcggcgaggcagtgtctgtcctgggactaggacccgcgaggtcgtacccagcgactataaccaccatctgggacggcatgaaagtcgtgagccacagcgtcgtctgtcacacagaatctgcgggcgtcatcgcaggtgctttcgtagggatactacttttcctcatcctggtggggttgctgatcttctttcttaagaggcgaaacaaaaagaagcagcagaagccagagctaagggacctggtgtttagcagtcctggagatatccctgccgaggactttgcagaccacgtcaggaaaaatgaaagggatagtaactgcggctttgcagataagtatcagcaactcagtttggtcggtcactctcagtcccagatggtggccagtgctagcgaaaataacgcaaagaacagataccggaacgtattaccatatgactggagtcgagtgcccttgaagcctatccatgaagagcccggctcagactatatcaacgcgtccttcatgcccggtctgtggtctccgcaggagttcatcgcaactcaggggcccctcccacagacagtcggagacttttggcgtctcgtttgggagcagcagtcccacacccttgtgatgctcacgaactgcatggaggctgggcgggtgaaatgtgaacattattggccactcgactcacagccttgtacacatgggcacctgagggtgaccttggtcggagaggaggtgatggaaaactggactgtcagagaactattgctcttacaggtagaggagcagaagacactgtccgtgagacaattccactaccaggcctggcccgaccacggcgtgccctcctcacccgacacactcctggcattctggcgcatgctgcgccaatggctggatcagaccatggagggcggaccccctatagttcactgttctgcaggggtggggcgaacaggtacgctcatcgccctcgatgttctgcttcggcagctccaaagcgagggtttactcggcccatttagtttcgtgaggaagatgcgcgaatcgcgccccttgatggtgcagactgaagcccagtacgtttttctgcaccagtgtattctacgctttctacagcagagtgcgcaagcccctgcagagaaagaggttccctacgaggacgtcgaaaacctcatatacgaaaacgtcgccgccatacaggcccacaaactggaagtttag

SEQ ID NO: 201744 - DNA, 3348 bp, Artificial Sequence
  Description of Artificial Sequence: Synthetic coding sequence
atggccggcgccggcggcggcctgggcgtgtggggcaacctggtgctgctgggcctttgctcgtggacaggcgcccgggctcccgcgcctaaccctggacgcaacctgaccgtcgagactcagaccacgtcaagcatttcactcagttgggaagtacccgacggtctggacagccaaaactcaaactactgggtacagtgtacgggagacgggggaacaaccgagaccaggaatacaactgctaccaatgtgaccgtggacggactaggccccggctcattatatacctgctctgtctgggtagaaaaggacggagttaactcttctgttggcaccgtgaccaccgcaaccgccccaaatcccgtaaggaatttgagagtggaagcccaaacaaatagcagcattgcacttacttgggaggtcccagatggcccagatccccagaactccacctatggggtggagtatacaggggacggaggccgagcaggaacacgctccacagcccatacgaatattacagtggatggcctcgaaccaggctgtctttacgccttttccatgtgggtcggtaaaaatggcattaactcctccagagaaacccgcaacgccaccactgctcacaatcctgtgcgtaacttacgagtcgaggctcaaaccacatcttcgattagcctgtcttgggaagtcccagacggcacagacccacagaactctacttactgcgtgcagtgcacaggggacggaggcaggaccgaaacacggaacactacagacacccgggtgactgttgatgggctgggtccaggatcactgtatacttgttcagtttgggtggaaaaggatggtgttaattctagtgttgaaatcgtaactagtgctactgctcctaacccagtcaggaatctcaccgtcgaggcccaaacaaattcttctatcgctcttacttgggaagttccagacgggcccgaccctcagaactccacctacggagtggaatacacaggggacggggggcgcgcgggcactcggtctacggcacacacaaacataaccgtcgataggttggagccagggtgtctgtatgtgttttctgtgtgggtgggcaaaaatgggataaatagctctagggaaaccaggaacgccaccacagccccaaacccggtgcgtaatctccacatggaaacgcagactaattcctcgatcgcactctgctgggaagttcctgatggcccttacccacaggactatacttactgggtagaatataccggtgacggaggaggtacggagacaaggaatactactaatactagtgttactgccgagcggctggagcctgggacactttacaccttctcagtgtgggctgagaagaacggggcaagagggtcacggcagaatgtgtccatctcgaccgtgcccaatgctgtaacgtctctgtctaaacaagactggactaactccactatcgctttaaggtggacggccccgcaaggccctgggcagtcttcctactcctactgggtgagttgggtgagagagggtatgaccgatccaagaacccagtctacctctggcacggacatcacactcaaggaattggaagccggatctttataccatctgactgtttgggccgaaagaaatgaagttcgcgggtacaattctactctgactgctgccacagcccctaacgaagtgaccgacctccagaacgaaacgcaaacaaagaatagcgtcatgttgtggtggaaagctcctggagaccctcactcacagttgtatgtttattgggttcagtgggctagcaaaggccacccccggcgggggcaggaccctcaggctaattgggttaatcagacgtctagaacaaatgagacctggtataaggtggaggctctggagccaggcaccctgtacaactttactgtatgggctgagcgcaacgatgtggccagcagcacccaatccctctgtgcttccacgtaccccgatacagtcacaatcacaagttgtgtctctacttccgcggggtatggagtaaatttgatctggtcctgccctcagggtggatacgaagcctttgaactggaggtgggggggcaaagagggagccaggaccggagtagctgcggagaggccgtttccgtgttgggattaggccccgccagatcctaccccgcgactatcaccactatctgggacggaatgaaggtggtctcccactcggtggtgtgccacacagagagtgccggcgtcattgccggtgcttttgttggaattcttttgttcttaattctggtcgggcttttgatctttttcctgaagagacgtaataagaagaagcaacaaaaacctgagctacgcgatctcgttttctctagccccggagatattccagccgaggactttgcagatcacgtgaggaagaatgaacgagactcaaactgtggcttcgctgataaatatcaacagctgtccctggtcggacactctcagagccaaatggtcgcttcagcctccgagaacaatgctaaaaacagatatagaaatgtgttgccctacgattggtcccgcgtacctctgaaacctattcacgaagaaccaggttctgattacatcaatgcctcattcatgccagggctgtggtccccacaggagttcatcgcaacacaaggtcccctgcctcagacagtcggggacttttggaggctggtgtgggagcaacaatcacatacacttgtgatgcttacaaactgcatggaggccggcagagttaagtgtgaacactattggccactggatagccagccctgtacgcatgggcatctgcgcgtcactttggtcggggaagaggtcatggagaattggacagttcgagagttattgctgctccaagtggaggaacagaagacactgagcgttcggcagttccactaccaggcctggcccgaccacggagtcccatcgtcgcccgatacccttttggcgttttggcgcatgctgcgacagtggttagaccagacaatggagggaggtccacccattgtccactgttcggcaggcgtgggacgcaccggaactctgatcgccctggatgtgctactgcggcaactgcagtccgaaggattattgggcccattcagcttcgtcagaaagatgcgcgaatctaggccactgatggtgcagacggaggctcagtacgtgttcctgcaccaatgcatcttgcggttcttgcagcaatcagcacaggctcctgccgaaaaggaagtcccttatgaagacgtcgagaatctaatttatgagaacgtggcagccatacaagctcataaactggaagtgtag

SEQ ID NO: 201745 - DNA, 1278 bp, Artificial Sequence
  Description of Artificial Sequence: Synthetic coding sequence
atgaagcccgccgcccgggaggcccggctgcccccccggagccccggtttacggtgggccctgcccttacttttattacttttacggttggggcagatcctttgcgcaggcggcacgccgagccccattcctgacccaagcgtagctaccgtagcaaccggtgaaaatgggattactcagataagcagcactgcagagtcattccataaacagaatggcacaggtaccccccaagtggagaccaatacgtcggaggatggggagtcaagcggggctaacgacagtctcaggacccccgagcaaggttccaatgggaccgatggagccagtcagaagactcccagctccactggtccatcccctgtcttcgacattaaggccgtaagcatcagtccgaccaacgtgattctgacctggaagagtaacgatacagccgcttccgagtataagtacgtagtaaaacacaaaatggaaaacgagaagactatcacagttgttcatcagccatggtgcaacattactggattaagaccggccacctcttacgtgttcagtatcactcccgggatcggcaatgaaacctggggggacccacgggtcattaaggtgattacagagcccatacctgtgtccgatctgcgcgtggcgctaaccggtgtgcgcaaggctgctctcagctggtccaacggcaatgggaccgcatcatgtcgcgtgttactggagtcaatagggagccacgaagagttgacccaggacagccgcctccaggtgaacatttcaggcctgaagcccggagtccagtacaacatcaacccttacctgctgcaatcgaacaaaacaaaaggcgatcccctgggtactgagggtggcctggacgcatcaaacactgagaggtctcgcgccggctctccgactgcacccgtgcatgatgaatccctggtcggcccagtcgatccaagctccggtcagcagagtcgagatacagaggtgctactggtgggcctagaaccagggacaaggtacaatgctacggtgtattctcaggctgctaatggcaccgaaggccagcctcaggctatcgagtttcggaccaatgcaattcaggtctttgacgtgacagctgttaacatatctgcgacttcccttactcttatctggaaggtaagcgataacgagagcagtagcaactacacttataagatccacgtggctggggagacagatagtagtaacttaaatgtctccgagccccgcgccgttatccctggactgagatag

SEQ ID NO: 201746 - DNA, 4014 bp, Artificial Sequence
  Description of Artificial Sequence: Synthetic coding sequence
atgaagcccgccgcccgggaggcccggctgcccccccggagccccgggctgagatgggccctgcctctgctgctccttttgctgcggctgggacagattctctgtgctggaggaacgccatctccgattcctgacccttccgttgcaaccgtcgctaccggagagaacgggatcacccagattagttcaacagcagagtctttccacaaacagaatggaacaggcacgccgcaagtggaaaccaatacctccgaagatggagaatcctctggcgccaacgattccctgcggacccctgaacagggctccaacggcacagacggtgccagtcagaaaacgccttcttctaccgggccttcgcccgtttttgatattaaggctgtgtctatcagtcccactaacgtgatactgacctggaaatccaatgacaccgctgcctctgaatataagtatgtcgtgaagcataagatggagaatgaaaagaccatcaccgtcgttcaccagccatggtgcaacattaccggcctgcggcccgctacctcgtatgtgttttccattactcccggcatagggaatgagacttggggagaccctagagtgatcaaagttatcaccgaaccgatcccagtttctgacttgagagtggccctgaccggagttcgaaaggcagccttaagttggtcaaatgggaacggcactgccagttgcagggtcctcctggagagcatcgggagccacgaagaactgacacaggattcaagactgcaggttaatatctccggactgaagcccggggttcagtataacattaacccctatctgctccaatccaataagaccaagggcgacccccttggcacagagggtggcctcgatgcttccaacaccgagcggagccgggccggctctcccaccgctcctgtgcacgatgaatctcttgttgggcccgtggatcccagctcaggccagcagagtagggatactgaagtcttgctggtcgggctggagcctgggactaggtataacgccacggtatacagtcaggccgcgaatgggacagagggacagccccaagccatagaatttaggacaaatgctatacaggtgttcgatgtaaccgctgtgaatatctcggcgacttcattgaccctgatctggaaggtgtctgataatgaatcgagttccaattacacttacaaaatccacgtggcaggtgaaaccgattcaagcaatcttaacgtgtcagagccaagggcagtgatccctgggcttaggtcttctaccttctataacattacagtgtgccctgttctgggcgatatcgagggaacacctggttttttgcaggttcacacccccccagtgccagtgagtgattttagagtgacggtggtatcaacaactgagatcggtctagcatggtcctcacacgacgccgagtcctttcagatgcacatcacacaggagggcgctggtaattctcgcgtcgaaattacgaccaatcagagtatcatcattgggggactgttcccaggaactaagtactgcttcgaaattgttcccaagggtcccaacggcactgagggggcttcccgtacagtttgcaataggaccgttccaagcgccgtgttcgatatccacgttgtgtatgtaaccaccaccgaaatgtggttggactggaagtccccagacggtgcctctgagtacgtctaccacctggtaattgagtccaaacatggaagcaaccacaccagcacgtatgacaaagccattacgttgcaggggttgataccgggtaccctgtataatatcactatttcacccgaagtcgaccacgtttggggtgatcccaatagtacggctcaatacacccgcccgtccaacgtgagtaacatcgatgtgagcactaacacgacagctgcgacactgtcttggcagaattttgacgatgcttcccccacttactcttactgcctgctgattgaaaaggcaggaaattcctcaaatgctactcaagttgtgaccgacatcggtataaccgatgcaactgtcacagagcttattcctggatcatcctatacggtcgagatcttcgctcaagtaggggacggaatcaagtcactcgagcccggacggaaaagtttctgcacagaccccgcttctatggcttcttttgattgtgaggtagtgcctaaggagcctgcccttgttctcaagtggacctgccccccgggtgccaatgcaggctttgaactagaggtatcctcgggcgcttggaacaatgctactcacctagagagctgctcttcagagaacggcaccgaatacagaacagaggtgacctatctcaattttagcacttcctacaacatcagcataaccacagtgagttgtgggaaaatggctgcccctactcggaatacatgtaccacggggattactgatcctccgccaccagacgggtctcccaatattacctcggtgtcccataatagtgttaaagtgaaatttagcggcttcgaggcaagccatggcccaatcaaagcatacgcagtgatcctgaccacaggggaggccggtcaccccagcgccgacgtacttaaatacacatacgaagatttcaagaaaggtgcttccgatacctacgttacttacctcattcgaaccgaggagaaaggtaggtctcagtccttaagtgaagtgctcaaatatgagatcgacgtgggaaacgaatccaccacattgggatattacaatggaaaactcgagcctctgggcagctaccgggcctgcgtcgccgggtttactaatatcaccttccatccacaaaacaaaggcctgatcgacggggccgagtcctatgtatcattctctcgatactccgatgcggttagcctgccacaagaccccggagtgatatgtggagcagtgttcggctgcatcttcggagctctggtcatagtgactgtgggaggatttatcttttggcgtaagaaacgtaaggatgctaaaaataatgaggtttccttttcacaaattaagccaaaaaagagtaaacttattagggtggagaactttgaggcctactttaagaagcagcaggccgactccaattgcggatttgcagaagaatatgaagacttgaaactggtagggatttcgcagcccaagtacgcggccgaactggccgagaatcggggcaagaatcgctataacaatgtcctaccgtatgatataagtcgggtgaagctttcagtgcagacacattcgactgatgactatatcaatgccaactacatgcctggctaccacagcaagaaggatttcatcgccacccagggaccgctcccgaatacgcttaaagatttctggcggatggtttgggaaaagaacgtatacgccattatcatgctaacaaagtgcgtagagcagggacgcacgaaatgcgaagagtactggccctcaaagcaggcccaagactatggcgatatcaccgttgctatgactagtgaaattgtgctgcccgagtggaccatccgtgatttcactgtcaagaacattcaaaccagtgagtcacatccactgcggcaattccacttcacctcatggccagaccacggggtcccagataccactgatttgttaatcaacttccggtatctcgtgcgcgattatatgaagcagagtcctccagagtcaccgatccttgtgcactgttcagcgggagtggggaggaccggcacgttcatcgccattgaccgactgatctaccagattgagaatgaaaatactgtcgatgtgtatggtatcgtttacgatctgcgcatgcatcgaccattgatggtacagaccgaggatcagtacgtgttcctgaaccagtgtgtgctcgatatagtgcgctcccagaaggatagtaaggtcgatctcatttaccagaacaccaccgctatgaccatctacgagaaccttgcacccgtcacgaccttcggcaagactaacggatacatcgcttag

SEQ ID NO: 201747 - DNA, 1620 bp, Artificial Sequence
  Description of Artificial Sequence: Synthetic coding sequence
atgaagcccgccgcccgggaggcccggctgcccccccggagccccgggctgcggtgggcccttcctctgttattgttgctcctcaggctcgggcaaattctttgcgctggtgggacacccagtcccattcccgatccttcggtcgccacggttgctacaggagagaatgggattacacaaattagttccaccgcagagtcttttcataagcagaacggcacgggtacacctcaagtggagacaaacacctcagaggatggcgaatcttctggtgcaaacgattccctcagaactccagagcaaggttccaacggcacagacggcgcttcccagaaaaccccatcgagcaccggtccgagcccagtgtttgacataaaagccgtcagtattagccctacgaatgtgatcttgacatggaaaagcaacgatacagctgcgtccgaatacaaatacgtggtgaaacacaaaatggaaaacgaaaagaccattacagtcgtccaccagccttggtgtaatatcaccgggcttagacccgcaaccagctacgtgtttagcatcacccccgggattggaaacgagacttggggtgacccccgggtcatcaaagtgatcaccgagcctattccagtttcagacttgagggtggccctgacaggagttcggaaggccgcactctcatggtcaaatggcaatggcacagcctcttgccgcgttctgttagaaagcattgggtcgcacgaggagttgactcaggatagccgcctccaggtcaatatctctggactgaagccaggtgtccagtacaatatcaacccttatctcctacagtccaataaaaccaagggcgatcctctcggcacagaaggtggcttagatgcttctaataccgaaagaagtcgcgcaggatcaccaacggcccccgtgcatgatgagagcctggtcgggccagtggacccaagctctggccagcagtccagagacacagaggtgcttctggtcggtcttgaacccgggacacgatataacgccaccgtctattcacaggccgctaatggaacggaaggacagccccaagctatcgaatttcgaaccaacgctatccaggtatttgacgttacagccgtgaacattagcgcgacctctctgacacttatatggaaggtctctgacaacgagtcgtcgtccaattatacgtacaagattcacgtcgcaggcgaaacggactcatccaacttgaacgtttccgagccacgggcagtgatccccggtctgagaagctctactttctataacattaccgtgtgccccgtccttggagacatcgaaggtacccccggctttctccaggtgcatacaccaccagtgccggtgagtgacttccgagtgactgtggtaagcacaactgaaatcggcctggcctggagctctcacgacgccgagtcgttccagatgcacattactcaagagggagccggtaactcccgagttgagattacaaccaatcagtctattatcatcggcggactgtttccgggtacaaagtactgttttgaaatagtccctaagggccctaacggaaccgagggggcaagccggaccgtgtgtaacaggaccggctag

SEQ ID NO: 201748 - DNA, 4419 bp, Artificial Sequence
  Description of Artificial Sequence: Synthetic coding sequence
atggacaccaccgccgccgccgccctgcccgccttcgtggccctgctcctcctgagtccatggcccttgctgggaagtgctcaagggcagttttcagcaggtgggtgtaccttcgatgatggaccaggcgcttgtgactatcaccaggacctgtacgatgacttcgaatgggttcatgtcagcgcacaggagccccattaccttcctccagaaatgccccaggggtcatacatgattgtggatagcagcgatcatgaccctggggagaaagccagactacagctgcccacgatgaaagaaaatgatacccactgcatcgatttcagctacctgctgtactcccaaaagggactaaacccagggactctgaatattctcgtccgggtcaacaagggccctctggccaaccctatatggaacgtaacgggcttcaccgggcgagattggctgcgtgccgagttagctgtgagtactttctggcccaacgaataccaggtgatattcgaagcagaggtaagtggcggccggagtgggtatatcgctatcgacgacatacaggtcttatcctacccctgcgacaagagccctcacttcctccggctcggagatgttgaggtaaatgccggtcagaacgctaccttccagtgtattgctactggtcgcgacgcagtccacaataaactttggctgcagcgcaggaacggggaggatatccccgttgcccagaccaaaaacatcaatcaccgtaggttcgccgcctccttcaggctgcaggaggttaccaagaccgatcaggatctgtaccggtgtgtaacccagagcgaaaggggaagtggggtttcaaatttcgctcagctcatcgtacgcgagcccccacgaccgatcgcccccccccaattactgggcgtcggaccaacctatctccttatccagctgaatgctaatagtatcattggggacggccctataatccttaaggaggtggagtaccggatgacttccggttcctggaccgagacccatgccgtgaatgctcccacctacaaattgtggcatttggacccagacacggaatacgaaatccgcgtgctgctcaccaggcccggtgaaggcggtacgggtctacccggaccaccactgattacccggaccaagtgcgctgaacctatgcgaacacccaaaacgttaaagattgccgagattcaagcaagaaggatcgcagttgactgggagtctctgggctacaacatcacccgctgccacacattcaatgtgaccatctgctatcattatttccgcggccacaacgaatcaaaggcggattgcctcgacatggaccctaaagccccacagcacgtggtgaatcatctgcccccctatactaacgtgtcactcaaaatgattctcaccaatcctgaaggaagaaaagagagcgaggaaacaatcattcagaccgacgaggacgtccccgggcctgtgccggtcaaatctctgcagggtaccagctttgagaataagatttttctgaactggaaggagccactggaccctaacgggattatcacccaatatgagatctcctattcttctatcaggtcatttgaccccgccgtgcctgttgcgggccctccgcaaacagtctccaatctgtggaattcaactcatcatgtattcatgcacctccaccctggcactacctaccagtttttcattagggcgtccaccgtcaaaggattcggaccagccaccgcgatcaacgttactacaaacatatccgcacctacactccctgattatgagggcgtggacgcgtccttaaacgagacagcaacgaccataactgtgctgttaaggccagctcaggcaaagggggctcctattagcgcatatcagattgtcgtcgaggagctccacccccatcgtactaagcgtgaggcaggcgccatggaatgttaccaggtgcctgtgacatatcagaacgctatgtccggtggagccccctactatttcgccgcggaactgccccccgggaacttgcctgagcccgcacctttcacagtaggggataataggacctaccagggattctggaatcctccactggccccacgaaagggttacaatatctatttccaggctatgtcttccgtggagaaagagacgaagacccagtgtgtgagaattgccacaaaggctgcagccaccgaggagcccgaggtcatcccagacccagcaaagcagaccgatcgagttgtgaagatagccggcatttccgccggaatactagtttttattcttctgttgttagtcgtaattctaattgttaaaaaaagacgttcctactactcatactcatattacctgaagttggcaaaaaagcggaaggatgctatgggcaatactaggcaggagatgacccacatggtcaatgctatggacagatcctatgcggaccagagcaccctccacgctgaagatcccctcagcattacattcatggatcagcacaactttagtccaaggctgcctaatgatcctctcgtgcctacagccgtgctggtaccgatcaccgatgagaaccacagcgccaccgctgagagctctcgactgctggatgtccctaggtacctctgtgaggggacagaatcaccctaccaaactggccagctgcatcccgcaatccgggttgccgacctgctccagcatattaatttgatgaagacgagtgatagttacgggtttaaggaagagtacgagtccttctttgagggccaaagcgcctcctgggacgttgccaaaaaggatcaaaacagggcgaagaacagatatggtaatatcatagcctacgatcactctagggtaattctccagcccgtagaggacgacccctctagcgattacattaatgctaactatatcgacatttggctatatagagatggttatcagaggccttcccactatatcgcaacacagggccccgtccacgaaaccgtgtatgacttctggcgcatgatatggcaagaacagtccgcctgtatagtcatggttaccaatctcgtagaggtagggagggtgaagtgctacaagtattggccagatgacactgaggtctacggagatttcaaagttacatgcgttgagatggagcccttggccgaatacgtcgtccggaccttcacgttggagcgtagagggtacaacgaaattcgggaggttaagcagttccattttaccgggtggcctgaccacggagttccttatcatgccaccggattgctctcctttattaggcgcgttaaactgtccaatccccccagtgccggtcccattgttgtccactgttcggctggtgcaggaaggacaggttgttacatcgtgatcgacattatgctggatatggcggaaagagagggagtggtggacatttacaattgcgtcaaggccctcaggtccagaaggatcaacatggtacagaccgaagaacagtacatttttattcacgacgccattttggaggcttgtttatgcggggaaactgctatccccgtttgtgagtttaaagcagcctacttcgacatgatcaggatagatagtcagaccaactcctcacacctgaaggatgaattccagacactgaactctgtgactccacggttgcaggcggaggattgtagtattgcatgcctgcctcgaaatcacgataaaaatcgtttcatggacatgttgccccccgatcggtgtcttccattcctgatcaccattgatggggagtcatcaaattacattaacgctgcactgatggatagctatcgacaacccgccgctttcatcgtgacgcagtatccgctgccaaataccgtcaaggacttctggcggctcgtctatgattacgggtgtacgtccatcgtaatgctgaacgaggtggatctctctcaggggtgccctcagtactggccagaggagggtatgctaaggtatggcccgattcaggtggaatgtatgagctgtagtatggactgcgatgtcattaaccggatttttcggatctgcaatctgacacgcccccaagaaggatatttaatggtgcaacagtttcaatacttgggctgggcctctcatcgggaggttcctgggagcaagcgaagttttctcaagttgattctacaggtggaaaaatggcaggaggaatgcgaggaaggggaaggacggactatcattcactgcttgaatggtggcggaagaagcggaatgttctgtgccataggcatcgtggtagaaatggtaaaacggcagaatgtggtcgacgtattccacgctgttaagaccttaagaaattccaaacccaatatggtggaggctccagagcagtaccgcttctgttacgacgtagcccttgagtaccttgaatcgtcttag

SEQ ID NO: 201749 - DNA, 4377 bp, Artificial Sequence
  Description of Artificial Sequence: Synthetic coding sequence
atggacaccaccgccgccgccgccctgcccgccttcgtggccctgctgttgctgtctccgtggccactactcggatccgctcagggacaattctccgcagggggatgcacctttgacgacggccccggcgcatgtgactatcaccaggatctgtacgatgatttcgaatgggtgcacgtgtcggcgcaggaacctcattacctgccaccagagatgccccagggttcctacatgatcgtcgactcaagtgatcatgatcctggcgagaaggcaaggctccagctgcccacaatgaaagaaaatgacactcattgcattgacttttcatatttgctgtattcacaaaagggcctcaaccctggtacactcaatatcttggtgagagtcaacaaagggccactcgccaatcctatttggaacgtgacaggatttacagggcgggattggctgagagcagagctggccgtgtccacattctggccaaacgagtaccaggttattttcgaggcagaggtgtctggtggccggtctggatacatagcaatcgacgacattcaagtgctgagctatccctgcgataagtcaccacattttctgcggctaggggacgtggaggttaacgctggtcagaatgctacatttcagtgtatagctactggaagggacgctgttcacaacaagctgtggctgcagcgccgcaacggggaggatattcctgtggctcagacaaagaatatcaaccaccgaaggttcgcagcaagttttcggctgcaggaggtcaccaagacagaccaagacttgtaccgctgtgtaactcaaagcgagcgggggtcaggtgtctccaacttcgcccagctgatagtgcgcgaaccaccaagacccatcgccccaccacagcttcttggagtcgggccaacatacctgcttattcagctcaacgcaaacagtattattggcgacggtcccataattctcaaagaggtggagtatcggatgacttcagggagttggacggaaacccacgctgtgaacgcacctacatataaactgtggcatctcgatcccgacacggagtacgagatcagggtgctgctgacacgtcctggcgaaggtggcacaggactgcccggacctcccttgattacacgcacaaagtgcgccgagccaatgcggacgcccaaaaccctaaaaatcgctgaaattcaagcccggagaatagcagtcgactgggagtccctgggctataacatcacgcggtgccatacattcaacgtcactatttgctatcattattttcgtggccataatgaaagtaaagccgactgtctcgacatggacccaaaagcaccacagcatgtggtgaaccatcttccgccttatacaaatgttagtctaaaaatgatcttaactaatcccgaaggccgcaaggagtccgaggaaacaatcatccagactgacgaagacgtgcctggtcctgttcctgttaagtcactgcagggaactagcttcgaaaataaaatattcctgaactggaaggagcctctggacccaaacgggatcattacgcagtatgagatatcgtactcatccatcagaagcttcgaccccgccgtgcccgtggcaggcccccctcaaacggtcagtaacctttggaacagtacccatcacgttttcatgcatttgcatcccggcactacctaccagttcttcatcagagccagcactgtgaagggcttcggtcccgccactgctattaacgtcaccaccaatatttctgcgccaacgctccctgattatgaaggcgtagatgccagtctgaatgagacagcgactacaattaccgttctactacggcccgctcaggctaagggggctcccatcagcgcctaccaaatagtcgtagaagaattgcaccctcacagaaccaaacgggaggccggcgccatggagtgttatcaggtgccagtcacataccaaaatgccatgtcagggggggcaccatattactttgctgccgaacttcccccagggaacctccccgaaccagcccccttcaccgtgggtgacaaccggacatatcaggggttctggaacccccctctggcccccagaaagggatataatatctattttcaggccatgagcagtgtcgagaaagagaccaagacccagtgtgtcagaattgctactaaggccgccgccacagaagaacctgaagtcattcctgacccagcaaagcagacggatagggttgtgaagatcgccggtataagcgccgggatacttgtcttcatactgctcctactggtggtaatcctgattgtaaagaagtctaagctagcgaagaagcggaaggatgccatggggaatacacggcaggagatgacacacatggtcaacgcgatggataggtcgtacgcggatcagagcaccctgcacgccgaagaccccttgagtataacttttatggatcagcacaacttttccccccgcctgccaaatgatcccctggtccctacagctgtactggatgagaaccactctgctacagccgaaagttccagactgctggatgttccacgatatctgtgtgagggtaccgagagcccataccagaccgggcaactacaccctgcgatcagagtcgctgatttgctgcaacatatcaacctcatgaaaacttcagattcttacgggttcaaggaggaatacgagtcattcttcgaaggccagtctgccagctgggacgtcgcaaagaaggaccagaaccgggcaaaaaataggtacggaaacatcattgcctacgatcatagcagggtcattctacagcccgttgaggacgatccatctagcgattacatcaacgctaattatatagacatttggctgtatcgcgacggataccagagaccaagccattatattgccacacaggggccagtgcatgaaactgtgtacgacttctggcggatgatatggcaggagcagtctgcttgtattgtgatggtgacgaacttagttgaggtgggacgagtcaaatgctataaatactggcctgatgacactgaagtctatggcgattttaaggtgacatgtgtggagatggagcccctagctgagtacgtagtacggacgtttacattggaacggcgcgggtataacgaaataagagaggtgaagcagttccattttacagggtggcctgaccatggggtgccatatcacgctacaggactcttgagcttcatccggcgtgtcaaactttctaatccaccatctgctggccccatcgtggtccattgctctgcaggggccggacggactggatgttatatcgtaatcgatataatgctcgatatggcagagcgcgagggcgtggtggatatctacaactgcgtcaaggccctgcggtcaaggagaatcaatatggtgcaaacggaggagcagtacatattcattcacgatgcaatactggaagcctgcctgtgcggggagaccgcgattcctgtgtgcgagttcaaggctgcctattttgacatgatccggattgactctcagactaactcctcccacttaaaggatgagttccagaccctcaattctgtcaccccaagactgcaggcagaggactgttcaattgcttgtctgccgaggaatcacgataagaacaggtttatggacatgctgccccccgacaggtgtctacctttcctgataaccatcgacggggagtcctccaattacattaacgctgcgctgatggattcatacaggcagcccgcggcatttatagtgacccaataccccctgccgaataccgtcaaggatttctggagactagtgtacgattacggatgcacaagcatcgtgatgctaaatgaagtggatcttagccagggttgcccacaatactggccagaggagggcatgcttagatatgggccgatccaggtggagtgcatgagttgctctatggattgtgacgtgattaatcgtatatttagaatatgtaatttaacgaggccccaagaggggtatttgatggtccaacagttccagtatctgggttgggcctcacacagggaagtacccggctctaaaaggtcctttctcaaattaatcctgcaggtagagaagtggcaagaagaatgcgaggagggagaagggaggacaataatccattgtctgaacggcggcgggcggagcgggatgttctgcgctatcgggattgtggtggagatggtgaagcgacaaaatgttgtcgacgtattccacgccgtaaaaacattaaggaacagcaagccaaatatggtggaggccccagagcagtaccgcttctgctacgatgttgccttggagtaccttgaaagcagctag

SEQ ID NO: 201750 - DNA, 4341 bp, Artificial Sequence
  Description of Artificial Sequence: Synthetic coding sequence
atggacaccaccgccgccgccgccctgcccgccttcgtggccctgctactgctctccccatggcctctgctgggctccgctcagggccagttcagcgctggcggctgtacattcgatgacggtccaggcgcttgcgattatcaccaggatctctacgacgatttcgagtgggtgcacgtatccgctcaagagccacactatttgccccctgagatgccccagggatcttacatgatagtggatagttccgaccacgatccgggggaaaaggccagacttcagttgccgaccatgaaggagaacgacacccactgcattgacttttcttacctgctatacagccaaaagggcctgaaccccggaacactgaatattttggtgcgtgttaacaagggaccccttgctaacccgatatggaatgtgacaggcttcactggcagggactggctccgagccgaactggctgtgtctacattttggccaaacgagtaccaggtgatcttcgaagctgaggtaagcggaggccgctccggctacatcgcaatcgacgatatacaggtactaagctacccctgcgacaaatcccctcacttccttagattgggagatgtagaggtgaatgcgggccaaaacgcgacatttcagtgcattgccacgggtagagatgccgtccacaacaaattgtggctgcagcgaaggaatggcgaagacatccccgttgcccagactaaaaatattaatcataggcgattcgccgcaagctttagattgcaggaagtcacaaaaaccgatcaggatctctacaggtgcgtgacgcagtcagaaaggggatccggggtctccaactttgcacagcttatcgtaagggaacccccccgtcccatcgctccgccgcagttactgggcgtgggcccgacgtatctcctgatacagctgaatgccaattcaattattggcgatggacctatcatcctgaaagaggtagagtataggatgacgtctggatcatggaccgagactcacgccgtcaacgccccaacctacaagttatggcatctcgatccagataccgaatacgaaataagagtgctgctcaccagaccgggggagggtggaaccggattacccgggccccccttgattactcggacaaaatgcgcggaacccatgaggactccaaaaaccttgaagattgccgagatccaggccagaagaatcgctgtggactgggaatcattgggatacaacattacccggtgtcatacttttaacgtcacgatctgctaccactactttcgcgggcacaacgaaagcaaggcagactgtctcgatatggacccgaaggcgcctcaacacgtggtcaaccatctgcccccttatactaacgtcagcctgaaaatgatcctaaccaatccggaggggcgaaaagaaagcgaagaaaccattattcagacggatgaggatgtcccagggcccgtgcccgtgaagtcactccagggtaccagtttcgaaaataaaatctttctgaactggaaagagcctttggatcctaacggtattataacccagtatgagatatcctattccagtatccgcagcttcgaccctgcagtcccagtcgccggacccccccagaccgtatcaaatctgtggaacagcacacaccacgtgttcatgcatctccatccgggtactacttatcagttcttcatccgcgcctccacagtaaaagggttcgggcctgctactgccattaatgtaacgacgaacatatccgccccgactctcccggactacgagggcgttgatgcctctctgaacgaaacagcgaccactattacagtgctcctgcgccccgcacaggccaagggcgcccccatcagcgcttatcaaattgtggtggaggaactgcatccccataggacgaaacgggaggccggcgctatggagtgttatcaggtgcccgttacttatcagaacgctatgagcgggggtgccccgtattattttgccgcagagctccccccagggaacttaccagagcccgctccattcacagtgggagataaccgcacttatcagggtttctggaacccgcctttggctccacgcaaggggtacaatatctactttcaggccatgtcttctgttgaaaaagagaccaaaacacaatgcgtgaggattgcaacaaaggcagccgccacggaagagccagaggtaatccctgacccagctaagcagaccgaccgagtcgttaagatcgctggtattagcgccggaatccttgtttttattctgctgctgttagtggtgatcttaatcgtcaagaagagcaagcttgccaagaagcggaaggatgcaatgggcaacacacgacaggaaatgacccatatggtaaatgctatggacagaagttacgctgatcagtccaccctgcacgctgaggatcctttatccattaccttcatggaccaacataacttttcaccgcggtatgagaatcacagcgccacggccgagtcctcacggttgctggacgtaccgcgctacctctgtgaaggcaccgaatccccttatcagacagggcaactgcacccagccatacgtgtagcagacctgttgcagcatattaacctgatgaagacatcggattcgtacgggtttaaggaggaatatgaaagcttttttgaagggcagtcagcgagctgggatgttgccaagaaagaccagaatagggccaaaaatcggtacggaaacattattgcatatgaccattcaagggtgatcctccagcctgtggaggacgatccctcctcagactacatcaacgccaactacatagacatttggttatacagggatggctaccaaaggccctcacattacatcgcaacccaaggaccagtacacgagacagtgtatgatttctggagaatgatctggcaggaacagtctgcctgcatcgtgatggtcactaaccttgtggaagtgggccgtgttaagtgttataaatactggccagacgacaccgaggtatatggtgactttaaagtcacatgtgtggagatggaaccactcgctgagtatgtggtgcgcactttcacactagagaggagggggtacaatgagatccgagaggtcaaacagttccatttcacgggatggcctgatcacggcgtgccttatcacgccacaggtctgttgtcatttatacgacgcgtgaaactgagtaatcccccaagcgcaggaccaatcgtggtgcattgctctgcaggggctggccggacaggctgttatatagtgatcgacattatgctcgacatggccgagcgcgaaggcgttgtggacatctataactgtgtcaaggcattaagatctcgtcgtatcaacatggtccaaacggaggagcagtacatcttcatccacgatgctatcctggaagcctgcctctgcggagagacagccattccagtctgtgaattcaaggccgcttacttcgatatgatcaggattgacagccagaccaactcatctcacctgaaggacgaatttcagacgctgaactctgtgacacccagacttcaggccgaggactgctctatcgcctgtcttccgcgcaaccatgataagaaccggtttatggacatgctacctcccgacagatgcctgccctttctgattaccatcgacggagaaagctctaactacatcaacgcagctcttatggactcctataggcagcctgccgcttttattgtgacccaatacccactgcctaacacggtgaaggacttctggcggcttgtgtacgactatgggtgcacttccattgtcatgcttaacgaggtcgacctgagccagggctgcccacaatactggcctgaagagggcatgctgcggtacggacctatacaagtcgaatgcatgtcttgtagcatggactgcgatgtaattaaccgtatcttcaggatttgtaatctgacccggccacaagagggatacctgatggtccaacaatttcagtacctgggctgggccagtcaccgcgaggtgcctggaagcaagcgctcatttttgaagcttatccttcaggtggaaaagtggcaggaggagtgtgaggagggcgagggcaggaccattatccactgcctgaatgggggggggcgctcgggtatgttctgtgccataggcatcgtggtggagatggtgaagcgtcagaatgtcgttgatgtgtttcatgccgtcaaaaccctgcgaaacagcaaacccaacatggtcgaggcccctgaacaatatagattctgttacgatgtcgcccttgaatacctggaatcttcttag

SEQ ID NO: 201751 - DNA, 4320 bp, Artificial Sequence
  Description of Artificial Sequence: Synthetic coding sequence
atggacaccaccgccgccgccgccctgcccgccttcgtggccctgctgcttttatccccatggcccctgctgggaagtgcgcaggggcaattttctgctggaggctgcacctttgatgatggcccgggagcctgcgattatcatcaagacctgtacgacgattttgagtgggtgcacgtcagtgcgcaggagcctcattatctgcctccagaaatgccgcaggggtcctatatgatcgtggacagctcagatcatgaccccggcgaaaaggcgcgtttacagctgcccaccatgaaggagaatgatacccactgtattgatttctcctacctgctgtatagtcagaagggtctgaaccctggtacgttgaacattttggttcgagtgaacaaaggccctctagcaaatcctatttggaatgtcaccggattcacagggagggactggcttcgtgctgagctcgccgtaagtacattctggccaaacgagtatcaggttatctttgaggccgaagtctccggtggacgctcagggtacatcgcgatcgatgatatacaagttttgtcatacccttgcgacaaatccccacattttctgcggctgggcgacgttgaggtcaatgccgggcaaaacgctacattccagtgtatcgcaaccggcagagacgcagtgcataataaactttggctccagcggcgtaacggagaggatatacccgtcgctcagaccaagaatatcaatcacaggcggttcgctgcctcgtttagattgcaggaggtaaccaaaaccgatcaggacctctaccgatgcgtaacccaatccgaacgggggagcggagtgtctaacttcgcacagttgatcgtcagagagcctcctaggcctattgcccccccccaactcctgggagtgggtccaacctatctgttgattcaactgaatgcgaattccatcattggcgatggccctatcattctgaaagaagtcgaatatcgtatgacaagcggctcctggacagaaacccatgctgtcaatgcccctacctataaactgtggcatttggatcccgacaccgaatatgagattagagtgctgttaactcgacctggcgaaggtggcaccggactgcccggcccgcctttgatcacccggaccaagtgcgccgaacccatgcgcactcctaagaccctgaagattgctgagattcaggcacgcagaatcgcggtggactgggaatccctggggtacaacattacccgctgtcatactttcaatgtcacgatctgttaccactattttaggggacacaacgagtctaaggcagactgtttagacatggacccgaaggcaccacaacatgtagtgaaccacctgcctccctacaccaacgtgtctcttaagatgattctcacaaaccctgaggggagaaaggaatccgaggagacaatcatacagaccgacgaggatgttccaggtccagttcccgtgaagtccctccaaggtaccagtttcgagaacaaaattttcctgaactggaaggaaccactggatcccaatggcataatcactcagtatgagatctcatacagctctattcgctcatttgaccctgccgtccccgtcgccggtccccctcagacggtttccaacctttggaacagtactcatcatgttttcatgcaccttcaccccggcacaacataccagtttttcatcagagctagtaccgtcaaaggcttcgggcctgcgacagcaattaacgtgacaaccaatatttctgcaccaaccctcccggattacgaaggcgtggacgccagtttgaatgaaaccgcgaccacaatcaccgtgctcctgagaccagctcaggccaagggggccccgatctcagcttaccagatcgtggtagaggaactgcacccgcacaggacgaagcgagaggctggtgctatggagtgctaccaggtccctgtgacctaccaaaacgcaatgtctggtggagccccctattacttcgcagctgagttgcctcccgggaatcttccagagccggccccgtttaccgtgggggacaatagaacttaccagggattctggaatccaccacttgccccccgcaagggctacaatatctattttcaggccatgagctccgtcgaaaaggagactaaaactcagtgcgttaggattgcgacaaaggcagccacagaggaacccgaggtgattccggatcctgccaagcaaaccgatcgcgtggtgaaaatagcgggcatcagcgctggaatcctggtattcattctcctgctgctcgtggtgattttaattgttaagaaaagcaaactggccaagaagcggaaggatgcgatgggcaacacacgtcaagagatgacacacatggtgaacgctatggaccggtcttacgcagaccaatctaccttgcatgcagaagatcctctgtctattacttttatggaccagcataacttctcccctagatacgagaatcacagtgctaccgcagagtcgagccgcctgttggacgtgccacgctacctgtgtgagggcacggaaagcccctaccagacgggtcaactgcaccccgccatccgtgttgccgacttgctccagcacattaaccttatgaagaccagcgatagttatggctttaaggaagagtatgagtcatttttcgaaggccagagcgcatcctgggacgttgcaaagaaggaccagaatcgggccaaaaacaggtatggcaacattatagcctacgaccactctcgagtgatccttcagcccgttgaggacgaccccagtagtgactatattaatgctaattatatagacggctaccagcgccccagtcattatatcgccacccaaggtccagttcatgaaacagtttacgatttctggcggatgatctggcaagaacaaagtgcttgcatcgtgatggtaacaaatctcgtcgaggtgggcagagtgaagtgttacaagtattggcccgacgataccgaggtctacggtgacttcaaagttacctgcgtggagatggaaccattggccgaatacgtggtgcgtaccttcacgctggaacgtaggggctataacgaaatccgggaagttaagcagttccactttacaggctggcccgatcacggtgtgccttatcacgccactggtctgctgtcctttatccggcgcgtgaagttgtctaatccaccaagtgcgggaccaatcgtcgtccattgcagcgccggtgccggaagaaccgggtgctacatagtgatcgacatcatgcttgatatggctgagagagaaggtgtggtggatatatataactgcgtgaaagcactgcgatccaggcggattaacatggttcagaccgaagagcagtacattttcatccacgatgctatcctcgaagcctgtctctgtggagagacagcaataccagtgtgcgaatttaaggcagcctattttgatatgattagaatcgattcccagacaaacagcagtcatctcaaggacgagtttcagacgctcaattccgtcacccctcgtctccaagccgaggattgcagcattgcatgcctgcctcggaaccatgataagaatagatttatggacatgctgccgccagatcgctgtctgccctttttgatcaccatcgacggtgaaagttctaactatattaacgctgccctgatggatagttaccgccaaccggcagcattcattgtgacacagtaccctctgcccaacaccgttaaggacttttggcgattggtttacgattacgggtgtaccagcatcgtcatgttgaacgaggttgacttgagccagggctgtcctcagtactggcctgaagagggcatgttacggtatgggcccatccaggtggagtgtatgtcttgctctatggattgcgacgttataaatagaatctttagaatttgcaacttaacacgaccccaagaggggtacctaatggtgcagcagttccagtatctggggtgggcatcccaccgggaagtgcctgggtctaagcgctcctttctgaagttgatactgcaggtggagaagtggcaggaggagtgcgaggaaggcgaaggcaggactattatccactgtttaaatggagggggacggtcgggaatgttttgcgcaatcgggattgttgtggagatggtaaaacgccaaaacgttgtggacgtgtttcacgcagttaaaacccttcgaaactccaaacccaacatggtcgaagccccagagcagtataggttttgttatgacgtggctcttgagtatcttgagagcagttag

SEQ ID NO: 201752 - DNA, 4323 bp, Artificial Sequence
  Description of Artificial Sequence: Synthetic coding sequence
atggacaccaccgccgccgccgccctgcccgccttcgtggccctgttgctcttgtccccatggcctctgcttggtagcgcccagggacagttctctgccgggggttgtacattcgatgatggacccggcgcctgcgactaccaccaggatctctacgatgactttgagtgggttcatgtgtcagcccaggaaccacattatctcccccctgagatgccccagggatcatatatgatagtggactcgtccgatcacgacccgggtgagaaagcaaggctgcagttacccacaatgaaagagaacgacacacattgcattgacttttcttatctgctttattcccaaaagggtctcaacccaggcacactcaacatactagtgagggtgaataaaggaccattagccaatccaatttggaatgtgaccggctttactggaagagactggctaagagctgaattagctgtgtcaactttttggccaaatgagtaccaagtgatcttcgaggctgaagtttctgggggccggtctggttacatcgctattgacgacatccaggtcttgtcctacccttgcgacaaaagtcctcattttctgcgactgggcgatgttgaggtgaacgctggccagaatgccaccttccagtgcatcgccaccggccgggacgcagtacataacaagctgtggctccaaagaagaaatggtgaagatatccctgtcgctcagacaaagaacataaatcatcgaaggttcgcggcgagcttcaggttgcaagaggttaccaaaacagaccaggatctctatagatgtgttactcagtcggagagaggaagtggagtgtcaaactttgcccaattaatagtacgtgagcctccgcggccaatcgcccctccacagcttcttggggtaggccccacatatttgctgatccagttgaacgccaactcgatcattggggatggtccaattatcctgaaggaggtagaatacagaatgaccagcgggagctggaccgaaacgcacgccgtcaacgcacccacctacaagctctggcatctcgatccagataccgaatatgaaatcagggttcttcttacaaggcctggagaaggaggtacaggactgccaggccctccactgatcacacggaccaagtgcgccgaacctatgcgaactcccaaaaccttgaagatcgccgaaatccaggcacgccgaatcgccgtcgattgggagagccttggctacaatataactcgctgccacacatttaacgtgacgatctgttaccattattttagagggcataatgagtcaaaagccgactgtctggacatggatcccaaagcccctcagcacgtggtcaaccacctgcctccttatacaaacgtgtccctgaagatgatcctcaccaacccagaagggagaaaagaaagtgaggagacaataatccagacagacgaggacgttccgggccctgtccccgtcaaatcgctccagggtacctcatttgaaaataaaatatttctgaactggaaggaaccattggacccaaacgggattatcacacagtacgaaataagctactcctcaatcagaagctttgatccggccgtgcccgtggcaggacccccccagacagtgagtaacctctggaatagcacgcaccatgtcttcatgcacttgcaccccggaacaacgtatcaattctttatccgtgcctccaccgtaaaggggttcggtcctgccacagccataaatgttacaacaaacattagcgccccgacactgccagattatgaaggagtcgatgcctcccttaacgagacggccacaacaatcaccgtgttgctgcggcctgcacaggctaagggcgcaccgataagcgcatatcagatcgtggtggaggagctgcaccctcatcgcacaaagcgggaagcaggcgctatggaatgttatcaggttcccgttacctaccagaatgctatgtcaggaggcgccccttattattttgcggccgaacttccacctggcaaccttccagaaccagccccctttactgtaggcgacaaccgtacatatcagggattttggaaccctcctctggcaccccgcaaggggtacaatatctacttccaggcaatgagttccgtggaaaaggagactaagacccaatgtgtgcgcattgcgaccaaggccgcagccacggaagagcctgaagttatccccgaccctgctaagcagaccgaccgagtggtaaaaattgctggaatctccgccggaattctcgtgttcatcctactactgctggttgtgattctcattgtcaaaaaaagtaaactggctaagaagcggaaggatgctatggggaacacacgccaggagatgacccacatggtgaatgccatggatagaagttacgccgaccagagcactctccacgcagaagatccattgagcatcaccttcatggaccagcacaactttagccccaggtatgagaaccacagcgccactgctgagagctcccgcctacttgatgtccccagatacctgtgtgaaggaacagagagtccataccagaccggacagctccacccagccatcagagtcgccgacctgctgcaacatatcaaccttatgaagactagtgactcgtatggcttcaaggaggaatacgaatcttttttcgaaggacagagtgccagttgggacgtggcgaaaaaagaccaaaaccgggcaaaaaaccggtacgggaacatcatcgcttacgaccactcaagggtcattctgcagccagtggaggatgatccttcttctgactatattaatgccaattacatcgacggctatcagcggcccagtcattacattgcaacccaggggccggtccacgagacagtatatgacttctggcgcatgatttggcaagaacaatcggcttgtatcgtcatggttaccaacctcgtcgaggtggggcgcgtgaaatgttataaatactggccagacgatacagaggtgtacggagatttcaaagtcacctgcgtcgagatggagcccttggccgagtatgtggtgcgcacctttaccctcgagcggaggggctataatgagattagggaggtgaagcagttccactttacaggctggccagatcacggcgtcccctaccacgctaccgggctccttagcttcatcaggcgagttaaactctctaatcctccttcagctggaccaatagtggtacactgctccgcgggtgctggtcgcacaggctgctacatcgtcattgatatcatgctggatatggcagaaagggaaggggtggtcgatatctataattgcgtcaaggctctgcgctcacggcggattaatatggtccaaacagaagagcagtacatctttatccacgatgcgatcctggaagcctgtctctgcggcgagactgctattccggtgtgcgaatttaaagcagcctacttcgatatgataagaatcgactctcagacgaactccagccacctgaaggatgagttccagacccttaactcggtgactccaagactccaggccgaggattgctccattgcctgtctacctagaaaccatgacaagaatcggtttatggacatgcttcctcccgatcgatgtctacccttcctgatcaccatagatggcgaaagttcaaactatatcaatgccgccctcatggacagctaccggcagccagcagccttcattgtcacccagtatcccctaccgaatacggtgaaagacttttggcggctggtgtatgattatggttgcaccagtattgtgatgcttaacgaagtcgacctcagccagggttgtccccaatattggccagaggagggaatgctcagatacggaccaattcaagtggagtgcatgtcctgttcaatggactgcgacgtaattaacaggatcttccgcatctgtaatctcacccgacctcaggaaggatacttaatggtgcagcagttccagtatcttggatgggcctctcaccgcgaggtacctgggtcaaagagatcattcctgaaactgatcctccaggtcgagaagtggcaggaggagtgcgaagagggcgagggccggaccatcatacactgcttgaacggcggagggcggtcagggatgttctgcgctatcggtatagttgttgagatggtcaagaggcagaatgtcgttgacgtctttcatgcagttaaaaccctccgcaactccaagccaaacatggttgaggccccggaacagtaccgattttgctacgacgtagccttggaatatctagagagttcatag

SEQ ID NO: 201753 - DNA, 4374 bp, Artificial Sequence
  Description of Artificial Sequence: Synthetic coding sequence
atggacaccaccgccgccgccgccctgcccgccttcgtggccctgctgctgctaagcccatggcccctactgggctcagctcagggtcaattctctgccggcggttgcaccttcgacgatggacctggggcctgcgactaccatcaggatctctacgatgatttcgaatgggtgcacgtgagcgcccaggagccacattacttgcctcctgaaatgccacaagggagttacatgatcgtcgattctagtgatcatgaccccggcgagaaggctcgcctgcagttacccactatgaaggaaaatgacactcactgtattgatttttcctacttgctctactcccaaaaagggttgaaccctggtacattgaacattctcgtgagggtgaataaaggccccctcgcaaatccaatctggaacgtgactgggttcaccggccgtgactggctacgcgccgagctggcagtgtcaacattttggcctaacgagtaccaggtgatattcgaagccgaggtatccggcggcaggtccggctacatcgccattgatgatattcaggtcttatcgtatccctgtgataagtcccctcacttccttcgactgggagacgtggaagtcaatgccggtcagaatgctaccttccagtgcatcgccaccggccgcgacgctgtgcataacaagctgtggctgcagcggagaaacggggaggatatccccgtggcccagactaaaaacatcaatcatcggcggttcgcagctagctttcggttacaagaggtaaccaaaaccgaccaggacctgtataggtgtgtgactcagtcggagaggggatcgggggtgagcaattttgcccagctgattgtgcgcgaacccccgagaccgattgcgccacctcagctactgggagtggggcccacttatctattgattcagctgaatgcaaatagcattattggcgatgggccaataatcctgaaagaagtcgagtatcgaatgacctctggtagctggacggaaacccacgctgtaaatgcccccacctacaagttatggcatcttgatccggatactgagtacgaaatccgagtcctcctgactcgacctggagaggggggaaccggactcccaggccccccacttatcactcgtactaaatgcgccgagcctatgaggacacccaagacactgaagatagccgaaatccaggcgagacggatcgccgtggactgggagtccctcgggtacaatatcaccagatgtcacacattcaatgtaaccatttgctaccactacttccggggtcacaacgaatctaaagccgattgcctcgacatggatcctaaggctccacagcatgttgtgaaccacctgcctccctacactaacgtgagtttgaagatgatactgactaatcctgaaggtcggaaagagtcagaagaaacaataatccaaaccgatgaggatgtgccaggacccgtaccagttaaatcccttcagggcacaagttttgagaacaaaatttttttgaattggaaagagccattggatccaaacggcataattacccaatacgagatctcctattcctctattcggtcattcgatccagctgtgcccgtggccggaccacctcaaacagtcagtaatctctggaacagtacccatcatgtgttcatgcacttgcatcccggcaccacatatcagttttttattagagcatcgacggtcaagggctttgggcccgccaccgcgatcaatgtcaccactaacatcagcgctccaacactccccgattatgagggcgtggacgcctcactgaatgaaaccgctaccaccatcaccgtgctgttacgccctgcccaagccaaaggtgcccccatctccgcctatcagatcgtcgtggaggagctccatccgcatcggacgaaaagagaagccggcgctatggaatgctatcaagtgccggtgacttaccagaatgccatgtctggcggcgccccttactactttgctgccgaactgccccccgggaacctgcctgaaccagccccattcacagtaggcgataatcgcacctaccagggtttttggaacccacctctggccccaagaaagggctacaatatttactttcaagccatgtcttccgtcgagaaggaaacgaagacccagtgtgtgcgcattgcaaccaaagccgccgccactgaagagccggaggtgataccggatcctgccaagcagacggaccgtgttgtgaaaatcgctgggatcagcgcaggcatcctggtctttatcctattgttgcttgttgtgattctcatcgttaaaaagagcaagcttgcaaaaaagaggaaggacgctatggggaatacccggcaggagatgactcatatggtgaatgcgatggatcgatcttacgccgatcagtctacgcttcacgctgaggaccctctcagcattactttcatggatcagcacaacttctctccccgcctgcccaacgaccctttggtcccaacagcagtgctcgatgagaaccacagcgctacggctgaatcatccagactcctggatgtccccaggtatctgtgtgagggaacagagtccccataccagaccggccagttacaccctgctattcgcgtggctgacttgctgcagcacattaatctgatgaaaacatctgatagctacggcttcaaagaggagtacgaatccttctttgagggtcagtcagcgtcttgggatgtggctaaaaaggatcagaatcgggctaagaaccgctacgggaacataatcgcctacgaccattcaagggtgatactgcagccagtagaggacgacccttcgagtgattacataaatgctaattatatcgacgtgagcatctttattggttatcagcggccgtctcactacatcgccacgcagggcccggtgcatgagacggtgtacgatttttggcggatgatctggcaggaacagtcagcctgtattgtaatggtgaccaatctcgtcgaggtgggaagagtcaagtgctataagtattggccagacgataccgaggtgtatggcgacttcaaggtgacctgtgtggagatggagcccctggccgagtatgtggtgaggactttcaccctagaaagaagaggttacaatgaaattcgggaagttaagcagttccacttcacaggatggccagaccacggggtgccatatcacgcaactgggttactgtcattcatcaggcgtgtgaagctctccaacccgcccagtgccggccccatcgtagtacactgctccgcaggggccggccgcacaggctgctacatcgtgatcgacattatgttggacatggccgaaagagaaggggtggtcgacatatacaattgcgtcaaagccttgcgaagcaggaggatcaatatggtccagacagaagaacaatatatctttattcacgatgcgatcctggaggcgtgcctgtgtggcgaaactgcaatccccgtgtgcgagtttaaggcagcgtatttcgacatgatacgtatagactcacagacaaatagctcccacctcaaggacgaattccaaacactgaacagcgttacccctagattgcaggccgaggattgtagcattgcatgtttaccaaggaatcacgacaaaaatagatttatggatatgttgccgccagatcggtgtctcccctttcttatcacgatagacggggagagttctaactacatcaacgcggcccttatggacagctaccggcagcccgccgcattcatcgtgacccagtaccctctacccaacacggtgaaagacttctggcggctcgtgtacgattacggctgcacttccatcgttatgctaaatgaggtggacctctcccaaggatgtcctcagtactggccggaggaaggcatgctgcggtacgggcctattcaggtagaatgtatgagttgtagcatggattgtgacgtgatcaatcgcattttccgcatttgcaaccttacccgtccacaggaaggctatctgatggtgcagcagtttcagtatctgggttgggctagtcacagagaggttcctggttctaaaaggtccttcctgaaattgatcctgcaggtagaaaaatggcaagaggagtgcgaagagggagaagggcggactatcatccactgtctgaacggcggcgggcgatctggaatgttctgtgcgattgggatcgtggtcgaaatggtaaagagacagaacgttgtggacgtcttccatgctgtgaaaaccctccggaattcaaagccaaacatggtcgaggctccggagcagtacagattctgctacgacgtggctctggagtaccttgagtcttcctag

SEQ ID NO: 201754 - DNA, 2244 bp, Artificial Sequence
  Description of Artificial Sequence: Synthetic coding sequence
atgaccctgaacggctgcatgctggtgctgaagagcctgatcatctaccatccaagatgccccaaagtcatatttgaggccgaagtttctggtgggaggtcagggtatattgctatagatgatatccaggtgctcagctatccttgtgacaaatccccacactttttgaggttgggagatgtggaggtgaacgcaggccagaacgcaacttttcagtgcattgcgacaggacgtgatgcggtgcataacaagctctggttgcagaggcgtaatggggaggatattcctgtggctcagaccaagaacataaatcacaggcgctttgcagcctctttcaggttgcaggaggtgacaaaaaccgatcaggatctgtaccgctgcgtcacgcaatcggagcggggatccggagtcagcaatttcgctcaactcattgtaagggagcctccgcgccctatagctccaccacaactgcttggtgtgggacctacctacctcttgattcagctgaatgccaattctattattggggatggccctattatcctaaaggaagtggaatatagaatgacctctggcagttggacggaaacacacgctgtgaatgccccaacctacaaactatggcacctcgaccccgacacagagtatgagatccgtgtgctattaacacgccctggtgaggggggcactgggctgcctgggccccctctcatcacaaggaccaaatgcgctgagcccatgcgcacccctaaaacgctgaagatagccgagatccaggcaagaagaattgctgtggattgggagtcactggggtacaacatcacacggtgccatactttcaatgtgacgatctgttaccactactttaggggacataatgaaagcaaggcagactgcctggacatggatcccaaggcgccccaacacgttgtaaatcacctgccaccatacactaatgtctctttaaagatgattcttaccaaccctgagggaaggaaggagtccgaggagaccatcattcagaccgatgaagacgtgcctgggcccgtacctgtcaaatctctgcagggcactagttttgagaacaaaatcttcttaaactggaaagaacccctggaccccaacggaataataacacaatacgagatcagttattcgtccatcagatcattcgacccagccgttccagtggccgggccccctcagacagtgagcaatctgtggaatagcacccaccacgtcttcatgcatctgcatcccgggactacctaccagtttttcatccgcgcctctacagtaaagggcttcgggcctgctacagccatcaacgtcactaccaatatcagcgcaccaacgctgcctgactacgaaggtgtagatgctagccttaatgaaacagctaccaccattacggtcttgctgaggcccgcccaggcgaaaggcgcacctatcagcgcctaccaaatcgtagtggaagagctgcacccgcatcgcacgaaacgcgaggctggagccatggaatgttaccaggttcctgtcacataccagaacgccatgtccggcggtgccccttactacttcgccgccgagttgccacccgggaatctccctgagccagcaccatttacagtgggcgataacaggacctaccaagggttctggaatcctccactcgcccctcgcaagggttataatatttattttcaggcaatgtccagtgtggagaaagaaaccaagacgcagtgcgtacgcatcgctacaaaggcggcggccacagaagagccagaggtaattcccgacccagccaaacaaaccgatcgggttgttaaaatcgccgggatctctgctggtattctggtctttattttattgctcttagtggttatcttgatcgtcaaaaaacggtacatttgttggcggaggcacatctgtatccgaaacatacgacgttcttattactcttattcctactaccttaagctggccaagaaaagaaaagacgccatgggtaacacgcgccaagagatgacccacatggttaacgccatggatcgaagctacgctgaccagtcgacgcttcacgcagaagacccactgagcatcacttttatggaccaacacaacttctcacccagactgccaaatgacccgctcgtacctacggctgtactggttccttcgcccggacgaaaaaacgtctaccatggcgataataactcattcttcgcgatatcctacctttag

SEQ ID NO: 201755 - DNA, 4389 bp, Artificial Sequence
  Description of Artificial Sequence: Synthetic coding sequence
atggacaccaccgccgccgccgccctgcccgccttcgtggccctgctgctcctgtcaccctggccattgctgggaagcgcccagggccagttttcagccggcggatgcacgttcgacgatgggcctggagcttgtgattatcatcaggacctgtacgatgacttcgagtgggtccacgtgtccgcccaagagcctcactacctccccccagagatgccacagggctcttacatgatagtggatagctccgatcacgacccaggggaaaaagcacggctccagctgcctaccatgaaggagaacgacactcattgcatcgacttctcatatctgttgtactctcagaaaggtttgaatccaggtacattgaacatcctggtgcgggttaacaaaggtcccctggctaatccgatttggaacgtaaccggctttaccggcagggattggttgagagccgagctggccgtatctacgttctggccgaacgaataccaggtgatttttgaggctgaggtctccggaggaaggagcggatatatcgctattgacgacattcaggtgctctcatacccatgtgataagtccccccacttcctacggctaggcgatgttgaagtaaacgccggtcagaacgccacgtttcaatgtattgcgactggcagagacgctgtgcacaacaaactgtggttgcagagacgcaatggcgaggatataccggtggcacaaactaaaaacataaaccaccggagatttgccgcatcattcagattgcaggaggtgactaagaccgatcaggatttgtaccgctgtgtgacacaatcggaaaggggttctggagtctccaatttcgcccagctgattgtgcgcgagccaccaaggcccatcgctccgccccaactgctgggagtaggacccacctacctgctgattcagctgaatgcgaacagtatcattggggacggaccgatcatccttaaagaagtcgaatatagaatgacgagcggcagctggaccgaaacacatgctgtgaatgctcctacctacaagttatggcacctcgacccagataccgagtacgagatacgagtgctcctgacccggcccggggagggcggcacaggcctcccagggccaccacttatcacccgcacgaagtgcgccgagcccatgcgaacccccaaaacacttaaaattgcagagatacaggccaggcggattgccgtggactgggaatccttgggatacaatatcacgaggtgccatacttttaacgtgacaatctgctaccattacttcagaggtcacaatgaatctaaggccgactgtttggacatggaccctaaggctccgcagcatgtcgttaatcacttgcccccttacactaatgtgagccttaagatgatcctaacaaacccagagggaaggaaggagtctgaagagaccattatccagaccgatgaagatgtccccggccctgtaccagtgaaatcactccaggggacatctttcgaaaacaagatattcttgaactggaaagagccgcttgaccccaacggaatcattactcagtatgagatctcatacagctccattcgctcgttcgatcctgccgtccctgtggctggccctccacagaccgtgagcaatctctggaatagcacccatcacgtttttatgcacctgcaccctggcaccacataccagttttttatccgcgcctcgactgttaaggggtttggtcccgccacagccatcaatgtgacgactaacattagcgctccaactctgcctgattatgagggtgtcgatgcatctctgaacgagaccgcgactacaattaccgtccttctgagacctgcccaggccaagggtgctcccattagtgcataccaaatcgtcgttgaagagttgcatcctcacaggacaaaacgagaggccggcgctatggagtgctaccaggtccccgtcacgtaccaaaacgcaatgagtggaggagcaccatattatttcgccgctgagctcccccctggcaacttaccggagcctgcccctttcacagttggcgacaatcggacgtaccaggggttctggaatccacctttggccccaagaaaaggctataatatctacttccaggccatgagctcggtggagaaggaaacgaagacacagtgtgtcagaattgcaactaaagcagcagcaacagaagagccggaagtgatacctgatcccgccaaacaaacagaccgcgtcgtcaagatagccgggatcagtgctggtattctagtttttattctcctgctgctcgttgtaatcctcattgtgaagaagtctaagctggctaagaagaggaaagacgccatgggcaatactagacaggagatgacacatatggtgaatgcgatggatcgttcatatgcagaccaatctacactgcatgccgaggaccctctgtctattacctttatggaccagcacaactttagccctaggctcccgaacgaccccctcgtgcccaccgcggttctcgttccaattacggatgaaaatcactcggctaccgcagaaagtagtaggctgcttgacgtgcctaggtatctctgcgaaggaacagagtccccctatcagactggtcaactgcacccggcaatcagggtggccgacctgttgcagcacatcaacctcatgaaaactagcgactcatacggctttaaagaggagtatgagtcattttttgaggggcagagtgcctcatgggatgtggccaagaaggatcagaacagggcgaagaatcggtacggcaatatcatcgcttatgatcactcgcgggtcatcctacagcccgtggaggacgatccatcctccgactatataaatgccaattacatcgacatatggctttaccgggatggttaccagcgtccctcccactacatcgctacccaggggccagtgcacgaaactgtgtatgacttctggcggatgatttggcaagaacagtccgcctgtatcgtgatggttactaacctggtcgaagttgggcgggtcaaatgctacaaatactggccagacgataccgaagtttacggggacttcaaggtgacttgtgtggagatggaacctctcgcagagtatgtcgttcgtacattcaccctggaacggcgcggatataatgagattcgtgaggtgaaacaatttcactttactgggtggccagaccacggggttccttaccatgccacagggctcctaagcttcattcgcagggttaagctgagcaacccccccagtgccggaccgattgtggtgcattgtagcgctggagcaggtcggaccgggtgttatatagtgatcgatattatgctcgacatggccgaacgggaaggggtggtagatatatacaattgtgtcaaggctctacgatcccgcagaatcaacatggtgcaaactgaggagcagtatatctttattcatgatgcaattctggaggcctgcctgtgtggggagaccgcaattcccgtgtgtgaattcaaggcagcctacttcgatatgatacgtatcgattcccagaccaattcttcccacctgaaagacgaatttcagaccttgaatagcgtgacgccccgattacaggctgaagactgctccattgcgtgtctgcctagaaatcatgataagaacaggtttatggacatgctgccccccgacagatgcctccctttcctgattacaatcgatggcgaatctagtaattatatcaatgccgccctgatggattcgtataggcagcccgccgcttttattgtgacacagtacccactgcccaacaccgtgaaggatttttggcggctggtgtatgactacggatgcacctccattgtgatgctgaacgaagttgatttaagtcagggatgtccccagtattggcctgaggaagggatgctgcgctacggacccatccaggtagaatgcatgagctgctctatggactgtgatgtcattaatcgtatatttcgaatctgcaatttaacacgcccccaggaaggttacttaatggtgcagcagttccaatacctgggctgggcctcccaccgggaggtgccaggaagtaaacggtcatttttgaaattgattctccaggtggagaaatggcaggaggaatgtgaggagggagagggccgcaccattatacactgtctgaacggagggggcaggtccggtatgttttgtgctatcggaattgtggttgagatggtcaagcgccagaacgtggtcgacgtttttcacgccgtcaagaccctgcggaattctaaacctaacatggtggaggcccctgaacagtaccggttctgttacgatgtcgcgctggagtatcttgaaagcagctag

SEQ ID NO: 201756 - DNA, 4359 bp, Artificial Sequence
  Description of Artificial Sequence: Synthetic coding sequence
atgcggggcctgggcacctgcctggccaccctggccggcctgctgctcacagcagccggggagacgttctcaggaggctgtctattcgatgagccctattctacatgcggctactcccagtccgaaggagatgacttcaattgggagcaagtgaatactctgacgaagcccactagtgacccctggatgccgagcgggtcctttatgctggtgaacgctagcggtcgccctgaggggcagcgggcccacctcctgctcccccagctgaaggaaaacgacacccattgcatcgacttccactactttgtgtcatctaagtctaattcaccacctggtttgctcaatgtgtatgtgaaagtgaataacggcccacttggtaaccccatttggaatataagcggggatcccactaggacatggaacagagcagagctcgcaatcagtacgttctggcccaacttctaccaggtaatatttgaggtgattacatctggacatcaagggtacttagctatcgatgaggtgaaggtacttggccatccctgcaccaggacccctcattttcttcgaattcagaatgtggaggtcaatgccggccagttcgctacttttcaatgctccgccatcgggcgcaccgttgccggggatcggctttggctacagggtattgatgtcagagatgccccactgaaagagatcaaagtgacttcctctcgtcgatttatcgcctcctttaacgtagtgaataccacaaaaagagacgccggtaagtaccgatgcatgattcgcacagaaggaggtgtgggtatcagtaactacgctgagctcgtggtcaaagagcctcccgtgccaattgcaccaccgcaactcgctagcgtgggcgcgacttatctctggatccagctgaacgccaattctatcaatggggacggccctattgtcgcccgcgaagttgagtactgtacagctagtggctcttggaatgacagacagccagtggattcaacctcttacaaaatcggtcatctcgaccctgacaccgagtatgagatcagcgtgctccttacacgaccaggtgagggaggaacaggcagcccagggccagctcttcggaccaggacaaagtgcgctgacccaatgcgcggccccagaaagcttgaggtcgttgaggtcaagtctcggcagattactataaggtgggagccattcggctacaatgtgacaaggtgtcattcctataatctaaccgtacactattgctaccaggtcggtggtcaggagcaggtgcgagaagaggtcagctgggacaccgaaaactctcaccctcagcataccattacaaatctctccccctatacgaacgttagcgtcaaactcattttgatgaatcctgaaggtaggaaggaaagccaagaactcatcgtccaaaccgacgaggatttaccgggcgcggtgccaactgaatctattcagggttccacgttcgaagaaaagatatttctccaatggcgggagcccactcagacctatggagttatcaccctgtacgaaattacctacaaggccgtttcttcctttgatcccgagatcgacctgtccaatcagtccggcagagtcagtaagctcggtaatgaaactcattttctgttctttggactgtaccctggcaccacgtacagcttcactatcagggctagcacagcaaaggggttcgggccacccgccactaaccagttcactaccaagatttcggctccttccatgccagcctatgaacttgagactccacttaaccaaactgacaacaccgtaaccgttatgctcaagcctgcccacagtagaggggcacccgtgtctgtgtaccagatcgtcgtggaagaagagcgtcccaggagaaccaaaaaaacaaccgagatcctgaaatgttacccagtcccaatccatttccagaatgcttcacttctgaacagtcagtattacttcgctgccgagttccccgctgattccctccaggccgcacaaccctttactatcggggataacaaaacttacaacgggtactggaatactcccttgctcccttataagagctacaggatctactttcaggccgccagccgtgctaacggtgaaactaaaatagattgtgtgcaagtggccaccaagggggcggccacaccaaaacctgtgcctgaacctgaaaaacagactgatcatacagtcaaaatagcgggagtgatcgctgggattctgctattcgtgatcatattcctgggggtggtgctagtaatgaaaaagaggaagcttgccaagaagagaaaagaaaccatgagtagtacacggcaggagatgacggtgatggtgaatagtatggataagtcctacgcggaacagggaaccaactgtgatgaggctttcagttttatggatactcacaaccttaatggcaggtcggttagcagcccgtcgtctttcacgatgaaaacaaacactctctctactagcgtgcccaattcttattatcccgacgaaacccataccatggctagcgacaccagcagtctcgtccagagccacacgtacaaaaagagggagcccgctgacgttccctatcagaccggtcagctccaccccgcaatcagagtggctgacttactgcagcacattacacagatgaagtgcgctgagggctacgggttcaaagaggaatacgagtctttcttcgagggacagtccgccccatgggactctgctaagaaggatgaaaatcgcatgaaaaaccgctacggcaacattattgcctatgaccactcgcgagtgcgactgcagacgattgaaggtgatactaattccgattacattaatggcaattacattgacggctaccacaggccgaaccattatattgccacgcagggccctatgcaggagactatatatgacttctggcgcatggtctggcatgagaatacggcgtcaatcattatggtgacgaacctggtcgaggtgggccgggttaagtgctgcaagtattggcccgacgatacagagatatacaaagatattaaagtgacattgattgaaactgaattgctggccgaatatgttatcaggacatttgctgtagagaaacggggcgttcacgaaatccgggaaattcgccagtttcattttaccggatggcccgaccacggagtcccttaccatgctacgggtctgttgggatttgtccgccaagtgaagtctaagtcaccgcctagcgccggaccactcgtggtccactgtagcgccggggcaggcagaacaggatgctttatcgtcattgacatcatgctcgatatggcagaacgggagggagtcgtggacatctataattgtgtgcgcgagctcaggagcagacgcgttaatatggtccagaccgaggagcagtatgtcttcatacatgacgccattttggaggcttgtctttgcggtgatacaagtgtgcctgcatcgcaggtaaggagcctttattacgatatgaataagctggacccacaaaccaacagctcgcagatcaaggaggaatttcggacacttaatatggtcacccctaccttgagggtggaggactgttccattgcccttttgccgcgtaatcacgaaaagaatcgctgcatggatatcctgcccccagatagatgtctccctttcctgataaccattgacggggagagctccaactacattaacgccgcactgatggacagttacaagcagccctcagcgttcattgttacccagcaccccctacctaataccgtgaaagatttttggaggctggtcctggactaccactgtacttcagtggtgatgcttaatgacgttgacccagcccaactttgtcctcagtattggccagagaatggcgttcacagacacgggccgattcaagtagagttcgtatctgccgacctggaggaggatatcatttcgagaatctttcggatttacaatgccgcacgcccacaggacggatacaggatggtgcagcaattccaatttttgggatggcccatgtaccgggacacccccgtttcaaagcgctcttttttgaagctcattaggcaggtagacaagtggcaagaggaatataacggcggagaggggcgcactgtggttcactgtctcaatggtgggggtcgctccggcactttctgcgccatctccatcgtgtgcgagatgctgcgccaccagagaacggtggacgtctttcacgctgttaagactctgcgtaataataaaccgaacatggttgacctcctggatcagtataaattctgctacgaggtggctttggagtatcttaattctggctag

SEQ ID NO: 201757 - DNA, 4173 bp, Artificial Sequence
  Description of Artificial Sequence: Synthetic coding sequence
atgcccagcggcagcttcatgctggtgaacgccagcggccggcccgagggccagagagctcacctgttactgcctcaactgaaggagaatgatacacactgcattgacttccactatttcgtcagctctaagtccaatagcccacctggactgctcaacgtgtatgtcaaagttaacaatgggcccctaggtaatccaatctggaacatctccggggatccaacacggacctggaacagggcagagctagcaatttcaaccttctggccgaacttctaccaggtaatatttgaggtgatcacatcgggtcatcaaggttacctggccatcgacgaggtgaaagtccttggccacccctgtacaaggaccccgcacttcttaaggattcaaaatgtagaagtgaacgctggccagttcgcaacttttcagtgcagcgccattgggagaacagtggctggggaccgtctgtggctgcaggggattgacgtccgcgacgctcctctcaaagaaattaaagtgacttccagtaggcgcttcatcgcttcctttaacgtggtgaacacaactaagagggacgccggcaagtaccgctgcatgattcgaacagaagggggcgtgggtatctccaattacgcggagctggtcgtaaaggagcccccagtcccaatagccccccctcagttggcctctgtgggagcgacctatctatggattcagctaaacgccaattccattaacggcgatggtcccatcgtggctcgggaagttgaatactgtactgcgagcggctcctggaacgatagacaacccgttgattccaccagctataagattggacatttagacccagatacggaatacgaaatcagcgtgctgcttactagacctggcgaaggcggcacaggatcacctgggcctgctctccggacacgtaccaaatgtgccgatcccatgaggggaccaagaaaattagaggtagtcgaagtgaaatccaggcaaatcactatacggtgggagccatttggatacaacgtgacaaggtgtcacagctataacctaactgtgcactactgctatcaggttggcgggcaggaacaagtgcgcgaggaagtctcatgggatactgagaactcacaccctcaacataccattactaacctctccccgtacaccaacgtctccgttaagctgattctgatgaacccagagggacgtaaggaatcccaggagctgatcgtacagactgatgaggatctcccgggagctgttccgacggagagcattcagggatcaacattcgaagagaaaatatttcttcaatggagggagccaactcagacatacggagtaatcacactgtacgagataacctataaagctgtgtcctcctttgacccagagatcgatctgtccaatcagagtggtagagtttctaaactgggcaacgagacccacttcttatttttcggcctttatcctgggaccacatattcttttactatcagggcttccacggctaaaggatttgggccaccggcaaccaaccagttcacgaccaagataagcgcccccagtatgcctgcctatgagttggagacacctctaaatcagacagataacaccgtgactgtaatgctgaaacctgcccacagcagaggcgctcctgtctcagtgtatcagatcgtggtcgaggaggagcgtccgaggcggacgaagaagacaactgaaattctaaagtgctatcctgtgccgatccattttcagaacgctagtctactgaattctcagtactatttcgcggcagagttccccgctgatagtctccaagcggcacagccttttactatcggtgataacaaaacatacaatggatactggaatacacccttgttaccttacaagagttatagaatttactttcaggcagcatctagagccaacggtgagacaaaaatcgactgtgtgcaggtggctaccaagggtgctgcaacccccaaacccgtccctgaacccgaaaagcagacagatcacacggttaagatcgccggcgtgatcgcaggcattttgctatttgtcatcatatttcttggcgtggtgctggtgatgaagaaaaggaagctagcaaaaaagaggaaggagaccatgagctctacacgccaggagatgactgtgatggtcaattcaatggataagtcttatgctgagcagggcactaactgcgacgaggccttctcctttatggacacccacaatctgaacggacgctcagtgtcttcaccctcatcttttacaatgaagacaaacacgctgtcaaccagcgtgccaaacagctactacccggacgaaacccatactatggcgagcgataccagcagtttagtccaatcgcacacttataaaaagcgcgaacccgccgacgtgccctatcagacaggccagttacatccagccatcagagtagccgatctactccaacacatcacacagatgaagtgtgccgagggatacggcttcaaggaagagtatgaaagcttctttgaggggcagtccgccccctgggactcagctaaaaaggacgagaacagaatgaagaacagatatgggaacattattgcctatgaccatagccgcgttagactccagactattgaaggggacaccaacagcgattatattaacggaaattacatcgatgggtaccacagacccaatcattacattgctacccagggccctatgcaagaaaccatatatgacttttggcgtatggtgtggcacgagaatacagctagcataatcatggtgaccaacctcgtggaagttggcagagtgaagtgttgcaagtattggcctgacgacacagaaatatacaaagatattaaagtgaccctgatcgaaacagaacttctggcggaatacgtgatcagaacctttgccgtggagaaacgcggtgtccacgaaatccgggagattagacagttccactttaccggttggccagaccacggggtcccttatcatgctacgggcctcctgggcttcgtccggcaggtcaagtccaagagtcctccaagcgcgggtcctcttgtcgtgcattgtagcgcaggcgcggggcgaacagggtgttttattgtcattgatataatgcttgacatggccgagagagaaggcgtggttgatatttataattgtgtcagagaactgcggtctaggagggtgaatatggttcaaactgaggagcagtatgtgtttattcacgacgctatcctggaggcatgcctgtgcggcgacacttctgtgcccgctagccaagtgagaagtctgtactacgacatgaataagctcgatccccagaccaactcatcccagataaaagaagagttccgcacactcaatatggttacgcctacattaagagtcgaggattgcagcattgcactcctacctagaaaccacgaaaagaacaggtgcatggacatactgcccccagaccgatgccttccattcttaattactattgacggagagagcagtaattatataaatgctgctctcatggatagttacaaacaaccttcagcgtttattgtgacccagcaccccttacctaatacagtcaaagacttctggcgcctggtgctggactaccattgtacttctgtggtgatgctgaatgatgtggatcccgcccagttgtgccctcagtactggcctgaaaatggcgtgcacagacatggtccgatacaagtggagttcgtgagtgctgacttagaggaagacatcataagcagaatctttcggatttacaacgccgcgcggccacaagacggctacagaatggtccagcaatttcagtttctgggttggccgatgtacagggatacccctgtgtcaaaacgatccttccttaagttgattcgccaggtggacaaatggcaggaggagtataacgggggggaggggaggactgtcgtgcactgccttaacggaggcggcagaagcgggaccttttgcgcaatctctattgtatgcgagatgttgcgtcaccagcggaccgtggacgtttttcatgccgtgaaaacgctgcgtaataataagccaaatatggttgacctgctggatcaatataaattctgctatgaggtggctcttgaatatctaaatagtggttag

SEQ ID NO: 201758 - DNA, 4401 bp, Artificial Sequence
  Description of Artificial Sequence: Synthetic coding sequence
atgcggggcctgggcacctgcctggccaccctggccggcctgctgcttaccgcagccggcgaaactttttccggaggatgcttgtttgacgagccttacagcacttgcgggtatagtcagtccgagggcgacgacttcaattgggagcaagtaaacacattaacgaagccaacaagtgatccttggatgccatcaggttcattcatgcttgttaatgcgtccgggagacccgaaggacagagagctcatcttcttttgccccagctgaaagagaatgacacccactgcatcgacttccattactttgtgtcaagcaagtctaatagcccacccggtctactgaacgtgtatgtgaaggttaacaatgggcccctgggaaatccaatttggaacatctccggggatccaactagaacgtggaaccgagccgagctggcaatcagtacattctggccgaacttttaccaggtgattttcgaggtcattacttctggtcaccaagggtatctggctatcgacgaggtgaaggtcttagggcacccttgtacccgaacaccccactttctcaggattcagaacgtggaagtgaacgccgggcagttcgccaccttccagtgctccgcaattgggagaacagtcgctggggatcgcctttggcttcaggggatcgatgtccgagatgccccgctgaaagaaattaaagtgacttcaagccggcgctttatagccagtttcaatgtcgttaacactacaaagagagacgcaggaaagtatcggtgtatgataaggactgagggtggggtagggatatcgaattacgcagagctggtggtgaaggagccaccagtacccatcgccccccctcaactggcatccgtgggagctacctacctgtggattcagctgaatgcaaattcaattaatggcgacggtcctatcgtcgcccgagaagtggagtactgcaccgcatcaggaagctggaatgatcgtcagcctgtggattctacaagctataagatcggccacctggaccctgatacagagtacgaaatttccgtgctgctcacccgccccggagagggaggtacaggatcgcctgggcccgcactccgaaccagaacaaaatgtgccgatcccatgcggggcccaaggaaacttgaggttgttgaggtgaaaagtaggcaaatcactattaggtgggaaccattcggctacaatgtcactagatgccattcatataatctgactgtccactattgttatcaggtgggaggccaagaacaggtgagagaagaggtgagctgggataccgagaactcacacccacaacacacgattaccaacctatccccctacaccaacgtctccgtgaagctgatcctgatgaatccagagggccgtaaagagagtcaagagctgatcgtccagacggatgaagatctcccaggtgctgtcccaacagagtcaattcagggttctacgtttgaagagaagatcttcttgcagtggagagaaccaacacagacctatggggtcataactctctatgagatcacctataaggccgtaagcagctttgacccagagatcgacctttctaatcagtcgggccgagtcagcaaactgggcaatgaaacgcactttttattcttcggcctgtaccccggcactacctattctttcactatccgagcctccaccgcaaaaggcttcggtccacccgctaccaaccagttcactaccaaaatatctgcaccgtctatgccggcgtacgaactggaaaccccattaaatcagactgacaatacagttaccgtgatgcttaaacctgcccatagcagaggggcaccagtttctgtttaccaaattgtggtggaggaggagagacccaggcgaactaaaaaaactaccgagattttgaaatgttatcccgtccctatccattttcagaatgcgtctctgttaaactcacagtattatttcgcggctgagttcccggccgacagcctgcaggcagctcagcccttcactattggcgacaataaaacctacaacgggtactggaacacgcctctgctgccttacaaaagttatcgcatatacttccaggcagcatccagggccaacggggaaacgaagatcgattgcgtccaggtggccaccaagggggcagctactccaaagccagtgcccgagcccgaaaagcagacagaccacactgtcaaaattgcgggggttatcgcaggcatcttactcttcgtcatcatttttctaggagtggtcttggtgatgaaaaagcgaaaactcgccaagaagagaaaggaaacgatgtcctcaactcggcaggagatgaccgtcatggtgaattctatggacaaatcatacgcagaacaggggaccaattgtgacgaggctttttcctttatggacacccataacttgaacggacgttcagtctcttccccttcctcctttacaatgaagacgaacactttgagtacatcggtgccgaattcctactatcctgatccatttgtaccgacggctattctcgatttcagtctcaataatgagacacataccatggcttccgatacaagttccctggtccagtctcacacctacaagaagagagagccagctgatgtcccctatcagaccgggcagctccacccagctattcgggtggccgatttgcttcaacatataacgcagatgaaatgcgccgaggggtacgggttcaaggaagagtatgagtcgttttttgaaggacagtcagcaccatgggactccgcaaagaaggatgaaaaccgtatgaaaaacagatacgggaatatcatcgcttatgaccactcccgagtccggcttcagacgatcgagggtgacacgaacagcgattacattaatgggaactatattgacgggtaccatagaccgaatcactacattgccacacagggtcctatgcaggagactatctatgacttctggaggatggtctggcatgaaaacactgcttctatcatcatggtgaccaatctggtcgaggtgggccgtgttaagtgctgtaagtattggccagacgatacggaaatctacaaggatatcaaagttacgctcatcgagaccgaattgctggcagagtacgtcatccgaacttttgcggtggaaaagaggggcgtgcacgagatccgcgaaatccggcagtttcactttacagggtggcccgaccacggggtaccctatcatgcgactggactcctgggctttgtccggcaggtgaagagcaaatctccccctagtgctggccccctcgtggttcactgtagcgccggagctggaaggaccggctgtttcattgtgattgatattatgctagatatggccgaaagggagggggtggtggacatctataactgtgtgcgggaattgagatcccggcgtgtgaatatggttcagactgaggagcagtacgttttcatacacgatgccattttggaagcctgtctttgcggtgatacgtctgtacccgcgtcacaggtgcgctccttgtactatgatatgaataagctcgacccccagaccaacagctcccaaatcaaggaagagttcaggaccctgaacatggttacacctaccctcagagtagaggactgctctatcgcactgctgccccgcaatcacgagaagaaccgatgcatggacattctgccccccgaccgctgccttccttttctcattaccatcgatggcgaatcatccaactatatcaacgccgcactgatggattcttataaacagccctctgctttcattgtgacacagcaccctcttccgaataccgtgaaagatttttggcgcctggtcctcgattatcattgtacctcggttgtcatgttgaatgacgtggatcccgcacagctgtgcccccagtattggccagagaacggcgtccaccgacatggaccgattcaggtcgagttcgtatccgccgatcttgaggaggatattatcagtaggatctttagaatctacaacgctgctcgcccccaagacggttataggatggtgcagcaatttcaatttcttggctggccaatgtatcgtgacacccccgtgtctaagaggtctttcctcaagctgataagacaggtggataaatggcaagaagagtataatgggggagagggaagaaccgtcgtgcactgtctgaatggcgggggaagaagcggcaccttctgcgcgattagcattgtatgcgagatgctacgccatcaacggaccgtggacgtgttccacgccgtgaagacccttagaaacaataagcccaacatggtggacctactggaccagtacaagttttgttacgaggtcgccctagagtatctgaatagtgggtag

SEQ ID NO: 201759 - DNA, 3720 bp, Artificial Sequence
  Description of Artificial Sequence: Synthetic coding sequence
atgggcaccctgagcctgcaccccggcatcgacgtgcgggacgcccctctcaaggagatcaaggtcacatcatctcgaaggttcatcgcaagcttcaacgtcgtaaacacaaccaagagagatgctggcaagtacaggtgtatgattcgcactgaaggtggagtgggcatttctaactacgcggaactcgtcgtgaaagagcctcctgttcctatagccccaccacagcttgccagtgtcggggcaacgtacctttggattcagcttaacgcaaactcaataaacggcgacgggcctatcgtggcaagggaggtggagtactgcacagcctccggctcatggaatgacaggcagccagtggactcaaccagctacaaaataggccatctggatcctgacaccgaatacgagataagcgtactcctgacacgcccgggagaaggaggtaccggctctcccggacctgcgctcagaacacgcacaaagtgtgcagaccccatgcgaggtccccggaagctggaggttgtcgaggttaagtcacggcagattaccatccgctgggagcccttcgggtataacgtcacgcgatgccactcctacaacctcactgtgcactactgctaccaggtgggcgggcaggagcaagttcgtgaagaggtatcatgggacacggagaactcacacccgcagcacaccattacgaacctcagcccctacaccaacgtgtctgtaaagttaattttgatgaaccccgaaggtagaaaggaaagtcaggagctgatcgtccagactgacgaggaccttccaggagctgtgccgacagaatcaatacaggggagtacattcgaggaaaagatttttctacagtggcgcgagccgacacagacgtacggcgtcattacactgtacgagattacatacaaggccgtgagttcattcgatccggagattgatttatctaatcagtccggacgtgtgtccaaactggggaatgagacgcacttcctcttctttggactgtacccgggaacgacatattcttttaccattagggccagtaccgcgaagggtttcggcccccctgccaccaatcagttcactacaaaaatatccgccccctccatgccggcctacgagcttgagacccccctgaatcagaccgacaacacggtgaccgtgatgctgaagcccgcccactcacgcggcgcgccagttagcgtgtaccagattgtggtggaggaagagagaccccgccggactaaaaaaacgaccgagatattgaagtgttaccccgtcccgatccatttccagaatgctagcctcctcaactcccaatactattttgctgccgagttccccgctgactccctccaggccgcgcagccatttaccatcggcgacaataagacctacaatggatattggaacacaccgctcttaccatataaaagctacagaatctattttcaggccgcttccagagcaaatggcgagactaagatcgactgtgtgcaggtcgctacaaagggtgccgctactcctaagcccgtgcccgagcccgaaaagcagactgatcacacggttaaaattgcgggtgtgatcgctggcatactgctgttcgtgattattttcctgggggtggtattagtcatgaagaagcgaaaattggccaagaagcggaaagaaaccatgtccagcactcggcaggaaatgactgtgatggttaacagcatggacaaatcctacgctgaacaggggacaaattgtgatgaagccttttcattcatggacacgcataacctgaatggacggagtgtgagcagcccttcgtcctttaccatgaagacaaataccctcagtacctcagtccctaattcatactatcccgacgagacccatactatggcctccgacacgagctccttagtgcagagtcacacctacaagaaaagggaacccgcggacgttccctatcagacaggtcagctacatcctgccatccgggtggccgaccttttgcagcacattacccagatgaaatgtgcagaaggttatggttttaaagaggaatatgagagtttttttgagggacagagcgcaccatgggacagtgcaaaaaaagatgagaaccgcatgaagaaccgctatggcaatattattgcctacgatcacagccgcgtaaggctccagacaatcgagggggatacaaacagcgattatatcaacggtaactacatcgatggataccacagacccaatcactacattgcaacacaaggaccgatgcaggagactatttacgatttctggcgtatggtgtggcacgagaatactgctagcattatcatggtgacgaacctggtggaagtaggcagggtgaaatgttgtaagtactggcctgacgacactgagatatacaaagacattaaggtgactctgatcgagaccgaactgttagctgaatatgttattcgtacatttgccgtcgaaaagcgcggtgttcacgagatccgagagatcagacagttccacttcaccgggtggccagatcacggggtgccatatcacgctaccggacttctgggcttcgtccggcaagtgaaatccaagagccccccctctgctggtcccctcgtggtgcactgcagcgccggtgctgggcggacaggctgtttcatagtcatcgacatcatgttagacatggcggaaagagagggagtggtcgacatctacaactgtgttcgggaacttcgtagccgaagggtcaacatggtacagacagaggagcagtatgtctttatccacgatgccatattggaggcatgtctgtgcggtgacacaagtgtccccgcctctcaggtgcgatctctatattatgacatgaacaagttggatccccagacaaattcttcccagatcaaggaagagttcaggacactcaatatggtgactcccactctgcgggtggaggattgcagcatagcactccttccacgtaatcacgagaaaaacaggtgcatggacatcctccctccagaccgctgcctgccctttctgattacgattgacggagagtcttcaaactatatcaatgccgcactgatggatagctacaagcagcccagtgcctttattgtcacccagcatccactgcctaacacagtgaaagatttttggcggctcgtcctcgattaccactgtactagcgttgtgatgctgaatgacgtggaccctgcacagttgtgcccccagtattggcccgagaatggagtgcacagacatggaccaatccaggtagaattcgtcagtgccgacctggaagaagatatcatatccaggatctttcgcatctacaacgcagctcgtcctcaggacggctacaggatggtgcagcagttccaattcctgggctggcccatgtacagggataccccagtctccaagagatccttcctcaagcttatccgccaggttgataaatggcaggaagaatacaacggcggtgaaggaaggacagttgtgcattgcctgaacgggggtggaagatccggaacattttgcgcgatctccatcgtatgtgagatgctgcggcaccagcggaccgtcgacgttttccacgcagtgaaaacactgcgaaataataagcctaacatggtcgatctcctggaccagtacaagttctgctacgaggttgcgcttgagtaccttaacagcggttag

SEQ ID NO: 201760 - DNA, 2940 bp, Artificial Sequence
  Description of Artificial Sequence: Synthetic coding sequence
atgcggcggccccggcggcccggcggcctgggcggcagcggcggccttcgactcctgttgtgcttactgctgttgagttctcggcctggaggttgctccgcggtgagcgcacacggctgccttttcgaccggagactgtgcagccacctggaggtctgcatccaggacggactgttcggccaatgtcaggttggcgtaggtcaggccagacccttactgcaggtcacgagcccagtgctgcagcggctgcagggggttcttcgacagctcatgagccagggcctatcttggcacgatgatctgacacagtacgtgatctctcaagagatggagcggattcccaggctccgccctccagagcctcgccctcgggatcgaagcggactggcgccgaagcgcccaggccccgctggtgaattattattacaagacatccctacaggtagcgctcctgctgcgcaacaccgtttaccgcaaccaccggtgggcaagggcggagcaggggcttcttcctcgctcagtccccttcaagccgaactcctcccacctctgctcgaacacctcctgctgcccccccagcctccccatccgtctcttagctacgagcctgcccttttgcagccatacctcttccatcagtttggatctcgcgatggctctagagtgtcagagggatcacccggaatggtgtccgtaggcccgttacctaaggcagaagctccggcactattttctcgtactgcgagtaaagggattttcggtgatcaccctggtcattcctacggggacctgcccggccctagtcccgcccagctgttccaggactctggtctgctttacctggcacaggaactccctgccccgagtagagccagggtgccgcggttgccagagcagggctcttcatccagggcggaagactcacctgaagggtacgagaaggagggactgggtgaccgcggcgaaaaacctgcgagtccggcagtgcagccagacgccgcccttcaaagactcgccgccgtgctggccgggtatggcgttgagctaaggcagttgaccccagaacaactctcaactctgctgaccctgttgcagctgcttccgaaaggtgccggaaggaaccctggcggagttgtgaatgtaggcgccgacattaaaaagacaatggagggccctgtggagggaagggacactgctgagctaccagctcggactagccccatgcccggccatcctacagcaagtccgacaagcagtgaagtgcagcaggtcccttctccagtgtcttccgaaccgcccaaagctgccagacccccagtcactcccgtgctgctggagaaaaaatctcctctgggacagagccagccgaccgtcgccggtcagccctctgcgcgccccgccgcagaggaatacggatatatagtgactgaccaaaaaccactctctctcgccgcaggtgtcaagcttttggagattcttgccgaacatgtgcacatgtcttctggcagttttatcaacatctcggtggtgggacccgcgctcactttcagaatccgacataacgagcagaacttgagcctggctgatgtcacccagcaggcgggactggtgaaaagcgagcttgaggcccagacaggcctgcagattttacagactggagtgggacaaagagaagaggctgctgctgtgctgccccagacggcgcacagtaccagccctatgaggagcgttcttctaacgctggtggcccttgccggtgtggcgggactgctggtcgccctagccgtggcgctctgtgtcagacaacatgctagacagcaggataaagagcgccttgctgccctgggaccggagggggcccacggagacacaacttttgaatatcaagatttgtgcaggcagcacatggccaccaaatcactgtttaaccgtgccgagggtccgcctgaaccttctcgggtgagtagcgtatcaagccaattttctgacgccgcgcaagctagcccgagttcacattctagtaccccatcctggtgtgaagagcctgcgcaggcgaatatggacatttccacgggacatatgatcctggcctatatggaagaccacctgaggaatcgggatcggctggctaaagaatggcaggctctgtgcgcctaccaagcagagcccaacacctgcgccaccgcccaaggagaggggaacatcaagaagaatcgccatccggacttcctgccttatgatcatgctaggatcaaactgaaggtcgagtcctctcctagcaggagcgattacatcaatgccagccctatcatcgaacacgaccctcggatgcctgcttatattgccacacagggtcctctaagccatactatcgccgatttttggcagatggtgtgggaatccgggtgtacagttattgtgatgttgactcccctggtggaggatggggtcaagcagtgcgataggtattggccggatgaaggcgcctcactttatcacgtgtatgaggtgaatcttgtgtccgaacacatttggtgtgaggatttcttggttagaagtttttatttgaaaaatgtgcagacccaggagacgcggacactcacccagttccatttcctgtcctggccagcggagggaactcctgccagtaccagacctctccttgactttaggaggaaagtaaacaagtgctatagaggcaggtcgtgtcctatcatagtccattgttctgatggcgctgggagaactggtacgtatatcctgattgatatggtgttgaatcgcatggccaagggggttaaggagattgatatcgctgctacgttagagcacgtccgggatcagagacctggtctagttcgtagtaaggaccaattcgagttcgcgctgaccgccgttgccgaggaggtgaatgccattttgaaggctctcccacagtag

SEQ ID NO: 201761 - DNA, 2853 bp, Artificial Sequence
  Description of Artificial Sequence: Synthetic coding sequence
atgcggcggccccggcggcccggcggcctgggcggcagcggcggcctgagactcttactgtgtctcctgctgctgtcaagcaggcccggcggatgcagtgcagttagcgcacacggatgcttgttcgatcggagattgtgctctcatctggaggtgtgtatccaagacggactcttcggtcagtgccaggtgggagtggggcaggcgcgcccgttgctccaggtaacctcacccgttctgcagaggctccagggggtgctgcgtcagttgatgtcacagggcctgtcttggcacgacgacctgacccaatacgtgatctcgcaggagatggaaaggatacctaggctcagacctccggagccccgccctcgggatcgatccggcctggcccccaagcgccccggtcccgccggcgagctcctgctgcaggacatccccactggcagcgcaccagctgcacagcatcgcttacctcagccccccgtcggcaaaggcggtgccggcgcctcgtccagcctgtctccacttcaggcagagctcttgccccccctgctggagcatttgctcctgcctccgcagcctccgcaccctagcttgtcttatgagccagcccttctacagccctatctctttcaccagttcggaagtcgggacggctcacgggtgagtgaaggttcccctggaatggtatcagtcgggcccctgcccaaggccgaggcgccagccctgttttcccgcacagcaagcaaggggattttcggtgatcaccccggacatagctatggggatcttccagggccttcccccgctcaacttttccaagatagcggcctgctatacctggcccaagaactgccagctcctagccgcgctagggtgccacgcctgcctgagcagggctcctcttctagagcagaggattctccggaaggatatgagaaagagggtctaggtgatcgaggggagaagcccgcgagccctgcggttcagcctgatgccgcgctccagcgtctcgccgccgttctggctgggtacggcgtggaactccggcagctgactccggaacaactgtccaccctgctaacccttctgcagcttctgccaaaaggagccgggaggaaccctggcggagtggtgaatgtcggtgccgacatcaagaaaaccatggagggacctgtggaaggccgagacaccgccgagctccctgcaagaacctcccctatgccgggtcatcccacagctagtcccactagctcagaagttcagcaggttccaagtcctgtgagctcagagcctcctaaagccgctcggcctcctgttacaccagtactgctggaaaaaaagtctcctttgggccagagtcagcccactgtcgccgggcagcctagtgctcggcctgcggctgaggagtatggatacatcgtcacagatcagaacgtggtcggtcccgctctgacttttcggatccggcataatgaacagaatttgtcattggcagacgtaactcaacaggctggcctcgtgaagtctgaattggaagcccagactggcctccaaatcttacagaccggagtggggcaacgcgaggaagcagccgcagttttaccacagaccgctcacagcacatctcctatgcggtcagtcctgctcacactggttgctctggctggtgtggcaggcttactggtggctctcgccgtggccctttgtgtacggcagcatgccaggcagcaggacaaagaacgccttgctgcacttggccctgaaggagcccacggcgacaccacgtttgaatatcaggacctctgtcggcagcatatggccaccaagtctctcttcaaccgggctgaagggccccctgagccgagccgcgtgtcttcagtcagctcgcagttttccgacgccgcccaggcatcgccttcctcccactcgtctaccccttcctggtgtgaagaacctgcccaagccaacatggatattagcactggccacatgatccttgcttacatggaagatcacctgagaaaccgcgaccggcttgctaaggaatggcaagctctgtgcgcctatcaggccgagcccaatacatgtgccacagcccagggcgaaggcaatataaagaaaaacagacatcccgattttcttccgtatgatcacgcaagaatcaagctgaaggtggaatcctctccaagcagatccgattatatcaacgcctcccctatcattgagcatgatcctcgaatgcccgcctatattgccacccagggtcccctttcacacactatcgccgacttttggcagatggtatgggagtccggctgtaccgttatcgttatgctcacccccctggtagaagacggtgtgaaacaatgcgaccggtactggccggacgagggagcctctctgtaccacgtgtacgaagtgaacctcgtgtccgaacacatctggtgcgaagattttcttgtgcgctcattttacttaaaaaacgtgcagacacaggagactcggacattaacccagtttcacttcctcagctggcctgccgagggaaccccagctagcacacgacccttgttggatttcagaagaaaggttaataagtgttaccgcggtaggtcctgccccattatcgtgcattgcagtgatggagccggaaggactgggacgtacatcctcatcgatatggttctcaatagaatggccaagggagtgaaagagatcgacatcgcagccactttggagcatgtcagagaccaacgcccaggtctggttcggtctaaggatcaatttgaattcgcactcacagcagtggccgaagaggtgaacgccattctcaaggctctaccacagtag

SEQ ID NO: 201762 - DNA, 489 bp, Artificial Sequence
  Description of Artificial Sequence: Synthetic coding sequence
atgcggcggccccggcggcccggcggcctgggcggcagcggcggcttaaggcttctgctgtgcctcttgcttctatcgtctcggcctggaggctgcagtgccgtctccgctcacggttgtctctttgataggcgcctgtgttcccacctcgaagtatgcattcaggatgggctctttgggcagtgtcaggttggtgtgggccaagcccgcccactcctccaagttacaagcccagtactccagcgcttacagggagtcctcaggcagcttatgtcccaggggctgtcatggcacgacgacctgacgcagtatgtgatttctcaagagatggaacgtatcccgcggcttcgccccccggagcctcgtccgcgggatcgcagcgggttagcccccaagcgtcccggtcctgctggggagctcctgctgcaagacatacccacgggaagcgcccctgcagcccaattgctctcagtcccgtccgccggatag

SEQ ID NO: 201763 - DNA, 2670 bp, Artificial Sequence
  Description of Artificial Sequence: Synthetic coding sequence
atgagccagggcctgagctggcacgacgacctgacccagtacgtgatcagtcaagaaatggagaggatacctcgtttacgcccccccgaaccgagacccagggatcgctcgggcttggcccctaagcgaccaggccccgcgggagagttactccttcaagacatcccgaccggatccgctccagccgcccagcaccgccttccccagccccccgtgggaaagggcggagctggagcctccagctctttgtccccgcttcaggccgagcttctgcctcccctcctcgaacacctgctgctgcccccacagcccccacatcctagcctgagctatgaacctgccttgttacagccatacctgtttcaccaatttggtagccgggacggatctagggttagtgagggctcccctggcatggttagtgttgggccgctgcctaaggcagaagcacccgctttattctcccgaacagcaagcaagggaatattcggggatcatcctgggcactcgtatggagacttgcctggcccaagccccgctcaactatttcaggattctggcctgctgtacttagctcaggagctgcctgcaccctcgcgggctcgagtgccgagattgcctgagcagggttcaagctccagggccgaggactcccctgaggggtatgaaaaggaggggctaggagataggggcgaaaagcccgcctcacctgctgtgcagcctgacgctgcgctgcagcgtctggccgccgtgttggctggctacggagtcgagctgcgccagctcacgcccgagcagctgagtacactccttaccctgcttcagcttctccccaagggcgccgggcgcaatccaggtggggttgtgaacgtcggagccgatattaagaaaaccatggaaggccccgtggagggacgggatacagcagaactccctgctagaacctctccaatgcctggtcatccaacagcgagccctacaagctctgaggtgcagcaggttcccagtccagtctcatccgagccacccaaagctgccagacccccagtgactcctgtacttctcgaaaaaaagtcccccttgggacagtctcagccaaccgtggccggtcagccgtccgcaagaccagccgccgaagagtacggctatatcgttactgaccagaagcctctgagccttgctgccggcgtgaaactgctagagatacttgctgaacacgtccacatgtcctcagggagctttatcaacatttccgttgtaggccccgctctgacttttaggatccgccataacgaacagaacttgagcctcgctgacgtaactcagcaggctggactggtcaagtcagaactggaggcacaaaccggattgcaaatcctccagactggcgtcggacagcgtgaggaagccgctgcagttctgccacagaccgctcacagtacttctcctatgcgaagcgttctgctgactctcgtcgccctggcaggtgtcgctgggcttcttgtcgcattggcagtggctctctgtgtgagacaacacgcccggcaacaggataaagaacggctggccgctttgggacccgaaggagctcacggggataccaccttcgagtatcaggatctgtgccgtcagcacatggccacaaaatctttatttaacagggctgaagggccccctgaaccctccagggtgagctccgtgtcctctcaattcagcgatgctgcccaggcttccccgagttcacacagctcaaccccctcttggtgcgaagagccggcccaggccaatatggacatctcaacggggcatatgatcctcgcatatatggaggaccatctaagaaaccgggatcggcttgcgaaggagtggcaggccctctgcgcctaccaggcggagcctaatacatgtgcaacagcccaaggagaaggtaatataaaaaaaaaccggcaccccgatttcctgccttacgatcatgcccgaattaagctgaaggtcgagtcttccccaagccgctctgactacatcaacgcatcaccgatcatcgaacacgatcctcggatgcctgcttacatcgctacacagggacccctttctcataccatagccgatttctggcagatggtttgggaatcaggttgcactgtcatcgtcatgttaacccctctggttgaagacggagtgaaacagtgtgatcgttactggcctgatgaaggcgccagtctctaccatgtatacgaggtgaatctggtcagtgaacacatatggtgcgaggatttcctcgtgcgttccttctacttaaagaacgtacagactcaggagacaaggacactgacgcagttccactttctgtcctggccggccgagggaactcccgcgtctactcgccctctgctggacttcagaaggaaggtgaataagtgttaccgaggacggagttgccccattatagtgcactgctctgacggggctggcaggaccggaacgtacattttgatcgacatggttctaaacaggatggccaaaggcgtgaaagaaatcgacattgctgctaccctggaacacgtcagagatcaaaggcccggactggttcggtctaaagaccaattcgagttcgcgctaaccgccgtggccgaggaggtgaatgcaatactcaaggcccttccccaatag

SEQ ID NO: 201764 - DNA, 2853 bp, Artificial Sequence
  Description of Artificial Sequence: Synthetic coding sequence
atgcggcggccccggcggcccggcggcctgggcggcagcggcggcctgcgccttctgttatgcctgctcctgctctcttctaggcccggtggatgctctgcggtcagtgcgcatgggtgcctgttcgaccggagattatgcagccacctcgaggtttgtatccaggatggtttgttcggccagtgtcaagtcggagtcggccaggcccgacctcttctccaggtgacaagtcccgtgctgcaacggctgcagggtgtgcttcggcaactcatgagtcaaggcctttcttggcacgacgaccttacgcagtatgtaatatcgcaagagatggagaggatccctcgccttcggccgcccgaacccaggcctcgggaccgctccggtctggctccaaaacgacctgggccagctggggagctgctcctgcaagacattcctaccggatcagctccggcagcccaacaccgcctgccgcaacctcccgttgggaagggcggagccggggcgtccagtagcctgtcccccctgcaggccgagctcctccctccactcttggagcacctgctgctccctcctcagcccccccacccaagcctgtcctatgagcccgccctccttcagccctatctgtttcatcaattcgggtcaagagatggaagccgggtcagtgaaggctccccgggtatggtctcagtgggcccactgcccaaggctgaggctcctgccctgttttcccggacagcgagtaagggaatcttcggggatcatcctggtcacagctacggcgacctgcccggcccctccccggcacagctgtttcaagatagcgggctcctttatctcgcacaggagctgccggccccttccagggctcgcgtgccaagacttcccgagcagggaagctcttccagagccgaggactcccccgaaggctatgaaaaggaaggactgggagaccggggggagaagccagcatccccagcagtgcagcctgatgcagccctgcagcgattagcggcagtgttagccggttacggagttgaattgaggcagctgaccccagagcagctatctacactgctgacacttcttcaactgttgccaaagggggctgggagaaatcctggaggtgtggtgaacgtgggcgcagacatcaaaaaaactatggaaggtccggttgaaggccgtgacactgcagagctccccgcaagaactagtcctatgcccgggcaccccactgcctctcccacgtccagtgaggttcagcaggtgcctagccccgtctcctccgagccaccaaaggctgcaagaccccccgtgacgccagtcctactggagaagaaaagcccattaggtcagagtcagcctacggttgcaggccaaccatccgcaagacctgccgcagaggagtacggatacattgtaacagatcagaatgttgtaggtcctgcccttacattcagaatccgtcataatgagcagaacttgagcttggctgatgtgacccagcaagctgggttagtgaagtcagaactggaagcccagacaggcctgcagattctgcagaccggcgtcgggcaaagagaggaggccgctgcagttctgccccagactgcccacagtacctcacctatgcgaagtgtccttctcaccctggtggctctggctggcgtggctgggctcctcgttgctctggctgtggcactgtgtgtacgccagcacgcacgacaacaggacaaggaacgcctggctgcccttggccccgaaggtgcccatggagacacaacattcgagtaccaggacttgtgccggcagcatatggccacaaagagtttattcaatcgggccgaaggcccccctgagccctctcgcgtgagcagtgtatcttcccagttcagcgatgcagcccaagcatccccttccagccatagttccacccctagctggtgtgaggaacctgctcaagctaatatggacatctccacaggacacatgatactggcttatatggaagatcacttaaggaacagagatagacttgccaaagagtggcaggctctgtgcgcctatcaggccgagccaaacacttgcgcaaccgcgcagggcgaaggcaatatcaagaagaatagacatccagatttcttaccatacgatcacgcccgtatcaagctgaaggttgagtctagtccatctcgctctgactatatcaatgcctctccaattatcgagcacgatccccgtatgcccgcctatatcgctacccagggaccattgagccacaccatcgccgatttttggcagatggtgtgggagagtggatgcacagtgattgttatgcttaccccactggtggaggatggtgtcaaacagtgcgatcgttactggcctgacgagggggcttccttataccacgtgtatgaagtcaatctcgtaagcgagcacatttggtgtgaggatttcctagtgcgctccttttacctgaagaacgttcagacccaagagacgcgtaccctcacacagtttcacttcctctcctggcccgctgaaggcacgcccgctagcactcgaccgctcctggacttccggcggaaagtcaacaagtgctaccgcgggcggtcatgtcctatcattgtccactgcagcgacggagcgggacggaccggcacctacatcctaatcgacatggtgctaaaccggatggcaaaaggggtgaaggaaatagacatagctgcgacgctagagcatgtgcgggaccagcgacctgggctagtcaggagtaaagatcagttcgagttcgccctcactgctgtagccgaagaagttaatgcgattctgaaggcactgccacaatag

SEQ ID NO: 201765 - DNA, 2961 bp, Artificial Sequence
  Description of Artificial Sequence: Synthetic coding sequence
atgggcccccccctgcccctgctgctgctgctgctgctgctgctgccgccacgagtgttgcccgctgccccaagctcagtgccccgtggcaggcagctgcccggcagactaggatgtctcctggaggaggggctctgcggagcgtccgaggcttgcgtgaatgacggggtatttggcaggtgccagaaggttcccgccatggatttttacagatacgaggtttctcctgttgccctacaacggttacgggtggcacttcagaaactgtcaggaacaggttttacctggcaagatgactacactcagtacgtcatggaccaggaactggctgacctccctaaaacatatctccggaggcctgaggccagttcccccgctagacccagtaagcacagcgttgggtctgaacggaggtacagtcgcgaaggcggcgcagccctagccaacgctttgaggaggcacctaccctttctggaagctctttcccaggctcccgcctccgatgtgctagcccgaactcacaccgcccaggaccgcccacctgccgagggggacgatcggttcagcgagtccatcctcacttacgttgcccacacgagtgcccttacataccctccagggagtcggacacaactccgagaggatctactccctcgcaccctgggacagctgcagcccgacgaactcagcccaaaggtagactcaggcgttgatcgccatcatttgatggcggcactgtccgcttacgccgcccagagaccccctgccccgccaggagagggatcactagaaccacagtaccttctgagagctccttcaagaatgccaagacctctgctggccccggcggcaccacagaaatggccttcacctttgggagatagcgaggacccatcaagcacaggcgatggcgctaggattcacacactgctgaaagacctgcagagacagcctgcggaggtccggggactgagcggcctggaactcgacggcatggccgagctgatggccggtcttatgcagggcgtcgatcacggcgtggctagaggctctccgggcagagctgctctaggcgagtcaggggaacaggctgacgggcctaaggctactctcagaggagactcctttccggatgatggtgtgcaggatgacgatgacaggttgtaccaggaggttcaccgccttagcgctacgctgggggggctgctgcaggaccacggctcgcgcctcctcccaggagctctaccattcgcccgcccactcgatatggaacggaagaaaagcgaacatcccgagtcatcactcagtagtgaggaggagactgccggcgtagaaaacgtgaagtctcagacatatagcaaggacctcctgggacagcagccacatagcgaacctggcgccgctgcattcggcgaacttcagaaccagatgccaggcccatccaaagaggaacaatctctcccagccggtgcccaggaggcactgtctgacggtctccagctggaggtccagccctctgaggaggaagccaggggatatatcgttaccgatagggaggtcctagggcctgcagtgacatttaaggtctcagcgaacgtccaaaacgttactacagaggacgtggagaaagccaccgtggataacaaggacaaactggaggagacctcaggccttaagatcctccagacaggcgtggggtcaaagtcaaaattgaagttcctgccgccccaggccgagcaagaagactctaccaaattcattgccctcaccctcgtgtccttggcctgtatccttggcgtgctcctcgctagcggcctaatttactgtctgcgccacagtagccagcaccgacttaaagaaaaactgtccggcctaggcggagaccccggcgcagacgctactgcagcctatcaggagctgtgcaggcagcgaatggcaactcggcctcccgaccgaccagagggcccacataccagcaggatctccagcgtttcatcacagttctctgacggtcctataccttcaccttctgctcgttcctcggcctcctcgtggtctgaagagccggtgcaatccaatatggatatctctacaggacacatgatcctctcatacatggaggatcacctgaaaaacaagaatcggctggagaaggagtgggaggctctctgtgcttaccaagctgagcccaacagttctttcgtcgctcagcgcgaggaaaacgtccctaaaaaccggagccttgccgtgctaacctacgaccattcacgcgtccttctgaaggccgagaacagtcacagtcactccgactacatcaatgcctctcctatcatggatcacgatccacgcaaccccgcttatatcgccacccaggggcccctgcctgcaacggtagccgacttctggcagatggtctgggaaagcggttgtgtcgtcattgtaatgctcacaccactggctgaaaatggagtgagacagtgttatcactactggcctgacgaaggctccaacctgtatcatatctacgaggtaaatctggtgagcgaacatatctggtgtgaagactttctggtgaggtcattttacctcaagaatctgcagacgaacgagacacgtacagtgacccagttccacttcctgagttggtatgaccgcggagttccaagctctagtcgctctttgctcgacttcaggcgtaaggtgaataagtgctacaggggccgatcgtgtcctattatcgttcactgttctgacggtgcagggagaagcggaacgtacgtgcttatcgatatggtgctcaacaagatggccaaaggggccaaggaaattgatattgcggccactctcgaacatctgagggatcagcgacccggcatggtccaaacaaaagaacagttcgaattcgctctgactgcggtagccgaggaagtgaatgccatcctgaaggcattgccacagtag

SEQ ID NO: 201766 - DNA, 2997 bp, Artificial Sequence
  Description of Artificial Sequence: Synthetic coding sequence
atgggcccccccctgcccctgctgctgctgctgctgctgctgctgcctccccgtgtgctcccagctgctccttcctcggtgccgagaggacggcagttgccgggtcgcctcgatggcgtttttggaagatgccagaaagtgcccgctatggacttctataggtacgaggttagtcccgtcgccctgcagcggctgagggtggcactccaaaagctcagtggtactggttttacatggcaggatgactatacacagtatgtgatggatcaggagctggccgacctgcctaaaacatatctgcgcagacctgaggcttccagccccgcccgcccatccaagcactccgtcggctctgaaaggcggtactcccgggaaggtggggccgccttagcgaatgctttgagacgccatttacccttcctggaggctctcagccaggctccagcctctgacgttctggcaaggacgcatacagcacaggacaggccacctgcagagggggacgatcggttcagtgagtcaattcttacctacgtggctcacaccagcgctcttacctacccccccggttcccggacacagctacgcgaagatctgctgccacggacattaggtcagctgcagcccgatgagcttagtccgaaggtggattccggagtcgatcgccaccatctcatggcagctctgagtgcctatgctgcccaaagacctcccgcgccaccaggagaagggagtctggaacctcagtacctcctaagagctccctcccgtatgccaaggcctcttttggcaccagctgcaccgcagaagtggccaagccccttaggagacagcgaagacccatccagcactggggacggcgcccgcatacataccctgctgaaagacttgcagcgtcagcccgccgaggtccgggggctgtccggcctcgagttggacggcatggccgagcttatggcaggactcatgcagggcgtggatcacggggtggccagaggtagtcccgggcgcgcagctctgggtgagtctggcgagcaagcagatggtccaaaggccacactgagaggagattcctttccagacgatggcgtccaagacgacgacgacaggctctaccaggaggtccatcgcttgagtgcgacactaggcgggttgctgcaggatcatggctctaggctgctgccaggagcacttcccttcgccagaccgctggacatggagcgcaagaaaagtgagcatccagagtcctccctgtcctctgaggaggaaaccgccggtgtcgagaacgtgaaatctcagacctactctaaagatctcctgggtcagcaaccgcattctgagccaggagccgccgcattcggcgagcttcagaatcagatgcctgggccttcaaaagaggagcagtccctgcccgctggagctcaagaggccctgtccgacggcctccagctggaagtgcagccttccgaagaggaggcacggggctatattgtgaccgacagagaccctcttaggccagaagagggcagaaggctggtagaagatgttgctagactgcttcaggtacccagctcagcgtttgctgacgtagaagtgctcggtccagccgtcactttcaaagtctcagccaatgtgcagaatgtcacaaccgaagatgttgagaaagcaacggtcgacaacaaggacaagttagaggagacctcgggattgaaaatcctccagacaggggtaggatctaaatctaaattgaaatttcttcctccccaggccgagcaggaagactccaccaaatttattgccctaacccttgtcagcctcgcatgtattttgggagtgctgctggccagtggtcttatttattgtctgagacatagctcacagcacaggttaaaagagaagctgagcgggcttggcggcgatcctggcgccgatgccacagccgcctaccaggaactctgcaggcagcggatggccaccaggccaccagatcgcccagaaggcccacatacgtctagaatcagctccgtgagcagccagttcagtgatgggcctattcctagccctagtgctaggagttctgcttcgagctggagcgaggagcccgttcagagcaatatggacatctccaccggtcacatgatcctatcctatatggaagatcacctgaagaacaagaatcgattagagaaggagtgggaagcactgtgtgcataccaggcagagccaaattcctcattcgtcgcacagagagaggaaaatgttcctaagaatagaagcctggccgtgctgacttacgaccacagccgggtgctcctgaaggcagagaactcccacagtcacagcgactacatcaatgctagcccaatcatggatcatgatcctaggaatccagcttacattgcgacacaaggacccttacctgccactgtagctgacttttggcagatggtctgggagtccggatgcgttgttatcgtgatgctgactccactggctgaaaatggcgtacgccagtgttaccactattggccagacgaagggtccaacctctaccacatttatgaggtgaatctagtatctgagcacatctggtgtgaagacttcttggtcagaagtttttacctgaagaatctgcagacaaatgaaactaggactgtgactcagtttcacttcctgagctggtatgatcgaggggtgccctcatccagtagatccttgctggacttccggcgtaaagtaaacaagtgttatagagggagatcctgtcctattattgtccattgcagtgacggggccggccgtagcggtacctacgtgcttatcgacatggttcttaacaagatggcaaagggcgccaaagagattgatatagctgcaaccttagaacacctgcgcgaccagcggcctggcatggtgcagacgaaggagcagtttgagtttgcgctgactgccgtcgccgaagaggtgaatgcgattctgaaggccctcccgcagtag

SEQ ID NO: 201767 - DNA, 3048 bp, Artificial Sequence
  Description of Artificial Sequence: Synthetic coding sequence
atgggcccccccctgcccctgctgctgctgctgctgctgctgctgcctccgagagtgctacctgccgctcccagctccgtgcccaggggtaggcaactgcccgggcgcctcggctgcctcctagaagaagggctgtgtggggcaagcgaggcatgtgtgaacgatggcgtgtttggtaggtgccagaaggtgccggccatggacttttataggtatgaagtatccccagtcgccctgcagcggcttagggtggctctgcagaagctgagtgggacgggattcacttggcaggacgattatacgcagtacgttatggaccaagagctggcagacctgccaaaaacgtatctccgacgccctgaggcttcctccccggcaaggccatcaaaacacagcgtgggatcagaacggagatacagtcgggagggaggggccgcgctggctaacgcactccgcagacatttgccattcctggaggccctgagccaagcgccggcttcagatgtgttggcccgcacacatactgcccaggatcgaccccccgctgaaggcgacgatagattctctgagagtattctgacttatgtggcacacaccagcgccctcacctatccacccggctccagaactcagcttcgcgaggatctgctgccaaggacactggggcaattgcagcccgatgaattatcccccaaagtggattctggagtcgatcgacaccatctcatggctgctctcagcgcgtatgccgcgcagcgaccccccgccccccccggtgaaggctcactagagccacagtatctacttcgggccccaagtcgaatgccacggccactgctcgcgcctgccgcacctcagaaatggccatctccccttggcgactccgaagacccgtcgtcaactggggacggcgcccggatccacaccttgctgaaggacctgcagcgtcagcccgccgaagtgcgaggccttagcgggttagagctcgatggcatggccgagctcatggcgggcctaatgcagggtgtcgaccacggtgtcgcaagagggagtcccggcagagccgctctgggggagtcaggggagcaggcagacgggccaaaggccaccctgaggggggattcattccccgatgacggggtgcaagacgacgatgacagactatatcaggaggtacatcgcctctcagcaaccctggggggtcttctacaggaccacggatccagattattacccggcgccctgccatttgctcgccctctggatatggagagaaagaaaagcgagcacccagagtccagccttagtagcgaagaagagacggctggagtggagaacgttaaatcgcaaacctactcaaaagacctgttaggtcagcagcctcatagtgaacccggtgccgcagccttcggtgagctacagaaccaaatgcccggcccatctaaagaagaacagagtctgccagcaggagcccaagaagccctttcagacggactacaactggaggtgcaacccagtgaggaagaagccagaggctatatagttaccgaccgagatcctctccgacctgaggaagggaggagactcgtggaggatgtcgcccgacttttgcaagtgccatctagtgcctttgccgatgtcgaagtcttgggtccagccgtgacctttaaggtgtccgcaaacgtgcagaatgttacgaccgaagatgtcgagaaagccaccgttgacaataaggacaaactggaggagacgtctggtctcaaaattctccaaacaggggtgggttccaagtcaaagctgaaattcctccctccacaagccgaacaggaagattccactaagtttatagcccttactttggtgagccttgcctgcatcctgggagtgctgctggccagcggcctaatctactgcctgagacattcttctcagcatagactaaaagagaagctcagcggcctggggggcgaccccggcgccgacgccacagccgcctaccaggagttgtgtcggcaacgaatggcaacacgcccacctgacagacctgagggacctcatacttcaagaatctcaagcgtctcatctcaattttcggatggaccaatcccctctccgagcgctcgaagctctgcctcgagttggtccgaggaacctgtgcagtctaacatggatatcagtaccgggcatatgatcctctcgtatatggaggatcacctgaaaaataaaaataggttggaaaaagaatgggaagccctgtgtgcctatcaggcagagccgaactcctcctttgtagcccagcgcgaagaaaatgtgccaaaaaaccgatcactggccgtactaacatatgaccactctcgcgtcctattgaaggccgaaaactcacacagtcatagtgactacattaatgcatccccaatcatggaccatgatccacggaaccctgcctatatcgccactcagggccctctcccagccacagtagccgatttctggcagatggtctgggagagtgggtgcgtggtgattgtgatgctgacccctctggctgagaatggagtgaggcagtgctatcactactggcccgacgaggggagtaacttgtatcatatatatgaagtgaatctcgtaagcgagcatatctggtgcgaagattttctggtgcggtcattctacctgaaaaacctgcagaccaatgagacacggacagtcacccagttccattttctttcatggtatgacagaggggtgccatcatcatccaggtcattgcttgatttccggcgaaaggttaacaagtgttaccggggacggtcgtgtccgattatcgtacactgctcggatggggcgggcagaagtggaacgtacgtgctgatcgacatggtattgaataaaatggcaaagggggccaaggaaatagacatcgcagcaactcttgaacatctccgagatcaaaggcccggcatggtgcagaccaaagagcagtttgagtttgctctgaccgccgtggctgaggaggtcaatgccattctgaaagccctccctcaatag

SEQ ID NO: 201768 - DNA, 3117 bp, Artificial Sequence
  Description of Artificial Sequence: Synthetic coding sequence
atggccgtggagagcgagtacagcctgctgcggaccgaggccagcttcccaacaatgaagatgttctgcgtgagccatacattgccaagggtcgaggttatgttcgtcagtgggcctcagaccagagaacgcactgagcctgtggatccacgctggcagtgtttggtgcaaatgtgggcgggctgtctcctggaggaagggctgtgtggggcatccgaggcgtgtgtcaatgatggcgtgttcggccgatgccagaaagtgcccgctatggacttctatcgctatgaggtcagccccgtggccctccagcgtcttcgtgtcgcgctacaaaaactgtcagggacaggattcacctggcaggatgattacacccagtatgtcatggaccaggagttggccgacttgcccaagacctacctgaggagaccagaggcgtcttcccctgccaggccaagcaagcactctgtcggctccgagaggaggtactcccgtgaagggggggctgccctggcgaatgcactgagaaggcacctgcctttcctggaggccctttcacaggcgcctgctagcgacgttctggctcgaacacacactgctcaagaccggccacccgcagagggggacgacaggttcagcgaaagcatccttacgtacgttgcccatacatctgcactcacatacccacccgggagcagaactcagctacgggaagacctgttgccacggactctgggccagttacagccggacgagctttccccaaaagtggatagtggggtggacaggcaccaccttatggcagccctgtccgcatacgctgcacagcgcccccctgctcctcctggcgagggttctctggagccccaatatttgctgcgcgctccatctcggatgcctagacctcttctcgcacccgccgctccccagaagtggccaagtccactgggcgatagcgaagacccatctagcacaggggacggagccaggattcacacactgctgaaagatctccaacgacagcctgcagaggtgcggggcttgtctggcctagaattagatggaatggccgagctgatggcgggactcatgcagggcgtcgaccacggagttgctaggggctctcccggaagggccgccttgggggagtcaggtgagcaggccgacgggcctaaggctacattgagaggggactccttccccgacgacggcgtacaagatgatgacgaccggctctatcaagaggttcatcgcttgtccgctaccctaggagggctgctgcaggaccatggaagcaggctgctgccaggcgctctgccctttgctcggccattggacatggaaaggaaaaaatccgagcaccccgagagtagcctctcctcggaggaagaaacagctggcgtcgagaatgtcaagtctcagacatatagtaaagacctgttgggccagcagcctcatagtgagccgggcgctgccgccttcggagagctccagaatcagatgcctggaccatccaaggaagagcagtctctcccagcaggagcacaggaagcactttcagatggccttcaactagaggtgcagcctagcgaggaagaagcccggggctacattgtgaccgaccgtgacccgctacgtcctgaggaaggcaggcgcttggtcgaggatgtggctagactgcttcaggtccccagcagcgcctttgccgacgtcgaagtgttagggccagccgtcaccttcaaagtgagcgcaaatgttcagaacgtgactactgaggatgtggagaaagccaccgtcgataataaggataagctggaggagacatccggcttaaagattctgcagaccggagtcgggtccaaatctaagttgaaatttctgcctccccaggccgagcaggaggattccaccaaatttatagcgcttactctggtgagtctagcctgtatccttggggtcctgctagcgtccggcctcatttattgtctgagacacagttctcagcacaggttaaaggagaagctgtccggcctgggcggggatcccggtgccgatgctaccgcggcgtatcaggagctgtgcaggcagaggatggctacccggccaccagacagacccgaaggaccacacacctccaggatctcctccgtctccagccagtttagcgatggtccgataccaagccccagcgcacgatctagcgcttcaagctggagcgaggagccagtgcagtctaatatggatatatccacaggccacatgatcctatcatatatggaggaccacctcaagaataagaaccggttggagaaagagtgggaggccctgtgcgcttaccaggcagaacctaacagttcttttgtagcacaacgcgaggaaaacgtgcctaaaaacagaagtctcgcggtgctcacttatgatcactcccgagttttgctcaaagcagagaattcccacagtcactccgattacataaatgcctccccaataatggaccatgatcccagaaacccagcatacatcgccacacaaggccccttacctgcaacagtcgctgatttttggcagatggtctgggaaagtggctgcgttgtaatcgtgatgctaactcccctcgcagaaaacggtgtgaggcagtgctatcactactggccagatgaaggatctaatctgtatcatatctacgaggttaacttagtgtctgaacacatttggtgtgaagactttttggtacgatccttctatctgaagaatctgcagacaaatgagacacgaacagtaactcagtttcactttctgtcctggtatgaccgcggggtcccgagcagctcaagaagcctgctggacttcaggcggaaggtgaacaaatgttacagaggtcgtagttgcccgattatagtgcattgttctgatggcgctggacggtcaggaacctacgtgctgatcgatatggttctgaataaaatggctaagggagccaaggagattgacattgccgcgacactggagcacctaagggaccaacgcccaggaatggtgcagacgaaggaacaatttgagtttgccctgactgcagtcgctgaagaagttaatgccatcctaaaggctttgcctcagtag

SEQ ID NO: 201769 - DNA, 2934 bp, Artificial Sequence
  Description of Artificial Sequence: Synthetic coding sequence
atgggcccccccctgcccctgctgctgctgctgctgctgctgctgccaccaagagtgctccctgcggccccatcctcagtgccccgcggacgacagttaccagggcggcttggatgcttgctcgaggaaggtctgtgcggagcgtctgaggcatgcgtgaacgggtttacttggcaggacgactacacccagtatgtcatggatcaggaactcgccgacctccctaagacatatctgcggaggccagaagctagctccccagctcgccccagcaaacattcagtcggctccgagcgacggtattccagggaaggaggagcagccctagccaatgccctgaggcgacacctgccatttctggaagccctgtcacaggctccagccagtgacgtgctggcaagaactcacactgcacaggataggccccccgccgagggtgacgacaggtttagcgaatcaatcctgacgtacgtggcccatacatcagctttgacttacccccctggcagccgaacccagttgagggaggatctcctgcctaggacacttggtcagctgcagcccgatgaactgtcacccaaggtggattcaggtgtggatagacatcatctgatggccgccttatcggcttacgccgcccagcgaccccctgccccccctggggaaggctctctggagccccaatacttactacgcgctccaagcaggatgccaagacctctcctggccccagccgccccacagaaatggcctagtcctttgggcgactccgaggatccatccagcaccggagatggggctaggatccacacactgttgaaggacctccagcgacagcccgccgaagttaggggactgtcagggctcgaactggacggaatggctgaactaatggctggactaatgcagggcgtggaccacggggtcgcaagggggtctcccgggcgagctgccttgggggaatctggagaacaggccgatggtccaaaagcaacactgcgaggcgatagtttccctgatgatggggtccaggacgatgacgatagactgtaccaggaagtgcacagactctccgcaactcttggcggactgctgcaggaccacgggtcacggcttctccctggcgctctcccctttgctagaccacttgacatggagaggaagaagagcgaacacccagagagctctctctcctcggaagaagagacagccggcgtcgagaatgttaagagccagacttacagcaaagatctccttggccagcagccgcacagtgagccaggtgccgctgcttttggggagcttcagaatcagatgccgggacccagcaaggaggagcagagcctgcctgccggggcccaggaagctcttagtgacggtctccaactggaagtgcagccatcggaggaggaagctaggggctacatcgttaccgaccgggacccacttcggccagaggaggggcgccgcctggtcgaggatgtagctcgattgttgcaggtgcccagctctgctttcgccgacgtagaggtgctaggtcctgctgtgacatttaaggtgtccgcaaacgtccagaacgtgaccacggaagatgttgagaaggctacagttgacaataaagacaaacttgaagaaaccagcggcctgaagatcttgcagacaggagtggggtcaaaaagcaagttaaagtttcttccccctcaggccgagcaggaggactccaccaaattcatcgctcttactctggtttcactcgcatgcattttgggagtactgctcgcaagcgggctcatctattgcctccgacattcttcccagcatcgcttgaaagaaaaacttagcgggctgggcggtgatccaggagccgacgccactgccgcttatcaggagctgtgtaggcagcgcatggccacccggcccccagatcgacctgaggggccccacacgtccaggataagcagtgtgtcctcccagttctcggacgggccaattccaagtccatctgccaggtcctctgcatccagctggtcagaggagcctgtccagtccaacatggacattagtactggccatatgattttaagctacatggaggatcacctgaaaaataaaaatcgcctggaaaaagaatgggaggcactgtgtgcttatcaggccgaaccaaactccagttttgtagcccagcgtgaggaaaacgtgcccaaaaatcgctccctggcagtcttaacatacgatcattcaagggtgctgctgaaggcagaaaactcccactcacatagtgattacattaatgcttcccccattatggatcatgaccccagaaatccagcctatattgctacgcagggcccgctaccggcaacagtagccgatttttggcaaatggtctgggagtctggctgcgtcgtcattgtgatgttaacccctcttgcagagaatggcgttcgccagtgttatcactactggcctgacgaaggatcaaacctataccatatctatgaggtcaacctggtttcagaacacatttggtgtgaggacttcttagtgcggtcgttttatttaaaaaatctgcaaacaaacgaaactaggaccgtaacccagtttcatttcttgtcttggtacgacagaggagtaccatcctcttcgcgctccctactcgattttagacgaaaagtcaataaatgttatcgcggcagaagttgtcccatcattgtgcattgttctgacggggctggtagaagtgggacctatgtgctgatcgatatggtcctgaacaaaatggctaaaggagccaaggagatcgacatagctgccacactggagcatttgagggaccaaagacctggcatggtacagacaaaggaacaatttgaattcgctctaactgccgtggctgaggaggtgaacgctatcttgaaggcactgccccaatag

SEQ ID NO: 201770 - DNA, 3651 bp, Artificial Sequence
  Description of Artificial Sequence: Synthetic coding sequence
atgggccacctgcccaccggcatccacggcgcccggcggctgctgcccttactgtggctctttgtgctgttcaagaacgctaccgcctttcacgtgactgtccaggatgataataatattgtcgtgtccttggaggctagcgacgtgatctcgccagcgtcagtctatgtcgtcaaaattacaggagaaagcaaaaactactttttcgaatttgaggagttcaacagtacactgccccctcccgtcatattcaaagcctcgtaccatggcttgtattatatcataactctggtagtggttaacggaaacgtggtcaccaaaccgtcccgctcgatcactgtgctgactaaacccctgcccgttacgtccgtgagcatatacgactacaagccgagccccgaaaccggggtgctatttgagattcactacccagagaagtacaacgtgttcactcgggtgaacatatcttactgggagggaaaagacttccgaacaatgctgtataaggacttcttcaaaggcaaaaccgtttttaaccactggctgcccggcatgtgttactctaacatcaccttccagttggtttcggaggctaccttcaataagtctactctggttgagtatagtggtgtttcacacgagccaaaacagcataggactgcaccctacccacctcagaacatttcagtaaggatcgtaaacctgaacaagaataattgggaggaacaatccggaaactttcctgaagagtcgttcatgagatcacaggatacaatcggtaaggagaaactgtttcactttactgaggaaacccctgagatccccagcggcaacatctcttccggatggcctgattttaatagttccgattatgagacaacatcacagccatactggtgggatagcgcatcagcggcacccgagagcgaagatgaattcgtctccgtcttgcccatggagtacgaaaataactcaacactgagcgagacagagaagtcaacctctgggtccttttccttttttcccgtccagatgattctaacttggctcccccccaaaccccctacggcattcgatggattccacattcatatcgagcgagaagagaattttacagaatatctgatggtcgacgaagaggcacacgagtttgtcgcagagctcaaagaaccaggtaagtataagctgagcgtgacaacattttcatcctcaggctcatgcgaaacaaggaaatcgcagagtgcgaaatcactcagcttttacatttccccctcaggtgagtggatcgaggagctgacagaaaagcctcaacatgtctctgtgcacgttctgtcctctactactgccctcatgtcctggacctccagccaagagaactacaatagcactattgtgtctgtagtttccttaacctgtcagaagcaaaaagagagtcagcggctcgaaaaacaatattgtacccaagtcaatagctccaagcccatcatcgagaacttggtaccaggggctcagtatcaagttgttatatatcttcgcaaaggacctctgattggccccccaagcgatcctgtcacgttcgccatcgtccccaccggcattaaggaccttatgctttaccccctaggccccactgccgtcgtgcttagctggacgagaccttatttaggtgttttccggaaatacgtagtggagatgttttattttaacccggcaaccatgaccagcgaatggacaacatattatgagattgcggctactgttagtctaactgccagcgtgagaattgccaatctgctgcctgcatggtattataatttccgtgttaccatggttacatggggcgaccctgagctatcatgctgcgactcctctaccatatcttttatcaccgcacccgtagcaccggaaattacatcagtggaatatttcaacagtctcctgtacatctcatggacgtacggcgatgacacgacggatctcagtcactcacggatgctccattggatggtggtcgctgaggggaaaaagaagatcaagaagtctgtgacaaggaatgtgatgacagccatcctgtccttacctccgggcgacatttataacttatcagtcacagcttgcaccgaacgcggaagtaatacttccatgcttcgattggtcaaactcgaacccgcaccccccaaaagcctgtttgccgttaataagactcaaacctccgttaccttactgtgggtagaggagggtgtcgccgacttcttcgaggttttttgtcagcaggtcggttcttcccagaagaccaagcttcaggagcctgtggctgtttcctcgcatgtcgtgacgatttcttccttgctgcccgcgaccgcatataattgcagcgtgacatccttttcccatgatagccctagcgtgcctacgttcattgcagtttccacgatggtgacggagatgaacccaaacgtagtggtcatctcagtcttagccatcctctctacattgcttatagggctattgctggtgaccctgatcatcttgagaaagaagcatttgcaaatggcacgcgagtgtggtgccgggacgtttgtgaatttcgcgtctctggagagagatggcaaactaccatataactggcgcagatctatcttcgcattcctgacattactcccttcatgcctttggactgactacttgctcgccttttatatcaacccctggtcaaaaaacgggctgaaaaaaagaaagttaacgaatcctgtgcaactggacgatttcgatgcctatattaaggatatggctaaagactccgactataaatttagcttgcagtttgaggagctgaagctgattgggctggacattccacactttgccgcagaccttccgttaaaccgctgcaaaaacaggtacaccaatatactaccttacgacttcagcagggtgcgcctggtgtccatgaacgaagaagaaggagcagattacattaatgcgaactacatccccgggtataacagcccccaagaatacattgcgactcaggggccacttccggaaactcggaacgacttctggaaaatggtgttacaacagaagtcccaaatcatcgttatgctgactcagtgcaacgagaaacgccgagtgaaatgcgaccactattggccatttacggaggagccaatcgcatacggcgacattactgttgagatgatttccgaggaagaacaggatgattgggcgtgccgccattttagaataaactatgccgacgaaatgcaggacgtgatgcacttcaattataccgcttggcccgaccacggcgtgcccacagccaacgccgcggaatctatactgcagttcgtgcacatggtgcgacagcaggcaacaaaatctaaggggcccatgataattcattgctctgctggggttggtagaacagggacctttatcgccctggatcgtctcttacaacacatcagggaccacgagttcgtggatatacttggcctggtgagcgagatgagatcctatcgcatgagcatggtgcagactgaagagcaatacattttcatccatcagtgtgtacagctcatgtggatgaagaaaaaacaacagttttgtatctccgacgtgatatatgagaacgtgagcaaaagttag

SEQ ID NO: 201771 - DNA, 3567 bp, Artificial Sequence
  Description of Artificial Sequence: Synthetic coding sequence
atgggccacctgcccaccggcatccacggcgcccggcggctgctgcctctcctgtggcttttcgtgctgttcaaaaacgccaccgcattccacgtaaccgtccaggatgataacaacattgtcgtcagcctggaggcctcagatgttatctcccctgcaagcgtatacgtggtgaaaattacaggcgagtctaagaactactttttcgagttcgaagagttcaactccactctgccaccgcccgtgatctttaaggcctcataccacgggctatactacatcattactcttgtggttgtgaacggcaacgtggtgactaagccatccagatctattaccgtgctgacaaagccacttcctgtgactagtgtgtcaatctatgattataagccaagtcctgagacaggcgtcctcttcgaaattcactatcctgagaagtataatgttttcacaagagtgaacatatcttactgggaggggaaagacttccgtacaatgctgtacaaagacttcttcaaagggaaaaccgtcttcaaccactggttgccgggtatgtgctattccaacatcaccttccagttggtgtctgaagccacttttaacaagagcaccctggtggaatactctggagtgagtcacgagccgaaacagcacaggaccgccccctacccaccacagaatatatctgtgcgcatcgtgaacctgaataagaataactgggaggaacaatctggtaacttcccagaggaatcctttatgcggagtcaggataccatcggaaaagaaaaacttttccattttactgaggaaacccccgagatcccatcgggtaacattagcagcgggtggcccgattttaacagcagtgactacgagaccacttcgcagccatactggtgggacagcgcctccgccgcccctgaaagtgaagatgagttcgtttctgtattgcccatggaatatgagaataattcaactctgagtgaaaccgaaaagtctaccagtggaagcttcagtttctttccagtccagatgatcctgacttggcttccccctaagccacctacagccttcgacggcttccatattcacatagaacgtgaggagaatttcaccgaatatctgatggttgacgaggaagctcacgagtttgttgctgagctcaaggaacccggtaaatacaaactgtccgtgactacatttagctcgtctggctcctgcgaaacacggaaatcccaaagcgcaaaatccttgtccttctacatcagcccttccggcgagtggattgaagaactgaccgagaaacctcaacacgtgtccgtccacgtgctgagttcaacgactgccctcatgtcatggacgagtagccaggaaaactacaactccacgatcgtgtccgttgtctctctgacctgtcaaaagcagaaagagagtcagcggctggaaaagcagtattgcacacaagtgaatagttccaagcccattatcgagaacctcgtgcctggggctcaatatcaggttgtcatttatctccggaaaggcccgctgattggcccaccaagcgacccagtgacttttgcaatcgtgccaacaggcattaaggacttaatgctttaccccttggggccaaccgcagtggtgttgtcttggaccaggccctatctaggggtatttcgtaagtatgtagttgagatgttctactttaatccggcaactatgacttcagagtggactacatattacgaaatcgcagcaacggtgagtctaaccgcttccgtccgtattgccaacctgctccccgcatggtattacaacttccgcgtgactatggtgacctggggggacccagaactttcttgttgcgactcctccacaatatcatttatcactgcgccagtcgcaccggagatcacaagtgtagagtattttaatagcctgctttacatatcttggacctacggagacgacactacggacttgtctcattcccggatgctgcactggatggtggtcgccgagggaaagaagaagattaaaaaaagtgtgactcgtaatgtgatgacagcaatcttgagtctgcccccaggcgacatttacaacctgtcagtgacagcctgcacagagcggggatctaatacatctatgctgagactggttaagttagagcccgcgcccccaaaatctcttttcgctgttaataagacccagactagtgttaccctgctctgggtcgaggagggtgtggccgatttcttcgaagtgttttgccagcaagtgggcagctcgcagaaaaccaaactccaggaacccgtggcagtatcatcccatgtagtgacaattagcagcctgctccctgcaacagcttataactgcagtgtgacctccttctcacacgacagcccgtccgtcccaacgttcatcgcagtctcaacgatggttacggagatgaatcccaacgtcgtggttatcagtgtattagccatactgtcgacactgctcataggactgttactcgtcactttaatcattttgcgtaagaaacacctccagatggccagggagtgtggcgctggcactttcgtaaacttcgccagcttagaacgggacggcaagctgccttacaactggtctaagaacgggctcaagaagaggaagttaactaacccggtgcaattggacgatttcgatgcatatatcaaggacatggctaaagactctgactacaagttctccctgcagtttgaagagctcaagctgattgggctcgacataccacattttgctgctgatcttcctcttaaccgctgtaagaaccgttatactaacattctcccatacgatttcagtcgcgtgagactggtttcaatgaatgaggaagagggggctgactacataaatgcaaattatatacccggatacaatagtcctcaggagtatattgctacccaggggcctcttcccgagacgcgaaacgacttctggaaaatggtgcttcagcagaagtcccagatcattgtaatgctcacacagtgcaatgagaaacgtcgggtaaaatgcgaccactattggccttttaccgaggagcccattgcttatggagatatcaccgtggaaatgatttcggaggaggagcaggacgattgggcctgccgacatttcagaatcaactacgctgatgaaatgcaagatgtgatgcactttaattacacagcgtggcccgaccatggagtaccaaccgccaatgctgccgaaagtattctccagttcgtccacatggtgaggcagcaagcaactaaatccaaaggtcccatgatcatccactgctctgctggggtgggcaggaccgggactttcattgctctcgatcgtctccttcaacatataagagaccatgagttcgtggatatccttgggttagtgtccgaaatgaggagctaccgtatgtcaatggtgcagaccgaggaacagtacattttcattcaccagtgcgtgcagctcatgtggatgaagaagaagcaacagttttgcatcagcgacgtgatctacgagaacgtctctaagagctag

SEQ ID NO: 201772 - DNA, 1218 bp, Artificial Sequence
  Description of Artificial Sequence: Synthetic coding sequence
atggtgaccgagatgaaccccaacgtggtggtgatcagcgtgctggccatcctgtcaacactacttattggcctcctgctggtaactctgatcattctgcggaagaaacatttgcagatggccagggagtgtggtgcgggcactttcgtgaattttgcgagcctggaaagggacggaaagctgccctacaattggcgcagatctattttcgcatttctgacactcctgcccagttgtctgtggaccgactacctcctagctttttacatcaacccttggagtaagaatgggctcaagaaacggaaactgaccaatcctgtgcaactagatgactttgacgcttatataaaagacatggctaaagacagtgattacaaattttcactgcagttcgaggaactcaagctgatcggactcgatatcccccatttcgccgctgatctgcctttaaatcgttgcaaaaacaggtatacaaatattctgccgtacgacttcagtcgtgtccggttggtgtctatgaatgaggaggaaggggctgattacatcaacgctaactacattcctggatacaattccccgcaggagtacattgcaacacaggggcccttaccagagacccgaaatgacttctggaagatggtgctgcaacaaaaaagtcagatcatcgtcatgctgactcagtgcaacgagaaacgaagggtcaaatgcgaccactattggcccttcaccgaagagcctattgcctacggcgatatcaccgtagaaatgatctctgaggaagagcaggatgattgggcttgccggcattttagaattaattacgcagatgagatgcaggacgttatgcattttaactatacagcctggcccgaccatggcgtccctaccgctaatgccgctgagagtattttgcaatttgtgcacatggtgcggcagcaggctaccaagagcaaggggccaatgatcattcattgctccgcaggcgtgggtagaacaggcactttcatcgccctagaccgcctactccaacatatccgggaccatgaatttgttgacatcctgggcctcgtgagcgaaatgagatcctatagaatgtcgatggtccagacagaggaacaatacatcttcatccaccagtgcgtacaactaatgtggatgaagaagaagcagcagttctgcatatcagatgtgatttacgaaaacgtttcgaaatcttag

SEQ ID NO: 201773 - DNA, 1218 bp, Artificial Sequence
  Description of Artificial Sequence: Synthetic coding sequence
atggtgaccgagatgaaccccaacgtggtggtgatcagcgtgctggctattctgtccactctgttaataggtctgctactggtcacgctgatcatactgagaaagaaacaccttcagatggccagagaatgcggcgccgggacctttgtaaacttcgcctcacttgaacgtgacggaaaactcccatataactggagacgctcaatcttcgccttcctcaccctgttgccttcatgcctgtggacagactaccttcttgccttttatatcaatccttggagcaaaaacggactgaaaaaacgaaagttgactaacccagtgcaactggatgacttcgatgcatatatcaaggatatggcaaaagacagcgattacaagttctccctgcaattcgaagaactgaagctgatcggactggacattcctcacttcgcagcagatctgccacttaacaggtgtaagaacagatacaccaatatactgccgtacgacttctctcgcgtaagactagtgtcaatgaacgaggaggaaggcgcagactacataaatgcaaattatattccggggtacaacagccctcaggagtacattgccacccaaggacccctgcctgaaacccgcaatgatttttggaagatggtgctccagcagaagtctcagattatcgtcatgcttactcagtgtaatgagaaaaggagggtcaagtgcgatcattactggccgttcaccgaggagcctattgcatatggcgatattactgtcgaaatgatttctgaagaagaacaggacgactgggcttgtaggcacttcagaattaactacgctgacgagatgcaggacgtcatgcatttcaactacactgcctggcctgaccacggcgttcctaccgcgaatgcggccgagagtattttacagttcgtgcacatggtgaggcaacaagctaccaagtccaagggcccgatgatcatacattgctcagccggcgtgggtcgcacaggaacatttatcgccctagacagactgttgcagcacattagggatcatgagttcgtggacatactgggactagtgtcagagatgcggagctaccggatgtctatggtgcagactgaagaacagtatatctttattcaccagtgcgtccaactgatgtggatgaagaaaaagcagcagttctgtatatccgacgtgatatacgagaatgtgtcaaaatcctag

SEQ ID NO: 201774 - DNA, 1134 bp, Artificial Sequence
  Description of Artificial Sequence: Synthetic coding sequence
atggtgaccgagatgaaccccaacgtggtggtgatcagcgtgctggccatcctgtctactctgctgatcggacttctgctggtcacactgatcattcttaggaaaaagcacctccagatggctagggagtgcggcgcagggacctttgttaactttgcaagccttgagagggacggtaaattgccatataattggagtaagaatggcctgaagaaacggaaactcacaaatcccgtgcagctcgacgatttcgatgcttatatcaaggacatggccaaagacagtgattacaagttctcattgcaattcgaagaacttaagctgattggcctggacatcccacattttgcggcggacttacccctgaaccgttgtaaaaataggtacactaacattctgccctatgactttagccgcgttcggctcgtttccatgaatgaggaagagggagccgattacattaacgcaaactacattcctggatataattctccccaggagtacatcgccactcagggtccacttccggagactaggaacgacttctggaaaatggtgctccagcagaagagccagattatcgtgatgctgacccaatgcaacgagaaaaggagagtcaagtgtgatcattactggccattcactgaagagccaatagcttatggcgatatcacagtggagatgatttctgaggaggagcaggatgactgggcttgccggcacttccgcatcaactacgctgatgagatgcaagacgtgatgcattttaactataccgcctggcccgaccacggcgtgcctaccgctaatgcagcagaatcaatcctccagttcgtacatatggtacgccaacaggcaacaaaatccaaaggtccaatgataatacattgctccgcaggagtgggcaggacaggcactttcatcgccctcgatcgcctgctgcaacatatccgtgaccatgaattcgtcgacatcctaggactcgtctctgagatgaggagctatcgaatgtccatggtgcagaccgaagagcagtacattttcatacatcagtgtgtgcaattgatgtggatgaagaagaaacagcagttctgtatcagcgacgttatttacgagaacgtttcaaagtcctag

SEQ ID NO: 201775 - DNA, 1134 bp, Artificial Sequence
  Description of Artificial Sequence: Synthetic coding sequence
atggtgaccgagatgaaccccaacgtggtggtgatcagcgtgctggccatcctttcgacactgctcataggccttctactggtgactctgataatcttgcgcaaaaagcatctgcagatggcaagggagtgtggggctggtacatttgtaaactttgccagtctagaacgggacgggaagttaccctacaactggagcaaaaacggcctcaaaaagcgcaaattaactaacccagtgcagctcgacgacttcgacgcgtatattaaggacatggcgaaggactctgactacaagttttccctgcagttcgaggagctcaagcttatcggtctggatatccctcattttgccgcagacctccctctgaatcgttgtaagaacaggtacaccaacattctgccttatgacttcagcagggtccgtttggtgtctatgaacgaagaagaaggcgcagactatatcaatgcaaactacatacccggatacaacagcccccaggagtacattgccactcagggaccactgccagagacaagaaatgacttttggaagatggtactccagcagaagtctcagatcattgtgatgctgactcagtgtaatgaaaaaagacgagtgaaatgcgaccattactggcccttcacggaagagcccattgcttacggtgatatcacggtcgaaatgatctccgaggaggaacaggacgattgggcgtgtcggcatttcaggattaactatgcggatgagatgcaggatgtgatgcactttaactacaccgcctggccggatcacggagtgcccactgctaatgctgccgaatccatcttgcagtttgtgcatatggttagacagcaggctaccaagtctaagggacccatgattatccattgctcagccggggtgggtaggaccggcaccttcatcgcgcttgaccggcttttgcagcatatccgcgaccacgagttcgtggatatcctgggccttgtatccgagatgaggagttacagaatgtcgatggtgcagacagaagagcagtacatctttattcaccagtgtgtgcagctgatgtggatgaaaaagaagcagcagttttgtatctcggatgtgatctacgaaaatgtatcaaaatcctag

SEQ ID NO: 201776 - DNA, 6888 bp, Artificial Sequence
  Description of Artificial Sequence: Synthetic coding sequence
atggacttcctgatcatcttcctgctgctgttcatcggcaccagcgagacccaggtcgatgtgtccaacgtggtgccgggaaccagatatgacatcaccatcagcagcattagcaccacgtatacatctcccgtgacccggatcgtaactacaaacgtgacaaagcctggaccccccgtttttcttgccggggagcgcgtaggctctgcggggatcctgctcagctggaataccccccctaacccaaatggaaggattatctcatacattgtgaagtataaagaggtgtgcccttggatgcagactgtatacacacaagtgaggtctaaaccagattctctcgaagttctgttaacaaatctgaatccaggtactacttatgagattaaagtcatcattttaaacgccactaaggtaggatgtctgctgagcccaattcttctgaataccgttttagagggcctcgctcgcgctattaacctgacaagagagtgtcagaccgtggacgcaggccagtgcgtgcaatgtgcggttcgggaacccaaacaggggtctacttctggcggtagggcacagactaacaaaaaaacggcagtgacatcggccgatctaaatcatactgcaggcgatcttcgtacgggacgtcttccccctcaacctctaacggccgagcagcccaattgggaggctcctcctagccgaggccggctcacgccacataaagcggggtatagctccgctacggccgccggcacgcaggctaaccgggtgtggtctcggccactggctaagatccagactacgattagagaatattataaacatctctacgcaaagaaggaagggatcctgccaaatagtttttacgaagcttctataattttgattccgaagccggttcctgaaggccccccacagaactgcgtgacaggaaacattactgggaagtctttctccattctgtgggacccacctactatcgttaccggtaagttttcatatagagtggaactttatggccccagtggtaggatcttggacaattccaccaaggaccttaagttcgcattcacaaacctcaccccttttacaatgtatgatgtctacatagctgccgagaccagcgccggaactgggccaaagagcaatatttcagtcttcacccctccagatgtgccgggagctgtcttcgatctccagttagcagaggtggagtccacccaagtgaggataacttggaaaaagccacgccagcccaatggcatcattaatcagtatcgcgtcaaagtgctagttcctgagactggcatcattttagaaaataccctattgacggggaataacgagtatattaatgatcctatggcaccagagatcgtgaacatagtggaacctatggtcggactctacgagggttccgctgagatgtcttctgatctacactcgctggcaaccttcatttacaatagccaccccgataaaaatttcccagcaaggaaccgggccgaggatcagacaagcccagttgttacgactagaaatcagtatataacagacatcgccgcagagcagctgagttacgtgatccgtaggcttgttccgttcaccgagcacatgatctctgtatctgcgttcacaattatgggcgaaggacctccaactgttttgagcgtgagaaccaggcagcaggtccccagcagtataaagatcatcaattataagaacatcagttccagcagtatcttgctgtactgggacccgcccgagtatcccaacggaaaaattacccactacacgatatacgctatggagctggacactaacagagccttccaaattacaaccattgacaacagtttcttaattactgggctgaaaaagtacacgaaatataagatgcgcgttgccgcctctactcacgttggtgaatcctcgctctcagaagagaacgacattttcgtacgtacctccgaggacgagccagaaagcagcccacaggacgtggaggtgatcgatgtgacagcagatgagatacgtctgaagtggtctccgccggaaaagccgaacggaatcatcattgcgtatgaagtcctctacaaaaacatcgatacattgtacatgaaaaacactagcacaaccgatatcatccttagaaacttgcgccctcacacactatacaacattagtgtgcgctcctatactagattcggtcacggaaatcaggtaagcagtctgctgtcagtaagaacttctgagacagtgccggattctgcgcccgaaaacattacctacaaaaatatctcttctggagagatagaactgagtttcctccctccatccagtccaaatggtatcatccagaagtacactatctatctgaaacgcagtaacggaaacgaagagaggacaatcaatacaacatcactgacccaaaatattaaagtgctcaaaaagtacacacagtacattattgaggtgagtgccagtacgttgaaaggggagggtgtcaggagcgcccccatcagcattctgacagaagaggatgcacctgacagtccaccacaggacttttctgtgaaacagttgtccggcgtgaccgtgaagctcagttggcagcccccgctggagccgaatggcattatcctgtactacacggtgtacgtctggaaccgctctagccttaagacaattaacgtgacggagacaagcctagaattgagtgatttagactataatgtggaatattcggcatacgtgactgcctctactaggttcggcgatgggaagacgagatccaatatcatctcttttcagacaccagaaggagctccctccgacccgcctaaggatgtctactatgccaacctgtccagcagttctatcattctgttctggacaccccctagtaagcccaatggcatcattcagtattacagcgtgtattaccggaatactagcggcaccttcatgcaaaacttcactctgcatgaggtcacaaacgactttgacaacatgacagtatctacgattatcgataagctcacaattttttcctattataccttctggctcacagcttccacttcagtggggaatgggaacaagtctagcgatattattgaagtgtacactgaccaggacataccagagggctttgtaggcaacttaacatatgaatccatcagcagcaccgcaatcaatgtgtcttgggttcctcccgcccagccaaatggcctggtcttttactacgtaagcctgatcttgcagcagaccccccgtcatgtaagaccccctctggtcacctacgagcgctccatctattttgacaacctggaaaagtatactgattacatcctcaaaatcaccccttcaactgaaaagggcttctccgatacttatactgcacaactatacattaaaactgaagaagatgtccccgagaccagccctattattaacactttcaagaatctgagttcaacctccgtgctacttagctgggaccccccagtgaagcctaacggggccattatcagctatgatctgaccctgcaaggccctaatgagaattacagttttattacatccgataattatatcattctagaagagcttagtccgttcacattgtacagctttttcgcggctgccagaacccggaaaggactgggaccttctagcatcttattcttttacactgatgaatccgtacctctagcccctccccagaatttaacattaatcaattgcacctctgatttcgtgtggctcaaatggtccccttcccctttgccaggcgggattgttaaagtgtatagtttcaagatacatgagcatgaaaccgacaccatctactacaaaaatatatcagggttcaaaaccgaggccaaattagtgggactggagcccgttagtacatactccataagggtatctgcctttacaaaggtcggcaatggaaatcagttttctaacgtggtcaaattcacgactcaagaatccgtgcctgacgtggtgcagaacatgcagtgcatggccacatcttggcagagcgtactggttaaatgggacccacccaaaaaagctaatggaattataacacagtacatggtgaccgtggagcgcaatagcaccaaagtttcacctcaggatcacatgtacacgttcataaaactgctggcaaatactagctacgtctttaaggtacgagcctctactagcgctggcgaaggagatgaatcaacctgccacgtgtctacattgccagagaccgtgccatcggtccctaccaatattgctttttcggacgtgcaatctacctcggcaactcttacctggatccggcccgacactatcttgggatattttcaaaattataaaataactacccagctaagagcccagaagtgcaaagaatgggagtctgaagagtgtgtcgaataccagaagattcagtacctctatgaagcacacctcacagaggaaactgtgtacggacttaagaagttcaggtggtaccggttccaggttgctgccagtaccaacgctggctatggaaacgcaagtaattggatctctaccaagaccctgcccgggcctcctgacggcccgcctgaaaatgtgcatgttgtggctacctcacccttcagtatatccatatcatggagcgaacctgccgtgatcactggacctacctgttatctgatcgatgtcaaaagtgtggataatgatgaatttaatataagtttcatcaaatcaaatgaggaaaataagacgatcgaaatcaaagatctcgaaatatttacacgttacagtgtggtcattactgcattcacgggcaatatcagcgcggcttatgtggaggggaaaagtagcgccgagatgatcgtcaccacgctggagagcgctcctaaagatccccctaataatatgaccttccagaagattccagacgaggtcaccaaatttcaattgaccttcctcccacccagtcaacccaacggcaatatccaggtgtaccaggccctggtctaccgggaggacgatcctaccgccgtacagattcacaatctcagtattattcaaaagaccaatacttttgtcatcgcaatgctcgagggtctaaagggcgggcatacctacaatattagcgtgtatgccgtgaactccgctggtgccgggcctaaggtcccaatgcgtatcacaatggacatcaaagccccggcaaggccgaagacaaaaccgaccccaatctatgatgcaacagggaagctgttagtcacaagcaccaccattacaatcagaatgcctatttgctactatagcgatgaccatggcccaatcaagaatgtgcaagtgttggtgacagagaccggcgcccaacacgatggtaacgtgaccaagtggtacgatgcctacttcaataaggctcgaccatactttaccaatgagggtttccctaatccgccctgcacagaagggaagacaaagttctcagggaacgaggaaatctatatcataggcgcggacaacgcctgcatgattcccgggaatgaggataagatctgcaatggccccctcaagcccaagaaacagtaccttttcaaattccgcgcaaccaacattatgggacagttcacagattccgattattctgacccggttaaaacccttggtgagggattgagcgaacgaaccgtggagattatcctatcagtgactttatgcatcctctctattatcctgcttggcacagcaatcttcgctttcgctcggatccggcagaagcagaaagaaggcggaacatattcccctcaagacgccgaaatcattgacacaaagctcaaactcgatcaacttattactgtggctgatctcgagctaaaagatgagcgcctgacaaggttgctgtcatacagaaaatccattaagccgatcagtaagaagagtttcttacagcacgtggaggaattgtgtaccaataacaacctgaagttccaggaggaattctccgaacttccaaagttcctgcaggacctgtcctccacagacgctgatctgccttggaaccgagccaaaaaccggttccctaatataaagccttataacaataatcgggttaagctgattgctgacgcttctgtccccggcagcgactatattaacgcatcatacatcagcgggtacttatgccccaatgagtttatcgccacacagggaccgctacccggcacagtaggcgatttctggagaatggtgtgggagacaagagccaagacactggtgatgctgacacagtgtttcgagaaaggaagaatacgctgtcaccagtactggccagaggacaataagcccgtgacagtgttcggagatatcgtaatcaccaaactgatggaagacgtgcagattgattggactattagagacttgaaaattgaaaggcacggggactgcatgactgtcagacaatgtaatttcacggcctggccagaacacggagtgcctgaaaattccgctcctctcattcacttcgttaaactggtccgagccagcagagcccacgatacgacccccatgattgtacattgctcggctggagtaggacggacaggtgtcttcattgcactcgaccatctcacccaacatatcaatgatcatgactttgtagatatttacggcttagtggccgaactaagatcagaaaggatgtgcatggttcaaaatctggcacagtatatctttcttcatcagtgcatcctggatctgttatcaaacaagggctctaaccagccaatttgctttgtaaattatagcgcactacagaaaatggactcgctggatgcgatggagggagatgtggaactcgaatgggaagaaactacgatgtag

SEQ ID NO: 201777 - DNA, 5787 bp, Artificial Sequence
  Description of Artificial Sequence: Synthetic coding sequence
atggcccccacctggggccccggcatggtgagcgtggtgggccccatgggcctcctggtcgttcttctggtaggaggctgcgctgccgaggagcccccgcgattcattaaggagccaaaggatcagatcggcgtgagcggaggagttgcatccttcgtgtgccaagccaccggggacccaaagccgcgggtgacgtggaataagaaaggcaagaaagtgaactctcagcgttttgagaccattgagtttgatgaatccgccggggccgtgttacgtatccagcctttgagaacacctcgtgatgaaaatgtctatgagtgcgtggcccaaaacagtgtaggcgaaataacagtacatgcgaagctgaccgtacttagggaggatcagctgccgagcggctttccaaacatagatatgggaccgcagcttaaggtggtcgagaggactcggactgctactatgctctgtgccgcaagtggcaacccggaccccgagattacatggtttaaagacttcctgcctgtggacccctccgccagtaatgggcgaataaaacaactgcgatctgaccaggccttcagtcacctgccaacaggcgctctccaaatcgaaagctccgaggagaccgatcagggtaagtatgaatgcgtggctactaacagtgctggagtccgctattcgtctccagctaacctctatgtgagagtgcgacgcgtggccccacggttttccatccttcctatgtcacacgagatcatgcctggcggcaatgtgaatatcacctgtgtggcagtgggctcgcctatgccttatgtgaagtggatgcagggagcagaggacctgactccagaagatgacatgccggtgggacggaacgtgctggaactcaccgacgttaaagactccgccaattatacctgcgtggctatgtcctccctgggcgtgattgaggctgttgcacagataactgtaaaatcccttcccaaggctcctggcactcccatggtgaccgaaaatacagccacatcgattaccatcacctgggactccggaaatccagatcctgtgagctactacgtcatcgaatataaaagcaaaagtcaagacggtccctaccagataaaggaggacattaccacaacccgctattcaattgggggtttgagtcccaacagtgaatatgagatctgggtttccgctgttaatagcatcggccagggacccccaagcgagtctgttgtgacgcgaacaggtgaacaggctcctgctagcgcccctagaaacgttcaggctagaatgcttagcgcaaccaccatgattgtccagtgggaagagcccgtggagcctaacggtcttatcagaggttatagggtgtactacacaatggagcccgagcatcctgtaggtaattggcaaaaacacaatgtggatgattctctactgactactgtaggaagcctgttggaggacgaaacgtataccgtccgggtgcttgctttcacttccgtgggtgatggtccactgagcgatcctatccaagtcaagacacaacaaggcgttccaggtcaacccatgaatctgcgagcagaggcgcgttcggagacaagtattactctatcctggtcccccccccgacaggaatcaattatcaagtatgagctgctgttcagggagggcgaccacggccgtgaggtgggacggacattcgacccaactaccagctacgtcgtagaagatctgaagcccaataccgagtacgcctttagactcgccgcccgatctccccagggccttggagcatttacaccagttgtcaggcagcggaccctgcagtcaaagccatctgcacctccccaagacgttaaatgcgtctctgtgagatctacagctatcctcgtgtcctggcgacctcctcctcctgaaactcataatggggcactggtcgggtactctgtaaggtaccggccacttgggtctgaggatccagaacccaaagaagtaaacggaatcccaccgacaactacccagatacttctggaagctctggaaaagtggacacagtatagaatcaccacagtggcacatactgaggtgggaccaggccccgagtcttcaccggtcgtggtcagaaccgatgaggacgtgccctctgccccgcccagaaaagtcgaggccgaggctttgaacgcgaccgcgatccgagtgctgtggagaagtcctgcgccgggccggcaacacggccagattaggggttaccaggtacattacgtacggatggagggggcggaggccagggggccaccaaggattaaggatgtcatgttggcagatgctcagtgggaaacagatgataccgctgaatacgaaatggtgattacgaacctgcagccagagacagcttattcgattaccgtagctgcatacaccatgaaaggagacggggcgcgttcaaaacctaaagtggttgtcaccaaaggcgcagtgctaggccgccccacgctgagtgttcaacagactcctgagggatcgctgcttgcaaggtgggagccccccgccggaaccgcagaggaccaagtgttggggtaccgtctccaattcggtagagaggacagcacccccctggcaacgcttgagtttcccccatccgaagataggtacaccgcttcaggggtccacaagggtgcaacttacgtattcaggctggctgccagaagccgtggcggcctgggtgaagaagcagccgaagtgctttcaatcccagaggacactcctcgaggacacccccagattttggaggctgccgggaacgcatcagccgggaccgtgctgctccgctggttgcccccggtccccgcagagagaaacggcgccatcgtgaaatatactgtagccgtgagggaggcaggggctctgggacctgcgcgggaaactgaactcccagccgcggccgaacctggagccgaaaatgcactcacactgcagggtctgaagcccgataccgcttacgacttgcaggtcagagcccacacaaggagaggtcccggtcctttctcaccgcccgtgaggtacagaacctttctaagagatcaggtttctccaaagaacttcaaagttaaaatgattatgaagaccagtgtgctcctttcttgggagttcccggacaattataactctccaacaccatacaagatccagtataacggattgaccctggatgtggacggcaggacgaccaagaagctgattacacatctcaaaccgcataccttctataattttgtgttgacaaacagaggctccagtctcggaggcctacagcagactgtgacagcctggactgcctttaatcttctgaacgggaagccatctgttgcaccaaagccggatgccgatggcttcatcatggtatacttgcccgatggccaaagtcccgtcccagtccagagctattttatcgtgatggtcccgctgcggaaatcccggggcggccagttcctcacccctctgggatcccccgaggatatggatctagaagaactaattcaagacatctctaggttgcagcgtcgtagcctgagacactctcggcagcttgaggtaccccgtccatacatcgctgctaggttctcagtcctgccacctactttccaccccggtgaccagaagcagtatggcggcttcgataaccgcggactcgagcccgggcaccggtatgtcctgttcgtactcgcagtgctccagaaatctgagcctactttcgccgcttccccgttttccgatccgtttcaactcgataatcctgatccccagcccatcgtcgacggggaggaagggctcatctgggttataggtccagtgctcgccgtggtttttattatctgtattgtcattgctatcttgctctacaaaaacaagccagacagtaagaggaaggacagcgaaccacggacaaaatgcttgttgaacaatgccgaccttgctccacaccatccaaaggacccagtcgagatgaggcgcattaactttcagacacccggaatgttgagccaccctcctataccaatagccgacatggctgagcatactgagcgtttgaaggccaacgatagcttgaagctcagccaagaatatgaatccatcgaccccggacagcaattcacctgggaacactccaatctggaagtgaataaacccaagaatcgctatgctaacgttatcgcatatgaccattcaagggtgatcctccagcctatagaagggatcatgggttctgattatatcaacgctaattacgtggatggctatcggtgtcagaatgcgtacatcgcaacgcagggccccctccctgaaacatttggagacttctggcgcatggtctgggagcagaggtcagcgactattgtgatgatgacacgattagaggaaaagagtcgcatcaagtgcgatcagtattggccaaatcgaggcacggagacatacggattcatccaggtcacactgttagacacaatcgaacttgccaccttctgtgttaggacttttagtttgcacaagaatggctcaagcgagaaaagggaggttcgacagtttcagttcaccgcttggcccgaccacggtgtgcctgagtatccgacacctttcctcgctttcctgaggcgggttaagacctgcaatccgccagacgcaggtccaatagtggtgcattgctcagcgggggttggccggacagggtgcttcattgtcatcgacgccatgctggaacggatcaaacctgaaaagaccgtggatgtgtatggccatgtgacattaatgagatcccagcggaattacatggtccaaactgaagaccaatatagcttcatacacgaagcacttctcgaagctgtgggctgtggtaacacggaagttccagcgaggagcctgtatgcttacatccagaagctggcccaggtcgaaccgggagagcacgtgactgggatggagctggaattcaaacgcctggcaaacagcaaggcccacaccagtaggttcatttccgctaacctcccatgcaataaatttaagaaccggttggtaaacatcatgccctatgagagcacccgcgtctgtttgcagccaatccgaggcgtcgaggggagcgactacatcaacgcaagcttcatagatgggtataggcagcagaaggcatacatagccacgcaggggccactcgccgaaactacagaagacttttggaggatgctttgggagaataattcaacaatcgtggtgatgctcaccaaactgcgggaaatgggtagggaaaagtgtcaccagtattggccggctgaacggagtgctagataccagtacttcgtcgttgaccccatggcagagtacaatatgccacagtatatccttagagaatttaaggtcacagatgcacgcgatggtcaaagtaggactgtcagacagtttcagttcacagactggccagaacagggcgtgcccaaatctggcgaggggtttatcgatttcattggtcaggtgcacaaaaccaaggagcagttcgggcaggatggtcccatcagcgttcactgctccgccggagttgggagaacaggagttttcatcacccttagcatagtgctggaaagaatgcgctacgagggagtagtggacatttttcagacagtgaagatgctgagaacccagaggcctgcaatggtccagaccgaggatgagtatcagttctgctaccaagccgcactggaatatctgggatcctttgatcactacgccacttag

SEQ ID NO: 201778 - DNA, 5733 bp, Artificial Sequence
  Description of Artificial Sequence: Synthetic coding sequence
atggcccccacctggggccccggcatggtgagcgtggtgggccccatgggcctcctcgtagtgctgcttgtcggcggctgtgccgcagaggagcctcccaggtttataaaggagccaaaagaccaaattggcgttagtggcggagtggcctcttttgtttgccaagctactggagatcccaaaccacgagttacatggaacaaaaagggaaagaaagttaatagccaaagatttgaaaccattgaatttgatgagagcgctggcgccgtcctccggattcagccacttaggaccccgcgcgatgaaaatgtgtacgaatgtgtggcccagaactctgtaggcgaaatcaccgtgcatgcaaagctcaccgtgctacgggaagaccagcttcctagtggattccctaatatcgatatgggaccccagttaaaagtcgtcgagaggacaagaaccgctaccatgctgtgtgctgctagcgggaacccggacccagagataacctggtttaaggacttcctcccagtggaccctagtgcatcaaatgggagaatcaagcaattacggagcggagccttacaaatcgaaagctctgaagagacagaccagggcaagtatgaatgcgtggccacaaattcggctggtgtgaggtatagtagcccggccaatctgtacgtgcgtgttagacgcgtcgcgcctcggttcagcattttaccgatgtcacacgaaattatgcctggcggtaacgtgaacatcacctgtgtcgcagtgggatctccaatgccctatgtaaagtggatgcaaggggcagaagacttgactcctgaagatgacatgcctgttggaaggaacgtgctggaactaactgacgtgaaagatagtgcaaattatacgtgcgtagctatgtctagtttgggagtcatcgaggcagtcgcacagattaccgtgaagtcactgccaaaagcccccggtacacccatggtaactgagaacaccgccacctccatcactattacgtgggattctggcaatccagaccccgtatcctattatgtaatagagtacaaatctaaaagccaggacggcccatatcagatcaaggaggatattaccacaaccaggtattcaatcggggggttatcacccaactccgaatacgaaatatgggtctcagctgtaaacagcatcgggcaggggccccccagcgaaagcgtggtcactaggactggtgaacaggcaccagcaagcgctccaagaaatgtccaggcgagaatgttgtcagccaccacgatgatagtacagtgggaggagcccgtggagccaaatggactcatccgtggctatagagtctattatacaatggagccggaacaccccgttggaaattggcaaaagcacaacgtggatgactccctgctcactactgtcggctcccttctggaggacgaaacttatacagtaagagtcctggcatttacctccgttggtgacgggcccctcagcgacccaatccaggtgaaaacccaacaaggtgtgcccggccagccgatgaacctcagggccgaggcgaggagcgagacaagcattacgctaagttggtctcccccacgccaagaatcgatcatcaagtacgagctgttgtttcgggagggcgaccatgggcgcgaggttgggaggacatttgatcccaccacgagctatgtagttgaagatctcaagccgaacaccgagtatgccttccgcctggctgcgcggtctcctcaggggctgggggcatttacaccggtcgtgaggcagagaacgctgcaatcaaaaccctcagctccccctcaggacgtgaaatgcgtgagcgtgcgatctactgctattctggtatcttggaggccaccgccccctgaaacacacaatggagcgttagtcggctattcagtgcggtacaggccactggggtcagaggatcccgaaccgaaggaagtgaacggcattcccccgactacaacccagatcctgctagaagcccttgagaaatggacccagtaccgcattaccactgttgcccacaccgaagttgggccgggcccggagtcctcaccagtcgtcgtgcggacagacgaagacgttccaagcgcaccaccccgcaaagtggaggccgaagctctcaatgctacggctatccgtgtgctgtggcgcagcccagcccccggccgccagcacggacaaattcgcggctaccaggtgcattacgtcaggatggaaggtgctgaggctaggggtcctccacgaatcaaggatgtgatgttagccgatgcccaggaaatggttatcaccaacctccagccagagacagcctatagcatcacagtggccgcatataccatgaaaggagatggcgcccgctctaagcctaaggtcgtggtcaccaagggagcagtgcttggtaggcctacattgagtgtgcagcagactcctgaaggtagcctccttgcacgctgggaaccgccagccggcaccgcagaggatcaggtgctgggttacagattgcagttcggaagggaggacagtactcccctcgccactctcgagtttccaccttcggaggacaggtataccgcctcgggagtacataaaggcgctacctacgtttttagattggccgcaaggtctcggggcggtctgggcgaggaagcggctgaggttttatcaattcctgaggatacaccacggggtcatcctcaaatcctggaagccgccgggaatgcatccgccggcaccgtgctgctgagatggctgccacctgttccggccgagagaaatggcgccatcgtcaaatacacagtggccgttagggaggccggcgctttggggcccgctagagagacagaactccccgctgcagctgagcctggagcggagaatgcattaacacttcagggcctaaagccggacaccgcttatgacctgcaggttagggcgcacacccggcgggggccaggccccttcagtccgccagtgcgataccgtacattcttgcgggaccaggtgtcccctaagaacttcaaggtgaagatgattatgaaaacctccgtattattgtcctgggagtttcccgataactacaatagcccgacaccttacaaaatccagtataacgggctgaccctggacgttgatggcagaaccaccaagaagctgatcacacacctgaaaccgcacaccttctacaatttcgtccttacaaatcggggatctagcctgggcggactgcagcagactgtgaccgcttggactgccttcaacctcctaaatggtaagccatcagtcgctccgaaacccgatgcagacggcttcataatggtgtacctgccagacgggcagtcccccgtgcccgttcagtcttatttcatcgtcatggttcccctgagaaaaagcaggggaggccaattcctaacccctctgggctcgcctgaagatatggacctggaagaactgatacaagatatttcgagactgcagcggcgcagcttgcgtcatagtaggcagctggaggtacccagaccctacatagccgcacggtttagcgtgcttccccctacatttcatcctggagatcaaaaacaatatggtggattcgataaccgcgggttagaacctgggcacagatatgtcctgttcgttctggccgttctgcagaaatccgagcccactttcgctgcaagcccattctcagaccccttccagctggataatcccgacccccagccaatagtcgacggcgaagagggcctaatttgggtgatcggacctgtgctcgctgtggtgttcattatctgcattgtgattgctatactgctgtacaagaacaaaccagattcaaaaagaaaggattcagagcccaggacaaagtgtctgctcaataatgccgacctggcaccccatcatcccaaagatccagtggagatgaggcggattaattttcaaactcctgggatgttgagccacccgcctatcccaatcgccgatatggccgagcacacagaacgcctgaaagcaaatgacagcctgaagctcagccaggaatatgagagtatagacccaggccagcagttcacttgggaacactccaatttagaagtgaataagcccaagaatagatatgccaacgttattgcgtacgatcactcaagagtgatcttacagcccattgagggcattatggggtccgactatataaatgcaaactacgttgatgggtatagatgtcaaaatgcctacatcgccacccagggacccctgccagaaacatttggcgacttctggcgtatggtgtgggaacagcggagcgccacgattgttatgatgactcgccttgaggagaaatcaaggatcaagtgcgatcaatattggccaaataggggaacagagacctacgggttcatccaggttacgcttctagataccatagagttggcaaccttctgcgtaagaactttcagtctccacaaaaatggcagctctgagaaacgcgaggtcaggcagttccagttcacggcctggccagaccatggagtgcctgagtacccaacaccctttctcgcatttctgcgcagggtcaagacatgcaacccccccgacgccggcccaatcgtagtgcattgttccgccggggtggggagaaccggctgctttatcgtgatcgacgcaatgttagaaagaatcaaacctgaaaaaacagtcgacgtgtatggccatgttactttaatgaggagtcagcggaattacatggtacagactgaagatcaatacagcttcatccatgaggcgctgctggaagccgtggggtgtggcaacaccgaagttcccgccagaagcctctacgcttatattcaaaagcttgcccaagtggaaccaggagagcacgtgactggcatggaactggaatttaagcggctggccaatagcaaggcccataccagccggtttatttctgccaacctgccctgcaataaatttaagaacaggctggtcaacattatgccatatgaaagtaccagagtgtgtctgcagcccataagaggtgtcgaaggctcagactacattaacgccagcttcatagatggatatcgccagcagaaagcatacatcgccacacagggacctttggcggagactaccgaggacttttggaggatgttgtgggagaataatagtacgatcgtggtgatgctgaccaaactccgggagatggggagggagaagtgccatcagtattggccggccgagcgctcagcccgatatcaatacttcgttgtggatcctatggcggagtataacatgccccagtatattctgagggagttcaaagttaccgacgccagggacgggcagtccagaacagtgaggcagttccagttcactgactggccagagcagggagtccctaaaagcggcgagggattcattgactttataggacaggtgcacaagacaaaggagcagtttggtcaagacggacctattagtgtccattgcagcgcaggtgttggaagaaccggcgttttcattacactttccatcgtcctggaacgcatgaggtatgaaggcgtggtggatatttttcagactgtcaaaatgctgcgcacacaaaggccggccatggtgcaaaccgaagatgaataccagttctgctatcaggcagccctggagtacctgggctctttcgaccactacgccacatag

SEQ ID NO: 201779 - DNA, 4506 bp, Artificial Sequence
  Description of Artificial Sequence: Synthetic coding sequence
atggcccccacctggggccccggcatggtgagcgtggtgggccccatggggctccttgtcgtccttttggtcgggggttgcgccgctgaagagccccctaggttcatcaaagagccgaaggatcagatcggggtgtccggaggagtcgccagcttcgtgtgccaggccacaggggatccaaaaccccgggtcacttggaataagaagggcaagaaggttaatagccagcggttcgagactattgagttcgacgagagcgctggagcagtcctccgcattcagccacttaggaccccgcgcgacgagaatgtctacgaatgcgtggcacaaaatagtgttggggagatcaccgtgcacgccaagctcaccgtgctgcgggaagaccaactccccagtggctttcccaatatagacatgggcccgcaattaaaagtggtcgaaaggactcggacagccacaatgctgtgtgccgctagtggcaaccccgatcccgaaatcacctggttcaaagatttcctacctgttgacccctccgcttcaaatgggcgaataaagcagctccggtctggggccttgcagattgaatccagcgaggagaccgaccaggggaagtacgagtgcgtggccacgaattctgccggggttcgatattcaagcccagcgaatctgtatgttcgtgtccgtagagtggctccacgattttccatcctgccgatgtcacacgagatcatgcccggagggaatgttaacattacttgcgtggccgtaggaagtccaatgccttacgtgaagtggatgcagggggccgaagatctgacaccagaggacgatatgcctgtggggcggaatgttctggagctcaccgatgtaaaggacagcgcaaattacacttgtgtagccatgtcctcactgggcgtgatagaagcggtcgcacagatcacagtcaagtccttgcctaaggcccctgggacgcccatggtgaccgagaatacggccacctcaattacaatcacatgggatagcggtaatccagaccccgtgagttattacgtaattgagtacaaatcgaagtcccaggacggcccttatcagatcaaagaggacatcacaacaacgcgctacagcatcgggggtctctcccccaacagcgagtatgagatctgggtgagcgccgtcaattctattggacagggcccaccgtctgagagcgtcgtgactcgtacgggcgagcaggcgccagcctctgcccctcgcaacgtgcaggcaagaatgttgtccgctacaactatgatcgtgcagtgggaagagccggtggagcccaacggactcatacggggctatcgcgtctactacactatggaacccgaacatcccgtgggaaactggcagaaacataatgtcgacgactccttactgaccacagtgggaagcctcctcgaggacgaaacctacaccgtgagagtcctcgcttttacctccgtcggtgatggacctctctcagatcctatccaagttaagactcagcagggagtccctgggcaaccaatgaatctgagggcggaggcccgctctgaaaccagcataaccctttcatggtcgcctccacggcaggagagcataatcaagtacgagttgctgttcagggagggggaccacggacgagaagtggggaggacatttgacccaactacatcttacgtggttgaggacctgaagcctaacactgagtatgccttcagactggcagcgcgctctccccagggcctgggagccttcactcctgtggtccggcaacgtacacttcagtccatttcgcccaaaaacttcaaagtcaagatgattatgaaaacatctgtcctgctgtcatgggagttcccggataattacaacagccccacgccttataagattcagtacaacgggttgacgctggacgttgatggacgtactacaaagaaactgataactcatctcaagccccacactttctacaattttgtcctgaccaacagggggtctagcttaggtggactgcagcaaacggtgaccgcctggaccgcctttaacctcctgaatggcaagccatccgtcgcacccaaaccagacgcagatggcttcattatggtgtacctgccagatggccagagccccgtgcctgtgcagtcttatttcattgtgatggttccacttcgtaagagtagaggcggtcagtttctaactcctttgggcagtcctgaggatatggacctcgaggaactgattcaggacatttcccgactgcagagaagatcactgcgccattccaggcagttggaggtgcctcggccatacattgctgcaagattctctgtgttaccccctacctttcaccccggagatcagaagcagtacgggggattcgacaacagaggcctggaaccagggcaccggtacgtactttttgtgctggccgtgttacagaaatccgaaccaacgtttgccgcatcaccgttttcggatcccttccagctggacaatcctgatccacagcctattgttgatggtgaagaggggttgatctgggtgatcggtccagtgttggcggtggtgtttatcatatgcatagtgatagccattctgctttacaagaataaacccgacagtaaacggaaggacagcgaaccacgcaccaaatgcttactaaataacgccgacctggctcctcaccaccccaaagatcctgttgaaatgcgccggattaattttcagacccccggtatgctatcccacccaccaatccctatagctgatatggcagagcatactgagagactgaaggccaacgactccctgaagctgagccaggaatatgagtctatcgacccaggccagcagtttacttgggaacattcgaacctggaggtcaataaacccaagaaccgatacgcaaacgtcattgcatatgatcatagtagggttatactgcagcctattgaaggaatcatgggaagcgactacataaatgccaactatgtggacggatatcgctgtcagaacgcttacatcgccacccaggggccactgcccgagacctttggagatttctggagaatggtgtgggaacaacgcagcgccaccatcgtgatgatgactagattggaggagaaatcccggattaaatgcgaccaatactggcctaatcggggcaccgagacatacgggttcatccaggttacactgcttgatacaattgagctggcaacattttgcgtgaggactttttccctccataagaatggctcctccgaaaagcgagaggtgcgtcagttccagtttaccgcatggcccgaccacggcgtccccgagtaccccactccctttctggccttcttgagacgtgtaaaaacatgcaacccccctgatgctggacccattgtagttcactgttctgctggagtgggtcgaaccggctgttttatcgtgattgatgcgatgctggagcgaattaagccggagaagacagtggatgtctacggccacgtcacactcatgaggtcccaaagaaactacatggttcaaaccgaggaccagtattcttttattcacgaggcattgctcgaggcggtcggctgcggcaacacagaagtgccagcaaggtccctttacgcatacatacaaaagcttgcacaggtcgaacctggtgaacacgtcactggaatggagttggagttcaagaggctggcaaactctaaggctcacactagtaggttcattagcgctaacttgccttgtaataaattcaaaaaccgcctagtcaatattatgccatacgagtccacccgtgtctgtctccagcccattcgtggcgtcgaggggagcgattacatcaacgcatcatttatcgatggataccgccagcagaaggcctatatcgcgacacagggacctctcgccgagaccactgaagatttctggcggatgctgtgggaaaacaatagcactatagttgtgatgctcacaaagttgcgtgaaatgggtagagaaaaatgtcaccagtattggccagcggaacggtcagcccgataccaatactttgtggtcgatcccatggcagaatataacatgccccagtacattttacgtgaattcaaagtgactgacgcccgggatggccagtccagaaccgtgagacagtttcaattcactgattggcccgagcaaggagttcctaagagcggcgagggctttatagacttcatcgggcaggtgcacaagacaaaggaacagttcggtcaggatggccctatctcagtgcactgttctgctggggtcggccggacaggtgtgttcattaccctgagcattgtgctcgaacgaatgaggtatgaaggagtggtagatattttccagactgtgaaaatgctcaggacacagcgtcctgcaatggtgcagacagaagacgaatatcagttttgctaccaggctgctttagagtacttaggatctttcgaccattacgccacttag

SEQ ID NO: 201780 - DNA, 5847 bp, Artificial Sequence
  Description of Artificial Sequence: Synthetic coding sequence
atggcccccacctggggccccggcatggtgagcgtggtgggccccatgggcctgttggtggtacttctagtggggggctgcgcagctgaggagccccctaggtttattaaggaacccaaggaccagataggagtgtcaggcggcgtggcttcttttgtgtgtcaagccacgggcgacccaaaacctcgcgtgacctggaacaagaaaggcaagaaggttaactcacaacgattcgaaacgattgagtttgacgagtcagctggcgccgtgctccgtattcagcctttgaggactccacgggacgagaatgtctacgagtgtgtggctcaaaacagtgtcggagagatcaccgtgcacgctaagcttacagtcctgagagaggaccagctgccatccggattcccaaacatcgacatgggcccacagctgaaggtggtcgaaagaaccaggacagccactatgctgtgcgctgcttcaggaaaccctgaccctgagatcacctggtttaaggatttcctgcctgtggatccttctgcctccaatggaagaattaagcagcttcgctccgatcaggctttctctcatcttccgaccggagcactccagattgaatcttccgaagaaactgaccaaggcaaatacgagtgtgttgccactaacagcgcgggggtccgatactctagtccagccaatctctatgttcgtgtgtggcggactgtgcggagagtcgcgcctcgcttttccatcctacctatgagccacgagattatgccagggggtaacgtgaacattacatgcgtcgcggtcgggagcccaatgccatacgtgaaatggatgcagggcgctgaggacctgacccctgaggacgacatgcctgtcggaaggaatgttttagaacttaccgacgtcaaggattccgccaactacacctgtgtggccatgtcatcactaggagttattgaggccgttgcccagatcactgtcaaaagcctgcccaaggccccaggcacacccatggtaacagagaatacagccacgtctattacaatcacttgggattctggtaacccagacccagtgagctattacgtcattgaatataagtccaaatcccaggacggtccctatcaaatcaaagaagacattactaccacccgctacagcattggaggcctgtctcctaattctgagtatgagatttgggtgagcgctgtgaactcaatcggtcagggccccccgtcagagtcggtagtaactcgcaccggcgagcaggcgcccgccagtgcaccccgaaatgtacaagccagaatgctaagtgctacgaccatgatagtccaatgggaagaacccgtggaaccaaatgggctgatccgggggtatagagtctattataccatggagccagaacacccagtcgggaactggcaaaagcacaatgtagacgacagcctacttactaccgtcggctctctgcttgaggacgagacttacaccgtcagagtgctggctttcacgtccgtgggggatggccctctgtcagatcccatccaagttaaaacacagcagggggtgcccgggcagccaatgaatctgcgtgccgaggcaagatccgaaacctcaattactctgtcatggtccccccctcggcaggaatctatcatcaagtacgaactgctattccgtgagggagatcacgggcgagaggtggggcgcacgttcgatcctactaccagctacgtggttgaggacctgaaaccgaatactgaatatgcatttcgtctggcagctcgctccccacaagggttgggagctttcactcctgtagtgcgacagaggacattgcaaagcaaaccttctgctcctcctcaggacgttaagtgtgtctcagtgagatccacagccattcttgtgtcttggcgaccaccgcctccagaaacacataacggcgccttggtcggctattccgttagatataggcccctcggctctgaggacccagagccaaaagaggtaaatggaattccaccaaccaccacccagattctcctggaagcccttgaaaagtggacacagtataggataactaccgtggcacacacggaagtgggtcccggacctgagagtagtccagtcgtggtaagaacggacgaggatgtgccctctgcccccccccggaaggtggaagccgaggcactcaacgctactgcaatccgagtgctgtggagatctccggcaccggggcgtcaacatggccagattcggggatatcaagtgcactatgtaaggatggaaggggctgaagctagaggtcccccccgtattaaggatgttatgttagctgacgcgcagtgggagacggatgacactgccgagtacgagatggttatcaccaacttgcagcccgaaacagcctacagtattactgtggcagcctacacaatgaagggcgacggcgcccgcagcaaacctaaggttgttgtgactaaaggcgctgttctcggccggccaacgttatcagtccagcagacgccggagggaagcttgctggctcgctgggagccgcccgcaggcacagcagaggatcaggtcctgggatacaggctccagtttggtcgagaggacagtacccctctagctacactggaatttccacctagtgaagatcgttacacagcttccggtgttcataagggagccacgtatgttttccggctagctgcgagatcccgggggggcctgggagaagaggctgccgaggtgctatctattcccgaggataccccacgggggcatccacagattctggaggctgcaggcaacgccagcgccggaaccgtgctgctaagatggctcccacccgtcccggctgaacggaatggcgccatcgttaagtacaccgtggcagtcagggaggctggggcccttggtccagctcgtgagaccgaactgccagctgcggccgagcccggagccgagaatgccctcacgctgcagggactcaagccggataccgcttacgatctacaggtaagagctcacacgaggcgcggaccaggaccattttctcctccggtgagatacagaacctttctacgtgatcaggtgagccccaaaaattttaaggttaagatgataatgaagacctctgtcttgcttagttgggaatttccggacaattacaactcacccaccccatacaagatccaatataacggactgacactggacgtggacggcagaaccacaaagaaactgattacccatcttaagccacacacattttacaactttgtactgactaaccgagggagctctctgggcgggctgcaacagacagtcaccgcgtggaccgccttcaacttgctgaacggaaagcccagtgtcgcacccaaaccagacgccgatggatttattatggtctatctccccgatggacagtcacctgtgcctgtgcagagctacttcatcgtgatggtgccactccggaagagccgcggtggacagttcttgacccctctgggtagccccgaagacatggacctcgaggaattgatacaggatatttccagactgcagcgccgatcactgagacatagcaggcagctggaagttcctcgcccttatattgcggctcgctttagcgtattgccaccaaccttccatcccggcgaccagaagcagtatggcggcttcgacaatcgtggcctggagccgggccaccgatatgtgcttttcgtgttggccgtactccaaaaaagtgaacccacattcgccgcctctcccttcagcgacccctttcaactcgacaacccggacccccagcctattgtagacggggaagagggtttaatctgggtgataggacctgtcctggctgtcgtgtttattatttgtatcgttatcgccattctgttgtataagaacaaaccagatagtaagcgaaaggatagcgagccaagaactaagtgcttattgaacaacgccgatctggccccccatcaccccaaggaccctgtggagatgagacgcatcaattttcagaccccagacagcgggctgcgctctccactacgcgaacccggtttccattttgagtcaatgctgtctcacccacctatccccatagcagatatggccgagcatacagaacgcctgaaggctaatgactcactcaaactgtcacaggagtacgagtctatagatcctggtcagcagttcacctgggagcattcaaatcttgaggtgaacaagcccaagaatcgctacgccaacgttatagcttatgatcactccagagttattttgcagccaatcgagggtatcatgggctccgattacattaatgcgaactatgtggacggatatcgatgccaaaatgcctacatcgcgacccaaggacctttaccagagacattcggtgatttctggcggatggtgtgggaacagagatctgcaaccatagtgatgatgacgcgcctggaggaaaaaagccgaataaagtgcgatcagtactggcccaatcgcgggaccgaaacatatggattcattcaggttacacttctcgatacaattgagctggccaccttctgcgttcgaaccttctcacttcataaaaacggctccagcgaaaaacgggaagttcgtcagtttcagtttacggcatggcccgaccacggtgtgccggagtatccaaccccattcctggcttttctgaggcgggtcaaaacttgcaatccacctgacgctgggcctatcgtggtgcactgttcagcaggagtcggccgaactggctgcttcatcgtcattgacgcgatgttggagcgcatcaagcctgagaaaacagtcgacgtctacgggcacgtcactctgatgcgcagccagcgaaactacatggtgcaaaccgaggatcagtattcctttatccacgaggccttactcgaggcggttggatgtgggaacacggaggtaccagcgcgaagtctgtacgcgtacattcagaaactggctcaggttgaaccaggggaacatgtgacaggaatggagctcgaatttaagcgactcgctaattctaaggcccataccagtcgtttcatcagcgcaaatctgccttgcaacaagtttaaaaatcgcctggtgaacattatgccctatgaaagcactcgggtctgcctccagccaatccgcggagtggagggatccgactacattaatgcaagcttcatcgacgggtacaggcagcagaaggcatacattgcaacgcaaggccctttggccgaaacaaccgaagatttctggagaatgctttgggaaaataactccaccattgtggtgatgcttacaaaactgcgcgaaatgggtagagaaaaatgtcaccagtactggccggcagagcgcagtgcaagatatcagtacttcgttgttgatcctatggctgaatacaacatgcctcagtacatattgcgtgaattcaaggttacggacgctagagatggtcagagtcgcactgtccggcagttccagttcactgattggcctgagcaaggcgtgcctaaatccggagagggctttattgactttatcggtcaggtgcacaagaccaaggagcagttcgggcaggatggccctattagcgtgcattgtagcgccggggtggggcgtacaggtgttttcatcaccctgtctattgtgctggagagaatgcggtatgagggagtggtggacattttccagaccgtgaaaatgttgcgtacccagcgccctgcgatggttcagacggaggatgaataccagttctgctaccaggctgccctcgagtatctgggaagtttcgaccattatgccacatag

SEQ ID NO: 201781 - DNA, 4593 bp, Artificial Sequence
  Description of Artificial Sequence: Synthetic coding sequence
atggcccccacctggggccccggcatggtgagcgtggtgggccccatgggcctgttggttgtccttctggtcgggggttgtgccgccgaggagcctccccggtttatcaaagagcccaaagaccagataggagtgagcgggggcgttgcttcgttcgtttgtcaggccacaggcgaccctaagcctcgggtgacatggaataagaagggcaagaaggtgaacagccaaaggtttgagacaatcgagttcgatgagagtgcaggcgcagttctgcggatccaaccccttcgaacacccagagacgagaatgtatacgagtgtgtggcccagaattcagttggagaaattactgtccatgcgaaactgacagtgttacgtgaggatcaactgccttccggtttcccaaacatagatatggggccacagctcaaagttgtggaaagaaccagaacggccaccatgctttgcgcagcctcaggtaacccagatccagagattacttggtttaaagatttcctccccgtggacccatcagctagcaatggccgcatcaagcaactcaggtctgatcaggccttcagccacctgcctacaggagccctgcagatcgagtcttccgaagaaaccgatcagggaaaatacgagtgcgtggccaccaattcggccggcgtacggtattcttcaccagccaatctctatgttagggtctggcgtacagtccgacgggtcgccccacgcttctctatacttcccatgagtcatgagattatgccagggggcaatgtcaacattacatgcgtagcagtgggcagccccatgccttatgtgaaatggatgcagggtgcggaagatctgacacctgaggacgatatgccagtgggcagaaatgtacttgaactaaccgacgtgaaagacagtgcaaactatacatgcgtagctatgtcttctctcggcgtcatcgaagccgtagctcagattaccgtgaagagcctccccaaggcccctggaacacccatggtgaccgaaaacaccgccacatcaattactatcacctgggactctgggaatcctgaccctgtgagctactacgtgatcgagtataaatccaagagccaggacggaccttatcagatcaaagaagatataaccactactcgttattctatcggtggcttaagcccaaattctgagtacgagatatgggtcagcgcggtcaatagcattggtcagggacccccaagcgaatcagtggtcacaagaacaggagagcaagcacccgccagcgctccgcggaatgttcaggcccggatgctctctgctactacaatgattgtgcaatgggaggaaccagtggaacccaacgggctcattcgtgggtatagagtgtattacaccatggagccagaacacccagtgggaaattggcagaagcataatgtcgacgattctttgctaactacggttggatcccttcttgaagacgaaacctacaccgttcgagttctggcgttcacctctgtcggagacgggccgctctcagaccctatccaggtcaaaacgcagcagggcgtacccggtcagcccatgaatctccgagccgaagctcgatctgagacctccatcaccctttcttggtctccacctcgccaggaaagcatcatcaaatatgagctcctgttcagagagggggatcacggacgcgaggtgggtcggaccttcgatcctacaacttcctatgttgtggaggacctcaaacctaataccgaatatgcctttcgcttggccgcaaggtcacctcagggactgggggcctttactccagtcgtgcgccagaggacactgcaatctattagccctaaaaactttaaggttaagatgatcatgaaaaccagcgtgctcctgagttgggagtttcctgacaactataactctccaactccatataaaatccagtacaacggtctgactttggacgttgatggccggactaccaaaaaacttatcacacatcttaagcctcacacattctataactttgtgctaaccaatcgaggcagctccctcggtggactccagcaaaccgttacagcttggactgcctttaatctcctcaatggcaagccaagtgtggctcctaagcccgatgctgacggctttattatggtgtacctccctgacggccaatctcctgtgcccgtgcagtcttactttatcgtgatggtgccgttgcgaaaatctagaggaggtcaattcctcacaccgctcggctcgcccgaggacatggacctggaggaactgatccaagatatcagccgactgcaacgtcgctctcttcggcactctagacaacttgaagtgccaagaccttacatagccgccagattctcggtcctaccaccgaccttccaccccggcgatcaaaagcagtacggagggtttgacaacagaggtctcgagccaggccataggtacgtcttgtttgtgcttgccgtcttacagaagagcgaacctacatttgcagcatctcctttttctgacccattccagctggataatccagacccacagccaattgtcgatggcgaggagggtctgatctgggtaatcgggcctgtgctggcagtcgtcttcatcatctgcattgtaattgcaatcctactgtataaaaacaaacccgacagcaagcgcaaagattccgagcctaggacaaaatgtctcctgaataacgccgatctggctccccatcaccccaaagacccggttgaaatgaggagaattaactttcagacccctgactcaggccttagatctcctcttagagagcccgggtttcactttgagtccatgcttagccaccccccaatccctatagcagatatggcggaacacacagaaagattgaaagcgaatgattcacttaaattgtctcaggagtacgagtcaatcgacccaggtcagcagtttacttgggagcattccaatctcgaggtcaataaacccaaaaaccgctacgcaaatgtcatagcatatgaccacagccgggtcattttgcaacctattgaggggatcatggggagcgactacattaacgccaattatgtggatgggtaccgctgtcaaaacgcttacatcgccactcagggccccttacccgaaacgttcggcgacttttggcgtatggtatgggaacagcgatctgccacgattgtcatgatgaccagactcgaggaaaagtcgagaatcaagtgtgatcagtactggccgaatcgtggtactgaaacctatgggtttatccaagtgaccttgctcgacaccatcgagttggccacattctgtgtgcgtaccttttctctccacaaaaatgggtcatcagagaaacgggaagtaagacagtttcaattcacagcatggccagatcatggcgtccctgagtaccccacgcctttcctggcattcctaagacgagtcaagacctgcaaccctcctgatgccggcccaattgtggtccattgcagtgcgggagtgggcaggacaggctgttttatagtgattgacgcgatgctggagcggattaagccagaaaaaactgtagacgtgtatggacatgtaaccctgatgcgctcccagcgcaattatatggtgcagaccgaggaccagtactccttcattcatgaggccttgctggaggcagttggctgtggaaataccgaggtgccggcgagatctttgtacgcctacattcaaaagctcgctcaagttgaaccaggcgaacacgttaccggtatggagctcgagtttaaaaggctcgccaattccaaggcccatacctcccggtttatctcagccaatctaccatgcaacaagttcaagaaccgcctggtgaacattatgccttatgaatctacccgagtctgcctccaacctattaggggcgtggagggttctgattatatcaacgcgagctttatcgacggctaccgacaacaaaaagcctatatagctacgcagggacctctcgccgaaacaaccgaggacttctggcggatgctatgggagaacaattccacaatcgtggtcatgctgaccaagctccgggagatgggtagagagaagtgccaccaatattggcccgctgagcggtccgcgcgctaccagtatttcgtggttgacccaatggctgagtacaacatgccgcaatatatattgcgagaatttaaggttactgacgctcgagatggccaatctcggactgtgcgacagttccagtttaccgactggccagaacagggcgtgcccaagagcggagagggcttcatcgatttcatcggccaggtgcacaagacaaaagaacagttcgggcaagacggccccatctccgtccactgttccgctggcgtgggtagaacgggggtgtttataactttgtctattgtcttggagaggatgcgatacgaaggggttgtggacatcttccagaccgttaagatgctgcgtactcagaggcccgccatggtgcagactgaagacgagtaccaattctgttaccaggctgccctggaatacctcggcagctttgaccactatgccacgtag

SEQ ID NO: 201782 - DNA, 5820 bp, Artificial Sequence
  Description of Artificial Sequence: Synthetic coding sequence
atggcccccacctggggccccggcatggtgagcgtggtgggccccatgggtctccttgttgtgttgttggttggcggctgtgccgccgaagagccacctcgtttcattaaggaaccaaaagatcaaatcggtgtatcaggcggtgtggcatcgttcgtctgccaagccactggtgacccgaagccacgggtcacatggaacaagaagggcaaaaaggtcaatagtcaaagatttgagacgatagaattcgatgagtctgccggcgcagtgcttcgaatacagcctttgcggacgccgagagacgaaaatgtgtatgaatgcgttgctcaaaactccgtgggcgagataacagtccatgccaagctgacagtgctccgcgaggatcagctgccatctggctttccaaacatcgacatgggacctcaactgaaagtggttgaacgcactcgaacagctaccatgctgtgtgccgcctctggcaaccctgatcccgagattacttggttcaaggatttcctcccagtggacccatcggcttccaacgggcgcatcaaacaactccggtcggatcaggcctttagtcacttacccacaggggcattgcagatcgaatctagcgaagagaccgatcaaggaaagtacgaatgcgtcgcaactaactcagccggtgtgaggtacagttcaccagccaacctgtacgtgcgggtttggcgcaccgtgagacgtgtggccccacggttttccatcctccctatgtctcatgagataatgccaggaggtaacgtaaacataacgtgtgttgccgtaggttctcccatgccctatgttaagtggatgcaaggcgctgaagaccttacgccggaggatgatatgccggttggtcgcaatgtgctagaactgaccgatgtgaaggattccgcgaactacacttgtgtcgccatgagcagtttgggcgtgatcgaggccgtggcccagatcactgtaaaatctctgcctaaagcccccggcactcctatggtgactgaaaacaccgcaacatctattaccatcacctgggactccggcaaccccgatcctgtgagctattacgtgattgaatacaaatctaaatcacaggacggcccataccaaattaaagaggacatcaccacaacgcggtactcaatcggcggcctttcacctaacagtgagtatgagatttgggtcagcgctgtgaattcaataggccagggtcctcctagtgaatctgttgtgactagaactggagagcaggctccagcttccgcacccaggaatgtccaggccaggatgctctccgccactaccatgattgtacagtgggaagaaccggtggaaccaaatggcctgatccgcggatacagagtttattatactatggagccagaacatcccgtcggtaattggcagaaacataacgtagacgactccttgctcacaacagtgggcagcttgctggaagatgagacatacactgtgcgagtgctcgcatttaccagcgtcggagatggacctctaagcgatccaatacaggtgaagacacagcagggcgtacctggccaaccgatgaacctgcgggcagaagcacgctcagaaacctcaatcaccctgtcatggtcccctccgcggcaggaatctatcattaagtatgaactgctcttcagggaaggcgaccatggcagagaagtagggaggacgtttgatccaaccacctcctacgtcgttgaggacctcaagcccaatacagaatatgccttcaggctggcggccagatcaccacaaggtctgggcgccttcactccagtggtccggcaacgcacgcttcagtctaaaccatctgctcctcctcaggacgttaaatgtgtgtccgtccggagcacagctatcttagtatcatggagaccacccccacctgagacccacaacggcgctcttgtgggctactccgtaaggtacagaccactgggtagtgaggatcccgaacccaaagaagtgaatggcattccccccacaactactcagattttactcgaggcccttgaaaagtggacacagtaccggattactaccgtggctcatacagaggtgggcccaggaccagagagttctccagtagttgtgcgtaccgacgaggatgtgccttcggcaccacctcggaaggttgaagctgaggctctgaatgcaacagccattagggtgctgtggcggagccctgctcctgggcggcaacatggacagataagggggtatcaagtgcattacgttcgcatggagggggccgaagcacggggaccaccccggattaaagacgtcatgctcgcagatgcacaagaaatggtgatcaccaatctgcagcccgaaaccgcttactccattaccgtcgcagcctacacaatgaagggtgatggcgctagatctaagccaaaggtcgtcgtgactaaaggcgcagtgctgggacgcccgacgctctccgtccagcagacacctgaaggtagcctgcttgcccgctgggagcccccagctggcaccgctgaggaccaagtcctgggctaccgactgcagtttgggcgggaagactccactcccttagccaccctcgagtttcctcccagcgaggaccgctacacagcctctggtgtgcataagggggctacgtacgtgttccgactggccgcccggtcacggggcggtctcggcgaggaggcagccgaagtcttatccattccagaggacacgccccgggggcatcctcaaattctggaggctgccggcaacgcttccgcaggaaccgtcctgctcaggtggctaccccccgtaccagctgagcggaatggcgctatagtcaaatacaccgttgctgttcgtgaagccggcgctctcggccctgcgcgtgaaactgagctgcccgccgccgccgagcccggcgcagagaacgccttgaccctccagggactaaaacccgacacagcgtacgatctgcaggtcagagctcacactcggcgggggccaggccctttcagcccccctgtacggtaccgtacatttttgagagaccaggtgtctcccaagaatttcaaagtgaagatgatcatgaagacttcagtgctgctttcctgggagtttccagataattataactcgcccaccccatacaaaattcagtacaatggactcaccctcgatgtggacggccgcacaaccaagaagctcattacccatctgaagccccacactttctacaatttcgtcctgacgaatcggggttcctcattaggcggcttacagcaaactgtcacagcctggactgcatttaatttgctgaatggaaaaccgagcgttgctcccaagcctgacgccgacgggtttataatggtctacctgccagacggacagtcaccagtccctgtgcagagctacttcatcgtcatggttcctttacggaaaagcaggggagggcagttcctcacacctttggggagccccgaggatatggacctggaggaactcatccaggacatttccagactacagcgcagatctctccgccactcaaggcagcttgaagtgcctaggccttatatagccgcgaggtttagtgtgctgccacctactttccacccgggggaccaaaaacagtacggtgggttcgacaacagggggctggaaccaggccataggtacgtgctctttgtcctggctgttctgcaaaaatcagaacctacatttgcagcttccccattttcagatccatttcagctggacaacccagatccacaaccaatcgtcgacggagaggaagggctgatctgggtgattggtcccgtgctggccgtggtgtttatcatatgcatcgtaatcgctatactactttataagaacaaaccggattcaaaacgtaaggatagcgagccccgaaccaaatgcctgcttaacaatgccgatctggcaccccatcatcccaaggatcctgttgaaatgcggaggatcaacttccagacaccagactctgggctgcgatcacctctgagagaacctggtttccatttcgagtctatgctgtctcatccgcctattcccatcgccgatatggccgaacacaccgaacgactaaaggcgaacgattcactgaaattgtcccaggaatatgaaagtatcgatccgggccagcagttcacgtgggagcattctaatctggaggtcaacaaaccaaaaaacagatacgcaaatgtgatagcctacgatcattcccgagtcattctgcagccaatcgagggtatcatggggagcgactatattaatgcaaactatgtagacggctatagatgtcaaaacgcatatatcgctactcaggggccattgcccgaaacctttggcgacttttggaggatggtttgggaacagagaagcgctacaattgtaatgatgacccgacttgaggagaaaagtcggatcaagtgtgaccaatactggccaaatcgcggtaccgaaacatacggcttcattcaggtcaccttacttgacaccatcgagttagctacattttgtgtgcggactttctccctgcataagaacggcagttcagagaaacgcgaggtgcgccagttccagttcacagcatggcccgaccacggcgtaccagaatatcctaccccgttcttagcattcttaagacgggttaaaacttgtaatccacccgacgccggacctatcgttgtacactgctccgcaggcgtgggcaggaccgggtgctttattgtgatagacgccatgctagaaaggatcaaacctgagaaaactgttgatgtgtatggccatgttacactcatgagaagccaaagaaactatatggtccagactgaggaccagtattcctttattcacgaggccctgctcgaggccgtaggatgtggaaataccgaggtccctgcccgcagcttgtacgcctacatacagaagctcgcacaggttgaaccgggtgaacacgtcactggaatggagctggagttcaaaaggttagcaaattcaaaagcccacacaagccggttcatatctgctaacctgccttgcaataaattcaagaaccgattagtcaatattatgccatacgaaagcaccagagtgtgcctgcagccaataaggggggtggaaggctcagactatatcaatgcttcttttattgatggttaccggcaacagaaagcctacatagccacccaggggcctctcgctgaaactactgaagacttttggcggatgctgtgggagaataatagcacaatcgttgtgatgctgaccaaactgcgtgagatggggcgtgagaaatgccaccaatactggccagctgagaggtctgcacggtaccagtacttcgttgttgatcccatggcggaatataacatgccccaatacattctaagggaatttaaagtgaccgacgcaagggatggccaatccagaacagtccgccagtttcaattcacagattggcccgaacagggggttcctaaaagcggagagggatttatcgattttattggccaagtgcacaagaccaaggagcagttcggtcaggacggacctatcagcgtccactgcagcgctggggtgggcagaactggtgtattcataactctgtctatcgtacttgagagaatgcgatacgaaggcgtcgtggacatattccagacagtgaagatgctgcgcacacagaggcctgctatggtccagacagaagacgagtaccaattttgctatcaggctgcactggagtatctcggctcgtttgaccattatgctacctag

SEQ ID NO: 201783 - DNA, 5847 bp, Artificial Sequence
  Description of Artificial Sequence: Synthetic coding sequence
atggcccccacctggggccccggcatggtgagcgtggtgggccccatggggcttctggttgtgttgctcgtcggcggctgtgccgctgaagagccgccccgctttatcaaagagcccaaggatcagatcggagtgagcgggggtgtggcgtctttcgtttgtcaggccactggggacccaaagccaagagttacatggaacaaaaagggtaagaaggtgaactctcagcgcttcgagacgatcgaattcgatgagagcgccggtgcagtgctgagaattcagccccttagaacgcccagagatgagaatgtttatgaatgcgtggcccagaacagtgttggcgaaattaccgtgcatgcaaaactcactgtgctgagggaggatcagctgccatctggattcccaaacattgacatggggccacagctgaaggtcgtagaacggaccagaaccgccactatgctttgcgcagcaagcggcaatccagaccccgagataacatggtttaaagatttcttacctgtggatcccagtgccagtaacggccgaatcaaacagctgcgatcagaaacgttcgagtcaacaccaattcggggcgcactgcaaatagagagctctgaagagacagatcaggggaagtacgaatgcgtggccaccaactccgccggcgtgaggtatagtagtcccgccaacctatatgtacgggagctccgagaggtaagaagggttgccccgaggtttagtatccttcctatgagtcatgagatcatgcctgggggcaatgttaatataacttgcgtggcagtgggcagtcctatgccatatgtcaaatggatgcaaggggctgaggacctgacgcccgaggacgacatgcctgtcggccgaaacgtgttagaactgactgacgttaaagattctgctaactatacttgcgttgccatgtctagtctcggggtaatcgaggcagtggcacagattacagtgaagtcactgcccaaagcaccggggacgcccatggtgacagagaacacagcaacgtccattaccattacatgggactccggcaacccggatcctgtgtcatactacgtaatcgagtacaagagtaagagtcaggacgggccctaccagatcaaagaggacattactaccactagatactcaatcggggggctctcccccaactcagaatacgagatttgggttagcgcagtgaactccattggccagggtccgccatctgaatctgtggtcactaggacaggcgagcaggccccagcatccgcacctaggaacgtccaagcacggatgctctcagcaaccaccatgatcgtgcaatgggaggaacccgtcgaacccaatgggttaatcagaggataccgcgtctattatacaatggaaccagaacatcctgtcggcaactggcagaaacacaacgtggatgacagtttgctgactaccgtgggatccttgctcgaggatgaaacctatactgttagggttttggcttttacgagtgtcggcgatggccccctgagcgatcccatacaggtcaaaacccaacagggcgtgccagggcaaccaatgaacttgcgggccgaggcccgcagcgagacgtccatcactctctcttggtcaccacctcgacaggagtcaattattaaatacgagctactgtttagggaaggagaccacggcagggaggtgggtcgcaccttcgaccctaccacgtcttatgtggtggaggatctgaagccgaatacagaatacgccttcaggctggcagctagatctccgcagggcctcggtgcttttacccccgtggttcgccaaagaactttgcagtctaagccatccgccccgcctcaggacgtgaaatgcgtgagtgtgaggtccacagcaatcctagtgtcctggcgccctcctccacccgaaacccataacggcgcacttgtgggctactcagtccgctaccgccccttgggaagcgaggatcctgaaccgaaggaagtgaacggtattccaccaaccacgacccagatacttcttgaggctctggagaagtggacgcagtataggataacaactgtcgcacatactgaggtgggtccaggacctgagtcctcacccgtagttgtacgcacagatgaagacgtgccctccgctccccctaggaaggtggaggccgaagctcttaacgccaccgccatacgggtgctgtggaggtcccctgccccagggcgccagcacgggcagataagggggtaccaggtccactacgtgcgaatggaaggtgccgaggcccgcggtccacctcggatcaaggacgtgatgctcgcagatgcccagtgggagactgacgatacggcagaatacgagatggttatcaccaatctacagccagaaactgcatattccatcactgttgctgcctataccatgaaaggggatggggccaggtccaagccgaaggtggttgtgaccaaaggagccgtgctgggacggcccacactgagtgtgcagcagacgcctgaagggtccctgctcgcaagatgggagcctccagctggtactgctgaggatcaagtgcttggctaccggctccagttcggccgggaagactctacgcccctcgcgacactagagtttcctccctcggaggacaggtatactgcttcaggagtgcacaagggggcaacatatgtctttaggctcgccgctcgcagccgtggcggcttgggagaggaggctgctgaggtactttcaatccccgaagacactccaagaggtcacccacagattctcgaagccgctggcaatgcctcagcgggtactgtgcttttgcggtggttgccaccggttcccgccgaaaggaacggagcaattgttaagtatactgtcgctgtgagagaagcgggtgcgctgggtccggcccgggaaaccgaattacctgccgcagccgagccgggtgccgaaaacgcattaacactccaaggacttaagcctgacactgcgtacgatctccaggtgagagcccatacccgcagaggccccggccctttctcacctcctgtgagatatagaacattcctgcgagaccaggtcagtcccaagaacttcaaggtgaaaatgataatgaaaacgagtgttctcctctcctgggagttccctgacaattataatagcccgaccccatataaaattcagtacaatggactgacccttgacgtggacggccgcaccaccaagaaattgattacccacttgaaaccccataccttctataacttcgtcttgaccaaccgcggcagttctctaggcggactccagcagactgtcaccgcctggacagcatttaaccttctcaacggaaaaccaagcgtagcaccaaaaccagacgccgacgggtttatcatggtttacctgcccgatggacaatctccagttccagtgcagagctactttatcgtgatggtcccgttacgaaagagcagaggaggacaattcctgaccccactcggctcgcctgaagacatggatttggaagaactgattcaggatatttctcgtctgcagaggcgcagtcttcgtcacagccgtcagcttgaggtgcctcgcccctacattgccgctcggttttccgtgctgccacccacattccaccccggcgatcaaaagcaatacggggggttcgacaacaggggcctagaacccggtcacagatacgtgctctttgtactcgccgttttacagaaatccgagccaacattcgccgcaagcccattttctgatccattccagctagacaatcctgaccctcagcctatcgtagatggcgaggagggcctaatctgggttatcggaccagtgttggcagtggtgttcattatctgcatcgtcattgctatactgctctataaaaataaacctgattctaaacgcaaagactctgagccaagaacaaagtgcttactcaacaacgctgacctagctccccaccatcctaaagacccggtcgaaatgagacggattaatttccagactccagactctggactgcggagccctctgcgtgagcctggctttcactttgagagcatgctatcacatccgcctataccgatcgccgatatggctgagcataccgaaaggcttaaggccaatgactccctaaaactctctcaggagtatgaatctatcgaccctggacagcagtttacttgggagcactcgaacttagaagttaataagcctaagaacaggtacgcaaacgttattgcctacgatcacagccgggtgattctccagcctatcgaggggatcatggggtccgattacatcaacgcaaattacgttgacgggtacaggtgtcagaatgcctacatcgccactcagggacccctgcctgaaacattcggtgacttctggcgaatggtgtgggagcagaggagcgctaccatagtgatgatgacgcgactggaggaaaaaagtcggatcaagtgcgaccagtattggcctaacagaggaaccgagacttacggattcatccaagtcaccctactggatacgattgagctggccaccttttgtgttcgcacattctctctgcacaaaaatggctccagtgaaaagcgcgaagttagacagttccagtttaccgcctggccagatcatggtgtgcccgaatacccaaccccgtttctggctttcttgaggagagtgaagacatgcaacccacctgatgcggggcccatcgtggttcactgttccgcaggcgtgggcagaactggctgtttcatcgttatagacgctatgttggaaagaatcaaacctgaaaagacggtggatgtgtatggccacgtaacgcttatgagatctcagaggaactatatggtacagaccgaggatcagtacagtttcattcacgaagctctattggaagcagtcggctgcggcaatacagaagtgcccgccagatctctctatgcatacatacaaaagcttgcacaggtggagccaggcgaacatgtgactggcatggagttagagttcaagcgcttggcgaactccaaagctcacacgagcaggtttatttcagccaacctgccttgcaacaaattcaagaaccgcctggtaaacattatgccatatgaatccaccagagtatgcctgcagcccatacgcggagtagagggctcagactatatcaacgctagctttatcgacggataccggcagcagaaagcctatatagccacgcagggtccattagcagagaccaccgaggatttttggagaatgctctgggagaacaatagtaccatcgtggtgatgcttactaaacttcgggagatgggtcgcgaaaagtgccatcaatattggcccgccgaacgctcagcaagataccaatatttcgtggtcgacccaatggcagagtacaacatgccacaatacatcttaagagagttcaaggttactgatgcccgtgacgggcaaagcagaacagtccggcagttccagtttacagactggcctgaacagggtgtgccaaagtcaggagagggctttatcgacttcattggacaggtgcataaaacaaaggaacagtttggccaagacggtcccatttctgttcattgctcagccggagttggacgtacgggcgtcttcataaccctatccatagtgcttgagcgcatgagatacgagggtgtggtagacattttccagactgttaaaatgctgcgcacccagcgccccgccatggtgcagactgaggacgagtaccaattctgttaccaggctgccctggagtacttaggctcatttgaccactatgctacctag

SEQ ID NO: 201784 - DNA, 5850 bp, Artificial Sequence
  Description of Artificial Sequence: Synthetic coding sequence
atggcccccacctggggccccggcatggtgagcgtggtgggccccatgggactgctggttgtcctcctagttggcggctgtgcggccgaggaaccgcccagatttatcaaagaacccaaagatcaaattggagtgagtggtggcgtggcgtcctttgtctgccaggctaccggagatcctaagcccagagtcacgtggaacaagaaaggcaaaaaagtaaattctcagcggttcgagacaattgaatttgacgaaagcgctggcgccgtcttgcggatccagccgcttcggaccccaagagatgaaaacgtctatgaatgcgtagcacagaactcagtgggagagatcaccgtccatgctaaattgacggtgcttcgagaggatcaactgccaagcggattccccaacattgatatgggcccccagcttaaagtcgtggaaaggacaaggacagccactatgttgtgcgccgcaagcgggaatcctgatccagagatcacctggttcaaagattttctgccagtcgatccctctgcgagcaacggtagaatcaaacaactccgacgtagcgaaacctttgaatcaacgcctattcgcggcgccctgcagattgaatccagtgaggagactgaccaaggtaaatatgagtgtgttgctaccaactccgctggggtgcgctatagctctcccgcgaacctatacgtcagggagctccgcgaagtcagaagggtggccccgcgattctcaatattgcccatgagtcatgagattatgcctggaggaaacgtcaacatcacctgcgtcgccgttgggtctccaatgccatatgtgaagtggatgcaaggggccgaggatttaaccccagaagacgatatgccagtcggcaggaatgtcctcgaattgaccgatgtgaaggatagcgccaactatacttgcgtcgctatgagctctctcggggtgatcgaagcagttgcccagatcacggtgaagagcctcccgaaggcccccggaactcctatggtcacggaaaacacagcaacttctataaccattacttgggattcaggcaacccggaccccgtcagctactacgttattgagtacaaatcaaagtctcaggatggtccataccagattaaagaagatattactactacgcgatactccatcggggggcttagcccaaactcagagtacgagatctgggtgagcgccgtgaattcaattggacaggggccaccctctgaatcagtcgtgacaagaacaggcgaacaggctccggcttccgccccccgcaacgtacaggcccggatgctcagcgcaactacaatgatagtgcagtgggaagagcccgtagaaccgaatggccttattcgaggctaccgagtgtattacactatggaaccagagcaccctgttggaaattggcaaaagcacaatgttgacgatagcttgctgactactgtgggctcattgctggaggacgaaacatatacggtacgggtgctggcatttacgtcggtgggagatgggcctctgtcagaccccatacaggtcaaaacccagcaaggcgtgccaggccagcccatgaaccttcgggcagaagccaggtctgagacctctataactctgtcctggtctcctcctcggcaagaatcaatcatcaagtacgagctgttatttcgcgaaggtgaccacggaagagaagtcggacgtacatttgatcccaccacctcttatgtggttgaggacttgaagcccaacaccgagtacgccttccgactggctgccagaagcccacaagggctgggggccttcactccggtcgtgcgacagcgcacccttcagtctaagccgagtgcaccgcctcaagatgtcaagtgcgtttctgtgaggtccactgctatactcgtgtcttggcggcccccccctcccgagactcacaacggcgctctggtcggctactcagtaaggtacaggcctttgggatctgaggatcccgagccaaaagaagtgaacgggatcccacccactacaactcagatcttgcttgaggcactcgagaaatggacccagtacagaatcaccacagtggcccatactgaggtcgggcctggtcccgaatcatcaccggtggtagtaagaaccgatgaagacgtgccttctgcaccccctcgaaaggtagaggcagaggccctgaacgccacagccattagggttctttggaggagcccagcccccggcaggcagcatggccagatcagaggctaccaggtacactatgttcgcatggagggggcggaggcaaggggcccaccccggataaaagacgtgatgctcgcagacgcacagtgggaaacagatgacacggcagaatacgagatggtgatcaccaacctacaacccgaaactgcctactccatcaccgtggccgcatacaccatgaagggtgatggagctcggtctaaacctaaggtcgtggtgactaagggggccgtgctgggccggcctacgctatccgttcaacaaacaccagagggaagtctgcttgccaggtgggaacccccagcaggaacagcggaggatcaagttctgggctatcgactgcagttcggccgagaagattccacccccctggcaacacttgaatttcctccctcagaagatcgttacacagcatctggtgtgcacaagggcgccacatacgtcttccggctggcggctagaagtcggggcgggcttggggaagaagcagccgaagtattaagtatacccgaggacacacctcgcggacatcctcagattctggaggcagccgggaacgcgtctgccggcaccgttctcctccggtggttaccacccgtgcctgctgagcggaatggagctatcgtgaaatacacagtggcggtgagggaggcgggagctctagggccagctagagagaccgagctcccagcagctgctgagcccggggctgaaaacgcactcactctgcagggactgaaaccggatacagcatacgacctacaagtgcgcgcacacacgaggcgagggcctgggcccttcagtccccccgtgcgttatcgaacattcttgcgggatcaagtttcccccaaaaactttaaagtgaaaatgatcatgaagacatcagtcctgctgagctgggaatttcccgataattataactccccgactccttataagattcagtataacggtctgacattggacgtggatggtcggaccaccaagaaactgatcacacacctgaaacctcacacgttttataatttcgtgttaacgaaccgtggctcttccctgggcgggctgcagcagacagtgacagcgtggacggcctttaatctcctgaacggtaagccttcggtggcccccaagcccgacgcagacggtttcatcatggtgtatttgcctgacgggcaatctcccgtcccagttcagtcttacttcattgttatggtgcccctcagaaaatctagaggaggccagtttctcacacccctgggttcccctgaggatatggatcttgaggagctaattcaagatatcagccgcctccagcgccgatcccttagacattcgagacaattagaagtgcccagaccatatatcgccgccagatttagtgtgcttccacccacattccacccaggggaccaaaaacagtatggcgggttcgacaaccgaggactggagcctggacacaggtatgtgcttttcgtactcgccgtgcttcagaagagtgagcccactttcgcagcctcacccttttctgacccgttccagcttgataaccctgacccgcagccaatcgtcgacggcgaggagggcctgatatgggttattgggccagtcctcgccgtcgtttttattatctgcatcgtaattgctattctcctttacaaaaagaagcctcatagcaagagaaaagactccgaaccccgcaccaagtgtctcctgaacaatgcggacctggcgcctcaccacccaaaagatccagttgagatgaggaggattaattttcaaacccccgattcagggctgcgctcacctctgagagagcctggatttcactttgagtctatgttgagccaccccccaatccccatcgccgacatggctgagcacacagagcggctcaaagccaacgattcccttaagttgagtcaggagtatgagtcaatcgaccctgggcaacaattcacttgggagcactccaacctggaggtaaataagcccaagaaccgttacgctaatgttattgcatacgatcattcacgcgtgatcttgcaaccaatcgaagggattatgggctctgattacattaacgcaaactacgtggacgggtacaggtgccagaatgcatatatagccactcagggccccctgcccgaaacattcggcgatttctggagaatggtgtgggagcaaagatcagctaccattgtcatgatgacccgtctggaagaaaaatcgcgcatcaaatgcgatcaatattggcccaataggggtacagagacttatggtttcatccaggtgacgttattggatactatagaacttgcaaccttttgtgtccgcacattttcattacataaaaatggcagtagtgagaagcgggaggttcgacagtttcagttcacagcttggcctgatcacggggtcccggaataccccacaccctttcttgcttttttgcgacgtgtgaagacctgcaacccaccggatgctggcccaatcgtggttcactgctccgcaggcgtaggacgcacagggtgctttattgtaatcgatgccatgctagaaagaatcaagccagaaaagactgtagacgtatatggccatgtcacactgatgagatcacaacggaactatatggtgcagacagaagatcagtactcattcatacacgaagcattattagaggctgtgggctgcggcaacacagaggtcccggcacgctcattgtacgcctacatccagaaactggcgcaagtggaacctggggagcacgtaacggggatggaattagagttcaagaggctcgccaattctaaagctcacaccagccgcttcatatctgcgaacctgccctgtaacaagttcaagaaccgccttgtgaacataatgccatatgaaagcacccgggtgtgcctgcagccaattcggggagtcgagggcagcgattacatcaacgcctctttcattgacggctacagacaacagaaggcctatatcgcaacacaaggccctctcgccgagacgaccgaggatttctggcggatgctttgggagaacaactccacaatcgtggttatgttaactaaactgcgtgagatgggacgtgaaaaatgccatcaatactggcctgctgagcgctccgctcgctatcaatatttcgtggttgaccctatggcagagtacaatatgccgcagtatatcctgcgcgaattcaaggtaaccgacgcacgggatgggcagagcagaaccgttcgacagtttcaattcacagactggccagagcaaggcgtgcctaagtccggtgaaggatttatagatttcatcggccaagttcataaaacgaaggaacaatttggacaggacggcccaatctccgtgcattgtagtgcgggggttggtcgcacgggtgtgtttatcaccttaagtatcgtcctcgagcgcatgaggtacgaaggggtagtggacatttttcagactgtgaagatgctgaggacccagcggccagccatggtccaaaccgaggatgagtaccagttctgctatcaggctgcattagagtacctcggctcctttgaccactacgcaacttag

SEQ ID NO: 201785 - DNA, 4683 bp, Artificial Sequence
  Description of Artificial Sequence: Synthetic coding sequence
cggagcgcccggggcctgagcgtgcgggaccggggcgccatccccttgcaagggggggaccgaagatcccttcccagtatggccccgacctggggtccgggtatggtgagtgtggtaggtcccatgggtctgttggtggtgcttcttgtcggcgggtgcgctgcggaagagcccccgaggtttattaaggagccgaaggaccagataggggtgtcgggaggagtcgcttcttttgtgtgccaagccacaggcgaccctaagccccgagtgacctggaataagaaggggaaaaaggtcaatagccagagattcgagaccatcgaatttgatgagtctgcaggagctgtcctccgcattcagcctcttcgcacgccccgagacgagaacgtttatgagtgcgtcgcacaaaactccgtcggtgaaataactgtccacgccaagctcacagtcctcagagaagaccagctcccaagcgggtttccaaatattgatatgggcccccagctgaaggtcgtcgaacgtacgcgaaccgctacaatgctgtgcgctgcctcaggcaatccggatccagaaatcacctggtttaaagattttctccctgttgatccatctgcttctaatggccgaattaaacagcttcggagcggagctttgcagatcgagagctccgaggaaaccgatcagggaaaatatgaatgtgtcgccacaaattctgcgggcgttaggtattctagccctgcaaatctgtacgtgcgcgtgcgacgtgtagcgccaagatttagcatcctacccatgtctcacgagatcatgcccggcgggaacgtcaacattacctgcgtggcggtcgggtccccgatgccctacgtaaaatggatgcaaggggctgaagatctaacacctgaggatgatatgccagtcggccgtaatgttcttgaactgaccgacgtcaaagatagtgccaattatacttgcgtggccatgagctcactcggcgtcatcgaggccgtcgctcagattacggtgaagagcttaccaaaggctcctggtacacctatggtgacagaaaacaccgctacttcaatcaccataacttgggacagcggcaaccctgatcccgtgagttactatgtcattgagtacaagagcaagtctcaggatggaccttaccagattaaggaggacattaccaccacacgatattcaataggcgggctttctcccaactccgagtacgagatatgggtgtctgccgtgaactccattggccaggggcctccatctgaaagtgttgttactaggaccggagagcaggcgccagcctctgcccccaggaacgtgcaggcgagaatgctgagtgctacaacgatgattgttcaatgggaggagcccgtcgaacctaatggacttatcagagggtatagagtctattatactatggagccagagcacccagtgggcaactggcagaagcataatgttgatgatagcctacttaccacagtggggtctctccttgaggacgagacatataccgtgagagttctggctttcacgtcagtaggcgatgggccattgtctgaccccatacaggtgaaaacacagcagggtgtccctggccagccaatgaacctccgggccgaagcaaggtccgaaaccagcattacactcagctggagccccccgagacaggaatctattatcaagtatgaactgctttttcgcgagggagaccacggtcgggaggtgggaaggacattcgatccaactaccagctatgtggttgaggacctcaagcccaacaccgaatatgccttcaggctcgcagcacgttcgccccagggcctgggcgcgttcacaccggtggtcagacaaagaaccctgcaatccatcagtcccaaaaactttaaagtcaaaatgatcatgaagaccagtgtgttactgagctgggaattccccgataattacaactctcctacaccgtataagattcagtacaacggcttaacactcgacgtagatggcaggaccactaaaaagctgattacacacctcaaacctcatactttctataactttgtactgactaatcggggctcctcactcggaggtctacaacagacagtgacagcgtggactgcttttaacctcttgaacggaaaacctagcgtggctccaaagccggacgctgatggattcataatggtgtaccttcccgatggacaaagcccagtccccgtacagtcatattttatagtgatggtgcctctcagaaagagcagagggggacaattccttaccccccttggtagtccggaggatatggatctcgaggaacttatccaggatatctcccgcctccagcgcaggagcctccgccactccaggcagctggaggtgccgcgaccttatatcgctgccagatttagtgtattgccaccaacttttcatcccggcgatcagaaacagtatgggggtttcgataacagggggctcgagccaggccatcggtatgtgttgttcgttctggccgtcctccaaaagtctgagcctactttcgcagcaagtcctttctctgatccattccagctggacaatcctgatccacagcccatcgttgatggcgaggaaggactcatctgggtcattgggcctgtgctggctgtggtcttcattatttgtattgttatagcgatattgttgtacaagaataaaccagattcgaaacgcaaagactctgaacctcggacaaagtgtctgctgaataatgcagatctggccccacaccacccaaaggacccagtcgaaatgagaagaatcaacttccaaactcccgatagcggcctgcggtcgccgctgagagagcccgggtttcatttcgagtccatgctcagtcacccccctatccctatcgctgatatggccgagcataccgaaagactcaaggctaacgatagcctcaaattgtcccaagaatacgagtctatagaccctggccagcagttcacctgggaacacagcaaccttgaggtaaacaagcccaagaatagatatgccaatgtcattgcttatgatcactctagggtgatcttgcagcctattgagggtatcatggggagcgattatattaatgcaaattatgttgacggatatcgttgtcagaatgcgtatatcgccacacaggggcctttacctgaaacgtttggcgatttttggcgcatggtctgggagcagcgctcagctaccattgtgatgatgaccagattggaagagaagtcacgaatcaaatgtgatcaatattggccaaaccgaggcacagagacctatgggtttatccaagtcaccctcctggacaccattgaactggcaacgttctgcgtgcggacattcagcctgcataaaaacggctccagcgagaagcgtgaggtacgccagtttcagtttacagcatggcctgatcacggagtacctgagtatcccacgccatttcttgcctttctgcgacgggtaaagacgtgtaatccaccggacgcagggcctatagtggttcactgctctgccggtgtgggtcgaactggctgttttatcgtaattgatgccatgctggagcgtatcaaacctgagaagaccgtcgatgtgtacggccatgtgactctgatgaggagtcagagaaattacatggtgcagacagaagaccagtattctttcatccatgaggccctacttgaagcagtcggatgcggcaataccgaagtccccgctcggtcgctctacgcctacattcagaagctggcccaggtggaacccggtgagcacgtcactggcatggaactggagtttaaacggctcgccaatagcaaagcccatacaagccgttttatttctgcgaatctaccttgcaataagttcaagaataggctggtcaatattatgccatatgagtccacccgggtgtgcctgcaacccataaggggcgttgagggcagcgattacatcaatgcaagtttcattgatggctatcgtcagcagaaagcttacatcgctacacagggtcctctggctgaaacgaccgaggacttctggaggatgctgtgggagaacaattccacaatagtggttatgctcacaaaattgcgcgagatgggcagggagaagtgccaccagtactggcccgctgaaagaagtgcgcgctatcagtactttgtggtggaccccatggccgagtataacatgcctcagtatatcttgagagagttcaaagtgaccgacgcacgggatggtcagtccaggactgtgagacagttccaattcacagattggcctgaacagggagtgcctaagagtggggagggatttatcgactttataggtcaagtacacaaaactaaagagcagtttggtcaggatgggcccatctcagtgcattgctcagcgggggtgggacgcaccggggtgtttatcaccctgtccatcgtgctggagaggatgcggtatgagggggtagtagacattttccagactgttaagatgctcagaacccagcgcccagcgatggtccagaccgaaaccgagtcaagaccaggctggagtgctgtggcccaatccagactgactgccagtagtgcatcttggattcacgccatcctacttccccaacctccagaatggctgggcctccaggtgtag

SEQ ID NO: 201786 - DNA, 4518 bp, Artificial Sequence
  Description of Artificial Sequence: Synthetic coding sequence
atggcccccacctggggccccggcatggtgagcgtggtgggccccatggggctcctagtggtcttactggtagggggatgcgcagctgaggaacccccgaggtttataaaggagccaaaagaccagatcggcgtgagcggaggcgtagcaagcttcgtttgtcaggcaaccggcgaccctaagccacgagtgacctggaataaaaagggtaagaaggtgaatagtcagcgctttgagacgatcgaattcgatgaaagcgccggcgcggtgcttaggattcagccgctaagaacacccagagatgagaacgtctatgaatgtgttgctcagaatagtgtcggcgaaatcactgtgcacgccaagttaaccgtgttacgagaggatcagctaccaagcgggtttccaaatatagatatgggcccacagctcaaagtcgtggaacggacccgcaccgcaactatgctctgtgctgcctccggcaaccctgaccccgaaatcacctggtttaaggacttcttaccagtggatcccagtgcaagcaatgggcgcatcaagcagctgcgtagcggagctttacagatcgagtccagtgaagaaacggatcagggtaaatatgagtgcgttgccaccaactccgctggggtgcgctattcgtccccagcaaacctctacgtgagagccctgagagaggtgcggagggtggctccgaggttctcaattttgcccatgtcccatgagataatgcctggcggaaacgttaacatcacctgtgtggccgtgggctccccgatgccctacgttaaatggatgcagggtgccgaggacctgactcccgaggacgacatgcctgtgggccgcaacgtgctagaactgaccgacgtgaaagacagtgcgaattatacctgcgtcgcaatgagttcactgggggtgattgaagctgtggctcagatcaccgttaagtctctgcctaaggccccaggaaccccgatggtaactgaaaatacagctacatctattacaataacatgggactcaggaaacccagatccagtctcatactatgttatcgaatacaaaagcaagtcacaagacggtccctaccagatcaaagaggatattaccacgacgcgctattctataggaggtctctcgcctaattccgagtacgaaatatgggtgtcagccgttaacagtatcggacaggggccaccatctgagtcagtggtgacacgcacaggtgagcaggctcccgcttcagccccccgtaatgtgcaggcccgcatgctctccgccacaacaatgattgtccaatgggaggaaccggtcgagcccaacgggctgataaggggctatcgtgtgtattacactatggagccagagcacccagtgggaaattggcagaaacataatgtggacgactccttgctaactaccgttgggtccttactggaggacgaaacttacaccgtgagggtcctggccttcactagcgtcggggacggtcccttgtcagatcccatccaggtgaaaactcagcagggtgtgcccggccaacctatgaacctgagggcagaggcacgtagtgaaacgagcattacactctcctggtcaccgcccagacaagaaagtatcataaagtatgaattattgttccgagaaggagatcatggaagagaggttggaaggacattcgaccccacaacgagttatgttgtcgaagacctgaaacccaacactgaatatgctttcaggcttgcggctaggtccccccaagggttgggcgccttcactcctgtggttcgccaaagaactctgcaatccatctcccccaagaatttcaaggttaagatgatcatgaagacctcagtactcctgagttgggagttccccgataattacaactctcccaccccgtacaaaatccagtataatggcctcactctggacgtggatggtaggacgaccaagaagctgattacccatctgaagccacatacattctacaattttgtcttaacaaaccggggcagcagcctcgggggactgcaacagactgtaacagcctggactgcgttcaacttgctcaatggtaaaccttccgtcgcacccaaacctgatgcagatggcttcattatggtgtaccttcctgacggtcaaagccccgtccctgtacagagctattttatcgttatggtgccgttacggaaatctcggggtggccagtttctgacacccctgggatcccctgaggacatggacttggaggaacttattcaagatatctctcgactccaacgcaggtctctccgacatagtcgacagctagaagtgccccggccgtacattgccgcgcgattttccgtactgccgcccacctttcacccaggggatcagaagcagtatggaggctttgataacagggggctggaaccagggcatcggtatgtgctgttcgtccttgctgttctccagaagagtgagccaaccttcgcggcttcccccttctccgacccgtttcagctggacaaccctgatccgcagccaattgtcgatggcgaagagggattaatctgggttattgggcccgtgctagccgtggtcttcattatctgtatagtgatcgcaattctattgtataaaaacaagccagacagtaagcggaaagatagcgaaccgaggacaaagtgtctgctgaacaatgctgatttggccccacatcatcctaaggatcccgttgagatgcgcaggataaactttcaaacgcccgggatgctttcgcacccacctattcccatcgctgacatggccgaacacaccgaaaggctcaaggccaatgattctttgaaactctcacaggagtatgagtcgatcgatcctggccagcagtttacctgggaacacagcaacttggaagtgaataaaccaaaaaataggtatgcgaacgtaatagcctacgaccatagcagggtgatcctccagcccattgaaggtattatgggcagcgattatataaacgcgaattatgttgacgggtaccgctgtcagaacgcttacattgctacacagggccccctacctgagacgtttggagatttctggcgaatggtgtgggagcagaggtctgcgacaattgtgatgatgacacggttagaagaaaaaagccggattaaatgcgatcagtattggcctaaccggggcacagagacatacggtttcatccaggtcacgctgttggacactattgaactggccacattctgcgtaagaacgtttagcttacacaagaatggtagctctgaaaagcgggaagtccgccagttccagttcacggcttggcctgaccacggggtacccgagtaccccacgcctttcctggcattcctgaggcgcgtgaagacttgcaatcccccagacgccgggcccatcgtcgtgcactgttcagcgggcgtgggcagaacaggatgttttattgtgatcgacgctatgttagagagaataaaacccgaaaagacggttgacgtttacgggcacgttactttaatgcgctcacagcgtaactacatggtgcagaccgaggaccagtatagcttcatccacgaagctctgctggaagccgtggggtgcgggaataccgaggtccccgcccgctcactatacgcttacatccagaagcttgcccaagtcgagccaggagagcacgtcacaggcatggagttggaattcaagaggctggccaactcaaaggcccacacaagccgcttcatctctgcgaatttgccttgcaacaagttcaaaaatcgcttggtcaatattatgccttatgaaagcacacgcgtctgtctccagcccattagaggtgttgagggtagcgactacataaacgctagcttcatagatggctaccggcagcagaaagcctatattgctacacaggggccactggctgagaccaccgaagacttctggcggatgctctgggaaaataacagcacaattgtggttatgcttactaagttgagggagatgggccgagagaagtgccaccaatactggcctgccgaacggtccgcgcgttaccagtatttcgtagtggaccctatggccgagtataacatgccccagtatattttaagggagttcaaagtcaccgatgcccgcgatggacagagcagaacagttcgtcaattccagttcacagattggcccgaacagggtgttcccaagtctggcgagggctttatagacttcatcggacaggtccataagacaaaagagcagttcggacaagacggaccaatcagtgttcattgttctgccggggttggccgcactggtgtgtttattacactctctatagttcttgaacgaatgaggtacgaaggagtcgtggatattttccagaccgttaagatgctgaggactcagcgtcctgccatggtgcagactgaagatgaataccagttttgttaccaggccgcgttggagtatctcggctccttcgatcattatgccacatag

SEQ ID NO: 201787 - DNA, 4329 bp, Artificial Sequence
  Description of Artificial Sequence: Synthetic coding sequence
atggcccgggcccaggccctggtgctggccctgaccttccagctgtgcgctcccgagaccgaaacccccgccgctggatgcaccttcgaagaggcgagtgaccccgctgttccttgcgaatacagtcaagcccaatacgatgacttccagtgggagcaggtgagaatccatcccgggactagagcgcccgccgacttgccccatggcagctacctgatggtcaacacctcccaacacgctccgggccaacgggcccatgtcatcttccagagtctatccgagaatgacacccattgcgtacagtttagctatttcctgtacagtagagacggacattcacccggcactctcggggtgtatgttagggtcaacggaggcccactgggtagtgccgtgtggaacatgaccgggtcccacggccgccaatggcatcaggcggagttagccgtgtccactttctggccaaacgagtatcaggttttgttcgaggccctgatcagtcctgatcggcgtgggtatatgggcctggacgacattctgctcctttcttacccctgcgccaaggcacctcatttttcccgactaggggacgttgaagtaaacgccggtcagaacgcttcatttcagtgcatggcggccggacgggccgccgaggcagagaggtttcttcttcagagacagagcggtgccctcgtcccagcggccggcgtaaggcacattagtcaccgcagattcctggccaccttcccactggccgctgtaagtagagccgagcaggatctatacaggtgtgtcagccaagcccccagaggagcgggagtcagtaatttcgctgagctgatcgtgaaggaacctcctacgcccatcgcccctccgcagttgctgcgagcggggccaacatacctcatcattcaattaaataccaactccatcattggcgacggtccgatcgttcgcaaagaaatcgagtaccggatggcccgggggccttgggccgaagtgcacgctgtctctcttcagacctataagctttggcacctagatccggacaccgagtacgagatcagtgtactgctcaccagacctggagatggggggacgggacgccccggtccaccgctcatcagtagaacaaaatgcgccgaacccatgcgcgcacccaagggattggcctttgccgagatccaggcacgtcagcttaccctgcagtgggaaccactcggttacaatgtcacacggtgccatacttacacggtgagcctttgctaccactacacattgggatcatcccacaaccagactatacgtgagtgtgtgaaaacagagcagggcgtgtcccggtacaccatcaagaatctcctaccgtaccggaacgtgcacgtgcgcctggtgctcacaaatcccgagggaagaaaagagggaaaggaggtgacattccagaccgatgaagacgtgccctccggcattgccgccgagtcacttacttttacacccctggaagacatgattttcctgaagtgggaggaaccacaggagccaaacgggctgatcacccagtacgaaatatcatatcaatccattgaatcctctgatcctgccgtgaacgtccctgggccgcggagaactatatccaaattacggaatgagacttatcatgtttttagtaatctgcatcctggcacgacctatcttttctctgtccgagctaggaccggcaaaggcttcgggcaggccgcactgacggaaatcactactaatattagcgctccctcctttgactacgcagatatgccctccccattgggcgagagcgaaaatactatcacagtcctgttgcgacccgcccaggggcgtggggcaccgatctctgtctaccaggttatcgtggaagaggagcgcgctcgccgactgcggagggaacctggcgggcaggattgcttcccagttcccctgacgttcgaagcggcactcgcgcgcggcctcgttcattacttcggcgccgaactcgccgcctcatcacttcccgaggcaatgccattcactgtgggtgataaccagacctataggggcttttggaacccccccctcgaaccccgcaaggcctacctaatttatttccaagctgccagccatttgaagggagagacccgattgaattgcattcggattgctagaaaggctgcatgtaaagagtcgaagcgtccgctggaggtgtctcagcgctcggaggaaatgggtcttattttaggtatctgcgccggcggtttggctgtgctgatcctgctgctgggagccataattgtgattataagaaaaggaaaacctgtgaatatgacaaaagccacagtgaattatcgacaggagaaaacacacatgatgtcagcggtcgaccggtcattcaccgatcagagcactctccaggaagacgaacgactggggctaagtttcatggacacccatggctactcaactagaggcgaccagaggtcaggcggggtgaccgaagcttccagcctcctgggtggcagcccgaggcgcccctgcggccggaagggtagcccataccacaccggtcagttgcaccctgcagtcagagttgccgatctcctgcagcacatcaatcagatgaagacggcggagggatatgggtttaagcaagagtacgaatcattctttgagggttgggacgcaacaaagaagaaggataaagtcaagggctccaggcaggaaccaatgccggcatacgaccggcaccgcgtcaaactgcaccctatgctgggtgatccgaacgcagattatatcaatgctaactatattgatctgagaggtggccgtacgggctaccaccggagcaatcacttcattgcaactcaaggccctaagcccgaaatggtgtacgacttctggcgcatggtctggcaagagcattgttcctccatcgtgatgatcaccaagctggttgaggtgggccgggttaagtgctctcggtattggcccgaggattcagatacgtatggtgacattaaaattatgctggtaaagacagaaacacttgccgaatatgttgtacggacgttcgccctggagcgacggggctattccgcccgccatgaagtgagacagtttcactttaccgcatggcctgaacacggcgtgccctaccacgctacagggctgctagctttcattagacgagtcaaggcttcaaccccccctgacgccggaccaattgtgatacactgttctgccggaaccggccggaccggctgctacatagtactggacgtgatgctcgacatggctgaatgtgagggcgtcgtggatatttacaattgtgttaaaacactttgcagtcgccgggttaacatgatacagacagaagagcaatatatcttcatccacgacgcgatcctggaagcgtgcctgtgcggcgagactaccatcccagtgagcgaatttaaggccacttataaggaaatgatccgaatcgacccgcagagcaattcatctcagctgcgcgaggagttccagacgctgaacagcgtgaccccacctctggatgtggaggaatgttcaattgctctgcttccacgcaacagggacaaaaatagatctatggatgtgctccctcctgatagatgcctgccttttctgatctccacggatggcgacagcaataactatataaacgccgctctgacagattcatatacccgatccgctgctttcatcgtgacactgcaccccttgcaaagtacaacccccgacttttggaggctggtttacgactatgggtgcacaagcatcgtgatgttgaatcaactgaatcagtcaaacagcgcatggccttgtcttcagtattggccagaacccggcagacagcaatatggcttgatggaggtggagttcatgtcaggaacggcagatgaggatcttgtggcccgggtgtttagggtgcagaatataagccggctgcaggagggacacttgctcgttcgccatttccagtttctgcggtggtcggcctaccgggatactcctgatagtaaaaaggccttcctgcatcttctcgcagaggttgacaagtggcaggccgagtctggcgacggccgcaccatcgttcattgcctcaatggaggcggacgatctggaactttttgcgcctgcgccaccgtgttagaaatgataaggtgccacaatttagtggatgtatttttcgcagcaaagactctaaggaactacaaaccgaatatggttgagacaatggatcagtatcacttctgctatgatgtagctctggagtatctggaggggctcgagtccaggtag

SEQ ID NO: 201788 - DNA, 4341 bp, Artificial Sequence
  Description of Artificial Sequence: Synthetic coding sequence
atggcccgggcccaggccctggtgctggccctgaccttccagctgtgtgccccagagacagaaacaccagccgcagggtgcacgttcgaggaggcctccgatcccgcagtcccatgtgaatactctcaggctcagtacgacgatttccagtgggaacaggtaaggatccacccaggtaccagagcgccggctgatctcccgcatggctcctatctgatggtgaacacaagtcagcacgcacccggtcagagagcacatgtcattttccagagcctaagtgagaatgacacccactgtgtccagttttcctacttcttatattctcgcgacgggcatagcccaggtacgctgggagtttatgtacgcgtgaatggcggcccactgggttctgctgtatggaacatgaccggatcacacggcagacaatggcaccaagcggagctggcagtctcaactttctggcccaatgagtatcaggttctgtttgaggcgttgatctctcccgacagaagaggctacatgggacttgacgacatcctcctgctctcctatccgtgcgctaaagcgcctcacttttcacggctgggtgacgttgaagttaacgctggccagaatgcctcttttcaatgcatggccgcaggaagggccgcagaggccgaacgtttcctgctgcagcggcagagcggagcattggttccagcagccggagtcaggcatatcagtcaccgcaggttcttggctactttccccctggccgctgtcagtagggccgaacaggacctctatagatgtgtgtcccaggcgcctaggggagctggtgtgtctaacttcgccgaactgattgttaaggagcctccaacccccatagcccccccacaactcttgcgggctggacctacttatctcatcattcagttaaacacaaacagtatcattggcgacgggccgattgtacgtaaagagattgaatatcggatggcccgcggaccctgggccgaagttcacgccgtttcgctccagacttacaagctgtggcatctggacccagacactgagtacgaaatcagcgtgttgctgacccgacctggcgacggaggcacagggagaccggggccacccctgatttcgcgcaccaagtgcgccgaaccaatgcgagcgccaaaggggctcgcttttgctgaaattcaagctcggcaactgacgctgcagtgggaacctctcggctataacgtcacaaggtgtcacacttacaccgtgagtctatgttaccattacaccctgggtagctcccataatcaaaccatccgtgagtgcgtgaagactgaacagggggttagccgttacactattaagaatctgttgccgtaccggaatgtgcatgtgcggctggtgttaacaaatcccgagggaagaaaggaggggaaagaggtcacctttcaaaccgacgaggacgtcccatctggaatcgcggcagaatccctgacatttaccccattggaggatatgatttttctgaagtgggaggagcctcaagagccaaacggcttaatcactcaatatgaaattagctaccaaagcatagaatcgagtgaccccgctgtcaatgttcctggaccccgccgcacaatcagtaagctgagaaacgagacatatcacgtgttttctaacttgcatccaggaaccacctacttgttttcggtgagagcgcggacgggaaagggctttgggcaggccgcgctgacggaaattacaactaatattagcgccccttccttcgactacgcagacatgccgagtccgctgggggagtctgagaacaccatcaccgtactgctacgcccagcacaaggacgcggtgctccaatcagtgtataccaggtcatcgtggaggaagaacgagctcgcaggctgaggagggagcccggtggacaggattgttttcccgtacctttaaccttcgaggccgctcttgcccgtggcctagtgcactacttcggggcagagcttgctgcttcaagtctgcctgaggccatgccatttaccgtgggggataaccaaacctatcgcgggttttggaacccgccactggagccaagaaaggcatacttaatatacttccaggcggcctcgcatctcaagggcgagacccggcttaactgcattcgaatagccaggaaagccgcttgcaaggaaagcaagaggccgcttgaggtcagccagcgttccgaggagatgggactcattctcgggatctgcgccggagggctggcagtgctaatcctcctgctgggcgccattattgtgataatacgtaagggcagggaccactatgcttattcctattatcccaagcccgtgaacatgactaaggctaccgtcaattataggcaagaaaagacccacatgatgagcgccgtggaccgcagtttcacagaccagagcaccctgcaggaagatgaacgactcggccttagcttcatggacacgcatggctactctaccaggggcgatcaaagaagcggcggggtcactgaagcatccagcctgctgggcggatcccctaggcgaccctgcgggcgaaagggatccccctaccacacaggacagctacatccggcagtgagagtggccgacctgctgcagcatattaaccagatgaagacagcagagggctacggtttcaaacaggaatacgagtcttttttcgaaggctgggatgccaccaagaaaaaagacaaagtgaaaggtagtaggcaggagccaatgccagcctacgacagacaccgggtcaagttacacccgatgctaggggatccaaacgcagattacataaatgccaactatatcgacgggtatcaccgtagcaaccactttatagcgactcaggggccgaaacccgagatggtgtacgacttttggagaatggtgtggcaggaacactgtagcagcattgtgatgatcacaaagctcgtggaggtggggcgtgtgaagtgtagtcgatattggcctgaagatagcgacacgtatggcgatattaagatcatgctagtgaaaacagagacattggccgagtatgtggtgcgcacattcgccctggagcggcgagggtatagtgcccgtcacgaagtaagacagttccactttaccgcctggcctgaacacggtgttccctaccacgccaccggactccttgctttcataagacgagtgaaggcatctacacctccagacgccggacctatcgtcatccattgtagcgctggcacaggccggaccggctgctacatcgtcctggacgttatgttagacatggccgaatgcgagggtgtggtggacatttacaattgcgtgaagactctgtgcagccggcgagtaaatatgatccagactgaggagcagtatatttttatacatgatgcaatccttgaggcctgtctgtgcggcgagactaccatccccgtcagcgaattcaaagcgacctacaaagaaatgattcggatcgatcctcagtcaaactctagccaactgagagaggaattccagaccctgaattcagtgacaccccccctggacgtggaagagtgcagcatagcattgttgcctcggaatcgagacaagaatagatcaatggatgtgctcccacctgatcgctgcttaccctttctaatctcaaccgatggggactccaataactacattaacgccgctctaacggattcttacactaggtccgccgccttcatagtcactctgcaccctctgcagagtaccactcccgatttctggaggctggtgtatgattatggttgcacttccatcgttatgctgaaccagctcaaccagtcaaactctgcgtggccctgtctccagtactggccagagccagggagacagcaatacggtctgatggaggttgaattcatgagtggtaccgctgacgaggacctggtggctagagtcttccgcgtccagaatatctcacgactgcaagaaggacatctcttggtccgccactttcagtttctgagatggtctgcttaccgtgacacaccagactccaaaaaggcttttctgcacttgctagcagaagtggataaatggcaggcggaaagcggcgatgggcgtaccatcgtgcactgtctgaatggcggtggacgaagcggcaccttctgtgcgtgtgcgactgtgttggagatgattcgctgccataatcttgttgatgtcttctttgcggctaagactctccggaactacaaaccaaatatggtggagacaatggatcaatatcatttctgttacgatgtggccttggagtacctggaaggcctggagagtaggtag

SEQ ID NO: 201789 - DNA, 4329 bp, Artificial Sequence
  Description of Artificial Sequence: Synthetic coding sequence
atggcccgggcccaggccctggtgctggccctgaccttccagctgtgtgcacccgaaacagaaacaccagctgccggttgtacattcgaagaggcttccgatccagccgttccttgcgaatactctcaggcccagtacgacgactttcaatgggagcaggtgaggatacacccaggtactcgggctcccgcagaccttcctcacgggagctatctgatggtcaacacatcccagcatgcacctggccagcgcgcgcacgtgattttccaatccttatcagagaacgacactcactgcgtccagttctcttacttcctgtatagccgagacggacactctcctgggacccttggcgtatatgtaagagtcaatggtgggcctctcggtagcgctgtgtggaacatgacgggctctcacggacgacaatggcatcaagctgagctcgcagtaagcaccttctggccaaatgaataccaagttctgtttgaggcgctcatttctcctgaccggcgcggatacatgggactggatgacatcctcctgcttagctacccatgcgcgaaagcaccacacttctcccggctaggggatgttgaggtgaacgcgggacagaacgccagctttcagtgtatggccgcagggcgggctgccgaggctgagcggttcctcttgcaacgtcaaagcggagccctagtcccggccgctggtgtcagacacatctcccacaggaggttcctcgcgacctttcccttggcggctgtaagccgcgctgagcaggatctgtataggtgtgtgagccaggcaccccggggcgctggcgtgtcaaattttgcggagttaattgtgaaagagccccctacacccatagcccccccccagttattaagggctggacctacatatctgatcatccagctcaatactaactctatcatcggtgacggccctatcgtgcgcaaagagatcgagtacaggatggccagagggccgtgggccgaagtgcatgctgtaagtctccagacctacaaactgtggcacttggacccggatacggaatatgagatatccgtgctcctcacccgtccaggggacggcggtacgggacgcccaggcccccccctgataagtagaactaagtgtgccgagcccatgcgcgccccaaagggcctcgcttttgccgaaatccaggctcgccaacttacgctgcagtgggagcctcttgggtataatgttactcggtgccacacttatacagtatctttgtgctatcattataccctgggctcctctcacaaccagacaattagggaatgcgttaaaaccgaacagggcgtttcaaggtatactattaaaaacctacttccctacaggaacgtacacgttcgcctagttctgactaacccagaaggtaggaaagaaggaaaagaagtaaccttccagaccgacgaagacgtaccatccggaatcgccgccgaatcccttacatttacccccctggaggacatgatttttttgaaatgggaagagccccaggagccgaacggtctgatcacgcagtacgaaatctcctaccagtcgattgagtcaagtgacccagccgtcaacgtgccaggacctcggagaacaatcagtaaactgagaaacgagacataccatgtcttctccaacctgcaccccggcacgacctatctgttctctgtgagggccaggacaggtaaagggtttgggcaagcagcccttaccgagatcactacaaacatctcggcaccatcctttgattatgccgacatgccaagtcctctgggtgagtctgagaataccatcacagtgctgctgagaccggctcagggacggggcgctccaatctccgtctatcaggtaatagtggaagaggaacgcgcgcgccgcttgcgccgagagcccggtggacaggattgcttcccagtgccactcactttcgaagctgccttggccagaggcttggtccactacttcggtgccgagctggccgcgtcgtctttgcctgaggccatgccattcaccgtgggtgataatcagacttacagggggttttggaatccccctctagaaccaaggaaagcatatctgatttattttcaagccgcaagtcacctgaagggcgagacccggctcaattgtattcgcatcgctcggaaagccgcatgtaaggagtctaaaaggccgctggaggtgtcgcagagatccgaggagatgggactgatattaggcatctgtgctggcggtctcgccgtgttaatccttcttcttggagccattatcgttatcataagaaaagggaagcccgttaacatgaccaaggcaacagtaaactaccggcaagagaagacgcacatgatgtccgccgtcgaccgctctttcactgatcagtctaccctccaagaggatgaacggcttggactgtcatttatggacactcatggatactccactcgcggagaccagcggtccggaggagtgactgaagcttcttccctccttggggggagcccaaggagaccttgtgggaggaaggggagtccctatcacactggacagctgcacccagcagtccgggttgcagatctcttgcagcatatcaaccagatgaagacagctgagggttatggctttaaacaggagtacgagagcttcttcgaaggctgggacgctacaaagaagaaagacaaggttaagggcagccggcaggaaccgatgccggcctacgaccgccaccgagtcaaactgcacccaatgttaggcgaccctaatgcggattacattaatgccaactacatagacattagaattaatcgggaaggttatcaccggtctaaccattttattgctactcagggtcccaagcctgagatggtatacgacttttggcgcatggtgtggcaggagcactgtagctccatcgtgatgataactaagcttgtggaagtgggacgggtaaaatgctccagatactggcctgaagacagcgatacctacggagacatcaaaatcatgctggtcaaaacggagaccttagctgagtatgttgtacgcacttttgccctcgagcgtaggggctactctgcccgtcacgaggtgaggcagtttcatttcacagcatggccagaacacggagttccctaccatgcaaccggcttgctagcgtttattaggagagtaaaagcatccaccccacccgatgccggccccattgtgattcattgttccgctggcacaggcagaaccggctgttatatcgtcttagatgtgatgctggacatggccgagtgcgaaggtgtggtggatatttataattgtgtcaagactctgtgctcgagaagggtgaacatgattcagactgaggaacaatatatcttcatccacgatgccatccttgaggcttgcttgtgtggcgagaccaccatcccagtgtcagagtttaaggcaacatacaaggaaatgatcagaatcgatccacagagcaacagcagtcagttgcgcgaagagtttcagacgctgaattcggtcacacctccactcgatgtcgaggagtgttctatagcactgcttccccgaaatagagataagaataggagcatggacgtgctccccccagaccgatgcctcccatttcttattagtactgacggcgacagcaacaattatatcaatgcagcattgacagactcctatacacgttcagcggcttttatcgtaaccctccacccgctgcagagcactacacctgacttctggagacttgtctatgattacggatgtaccagcatcgttatgctgaatcaactgaaccagtctaacagtgcttggccatgcctccaatattggcctgaacctgggaggcagcagtatggcctcatggaagtagaattcatgtctggaacagccgacgaggacctcgtagcaagagtgttccgggttcagaacatttcacgcttacaggagggccatctcttggtcaggcacttccagtttcttcggtggtctgcctaccgggacacgccagactcgaagaaagccttcctgcatctgctggcagaggttgataaatggcaggcagagagtggagacggcaggaccattgtacactgtcttaatggtgggggaagaagtggcaccttctgcgcctgtgcgactgtgctcgagatgataagatgtcacaacctggttgacgtgttctttgccgcgaagaccttacggaattacaaacctaatatggttgagaccatggatcagtaccacttttgttacgacgtggcgttagaatacctcgaggggctggagtcaagatag

SEQ ID NO: 201790 - DNA, 4311 bp, Artificial Sequence
  Description of Artificial Sequence: Synthetic coding sequence
atggcccgggcccaggccctggtgctggccctgaccttccagctgtgcgctcccgagacagagacacccgccgccggatgcacatttgaggaggctagcgaccccgcggtgccttgtgaatattcacaagcacaatatgacgactttcagtgggagcaggtccggatccatccaggaacccgagcccctgccgatctgccccatggctcgtatctcatggtgaatacatcacagcatgcccctggacagagggcccacgtaatctttcaaagcctgtctgagaatgacacccattgtgttcaattttcctactttctgtatagtagagacgggcacagccctggcactcttggggtgtacgtccgcgtgaacggtggaccgctgggtagtgccgtttggaacatgacaggctcccacggaaggcaatggcaccaggcagagctggctgtgagcactttctggcccaatgaataccaagtgctgtttgaagccttgattagccccgatcgccggggttatatgggtcttgatgatatccttctgcttagctacccttgcgctaaagctccacacttcagcagacttggggacgtagaggtcaacgcggggcagaatgcaagcttccagtgcatggctgccggccgagcagctgaagcagagagatttctgctccagcggcagtccggtgctctcgttcccgctgcaggggttagacacatttcccatagacggttcctcgccacgtttccgctcgctgccgtgagtcgggcagagcaggacctgtatcgatgtgtgagccaggcaccccgcggcgcaggggtgagtaattttgctgaactgatcgttaaggaaccacccacacccatagctcccccgcagctgctgcgggcaggtcccacctatctcattatacagctcaataccaacagtattataggcgatggcccaatcgtgaggaaggaaattgaatacagaatggcacgaggaccctgggccgaggtgcacgccgttagcctacagacctataaattgtggcatctcgatcctgacaccgaatatgagatttctgtactacttactcggcccggggatggaggcacgggtaggccaggcccgcctttgatttcacgcaccaaatgtgctgagccgatgcgggcaccgaagggtctggctttcgcagaaatacaggctagacagttgaccctccagtgggagcctctaggatacaacgtgactcgatgccatacatacactgttagcctctgctaccactatacacttggaagtagccataaccagaccataagggagtgcgttaagaccgagcaaggagtttcccgatatacaattaagaaccttcttccctataggaatgtgcacgtgcgtctcgtgttaaccaaccccgagggtagaaaggaaggaaaagaagtcacatttcagaccgacgaggacgtaccatctggtatagccgctgagtcactgacatttactcctcttgaagatatgatatttttgaagtgggaagaaccccaggagcctaacggcttgatcacgcagtacgagatttcttaccagagtatcgagagctccgaccctgccgtcaacgtgcctggtccaagacgtaccatctctaagcttaggaacgagacctatcacgttttttcaaatctgcatcctggaactacctacttattctcagtcagagcccgaacaggaaaaggctttggccaagcagccttaacagagatcaccactaacatctctgctcccagtttcgattatgccgatatgccctctcctctgggcgaaagtgaaaataccatcaccgtgctgctaagacctgcccaggggaggggggcccctatcagcgtctatcaagtgattgttgaggaggaaagggccaggcgtctccgtagggagcctgggggacaggattgctttcccgttcccctcacatttgaagcagctttggccaggggattggtgcattacttcggtgccgagctcgccgcctcatctctgcccgaggcaatgcccttcaccgtgggggataaccagacgtatcgtggattctggaacccccctctcgaaccacgcaaagcctacttgatttattttcaggcagctagccaccttaaaggcgagactcgcctaaactgcatccggatcgctcggaaagccgcctgcaaggagtcaaagcggcctctggaggtgtctcaaagatctgaagaaatgggccttattctaggcatatgtgcgggtggactggcagtgttaatcttactcctgggggcaatcatcgtcattatcaggaaaggaaaacctgtgaacatgaccaaggccacggtcaactatcggcaggaaaaaactcacatgatgtcagccgtggataggagcttcaccgaccagtcaacattgcaggaagacgagcgtctggggttgagtttcatggatacacatggatattctacacgcggggaccaaaggagcgggggggtgaccgaggccagctccctcctcggaggcagtcccaggaggccctgcggacgcaaaggttcgccttatcatacaggtcagctccatcctgctgtacgcgttgccgatctccttcaacacatcaaccagatgaaaacggcggagggctacggcttcaagcaggagtatgaaagcttctttgaaggatgggacgctacaaagaaaaaggacaaggtgaaaggtagccgacaggaacccatgcctgcatatgaccggcacagggtgaaactgcatcctatgctcggcgatcccaacgcagactatattaatgcgaattacattgatggatatcaccgttctaatcacttcatcgccacacagggacccaaacccgagatggtctacgatttctggcgcatggtgtggcaagaacattgttccagtatagtgatgataaccaagctcgttgaagtaggccgagttaagtgctcacgctattggcctgaagactccgacacctatggcgatatcaagatcatgctggtgaagacagaaactcttgctgaatatgtagtccgaacattcgcgctggaaaggcggggatatagcgcacggcatgaggtgcgccaattccattttactgcctggccggaacacggcgttccatatcacgcaactggcctgcttgccttcatcagacgtgtgaaagcttccacaccccccgatgcgggcccaattgtgatccactgttctgctggcacaggtaggaccggatgctacatcgtcctagacgtaatgcttgacatggcagaatgtgagggggtggtggacatttataactgtgttaagaccctgtgttcccgcagggtgaatatgatccaaactgaagagcagtatatctttatccacgacgcaatactggaagcctgcttatgcggggaaaccactattccagtgagcgagttcaaggcaacatacaaagaaatgatccggattgatcctcagtctaatagctcacagcttagagaagagtttcagacactgaattccgtcactcccccacttgatgtggaggagtgttctatcgccttactccctcgcaacagagataaaaatcgttctatggatgttctgccgcctgataggtgtctgcccttccttatcagcaccgacggcgacagtaacaactacattaacgctgctctgacagacagctatacacggtccgccgcgttcatagtaacgctacaccctttgcagtctacgacgccggacttctggcgtctcgtctatgattatggttgcaccagcattgttatgcttaaccagctaaaccagtcaaactcggcctggccgtgcctgcagtattggcctgagcctggccgccagcagtacgggctgatggaggtcgagttcatgtctggcacagctgatgaagacctggtggctcgtgtattccgcgtacagaacatttcaaggctgcaggaaggacatctgctggtcaggcacttccagtttcttcgatggtccgcctatcgtgatacgccagacagtaagaaagcctttttgcatctactcgctgaagttgacaaatggcaagccgagtccggcgatggcagaaccatcgtgcactgcctcaacggcggcggcaggagcggaaccttttgcgcatgcgccacagttctggaaatgatcaggtgccacaacctggtggacgtctttttcgcggcaaagacacttcggaactataaacccaacatggttgagacgatggatcaataccacttttgctacgacgtcgctctcgagtacctggagggacttgagtcccggtag

SEQ ID NO: 201791 - DNA, 4302 bp, Artificial Sequence
  Description of Artificial Sequence: Synthetic coding sequence
atggcccgggcccaggccctggtgctggccctgaccttccagctgtgcgcacctgaaaccgagactccggccgcagggtgtacgtttgaggaagcaagcgatcccgcagtcccctgtgagtattcccaggcacaatatgatgacttccagtgggaacaggttcggatccaccccggtacccgggccccggcagacctcccacacggcagttacctgatggtaaatacaagccaacacgccccaggccagcgggcacacgtgatctttcaatctctcagtgagaatgacacccattgcgtgcagttctcttacttcctatattcccgtgatggtcattctccgggcacactcggcgtgtacgtacgcgtcaatggtgggcctctcggctccgcagtttggaatatgaccgggtcccatgggaggcaatggcatcaggctgagctagccgtgtccaccttctggccaaacgagtatcaagtgctattcgaagctctgatctcacctgaccgccgcgggtatatgggactggatgacatccttctgttgtcctacccttgcgccaaagctcctcactttagccgccttggtgacgttgaggtgaatgccggacagaacgcctcattccagtgcatggcggccgggagggctgcggaggccgagcgatttctattgcaaaggcagagtggggccctggtgcctgccgctggcgtgcgccatatatcacacaggcgatttctggccactttccccctggccgccgtctccagagcagaacaggacctgtataggtgtgtgtcccaagcacctcgcggagctggggtctcaaacttcgctgagttgatcgtgaaggagcctcccacaccgatagcaccgcctcaacttctgcgtgccggtcctacatacttaattatacagctgaacaccaactctattatcggagatgggcctatagtgcgcaaggagatcgagtatcgaatggcaagagggccatgggccgaggtgcacgccgtgagcctccaaacttataagctgtggcatttagaccccgataccgagtatgaaatctcagttctgctgacaagaccgggagatggaggtaccggcaggcccgggccccccctcatctcccggaccaagtgcgcagaacctatgcgggctccaaaaggcttagccttcgcggagatccaggctaggcagcttaccctgcagtgggaacccttgggatacaatgtgacacggtgtcacacctacactgtctctctctgctaccactacacgctcgggtcttctcacaaccagactatacgagagtgtgtcaaaactgagcagggggtaagcaggtataccatcaaaaatctgctgccttatcgcaacgtgcacgtgagactggtgcttactaatccggagggccgaaaagagggcaaggaagtgacatttcagaccgacgaggacgtcccctctggtattgctgcagagagtctgacattcactccattggaggatatgatattcctaaaatgggaggaaccgcaggagccaaatggcttaatcacccagtacgagattagctatcagtccatagagagctccgacccagccgttaatgtgccaggtccccggagaactatttccaagcttcggaacgagacatatcatgtcttttcaaaccttcatcccggaacaacatacctcttttccgtaagagcacggacaggtaaaggcttcgggcaagccgctttgaccgagataacaacaaacattagcgcgcccagtttcgactacgctgatatgcccagccccctgggggaatcagaaaacacaatcaccgtgctgctgaggcccgcccaagggaggggggccccaatttcagtgtatcaggtgattgtggaggaggaaagagcccgacggctgagacgtgagcctggcggtcaggactgtttcccagttcccctcacatttgaggcagctctggcaagaggcctggtgcactacttcggagccgaactggcggcctcgagcctgcccgaagccatgcctttcacagtcggcgacaaccagacttaccgggggttttggaaccctccgctggagccccgcaaagcctatctgatttactttcaggctgcttcacacctaaagggtgagacccgccttaattgcatccggatagctcgtaaggctgcctgcaaagaatctaagcggccattggaggtcagccagaggagcgaggagatggggctcatcctgggcatctgtgcaggaggcctcgccgttttaatcctgcttctgggggccatcattgtgattattcgaaagggaaaacctgtaaatatgaccaaggcaactgtcaactaccggcaggaaaaaacccacatgatgagcgccgtcgaccggagctttacagatcaatccaccctgcaggaggacgaaaggctggggttgtcctttatggatacccacgggtactctacacggggtgaccaaagaagtggcggggttaccgaagccagttctttgctaggagggtccccccgccggccgtgtggacggaagggaagtccctaccacacaggacagcttcacccagcagtgcgagtagctgatctgctccagcacattaaccaaatgaagaccgcagaaggatatggcttcaaacaggagtacgagagttttttcgaggggtgggatgctactaagaagaaggataaagttaaaggctccagacaggagcccatgcccgcctacgataggcaccgagtaaagctccatcccatgctcggggacccgaacgcggattatataaacgccaattacatcgacgggtaccaccgttccaaccactttatcgctacacagggccccaagcccgagatggtgtatgacttttggaggatggtgtggcaagaacactgctcttccatcgtaatgattacgaaactggtggaagtgaagtgctctagatactggcccgaggacagtgacacctatggcgacatcaagatcatgctggtcaagaccgagactctggccgagtatgtggtgcggaccttcgctctagaaaggcgtggatactccgccaggcacgaggtgcggcagtttcacttcaccgcctggccggaacacggcgttccctaccatgccacagggttactggcctttattcgtagagtgaaagcttctacgccgccagacgccggccctatcgtaattcactgcagtgctggaactgggcggactggatgctacattgtactggacgttatgttagatatggccgagtgcgagggggtggtcgacatctacaattgtgtgaaaacattgtgtagccgccgcgtaaacatgattcaaacagaggaacaatatatctttatacatgacgccatcctggaagcctgcctctgtggcgagacaaccattcccgtctcagagttcaaggccacatataaggagatgatccgaattgaccctcaatcaaattcaagccaattacgagaggagtttcaaactctcaactccgttaccccgcccttagatgtagaggagtgctcaatagcactgttgccccgtaaccgggataagaaccggtccatggatgttctgccaccggacaggtgcttgccatttttaatttcaaccgatggagattccaacaactatatcaacgccgcacttactgacagctatacccgtagtgccgccttcattgtgacgctccaccctctgcagagtacaacccccgacttttggcggttggtatatgactacggctgtacaagcattgtgatgttaaatcagctgaaccagtcaaatagcgcctggccctgtctgcagtattggcccgagcccggccgccagcaatacggcctcatggaggtggaattcatgtccggcactgctgatgaagacctcgtggcccgtgtgtttcgggtgcaaaatatatcaaggctgcaggagggccacctactggtgcgtcattttcagtttctgcgctggtcagcatatagggatactcccgacagtaaaaaggcattcctgcatcttctggctgaggtggacaaatggcaggcagagtcaggagacgggagaacaatcgtgcactgtctcaacgggggtgggagaagcggcaccttttgcgcttgcgccaccgttttggagatgattcgctgccacaatctggtcgacgtattttttgcagctaagacgctgcgtaattacaagccaaatatggtcgagacaatggatcagtaccacttctgctatgacgtggctctggagtacctggagggactggaatccagatag

SEQ ID NO: 201792 - DNA, 6948 bp, Artificial Sequence
  Description of Artificial Sequence: Synthetic coding sequence
atgcggatcctgaagcggttcctggcctgcatccagctgctgtgcgtttgcagacttgactgggctaacggctattaccggcagcagagaaaattagtggaagaaataggttggagttatacaggagccctaaatcagaaaaactgggggaagaaatatcctacctgtaactctcccaaacagtctcctataaatattgatgaagatttaactcaggtgaacgtgaatctgaagaagctgaagttccaggggtgggacaagacaagcctggagaacaccttcattcacaacactggaaagacagtcgaaatcaacctcacaaacgattatagagtgtcaggaggcgtcagcgagatggtgttcaaggccagtaagattaccttccactggggaaaatgcaacatgagctctgacggttccgagcattccctggagggacagaagtttcctctcgagatgcagatatactgcttcgatgcagaccgcttctcctccttcgaggaggctgtaaagggtaaggggaaattacgcgccttgagcatcctgtttgaggttggaaccgaagagaacttggactttaaagccatcattgacggtgtcgagagtgttagtcggttcgggaaacaggctgcccttgacccattcattttgttaaatctgcttcctaactctacggataagtattacatttataacggctccttaacgtcacccccctgcaccgatacagtcgattggattgtttttaaggatacagtctccatttctgagagtcagctcgctgtgttttgcgaggtgctgaccatgcagcaatcgggatacgttatgttaatggattatctgcagaataacttccgtgagcagcagtataagttcagcaggcaggtgtttagctcgtacaccgggaaggaggagattcatgaggctgtatgctccagcgagcctgagaatgtgcaggctgatcccgagaattacacgagtctgctcgttacatgggaacgtccacgtgtagtgtacgacacaatgattgaaaagttcgcagtgctgtatcagcagctggacggtgaagaccagacgaagcatgagtttttgactgacggataccaagacctcggtgccatcttaaacaatcttctacccaatatgagttatgtacttcagatcgttgccatatgtactaacggtctctatggaaagtacagcgaccaattgattgtggatatgccaacagacaaccccgaactggacctcttcccagaactcataggaactgaagaaattatcaaagaggaagaggagggaaaagatatcgaggaaggtgctatcgtgaacccaggcagagacagcgcaacaaaccagatacgaaaaaaggagccccaaatcagcacaaccacccactataaccgcatcggcactaaatacaatgaggccaaaacaaaccggtcaccaacaaggggctcagagtttagcgggaagggtgacgtgcccaatacaagtttgaactccacaagccagcctgtgactaagctggctaccgaaaaggacatctcactcacctcgcaaacggttacggagctcccaccacacaccgtagaagggacctcagcgagcctgaacgatggatctaagacggttctaagaagccctcacatgaacctgtcgggcacagcagaaagcctgaacacagtaagcattaccgagtatgaggaggagtctctgcttaccagtttcaagctcgatacaggagccgaggattcatctggaagctcgcccgctactagcgccattccgtttatttcggagaacataagccaggggtatatcttttcgagtgaaaacccagagaccatcacctacgatgttctaatacctgagagcgcccggaacgctagtgaggattctacctcgtctggcagtgaagagtctttaaaggatccatccatggaggggaatgtatggttcccatccagtaccgacatcacagctcagccagacgtggggtctggcagggaaagtttcctgcaaaccaactacactgaaattagagttgacgaatcggaaaaaactaccaagtctttctccgccggtcccgtaatgtctcagggtcccagcgtgactgacctggagatgccacactacagtacctttgcctattttccgacagaagtaactccccacgcctttacaccatctagtagacaacaggacctggtgtctaccgtgaatgtggtgtactcccagacaactcagccggtttacaatggcgagacccccctgcagcctagctattcgtccgaggtgttccctttggtcaccccgctcctgctggataaccagattctgaacacgacacctgctgcgagcagctcagactctgcgttacacgcaacaccagtgttcccatctgtggacgtgtcctttgaatccatcctgtcctcctatgatggggctcccctcctacccttctccagtgccagcttttcatctgaactgttccgccatttgcacacagtgtctcagattttgccgcaggttacaagcgccactgaaagcgacaaagtgccactgcacgccagtctgcccgtggcaggtggagatctgcttcttgagccctctctggcccaatacagtgatgtcctcagcacaacccacgcagcatccgagaccctggagtttgggtccgaaagtggggtactgtacaagaccctgatgtttagccaggtggagcccccctcttctgacgctatgatgcatgcgcggagctctggcccggagcctagttacgccctatccgacaatgagggcagccaacacatcttcacagtgtcttattcctctgccattccggtgcatgatagtgttggcgtaacatatcaaggatccctgttctctggcccatcccatatcccaatccctaagagctcactcatcactccaaccgccagtctgctgcagccaacacacgcgttgagcggtgatggcgaatggtcgggcgctagcagcgattccgagtttttgctgcctgacacggacggtctcactgctcttaacatcagtagccctgtcagcgtagctgaatttacctatacgacgagcgtctttggagatgacaacaaagcattatccaaatctgagattatatatggtaacgaaaccgaattgcagatccccagtttcaacgagatggtgtacccatcagaaagcaccgtgatgccaaacatgtatgacaatgtgaacaaactgaatgcttctttgcaggagaccagtgtcagcatctcctcaacaaaaggcatgttccccggatccctggcacatacaactaccaaggtcttcgatcacgaaatcagccaggtgcctgaaaataacttctccgtgcagcccacgcatacagtgtctcaagcatctggtgacacatcactgaaacctgtcttgtcagcaaactcggagccagcgtcctctgaccccgcctcaagcgagatgctgagcccaagcacacagttgctgttttacgaaaccagcgcaagcttcagcactgaagttctcttacagcctagtttccaggctagtgatgtagacacgctgctcaaaacagtgcttccagccgtcccgtccgatccaatcttggttgaaactccaaaggtggacaagatctcttccacaatgctgcacctaatcgttagcaatagtgcttcatccgaaaacatgctccatagcaccagtgtacccgtcttcgacgtctctcccacttcccacatgcattccgcctctctccagggcctgaccattagctacgctagcgaaaagtacgaaccggtgctgctcaagagtgagtcatcacaccaggtggtgccttctctatacagtaacgatgagctcttccagacggcaaatctcgagataaaccaggcccatcctcccaagggcagacatgtgtttgccactcctgtgttatccatcgacgaaccccttaacacccttatcaacaagctgatacattccgacgagatcctgactagcactaagagctcagtgaccgggaaggtgtttgcgggcattcctactgtcgcttctgatacatttgtgagcacagaccattccgtgcccatagggaacgggcatgtcgctatcaccgcagtaagcccacatagagacggttccgtaacctcaacgaagctgctattcccctccaaagcgacatccgagctatctcactcggcgaagtctgacgctgggttggtcggcgggggggaggatggggatacagacgatgatggcgacgacgatgatgacgataggggcagcgatgggctgtccattcacaaatgtatgagctgttcttcttaccgggaatcccaagaaaaagttatgaatgacagcgacacgcacgaaaactcactcatggatcagaataatcctatctcatacagcctcagtgagaattctgaggaggacaaccgtgttacatctgtgtcctccgattctcagacggggatggatagatctcccggaaagtctccatcagcaaacggtctgtcccagaagcacaatgacgggaaagaagaaaacgatattcaaactggttccgcacttttacctctgtcaccagagagtaaggcttgggccgtcttgacctccgatgaagagagcgggagcggccagggtacaagtgactcactgaatgaaaacgagactagtactgacttttctttcgctgacaccaatgagaaagatgctgacgggatccttgcagccggagattcagaaatcacacccggtttcccccagtcaccaacctcctcagtgacatctgaaaacagcgaggtgttccatgtatcggaagccgaggcctccaattcttcacacgaatcacggataggactcgccgaaggcctggagagcgaaaagaaggccgtgattcccctggtgattgtgtccgcactgacctttatttgtcttgtagtactagttggtatcctaatctattggaggaagtgcttccagaccgcccacttctatttagaggacagtacttctcctagggttatctctactccacccacccccatattccctatttctgacgacgtgggagctatccccatcaagcacttccctaagcacgtagccgacctgcacgctagcagcgggtttactgaagagttcgaaacactcaaagaattttatcaggaagtgcagtcttgtactgtggacctgggcataaccgccgactcctctaaccacccagacaataagcataagaaccgttatattaacatcgtcgcatacgaccatagtagggtaaaactggcccagctggcggagaaggacggcaaacttacggactacatcaacgccaattatgtggatggctacaatagaccaaaagcctacatcgctgcacaagggcctctgaagtccactgcagaggatttttggcgcatgatctgggaacataacgtcgaggtcattgtgatgatcaccaatctagtggagaagggtcgccgcaagtgcgatcagtactggcccgccgatggcagtgaggaatacggtaattttctggtgacacagaaatcggtacaagtgcttgcatattacacagtcagaaacttcaccctccgcaacacaaaaattaaaaagggctctcaaaaagggcgaccgtcaggccgcgttgtgacgcaataccactatacccagtggccggatatgggggtaccagaatacagcctccccgtgctgacatttgtccggaaggctgcgtacgccaagagacacgctgttggacccgtggttgttcactgctctgcaggcgtcggaagaaccgggacatacatcgtgctggattctatgttgcagcagatccagcacgagggtacggtgaatatctttggcttcctgaaacatatcagatcccagcggaattacctagtccagaccgaggagcagtatgtctttatccacgacacactcgtcgaggcaatcctgtccaaagaaaccgaagtcctggacagccatattcatgcctatgttaatgctctgctcatacccggacctgctggcaagacaaagcttgaaaaacagttccagttgctctcacagtcaaacatccagcagagtgactattccgcagcattgaagcagtgtaatagggaaaaaaatcgcacctcctccataatcccggttgagcgcagccgggtggggatttcaagtttgagcggcgaaggtacagattacattaatgccagctatatcatgggatactaccagtcaaacgaattcatcattacacagcacccactgttacatactatcaaggacttttggcggatgatctgggaccacaacgcacagctggtagtgatgatcccagacgggcagaatatggctgaagatgagtttgtgtattggcccaacaaggatgaaccaattaactgcgaaagcttcaaagttaccctgatggccgaggaacataaatgcctatctaatgaggagaagttaatcatacaggactttatcctggaagccacgcaagatgattacgtccttgaggtgagacatttccagtgtcctaaatggccaaatcccgacagccctatctcgaagaccttcgagctgattagcgtcattaaggaagaggcagctaacagggatgggcctatgattgtgcacgacgagcacggaggcgtaacagccggaacattctgcgctctaacaactttgatgcatcagctggagaaagaaaactcggtggatgtgtaccaggtggccaagatgataaaccttatgagacccggtgtcttcgccgatatcgaacagtaccagtttctatataaagtgatattaagcctggtttctacacgtcaggaggagaacccctctaccagcctcgactccaatggcgctgccctgcctgacggaaacatcgcagagtcactagagtctctggtgtag

SEQ ID NO: 201793 - DNA, 474 bp, Artificial Sequence
  Description of Artificial Sequence: Synthetic coding sequence
atgggccggctgaccgaggccgccgccgccggcagcggcagccgggccgcaggctgggccggtagcccacccactttgctgccactgagccccacgtctcccaggtgcgccgccactatggcatccagcgatgaggatggaaccaacgggggggctagtgaagccggtgaggatcgagaggcccctggcgagcggcgcaggttgggcgtgcttgctaccgcctggcttaccttctacgatatcgccatgaccgccggacggttaatccttagccctcgtctcgagtgtattggcgccattagcgcccactgccaacctcagccccccgaattcaagcgattttcttgcttgggattaagatcttcatgggactacaaacggggccctccaagacccatcaacttctgcatcttcggccgagaccgcgtcagtccctgttggcccggatggagccgcacgcccgatctgaaatag

SEQ ID NO: 201794 - DNA, 867 bp, Artificial Sequence
  Description of Artificial Sequence: Synthetic coding sequence
atgggccggctgaccgaggccgccgccgccggcagcggcagccgggcagcaggttgggcagggagccccccaaccctgcttcctttatcccctacgtcccctcggtgcgctgcaaccatggcctcttccgacgaagacggcaccaatgggggcgccagcgaagctggcgaggacagggaagcaccaggcgaacgcagaagactaggcgtgctggctacagcctggctgaccttctacgatatcgccatgactgccggctggcttgttctggcgatcgccatggtccggttctatatggagaaggggactcataggggactgtacaaatccattcagaaaaccctgaaattctttcagacattcgctctgctggaaatcgtgcactgtcttatcggcattgttcccacatcagtgatcgttacaggggtgcaggtttccagccgcatatttatggtttggctcatcactcactccatcaagcctatccagaatgaggagagcgtagtgcttttccttgtggcttggactgtcactgagattaccagatattccttctacaccttttctctgttggatcatctgccttactttatcaaatgggcccgctataatttttttatcattctgtatcccgtgggcgtggctggcgagttattgactatatacgccgcgctgccccatgttaagaaaactgggatgttttcaattcggctccctaacaaatacaatgtgagtttcgattactactactttttgctgatcaccatggcatcttatatcccactgttccctcagctgtacttccacatgctgcggcagaggcgaaaggtgttacacggcgaagtcattgtcgaaaaagatgactag

SEQ ID NO: 201795 - DNA, 1269 bp, Artificial Sequence
  Description of Artificial Sequence: Synthetic coding sequence
atggccggctgcgtgcccctgctgcagggcctggtgctggtgctggccctgcaccgggtggagccctccgcaacctctctgaaggaaagacatggacttcattctgatagcgcctgcacgggagtgcaagaaagcttattcctgcctgcatccaaagccaatgacgtgctggtgcgttggaaaagggctggtagctatttgcttgaggagttgttcgaggggaatctcgaaaaagaatgctacgaagagatctgcgtctatgaggaagcccgggaggtcttcgaaaacgaagtcgttactgatgagttttggaggcgctacaagggcggctctccctgtatatcacagccctgccttcacaacggctcttgccaagatagcatctgggggtacacctgcacttgttccccggggtatgaggggtcaaattgcgaattggccaaaaatgagtgtcatcctgagcggacagacggttgccaacatttttgcctgccaggccaagagtcttacacatgctcctgtgcacagggttatcgattgggggaggatcacaagcaatgcgtgccccacgaccaatgcgcatgtggcgtccttacctctgagaaacgggcacctgacctgcaggacctcccctggcaagtgaaattgactaattccgaggggaaagacttctgtggtggggtcatcataagggagaactttgtactcaccaccgccaaatgctctctactccatagaaacataacggttaagacgtactttaataggacatctcaggatcctttaatgattaaaatcacgcatgtgcacgtgcatatgcggtacgacgcggatgcaggggaaaatgacctttccctgctcgaactggagtggcccatacagtgtcctggtgctggactccctgtatgtacccctgagaaagactttgcggagcatctactgatcccaagaacacgcggcctcctgtccggttgggccaggaacggaaccgacttaggaaactctctcaccacccgtcctgtaacattagtggagggcgaagaatgtggccaggtgcttaatgtgactgtcactacacgcacatactgtgagcgatcaagcgtcgcagcaatgcattggatggatggatcagtcgtcacccgggaacatagggggagttggtttctgacgggggtcctggggtctcagcctgtcggcgggcaggctcatatggtgttggtgaccaaggtgtcgcggtactccttatggttcaagcaaattatgaactag

SEQ ID NO: 201796 - DNA, 1203 bp, Artificial Sequence
  Description of Artificial Sequence: Synthetic coding sequence
atggccggctgcgtgcccctgctgcagggcctggtgctggtgctggccctgcaccgagtggagccctctgtgttcctgcctgcaagtaaggctaacgatgttctggtgagatggaagcgtgcgggttcgtacctgttagaggagctgtttgaagggaacttagagaaagagtgttatgaagaaatttgcgtgtatgaggaagcacgggaggtgttcgagaacgaagtggtgactgacgaattttggcggcgatataagggcggctccccttgtatttcacagccctgcctgcataacggaagctgtcaagacagcatctgggggtatacctgcacctgctccccaggctacgaaggctccaactgtgagctggcaaaaaatgagtgtcaccccgaacgtaccgacggatgccaacacttttgtctccccggtcaagagtcttatacctgttcttgcgcacagggttaccgtctaggggaggaccataaacagtgcgtccctcatgaccagtgcgcctgcggcgtgctgacctccgagaaacgggcaccggacctgcaagatctcccttggcaggtgaaactcacaaattcagaaggaaaggacttctgcggtggtgtcatcatccgcgaaaatttcgtgctgacaaccgccaagtgcagcctcctgcaccggaatattacagtcaagacctatttcaataggacgtctcaggatccactaatgattaagatcacccacgtccacgtgcatatgcgctacgatgcggatgctggcgaaaacgacctgagcctcctcgagctggaatggcctatccagtgccctggtgcaggattgcccgtgtgtacacccgaaaaggactttgccgagcaccttttaataccaagaactagagggctgttgtccggttgggcacgaaatggaaccgatctgggtaactcactgactacgcgtccggtcaccttggtggaaggcgaggagtgtgggcaggtgctgaatgtgacagttaccacaagaacgtactgcgaacggagcagtgtggccgcaatgcattggatggacggcagcgtggtgacgagagagcacaggggaagctggttcctgaccggggtgctgggcagccagccagtaggaggacaggcccatatggtactggtaacaaaagtatctagatactccctgtggttcaaacagattatgaactag

SEQ ID NO: 201797 - DNA, 1053 bp, Artificial Sequence
  Description of Artificial Sequence: Synthetic coding sequence
atggagcccaagcggatccgggagggctacctggtgaagaagggctcggtgtttaatacctggaagccaatgtgggtcgtccttctggaggatggcatcgaattttataaaaaaaaatcagataattcccccaaggggatgatacccctgaagggatctacgctgacaagcccgtgtcaggactttgggaagcgaatgttcgtcttcaaaataactaccacaaagcaacaggaccatttcttccaggcagctttcctggaagagcgggatgcatgggtaagggacattaagaaggctataaagtgcatcgagggcgggcagaagtttgccagaaaatccaccagacgttctattcggttgccagagacaatcgacctcggtgcgctctacttgtctatgaaagacacagagaagggaataaaggaactgaacctggaaaaggataagaaaatatttaaccattgctttaccggtaactgtgtgatcgattggctggtgagcaatcaatcagtgaggaatcgtcaggagggtctgatgatcgcaagttctctcctgaacgagggttatctacagcccgctggagacatgtccaaatctgccgtcgatgggactgccgagaatccgttcttggataacccagacgccttctactattttcctgattcaggatttttctgcgaagagaacagtagcgacgacgacgtcatcctgaaagaggaattccggggggtgatcatcaaacagggctgccttctcaaacagggacacaggcggaagaattggaaagttaggaaattcatacttcgagaggatccagcttacctccactattacgacccggccggcgcggaagaccccttgggcgcgattcacttgcgaggatgtgtggtgacctccgtggaatctaattcgaatggaaggaagagcgaggaggaaaacctgttcgagattattacggccgatgaggtacactactttctccaggcggccacacccaaggagagaacggaatggatcagagctattcagatggcaagcaggaccgggaagtag

SEQ ID NO: 201798 - DNA, 648 bp, Artificial Sequence
  Description of Artificial Sequence: Synthetic coding sequence
atggccagcctgcagatgcggggcaaccccggcagccacttctgcggcgggaccttgattcacccatcatttgttctgactgcggcgcattgtctgagagatatccctcagaggctggtaaacgtggtattaggggcacacaatgtgcgcacacaagaacccacccagcagcatttctccgtggcacaagtcttcctgaataactacgacgctgagaacaaactgaacgacgtactgctaatccaactcagcagtcctgccaatctgtctgcctccgtggccaccgtacagctgccccaacaggaccagccggttccacatggaactcagtgcctagcaatgggctggggaagagtcggggcccatgaccctcctgctcaggtgctgcaggagctgaatgttacagtggtcacttttttttgtaggccccataacatatgtacatttgtcccgcggcggaaggctggcatctgtttcggcgactccggcggacctcttatttgtgatggaatcattcaggggatcgatagtttcgtaatttggggctgtgcaaccaggttatttcctgactttttcaccagggtggctctgtacgtagactggatcagatcgactttaagacgagtggaggcaaaggggcggccctag

SEQ ID NO: 201799 - DNA, 858 bp, Artificial Sequence
  Description of Artificial Sequence: Synthetic coding sequence
atgcccggcgcccggagcggcggcagcggcggcgacggcagcaacagcggaagttattctggtgatgccagcggagcggtgactgtgtgggaggttgtgagcctactgggaaagcttctgggcacggtcgtcgctctgaaagtggtgctgtacttactcagagtctgcctagcgatggcctggaagtcaggtggcgcctcacattctgagctgattcataatctgcgtaaaaacgggatcataaagacagacaaggtgttcgaggtaatgctggccacagatagaagccactatgctaaatgtaacccttatatggactctccgcagtccatcggtttccaggctacgataagcgctccacacatgcacgcatatgccctggagttgcttttcgatcagctccatgaaggcgccaaagccctggacgtcggcagcgggtctggcatcttaactgcatgtttcgccaggatggttggttgcacaggaaaggtgattggaatagatcacattaaagaacttgtagatgacagcgttaataacgtgcggaaggatgatccaaccttgctcagtagcggtagagtgcagctggtagtaggggatgggcggatgggttacgccgaggaggccccctacgacgcaatccatgtcggagcagccgcgcccgtcgtacctcaggctctcatcgaccagctaaagcccggcggtaggctaatattgcccgtggggccagccggaggcaaccagatgctcgagcagtacgacaagctgcaggacggatccataaagatgaagcctctgatgggcgtcatatatgttcctttgaccgataaagaaaagcaatggtcacgctggaagtag

SEQ ID NO: 201800 - DNA, 684 bp, Artificial Sequence
  Description of Artificial Sequence: Synthetic coding sequence
atggcctggaagagcggcggcgccagccacagcgagctgatccacaatcttaggaagaacggtattataaagactgataaagtattcgaggtcatgcttgctaccgaccgtagtcactatgctaagtgcaatccttacatggacagcccgcagtcaatcggattccaggccaccatctcagcgccacacatgcatgcttacgctcttgagctgctgttcgatcagctccatgagggggccaaagctctggacgttgggtctggtagcggcatcctcacggcatgcttcgcaaggatggtgggatgcacaggcaaggtgatcgggatcgatcatatcaaggaactggtggatgactcagtgaataacgtgcggaaagatgatcccaccctgctgtcatctggaagagtgcaactagtcgtgggagacggccggatgggctatgccgaagaagctccttacgacgcaatccatgttggggcagccgctccggtggttccacaggcacttatcgaccaacttaaacccggaggccgcttaattcttcccgtgggaccagcaggcggtaaccagatgttggagcaatacgacaaactccaagatggcagcatcaagatgaaacctctcatgggcgtgatctatgttcctctgacagataaggaaaagcagtggtcaaggtggaaatag

SEQ ID NO: 201801 - DNA, 861 bp, Artificial Sequence
  Description of Artificial Sequence: Synthetic coding sequence
atgcccggcgcccggagcggcggcagcggcggcgacggcagcaactctggttcctactcaggagatgccagcggagcagttacggtgtgggaggtcgtgtcactcctgggcaagctgctggggaccgtggtggcactcaaagtggttctgtacctgttgcgcgtttgtctggcaatggcttggaagagcgggggggcctcccacagtgaactgatacataatctcaggaagaatggtatcatcaagacagacaaagtgttcgaggtgatgttagcaactgaccgttcccactacgctaaatgcaatccatatatggactccccacagagcatcggcttccaagccactattagcgcaccccacatgcatgcatatgccctggaactcctcttcgatcagctccatgagggtgctaaggcgctggatgtgggaagcgggtctggcatactgaccgcctgcttcgctcgaatggttggttgcacaggcaaagtgatcggcatagatcacatcaaagagctggtggacgatagtgtgaataatgtccgcaaggatgatcccaccctattatccagcggcagagtccagcttgtcgtgggcgatggtcgcatggggtatgctgaggaagctccctatgacgccatccacgtcggcgctgccgcccctgtggtgccacaagcgctgatcgatcaactgaagcctggcggacgcctgatcttgcctgtgggccccgctggaggaaaccagatgttagaacagtatgacaaactccaggatggctccatcaaaatgaagcctcttatgggggtgatctacgtgccgcttacagacaaggaaaaacagtggtccagagacgagctgtag

SEQ ID NO: 201802 - DNA, 858 bp, Artificial Sequence
  Description of Artificial Sequence: Synthetic coding sequence
atgcccggcgcccggagcggcggcagcggcggcgacggcagcaacagtggtagctacagcggggatgccagtggggccgtaacagtatgggaggtggtgtcacttttgggaaagctgctagggacagtagtggccctgaaagtcgtgctctatctgctacgcgtctgtctggctatggcgtggaaatctggaggggcctcacactcggagctgatacacaacctgcggaaaaatgggatcataaaaacagacaaggtgttcgaggtgatgttagccacagatagaagccactatgctaaatgtaacccctacatggattccccacaatctattgggtttcaagcgaccatctcggctccgcatatgcacgcatatgcacttgaactgctgttcgatcaactccacgagggcgccaaggccttggacgtaggaagcggatccggaattctcaccgcctgcttcgcaagaatggtggggtgcactgggaaagtgataggcatcgaccatatcaaggaacttgtggacgatagtgtgaacaatgtgcggaaggacgaccctactttgctctcatcaggcagagttcagctggtcgttggggacggccgcatgggttacgccgaggaggctccctacgacgctatacacgtcggggctgctgcccccgtggtgccccaggccttgatcgatcaactgaagcccggcggcaggctcatcctgcccgtcgggcccgccggcgggaaccagatgctggaacagtacgacaaactgcaggatgggagtataaagatgaagcccttgatgggagtcatctacgtgccacttactgataaggagaaacagtggagcaggtggaaatag

SEQ ID NO: 201803 - DNA, 579 bp, Artificial Sequence
  Description of Artificial Sequence: Synthetic coding sequence
atggcctggaagagcggcggcgccagccacagcgagctgatccacaatctcaggtcctttcaggccaccattagcgctccacacatgcatgcctacgcgctggaactccttttcgatcagcttcatgaaggagctaaggctctggacgtggggagcggcagcggtatcctcactgcttgttttgccaggatggtggggtgcacaggcaaagtgataggtatagatcatatcaaagaacttgtggacgactcggtgaataatgtccggaaggatgacccaacattgctgagcagtggacgcgtacaactggtggttggggacgggcgaatgggctatgccgaagaggctccctatgacgccattcacgttggggccgctgcacccgtggtgccccaggcattaatcgatcagcttaagcccggaggccgattgatcctcccagtgggaccggctgggggaaaccagatgttggaacagtatgacaaactccaggacggctccatcaaaatgaaaccacttatgggagtcatctacgtgcccctgaccgacaaggagaagcagtggtctagatggaagtag

SEQ ID NO: 201804 - DNA, 2016 bp, Artificial Sequence
  Description of Artificial Sequence: Synthetic coding sequence
atgaagcagatcttcttcctggacgacagcggcccccccttcggccatatggtcctggccttgggcggatatttgggcggcttcgatggtaatttcctttggaatagaatcggggccgaatattcctctaatgttcccgtgtggtccttaagactccttccagccctggcaggagcgctgagcgtgcccatggcctaccagatcgtgttggagctacatttcagtcattgcgctgcaatgggcgcggccttgttgatgttgattgagaatgccctcatcactcagtcccgactcatgcttcttgaatcagtgctgatctttttcaatctcctggccgtgctgagctacctcaaattctttaattgccagaagcacagtccattttctttaagctggtggttttggctaactcttactggtgttgcttgttcgtgtgctgttgggatcaagtacatgggcgtattcacctatgtgctggtcctcggagtggcagcagtacacgcttggcatttgctgggagatcagaccctgagcaatgtctgtgtgttttgccacctgctggcgcgagctgtcgccctactggtgatccctgtagtcttgtacctcctgttcttctatgtacacttgattctcgtttttagaagcggaccgcacgaccaaatcatgagttccgctttccaggcctccctggagggcggacttgccaggattacgcagggccagccgctggaagtggcatttggatctcaggtaactctgcggaacgtttttggtaagcctgtaccctgttggcttcattctcatcaggacacataccctatgatctatgaaaatggcaggggctctagccaccagcagcaagtgacttgctaccccttcaaggacgtgaacaattggtggatagtgaaagacccccggcgacaccagctggtggtctcttcccctcctaggcctgtgaggcatggcgacatggtgcagctggtccacgggatgaccacgagatcgcttaacacccatgatgtggcggccccgttatctccacattcacaagaagtgagctgctatatcgactacaacatttcaatgcccgctcagaacctatggcgcctggagatcgtaaataggggatccgacaccgatgtctggaaaaccatcctttccgaggttcgctttgtccacgttaacacttctgccgtcctgaagctgagcggcgcacatctccctgattggggctatcggcaacttgaaattgtgggcgagaaattatctagaggataccacggttctaccgtgtggaatgtggaagagcatcgatatggggctagccaggagcagcgggaacgggagcgggagttgcattcgcctgctcaagttgatgtttcacgcaacctgtctttcatggccagatttagcgaattgcagtggcgaatgctagcactgcgtagcgacgactccgagcacaagtactcaagttcccctctggaatgggttaccctggataccaatattgcatactggctccacccacgcacttcagcccagatccacttactcgggaatattgtcatttgggtttccggatcactcgccctggccatctacgctttgctgtccttatggtatctgctcagaaggaggaggaatgtccacgacctgccccaagacgcttggctgaggtgggttttggctggtgctctctgtgccgggggatgggccgtgaattacctgccgttttttctcatggaaaaaaccctttttctttatcactatctcccagcgctcacattccaaattctactcctgccagttgttctacagcatatatcggatcatttgtgcagatcgcagttgcagaggtctattttctctgcactggtggtggcctggtacagcagtgcctgtcacgtgagcaacacgttgcgaccactgacctatggtgataaatccctttcaccacacgagttaaaggcgctgaggtggaaggatagttgggacatcctgatccgaaagcattag

SEQ ID NO: 201805 - DNA, 2088 bp, Artificial Sequence
  Description of Artificial Sequence: Synthetic coding sequence
atgtggggcttcctgaagcggcccgtggtggtgaccgccgacatcaatttgagcctggtggccctgactggtatgggcctgctctctcgtctgtggaggcttacctacccacgtgctgtcgtcttatttcggcgcatacgctggcagttcttcgtcgagcagaactggtcaagcgtcgtggcctttcccgaatactcatccaatgtgccagtgtggtcactccggcttctgcctgcactggcaggagctctgagtgtgcccatggcttatcagattgttctggaacttcacttctcccattgtgctgccatgggggctgctcttctcatgctgattgaaaatgctctcatcacacagtcgcggctgatgttgctcgagtccgtgcttattttcttcaacctcctggccgtgctgtcttaccttaagttttttaactgtcagaagcatagtccatttagtctatcttggtggttttggttaaccctgactggggttgcttgttcttgcgctgtcggcattaagtatatgggagtgttcacatacgtactcgtgctgggagtcgcagcagtccacgcatggcatctgctgggagatcagaccctgtccaacgtatgcgtcttctgccacctgctcgctagggctgttgcactactcgtcattccagtggtgctgtatttgctttttttctacgtgcacctgattctggtgttccggtctggccctcacgatcaaatcatgagctcggctttccaggcctccttggaaggggggctcgctagaatcacccagggccagcccttagaagtggccttcggcagccaggttaccctcagaaacgtgttcggaaagcctgtcccatgctggctgcattcccaccaggatacttacccaatgatctatgagaacggtcgaggcagtagtcaccagcagcaggttacatgctatcctttcaaagatgtgaataattggtggatagttaaagatccaagaaggcaccagctcgttgttagttcccctcctcgcccagttcgtcacggggacatggtccagctggtccacggtatgacaacccgttcgctaaacacgcacgacgtagcggctcctttgtctccacattcccaggaagtaagctgctacatcgactataatatctctatgccagcccagaacctgtggcggctggaaatcgtgaaccgtggctccgacacggatgtttggaaaaccatcctcagcgaagtgcgcttcgtccacgtgaatacctcggccgttcttaagttaagtggagcccaccttcccgactggggatacaggcagcttgagatagtcggggagaagctgtctaggggttaccatggttccacagtgtggaacgtcgaggaacatcgttatggagcctcacaagagcagagagaacgcgaacgggagctccatagtcctgctcaggttgatgtgagcaggaatctgagctttatggcccgattctctgaactccagtggcgcatgctcgctctacgctctgacgactcagagcataaatactcctctagcccgcttgagtgggtaactcttgatactaatatcgcatattggctgcatccgcgcacctcagcccagattcacctattgggcaatattgtcatatgggtgagcggaagtctcgcacttgccatctacgcccttctctctctctggtacctcctgcggcggaggcggaatgtccacgacctcccacaagatgcttggctccggtgggtattagctggcgcactgtgcgccggaggatgggcggtgaactacttgcccttcttcttaatggaaaaaactctcttcctttaccactatctacctgctctgaccttccagatccttctgttaccagttgtcctccagcatatttccgaccacctgtgccgcagccagcttcaacgatctatctttagtgccttggttgtagcgtggtactctagcgcctgccatgtttcaaataccctgaggcccttgacctatggtgataaaagtcttagtccccacgaattgaaggctttgcggtggaaagacagttgggacatcctgatacgaaaacattag

SEQ ID NO: 201806 - DNA, 1041 bp, Artificial Sequence
  Description of Artificial Sequence: Synthetic coding sequence
tggcggggcggcggctgcaccagccccgccaccctgggcgccgcccggggcgctgtcgggatcgggaaggaggggcagtaccagcccctcattgcttcactgacctgggggcttgtgcctctctcacaagcgcaggagatcgtaaacagggggagcgataccgacgtctggaaaactatcttatcagaagttaggttcgtccatgtgaatacaagcgctgtattaaagctgagcggggcccatctcccagactggggctaccgccagctcgaaattgttggggaaaaactatccagagggtatcacgggtcgaccgtatggaacgtggaagaacatcgctacggggcctcccaggaacaaagggagcgcgagagggaattacactctcctgcccaggtagatgtctctcgtaacctgtcttttatggcccggttcagtgaactgcaatggagaatgcttgccctgagatcagacgactcagagcacaagtactcctcaagtcctctcgaatgggtaacacttgataccaatatcgcttactggctccacccaagaaccagcgcccagattcacctcttaggaaatatcgtgatctgggtctccggtagtctcgcacttgcaatatacgcactcttgtccctatggtatctgctgaggcgccggcgaaatgtgcacgatcttccccaggatgcctggctaagatgggtgctggcaggcgccctgtgcgctggaggctgggcagtcaattatttaccgttttttctgatggaaaaaacactgtttctgtaccactacctgcctgccctaacctttcagatcctgctgttgccggtcgtgcttcagcacattagcgaccacctgtgccggagccagctgcagcggagcattttctctgctctggtggtggcgtggtactccagtgcttgccacgttagcaataccctccgtccactcacttacggtgacaaatccttgagcccgcatgagctgaaggcgcttagatggaaggatagctgggatattttgatccggaaacactag

SEQ ID NO: 201807 - DNA, 471 bp, Artificial Sequence
  Description of Artificial Sequence: Synthetic coding sequence
atggcctaccagatcgtgctggagctgcacttcagccactgcgccgctatgggtgccgccctcttaatgctcatcgagaacgctctgatcacccagtcacgcctgatgttactggagtctgtgctcatattcttcaacttgttggccgtcctgagttatctgaagtttttcaattgtcaaaaacatagtctgcccctatgggccccccgtcctaaccacgtccagtgtcttcccggacagttaagggggcgcacttcaagtgaccactccggttctgccactggcgggggcttatgggtgcccggccatagtgaggaaaggctgtgggaaacctgtgcgctgctagcaagcttccctcccgggcacctgccccatgatgtgcgatacgaaaatggtcgtgggtcttctcaccagcagcaggtgacctgctaccccttcaaagacgtgaataactggtggatcgtgaagtag

SEQ ID NO: 201808 - DNA, 2244 bp, Artificial Sequence
  Description of Artificial Sequence: Synthetic coding sequence
atgtggggcttcctgaagcggcccgtggtggtgaccgccgacatcaatcttagcctcgtcgccctaaccggcatgggtctcttgtctcgcctctggcgcctcacatacccgcgcgcggtagtgttcgatgaagtctactatggccagtacatctccttttatatgaaacagatttttttccttgacgacagcggacccccgtttggccatatggtgctggctctgggcggatatctgggagggtttgatggcaactttctatggaacagaattggggcggagtacagttcaaacgtgccagtttggagcttacgtctgctgcccgcacttgcgggggctttgtctgtgcccatggcctatcaaattgtgttggagcttcacttcagtcactgcgccgccatgggagccgccctgttaatgctaattgagaatgcgctaattacccagtcccgcctcatgttgcttgaaagcgttctgattttttttaaccttctggctgtgctgagttacctcaagttcttcaattgccagaaacattcaccattttcgttatcttggtggttctggttgaccctcacaggcgttgcctgttcctgcgcggttggaatcaagtacatgggagtcttcacgtatgtactcgtgctcggtgttgctgctgtgcacgcttggcatttactgggcgaccagactctgagcaatgtcggcgccgacgttcagtgctgtatgaggcccgcctgtatgggacagatgcagatgtctcagggcgtgtgcgtattctgccatttattagctcgcgcagtcgcattgttggtgatacccgttgtgctgtatttgctgttcttctacgtgcatctgatacttgtctttcgaagcggaccacatgatcaaatcatgtcctcagctttccaagctagcttggagggtggactggctcggatcacacagggccagccattagaggtggccttcgggtctcaggtaaccctgcgaaatgtattcggcaaacccgtgccatgctggctccattctcatcaggacacttatcccatgatatacgagaacggccgcggttcctcacatcagcaacaggttacatgttatccatttaaggacgtgaataactggtggatcgtgaaggatccacgcagacatcagttggtggtgagctcgcctcccagacctgtgcgccacggcgacatggtgcagctagttcatggcatgactacacggagcctgaacacacacgacgtggcagcgcccctgtcccctcactctcaggaggtgtcctgctacattgactacaatatttctatgcccgcccaaaacctttggcgtcttgaaattgtcaaccgggggtctgacactgacgtttggaaaacaatattatccgaggtgcggttcgtgcatgtgaatactagcgccgtccttaagctttcaggcgcccatttgcctgactggggctacagacagttagaaatcgtgggggaaaaactgtctcgtggatatcacggatcgaccgtctggaatgtggaggagcataggtatggcgccagccaggagcagagggagagggagagggagttgcactcccccgcccaggtggatgtgagtcggaacttatcattcatggccagattttctgagttacagtggcgaatgctggccctgcggtcagatgactcagagcataaatattcctcaagcccgctggaatgggtcactctggatacaaacatagcctactggcttcatccacggacctccgctcagatccacttgcttggtaatatcgtgatttgggtctctggaagcctcgccctggctatctacgcccttctgtctctttggtacctgttgaggcgtcggcggaatgtgcacgacctgcctcaggatgcctggctgcggtgggtgctggctggagcattgtgcgcaggcggctgggcagtgaattaccttccattttttctgatggagaagacattgtttctctaccattatctcccagcacttacttttcagatactgctgctacctgtagttctgcaacacattagcgatcacttatgcaggtcgcaactgcagcggagtatcttcagcgccctggtcgtcgcttggtacagctccgcctgtcatgtaagcaacacccttaggcccctgacttatggggacaaaagtctcagtccccacgagctcaaagcgctccgatggaaagatagctgggatatactgattcgtaaacattag

SEQ ID NO: 201809 - DNA, 2178 bp, Artificial Sequence
  Description of Artificial Sequence: Synthetic coding sequence
atgtggggcttcctgaagcggcccgtggtggtgaccgccgacatcaatctgtctctggtcgctctgacaggtatgggcctgctgagcaggctgtggaggttgacttacccgcgcgctgttgtatttgacgaggtgtactacgggcagtacatatcgttttacatgaagcagatctttttccttgacgattccggccctccatttgggcatatggtgctcgcccttggtggctacctgggaggctttgatggtaattttttatggaatcgtatcggcgcagaatattcaagtaatgttccggtttggtctctgagactgttaccggcactggcgggggccctatctgtcccaatggcctaccagatcgtcctcgaattacacttctcgcattgcgcggccatgggagccgctctccttatgctgatcgaaaatgcattaattacacagtctcggttgatgcttctggaatcggtgttgattttttttaatcttctagctgtcttaagctatctgaaattttttaattgtcagaagcatagccctttttctctgtcttggtggttctggctcacattgacaggtgtagcctgttcttgcgccgtagggatcaagtacatgggcgttttcacttacgtgctggttctgggagtggctgcagtgcatgcttggcatttactgggcgaccagacgctgagcaatgtgtgcgttttctgtcatctgctcgcacgggcggttgccctgctggtgatccctgtggtcctctatctgctgttcttttacgtccatctgatcttagtgtttcgcagtggtcctcacgaccagattatgagctccgccttccaagcatctctggagggcgggcttgcccgcattactcaaggccaacccctggaggttgcatttggatcccaggtgacactccgcaatgttttcggaaagccagtcccatgctggctacactcccatcaggacacttacccgatgatttacgaaaatggccgcgggtcgtctcaccagcagcaggtgacgtgctatccttttaaggatgtgaacaactggtggatcgtgaaagatcctagacgccatcagctggttgtgtcctctccacctcgtcctgtcaggcacggtgatatggtccaactcgttcatggcatgactacccgtagtctgaacacccatgatgttgccgcccccctgagtccgcactcccaggaagtgtcatgttatatcgattacaacatttcaatgcctgctcaaaatctgtggcgattagaaatcgtgaatagggggagtgacacagacgtgtggaaaactatcctgagcgaagtgcggttcgttcacgttaacacatctgcagtgctgaagttgagcggcgctcacctccctgactggggatatagacagttagagattgttggagagaagttgagtagagggtaccatggatccacagtgtggaatgtggaggagcatcgctatggggcgtcccaggaacagagagagagagaaagggaactacactcaccggcacaggtggatgtttcccggaatctatcctttatggcgcgatttagtgaacttcaatggcgaatgctggccctcagaagtgatgattccgagcataaatatagctctagtcccctggagtgggtgacactggatactaatattgcttactggctgcatccccggacatctgcgcagattcatctcttgggaaatatcgtcatttgggtgagcggctcactggccctcgccatttatgcactgctctcactctggtatctgttacgacgccggaggaacgtgcacgatttgccacaggacgcctggttgcgatgggtgcttgctggagcgctctgcgccggtggctgggcagtcaactatctgcccttcttccttatggaaaagacgttattcctgtatcattacctccccgcacttaccttccagatactcctgcttccagtggtgcttcaacatatcagcgaccatctctgtaggtcccagctgcagcggtcaatattctccgcactcgtggtggcctggtactcaagcgcctgtcatgtgtctaacacactgcgtccactaacgtatggcgataaatccctaagccctcatgaattaaaagcgcttagatggaaagatagttgggatatactgatacgtaagcactag

SEQ ID NO: 201810 - DNA, 1827 bp, Artificial Sequence
  Description of Artificial Sequence: Synthetic coding sequence
atggcctaccagatcgtgctggagctgcacttcagccactgcgccgccatgggcgccgccctccttatgctgatagagaatgctctgattacccagtctaggctgatgcttctggaatctgtactaatcttcttcaacctgctggcagtgctgtcttacctaaagttttttaactgtcagaagcattccccattttcactgtcttggtggttctggttgactcttaccggcgttgcgtgcagctgtgcggttggaattaaatacatgggagtattcacgtacgtcctggttctgggcgttgctgccgttcacgcctggcacctgctgggcgatcagacactatctaacgtttgcgtgttctgccacttgctcgcaagagccgttgccctcctcgtgatccccgtggtgctttatctgctgttcttctatgtgcatctgatcctggtgttccgcagcggcccccacgaccagataatgtcgtcggctttccaggcctcgctcgagggaggactggcgcggattacccaggggcagcccctcgaagtagcctttgggtcccaagtcaccctgagaaatgtttttggaaaacctgtgccctgctggctgcactcacaccaggacacataccctatgatttatgagaatggcaggggctcgagccaccagcaacaggtgacatgctaccccttcaaagatgtgaacaactggtggatcgtgaaggatccccggcgtcatcaacttgtggttagctccccccccagaccagttcgacatggggatatggtacagctcgtccatgggatgaccacccgaagcctgaatacacacgatgtggcagcaccactttcacctcactctcaagaggtgtcgtgctacattgattacaacatcagcatgcccgcacagaatctctggcgcctggaaattgttaaccgagggtctgatactgacgtgtggaagacaatactcagcgaagttaggttcgtccacgttaacacctctgctgtgttgaagctgagcggggctcatctgcctgactgggggtaccggcaactcgagatcgtaggcgaaaaacttagcaggggctaccacggctctacagtgtggaatgtcgaggagcacagatatggtgccagccaagagcagcgcgaaagagagcgcgaattgcattcccccgcacaggtcgacgtcagtcgtaacctttcattcatggcccggttctccgagctgcaatggaggatgctggcgctgcgcagcgatgactctgaacacaaatattcaagctctcccttggagtgggtgactctggataccaacatcgcttactggttgcatcctcgcacaagcgcacagatccacttgctgggcaacatcgtcatatgggtatcaggctctcttgctctggccatttatgccctgctatccctgtggtatctgctgcggaggaggagaaatgtgcacgacttgccccaggatgcctggctgcgttgggtactggctggcgcactctgcgcaggaggctgggctgtcaattacctgcctttctttctgatggaaaaaaccctatttctgtatcattatttacctgctctcactttccagattctgctcctgcccgtagtgcttcaacatatctccgatcatttgtgtagaagccagttacagcgtagcattttctcagctttggtcgtagcttggtactcctctgcgtgccacgtgtctaatactctgagacccctcacatatggtgacaagtcgctaagcccccatgagctcaaggccttaaggtggaaggactcctgggatatcctgatcaggaagcactag

SEQ ID NO: 201811 - DNA, 471 bp, Artificial Sequence
  Description of Artificial Sequence: Synthetic coding sequence
atggcctaccagatcgtgctggagctgcacttcagccactgcgccgctatgggggctgccctactaatgttaatcgagaatgcactgatcacccagtcacggttgatgctgcttgagagcgtgctaattttttttaacctcctcgcagtgctgagctatctgaagttctttaattgccagaaacattcgctgcccctatgggcccccaggcctaaccatgtacagtgcctgcctggacaactcaggggcagaacaagtagcgatcattcagggtctgctactggaggtggattgtgggtccccggtcactccgaagaaaggctgtgggagacctgcgcacttctggcatctttccctcccggacacctcccccacgacgttagatacgaaaacggacgggggtcttcccatcagcaacaggtcacctgttatccatttaaagacgtgaacaactggtggattgtgaaatag

SEQ ID NO: 201812 - DNA, 429 bp, Artificial Sequence
  Description of Artificial Sequence: Synthetic coding sequence
atgtggggcttcctgaagcggcccgtggtggtgaccgccgacatcaacctctccctcgtggcactgactggcatgggcctgctgagccggctgtggcgattgacatatccgcgcgcggtcgtgttcgatgaggtctattatggacagtatatctccttctatatgaaacagatcttcttccttgatgactccggcccgcccttcggacatatggtccttgctctgggcgggtacctggggggttttgatggtaacttcctgtggaatcgcatcggagctgagtattcgtctaatgtgcctgtgtggagcctccgactccttcccgccctcgccggggcactcagcgtacccatggcctaccaaatcgtgctggaactccatttctcacattgtgctgctatgggcgccgccctcctgatgctgatctag

SEQ ID NO: 201813 - DNA, 1722 bp, Artificial Sequence
  Description of Artificial Sequence: Synthetic coding sequence
atgctgctggagagcgtgctgatcttcttcaacctgctggccgtgttgtcctacctaaagtttttcaactgtcaaaagcattcacctttctctctctcttggtggttctggcttactttgacaggcgtggcatgtagctgtgctgtgggaataaagtacatgggagtatttacatacgtcttagtgcttggtgttgcagctgttcacgcttggcacctgttgggtgatcaaactctctccaacgtgtgtgtcttttgccacctccttgcacgagcggtggctctgcttgttatcccagtagtcctctatctcctttttttttatgttcacttgatcttggtgttccgaagcggaccccacgaccaaattatgagctctgccttccaagcctcgctcgagggaggcctcgctcgaataacacagggacagccacttgaggtggcctttggaagccaggtaacccttcggaatgttttcgggaaaccggtgccctgctggctgcatagccaccaggatacctaccccatgatctacgagaatgggaggggtagttcccatcaacagcaggtgacatgttacccgttcaaggatgttaataactggtggattgtcaaagaccctaggagacatcaactagtggtgtccagccctcctagacccgtccggcacggggacatggtacagctggtacacgggatgaccaccaggagtctgaatactcatgacgttgccgcccccctgtcgcctcattctcaggaggttagttgttacatcgactacaacatcagcatgcccgcccagaacctgtggaggttggagattgtcaataggggaagcgacaccgacgtgtggaaaactatcttgtctgaagtgagattcgtgcatgttaacacatccgccgtgctaaagctcagcggggcccacctacctgattggggttatcgccagcttgagatcgtcggggaaaagctctcccggggatatcatggcagtactgtctggaatgtggaggaacataggtatggcgcgtctcaggagcaaagggagagggaaagggagcttcacagccctgctcaggttgatgtgtctcgaaatctgtcatttatggcaagattctcagagctgcagtggcgtatgctggcactccggagcgacgatagcgagcataagtacagttcgagtcctttggagtgggtgaccctggacactaatattgcctattggctgcaccccagaaccagcgcccaaattcacctgttgggcaacatcgttatttgggtgtccggctctctcgcactggccatctacgctcttctgtctctatggtatctccttcggaggcgtcggaatgtccatgacctgcctcaggacgcctggttgcggtgggtgctggctggggctctttgtgccggcggatgggccgtgaattatcttcctttctttctgatggagaaaacactgttcttgtatcattacctgccagccctcacttttcaaatcctcctcctccctgtcgtgcttcaacatatctccgaccacctatgcagaagccaattacagcgatccattttctctgccctggtggtggcttggtacagttctgcgtgccacgtttctaacactctgaggccgcttacttatggggataagtccttgtcacctcacgaactgaaggctctgagatggaaggactcctgggacatcctgatcagaaagcattag

SEQ ID NO: 201814 - DNA, 2178 bp, Artificial Sequence
  Description of Artificial Sequence: Synthetic coding sequence
atgtggggcttcctgaagcggcccgtggtggtgaccgccgacatcaatctatccctggtggcacttacaggtatgggccttctgtctaggctgtggcgactcacatatccccgggccgtggtgttcgacgaagtctattacggacaatacatctcattctatatgaaacagattttttttctcgacgactctggacccccattcggacatatggtcctcgccctaggggggtatttgggggggtttgacggaaacttcctgtggaacagaattggtgctgaatacagcagcaacgtgccagtctggagcctcagattgcttccagccctggccggggctctgtctgtgccgatggcctaccagatcgtgctggaactgcatttcagccactgcgctgcaatgggcgcggcccttctcatgcttatcgagaacgctctgattactcagtcccgtctcatgctgctggaaagcgtgttgatcttcttcaatctgctggccgtgctgtcatacttgaaattcttcaattgtcagaagcattctcccttctccctgtcatggtggttttggttgacgctgacaggggtagcatgcagttgcgcagtcggcatcaaatacatgggtgtctttacctacgtgcttgtgctgggggtcgccgctgtccatgcgtggcatctgcttggcgaccagactctcagcaacgtgtgcgtattttgtcatctgctggcaagagccgtcgcactgttagtgatcccagtggttctgtatctgctgtttttttatgtgcaccttatactggtctttcggtcgggcccccatgatcagatcatgtcctccgcatttcaggcatccctagaaggcggacttgcaaggattactcaaggacagccgcttgaagttgcattcggatctcaggttacccttcggaatgtcttcggtaagcccgtaccttgctggctacacagccaccaggatacataccccatgatatacgagaatggccggggcagcagccaccaacaacaggtgacatgctatcctttcaaggacgttaacaattggtggattgtcaaagaccccaggaggcatcaattggttgtatcttctcccccccgacctgtcagacacggagatatggtgcagctggtgcatggcatgaccacacgctccctcaatacccacgacgttgctgcccccctgtctccccattcacaggaggtttcgtgctacatcgactacaatatctctatgcctgcacagaacctgtggcggcttgagatcgtaaaccgaggaagcgatacggatgtgtggaagacaattctaagcgaggtgaggtttgtccacgttaataccagcgccgtgcttaagctaagcggagcacacctgcctgactggggctacagacagctcgaaatcgtgggagagaaactctctaggggctatcatggcagcactgtgtggaatgtggaagaacatcggtacggtgcttctcaggaacagagggagagagagcgggaactacattcaccggctcaggtggatgtctcgcgaaatctgtctttcatggcgcgcttcagcgagttgcagtggcggatgctagccctgcggtccgacgacagcgaacataaatactctagttctcctttagagtgggtaaccctggacaccaatattgcatattggctgcatccacgcaccagcgcacaaatccatcttctcggaaacatagtgatatgggtgtccggtagtttagccctggcaatctatgcattgctgagcctgtggtacttgttaagaagacgcaggaacgttcacgacctgccccaggacgcttggctccgatgggtgctggctggcgctctctgtgccggaggctgggctgtcaattacctcccgttcttcctaatggagaagacccttttcctttatcattacttaccagcccttacgtttcaaattctactgctgcccgtggtgttgcagcacatctccgaccatctgtgcagaagtcagctccagaggtcaatattttccgcgctggtcgttgcctggtactcctcggcatgccacgtttccaacacactccgtcccctgacctacggagataaatctttatcgcctcacgagctaaaggccctcaggtggaaggactcgtgggatattctcatcaggaagcattag

SEQ ID NO: 201815 - DNA, 507 bp, Artificial Sequence
  Description of Artificial Sequence: Synthetic coding sequence
atggcctaccagatcgtgctggagctgcacttcagccactgcgccgcaatgggagccgcgctgcttatgcttatcgagaatgctcttattactcagtccaggctgatgctgctcgagtccgtcctgatctttttcaacctactggcagtgctcagttatctaaagttttttaattgccagaaacattcacctttctccctgtcctggtggttttggctgacactaacaggtgtggcttgtagttgcgccgtcggtatcaaatatatgggagtcttcacctacgttctggtcctgggtgtggccgccgtgcatgcctggcacttgttgggcgatcaaacgttgtcaaacgtgtgtgtcttttgccatctgctggcccgcgcggtggcgctcttggtaattccggtcgtcctgtacttattgtttttctatgtacatctgattctcgtgttccggtccggcccccatgatcagattatgtcttctgcattccaggcctctctcgaatag

SEQ ID NO: 201816 - DNA, 894 bp, Artificial Sequence
  Description of Artificial Sequence: Synthetic coding sequence
atggcctaccagatcgtgctggagctgcacttcagccactgcgccgctatgggggccgccctactgatgctaattgaaaacgctttaatcactcagagtcggctgatgttgctcgagtcggtgttgattttttttaaccttctagctgtgctcagctacctgaaattctttaattgccagaaacatagtccctttagcctctcctggtggttttggctgactctgacaggagtggcatgttcatgcgctgtgggcatcaaatacatgggggtattcacctacgtcttagttctcggggtcgccgctgtgcacgcctggcacctactcggggatcagactctgtcaaacgtcggagcagacgtgcaatgttgcatgcggccagcctgcatgggacagatgcagatgagccaaggagtgtgtgtcttttgccatcttctggcacgagcagttgccctactggtgattccagtggttttgtacctgctgtttttctacgtgcatttaatcctggtgttccgcagtggccctcacgaccagatcatgtcttcagcctttcaggccagccttgagggcggtctggcccgcattacccagggccaacctctcgaggtggcctttggctctcaagttaccttacgaaatgtgtttggaaaacccgttccctgttggctgcatagtcatcaggatacgtaccctatgatttacgagaatgggcgcggtagttcccatcaacagcaggtaacgtgttatcccttcaaggatgtcaataattggtggatagtcaaggacccacggagacaccagctggttgtttcttctccccctagacctgtcaggcacggcgacatggtacagctcgtacatgggatgaccaccagaagcctgaacacatag

SEQ ID NO: 201817 - DNA, 657 bp, Artificial Sequence
  Description of Artificial Sequence: Synthetic coding sequence
atgaagcagatcttcttcctggacgacagcggcccccccttcggccatatggtgctagcactgggtgggtatctgggagggttcgatggaaacttcctgtggaatagaattggggctgagtactcttccaacgtgcccgtttggagcctgcgtcttctccctgccctggcaggcgccctctctgtccccatggcatatcagatcgtgctggagttgcacttctcccactgtgctgccatgggcgccgcactgttgatgctcatagagaacgcgctcattacgcagtcacggctgatgctgctggagtcggtcctcatcttttttaacctcctggcggtgctgagctatcttaagttcttcaactgtcagaagcactccccgttttcgttgtcttggtggttttggctgactctgaccggcgtcgcctgttcctgcgcagtcggcatcaaatacatgggcgtgttcacctacgtgctggtactgggagtggcagctgttcatgcctggcaccttttgggagatcaaacactgtccaacgtgggagctgacgtgcagtgttgcatgagaccagcctgcatgggccagatgcagatgtcccaaggcgtgtgcgtgttttgccacctgctggctcgggcagtagcgcttctggttatttag

SEQ ID NO: 201818 - DNA, 1398 bp, Artificial Sequence
  Description of Artificial Sequence: Synthetic coding sequence
atggccatcttctgcggcaccgagctggagcaggtgtgcgtgttctgccacctgttagccagggctgtcgccctccttgtgatcccagtggtattgtacctcctgttcttctatgtccatttaatcctcgtgttcaggtctggcccccacgatcaaatcatgtcctctgcttttcaggcctcactcgagggtggtcttgcgagaatcacccagggccagcccttggaggtggcatttggcagccaagtgacactccgtaacgtgtttggaaaacccgtcccttgttggctacattcacaccaggacacctaccctatgatctacgaaaacggcagggggagcagccaccagcaacaagtcacctgttatccttttaaagacgttaataattggtggatcgtcaaagatccacggcggcatcagttggttgttagctcccctccccggcctgtgcgtcacggtgatatggtccagttggtccatggaatgacaactcgcagcttgaacacccacgacgtggcagcccccctgagtccccatagtcaagaagtctcatgctacattgactacaacatctccatgcctgctcagaacctgtggagacttgaaattgtgaatcgtggaagcgataccgatgtgtggaagaccatactcagcgaagttcgcttcgtccacgtcaataccagcgccgtgcttaagcttagtggtgctcacctgcctgactggggctataggcagttggaaattgtaggtgagaaacttagcaggggctaccacggctccacagtgtggaacgtggaggaacaccgctacggcgcctcccaggagcaacgcgagcgtgaaagggagctgcattctcctgcacaggtcgatgtgtctagaaatcttagtttcatggcacgattctccgagttgcaggctcagattcatcttttggggaatatcgttatttgggtctctggcagcctggccctggccatttacgccctgctctctctctggtaccttttgcgaagaaggcggaacgttcatgacctgccgcaagacgcatggctgagatgggtgctggccggggcattatgtgctggcggctgggctgtgaactatctccccttttttctgatggagaaaacgctgttcttgtaccattacctgccggccctcacattccagatattgctcctaccagttgtgttacagcatatctcagaccacttatgcagaagccaactgcagagatcaattttcagcgccctcgtggtcgcttggtactcatccgcttgtcatgtctccaacactttacggccccttacctacggcgacaagtccttatcacctcacgaactgaaagctctacggtggaaggatagctgggatattttaatcagaaaacactag

SEQ ID NO: 201819 - DNA, 2253 bp, Artificial Sequence
  Description of Artificial Sequence: Synthetic coding sequence
atgccccccgccaccggcggcggcctggccgagagcgagctgcggcctaggagaggaagatgcggaccacaagccgccagagccgccggtcgggatgtggccgccgaggctgtggccagaagccctaagaggcccgcttggggctcaagacggttcgaagcagtcggatggtgggctctcctggctttggttactctgctctcgttcgctacacgctttcataggctggatgaacctcctcacatctgttgggacgagactcacttcggaaaaatggggtcttactacataaatcgaacttttttcttcgacgtgcacccccctctgggtaagatgctaataggacttgccggctacctctcaggttacgatggcactttcctttttcagaagcccggcgacaagtacgagcaccattcttatatgggcatgcgagggttttgcgctttcctcggctcctggctggtgccgttcgcttacctcactgtcctggacctgagcaaatccctttcggcagcactgcttactgccgctctcctcacattcgataccggatgtttgaccctgagtcagtatatcttactggacccaatccttatgttctttatcatggcagctatgctgagtatggtgaagtataactcttgcgctgatcgcccattttccgccccttggtggttctggctttcccttaccggggtcagtctggccggcgctctgggcgtgaagtttgtgggactctttataatcttgcaggttggactcaacacaatagctgacctgtggtacctttttggcgacctatctttgtcactcgtaactgtgggcaaacatcttactgcccgcgttctctgtttgattgtgcttcccctcgctctctataccgcgacgtttgcagtacattttatggtgctttcaaagtccggccctggcgacggattcttctcttctgccttccaagcacggctttccgggaataatctccacaacgcttcaatacctgaacacctagcctatggatcggtcatcacagttaaaaacctacggatggctatcggctatttgcatagccaccgtcatctttaccccgaaggcattggtgcacggcaacagcaagtgactacctatctccataaggattataataatctttggatcatcaagaagcacaacacaaattccgaccctctggacccttcctttccagtggaattcgtgaggcacggggacattatccgactggagcacaaggagacatccagaaatctacattcacattatcatgaagcgcctatgacgcggaagcactatcaggtaaccggatatggcatcaacggaaccggtgatagcaatgatttctggaggattgaagtggtgaatcgaaaattcggcaaccgcatcaaggtgttgagatctagaatccgattcatacacctggtcaccggttgtgtgctgggctcatccggcaaagtgttgcccaaatggggctgggaacagctcgaagtgacttgtaccccatatctgaaggagacactgaatagtatctggaacgttgaagatcatattaatccaaagttgccgaatataagcctggatgtgctccaaccatccttccccgagattttactagagagtcacatggtcatgataaggggcaacagtggactgaagccaaaggataatgagtttacaagcaaaccgtggcattggcctataaactatcagggactcagattttctggggtcaacgacaccgattttagagtgtacctgttaggcaacccagttgtttggtggctgaacctgctcagcattgctctgtatttgttgagcggatctatcatcgctgtggctatgcaacgtggcgctcgactccctgccgaggttgccgggctgagtcaggttctgttacgaggtggggggcaggttctgctgggctggactctccattactttcctttttttctaatgggtcgggttctctactttcatcactacttccccgccatgctgttctctagcatgctgacaggaatactctgggataccctgctacgcctgtgcgcttggggactcgcttcgtggccgctggcccgagggattcatgtagctggaatcctctccctgctgctcgggacagcatattcattctatctttttcatcctctcgcttacggaatggtcggtcccttggctcaggacccgcagtcgccaatggccgggctgaggtggctcgattcctgggacttttag

SEQ ID NO: 201820 - DNA, 669 bp, Artificial Sequence
  Description of Artificial Sequence: Synthetic coding sequence
atgaagctgcccctgctgctggccctgctgttcggcgccgtgagcgccctgcacctgcgaagcgaaacctccacgttcgaaacaccactaggtgcaaagacactacccgaggacgaggagactcccgagcaggagatggaagaaaccccctgccgggaactggaagaggaggaggaatggggttcaggatccgaagacgccagtaaaaaggatggggccgtggaaagtatctctgtgccagacatggtcgacaaaaacctcacctgtccagaggaggaggacacagtcaaagtggtgggcatcccaggctgtcaaacctgtagatacctcctggtgaggtcgttgcaaaccttctcgcaggcatggttcacatgtaggagatgctaccgcggcaaccttgtcagcatccacaacttcaatattaactacaggatacagtgtagtgtcagcgccctcaaccaaggacaggtgtggattggaggtcgaattactggctccgggcgctgccgcagatttcagtgggtcgatggctcacgatggaatttcgcttactgggccgctcatcagccatggtccagaggcgggcactgcgttgctctttgtactcggggcggccactggcgacgagctcactgtttacgccgcctgcccttcatttgttcttactag

SEQ ID NO: 201821 - DNA, 669 bp, Artificial Sequence
  Description of Artificial Sequence: Synthetic coding sequence
atgaagctgcccctgctgctggccctgctgttcggcgccgtgagcgctcttcacctgcgatcagagacttctacattcgagaccccgctgggggctaagacactacctgaggacgaggagacaccggagcaggagatggaagagaccccctgtagggagctggaggaagaggaggagtggggttccgggagtgaggatgcttcgaaaaaggacggagcggtcgaaagtatttcggtcccagacatggtagataagaacctaacttgcccggaggaagaagatacagttaaggtggttggaattcctggttgtcagacctgcaggtatctgctggttaggagccttcagacattcagccaagcttggtttacatgccgccggtgttaccggggaaacttggtttcaattcacaactttaacatcaactatcggatccaatgttccgtttcagctctgaaccagggccaggtctggatcggcggccgcattaccggttcagggagatgtcggaggttccagtgggtggatggtagcaggtggaattttgcctactgggctgcacaccagccctggtcgaggggaggccattgcgtggccctgtgcacacgcggcgggcactggcgaagggcccattgcttaagaaggctgccttttatctgctcatactag

SEQ ID NO: 201822 - DNA, 636 bp, Artificial Sequence
  Description of Artificial Sequence: Synthetic coding sequence
atgaagctgcccctgctgctggccctgctgttcggcgccgtgagcgccctgcatttgcgctcagagacttccacatttgagacacccttgggtgccaaaactctgcccgaagacgaagagacgcctgagcaagaaatggaagaaacgccctgccgggagttggaagaggaggaagagtgggggagtggctcagaggatgcaagcaagaaggatggggcggttgagtctatctccgtcccagacatggttgataaaaatctgacttgtcccgaagaagaggatactgtgaaggttgtcggcattcccggctgccaaacctgccgctacctcctgttcacgtgtcgccgctgctatcgaggaaacctggtctctatccataatttcaatatcaattaccggatacagtgttccgtttcagcgcttaaccagggccaagtgtggatcggcggccggattactggatctggacggtgccgcagatttcagtgggtcgacggctcccgctggaactttgcttattgggccgcccaccagccctggtccaggggcggccattgcgtggcattatgtacacggggagggcactggaggagagcacactgcttacgcagactgccattcatttgttcatattag

SEQ ID NO: 201823 - DNA, 678 bp, Artificial Sequence
  Description of Artificial Sequence: Synthetic coding sequence
atgcagtgcctgctgctgctgcccttcctgctgctgggcaccgtgtcagcactgcacctcgaaaacgacgctcctcatctggaaagcctggaaacccaggcggatttgggacaagacctggactcctccaaggaacaggaaagggatctggcccttactgaagaagtgatccaggccgagggggaggaggtaaaagcctcagcctgccaagataattttgaggacgaggaggccatggagtctgatccagctgccctcgataaggactttcaatgtccacgtgaggaggatatagtggaagtgcaggggtcgccgaggtgtaagatctgtcggtatctgctggtgaggacccctaagacattcgccgaggcacaaaacgtgtgttctcgctgctatggcggtaatctagtctcaatccacgatttcaattttaattatcgaatacagtgctgcacgagcacagtgaaccaggcccaggtgtggatcggaggaaacctcagaggatggttcttatggaaaagattttgctggactgacggcagccattggaatttcgcttattggtctccagggcagccgggtaacggacaggggagctgcgttgccctctgtactaagggaggctactggcgtagggcgcagtgcgacaagcagctcccattcgtatgctctttctag

SEQ ID NO: 201824 - DNA, 4092 bp, Artificial Sequence
  Description of Artificial Sequence: Synthetic coding sequence
atggcctggaagaccctgcccatctacctgctgctgctgctgagcgtcttcgtaattcagcaggtatcctcccaggaattaagctgtaagggcagatgcttcgaaagcttcgagcgcggaagggaatgtgattgtgatgctcagtgtaaaaaatacgataagtgctgcccagactacgaatcgttttgcgccgaagtgcataatccgaccagcccaccctccagcaagaaggcacctccacccagcggggccagccagaccatcaaatcaaccactaagaggtcccctaaaccaccaaacaagaaaaaaaccaagaaggtgatcgagtctgaagaaattacagaagagcatagcgtgtcagagaatcaggagtccagctcgagctccagttccagctcgtccagctccaccatcaggaaaatcaagtctagtaagaactcagcagccaatagggaattgcagaagaagctgaaagttaaggacaataagaagaatcgtacaaaaaagaaaccgacccctaaaccaccagtcgtggacgaagctggttcagggctggacaatggagacttcaaagtaacgacccctgatacctctactacacagcataacaaagtgagcacatcccccaaaatcacgaccgctaagcctatcaacccccgcccctctcttccccctaactctgacacctcaaaggagacatctctgacagttaacaaggagactacggtcgagactaaggagacaaccacaacaaacaaacagacctccactgacggcaaagaaaagacaacttcagcgaaggagacccaaagcattgagaagacctcagccaaggaccttgctcccacatccaaagtgctagccaaacccacaccaaaggctgaaaccaccacaaaggggccggcgctcacgaccccgaaagaacccactcctactacccccaaggagcctgccagtacaacacccaaagagccgacccctactaccatcaagagcgcccccactacccccaaggagcccgcccctaccaccaccaaatccgcacccaccaccccaaaggaacccgctccaacaacaacaaaggaaccggccccgacaactcccaaggaaccagctccaacaacaactaaagaacccgcgcctacaaccactaaaagcgccccaaccacccctaaagagcctgcccctacaaccccaaaaaaaccagcaccgacaacacccaaagaaccagccccaactacacccaaggagccaaccccaacaacacccaaagagcctgcgccaactacaaaagaacctgcaccaactaccccgaaagaaccagctcccaccgctcccaaaaaaccggcccctactacaccaaaggagccagcgccgacaacgccaaaggagccagccccaaccactacaaaggaaccttcaccaactacacctaaggaaccagctcccaccacgactaagtccgcacctaccacaacaaaggagccagctcccactaccaccaaaagcgcccctactacgcccaaggaaccatccccaacaactaccaaggagcctgctcctaccactcctaaggagccggcacccacaacccctaaaaaacctgcccctacgacgcccaaggagcctgcccctaccactcccaaagagcccgccccaactaccacgaagaaaccggctcctaccacccctaaagagccagctccgacgactccgaaggagaccgctcccacaactccgaagaagttgacccctacaacgcccgagaagctggctccgaccacccccgagaaacctgctccaactacccccgaggaactcgcaccaactacacccgaagagccaacccccacaacacctgaagaaccagcccccacgactcccaaggctgctgctcccaacaccccgaaggaacccgcacctaccaccccaaaagagcccgcccccacaactcctaaggaaccagcccccaccactccgaaggaaacggcccctaccaccccgaaaggtactgcccctaccacgctaaaggagcctgcgccaaccacccccaagaagcctgctcccaaggagctggcaccgacaaccacgaaggaacctacctctacaacatgcgataagcccgctcctacgaccccaaaaggaacagcacccactactccaaaagagccggcccccactacccccaaagaaccagccccaaccacaccaaaagggacagcgccgacaacactaaaggaaccagctccaaccactcctaagaaacccgcccccaaggaactagcccctacaactacaaagggaccaactagtaccacctcagacaagcctgcgcccaccactccaaaggaaacagcacccaccacccctaaggagccagcaccaaccactccaaagaagcctgctcccacaacccccgagaccccaccacctacgacttctgaagtcagcacccctaccaccaccaaggaacctactaccattcacaaaagtcccgacgagtctaccccagaattatcagcggagcccacccctaaggcactcgagaattctcccaaggaacccggggtgccaacaacaaaaactcccgccgccaccaaacctgaaatgacaaccactgccaaagacaagaccactgaacgagatctgcggaccaccccggagaccactaccgccgccccaaaaatgaccaaggaaactgccaccacaacggagaagaccacagagagcaagataacagctactaccactcaggtgacttcaaccacaacacaggacactacacccttcaagattacgactcttaagactaccaccctggcaccaaaggtcaccaccactaagaaaacaattacaacaaccgagatcatgaataagcctgaggagacagcaaaacccaaagaccgggccaccaatagcaaggctacaactcctaaaccacagaaaccaactaaagcccccaagaaacccacctctaccaagaagccaaagaccatgccccgggtgcggaagcctaaaactaccccaactccacgcaaaatgaccagcaccatgcctgaattaaatccaacctcacgtatcgccgaggccatgcttcagaccaccaccaggccaaatcaaacacccaattcgaagttggtcgaagtgaaccctaagagcgaagatgctggtggcgctgagggcgagacgccacatatgctgttaaggccccacgtcttcatgcccgaagtgactccagacatggattacctgccgcgtgttccaaaccagggaataatcatcaaccctatgcttagcgacgagacaaatatttgcaacggaaagcccgtggatggactcacgaccttaagaaatggcactctcgtcgcttttcgaggacactatttttggatgctgtcccccttctcaccaccctcccccgcccgtaggattaccgaagtgtgggggatcccctcgcccatcgacacagtcttcacacgttgtaattgcgagggaaagaccttctttttcaaggactcccaatactggcggtttacgaacgatattaaagacgcaggctatcctaagccaatttttaagggtttcggcggactgacagggcaaattgttgcggcactttccacggccaagtacaaaaactggcctgagtcagtttatttttttaagcgtgggggatctattcagcagtatatttataaacaagagcctgtccagaagtgtcccggacgcagaccagccctgaattacccagtatacggcgaaaccacacaggttaggcgccggcgatttgagcgcgcaatcgggccctctcagacacatactatccgcatccagtatagtcctgccaggttggcctaccaggacaaaggggtcctacataacgaagtaaaagtgagcattctatggagaggccttcctaatgttgttacttctgcaatcagcctcccaaacatccggaagccagacggctacgattactacgcgttctccaaagaccagtactataacatcgatgtgccaagccgtaccgcccgagccatcacgacacggagcggacagacattgtccaaggtctggtacaactgcccatag

SEQ ID NO: 201825 - DNA, 2802 bp, Artificial Sequence
  Description of Artificial Sequence: Synthetic coding sequence
atggcctggaagaccctgcccatctacctgctgctgctgctgagcgtgttcgtaattcaacaggtttcctcacaggagctatcctgcaagggccggtgctttgagtcctttgaaaggggacgagagtgcgactgtgacgcacaatgtaaaaaatacgataaatgttgtcctgattacgagtccttttgtgcggaagtacacaatcccactagtccgcccagttctaagaaggcacctccgccgagcggcgcctctcagactattaaaagcacaacaaaaagatctcccaagccccccaataaaaagaagaccaagaaggttatcgaatccgaggaaattacagaagagcattcagtgtcagaaaaccaagaatctagcagttccagtagctcatcctcctccagttcaactattaggaaaattaaaagtagcaaaaacagcgccgctaacagagaactgcaaaaaaagctgaaagttaaagacaacaaaaagaataggaccaaaaaaaagcccacccctaaacctccggtggtggacgaagctggtagcggcctagataatggggattttaaggttacgacccctgatacttcaaccacacaacacaataaggtctctacatcgcctaagatcaccactgctaagccaattaatccccggcctagtctgcctcccaattccgacaccagcaaagaaacaagtctaaccgtgaacaaggaaaccactgttgagaccaaagagacaactaccaccaacaagcagacgagcacggacgggaaagagaaaactaccagtgccaaggaaacgcagtccattgaaaaaacctctgctaaagatcttgcccccactagtaaggttctggctaagccaactcctaaagctgaaacaactaccaagggtcccgcactcaccacaccgaaggagccgacgccaaccaccccaaaggaaccagcgagtaccaccccgaaggagcccaccccgactactatcaagtccgcaccaacaacacctaaggagcctgccccaactactacaaagtccgcccctacaacccctaaggaaccggctccaacgactaccaaggagcccgcgcccactactccaaaaaaacctgcccccacaacaccagagacgccccccccgacaacctccgaggtctcaacacctacaactaccaaggaaccaacgactattcacaagagccctgacgagagcacacccgaattgagtgctgaacccacccccaaggctctggaaaacagtcccaaggagccgggcgtacctaccacaaaaacaccagccgccaccaagccagagatgacaacaaccgccaaggataaaaccactgagagagatctacgaaccacccctgagacaactacagccgctcccaagatgactaaagaaactgcaactaccaccgagaagactaccgagagtaaaatcactgcgacgacaacacaggtgacttccactacaacccaggatactactcccttcaaaatcacaacactgaaaacgacaacattggcacctaaggtgacaacgacgaagaagactatcacaacaaccgagattatgaataagcccgaggaaacagctaaacccaaagacagagctacgaattccaaggctaccacacccaaaccccaaaagcctactaaggcccctaagaaacccacttcaaccaagaagccgaagacaatgcccagagtcaggaagccgaaaaccacgcctacgcctaggaaaatgaccagtactatgccagagttaaaccccacctcccgtattgccgaggctatgctgcagacgactactcggcccaaccagacccctaacagcaagcttgttgaggtaaatcctaaatctgaggatgcagggggcgccgagggggaaacccctcacatgctgcttcgaccacatgtctttatgccggaggtaacacccgacatggactacttgcctagggttcccaaccagggcatcattataaacccaatgctgtctgatgagaccaacatttgcaatggcaagccagtggacggcctaacgacactgagaaacggaaccttggtggcattccgcggacactacttctggatgctgtcccccttctcaccaccatcaccggcaaggcgtatcactgaggtgtggggaatcccctcacccatagatacagtctttacaagatgcaactgcgaagggaagactttcttcttcaaggattcccagtattggaggttcactaatgatatcaaagatgccggatatcccaagcctatttttaaaggcttcgggggactgaccggccagatcgtggccgcgctctctacagcaaagtataaaaattggcctgaatctgtttacttctttaaacgcggcggcagtatacaacagtacatttataagcaggagcctgtccaaaagtgtcccggacgtagaccagcacttaattacccagtctacggcgaaacaacccaggtgaggagaagacgattcgagagggcaatagggcctagccagacccacaccatcagaatccaatatagccctgcccggctggcttaccaggataagggggtcctgcacaacgaggtcaaagtgagcatactttggcgaggcttgcctaacgtcgtcactagcgctatttcactcccgaacattcggaaaccggatggctacgactattacgctttctccaaggaccagtactacaacatcgatgtcccctccaggacagctcgagccatcacgacgagaagtggacagactctgtctaaggtgtggtacaactgtccgtag

SEQ ID NO: 201826 - DNA, 3936 bp, Artificial Sequence
  Description of Artificial Sequence: Synthetic coding sequence
atggcctggaagaccctgcccatctacctgctgctgctgctgagcgtgttcgtgatccaacaggtgtcctctcaggacctgagctcttgcgccggccgatgtggcgagggctattcacgagatgctacctgtaactgcgattataactgtcagcactacatggagtgctgccctgatttcaagagagtgtgtaccgctgaattgtcgtgtaaaggaagatgcttcgagtctttcgaaagaggaagggagtgcgactgcgatgctcagtgcaaaaaatatgacaagtgctgtccagattacgagagcttctgcgctgaggtgaaggacaacaagaaaaatcgtacaaaaaagaaaccgacccccaaaccccctgtggtcgatgaggcaggttctgggcttgacaatggagatttcaaagtaacaacacccgacacgtccacaacacaacacaacaaagtctccaccagccctaagatcacaaccgctaagcccattaatccacgtcccagccttccgccaaacagcgataccagcaaagaaaccagcctgactgtaaataaagagacaaccgtcgagactaaggagacaactacgacaaataagcagaccagcactgatggtaaagagaagaccacgtctgccaaggaaactcagtccatcgaaaaaacatccgctaaggatctcgcacccacctccaaggtgcttgccaaacccacaccgaaagccgagaccaccactaagggccccgctctcactacccctaaagagcctactcccacgacgcccaaggagcctgcttcaaccactcccaaggagccaactccgaccacaattaaatcggcgcccacaaccccaaaggaacccgcccctactacaaccaagagtgcgcctactactcccaaggaacctgcccccacaacaacgaaagagccagcccctacgactccaaaggagcctgcaccaactacaactaaagaaccagccccaactacaaccaaatcggcacctacaacccccaaggagcccgctccaactacgcctaagaagcctgcacctaccacgccaaaagagccagcacccaccacacccaaagagcccactcctaccactccaaaggaacctgccccaaccactaaggagcctgctcctacaacaccgaaggaacccgcacccactgcaccaaagaagccagcccccaccacgccaaaggagccagcacccacgaccccaaaagaacccgcccccaccactacaaaggaaccatctcctacaacccctaaggaacctgctccaaccactacgaagtcagcccccacaacaactaaagaacctgcccccaccaccactaaaagcgctccgactacgccaaaagagccatctcccacgactacgaaggagccagcacccactactcccaaagagcccgctcccacgaccccaaagaagcctgctcctaccaccccaaaggagccagctcccaccacaccaaaggaacccgccccaactactacaaagaagcctgcccccactactccgaaggaacccgcaccaaccactccaaaagaaaccgctccaaccaccccaaaaaaactcacgcccacaacaccagagaagttggctccgaccacccccgaaaagccggccccgaccacacccgaggaacttgcccccacgacgccagaggagccaaccccaacgactcccgaggagcccgctcctaccaccccaaaagccgcggctcccaatactccaaaggagccggccccgacaactcccaaggagcccgcccccaccactcctaaggagcccgccccgacaacaccaaaagagactgcaccaaccacccctaaaggcaccgctccaactacccttaaggagccagccccaaccacgcccaagaagccagctccgaaggagctggcaccgaccacaaccaaagagcctacatccacaacctgcgacaagccggcacccaccacccccaaaggtacagcccccaccacgcccaaagaaccagccccgactactcctaaggagccggcccctaccacacccaaagggaccgccccaactaccttgaaggagcctgcgccaactacccccaagaagccagcacccaaggagcttgcgccaaccactaccaagggtcccacatcaaccaccagtgataagcccgctccgacaactccaaaagaaacggctcccacaacccctaaggaacccgccccgaccactcctaagaagcccgccccaaccaccccagaaacaccgcctcccactacaagcgaagtcagcacacctaccaccaccaaggaaccaacaaccatacataaaagtccagacgagagcacccctgagttgagtgcagagcctactccgaaagccctggagaatagtcctaaagaaccaggagtgccaaccaccaagacacctgcagccaccaagccagaaatgacgaccaccgccaaggacaaaacaacagagagggacctgcggacaaccccagaaacaacaacggccgcccccaaaatgactaaagaaaccgccacgactactgagaagaccacggagtcaaagatcaccgctaccaccacgcaggtcactagtaccaccacccaagataccacccccttcaagatcactactctgaagaccacaacccttgcccccaaggtcacaactaccaagaagaccatcactaccaccgaaatcatgaataagcctgaagagacggcaaagccgaaggaccgtgccaccaactctaaggcgaccactcccaaaccccagaaaccaacaaaagcccccaaaaaaccaacgtcaaccaaaaaacccaagacgatgcctcgtgtcagaaagcccaagacaactcctacgcctcgcaaaatgaccagtactatgcccgaactgaatcccacctccaggatcgccgaggccatgcttcagaccacaacaagacctaatcaaacaccaaactcaaagctcgtggaggtcaaccccaaaagtgaagacgccgggggcgcagagggcgagacacctcatatgctcctaaggcctcacgtcttcatgccggaggtaacgccagacatggattacctccctcgggtcccaaatcaaggaataattattaatcctatgctgtcagatgagactaatatatgtaacgggaaaccagtggacggactgacaacgctgcgaaacggcaccctggtggcatttcgtgggcactatttttggatgctgtctcccttttcccctccctccccggcaaggcgcatcaccgaagtgtggggtattcctagtccgatcgacaccgtctttacgagatgcaactgcgagggaaaaaccttttttttcaaggacagccaatactggagatttaccaatgacattaaggacgccgggtacccaaagcctatctttaaagggtttggcggcctgaccgggcaaatcgtggcagcgttgtcaactgccaaatacaagaactggccagagtctgtatacttctttaaacgtggggggagcatccagcaatacatctataaacaggagcccgtacagaaatgtccgggccgcaggccagccctcaattatccagtttacggggaaaccacgcaagttcgccgccggcgatttgagcgggccatcggccctagtcagactcataccattaggattcagtattctcccgcacgactcgcctaccaggataaaggcgtactacataatgaagtcaaggtgtcaattctgtggcggggcctacctaacgttgtgacttccgcgataagcctgcctaacataaggaagccagacggctatgattattatgccttctcaaaggaccagtactacaatatcgacgtgcccagccggaccgcccgcgcaatcacaacacggtcgggccagactctgtcaaaagtttggtacaactgtccatag

SEQ ID NO: 201827 - DNA, 4086 bp, Artificial Sequence
  Description of Artificial Sequence: Synthetic coding sequence
atggcctggaagaccctgcccatctacctgctgctgctgctgagcgtgtttgtgatccaacaggtgtcatcacaggacctgagctcctgtgccggccggtgtggggaaggttactcccgcgacgctacctgcaactgcgactacaactgtcagcactatatggagtgctgccctgatttcaagcgcgtgtgcacagccgagctcagctgcaagggccggtgcttcgagagttttgaacggggtagagaatgcgactgtgatgcacagtgtaagaaatacgataagtgctgtcctgactacgagagtttctgtgctgaagtgcacaaccccacatctcccccttcaagcaaaaaggccccaccaccctcaggcgcatcccagacaatcaagtctaccacaaaaagaagcccaaagcctcctaataaaaaaaagacaaagaaagttattgaatcagaagagattaccgaagtgaaggataataagaagaatagaacaaagaaaaaacccacccccaaacccccagtggtcgacgaggccggctccggcctggataatggcgatttcaaggtcacaacacctgacaccagtactactcagcataataaagtatcaacctctccaaaaatcactacagcgaaaccaataaatcctcggccctcccttccccctaattctgacactagcaaggaaacatctttaaccgtgaacaaagaaaccactgtagagacaaaagaaaccaccacaaccaacaaacagacctccaccgatgggaaggagaagaccacctcagccaaagaaactcagtcaatcgagaagacatcagccaaagacctagctccaacatccaaagttctggctaaacctacacccaaggccgaaaccactactaagggacccgctcttaccacacctaaagagcctacccctaccacgcctaaagagcccgcatccacgacacctaaagaacctacaccaacaactattaaatctgctccaactacaccaaaggaaccagcacccaccacaacaaaatcagctcccacgacccccaaggagcccgcccctaccaccacaaaggagccagctcccaccacccccaaggaaccggcacctactaccacgaaggaacccgctccaactaccacaaagagcgcccctaccactcctaaagagccggctcctacaactcctaaaaaacccgctccgacgacccctaaggaaccagcccctaccacgcctaaggagccaactcctactaccccaaaggaaccagcccccacgacaaaggagcccgcaccaaccactcccaaagagcctgccccaaccgctcccaaaaaacccgcacctaccactccgaaggaacctgctccaactactcccaaggaacctgcgcccacaacaaccaaagaacccagcccaaccaccccgaaggaaccagcccccaccactacgaagtcggctccaacgaccaccaaagaacctgcacccactactaccaagagtgccccaacaacgcccaaagagccctcacctactacaaccaaagagcccgcaccaaccacccccaaagaacccgctccgaccaccccgaagaaacctgcacctacaacacctaaagaacctgcccccacaactcctaaggaacctgcccctaccactactaagaagcccgctcctacgactcccaaagaacccgccccaaccactccaaaagagactgccccaacaactccgaagaaactgacgcccacaacacccgagaagctcgcaccgacgacaccagagaaacccgcgcctacgacacccgaggagctcgcaccaacaacgcccgaagagccaacccctactacccctgaggaacccgcacccacaactcccaaggccgcagcccctaacactcctaaggaacccgcacctactacccctaaggaaccagcccctactacacctaaggagcccgccccaactactcctaaagagacagctccaaccacacccaaagggactgcgcccacaaccttaaaagaaccagctccaactactccaaagaaaccagctcctaaagaattagcgcctaccacaacgaaagaaccaacgagcacaacctgtgataaaccagcgcccaccaccccaaaaggcacggcgcctaccactccgaaagagcccgcaccaaccactcccaaggaaccagccccaacaacacctaaggggacagccccaacgaccctaaaagagcccgccccaacaactcccaagaagcccgctcctaaagaactggctccgactaccacaaaaggccctacctctactacctccgacaagcccgcccctacaacaccgaaggaaacagcaccgacaacgccaaaagaaccagcacccaccactcccaagaagccagcaccgaccacgcctgagacacctccgcccacaacaagcgaggtctccacccccactactaccaaggaacctacaacaattcataaatctccagatgaatcaactccggagctgtccgccgagcctacaccaaaggctctggaaaactctccaaaggagcctggtgtgccaactactaaaacacccgccgctacaaaacccgaaatgacgacaacggccaaagataagaccactgagcgcgatcttaggacgacaccagaaaccaccactgctgcgccaaagatgactaaggaaacagccacgaccacagaaaaaacaacagagtccaaaataacagcaacaaccactcaagtgacttctacaactacacaggatacaactcccttcaagataaccacattgaagaccaccactctggctcccaaggtgacaaccacaaagaagactatcacaacgaccgaaataatgaataaacccgaggaaaccgcgaagcccaaagaccgggcaaccaactcaaaggccactacgccgaaaccacagaagcctactaaagcgcccaaaaaacccacctctacaaagaagcctaagacaatgcctcgggtgcgtaagcctaaaacgactcccacaccccgcaagatgacctctaccatgccagaattaaatcctacctcaagaatcgctgaagccatgctccagactaccacaagaccaaaccagaccccaaactcaaaactcgtcgaggtcaatccaaagtctgaggatgcaggcggggcggaaggagaaaccccacacatgctgctgcggccacacgtgttcatgccagaggtgaccccagatatggattatcttccacgagtgcctaatcagggtattattataaaccctatgctgtccgatgaaactaacatctgtaatggcaagcccgtagacggcttgactaccctgaggaacggcaccctcgttgcctttagaggtcattatttttggatgctctcccctttcagcccgccatctcccgctcgcaggatcacagaagtgtggggtatacccagcccaatcgacaccgtcttcactagatgtaattgtgaggggaaaaccttcttcttcaaagacagtcagtattggaggtttaccaacgacatcaaagacgcaggttatcccaagcctattttcaagggtttcggcggcctgacaggtcagatagtggcggctttaagtaccgccaagtacaaaaactggccggaaagtgtatatttttttaagcgcgggggctccatacaacagtatatttataagcaggaacccgtccagaagtgcccaggacgccgcccagccctgaattaccctgtgtacggcgagactacacaggtgcgcaggaggcgcttcgagagggcgattggtccatcccaaacccacacgatcaggatccagtattctccagctaggctggcctatcaggataagggggtcctgcataatgaagtgaaagtgagcattttatggcgaggtctcccaaatgtcgttacgtcagcaatatcactgcctaatattagaaagccagacggatatgattactacgcatttagcaaggatcagtactacaacattgacgtcccatcgcggacagcacgggcgattacgacgcgctccgggcaaaccctgagcaaagtgtggtataattgcccatag

SEQ ID NO: 201828 - DNA, 4215 bp, Artificial Sequence
  Description of Artificial Sequence: Synthetic coding sequence
atggcctggaagaccctgcccatctacctgctgctgctgctgagcgtctttgtaattcagcaagtgtcctcccaggatttgtcctcctgtgccgggaggtgcggtgagggctactctagggatgccacttgcaactgtgattataattgtcagcattatatggagtgctgccctgactttaagagggtgtgtactgccgagctgtcttgtaaaggtcgctgttttgaaagctttgaacgcgggcgtgagtgcgactgtgatgctcagtgtaagaagtatgacaaatgctgccctgattatgaaagcttttgtgcagaagtgcataatcccacatcgccgccctcatctaagaaggctcccccaccatctggcgcttcgcagaccatcaagtctacaaccaagcgcagcccgaaaccaccaaacaagaagaagacaaagaaggttattgagtcggaggaaattaccgaagagcactccgtgtctgagaaccaggaaagctcctctagtagctcgagtagcagctcctccagcacgatcagaaagatcaagtctagcaagaactctgctgcgaatcgtgagctgcagaagaagctgaaagtcaaagataacaaaaaaaatcgcaccaagaaaaaaccaacgcctaagcctcctgtcgtggacgaagccggatcggggttggacaacggagacttcaaggtgaccacccccgatacatccaccacccagcacaataaggtttcaactagcccaaaaatcacaactgcgaagccaattaaccctcgcccttcactgcctccaaatagtgacacatcaaaggagacatccctgaccgtcaataaggagaccactgtggaaacaaaagagaccacaactactaacaagcagacgtcgaccgatgggaaagagaaaaccaccagcgccaaagagactcagtccatagaaaagacatccgctaaagatctggcccccacaagcaaggtactagcaaagccaactccgaaagctgagacaaccaccaagggccctgccctcacaactcccaaagagcccactccgaccacacccaaggagcctgctagcactacccctaaggaacccactcctacaaccataaagagtgcccccaccactcccaaggagccagcacccaccaccaccaagtcggcccctaccaccccaaaggaaccagccccaactacaactaaagagcccgcccccactacccctaaagaaccagcgcccaccactaccaaagaacccgctcctacaactacaaagtccgctccaacgacccctaaggaaccagcccccaccacccctaaaaaaccagccccgaccactcccaaagaacctgccccaacaacgccaaaagaaccaacccctaccacaccgaaggagcccgcccccaccactaaagagcctgccccaactacacccaaagaacccgctcctaccgcgccaaagaaacctgctccaaccactccaaaggagcctgccccaactacccccaaggagccagctcctacaacaacaaaggaaccgtcacctacaacccccaaagagccagcacccactactaccaagtccgcccccacaacaacaaaagaaccagctcctaccactacaaagtccgcacctaccactcccaaggaaccctcgcctacaaccaccaaggaaccggcaccaacgactccaaaggagcccgctcccaccacccccaaaaagcccgcacccaccacccctaaggagcctgcccccaccacgcccaaagagccagctccaacaactacaaagaagccggctcctacaaccccaaaggagcccgcccctaccacacctaaagagaccgctcccacaactcccaagaaactcacgcccaccactcccgaaaagctggctccaacaacccccgagaagccggcccccaccaccccagaggagctcgccccaaccactcctgaggaacctactcctactacacctgaggaacccgccccaacaactcctaaagcagcagcccctaatacccctaaggagcctgcccccacgactccaaaagaacccgctcccactaccccaaaggaaccggcgcccaccaccccgaaagaaaccgcccctacaacacccaaaggcacagccccaactacactcaaggagcccgccccaaccacacctaagaagcctgcaccaaaggagctcgcccccaccaccacaaaagaaccaacctcaacaacctgtgataaacctgcccccaccacaccaaagggaacagcccccaccacccctaaagagcccgcaccgacaactccaaaggaaccggctcctactactccaaagggcaccgcgcccactacgctgaaggagcccgcccctaccacccccaagaagcctgctcccaaggaactcgcgcccaccactacgaagggaccaacttcaactacatccgacaaacctgcacctaccacacctaaggagacggctccgactacaccaaaagagcctgccccgaccactccgaaaaaacctgctccaactactcctgagactccacccccaactacatcagaagtttccaccccaacaacaaccaaggagccaacaacaatccacaagagtcctgacgagtccacaccagagctttctgccgagccgacacctaaagcacttgagaatagcccaaaggaaccaggagtgcccactacaaaaacccctgccgctacgaagccagagatgacgaccacagcaaaggataaaacaaccgaacgggacctgcgaaccacacctgaaactacaacagccgctcctaagatgactaaggagacggctactacaaccgaaaagacgaccgaatccaagataaccgctaccactacacaggtcacaagcacaacaacacaggacaccacacctttcaaaattactaccttgaaaacaacaacgctggcccccaaggtgacaacaaccaaaaagacaatcaccacaacagaaatcatgaataagcctgaggaaaccgccaaaccaaaagacagagccacaaattccaaggccaccacccccaagccgcagaaacccacaaaggccccaaaaaagccaacatcaactaagaaacccaagacaatgccacgggtgcgcaagccaaagaccactccaactcccaggaagatgacttccacgatgcccgaactgaatcccacctctcgaatcgctgaagccatgcttcagacaaccactcggcctaatcaaacgccgaacagcaagctggtggaagtaaaccccaaaagtgaagacgccggaggagcagagggagaaaccccacacatgctgctaagaccccacgtgttcatgcccgaagtgactcccgacatggactaccttccgcgcgtgcccaaccaagggattattatcaatccaatgctgagtgacgagactaacatctgcaatggcaaaccagtcgacggcctgaccaccctccggaacggtacgctggtggcctttagagggcactacttttggatgctttctccattctcgcccccctctccagctcggaggatcacggaggtttggggaattcccagccccattgatactgtctttacccgatgcaactgtgaagggaaaactttcttctttaaagactcacagtactggaggttcacaaacgacatcaaagacgcaggctatcctaagccaatatttaaaggattcggcgggctgacaggacagatcgttgctgccctatcgactgcgaagtacaaaaattggcccgagagtgtttacttctttaaacgaggtggaagcatccagcaatacatctataagcaggagcccgtgcagaaatgccccggccgtcggccagcgctgaactatccagtgtatggcgaaaccactcaggtgcggcgcaggcggttcgaaagggcaattggaccaagtcagacccacaccatacggatccagtattctcctgccaggctggcctaccaggataagggcgtgctgcataacgaagttaaggttagcatcttgtggcggggtctgcctaacgtggtgacttccgccatcagtctgcctaacattcgtaagccggatggctacgactactatgcctttagtaaggatcaatattacaacattgacgtgccatctagaacagcacgggcaatcactacgcggtctggacagactctgtctaaggtgtggtacaattgcccttag

SEQ ID NO: 201829 - DNA, 834 bp, Artificial Sequence
  Description of Artificial Sequence: Synthetic coding sequence
atgggcctgctggagtgctgcgcccggtgcctggtgggcgcccccttcgcttctctcgttgctactggactgtgctttttcggcgttgccctgttctgtggatgcggacacgaggctctcactgggaccgagaagctgattgaaacctacttcagcaagaattatcaagactacgagtatctgatcaacgtgatccacgcttttcagtatgtcatttacgggactgcaagtttcttctttctctatggtgctctgctgctggctgagggtttttataccaccggtgctgttaggcagattttcggtgactacaaaaccaccatttgcggaaaaggactgtctgcgaccgttaccggggggcaaaaagggaggggcagcagaggtcaacaccaggcccactcactggaacgcgtatgccattgcttagggaaatggctggggcacccggataagttcgtcgggattacgtacgccttgacagtcgtttggctgctggtgtttgcgtgttctgctgtgcctgtgtacatctatttcaatacttggacaacctgccagagtattgcattcccaagcaagacctctgcctcaatcggaagtctatgcgcggatgctagaatgtacggtgtgctgccatggaatgcctttccgggtaaggtgtgtggatccaacctgcttagcatttgtaaaaccgccgagttccagatgacattccacctgttcatcgcagcgttcgtgggcgcagcggccacactggtctctttgctgacctttatgatcgctgctacatataattttgccgtgctgaaacttatgggccgcggcacgaagttctag

SEQ ID NO: 201830 - DNA, 729 bp, Artificial Sequence
  Description of Artificial Sequence: Synthetic coding sequence
atgggcctgctggagtgctgcgcccggtgcctggtgggcgccccctttgcttcactcgtggctactggcctgtgtttttttggggttgctctgttctgcgggtgcggacacgaagccctgacagggacggagaaactgatcgaaacctacttttcaaagaattaccaagactatgagtatttgatcaacgttatccatgcttttcagtacgttatctacggaacagcctcatttttctttctctatggagccctcctcctggccgaggggttctatactacaggtgctgtgcgacagattttcggggactataagaccacaatttgtggcaaaggactgagtgccacatttgtggggatcacctatgctctaactgtggtttggcttctggtgttcgcatgtagtgccgtgccagtttacatttactttaacacttggacaacctgccagtccatcgctttcccctccaaaaccagcgcaagcatcggaagcttatgcgcagatgcccggatgtacggtgttctcccgtggaatgcgttcccaggaaaggtgtgcggtagtaacctgctttcaatctgtaagacggcggaattccagatgacatttcacctgttcatcgccgcattcgtgggggccgccgccacactggtgagtctgctgaccttcatgattgccgctacttacaacttcgcagtcctaaagcttatgggccggggtaccaaattctag

SEQ ID NO: 201831 - DNA, 834 bp, Artificial Sequence
  Description of Artificial Sequence: Synthetic coding sequence
atgggcctgctggagtgctgcgcccggtgcctggtgggcgccccctttgccagcctggtagccacggggctgtgcttttttggcgtggccttgttctgcggctgtgggcacgaagctctgaccggaacagaaaagctcatcgagacttacttctcgaaaaattaccaggactatgagtaccttatcaacgtgattcatgccttccaatatgtgatctacggcaccgcttctttctttttcctgtacggcgccctgttactcgcagaaggtttttacacaactggagcagtgaggcagatcttcggggactacaaaactacaatctgtggaaaggggctgtccgccacagtcacaggtggccagaagggcaggggatcacggggacagcatcaagcacactcattggaacgtgtgtgccattgcctggggaagtggctgggccatcctgataaattcgtaggcattacttatgccctcaccgtagtttggcttctcgtattcgcatgttccgccgtgcctgtgtacatatactttaatacttggactacgtgccagtccatcgctttcccaagcaagacgtctgcttcaatcgggtccttatgtgccgacgcccgaatgtatggagtcctcccctggaacgcattccctggcaaagtgtgtggcagcaacctcctgtccatttgcaaaacagcagagttccagatgacttttcacctcttcatcgctgcatttgtcggggctgccgctactctggtaagtttattgacttttatgattgctgcaacctacaattttgccgtgctgaagctgatgggtagagggactaaattctag

SEQ ID NO: 201832 - DNA, 384 bp, Artificial Sequence
  Description of Artificial Sequence: Synthetic coding sequence
atgggcctgctggagtgctgcgcccggtgcctggtgggcgcccccttcgctagcctcgttgcaaccgggctgtgcttctttggtgtggcactgttttgcggctgtggtcatgaggccctgactgggactgagaaactcatcgagacttatttctctaagaactaccaagattatgaatacctcatcaacgtgattcatgcgtttcagtatgtcatttacggcacagcatcttttttcttcctgtacggggcgcttctcctggccgagggtttttacacgacaggtgccgttagacagattttcggtgattataagacaaccatctgcggcaagggactatccgccaccgtgaccggaggccagaaaggtcggggatctcgctag

SEQ ID NO: 201833 - DNA, 768 bp, Artificial Sequence
  Description of Artificial Sequence: Synthetic coding sequence
atgggcctgctggagtgctgcgcccggtgcctggtgggcgcccccttcgctagcctcgtggccacaggcttgtgcttttttggggtcgcactgttctgtgggtgcggccatgaagctcttaccggtaccgaaaagctgatagaaacctattttagcaagaattaccaggattacgagtatctaattaatgtgatccacgcctttcagtacgtgatatatggcacagcaagctttttttttctgtatggcgctctcctgttggccgagggcttctatacaaccggcgcagtcagacagaagggccgcggctcaagggggcaacaccaagcccactctctcgaacgcgtatgccactgcctcgggaagtggctgggccaccccgacaagttcgtagggatcacatatgctctgaccgtggtctggctcctggtttttgcatgcagcgcagttccagtgtacatctacttcaatacatggacaacctgccaaagcatcgcctttccatctaagactagcgcttccattgggtccctgtgtgctgacgcccgcatgtatggcgtgctgccctggaacgcgttcccaggcaaggtctgtggttctaacctgctctccatctgtaaaacagctgagttccagatgacctttcatctctttattgccgccttcgttggagcagcagcaacactggtgagcctgctgactttcatgatcgccgctacgtacaatttcgccgtgctgaaactgatgggccgcggaacgaaattttag

SEQ ID NO: 201834 - DNA, 414 bp, Artificial Sequence
  Description of Artificial Sequence: Synthetic coding sequence
atgggcctgctggagtgctgcgcccggtgcctggtgggcgcccccttcgcaagtttggtggccacaggtctatgcttctttggggtggcgctgttctgcggttgcggacacgaggccctgaccggcacagagaaattaattgagacctacttttccaaaaattatcaggactacgagtatctgattaatgtgattcacgcttttcaatatgtgatttacggcactgcttcgtttttctttttatatggcgccctgttactggccgaaggcttctacaccacgggtgcagtgcgccagattttcggcgattataagactaccatctgtggcaaagggcttagcgccaccgtcacagggggacagaaagggcgaggctcccggggccagcatcaggcccactccttagaaaggtag

SEQ ID NO: 201835 - DNA, 303 bp, Artificial Sequence
  Description of Artificial Sequence: Synthetic coding sequence
atgggcctgctggagtgctgcgcccggtgcctggtgggcgcccccttcgcttcactggtagcaaccggcctttgcttctttggggttgcgctgttttgtggttgcggccacgaagctctgaccggcactgagaaattgattgaaacttatttttcaaagaattatcaagactatgagtatttaatcaatgtaatccacgcctttcagtacgtaatctatggcactgcatcatttttctttctgtatggtgccctcctgttggctgaagggttttatacaacaggggctgtacgccagatctag

SEQ ID NO: 201836 - DNA, 372 bp, Artificial Sequence
  Description of Artificial Sequence: Synthetic coding sequence
atgggcctgctggagtgctgcgcccggtgcctggtgggcgcccccttcgccagcctggtggcaaccggattatgcttcttcggcgtggcgttgttctgcggatgcggccatgaggccctgacaggaacagagaaattgatagaaacatatttcagcaaaaattatcaagattatgaatatttgattaatgtaattcacgccttccagtacgtgatctatggaacagcatctttttttttcttatacggcgcccttctcctcgcggagggtttctacactactggagcagtgcgtcaaatcttcggagactacaaaactactatatgcggcaaaggactctctgctaccgtgacaggagggcagaaggggtag

SEQ ID NO: 201837 - DNA, 339 bp, Artificial Sequence
  Description of Artificial Sequence: Synthetic coding sequence
atgggcctgctggagtgctgcgcccggtgcctggtgggcgcccccttcgccagcttggtcgccacaggcctatgcttcttcggcgtggccctgttttgcggatgtggacatgaggccctgaccggaaccgagaagctaatcgagacgtatttttctaagaattaccaggactatgagtatctcatcaatgtgattcacgcttttcagtacgtaatctacgggaccgccagcttcttcttcctgtatggcgcgctgctcttggccgaaggcttctacacaacaggtgctgtgcgccaaatattcggcgactacaagacaactatctgtggcaagggatag

SEQ ID NO: 201838 - DNA, 411 bp, Artificial Sequence
  Description of Artificial Sequence: Synthetic coding sequence
atgggcctgctggagtgctgcgcccggtgcctggtgggcgccccctttgcgtcgctggtggctacaggtctgtgttttttcggtgtagcgctgttctgtggatgtgggcatgaagccctgaccggcacagaaaagctcattgaaacctacttctctaaaaactaccaagattatgagtatttgattaacgtcattcatgcatttcagtacgtcatctatgggacagccagtttcttttttctgtacggggccctgctattggctgaaggcttctacaccacgggggccgttcggcagattttcggggattataaaaccacgatttgtgggaagggactcagcgccacagtgaccggagggcagaaaggtagaggctcccgcggccaacaccaggctcattctctggagtag

SEQ ID NO: 201839 - DNA, 438 bp, Artificial Sequence
  Description of Artificial Sequence: Synthetic coding sequence
atggccgacagcgagcggctgagcgcccccggctgctgggccgcctgcaccaatttttccagaactcgcaaggggattctgctctttgcggaaattatcctttgcctggtcattctgatatgcttcagcgcgtctactcccggttactcttctctgagcgtcatagagatgattttggcggccatattcttcgtcgtgtacatgtgtgacctgcacaccaaaatcccatttataaactggccctggtctgatttctttcgtaccttaattgcagctatactttaccttattacatccattgttgtgcttgtcgagcgggggaaccactccaaaattgtggcaggtgtcaaggcaatgggcgcggcactaaagcaccgcgccaagggtctgaggagccagggaccttttctgcccctgctgctcgccgagattgtatag

SEQ ID NO: 201840 - DNA, 459 bp, Artificial Sequence
  Description of Artificial Sequence: Synthetic coding sequence
atggccgacagcgagcggctgagcgcccccggctgctgggccgcctgcaccaactttagccggacacgcaaaggaatcctactgttcgcggagataattctttgcttagttatcctcatttgcttcagcgcttccacccccggatatagcagccttagtgtaattgaaatgattcttgctgccatcttttttgtggtttacatgtgcgacctgcacacgaaaatcccctttatcaattggccttggagtgacttctttagaactttaatcgccgccatcctgtatttgataacttccatcgtggtcttggtggagcgtgggaatcatagtaaaatcgtcgctggcgtgttggggttgatcgcaacctgtttgttcgggtatgatgcttacgtgaccttccccgtgagacagcctagacatacggcagcccccaccgacccagcagatggtcccgtctag

SEQ ID NO: 201841 - DNA, 336 bp, Artificial Sequence
  Description of Artificial Sequence: Synthetic coding sequence
atgagcgacgccgccgtggacaccagcagcgagatcaccaccaaggatctgaaagagaaaaaggaagtggtggaggaggcggagaatggcagagacgctcctgcgaatggaaacgccgagaatgaagaaaacggggagcaggaagctgacaatgaggtcgacgaggaggaggaggagggaggagaggaggaggaggaagaggaggaaggagatggggaagaagaagacggtgacgaggacgaagaagcggaaagcgctaccggtaaaagagccgcggaggatgacgaggacgacgatgtggacaccaaaaagcaaaaaacagatgaagacgattag

SEQ ID NO: 201842 - DNA, 408 bp, Artificial Sequence
  Description of Artificial Sequence: Synthetic coding sequence
atgcagaccttcggccccgccggcgtggccgccgtgggccggcgggtagagtcgccagccgatcgaagggcgacgagggcttgccactgcaagctgtgcctgcctgcaggctcactgcaaggcctaaagggagaagaaggaagtgtcgaggaggctgagaatgggcgtgacgcgcctgccaatggtaacgccaatgaagaaaatggtgagcaggaggcagacaatgaggtggatgaagaagaagaggaagggggtgaggaagaggaagaagaggaagaaggcgacggtgaagaagaggatggggatgaggatgaagaggctgagagtgccactggtaaaagggccgccgaggacgatgaggacgatgacgtggatacaaagaagcagaagaccgatgaagatgactag

SEQ ID NO: 201843 - DNA, 333 bp, Artificial Sequence
  Description of Artificial Sequence: Synthetic coding sequence
atgagcgacgccgccgtggacaccagcagcgagatcaccaccaaggacctgaaggaaaagaaggaggtggtcgaggaggccgagaatggacgtgatgctccggcaaatgggaacgctaatgaggaaaacggcgagcaggaagcagataacgaggtggatgaggaagaggaagaagggggagaggaggaagaagaggaagaggagggagacggagaggaagaagatggcgatgaagacgaagaggcagaatctgcaactggtaagcgcgccgccgaagacgacgaggacgatgacgtggacactaagaaacagaagactgatgaggacgactag

SEQ ID NO: 201844 - DNA, 3714 bp, Artificial Sequence
  Description of Artificial Sequence: Synthetic coding sequence
atggacagcggcgccggcggccggcggtgccccgaggccgccctgcttattcttgggccaccccgaatggaacacctccgccactctccaggacccggcggtcagcgacttctgttaccatcgatgctcttagccttgctgcttctactggcaccatcccccggccatgcaacacgggtcgtgtataaagtgcctgaagaacaacctcccaataccctcattggaagcttggctgccgattacggttttcccgatgtaggccacctatacaaattagaagtgggcgcaccatacctgagggtggatggcaagacaggcgacatctttaccaccgagacctctatcgaccgagaaggcttacgcgagtgtcagaatcagcttcccggtgatccatgcatattggagtttgaagttagcattaccgacctcgtacaaaacggctctccacggctcctcgagggccaaatcgaggtgcaggatatcaacgataatacacccaatttcgcctccccggttattaccctcgctattcccgaaaatactaacattggcagcttgtttcctataccactggccagtgacagagatgccggcccgaacggtgtggctagctatgagctgcaagccggccctgaagcacaagagctgttcggcttgcaggtggccgaagatcaagaagagaagcagccgcagctgatagtgatgggcaacctcgatagagaacgctgggatagttatgacctgacaatcaaggtgcaggatggcgggagccctccaagggcaagctcagctctcctgcgggtcactgttctagatactaacgataacgcccctaaatttgagagacccagttacgaggctgagctgtctgagaattcccctattggacactctgtgatccaggtgaaggctaacgactctgaccaaggagccaacgcggaaatcgagtacacctttcaccaggcacccgaggtggtcaggcgcctgctgcgccttgaccgcaatacaggactcatcacagtgcaaggaccagtagatcgggaggacctttctacacttcggtttagcgtgctggcaaaggatcgcggaacaaatcctaaatccgcgcgggcccaggtagtggtgactgtgaaggatatgaatgacaacgcacctacaatagaaatacgcggtataggcctggtgacccaccaggatggcatggctaatataagtgaggatgttgccgaggagactgctgtcgctctggtacaggtatccgacagggatgaaggagagaatgctgccgtaacatgtgttgtcgcgggcgatgtaccttttcagctcaggcaggccagtgaaacaggctccgattcaaaaaaaaagtatttcctgcaaaccaccactcctctggactatgagaaggtcaaagattatacaattgagatagtagcagtggactctggcaatccgcctctgtcgagcacaaactcccttaaggtacaagtggtggacgtgaatgataacgctccagtatttacccagtcagttactgaggtcgcgtttccagagaataacaagccaggggaagtgatcgctgagatcaccgcctcagacgcagattctggctcgaacgccgaacttgtgtattctctcgagcccgagccagccgctaaaggactgttcacaatctctcccgagaccggcgagatccaggtgaagacaagcctagacagggagcagagagagagctacgagctcaaagtcgtcgccgccgatcgcggatccccaagccttcaaggcaccgccactgttttagtgaacgtgctggattgcaacgataatgacccaaagttcatgctctctggctacaacttctcggtcatggaaaacatgccagccctcagtcctgtgggcatggtgactgtaatagacggggataaaggtgaaaacgcccaggttcagctcagcgttgagcaggacaacggagactttgtgatacaaaatgggacagggacgatcctgtcgagtctgtctttcgatcgagaacaacaatctacgtacacgttccagctaaaggctgtcgatgggggcgttcctccccgatctgcctacgtgggagttaccattaacgttcttgatgagaatgacaacgcaccatacattaccgcaccctcaaatacatcgcataagctactgacacctcaaacacggctgggagaaacagtgtcgcaggtggcagctgaggattttgactccggggtcaacgctgagcttatatattctatcgccggagggaacccatacggcctcttccagatcggctcgcactctggcgctatcactcttgagaaagagatcgagcgtagacaccacggactccacaggctggtggtgaaagtatccgaccgtggaaagccaccacgatacggcacagcgctcgtacacttatatgtcaacgagaccctggcaaatcggacacttctggaaaccttgctaggccactcactcgacactcctctcgatattgacatagccggtgatcccgaatatgagaggagcaagcagcgtggtaatattttgtttggcgtggtagctggggtggtcgcagtcgcattgctgatagctctcgccgtgttagtgcggtactgtagacaaagggaggccaaatccggctatcaggccggcaagaaagaaacaaaggacctgtacgcgccgaaacccagcggaaaagcctccaaggggaacaaatctaagggaaaaaaatcgaaatctcccaagcccgttaagcctgtggaagatgaggacgaagccggtctccaaaagtcactgaaattcaatttaatgagcgacgctcctggagacagccctcgcatccacctgccactgaattatccgccaggctctccagatctgggtagacactatcgttcaaacagcccgctcccctcgatacagctgcaaccccagtcgccctcagcctcaaaaaaacaccaagtggtgcaagatctgcctcccgccaacacttttgtggggacaggggatactacctcgacggggagtgaacagtacagtgactacagttacaggacgaacccaccaaaatatcctagcaagcagctcccgcatcgacgtgtcacgttttcagctaccagtcaggcccaagaactgcaggaccccagtcaacactcctactatgatagcgggttggaagagagcgaaacacccagctccaaatccagctctggcccccgtctcggccccctggctctcccggaagaccactacgagcgcacaacccccgacggcagcatcggggaaatggagcatccggagaatgaccttcgacctctgccggatgttgccatgaccggaacatgcaccagagaatgctccgagttcggacatagtgacacctgctggatgccaggacaaagctccccctccaggcgcaccaaaagctccgcactgaagctgtccactttcgtgccatatcaggatcgtggcggacaggagccggcaggagcggggtctccatcccccccagaggatagaaacaccaagacagctccggtgcggctacttccttcctattcagctttctctcattcaagccacgacagctgcaaagatagtgcaacattggaggagatacccctcactcagacatctgactttccccccgctgccacccccgcatcagcccaaactgccaaacgggaaatctacctctag

SEQ ID NO: 201845 - DNA, 3183 bp, Artificial Sequence
  Description of Artificial Sequence: Synthetic coding sequence
atggacagcggcgccggcggccggcggtgccccgaggccgccctgctaatactggggcctccacgaatggagcatctcagacactctcctggccctgggggccagcgtctcttgctcccatctatgctcttggcactgctgctgctactggcaccttccccgggccacgccacccgggtggtgtacaaggtgccagaggaacagcccccaaacacgctgattggttctctggcagctgattacggctttcctgatgtcggacacctctacaaactcgaagtcggggcaccatacctcagggtagatggaaagaccggggacatttttacaaccgagacatccatcgacagggagggactcagagagtgtcagaatcaactgcccggtgatccgtgcattctggaatttgaggtttccattactgatcttgtgcagaatgggagccctcgactattggaggggcagatcgaggttcaggacattaatgacaatacgccaaatttcgcatctcctgtcataactttggcaatccccgagaacacaaacattgggtctctctttcctatacctctggcatccgaccgcgacgctggccctaatggcgtcgctagctatgagcttcaggctggtccagaagctcaggagctgttcgggctgcaggtcgctgaagatcaagaggaaaagcaacctcagctcatcgtaatgggtaatctggatcgggagagatgggacagttatgacttgaccataaaagtgcaggacggcggctcaccgccacgagcctcatcggccctgttgcgcgttaccgtcctagacaccaatgacaatgcccctaagtttgagagaccttcatatgaggccgaactctccgaaaatagtcctatcggtcacagtgtcattcaggttaaggctaatgatagcgaccagggcgcaaatgctgagatagagtatacctttcaccaagcacctgaagtggtgaggcgactacttcgtctcgatcgtaacaccggcttaattaccgtgcaaggaccagttgacagagaggacctttctactttgcgcttctctgtcctggccaaggatcgagggactaaccctaagagcgcccgggctcaggttgtggtgactgtgaaagacatgaacgacaacgctcccaccatcgaaattagaggcattggcctggtgacccatcaggacgggatggctaatattagcgaggatgtggctgaggaaacggctgtggctttggtccaagtgtccgaccgggacgagggggagaatgccgccgtgacatgtgttgtagccggggatgtgccctttcagctgaggcaagctagcgaaaccggctccgatagtaaaaagaaatactttttacagactaccacccccttggattatgagaaggtgaaggactataccattgagattgtggctgtcgactctgggaatcccccactttcaagcacaaattcattaaaagttcaggtggtggatgtcaacgataatgcgcccgtgttcacccagagtgtcaccgaggtggcgtttcccgagaataacaagcctggggaggtgatcgccgagataaccgccagtgatgcagatagcggttctaacgctgagctggtgtattccttggagccagaaccagcagctaagggcctgtttactatatcaccagaaaccggagaaattcaggtgaaaaccagcttagaccgcgaacagagagagtcatatgaattgaaggttgtggctgccgatagaggatctccctccttgcagggaaccgctactgtgcttgtgaatgtgctggactgtaatgacaacgatccaaaattcatgctaagcggttacaactttagtgttatggagaacatgcccgcactatcccccgtgggtatggtaactgtaattgatggggataagggggagaacgcccaggtacaactgtcggtggaacaagacaacggagacttcgtgatccagaatggcacgggcaccattctctcctcactctcttttgaccgggagcagcaaagtacctacacctttcagttaaaggccgtggatggaggggtcccccctcgctctgcgtatgtgggagtcacgattaacgtcctggatgaaaacgacaacgcaccctacatcaccgccccgtctaatacctcacacaaactgctgactccccaaacaaggctcggcgagaccgtcagtcaggttgccgccgaggatttcgactcgggagtgaatgctgaattgatctattccattgccggcggtaacccatacggcttgttccagatcggatctcactctggggccatcactcttgagaaggaaattgagcgcagacatcacggtctgcatcggctagtggtcaaagtgtcagacagggggaagcccccgaggtatggaacagcactggtccacctgtacgtgaatgagacactggcaaatcgcaccctgctagaaacactcctcggccactcactggataccccacttgacattgatattgcgggagatcccgaatacgaaaggtctaagcaacggggcaacatcctatttggggttgtggctggcgtcgtggcggtggcacttctgatcgcactcgcggtactagtgcggtattgtagacagagagaggctaagtctggttaccaggctgggaaaaaagaaacaaaagacctctacgccccgaagccgagcggaaaagcatcaaaggggaacaagagcaagggcaagaaatctaagagccctaaaccggttaaaccagtggaggatgaagacgaggccggactccagaaaagcttgaaattcaatctcatgagtgacgcgccaggggattctcccaggatacacctgcccctgaattatccacctggaagccctgatctagggagacactaccggagtaactctccattgccatctatccagctgcaaccgcagtctcctagcgcaagcaaaaagcaccaggtggtccaagatctgccccccgcaaacacatttgtgggtactggagacactacctccaccggcagcgaacaatatagtgattactcctatagaacaaaccctccgaagtacccgtcaaaacaagttggacagcccttccagttatccaccccccagcccctcccccatccctatcatggagccatttggacggaagtttgggagtag

SEQ ID NO: 201846 - DNA, 3147 bp, Artificial Sequence
  Description of Artificial Sequence: Synthetic coding sequence
atggacagcggcgccggcggccggcggtgccccgaggccgccctgctgattttgggaccccctcgcatggagcatcttcggcatagccccggaccaggcggtcagagactgttgctgccatccatgctcctcgcactgctgcttctgctcgccccgagcccaggtcacgctacacgcgtggtttacaaagtaccggaagaacaacccccaaatacactcatcgggtctctggctgccgactacggctttcccgatgtgggacacttatataagctggaagtgggggcgccttacctgagggtggatggaaaaacgggtgatatctttacaactgaaacaagtatagaccgagagggactaagagagtgtcagaatcagctgcccggcgatccatgtatcctcgaatttgaggtttccatcacagatctagtgcagaatgggtctccacgcctgctggagggtcagatcgaagtgcaagacatcaatgacaacacccccaatttcgcaagcccagttatcactctcgccatccctgagaacacaaatataggaagtctctttcccatacccctggccagcgacagagatgcgggcccgaatggcgtagcatcatacgagcttcaggtggccgaggatcaggaagagaagcagccccagttgatagtgatggggaacctggatcgggaacggtgggacagctatgatctcacgatcaaggtgcaggatggggggtcccccccacgtgccagttcagcccttttaagagtaacagtcttagatacaaacgacaatgcccccaagttcgaacgaccaagttacgaggcagaactctctgagaactcccccattggccactctgtgattcaggtcaaggccaacgattcagaccagggcgcaaatgctgaaattgagtacaccttccatcaggctcccgaggtcgttagacgtctcctccgcctggatcgcaataccggcctcatcactgtgcagggtccggttgatcgtgaagatctctcgaccctcagattctcagtgttggcaaaagatcgggggacgaaccccaaatctgctcgggctcaggtggttgtcacagttaaagatatgaatgataacgctcccacaatcgaaatccggggaatcggactcgttactcaccaagatgggatggccaatatcagcgaggacgtcgctgaggagacggcagtggcccttgttcaggtgtccgacagagacgaaggggaaaacgcagccgtgacctgtgtggttgcgggagacgtcccatttcaactcagacaggcatcagagaccggttcagactcgaaaaaaaagtatttcctgcagaccaccactcctttagattacgagaaagtgaaggattacaccatagaaatcgtggccgtggatagcggtaacccacccctctcctccacaaatagcctgaaggtgcaggtggttgatgttaacgacaacgcccctgtgtttacgcagtctgtgaccgaagttgcattcccagagaacaacaaacctggggaggtgatagccgagattactgcctctgacgccgatagtggctcaaacgccgaattggtctattctctggagcccgagcccgccgccaaaggactcttcaccatctctccggaaaccggcgagatacaggtaaaaactagcctagatcgggaacaacgggagtcctatgagctaaaggtggtcgctgccgatcggggatctccatctctccaggggaccgctactgtccttgtcaatgttctcgactgcaacgacaacgaccctaagttcatgctatccggttataatttttccgttatggaaaatatgccggccctgagtcccgtgggtatggtgacagtgatcgatggggataagggtgaaaatgctcaggtccagctgtctgtagagcaagataacggggactttgtcatacagaacggcacagggactatcctaagcagtttaagctttgatagagagcaacaatctacctacacattccagctgaaggctgtcgacggaggagtgccgccacgaagtgcttacgtgggggtaacaattaatgtcttggatgagaacgacaacgccccctatattaccgccccaagcaacactagtcataagctgctgactccacagaccaggctgggcgaaactgtgtctcaggtggccgctgaagattttgacagcggcgttaatgccgaacttatttactccattgcagggggaaacccttacggcttgttccaaattggatcccacagtggggctataacacttgagaaggagatcgaaaggcggcaccatgggctccatcgactggttgtcaaggtgtcagatcgggggaaacctcctcgctacggaaccgccctggtgcacctatacgtgaatgaaaccctggctaatcgcactctgctggaaacactgctaggacatagcttggatacaccactggatattgacatcgcgggggacccagagtatgaaagatcgaaacagagaggaaatatcctgttcggggtggtcgctggagtggttgcagtggccctgcttatcgcgctggctgttttggtgcgctattgccgccagagagaggctaaaagcggatatcaagcaggcaagaaagagactaaggacctgtacgcccccaagcccagcggcaaggcatccaagggaaataagtcaaagggtaaaaagagcaaaagtccaaagccagtaaagcccgtggaggacgaagatgaggctgggttacaaaaatcgttgaaatttaatctgatgtccgacgcacctggcgacagtccaagaatccatttaccattgaactacccaccagggtcccccgacctcggcaggcattaccgttcaaacagtcctcttcctagtatacaactgcagcctcagtccccaagtgcaagtaaaaaacatcaggtggtgcaggatctgccccctgctaatacctttgttggcaccggcgatactacttccactggatccgagcagtattccgattacagctatcgtacaaatccgcctaagtatccaagcaagcaggtagggcagccttttcagctgtctaccccacagcctctacctcacccataccacggcgcaatttggaccgaggtgtgggaatag

SEQ ID NO: 201847 - DNA, 3117 bp, Artificial Sequence
  Description of Artificial Sequence: Synthetic coding sequence
atggagcacctgcggcacagccccggccccggcggccagcggctgcttctaccctcaatgctgctcgccctgctcttgctgctggctccttctcctgggcacgctactagggtggtttataaggtgcctgaagagcagccacccaatacgttaatcggcagcttggccgctgactatggtttccctgacgtgggccatctgtacaagctggaggttggcgctccgtatctgcgggtagacggcaagaccggcgacatcttcacgactgagaccagcatcgatcgcgagggtctccgggagtgtcagaatcagctgcccggagatccttgcatcctagagtttgaggtctccattacagatctagtccagaatggatctccacgcctcctcgaaggacagatagaagtgcaagacatcaacgacaacactccaaatttcgcttcacccgttattacacttgctatacctgaaaataccaatattgggagtcttttccctatacctttggctagcgaccgcgatgccggccccaacggagtggcttcatacgagcttcaagccgggcccgaggctcaagaactgtttggactacaggtggcagaggatcaggaagagaagcagccacaactcattgtgatgggcaacctggatagagagagatgggacagctacgacttgaccattaaggtgcaggacggtggatccccccccagggcttcctcagccctgctgcgagttaccgtgctcgacaccaacgataatgcacccaagttcgagaggccatcttacgaggccgaactctctgaaaattcccccataggccactctgtaatccaagtgaaggcgaacgactccgaccagggcgcaaatgccgagatagaatatacatttcaccaggccccagaggtggtccgcaggctgttgcggctggatcgcaataccggactaatcactgtgcagggacccgtcgacagggaagatttgagtactctgaggttcagcgtgcttgccaaagatagggggaccaatcccaagtcagcccgcgcacaggtggttgtcacagtgaaggatatgaacgataatgctcctacaatagaaatcaggggcatcggcctggttacccaccaagatgggatggccaatatcagtgaagacgtggctgaagagactgctgttgccctggtgcaagtgtctgaccgggacgaaggagagaatgcagcagtgacatgcgtggtggcaggtgatgtacccttccaactgagacaggctagtgaaactggcagcgactccaaaaagaaatacttcctccagactacgacaccacttgattatgagaaagtaaaggattataccatagaaatagtcgcggtcgattccggtaaccctcctttgtcctccactaactctctgaaggtgcaagttgtagatgtcaacgataacgctcccgtgttcactcagtccgttaccgaggtggcgtttccagaaaacaacaagcccggcgaagtcatcgccgagattaccgcctctgacgctgattccggcagcaatgccgagttggtgtacagcctcgaacctgagccagcagccaagggcctctttactatatcacctgagaccggcgaaatccaggtgaagacctccctagatcgggaacagcgggaatcctacgagctgaaagtcgtggctgctgaccgcggttcccctagcttgcagggaaccgctaccgtcttagtgaatgtgttggattgtaacgacaatgaccctaagtttatgctgtctggatacaatttttctgtgatggagaacatgccagccctctcacccgtgggtatggtcacagttatcgacggcgacaaaggtgaaaatgctcaggtccagctctccgtggaacaagacaatggcgattttgtgatccagaacggaacaggaacaattcttagctcattgtcatttgaccgggaacagcagtccacctacacgtttcagctgaaggcagtggatggaggagtgccgccccggtctgcttatgtcggagtgacgatcaatgtgttagacgagaacgataacgccccatacataacagccccgagcaacacatcccataagctgctcacacctcagactcgtctcggcgaaacagtctcccaggtagcagccgaggattttgatagtggagttaacgccgagttgatttactcgattgcagggggaaacccatacgggttgttccagatcggctctcattccggggccatcactctggagaaagagattgaacggcgccaccacggtctccataggctcgtggtgaaggtcagcgatcgtggcaagcccccccgatatggtaccgctctcgtccacttgtacgtgaacgaaactctcgcaaaccgcacccttcttgagactctgttgggacacagtctggacacaccacttgacatcgatatcgcaggtgatcccgagtatgaaaggtcaaagcagcggggaaacattttatttggcgtcgtagcgggcgttgtcgcagtagccctcttgatcgcccttgctgtgttggtccgatattgccgccagcgggaggccaaaagtggttaccaggccggaaaaaaggagacaaaggatctttacgcacctaaaccttccggcaaggcatcaaaagggaacaaatctaagggtaagaagagtaagtctcctaaaccggtgaaaccggtggaagatgaggacgaggcaggtttgcagaagtctctcaaattcaaccttatgagcgacgcccccggcgatagcccccgaattcacctcccgctgaactatccacccggctcccctgaccttgggcgccattaccgatctaacagtcctctgccttcaatccagctccaaccccagtccccatcggcctctaagaaacatcaggtcgtgcaggacttgccccctgcgaataccttcgtggggaccggtgacactaccagtacaggctctgagcagtatagtgactattcctacagaaccaacccccctaagtacccgtccaagcaggttggccagccgtttcagttgtctactccacagcctttaccgcatccctaccatggagctatctggactgaggtctgggagtag

SEQ ID NO: 201848 - DNA, 3123 bp, Artificial Sequence
  Description of Artificial Sequence: Synthetic coding sequence
atgatcgtgctgctgctgttcgccctgctgtggatggtggagggcgtgttcagccagcttcattacactgttcaggaagaacaggaacacggaactttcgtcggaaatatagctgaggatctgggattggatatcacaaaactgtcagcacgtggattccagactgtgcccaattctcgaacgccgtatttagacctgaatcttgaaacaggcgtcctgtatgttaatgagaagatcgaccgtgaacaaatttgtaaacagagtccaagctgtgtcctgcatctggaggtgttcctggagaacccgcttgagctgtttcaggtggaaattgaggtgcttgatattaacgataaccccccttcctttcccgagcccgacttaacagtcgagatttctgagagcgctacccctggaactcgcttccctctggagagcgcttttgatcccgacgtcggcacaaactctctgcgagactacgagatcacgcctaattcctatttctcactggacgtgcagacccaaggagatggcaatcgatttgcggaactcgttttggagaagccgttagaccgggaacaacaagctgtgcaccgctatgtgctaaccgccgttgacggtggaggaggtggaggcgtgggggaaggcggcggaggagggggcggggccggactcccaccacagcagcagcgcaccggtacagccctcctcaccattcgagtcctggactcaaatgataatgtgccagcttttgaccagccagtgtacaccgtgtctctaccagaaaactcacctccagggaccctcgtgatccagctaaacgccacggacccagatgaaggccaaaacggagaagtcgtgtacagctttagcagtcacatttctccacgggcccgtgagctgtttggcctgtccccccggactgggcggctggaagtctctggcgaacttgattacgaggagagccccgtgtatcaagtatacgttcaggcgaaggatctgggacccaatgccgtgcccgcccattgcaaggtgctggtacgcgtcctcgacgccaacgacaacgccccagagatttctttcagcactgtcaaggaggctgttagtgagggagcggcacctggcacggtggtggccctgtttagcgtgactgatagagacagcgaggagaacggtcaggttcagtgcgaattactgggcgacgttccatttcggcttaaaagctcttttaagaattactacacgatcgttaccgaggccccccttgatcgggaggcaggggattcttataccctgaccgtggttgcccgagaccggggggaaccagcactcagcacctctaagtccatacaagtgcaggtgagcgatgtgaacgacaacgcccctcgattttctcaacctgtctacgatgtgtacgtgacagagaacaacgttcccggtgcatacatatatgccgtctcagctactgaccgggacgaaggcgctaatgcccagctcgcatatagtatcctcgaatgccaaatacagggaatgtccgtatttacttacgtctcaattaactcagaaaacggctatctctacgctctgaggtctttcgactacgaacaattgaaggatttcagcttccaggtggaagcccgggacgcaggatcgcctcaagccctcgccggaaacgctaccgtgaacattctcattgtcgaccagaatgacaatgccccagctatcgtcgcccccttacctggacggaacgggacccccgctcgggaagtgctgccacggagtgcggagcctggttatctgctgacccgggtcgcggcggttgacgcagatgacggagagaatgccagactgacatattccatcgttcggggcaatgagatgaatctgttccggatggactggcgaactggcgagctgcgcacagctcggcgggtccctgcaaagagggatccacaacgcccgtacgagctggtgatagaggtgagagatcatggtcagcctccattgtccagtacagcaactctggtggtccagctcgttgatggagcagttgagcctcaaggcgggggggggtctggtgggggaggctctggggaacatcagcgcccatcccgctcaggcggaggcgagacttccctagatcttacacttattctgattatcgccctggggtcagtgtcattcatcttcttgctcgctatgatcgtccttgcggtgcgatgtcagaaagagaaaaaacttaacatctacacttgcttggccagtgactgttgcttgtgctgctgttgctgcggaggggggggaagtacctgctgcgggcggcaggctagggcaagaaaaaagaaactgagcaaaagcgatatcatgctggtgcaatcgagtaatgttccctcaaaccccgcacaagttcctattgaggaaagtgggggattcgggtcccaccatcacaaccagaactactgctaccaggtgtgccttacccctgagtcagctaaaacggatctgatgtttctcaaaccttgtagcccgtcccgcagcaccgatactgaacataacccttgcggcgctattgtgaccggttacacggaccagcagcctgacatcatcagcaacggtagtatcctctcaaacgaaactaaacaccagcgtgcggaattgtcctatctcgtcgaccggcctaggagggttaacagttcagcattccaggaagcggatatcgtctcatccaaagatagcgggcatggcgactccgaacaaggcgactcagatcatgatgccaccaacagggcacaatctgccgggatggatctgtttagcaactgtaccgaagaatgtaaagcactgggtcatagcgatcgatgctggatgccctcttttgtgcccagtgatggacgacaggcggctgattacagaagcaacttacatgtgcctggaatggactctgtccccgacactgaagttttcgagaccccagaagctcagcctggcgccgagagatcgttttccacttttgggaaggagaaggctttacacagcacgctggaacgaaaggagctggatggactactgactaatactcgggcgccttacaaacctccatacctgactcggaaaagaatttgctag

SEQ ID NO: 201849 - DNA, 3123 bp, Artificial Sequence
  Description of Artificial Sequence: Synthetic coding sequence
atgatcgtgctgctgctgttcgccctgctgtggatggtggagggcgtcttttctcagctgcactacaccgtacaggaggaacaagaacacgggacgtttgttggaaacatcgctgaggatttagggctggacatcactaaactgtccgcgaggggtttccaaacggtccctaactctaggactccctatttggatctcaacctggagacgggtgtgctgtacgtgaatgaaaaaatcgaccgcgagcagatatgcaagcagtctccgtcatgtgtgctgcacctcgaagttttcctcgaaaatccactggaactattccaggtggaaatcgaagtgctcgacataaatgacaatcctccttcctttcccgagccagatttaaccgtagagataagcgagtcagccaccccgggaactaggtttccattggaatccgcctttgaccccgacgtcgggaccaactctcttagagattacgaaattaccccaaattcctatttcagcctggatgtccagactcagggcgacggcaatagattcgccgagttggtgctcgaaaagcccctggatagggagcagcaggctgtgcaccgctatgtgctgaccgccgtcgatggtgggggaggcggcggtgttggcgaaggagggggcggaggaggaggcgccgggttgcctccccagcagcagaggacgggtactgcgttgctgactatccgagtgctggacagcaacgataatgtaccagccttcgaccagccagtgtataccgtaagtctgccggaaaattcccctccgggaacacttgtcatccagctcaatgccacagatccagatgagggacagaacggcgaagtggtgtattcttttagttcccacatctctcctcgggctcgagagctcttcggtctgagcccgcgcacaggacggctggaggttagtggcgagctggactacgaagaatctcctgtgtatcaggtatatgtgcaggcaaaagacctcggtcctaatgccgtccctgcccattgcaaagtgcttgtaagagtgctggacgcaaacgataatgccccagagatctcattcagcaccgtgaaggaagctgtaagcgagggcgccgctccagggacggtagtcgcacttttttcagtcacagacagggacagtgaagagaacgggcaggtgcagtgcgaattattgggcgacgttccattcagactgaaaagcagctttaaaaattactatacaatagtgaccgaagcaccactggaccgcgaggccggcgactcttataccctgaccgttgttgcgcgcgaccggggagagccagcactgtccacttcaaagagcattcaagtccaggtgagcgacgtcaacgataatgctccccgcttctcgcagcccgtttatgatgtgtatgtaacagaaaacaacgtgcctggggcctatatctatgccgttagcgctacagaccgggacgaaggggctaacgcgcaactggcctacagcatactcgagtgccaaatccagggcatgagtgtctttacttacgtgagcattaattcagaaaacggctatctgtacgcacttcgcagttttgactacgagcagctaaaagatttcagttttcaggtggaagcacgcgacgctggctctccccaggctcttgctggaaatgcgacggtgaatattctgatagtggatcagaacgataatgccccagccatagtggctcccctgcctggcaggaatggaacccccgccagggaggtgctgccacggtccgcggagccagggtacctgcttactagggtcgcggccgtggatgctgatgacggggagaacgcccgcttaacttattcaatcgtcagaggaaacgagatgaatttatttaggatggactggaggacgggcgagttacgcactgcacggagagtgccagccaagagagacccacagcggccatatgaactagtcattgaggtcagagatcatggccagcccccattatcatcaactgcaactcttgtggtgcagttagtggacggagccgtggagcctcagggcggcggcgggagtgggggcgggggctctggagagcaccagaggccctcccgctccggcggcggcgaaaccagtctggatctcactctaattctaataatagccttgggatcagtttcattcattttcctgctcgcgatgatagtgctggcggttcgatgtcagaaggaaaaaaagttgaatatctacacctgcctggcatcagattgctgcctttgctgttgctgttgcgggggaggaggaagcacctgctgtgggcgccaggcgagggccaggaagaaaaagttgtctaaatccgatattatgctggtgcagtcctccaacgtgccttccaatcctgcccaggtacccatcgaagaatcggggggatttgggtcccaccaccataaccagaactattgctatcaggtctgtctgacccctgagagcgcaaagaccgatttgatgttcttgaaaccgtgctccccctcaagatctaccgatactgagcataatccctgtggagcaatcgttactggttacaccgatcagcagccagatattatctccaacggctccatcctgtccaacgagactaaacatcagagagcagaactgagctacctggtggacaggccaaggagagtgaactcttccgcattccaagaagccgatatcgtgagttctaaggattcaggccacggcgactcagaacagggagattcagatcacgatgcaacaaatagagctcagtccgcaggaatggatctattttccaactgtaccgaagagtgcaaggcccttggtcactctgacagatgctggatgccaagttttgtgcccagcgatggacgccaggctgccgactatcgatcaaatcttcacgtccccgggatggacagcgttccggatactgaagtcttcgagacacccgaggcacaaccaggcgccgaacggagtttctctaccttcgggaaagagaaagccctccatagtacccttgaaagaaaagagctggacggactgttgaccaacacccgggcaccgtataagcccccgtatcttagaaagaagcaaaggtgctag

SEQ ID NO: 201850 - DNA, 3933 bp, Artificial Sequence
  Description of Artificial Sequence: Synthetic coding sequence
atggacctgctgagcggcacctacatcttcgccgtgctgctggcctgtgtggtgttccactccggggctcaggagaagaattacacaatccgtgaggagatgccagagaatgtgcttatcggagatttgctaaaggatctgaacctctcgctgatccccaataagagcctaacaaccgccatgcagtttaagctggtgtataagactggtgatgtgccactgatcagaattgaagaagataccggagagatatttaccactggagctaggatagaccgggaaaaactctgtgctgggatccctagggacgagcattgcttctatgaagtcgaggtcgcgattttgcctgatgagatttttcgactggtcaagattcggttcctcatcgaggatattaatgacaatgcccctctcttccccgcgaccgtgatcaacatctcaatccccgagaattctgcgataaatagtaaatacaccctccccgcagccgtggatccggacgtcggaattaacggagtccaaaactacgagctcattaaaagtcagaatatatttgggcttgacgtcattgagaccccagagggcgacaagatgcctcaattgatcgtgcaaaaggagttagatcgcgaggaaaaagatacatacgtcatgaaggttaaggtcgaggatggcgggtttccgcaacggtcttccaccgcaattctgcaggttagcgtgactgatacaaacgacaaccatccggtcttcaaggaaactgagattgaagtgagcatcccagagaatgcgccagtaggaacttccgttactcaactgcacgcgactgacgcagacatcggggagaatgccaaaatccacttctcctttagcaatctggtgagtaacattgcaaggcgcttatttcacctgaacgcaaccacgggcctaatcacaattaaggagccgctggacagagaagagacacccaaccataagctgctggttctggcctccgacggtggcctcatgccagctagggccatggtgctggtcaacgtaacggatgtgaacgacaacgtcccaagcatcgacatcagatacattgtgaacccagtgaatgacaccgtggtgttatcagagaacatccctttgaataccaagattgcccttatcaccgtgaccgacaaggacgctgaccataatggccgagtgacctgttttacagatcacgaaattccatttcgcctgcgccctgtgttcagtaaccagttccttctggaaaccgcagcctatctggactacgagtctacgaaggaatacgccataaaattactcgctgcggacgccggcaaaccgcccctgaatcagtcggctatgctgtttatcaaagtgaaggatgaaaacgataacgcccccgtgttcacccaatcgtttgtcacagtaagcatacccgagaacaactccccaggcatacagctgacgaaagtatcggccatggacgctgattctggccctaacgctaagattaattacctgctcggccccgatgcccctcccgagttcagtctggattgccgcaccggcatgctgactgtggtcaaaaagctggatcgagaaaaggaggataagtacctctttaccattctggctaaagacaatggcgtaccacccctaacctctaacgtgaccgttttcgtgtccataatagatcagaatgacaatagccctgtatttacccacaatgagtataatttttatgtcccagagaatctgccaaggcatggtaccgtgggactgattaccgttaccgacccagactacggagacaactccgcggtgaccttgagcatcctggacgaaaatgacgattttaccatcgattcacagaccggggtgatcaggcccaacatctccttcgatagagaaaagcaagaaagctataccttctatgtcaaagctgaagatggcggccgggtcagccggtcgtccagtgctaaggtcaccattaacgtggtggacgtaaatgacaataagcctgtctttatagtgccacctagtaattgcagttacgaactcgtgctccctagcacaaacccagggacggttgtgttccaggtcattgccgtggataatgataccggcatgaatgccgaggtcaggtattccatcgtgggcgggaacactagagatctgttcgccatcgaccaagagacaggaaacattacattgatggagaagtgtgacgtgacagaccttggcctgcaccgtgtgctggtgaaggccaatgacctcggccaacccgatagcctcttctcggtggtgatcgtgaatctgttcgtgaacgaatcagtgactaatgcaaccctaatcaacgaattggtgaggaagtcaacggaggctccagttaccccaaacactgaaatcgctgatgtttcatcccccactagtgattacgtaaaaatactggtggcagccgtggccggcacgatcacagtcgtggtggtaatctttattacagccgtggtgcggtgcaggcaggcccctcacctgaaggccgctcagaaaaacaaacagaactccgagtgggcaacgccgaaccctgagaacaggcagatgattatgatgaaaaagaaaaagaaaaagaagaagcactcccccaagaatctgctgcttaacttcgtcaccatagaagaaacaaaggccgatgacgtggactctgacggcaatagggtaacgctggacctccccatcgatcttgaggagcagaccatgggcaagtacaactgggtgaccactcctacaacctttaagcctgactcccctgatctggcacggcactacaagagcgcatcccctcagccagcctttcaaatccagccagagacccccctgaatagtaaacaccacattatccaggagctaccactagacaatacattcgtcgcctgcgatagcatttccaagtgtagctcttcctcctcggatccttactcagtcagtgattgtggctatccagtcacaaccttcgaagtcccagtgagcgttcatacgagaccaagccagagacgcgtgacctttcatctgcctgaggggtcccaagagtcctcctctgatggtggtctcggcgaccatgacgctggcagtctgacatccacaagccacggtctgcctctggggtacccacaagaagaatacttcgaccgagcaacacctagcaatcgaaccgagggcgacggcaatagcgacccagaaagtacatttatccctagaagtccaacggcagccgagataacggtccagccaacggtagaggaggcatccgataactgcacgcaggagtgtctaatctatggccattctgacgcttgttggatgccagcatcgcttgatcattcctcatccagccaggcacaggcctcggccctttgtcacagcccccccttaagccaggcgagtactcaacaccacagcccacgcgtgacccaaaccattgccctgtgccatagcccccccgtaacgcagacaattgctctctgccactccccgccccccatccaagtctctgctctgcatcattcccccccactggtccaggccacagcgctgcatcactcccctccgagtgcgcaggcctctgcactgtgctacagtcctccactggcacaagctgcggccatttctcactcctcacctctgcctcaggttatcgcacttcacaggagccaggcccagagcagcgttagtctgcaacaggggtgggtccaaggagcagacggcctgtgcagtgtggaccagggtgtccaggggagtgccacgtctcagttctataccatgtccgagcgactacacccctcggatgactcaattaaggtgatacctctcactacattcactcctcgccagcaggcccggccgagccggggagatagccctatcatggaggagcatcctttatag

SEQ ID NO: 201851 - DNA, 4044 bp, Artificial Sequence
  Description of Artificial Sequence: Synthetic coding sequence
atggacctgctgagcggcacctacatcttcgccgtgctgctggcctgtgtggtcttccattctggagcccaggagaaaaattatacgataagagaagaaatgcctgagaacgtgctgatcggggacctgcttaaggatttaaacctgtcgctaattcctaacaaatctctaacaaccgccatgcagttcaagctggtgtacaagaccggtgatgtacctctgatccgcatagaggaagatacgggggagatctttacaaccggggccagaatcgaccgggaaaaattgtgtgctggaatcccgagagatgagcattgtttttatgaggttgaagttgctattctccccgatgaaatttttcgcctggttaagattaggttcctgattgaggatattaacgataatgcccccctgtttcctgcaacagtgatcaatatttcaatccccgagaattctgccatcaactctaagtacacccttcctgcagccgtggacccagatgtagggattaatggcgtacaaaattacgagctgatcaaatcacagaatattttcggtcttgacgtgatagaaacccctgagggggataaaatgccccagctgatcgtccagaaagagttggaccgcgaggaaaaagacacatacgtcatgaaggttaaggtggaggatggtggtttcccgcaacgctcaagcaccgcgatcctccaagttagcgtgaccgacaccaacgacaatcacccagttttcaaggagactgaaattgaggtgtccatccctgaaaacgcacctgtcggcaccagtgttacgcagttgcatgcaacagacgctgatataggtgaaaatgctaaaatacacttttccttcagcaatctggtgagtaatatcgctcgtcgtctcttccacctgaacgccaccaccggtcttatcacaatcaaggagccactcgacagagaagagacgcctaaccacaagttgctcgtgctggcttctgatggcggcttaatgccagctcgggccatggtgctagtgaatgtcacggatgtcaacgacaacgttccctccattgatatcagatatatcgtgaaccctgttaacgatacggtggtgctgagtgagaatatccctctgaatacgaaaatcgctctaatcaccgtgactgataaggatgcagaccataacgggagggtaacctgtttcacagatcacgaaatcccattcaggctgaggccggtgttcagcaaccagttccttctcgagactgccgcttatcttgactatgagtcaacgaaagagtacgcgatcaagcttctggccgcagatgcaggcaagccacctctcaaccaaagtgctatgctcttcatcaaagtgaaggatgaaaacgataatgcgccagtgtttacacagtcttttgtaaccgtctctatccccgaaaacaatagcccaggcattcagctgaccaaggtgtctgcaatggacgccgacagcggccctaatgcaaaaataaattacttgttaggtccagacgctccaccagagtttagcctggactgtcgcaccggtatgctcacagtcgtaaagaagctggatagagagaaggaagacaaatatctattcaccattttggccaaggacaacggcgttccacccctgacatcgaacgtgacggtatttgtttctattatcgaccagaacgacaatagtccagtattcacccataacgagtacaacttctatgttccagaaaatctaccaagacacggaaccgtggggctgataaccgtgactgaccctgattacggcgataatagcgccgtgactttatccattctggatgagaatgacgactttacaatcgattcccaaaccggcgtgatccgcccgaacatctccttcgatagagaaaaacaagaatcatacaccttttacgtgaaagcagaagacggaggtagggtgtcccgttcctcgagcgccaaagtcaccattaacgtggtagacgtgaatgataataagccggtgtttatagtgccccccagtaactgcagttacgagttggtgctcccctcaaccaatccaggtacggtggtctttcaggtgatcgccgttgacaacgacacaggtatgaatgccgaggtcagatacagtatagttggagggaacacacgcgacttatttgcgattgaccaagagacgggcaatataacgctaatggaaaagtgcgacgttaccgatttgggcctgcaccgggtgctggttaaagcaaatgatcttgggcagcccgacagtctattctctgtcgtaatcgttaatctgtttgttaatgaatccgtgactaacgcaacgctaattaacgagctcgtgcggaagtccaccgaggctcctgtgacgccaaatacggagattgcagatgtgagtagtcccacatccgactacgtcaagattctggtggcggcagtagcaggaacaataacagttgtggttgttatattcataaccgctgtcgtccggtgtcgacaggccccacatttaaaagccgctcagaaaaacaagcagaattctgagtgggccacgcctaatcccgagaatcggcagatgattatgatgaaaaaaaaaaaaaagaagaagaagcatagccccaaaaatttacttctgaattttgtcacaattgaggaaactaaggcggacgatgtggattcagacggaaacagggtaacgcttgatctacctattgatttggaagaacagaccatgggaaagtataactgggtaaccacccctacgactttcaagcctgattcgccagaccttgctagacattataaatcagccagccctcagcctgccttccagatacagcctgagacacccctgaactcgaagcaccacattatccaagagcttcctctcgacaatacatttgtagcgtgcgacagcatctccaagtgtagctctagctcgagtgatccttactctgtgtcggactgtggctaccctgttaccacctttgaggtccctgttagtgtgcatacccgacctcccatgaaggaagtggtcagatcttgcacgccaatgaaggagtctaccactatggaaatctggatccaccctcagcctcagcgcaaaagcgaaggcaaggttgccggcaagagtcagcgcagagtcacttttcaccttccagaaggaagccaagaatcgtccagcgatggaggccttggtgaccatgacgctggcagtctcacgagcacatcacacggccttcccctcggctatccccaggaggaatactttgacagggccaccccgtcaaataggacagagggagatggtaactccgaccctgagtcgacattcatccctagatctccaactgcggccgagattaccgttcagccaacagtcgaagaggcttctgacaactgcacacaagaatgcctgatctacggacactccgacgcctgctggatgcctgcctcgctcgaccattcatcatcttctcaggcccaggcctctgccctctgtcacagtccccccttgtcacaggcaagcacccagcaccactccccaagggtgactcagaccattgccctttgccacagtcctcccgtaacacagacaatcgctctgtgtcactcaccacctccaatccaggtttcagccctgcaccactctccccctctggtccaagctaccgcactgcaccactctccaccgagtgcccaggcaagcgcactgtgttatagtcccccactggcccaagctgccgctatttcgcactctagccctctgccacaggtgatcgcattacaccgcagtcaggctcagtcctctgttagtctgcagcagggttgggtacaaggagccgacgggctgtgctccgtcgaccagggggtgcaggggtccgcaaccagtcaattttatacgatgtcggagaggttacatcccagcgacgactcaatcaaggtcattcctctgactactttcactcctcgacagcaggccaggcccagcaggggtgactctccgattatggaagaacaccccctctag

SEQ ID NO: 201852 - DNA, 3990 bp, Artificial Sequence
  Description of Artificial Sequence: Synthetic coding sequence
atggacctgctgagcggcacctacatcttcgccgtgctgctggcctgtgttgtctttcattcaggcgcgcaggaaaagaactatacaatcagagaagagatgcctgagaatgtgctaattggcgatttgcttaaggatctcaatctgtccctaatccccaacaagtccctcacgaccgcaatgcagtttaagttagtctacaaaactggagacgtaccacttattcggatcgaggaagacaccggtgagatttttaccactggtgctcgcatcgaccgcgaaaagctatgtgccgggatccctcgcgacgagcactgcttttatgaagtggaggttgccatattacccgacgagattttcagacttgtgaagattagatttctgatcgaagacattaacgacaacgcccctctgtttcctgccactgtaatcaatatcagcatcccagaaaactccgctatcaatagcaagtacaccctacccgctgccgtcgacccagatgtcggtatcaacggagttcagaactacgaacttattaaatcccaaaatattttcggtttggacgtaattgagacccctgagggggataaaatgccacagctgatcgtgcagaaagagttagaccgagaggaaaaggatacttacgttatgaaggtgaaggtcgaggacgggggatttcctcagcgctcaagtacagcaatcctccaggtttctgtaactgatactaacgataaccacccagtgtttaaggaaaccgagatcgaggtgagcattcccgagaacgcacccgtcggcacatctgtcacccaacttcatgccacagacgcagacatcggagaaaacgccaagatccatttcagtttctccaatctagtaagtaacattgccagaagactatttcatctaaacgccactaccggcctgattactataaaggagcctctggatagggaggaaactccaaaccacaagctgttggtgctagcgtcagacggaggactgatgcccgcaagagccatggtgctcgtgaacgtgacagatgtgaatgataacgtgccatccatagacattcgctacattgtgaatcccgtcaatgatactgtcgtgctgagcgaaaacattcccctgaacaccaaaattgccctcatcactgtgactgacaaagacgccgaccataacggacgcgtgacatgctttacagatcatgagattccatttaggctgagacctgttttttccaatcagttcctgctcgagacagccgcatatttggactacgagtccaccaaagagtatgccatcaaacttctcgccgcagacgccggcaagccacccttgaaccagtccgcaatgctgttcattaaggtgaaggacgagaatgataatgcgcccgtcttcacacaatcgttcgtgacagtatcaatacccgagaataactcgccaggcatacagctcaccaaggtgagtgctatggatgccgatagcgggcctaacgctaagataaactacctactgggaccagatgcaccgccagagtttagccttgactgtagaacaggtatgcttacagtggtgaagaagctggatcgtgagaaggaggacaagtatttgtttaccatcttggctaaggataatggagtgccaccattaactagcaacgtcacagtatttgtttcaatcattgatcagaatgacaactccccagtgttcactcataacgagtacaacttctacgtacctgaaaatttgccgcggcacggtaccgtggggttaattaccgttacggaccccgattacggagataactcagccgtgaccttgtcaatcctggatgaaaatgacgacttcactatcgactcacagaccggcgtgatcaggcctaatattagttttgatcgcgaaaaacaggagagttataccttctacgttaaggcagaggacggtgggagggtgtctcggtcttcctccgcaaaggttactatcaacgtggtggatgtgaacgataataagcccgtattcattgttcctccttctaactgcagttacgagctcgtactcccatcaaccaaccccggaacggttgtgttccaggtgattgcagtggataatgacactggcatgaatgccgaggtccgttattcaattgtcggcggaaacacccgcgacctgtttgctatagatcaggagaccggcaatattacactaatggaaaagtgcgacgtcaccgacctcggcttgcaccgggtattggtgaaggcaaacgacctggggcagcccgacagtctatttagtgtcgtcatagtcaaccttttcgtgaacgaatctgttacaaacgcaacccttattaacgaactggtcagaaagagtacagaggctcccgttacccctaataccgaaattgccgatgtaagcagtccaaccagcgactacgtgaaaatcttggtggctgccgtagcgggcacgatcacagtggtggtggtgatcttcataacagcagtcgtgcgatgtcgacaggcgcctcatctgaaagctgctcagaaaaacaagcagaactccgagtgggccacccccaaccccgaaaacagacagatgatcatgatgaaaaaaaagaagaagaaaaagaaacacagccctaaaaatctgctgttgaacttcgtaacaatcgaggagacaaaggctgatgacgtggatagcgatggaaaccgcgtcactcttgacctgccaatagacctggaagagcagactatgggcaaatacaattgggtgacaacaccaactacctttaaacccgattccccagacctggcacgccattataagtctgcaagcccccagccagcatttcaaatccagcctgaaactcctcttaactctaagcaccacatcatccaggaactgcctctagataacacatttgtggcttgcgacagtatcagcaagtgcagctcttccagtagcgacccatatagcgtgtctgattgcgggtatcccgtgacaacttttgaagtcccggtcagcgtgcacacaagacctcctatgaaagaggtggtaaggtcttgtacaccaatgaaggaatctaccactatggagatttggattcatccccagccacagtctcagcgtagagttacatttcacctgcctgaaggatcccaggagtcctcctcagatggcggactgggggatcacgatgccggaagcctgactagtacaagccacgggctcccgctgggttacccacaggaggagtacttcgaccgagctactccatcaaaccgcaccgagggggatggcaactctgatcctgaaagtaccgctgaaatcacagtacagccaactgtagaggaagccagtgataactgcacgcaggagtgtctgatttacggccattcagacgcgtgttggatgcctgcatctcttgatcactcatccagctcacaggcccaggcttccgccctgtgtcacagcccaccattgtcccaggcctcgacccagcatcactccccacgagtgactcaaaccatagctctttgtcatagcccacctgttacccagaccatcgcgttgtgccactctccccccccgattcaggtctctgcgctgcatcacagcccaccgcttgttcaagcaaccgctctccatcatagtcccccatcagcacaggcgagcgccctttgttacagcccaccgctggcacaggctgcagcaattagtcattcatcacccctaccacaggtcattgcgctccaccggtcacaagcccagagctcagtaagtctgcagcaaggttgggtgcagggggcagatggcctgtgctctgtggatcagggagtgcagggaagtgcgacaagtcagttctacaccatgtccgaaaggctgcatccgtccgatgacagtattaaggtcatccctctcacgacttttaccccccgccagcaggcccggccatcacgcggcgattctccaattatggaggaacaccccctgtag

SEQ ID NO: 201853 - DNA, 3066 bp, Artificial Sequence
  Description of Artificial Sequence: Synthetic coding sequence
atggacctgctgagcggcacctacatcttcgccgtgctgctggcctgtgtggtgttccacagcggtgcccaagagaagaactatacaatccgagaggagatgcccgagaatgtcctgatcggagacttgttgaaagacttaaacctgtcattaatacctaataaatcactcactactgcgatgcaattcaagctggtgtacaaaaccggggatgttccacttatccggattgaggaggacaccggagagattttcaccactggggctagaatcgatagagagaagctctgtgctggcatcccccgagatgaacactgtttctacgaagtggaagtggcgatcctgccggacgagatatttaggttggtgaaaattcggtttctcatcgaggacatcaacgacaacgccccactctttcctgccactgtgatcaacatatccataccagagaactcggcgatcaattcaaagtacacgttacccgcagcagtagatcccgatgttggtataaacggcgtccagaattatgagctgattaaatcccagaacatcttcggtctggacgtgatcgaaaccccggagggcgataagatgccacaacttattgtgcagaaggaactagaccgggaagagaaagacacatatgtcatgaaagtaaaggtggaagatggcggattccctcagcggtcatcaactgcgattctgcaggtgtccgtgacagatactaacgacaatcaccccgtcttcaaagaaacggaaatcgaagtcagcatccctgagaacgcgcctgtgggcacttccgtgacccagctgcacgccactgacgccgacatcggcgagaatgcaaagatccatttcagtttctccaacctggtgtcaaatatcgcccgacgcctgttccatctgaatgcaactactggattaatcaccatcaaagagcccctggacagggaggaaaccccgaatcacaagctgctcgtgttggcttcagacggcggcttaatgccagcccgggctatggtccttgttaacgttacagatgtgaacgacaacgtgccgagtatcgatatcaggtacatcgttaaccccgtaaatgataccgttgtgctgagcgaaaacatccctctgaatactaaaatcgccctgatcactgtcactgacaaggatgcggatcataacgggagagtaacttgtttcaccgaccatgagatcccattcagactgcgcccggtctttagtaaccagttcctcctcgagactgcggcatatctggactatgaatcaacaaaagaatacgcaattaagctgctcgccgcagacgctggtaaaccacctcttaatcagtcagctatgctgtttataaaagtcaaggacgagaacgataatgcccctgtgtttacccaaagctttgtgaccgtctctattcctgagaacaacagccctggcattcaattgacaaaggttagtgctatggatgcagacagcggtccgaatgccaaaattaactacctcctgggccccgacgctccaccagagttctccctcgactgccgtactgggatgctaaccgttgtgaagaaactggaccgtgagaaagaggacaagtatctgttcactatcctggcaaaagataatggtgtacccccactgacgtctaacgtgactgtgtttgtgagtataattgatcagaatgataattctccagttttcacccataacgagtacaacttttatgtaccggaaaacctgcctcgccacggcaccgttggattgattactgtgacagaccccgactatggcgataatagtgcggtgacattgtccattctggacgagaacgacgacttcactatcgatagccagacgggcgtaattagacccaacatctcttttgaccgcgagaagcaggaatcttataccttttacgtgaaagccgaagatggtgggcgggttagtagatcttctagcgcaaaggttacgatcaacgtagtggatgtcaacgataataaacccgtctttattgttcccccctccaactgctcttacgagctagtactcccgtcgaccaaccctggtacagtcgttttccaggtgatcgcagtagataacgacacaggaatgaatgcggaagtaaggtacagtatcgtcggtggcaacacacgggatcttttcgccatcgatcaggagaccgggaacatcacactgatggagaaatgcgacgttacagacctaggcctccatagagtcttggtcaaggcaaacgaccttggtcagcctgacagcctgttcagtgtggtaatcgtgaatctctttgttaatgagagcgtgacaaacgccacactcattaatgagttagttcgcaaatctacagaggccccagtaacccctaacacagaaattgcggacgtgtcatctcctaccagcgactatgtcaaaatactggtcgccgctgtcgcgggaactattaccgtagtcgtggtgatatttataacagctgtggtacggtgccggcaggcgcctcacctaaaagcggctcagaagaacaaacaaaactccgagtgggcgacccccaacccggagaacagacagatgatcatgatgaagaaaaaaaagaaaaagaaaaagcatagccccaaaaatctgcttctcaactttgtgacgatagaggagaccaaggccgacgatgtggattcagatggcaaccgtgtgacgctggacttgcccatcgacctcgaggaacaaacaatggggaagtataactgggtaactacgcctaccactttcaagccagactcacccgatttagctcggcactacaaaagcgctagtcctcaaccagccttccaaatccagccagagacgccgctgaattctaaacatcacattatccaagagctgccattggacaacacattcgttgcctgcgacagcatctctaagtgctctagcagctctagcgatccctactctgtgtcagactgtgggtaccccgttacaacttttgaagtccccgttagcgtccacacacgccccgtgggtattcaggtgtctaatactacattctag

SEQ ID NO: 201854 - DNA, 3933 bp, Artificial Sequence
  Description of Artificial Sequence: Synthetic coding sequence
atggacctgctgagcggcacctacatcttcgccgtgctgctggcctgtgtggtgttccattcaggcgcacaagagaagaactacaccatcagggaagagatgccggaaaatgtcctgattggcgatttgctcaaggatctgaatctatcactgattcccaataagagcctgacaacagcgatgcaatttaagctcgtttacaaaacgggggatgttccgttaatcagaatcgaagaggatactggcgaaatttttactactggagcccggattgaccgggagaaactgtgcgccggcattcctcgggacgaacattgtttttacgaagtggaagtggctattcttcctgacgagatttttaggctggtcaaaatcagattcctgatagaggatatcaatgacaacgcccccctgttccccgcaaccgttatcaatatcagtatccccgaaaacagtgctattaattcgaagtatacgttgccagccgcggtagatcctgatgtcggcatcaacggggtccagaattatgagctgatcaaatctcagaacatctttggtctggatgtgatcgagactcctgagggagacaagatgcctcaattgattgtccagaaggagcttgatagggaggagaaagacacctatgttatgaaggtgaaagtggaagacggcgggttccctcaacgtagtagcacagccatcctccaggtgtccgtgacagacaccaatgataaccatcccgttttcaaggagaccgagattgaagtcagcatccccgagaatgccccagtggggacctcggtgacccagctccatgctaccgacgctgacattggcgagaatgcgaagattcatttctccttctcaaacctggttagcaatatcgctcgacggcttttccacttaaacgcaacgacaggtctgatcaccattaaggagccactggacagagaagaaactccaaaccacaaactattggtcctcgcctctgatggcggactgatgccggcccgggctatggtactggttaatgttacagatgtgaatgacaatgtgccttcaatagacataaggtatatcgtgaaccctgtcaacgatactgtggtgctgagcgaaaacatcccgctcaacactaagatcgcactcataacggttaccgacaaagacgccgaccacaacgggcgggtgacttgtttcacagaccacgaaattcctttccgacttagacccgttttctctaaccagttcttactggagactgctgcatacttggactacgaatctaccaaagaatatgcaatcaaacttttggctgctgatgcaggcaagccaccgttgaaccagtccgcaatgctgtttatcaaggtcaaggacgaaaatgataacgcccccgtgtttacacagtcattcgtgaccgtatctattcccgaaaataactcccccggtattcaattgactaaagtaagcgccatggatgccgactctggtccaaacgctaagatcaactacctcttaggacctgacgccccacctgagtttagcctcgactgccgaacaggaatgttgactgtggtcaagaagcttgaccgcgagaaagaggacaaatacttatttaccatactggccaaagacaatggagtcccaccgctgacttcgaatgttacagtcttcgtgagtataatcgatcagaacgataatagccctgttttcacccacaacgaatacaatttttacgtcccggagaacctccctcggcatgggaccgttggcttgatcacagtcactgatcccgactacggagataattctgctgtgacgcttagtatccttgacgaaaatgacgatttcactattgacagccagacaggagttatccgtcccaatataagctttgatcgcgagaaacaggagtcttatactttctacgtgaaagctgaagacgggggtagagtgagtaggtcctcatcagcaaaggtgaccattaatgtcgtcgacgtgaacgacaacaagcccgtgttcatcgtgcctcccagcaactgctcctacgagttagtgctgcctagcaccaaccccggaacagtggtgtttcaggtaatcgccgttgacaacgatactggcatgaacgccgaggtgcgatatagcatcgtcggagggaacactcgagacctatttgcaatagatcaggaaactggcaatatcaccctcatggaaaaatgcgacgtgaccgatctcgggctgcatcgcgtgctcgtcaaggctaatgatttgggtcagccagacagcctgttctctgtggtgattgtgaacctgttcgtgaacgagtctgtgacgaatgccacactcataaacgaattggtgagaaaaagcacagaagccccagttacccctaatactgaaattgctgatgtttcatccccgacctcggactatgtgaagatcttggttgccgcagttgccggcaccatcaccgtggtcgtggtgatcttcatcactgcggtcgtccgttgtcgacaagcaccacacctgaaggctgcccagaagaataagcagaactccgagtgggctacccccaatcccgaaaatcggcaaatgattatgatgaagaaaaagaaaaagaagaaaaaacatagtccaaagaacttgctgttgaatttcgtgaccatagaagaaaccaaagctgacgatgtggattccgacggcaatcgggtgacattggatctgccaattgatctggaagaacagacgatgggtaaatacaattgggtgactactcccactacatttaagccagactctcctgacctcgctagacactacaaatcagccagtccccagcctgccttccagattcaaccagagaccccgctgaactcaaagcaccatatcatccaggagttacctctggataacaccttcgtggcatgtgactcgatctctaagtgttcctcttccagcagtgatccttatagcgtcagcgactgtggctacccagtaaccacatttgaagtgccagtttccgttcacacccgcccctcccagcggcgagtgacgttccatctgcctgagggcagtcaggaaagctcttctgatggcggcctgggtgatcatgacgccggttctcttaccagcaccagccacggccttccgcttggatacccacaggaggaatactttgatcgcgctacccctagtaaccgaacggagggggacgggaacagtgatcccgagagcacctttatccctggcctgaagaaggctgctgaaattaccgttcaacccaccgtcgaagaggcaagtgacaactgtacgcaggaatgcctgatttatgggcattcagatgcctgttggatgcctgcctcattggaccattcatccagctcccaggcacaggctagtgcgctatgtcactctccccccctttctcaggcctccacccagcatcattctccgagagtaacgcaaacaattgcgttgtgccattccccacccgtcactcaaactattgccctgtgccactccccaccccctatccaagtctctgcactgcaccacagtccccccttagtgcaagctaccgctctgcaccatagcccacccagcgcgcaagctagtgccttatgttactcaccgcctttagcccaggcagccgccattagccacagctcccctttgccacaggtgattgctctgcacaggagccaggctcagagttccgtgtccctccagcagggctgggtccagggcgccgatggactgtgcagtgtggatcaaggagtgcaggggtccgcgactagccagttctacactatgtccgagcgcttgcaccctagcgacgattctattaaggtaatcccactaactacttttacacctcgccaacaggcccgccccagcaggggcgattccccaatcatggaagaacacccactctag

SEQ ID NO: 201855 - DNA, 4044 bp, Artificial Sequence
  Description of Artificial Sequence: Synthetic coding sequence
atggacctgctgagcggcacctacatcttcgccgtgctgctggcctgtgtggtgttccattcaggagcccaagaaaagaactacaccatcagggaggaaatgcccgagaatgtgctgattggcgacctacttaaagacttaaatctctccctgatcccaaacaaatcgttgacaaccgccatgcagtttaagctggtgtataaaacgggagacgtgcctctaattagaatcgaagaggatactggtgaaatatttacaacaggcgcccgaatcgacagagagaagttgtgtgcgggcatcccaagggatgagcattgcttttatgaagtggaggtggcaattctgcctgatgaaattttcaggttagtgaaaatcagatttctgatcgaggatattaacgataatgcaccccttttcccagccactgttataaatatttcaatacccgagaactcggccatcaattccaagtataccttgccggccgcggtggaccccgacgtcggcatcaacggggtccagaattatgagctgattaagagccaaaatatttttggccttgacgtgattgagacacccgaaggggataaaatgccacagctaattgtccaaaaggaactggaccgagaggagaaggacacctacgtgatgaaggtgaaagtcgaggacggtggcttcccccagagatcttccactgcaatcctacaggtatccgtaactgatacgaacgataatcacccggtgttcaaggaaacggaaatcgaggtttccatcccggagaatgctcccgttggcacttcagtgactcaactgcatgcaactgatgccgatatcggagagaacgccaaaattcacttctcattctccaatctggtgtctaacatcgcacgccggctgttccacctcaacgccactaccggattgatcacaatcaaggaacccctggatagagaggaaacaccaaatcacaaattgctggtgcttgcaagcgacggaggtctcatgccggccagagccatggtgttagtcaatgtgacggacgttaacgacaatgtcccctccattgacatcagatacattgtgaatcccgttaacgacaccgtcgtgttgagcgaaaacatacctctgaacactaagatcgccctcatcaccgttactgacaaggacgcagatcacaacggcagggtgacatgcttcaccgaccacgagatcccttttagactgagacctgtgttcagcaaccagtttctcctggagaccgccgcttatttggactatgagagcactaaggaatatgccatcaagctcctcgctgccgatgcaggaaaacctccactgaaccagtccgcaatgctgttcatcaaggtaaaagacgagaacgacaatgcaccggtcttcacacagtcctttgtgacagtgtcaatccctgaaaataacagtccaggcatacagctgacgaaggtctcagctatggatgccgatagcgggcctaacgcaaaaattaactacctgctggggcccgatgctcccccagaattctctcttgactgccgaacagggatgctcacagtcgtgaaaaagctcgaccgcgagaaggaagataagtacttgtttactatcctggcgaaggacaatggcgtgcccccattaacatcaaacgttacagtgtttgtttccattattgatcagaatgataatagccccgtgttcacacacaacgagtataacttctacgttccggaaaatttgccacgccatggcacggttggcttgatcacagtcaccgaccccgattacggagacaactccgccgtgaccctgagcatcctggacgagaatgatgactttaccatcgattcacagaccggcgtaatccgcccaaatatcagctttgacagggaaaaacaggaatcttacactttctacgttaaagccgaggacgggggccgcgtaagccgcagctcatcggcaaaggtgaccatcaatgttgtggacgtgaacgataacaagcctgtgttcatcgttccaccatctaactgttcctatgaattggtgttgccaagcacaaaccccggaacagtcgtctttcaggtcatcgccgtcgataacgacacaggcatgaacgctgaggtccgctattccatcgttggagggaacacccgcgacctgtttgcgattgaccaggagacagggaacattactctgatggagaaatgcgatgtgactgatctgggcctgcatagggtcctggtaaaagccaatgacttaggccagcctgacagcttattcagtgtagtcatcgtaaatctatttgtcaatgagagcgtaactaacgccacactcattaacgaactcgtacgtaaatctacggaggcccccgtaaccccaaacacagagatcgccgacgtgtctagccccacatccgactacgttaagatcctggtagccgcggtggcgggaaccattacggtggtggtggtgatctttataaccgcagtcgtgcgatgtagacaggcgccccaccttaaggccgctcagaaaaacaaacagaattccgaatgggccacaccaaatcctgagaaccgccagatgattatgatgaagaaaaagaagaaaaagaagaaacactccccaaaaaatcttctcctgaatttcgtgactattgaggaaacaaaggcagatgacgtggacagcgatgggaaccgagtgacactagatttgcctatcgacctggaggagcagactatgggtaagtacaattgggtgactacgcccactacgttcaagcccgactctcctgatctcgctaggcattacaagagtgcaagcccacaaccagcctttcagattcaacccgaaacacctctgaattcaaaacaccacatcattcaggagctgccactagacaatacctttgtggcttgtgacagtatttctaaatgtagtagtagtagctctgacccctactcagtctctgactgcggatatccagttactactttcgaggtgcctgtgagcgtacacaccaggcctcctatgaaggaagttgtccgcagttgtacccctatgaaggaatccaccacgatggagatctggatacatcctcaacctcagaggaagtccgagggaaaagtggcaggcaaatcacaaagaagagttacttttcatctgccggagggctcacaagagagctcctccgatggaggccttggagaccacgacgcaggttctttgactagcactagccacggcctgccgctggggtacccccaggaggaatacttcgaccgtgcaacaccttcaaaccggactgagggcgacggaaacagcgatccagagagcacattcatcccaggtctgaagaaagcggctgagataacggtgcaaccaacggttgaggaggctagtgataattgtacgcaggaatgcttaatttacggacacagtgatgcctgttggatgcccgcaagtctggatcacagttcctcctcgcaggcacaagcaagtgccctctgccactccccacctctttcacaggccagcactcaacaccactcacctcgcgtaacccagaccatcgccttgtgccacagtccacccgtaacacagacaatcgctctgtgtcattctccaccaccaatccaggtaagcgctctgcatcattcaccccctctagttcaggctacagccctgcatcattcccctcccagcgcccaggcatctgcattgtgctattcgcctcctctagcgcaggctgccgccatttcccattcaagcccgctccctcaggtcatcgcccttcatagatcccaagctcagagcagcgtgtctctgcagcagggttgggtccagggcgcggacggtttgtgttccgtggaccagggagtacaagggagcgctaccagccagttttacaccatgagtgaacgccttcacccctctgacgacagcattaaggtgatcccactgacaacctttaccccgcgtcagcaagcccgcccatcccgtggtgattctccaattatggaggaacacccactgtag

SEQ ID NO: 201856 - DNA, 4014 bp, Artificial Sequence
  Description of Artificial Sequence: Synthetic coding sequence
atggacctgctgagcggcacctacatcttcgccgtgctgctggcctgcgtggtgttccactccggcgcacaagagaaaaactacactatccgggaggagatgcctgagaatgttctgattggtgacctgcttaaggacctgaacttgtcacttatcccaaacaaatctctgactacagccatgcaattcaaacttgtttataagaccggcgacgtacctcttatcagaatcgaggaggacacaggcgagatctttacaacaggggcacgtattgatagggaaaagctctgcgcaggaattccaagggacgagcactgcttctatgaggttgaggtggccattttgcctgatgaaatatttagactggtgaagatccggttcctgattgaggacatcaacgacaacgcacccctgttccctgcaacagttataaacatctccattccggagaactccgcaatcaatagcaaatacacactgcccgcagcagtggaccctgacgtgggtattaacggcgttcagaactacgagctgatcaaaagccagaatatctttggcctagatgttattgagacacctgaaggcgataagatgccgcagttaattgtccagaaagagctggaccgtgaagagaaagatacatatgtgatgaaggtgaaagttgaagacggaggcttcccacaaaggtctagtacagccattctccaggtgagcgtaaccgatacaaatgacaatcaccccgtgttcaaggagaccgagatcgaagtgtcgataccagaaaatgccccagtgggaacttctgtcacccagctgcacgcaaccgacgcagatatcggtgaaaatgccaaaattcacttttcttttagcaaccttgtgagcaatattgcacggcgcctttttcatttgaacgccacaactggtctgattactatcaaagaaccactggatagagaagagactcccaatcataagctgctggtgcttgcatccgacggagggctgatgccagcgagggccatggtgctggtcaacgtcactgacgtgaacgataatgtgcctagcattgacatccggtacatagttaacccagtcaatgataccgttgttctatccgaaaatattcctctcaatactaaaattgcccttattacagtcaccgacaaagatgcagaccataacgggagagtgacctgctttaccgatcacgagatcccttttcgccttcgccctgtgttcagtaaccaatttctcctagagactgctgcgtatctcgactatgaaagcactaaagagtacgcgatcaaactgctcgccgctgatgccggcaagcccccactgaatcagagcgccatgctttttattaaggtgaaggatgagaatgacaatgctccggtgtttacccagtcgttcgtaacagtctctatccctgagaataattcgccagggatccagctgactaaggtgtcagccatggacgccgattcggggcccaatgccaaaattaactacttgctgggaccagatgctccacccgagttttctctcgattgcagaaccgggatgctcacagtcgtcaagaagctggatagagagaaagaggataagtacttatttacaattctggccaaggacaacggagttcctccgctcacctccaatgtgacggtgttcgtgtccattatcgaccagaatgataactctcctgtcttcacccataatgagtacaacttctacgtcccggagaatttgcctcgacatggaactgtgggtttgattacagtcacggatccagattacggggacaatagtgcagtcacactctccattctcgacgaaaacgacgactttacaatcgatagtcagacaggggtcattagacccaatatttctttcgaccgagagaagcaggagtcctacacattttatgtgaaagccgaggacggtggccgggtgagtcggtcttcaagtgccaaagttacaattaacgttgtcgacgtgaatgataacaaaccagtcttcatcgtgcctcctagcaactgctcttatgaattagtacttccatccaccaatcccgggactgtggtttttcaggtgattgccgtcgataatgatacaggcatgaacgccgaggtccggtattccattgtgggtggcaatacccgtgatttgtttgccattgaccaggagaccgggaacattactctcatggagaagtgtgacgtcactgacctcggcctgcacagagtcttagttaaagcgaacgacttgggacagccagactctctttttagtgtggtgattgtgaacctttttgtgaacgagtcggtgactaatgccaccctgattaatgaattggtgaggaagtccaccgaggcccctgtgaccccaaacacagagatcgccgatgtttccagccctacaagcgattatgtgaaaattttggtcgcagctgtggcgggaacgatcacggtcgttgtcgtgattttcatcactgctgtcgtccgctgccgccaggcgcctcatttgaaagccgcccagaagaataagcagaacagcgagtgggcaacccctaaccccgagaacagacagatgattatgatgaaaaaaaaaaaaaagaaaaaaaaacatagccctaaaaatctcctgctgaacttcgtcacaatcgaagagacgaaggctgacgatgtggattcagacggcaaccgggttactctcgatttaccaattgatctggaagagcagactatgggtaagtataactgggtgaccactccaaccacttttaaaccagatagcccagacctggctaggcactataaatcagctagccctcaacccgcttttcagattcagcctgagaccccactgaatagcaagcaccacatcatacaagaattgcccctcgacaacacgttcgtcgcctgtgactcaatttctaaatgttcctcatcatcttccgacccctactctgttagcgattgcggatatccagtaacaactttcgaagtgcctgtgtctgtgcacacccggccccctatgaaagaggtcgtgcgaagttgtactcccatgaaggagagcaccacaatggagatctggatccacccccaaccacagtcgcaaagacgcgtaacgttccaccttcccgaggggtctcaggagtcctcctcagatggaggattgggtgatcacgatgcaggttctctcacaagcactagccatggcctgccattagggtacccacaggaggagtacttcgatcgtgcaacgccctctaataggacagagggcgatggtaatagcgatcctgaatccaccttcattcccggcctcaagaaagctgccgaaatcaccgtgcagccgacggtcgaggaggcttccgacaactgtacccaggaatgtttaatttatggccacagtgacgcctgctggatgccagcttctcttgaccacagtagctcatcacaggcccaggcgtctgccctgtgccattctcccccactatcacaggcttctacccaacatcactcccctagagtgacccagacaatcgcactgtgccattcccccccggttactcagactatcgctttatgccatagtccaccacctattcaagtgagcgctctgcaccacagtcctcccctggttcaggcgaccgcactacatcacagccccccttctgcacaagcctccgctctctgttactctccgccccttgcccaagccgcagccattagtcattcttcgcccctacctcaggtgatcgctttgcatcggagtcaggcgcaatcctccgtatcactgcagcagggctgggttcagggggctgacggactatgcagcgtcgatcagggcgtgcaaggttcagctaccagccaattctacaccatgagcgaacgactccacccttccgatgactcgattaaagtgattcccttaactacttttactccccgccagcaggcccggccctcacgtggggattcccccattatggaagagcaccccctttag

SEQ ID NO: 201857 - DNA, 3078 bp, Artificial Sequence
  Description of Artificial Sequence: Synthetic coding sequence
atggacctgctgagcggcacctacatcttcgccgtgctgctggcctgcgttgtttttcatagcggcgcccaggagaagaactatactattcgcgaagaaatgcccgaaaacgttttgattggcgacctgctgaaagacctcaacttgtctttgattccaaataaatccctgacgacagccatgcagttcaagttggtctataaaacaggggacgttcccctcatacggatagaggaggataccggggagatcttcaccacgggggcacgtattgatagggaaaaactttgcgctgggatccccagggacgaacactgcttttacgaggttgaagtcgccattctgccagacgagatttttcgcctcgtcaaaatcagattcttaatagaagatataaacgataacgcccccctgtttcctgctactgtcattaacatttccatcccagagaacagcgccattaactcgaaatacacacttcctgcggctgtggaccctgacgtaggaattaacggcgtacaaaactacgagctgataaagagccagaacatcttcggacttgacgtgatcgagactcccgaaggagataagatgccccagctgattgtgcaaaaggagcttgatcgggaggaaaaagatacttatgtgatgaaggttaaggtagaggatggcgggttcccccagcgttcaagcacagccatcttgcaggtttccgttacagacacaaatgataatcatccagtcttcaaagaaacagagatagaagtgtccatcccagaaaacgcgcctgtcgggacatccgtgacccaactccacgctacggacgcagacatcggcgagaacgctaaaatccactttagtttcagtaatttagtgagcaatatcgcccgtcgcctcttccatctgaatgccacaacggggctaatcacaataaaggagcccttggacagagaggagactcccaatcataaactgttagtgctcgctagcgacggagggctgatgcctgcgcgggcaatggtcctggtgaacgtaaccgatgtgaacgataatgtcccttccatcgacattcgctacatcgtcaatccggtaaacgacacagtagtgctgtctgaaaacatccctctgaataccaaaatcgcactcattaccgttactgacaaagatgccgaccacaacggccgggtcacgtgctttactgatcacgagatcccattcaggctgagaccagtctttagcaaccaattccttctggagactgccgcctacctggactacgaaagtaccaaagagtacgcaatcaagttgttggcagcggatgccggaaagccaccattgaaccagagcgcaatgttatttattaaagtaaaggacgagaacgataacgcccccgtctttactcaaagctttgtgaccgttagcataccggagaataatagccccggaatccagctcacaaaagtgagcgccatggatgctgacagcggccccaatgctaagattaattaccttctggggccagacgcccctccagaattctctcttgactgtaggactggcatgctaaccgtcgtcaagaaactggaccgagagaaggaggataaatacctcttcaccattctggccaaggacaacggcgttcccccactaactagcaatgtcaccgtatttgtttcgatcattgaccagaacgacaactcaccagtgttcacccacaatgaatacaatttttacgtcccggaaaacctgcctaggcacggaactgtcggtttaattactgtgaccgatcctgattatggcgataactcagccgttacgctgagcattctggacgaaaacgacgattttacgatcgacagccagactggagttatacgccctaacattagtttcgaccgagagaagcaggagagttacactttctacgtaaaggctgaggacgggggcagggtgtcaaggagctccagcgcaaaggttacgatcaatgtagttgacgtgaatgacaacaagcccgttttcatcgtacccccttcaaactgcagttatgagctcgtcttacctagcactaacccgggtacggtggttttccaggtgatagccgtggacaatgataccgggatgaacgcggaggtccgctacagcattgttggcggcaatacccgggatctcttcgccatcgaccaggagactggaaatattacactgatggagaagtgcgatgtcacagatttgggcctacacagagtcctcgtcaaggcaaacgacctggggcagccagacagcctgttctccgtggttatcgtgaacctcttcgttaatgagtcagtgacgaatgcgacattgattaacgaactggtccggaagtctacagaagcaccagtcacccctaacaccgagatcgcggacgtgagttctccaaccagtgactatgttaaaatcctggtggcagctgtggccggaacaatcaccgtggtggttgtgatttttatcaccgctgtggtccggtgcagacaggcaccccacctgaaagctgcgcagaagaataaacagaactccgagtgggcaacccccaaccctgaaaacaggcagatgattatgatgaaaaaaaagaagaagaagaaaaagcattcgccaaaaaatttgctgctgaactttgtgacgatcgaggagacaaaggccgatgacgttgattctgatggcaaccgcgtgacgctggatctgcccattgacctggaggagcaaacaatgggaaaatacaattgggtgacaactccaactacttttaaacctgatagtcccgacctggcacggcactataagagtgcatctcctcaaccagctttccaaatccagcctgagacacctctgaattccaaacaccacatcatacaagaactgcctctcgacaatacttttgtagcctgtgactcgatctcaaaatgcagtagcagttcgtctgatccctattctgtcagcgactgtggataccccgttaccactttcgaggtgcctgtttcagtacataccaggccaacagattcacgcacctctaccattgagatatgtagtgaaatttag

SEQ ID NO: 201858 - DNA, 4020 bp, Artificial Sequence
  Description of Artificial Sequence: Synthetic coding sequence
atggacctgctgagcggcacctacatcttcgccgtgctgctggcctgcgtcgtattccacagcggcgcccaggaaaaaaattacaccattcgcgaggaaatgccagaaaatgttctgataggggatctgctaaaggacctgaatctttcgctcatccccaacaagtcactgacaaccgcaatgcagttcaaactggtttacaaaaccggggatgtgcccctgatccgtattgaagaggacacaggagagatcttcaccacgggggcccggatagatagggaaaagctgtgtgcgggtatcccacgagatgagcattgtttttatgaagtcgaggtagcaatcttaccagacgaaatctttcggctggtgaagattcgctttctgattgaggacattaacgacaatgctccactgttccctgcaaccgtgataaacattagcatcccagagaattctgcgattaactcgaagtatacactccccgcggctgttgacccagatgttggtataaacggcgtccagaattacgagttgattaagtcacagaacattttcggacttgatgtgattgaaaccccagagggcgacaagatgcctcagttaatagtgcagaaagaactggaccgtgaagagaaggatacttatgtgatgaaggtaaaagtggaggatggcgggtttccacaaaggagtagcaccgctatcctccaagtaagcgtcacagacaccaacgacaatcatcccgtctttaaagagacggagatcgaagtatcaatccctgagaacgcaccggtcggcacatcggtgactcagttacacgccacagatgcagacatcggcgagaatgccaaaatccattttagttttagcaatctggtgtcaaatatagccaggaggcttttccacctcaatgccaccaccggtttaatcaccatcaaggaaccactggatagggaagaaaccccaaaccataagcttctcgtactagcctctgacggtggactgatgcctgctagggcaatggtgttagttaacgtgaccgacgtgaatgacaatgtgccttccattgatattcgctatatcgtgaacccagtaaacgatactgttgtgctctccgagaatattccactgaacaccaagatcgcattgattacggtcacggataaagacgccgatcataacgggcgggtgacgtgttttaccgaccatgaaatcccattccggctgaggccggtgtttagcaaccagtttctcttggaaaccgcagcctacttagactatgagagcaccaaagaatatgccattaaactgctggctgccgatgcaggcaaaccccccctaaaccagtccgccatgctgttcatcaaggttaaggatgaaaacgacaacgcgcctgtcttcacccagtcgtttgtgacggtaagcatccctgagaataacagccccggtattcagctgactaaggtaagcgccatggacgctgacagcggtcccaacgccaagatcaattacctgcttggacctgatgccccccccgagtttagccttgattgccgtacggggatgctcaccgtagtcaaaaaacttgaccgcgaaaaagaggataagtatctgtttaccatcctggctaaggataacggtgtgccacctctgacttctaacgtcaccgtgtttgtgtcaattatcgatcagaatgataatagcccagtgttcacgcacaacgaatataacttttatgttccagaaaatctaccacggcatggaaccgtgggccttatcacggtgacagaccccgactatggggataacagtgccgttactttgagcattctggatgaaaatgatgattttactatagacagtcaaacaggcgtaatccggcctaatatatctttcgatagagaaaagcaggagtcctacactttttatgtgaaggccgaagacggaggcagagtttccagaagttcctccgccaaagtcaccatcaatgtagtcgacgtgaatgacaacaaaccggtattcattgtccctccatccaattgttcctatgaattggtgctcccaagcacaaatccaggcactgtggtgtttcaggttattgccgtggacaatgataccggaatgaacgccgaggtgagatactccattgtgggcggtaacactagggatctcttcgcaatcgaccaagaaaccggtaacattactttgatggagaaatgtgatgttacggatctggggctgcacagggtgctcgtgaaagctaacgatctgggccagcccgattctttgtttagtgttgtgattgtcaatttattcgttaacgagtctgtgacaaacgccactttaatcaacgaactggtgcggaagtcaacagaggcccccgtgacgccaaataccgagatagccgacgtcagtagccccacctctgactacgtaaagattcttgtcgcagccgtggccggcaccatcaccgtcgtggtggtaattttcatcactgccgtggtgaggtgtcgccaggctcctcatctgaaggctgcccagaaaaacaagcagaattccgagtgggccactccaaaccctgaaaaccgccaaatgatcatgatgaagaaaaaaaagaaaaaaaagaagcatagtcccaagaatctgctgcttaattttgttaccatcgaggaaaccaaagcagatgacgtagacagtgacggaaatcgcgtcactctggatctgccgatcgacctggaagagcagaccatgggcaaatacaattgggtcactacgcccactacatttaaaccagacagtccagacctcgctaggcactacaagtctgcttcccctcagccggccttccagattcagcccgagactccactcaactccaaacaccacataattcaggagcttccacttgacaataccttcgttgcatgcgacagtatctcaaaatgcagctcgagctctagcgatccctacagcgttagcgactgcggctatcctgtcactactttcgaagtcccagtgtccgtccacacccgccccccaatgaaagaggtggtaaggtcatgtacccccatgaaggaaagtactactatggagatttggattcaccctcaaccccagcggaagagtgaaggcaaagtggccgggaagtcacaacgtagagtgacttttcacctgccggagggcagccaggaatccagttcagatggagggttgggggaccacgatgccggctccctcacttctacatctcacgggttacccctgggctatccccaggaagagtactttgacagggcaactccgtctaatcgaaccgagggggacggaaacagcgatccagagtcaactgccgagattacagtccaaccaactgtagaggaggcttctgacaactgcacgcaggaatgcttaatttatggccacagcgacgcctgttggatgcccgccagcctggatcattcttcttcaagccaggcccaggccagcgccctgtgtcatagccctcccttaagccaggccagtactcaacaccattctcccagagtcacgcagaccattgccctctgtcactcaccccctgttacacaaaccattgcactctgtcattctccaccccccatacaggtcagtgccctacatcatagccctccactagttcaagcgaccgcactgcatcatagtccgcccagcgctcaagcatcagccctttgttatagcccacccctggcgcaagccgcggctatctcacatagctctcctctgcctcaggtcatagccttgcatcggtcccaggctcagagctccgtttctctccaacaggggtgggttcagggtgcagatgggctgtgctcggttgaccagggcgtgcagggatcggccactagtcagttctacacaatgagcgaacggcttcacccctctgacgactcaatcaaggtcatcccacttaccactttcaccccgcgccagcaggctagaccttccaggggggattcccccatcatggaagagcatccgttgtag

SEQ ID NO: 201859 - DNA, 3198 bp, Artificial Sequence
  Description of Artificial Sequence: Synthetic coding sequence
atggacctgctgagcggcacctacatcttcgccgtgctgctggcctgtgtggttttccatagcggtgcccaggagaagaactataccatcagagaagaaatgcctgaaaatgtgctcatcggcgatctccttaaggacctgaatttgtccctgattccgaacaagtccttgactaccgcgatgcagttcaagctggtttataaaaccggagatgtccccctgattagaattgaagaggataccggcgagatttttacaacgggagcccggattgatagagaaaagctgtgtgctggcatacctcgggatgaacattgcttctatgaggtcgaggtcgcaattctgcctgacgagattttcagactggtgaagatccgctttctaatcgaggatatcaatgataatgctcccctttttccagccactgtcatcaacataagtatccctgagaactctgccattaatagtaagtacacactgccagcagccgttgatcctgacgtgggcattaacggcgtccagaactacgaattgattaagagccaaaacatctttggtcttgacgtgatcgaaactcctgagggcgacaagatgcctcaactgattgtccagaaggaactcgatcgtgaggagaaagatacgtatgtcatgaaggtcaaagtcgaagatggcggtttcccccaacggtctagcactgcaatattacaggtcagcgtgactgacaccaatgacaatcatcctgtcttcaaagaaactgaaatagaagtaagcatcccagagaatgcacctgttggcacttctgtcacccagttacacgcaactgacgccgacattggggagaatgctaagatccacttttccttctccaatctcgtgagcaacattgctcgcaggctgtttcaccttaacgccaccaccgggctgataactatcaaagaaccgctggatcgggaagagaccccaaatcataaactgcttgtcctggcgtcagacggaggattaatgcccgctcgtgcaatggttcttgtgaacgtaactgacgtgaatgacaatgtcccatcgatcgatatcagatacattgtcaaccctgtcaatgataccgttgtgttgtcagaaaacatcccgctcaacaccaaaatagcactaatcacggtgacagacaaagacgctgatcacaatggaagggtcacctgctttaccgatcacgagatccccttcagactgagaccagtgttttctaatcagttcctgctggaaacagccgcctatctagactacgaaagtacaaaggaatacgcgatcaagctgctggcagccgatgctggaaagccccctctgaaccagtccgccatgctgttcatcaaggtgaaagatgagaacgacaatgctcccgtgtttacccaatccttcgtcaccgtctctatcccagagaataattccccgggtatccagcttacgaaagtttctgctatggacgctgattcaggaccaaatgctaaaattaactatctactcggtcctgacgcccccccggaatttagcctggattgtaggacaggcatgttgacagtcgtcaagaagctcgacagggaaaaggaagataagtatctgtttaccattttggccaaggacaatggtgtcccacccttaacttccaacgtgaccgtgtttgtgtccattattgatcagaatgacaatagccccgtcttcacacacaacgaatacaatttttatgtccccgagaaccttccaaggcacggcacggtcggcctgatcaccgtaacggacccagactacggcgataactccgcagttaccttgagcattcttgatgagaacgacgatttcactatcgacagtcagacaggcgttatccggcccaatatatcatttgaccgggaaaagcaggaaagttatacattttatgtgaaagccgaagacggaggccgagtgtctagatctagtagtgcgaaagtaactatcaacgttgtcgacgtgaacgataacaaacctgtctttattgtgccaccgtctaactgcagctatgagctggtgctgccctctaccaacccgggcactgtggtattccaggtcattgcggtggacaacgatactggcatgaatgcggaggtgcggtactccattgtgggaggcaacacaagagacttgttcgcaattgaccaggaaacggggaacattacactcatggaaaaatgcgacgttactgacctgggactacaccgtgtgctggtgaaagccaatgatctaggtcagcccgactccctcttttccgtcgttatcgtgaatctttttgtcaatgagtcggtaactaacgcaaccttgatcaacgaactggtgcggaagtctacagaggcgcccgtcacacctaataccgaaatagctgacgttagctctccaacctccgattatgtcaaaatcttagtggcagccgtggccggaaccattaccgtcgtggttgtgatttttatcactgccgtagtccgttgcagacaggcgcctcatctgaaagctgcccagaagaacaaacagaatagcgaatgggctacgcctaatccagaaaacagacaaatgatcatgatgaagaagaagaaaaaaaagaagaaacattctccaaaaaaccttctcctgaattttgtaaccattgaagaaaccaaggcagatgatgtggactccgatgggaatcgcgtgacgcttgatctgcctatcgatttagaggaacagactatgggaaaatacaattgggtgaccacacctacgactttcaaacccgatagtccagatctcgcccggcactacaagtctgcaagtccgcagcccgccttccagatccagcccgaaaccccactgaactctaagcaccatattatacaggagctaccactggacaatacattcgtcgcctgcgactcgatctctaagtgtagttcaagctcaagcgacccttactctgttagtgactgcggttacccggtgaccacctttgaagtacccgtgagtgtacacaccagacccccaatgaaggaggtggtgagaagctgtacacctatgaaggagagcaccaccatggaaatctggattcacccacagcctcagcgtaaaagcgaaggtaaggtggctggcaagactgtgctgacatcttcttcgccaagcgcaatgaccctgagttacttggactag

SEQ ID NO: 201860 - DNA, 1344 bp, Artificial Sequence
  Description of Artificial Sequence: Synthetic coding sequence
atggccaccgccgccaccaccaccaccaccaccaccgccaccgtggcgctaacaacctcctgggacaacgccaccgggagaccgaccgccgaaccagatcctatactcgataattacgttttgctggtagtggtaatgagtctgttcgttgggggaacgcttgtcgtgttgtctggcgtcctgctcctatgtaagaggtgttgggatgttcatcaaaggttgaacagggctatggaagaagcggaaaaaactaccactacgtacttagacaacggtactcatccagcccaggacccggacttccgtggcgaagacccagagtgtcaagacgcagagacagaacgcttcctgtccacatcctcaaccggcaggcgggttagcttcaacgaagcagcactcttcgaacagtcccgaaagacccaggacaagggacgccggtatactcttaccgagggtgactttcatcacttaaaaaatgcaaggttaacccacttgcacttacctccactgaagatcgtgactatacacgagtgcgacagtggcgaggcatcgagtgctacaaccccacaccctgcaacctctccaaaggccacactggccatcttccagcctcccggaaaggccttgacggggcgctccgtcggccctagtagtgctctacccggggatccatataacagcgccgctggggcgaccgacttcgccgaaatctcaccatccgcaagttcagattctggcgagggcacttcgcttgacgctggcacacgaagcacaaaagccggcggcccaggcgcagcggctgggcccggggaggcaggtcctggatccggagccggcacagtccttcagtttcttacgaggcttcgacggcatgcttctctggatggggcgtctccgtattttaaagtgaagaaatggaaacttgagccatcccagagggcagcttccttggacacacgcggctcccccaagcgacaccacttccagcgtcagagagccgcttctgagtcgacagagcaggaggagggagacgcacctcaggaggatttcatccaatatatcgccagagccggcgacgcagtggccttcccgcatccaagaccctttttagcctctcccccccctgccttggggaggtacttttctgttgacggtggggccagaggggggcccgtgggcccttgcccacccagtcctcctcccagacggcccagagaaagatcccctgggcctgtggatacccggagccccgccagtagcggcaaagcaccgccccggggcggactgacaggggctacttctcccgcctggacacgcggcgggaaacagggtgagacgggatag

SEQ ID NO: 201861 - DNA, 3114 bp, Artificial Sequence
  Description of Artificial Sequence: Synthetic coding sequence
atgaccgtgggcttcaacagcgacatcagcagcgtggtgcgggtgaataccaccaattgccacaaatgtctgctctctggaacatacatcttcgccgtcctgctagtgtgcgttgtgtttcattccggcgctcaggaaaagaattacactatcagggaggagatccctgagaacgtcttgattggcaatctgttgaaggacctgaacttgtctctaattccgaataaaagtctgacaaccacaatgcaatttaagcttgtatataagacgggcgatgtgccactaattcggattgaggaagataccggtgagatctttactaccggtgctagaatcgaccgcgagaagctgtgtgcgggcatacctcgagacgaacattgtttttacgaagtggaggttgccatccttccagacgaaatctttcggttggtcaagatccggttcctaattgaggacatcaatgacaatgctcccttgttcccagctaccgtcattaatatctccatccccgagaatagcgccatcaacagtaaatacaccctaccagccgctgtggacccagacgttggaattaacggggtccagaactatgaattaattaaatcgcagaatattttcgggttagacgtgattgagaccccagagggggataagatgcctcagctgatcgtgcaaaaagaactcgacagggaggagaaagatacctacgttatgaaggtgaaagtcgaagacggcggattccctcagcgttctagcacggcgattctgcaggtgagcgttactgacacgaatgacaaccaccccgtatttaaagagaccgaaatcgaggtctctattcccgagaatgcacccgtcggaacatccgttacccagctgcacgcaacagacgccgacattggtgagaacgccaagattcacttctctttttcaaacttagtgtccaatattgcaaggcgattgttccatttaaatgcgacgacaggcctgatcacaattaaggaaccactggacagggaagagactcccaaccataagctgctggtgctggcctccgatggcggcctgatgcctgcacgcgccatggttctggtgaacgttacagatgtaaacgataacgtgccctccatcgacatacggtacatagtgaatcctgtgaatgatacggtcgtcctttcagaaaacattcctctgaacactaagatcgcgctgattactgtcaccgacaaggatgcagatcacaacggcagagtgacttgctttacagaccatgaaatcccctttaggctccggccggtattctccaaccagtttcttcttgaaaacgcggcgtacctcgactacgaaagcactaaggagtatgccataaagttgcttgctgctgatgcggggaagcctcccctgaatcagtccgccatgctgttcattaaggtcaaggacgaaaacgataacgctccagtcttcacgcaaagctttgtgaccgttagtattccagagaataattcccccgggattcagctcatgaaggtgagtgcaacagatgcagactcaggcccaaacgctgaaatcaactatttgttaggtccggacgccccccccgaattttctctggacaggcggaccggcatgctgaccgtcgtgaaaaaactggaccgcgaaaaggaagacaaatatctgttcaccatcctggctaaggacaatggagtacctccattaacatcaaatgtcactgtctttgtgagcatcattgaccagaacgacaacagccctgtgttcacacacaacgaatacaaattttacgtaccagagaatctgccacgacatggtacagttggattaattacagtgacggaccctgattacggggataactcagccgtgacacttagtattctggacgagaatgacgattttacaatcgatagccagacaggcgtcatccgccccaatatcagttttgatagagaaaaacaggagagttatactttttacgtaaaggccgaagacggggggcgagttagtcggtccagtagtgctaaagtgactatcaatgtcgtcgatgtgaatgataataaacccgtgtttattgtccctccctacaattattcatacgagctggtattgcctagcaccaaccctggcacagtggtttttcaggttatcgccgtcgacaacgacaccggaatgaacgctgaggtgcgatattctatcgtgggtggaaacaccagagatctgtttgccattgatcaagagaccgggaacatcacactcatggaaaagtgcgacgtcaccgatctggggctccatagggtgctggtcaaggcaaatgacctcggccagcccgacagcctctttagtgtcgtgatcgtcaacctgttcgttaatgagtccgtaactaacgccacactgatcaacgagcttgtgcggaagtcaatcgaggccccagtgacaccgaacaccgagatcgccgatgtttcatcccctaccagcgattacgtgaagatcttggtggcggctgtggcgggaacgatcacggtcgtcgtagtgattttcattacggctgtggtgaggtgtcggcaggccccacatcttaaggcagcgcaaaagaacatgcagaactctgaatgggcaacgccaaacccggagaatagacaaatgatcatgatgaagaagaagaaaaaaaaaaagaaacatagccccaaaaacttactcctgaacgtggtgaccatcgaggaaaccaaggctgacgacgttgacagtgacggcaaccgcgtgaccctggatctccctatagatctcgaggagcagaccatgggaaagtacaattgggttaccacccccactacttttaaacccgactccccagatctagctcgccactacaaatcagctagtccacaaccagcattccagatccagcccgaaactccactgaacttgaagcaccacatcatccaggagctaccactggacaatacctttgttgcatgtgattccatctctaactgtagttcatcctccagtgacccatactcggtttcagactgtggctatcccgtgacaaccttcgaggtgccagtctccgttcatacacggccaacagatagtaggacatag

SEQ ID NO: 201862 - DNA, 3147 bp, Artificial Sequence
  Description of Artificial Sequence: Synthetic coding sequence
atgttccgggtgggcttcctgatcatcagcagcagcagcagcctgagccctctattactcgtgtcagtggttagagtaaacactaccaactgtcataagtgcttactatcaggaacctacatcttcgccgtgctacttgtatgcgtcgttttccactctggggcacaggagaaaaactacactatacgggaagagatccctgagaatgtgctcatcggtaacctccttaaagatctcaacctctccctgattcccaacaaaagcttgacaactacgatgcagttcaagctcgtttacaaaaccggagacgttccactcatccgcatagaggaagacacaggcgagatcttcaccaccggcgccagaattgacagggaaaagctctgtgcaggaatcccacgagacgagcactgtttttatgaagtcgaggtcgccattctgccagacgagattttcagactggtcaagatcagatttcttatcgaggacattaatgataacgcaccgctctttccggctacagtgatcaatatctccatccccgagaactcagcgatcaactctaagtatactttgcccgcagccgtagacccggatgtggggatcaacggagtacagaattatgaactgataaagagccaaaacatattcggtctcgatgtgattgagactcccgaaggcgacaaaatgccccagcttattgtgcagaaggaactggatagagaggaaaaggacacttacgtgatgaaagtgaaagttgaggacggcggtttccctcagaggtcctccacagccatcctgcaagtgtccgtgactgatacaaatgataatcaccctgtgtttaaagagacagagatagaagtgtctatacccgaaaatgcaccggtgggaacaagcgtcactcagctgcacgccaccgatgctgatatcggcgagaatgccaagatacatttcagcttcagcaatttggtatctaatatcgccagacgcctcttccatctgaatgctacaacaggcctgatcaccataaaggaaccactggatagggaggaaacgccaaatcacaagttgctggtgctggcctccgacggtggactaatgcctgcgcgtgcaatggtgttggttaatgttaccgacgtcaatgataatgtcccatctatagacatccgctatattgtcaatccagtaaatgatactgttgtactgtccgaaaatatacccctcaacacgaaaatagccctcattactgttacggataaggatgcagaccataatggtagggtaacgtgctttacagaccacgagattccattccggttgagacccgtcttttccaatcaattcttgctcgagaatgcagcctacttggactacgagagcaccaaggagtatgctattaagctcctggccgccgacgccggcaagcctccacttaaccagtccgcgatgctctttattaaagtgaaggacgagaatgacaacgctcccgtgtttacgcagagtttcgtaactgtaagcataccggaaaacaattctccgggaatccagctcatgaaagtcagcgccaccgatgcggactccggcccaaacgctgagattaattatctcctcgggccagatgcacctcctgaatttagcttggatagacggaccgggatgctgaccgtggtgaagaaactggacagagagaaagaggataagtatctgtttacaatcctcgccaaggacaacggagtccccccgcttactagcaacgttaccgtgtttgtctcaattatcgatcaaaacgataatagcccggtgttcacccacaacgagtacaaattttacgtccccgagaacctccctagacatggaaccgtcgggctgattacagtaactgatccagactacggcgacaactccgcagtgaccctgtcaattctggatgaaaatgacgatttcacaatcgactcccaaacaggtgtgattagaccgaacatatcattcgatagggagaagcaggaaagctacactttctatgtgaaggccgaagacggaggtcgtgttagtagaagtagttcagcgaaggttactatcaacgtcgttgacgtgaacgataataagccagtcttcatcgtgcccccatacaattacagttatgagttagtacttccgtccacgaaccccggaacagttgtattccaagttattgccgtggataatgatacgggcatgaatgccgaggtcagatactctattgttggcgggaacactcgggacctgttcgcaattgaccaggaaaccggtaacattaccctgatggagaagtgcgatgtcaccgacctggggttgcatcgggtcttagttaaggccaatgatcttggacagcccgattccctgttctcagtggttattgtgaacctgttcgtaaacgaaagcgtgaccaacgcaaccctcatcaacgaactggtgcgcaaaagcatcgaggcccccgtcactcctaacactgaaattgccgacgtcagctcgcccacaagcgattatgtgaagatcttggtcgccgcagtcgcgggcactataacagtggtagttgtgattttcataaccgctgtggtacgctgccggcaggccccacacctgaaagctgcccaaaaaaatatgcagaactcagagtgggccaccccgaatccagaaaaccgtcagatgatcatgatgaagaaaaaaaaaaaaaagaagaaacactcccctaagaatctgctcctgaacgtggtgacaatcgaagaaacaaaggcagacgacgtagattcagacggcaatcgcgtcacccttgacttacccattgacctcgaagagcaaactatgggtaaatataactgggtgacgacaccaacaacttttaaacctgattcaccagatttagctagacattataagagtgctagtccacaaccagcctttcaaatacagcccgaaacacccctgaatcttaaacatcacatcatccaagaactccccctcgacaacaccttcgtggcgtgcgactccatctctaattgctcctcttcaagctccgacccctattcagtctcagactgtgggtacccagtgaccacattcgaggtgcctgtgtccgtccacaccaggccgaccgatagtagaacatag

SEQ ID NO: 201863 - DNA, 3960 bp, Artificial Sequence
  Description of Artificial Sequence: Synthetic coding sequence
tgagtggtgcgggtgaacaccaccaactgccacaagtgcctgctgagcgggacctacatcttcgccgtcctcttagtatgcgtagtgtttcacagtggagcccaggagaagaattatacaataagggaagagataccagagaatgtgctcataggaaatctgctcaaagatctgaaccttagtctgattcccaataagtcacttacaacaacaatgcagttcaaactggtttacaagaccggtgacgtgccactaattcgtatcgaggaagataccggagaaatctttaccactggggccaggatcgatcgcgagaagctctgtgcagggatcccaagagatgaacactgtttctacgaagttgaagtggccatccttcccgatgagatcttccgattggtcaagatcagattccttatcgaggacattaatgacaatgctccactgttcccagccaccgtgattaacatctccatcccggaaaattctgctatcaattccaaatatacgctgcctgccgccgtggaccccgatgttggcatcaatggtgtgcagaattacgagctgattaagtcccagaatatctttggcctagatgttattgaaactcccgagggcgacaaaatgccgcagctcatagtgcagaaggaactggacagggaggaaaaggacacctacgtgatgaaagtgaaagtcgaggatggcgggttcccccagagatcgagcaccgctatcctccaggtgagcgtcaccgacacaaatgataaccaccctgtgtttaaagagacggaaatcgaggtgagtattcctgaaaatgcgcctgtgggcacctccgtcacccagcttcacgcaactgatgcagatatcggtgaaaacgcaaagattcacttcagtttcagtaacctagtgtccaatatcgctaggcgcctcttccatttgaacgccactaccggactgataacgattaaggaacctttagatcgagaagaaactcccaatcacaagttgctggtcctggcttccgacggcggccttatgccggctagggccatggtcctggtaaacgtgaccgacgtaaacgacaatgttccttccatagatatcaggtacatcgtgaacccggtgaatgacacagtagttctgtccgagaacatacctctgaacacaaaaatcgctctgattaccgtcactgacaaggacgctgatcacaacggccgcgtcacctgctttactgaccatgagatcccctttagactccggcctgtattttccaatcagttcctcctggaaaatgcggcctatctggattatgagtctaccaaggaatacgccatcaaactactggccgccgatgctggcaaaccacccctgaaccagagcgcgatgctgtttataaaggtcaaggatgaaaatgataatgcccccgtgttcacacaatccttcgtgactgtctccatccccgaaaacaactctcccggcatccagttgatgaaggtgtcagccactgatgcagacagtggacccaacgctgagattaattatctgctggggcctgacgcccctcccgaattttccctggatcggcgcaccggcatgcttaccgtggtgaaaaaactagatagggagaaggaagacaagtatttgttcacaattctggcgaaagataatggagttcctcctttgacaagtaacgtaaccgttttcgtttctattatcgatcagaatgacaactcaccggtattcacccacaacgaatacaagttctatgtgcccgagaatttgcctcgacacggcactgtgggcttgattactgtaaccgaccccgactacggtgataactcagctgtgacattatccattctcgatgaaaacgatgattttacaatcgattcccaaacaggagttattaggcccaacatcagcttcgaccgggaaaagcaagagtcatataccttttatgtgaaggcagaagacggggggagagtgtctaggtcttcatcagctaaggtgacaatcaacgttgtggacgtgaacgataataaaccggtctttatcgtgccaccgtataattatagctatgagctcgtactcccaagcacgaatcccgggactgtggtctttcaagtgatagctgtagataatgacacggggatgaatgccgaagttcggtatagtatcgtggggggaaacacccgcgacctattcgccatcgaccaggagacaggcaacatcacactgatggaaaaatgtgatgtgactgacctaggactgcatagggtcctggtgaaggcaaatgacctgggtcagccagattccctcttttctgtggtaatcgtgaacctgtttgtgaacgagtccgtgacaaatgccacacttatcaacgagctggtcagaaaaagtatagaggccccggtcacacccaatactgagattgcagacgtatccagtccaacctccgactacgtcaagatcttagttgctgccgtggcaggcaccatcaccgttgttgtggtgatctttatcaccgcagttgtgaggtgtcgccaggccccacacctcaaggcggcacaaaaaaacatgcagaactccgaatgggcgaccccaaatccagagaaccgccagatgattatgatgaaaaaaaagaaaaagaaaaaaaaacatagtcccaagaatttgttgctcaatgttgtaaccatagaggagacaaaggctgatgacgtggatagtgacggcaaccgtgtgacactggacctaccgattgacctggaagaacaaacaatgggaaagtacaactgggttactacacctactacattcaagcctgactctcctgatcttgcgagacactataagagcgcatccccacagcccgccttccagatccagcctgagacccctctcaacttgaaacaccacattattcaggaactacccctggataacacattcgtcgcctgcgactccataagcaattgttccagcagtagtagcgatccttactccgtatcagactgcggttaccccgtaacgacattcgaagtccccgtatccgtacacacccgtcccagtcagagaagagtcactttccacttgcctgagggctcccaggaaagctcaagtgacggcggcctgggagatcacgatgctggctccctgacctcaacctcacatggactgcctctcggatacccccaggaggaatattttgacagggctaccccctccaatcgtacagaaggcgatggcaactccgaccccgaatccacctttatcccaggtctgaaaaaggaaattaccgttcagccaactgtggaggaggcatccgataattgtacacaggagtgtcttatttatggccatagtgacgcgtgttggatgcctgcaagcctcgatcattcctcttcatcacaggcccaggcctcggctctatgtcactccccgccgttaagccaggctagcacgcagcaccacagccctcccgtgacccaaactattgtactctgtcacagtcccccagtaacacagactattgctctgtgtcacagccctccccctattcaagtcagcgctctgcatcatagtccaccacttgttcagggaacagccctgcaccatagccctcctagtgcccaggcatccgctctatgctatagccccccgctcgcccaggctgcagcaatttctcacagctcctcattacctcaggttatcgctctgcatcgctcacaagcacaatcttcggtgtccttgcagcagggctgggtccagggggcaaacgggctgtgttccgtggaccagggagtgcagggaagcgccacatcccagttctatacaatgtcagagcggctgcacccctctgacgattcaatcaaggtcatcccccttaccacctttgcaccccgtcagcaggcacggcctagccgcggtgattcacctattatggaaacacatcccttgtag

SEQ ID NO: 201864 - DNA, 1080 bp, Artificial Sequence
  Description of Artificial Sequence: Synthetic coding sequence
atgcggagcatccggaagcggtggaccatctgcaccatcagcctgctgttgattttctacaagactaaagagattgcccggacggaagagcatcaggagacacaattaatcggcgatggagagctctcactgagtagaagtctagtcaactcttctgacaagatcatccgaaaggcaggatcttctatctttcagcataatgtggagggctggaaaatcaactcatcgctggtgctcgagattcgaaaaaatatcctacgctttttagacgcagagcgtgacgtgtccgttgtgaagtcttcctttaaaccaggggacgtcatccactacgtattggaccggcgcaggaccctgaatatcagccatgacctgcacagccttctgccagaggtgtcccctatgaagaatcgcagatttaaaacatgtgcagtggtcggaaattccggtatcctgttggacagtgagtgcggcaaggagatcgattcccataacttcgtgatcaggtgtaacctggcaccagtcgtggagtttgctgccgatgttggcactaaatctgattttattactatgaatccatccgttgtgcaacgtgccttcggcggcttcaggaacgagagcgatcgggaaaagtttgtccaccggttatcgatgttaaatgattcggtcctttggatccctgcgttcatggtaaaggggggagaaaaacacgtggagtgggtgaatgcactgatcctcaaaaataaattgaaagtaaggacagcttacccatcactgcgactgattcatgcggtccggggctactggctgactaataaggtcccaatcaaacgcccaagcactggcctgctgatgtacactctggctacgcggttctgcgacgagatccacctgtacgggttttggccattcccaaaggacctaaacggaaaagccgtgaagtatcactactatgacgacttgaaatacaggtactttagtaatgcctctcctcaccgaatgccgttggagtttaagactcttaatgtcctccataacagaggggcccttaagctaacaaccggaaaatgtgtgaaacagtag

SEQ ID NO: 201865 - DNA, 72 bp, Artificial Sequence
  Description of Artificial Sequence: Synthetic coding sequence
atgatgcagctgctgcagctgctgctgggcctgctgggccccggcgggtacctgttcttactgggcgattag

SEQ ID NO: 201866 - DNA, 3480 bp, Artificial Sequence
  Description of Artificial Sequence: Synthetic coding sequence
atgtacctgagcatctgctgctgcttcctgctgtgggcccccgccctcacacttaaaaaccttaactattccgttccagaagagcaaggcgccggtacagtaattggcaacatcggcagggacgcccgcctccagccaggcttaccgccagccgagcggggtggaggaggccgatctaagtctgggtcctaccgagtcctcgagaacagcgcacctcatctgttggatgtagacgcagactctgggctgttgtatacgaaacagcgcattgaccgcgagtctctgtgcagacataacgccaagtgtcagcttagtttagaggttttcgcaaacgacaaagagatctgcatgattaaggtcgagatccaagacatcaacgacaatgccccaagcttttcaagcgaccagattgaaatggacatcagcgagaacgctgcccccggcactaggtttccattgacttccgcccatgaccccgacgccggggagaatgggctgagaacgtatctgctaacaagagacgaccacggcctgttcggcctggatgtcaaaagtcgcggcgacggcactaagtttccggaattagtgatacaaaaagctcttgatcgtgagcagcagaaccatcatacactcgtactaaccgccttagacgggggagagccaccaaggagcgcgaccgtccaaattaatgtaaaggtaatagactccaacgacaacagccctgtatttgaggcaccaagctatcttgttgaactgccggaaaatgcccctctgggaacggtggtgattgacttgaacgctacagacgccgatgaggggccgaacggcgaggtgttgtattccttctcttcctatgtccctgatcgagtaagggagcttttttccattgacccaaagaccggcctgattagggtgaaggggaatctggattatgaggagaatggcatgctggaaattgacgtgcaggcccgtgacctgggcccgaatcctatcccagcacactgtaaggtaacggtgaaattgatcgatagaaatgataatgccccctcaattggcttcgtctccgtgcggcagggagcactgtccgaagcagcgcctcccggcacagtcatcgcgctggtgagggtgaccgacagggacagcggaaagaacggccaattgcagtgtagggtgctgggaggaggggggaccggaggagggggcgggcttgggggccctgggggcagtgttccatttaagctggaagagaactatgataacttctacaccgtcgttactgataggccactcgatcgtgaaacacaagatgagtacaacgtgactatagtcgcgcgggatgggggatcccctcccctgaatagtaccaagagttttgctattaaaatcctggatgaaaacgataacccccctagattcactaagggcctgtacgtgctgcaagtacacgagaacaacattccgggtgagtacctgggaagtgtattggcccaggaccccgatcttggccagaatgggaccgtgtcctatagtattctccccagtcatattggggacgtttcgatttacacctacgtctctgtgaacccaaccaatggggctatctacgctttgcgtagttttaacttcgaacagactaaggccttcgaattcaaggtgttagcaaaggattccggagcacccgcccatctcgagtctaacgctacagtgagagtgactgttttggacgttaatgataatgccccagtaattgtcctgcctactctacagaatgatacggcggaactgcaggtgccgaggaacgcaggactcggctacctagtatccaccgttagggccctggacagtgatttcggcgagtcaggcaggctgacatacgagattgtggatgggaatgatgaccacctctttgagatcgatccatcctctggggagattcgtactcttcacccattttgggaggacgtgacacctgtcgtggagctggttgttaaagtgaccgaccacgggaaaccaaccctcagcgctgtagcgaaactcataattaggtccgtttcagggtccctgccggaaggcgttccaagagtgaacggggagcagcaccattgggatatgtcattgccgttaatcgtcactttatctacgatctcgatcatcttactcgctgccatgatcaccatcgccgttaagtgcaagcgcgagaacaaagagattagaacttacaattgtaggatagccgagtactcacacccccagctcggaggcgggaagggaaagaaaaagaagattaacaagaatgatatcatgttggtgcagtctgaagtagaggagcgaaacgcaatgaatgttatgaatgtggtgtcttccccaagtttagcaacctcgccaatgtacttcgactaccagactcgtctgccacttagttcccctaggtccgaagttatgtacctgaaacctgctagcaataaccttacggtgccccagggacacgcaggttgtcacacctcctttactgggcaggggacaaacgcatccgaaacaccagcaactaggatgtcaatcatccagacggataatttccctgcggagccaaattacatgggatcccgacagcagtttgtgcagagtagcagcacctttaaagaccctgaaagagcctccctgcgtgattccggacacggcgattcagatcaagcggatagtgatcaggatacgaacaagggctcatgttgtgacatgagcgttagagaggcactgaagatgaaaactacaagtacaaagtcccaacccctcgagcaggaacctgaagagtgtgtcaattgcactgacgagtgtcgggtgcttggccattcagacaggtgctggatgcctcagtttcccgcagcaaaccaggccgaaaatgccgattatcggacgaacctgttcgtgcctacggtagaggcaaatgtggagactgaaacatacgaaactgtcaacccaacaggcaaaaagacgttctgtacatttggtaaagacaaaagggaacatacaatcctgatagcaaacgtaaagccatacctaaaggctaagagggcgctgtctccactgctgcaagaggtacctagtgcctcatcgtccccgacaaaagcatgcattgagccctgtacctcgaccaagggtagcctggatggatgcgaagctaaacccggcgccctggccgaagcatctagtcagtaccttcctactgattcgcagtatttgagtccgagtaagcagccacgggaccccccatttatggcgtcagatcagatggcccgggtctttgctgatgtgcacagccgggcgagcagggattcctctgaaatgggagcagtgctggagcagttagaccaccccaatcgagatctcgggagggagtccgtcgatgctgaggaggtcgtccgggaaatcgacaagctcttgcaagattgtcgtggcaacgacccagtcgcagtgcgaaagtag

SEQ ID NO: 201867 - DNA, 3408 bp, Artificial Sequence
  Description of Artificial Sequence: Synthetic coding sequence
atgcaccagatgaacgccaagatgcacttccggttcgtgttcgccctgctcattgtgtccttcaatcacgacgtcctcggaaaaaacctgaaatataggatatatgaagaacaacgggtgggaagcgtgatagccaggctgtcagaagatgtcgctgacgttttgctcaagcttccgaatccgagtacagtgcgctttagagcgatgcaaagaggaaatagcccgctgctggttgtcaacgaggacaacggagaaatatcaattggggccaccatagacagagagcagctatgtcagaaaaatttgaattgctcaattgagttcgatgtcatcaccctccccaccgagcacttgcaactgtttcacatcgaggtggaagtcctagatatcaatgataactccccacagttttccaggtctctgatccctatcgaaatttcggaatcagcagcagtgggtacccgcatacctctggatagcgcctttgacccggacgtcggggaaaacagtcttcacacctactccttatccgcgaacgacttttttaatatcgaagtacggaccagaactgacggagcaaaatacgctgagttgattgtggtccgggagctagatcgggagcttaaaagtagttacgaactgcaactgaccgcttcagatatgggggtaccgcagagatctggcagcagcatactaaaaatcagtatctccgattcaaacgacaatagtcctgccttcgaacaacagtcttacatcattcagctgctggagaattctcctgttggtacattgctgctggacctgaacgcgacggaccctgatgaaggcgccaatgggaaaatagtctactccttttcttctcacgtttctccaaaaatcatggagacctttaaaatcgattcagagcgtggccatcttacactcttcaagcaggtcgattacgaaattacaaaatcatatgaaatagacgtgcaggcccaggatctgggtccaaatagcatcccagcccattgtaagatcatcataaaggttgttgatgtgaacgacaataagccagaaataaacatcaacctgatgagccccggcaaagaagagatcagttatatctttgagggagaccccatcgacaccttcgtggcactggtaagggtacaggacaaggattccggtctgaatggagaaatagtgtgtaaactccacggccacgggcattttaaattgcagaaaacgtatgaaaacaattaccttattctgaccaacgccaccctggatcgagaaaaaagaagcgaatactcattaacagtgattgccgaggaccgtggcacccccagtctctctaccgtgaaacatttcactgtccagatcaatgatattaatgataatcctcctcattttcagcgctcccggtatgaattcgtgatatcagaaaacaatagcccaggggcctatattaccacagttacagccacagatcccgatctgggagaaaacggacaggtgacctatactatactggagagttttatactcgggtcctcaatcactacttacgtgacaatcgacccaagcaacggggctatctacgctcttcggattttcgatcacgaagaagtcagccagattacatttgtggtggaagcgcgggacggagggtctccaaagcagttggtgagtaataccaccgttgtgttgacaataatagacgagaatgacaacgtgccggtggtcattgggcctgcattgaggaacaataccgctgaaattaccatccccaaaggtgccgagagcggttttcatgttacccgcatcagggcaatagacagggacagcggtgtgaatgccgagttaagctgcgcaattgtggccgggaatgaggagaatatctttattatcgatccccgaagctgcgatatccatacaaatgtcagcatggatagcgtgccgtatacggagtgggaattgtccgttatcattcaggataaggggaacccccagctccatacgaaagtactgctgaagtgcatgatatttgagtacgctgagtccgtgacatccacggccatgactagcgttagccaggccagtctggatgtcagtatgatcatcatcatcagtcttggggccatttgcgcagtcttgctagtcattatggtgctcttcgctactagatgcaaccgggaaaagaaagatacacggagctacaattgcagagtggctgaatcaacttatcaacatcatcctaaacgacccagtcgccaaatccacaagggagatatcaccctggtgcccactatcaatggcaccctacccattagaagccatcatcgaagttctcctagttcctcacccactctggagaggggacagatggggagccgacagtcacacaattcccatcaaagtctgaactcccttgtgaccatctctagcaatcatgttcccgagaactttagcctggaactaacccacgctactcccgcggtggagcaggtgagtcaacttttgagcatgctgcatcaagggcagtaccagccccgcccttcatttcgggggaacaaatactctcggagttacagatacgccctgcaggacatggacaagttctccttgaaggattctggtaggggcgactccgaggcaggcgacagtgattatgatctgggtcgcgactctcctattgatcgcctactgggtgaaggcttctccgatcttttcctaacagacggtaggatccccgccgcaatgaggttgtgcactgaggaatgccgggtcctgggtcactccgatcaatgttggatgccccccctgccaagccccagcagcgattaccggagtaacatgtttatccccggagaagagttccccacccagccccagcagcagcatccacaccagagccttgaggacgatgcccagccagccgactcaggcgagaagaagaaaagcttctcaacattcggcaaagactcccctaatgatgaggacacgggggataccagcaccagctcgctgttgtccgagatgtcttctgtcttccagcgtctcctgccacctagcttggatacttattccgagtgttccgaggttgatcgctccaattctctggagcgcaggaaaggccctctgcccgccaaaactgttggataccctcaaggcgtggccgcatgggcggcttccacccactttcaaaaccccacaaccaattgcggcccacccttggggacccattcctctgtgcagccgtcatcaaaatggcttcctgccatggaagagatccctgagaattacgaagaggacgatttcgataatgttctgaatcatctcaacgatggaaaacatgagctgatggatgcgagcgagcttgtggcagagattaacaagctgctccaggacgtgcgtcaatcttag

SEQ ID NO: 201868 - DNA, 3405 bp, Artificial Sequence
  Description of Artificial Sequence: Synthetic coding sequence
atgcaccagatgaacgccaagatgcacttccggttcgtgttcgccctgctgatcgtaagttttaatcacgacgttctgggtaagaacctgaaatatagaatctatgaagagcaacgagtcggatccgttattgcacggctgtccgaggacgtcgctgatgtgttgctaaagcttcccaacccaagtaccgtccgattcagagctatgcaacgcggaaactctccactcctggttgtgaacgaggataatggtgagataagtattggcgccaccatcgatagagagcagctctgccaaaaaaacctcaattgcagcattgagtttgacgtgattaccctgcctacggaacacttacagctgtttcacattgaggtggaggtactggacattaatgacaactccccccagttcagtcggagcctcataccgattgagatcagcgaatctgcagctgttggaacgagaatacctctggattccgccttcgatccagatgtgggcgagaactccctgcacacttactcattgagcgctaatgacttctttaatatcgaggtgcgcactcggaccgatggggccaagtacgctgaactcatagtggtaagagagctggatagggaacttaaatcatcctacgaactacagctcacggctagcgatatgggagtgccgcagcggtccgggtcctccatcctgaaaatcagcatctccgacagtaatgacaatagccccgcattcgaacaacagtcctacatcattcagctgcttgaaaactcccctgttggcaccctgctgctggatctgaatgcgactgaccccgacgagggcgccaatggcaagattgtttattccttttcttcacatgtgtctcccaagatcatggagacttttaaaatcgattctgagcgcggacacttgactttatttaagcaggtggactatgagattacaaagtcctacgagatcgatgttcaggcccaggacctgggccctaactccatcccggctcactgtaagatcattatcaaggtggtggacgtcaatgataacaaacccgagatcaatattaatttaatgtcccccggaaaggaggagatctcttatatctttgagggcgacccaatcgatacattcgttgcactggtccgtgtgcaggataaagactccggccttaacggcgagatagtgtgtaagctccacggacacgggcatttcaaactacaaaagacatatgagaacaactatctgattctgactaacgccacgctagatagggaaaagcgaagcgagtatagcctaacggtcattgccgaagatcgggggacaccaagtctgagcaccgtcaagcactttaccgtgcagattaacgacattaatgataaccctccccactttcagcgctccaggtacgaatttgtgatttccgaaaataacagccccggcgcgtatatcacaaccgtgacagcgaccgatccagatctcggggagaacgggcaggttacatacacaattctcgaatcttttatattgggctcaagcatcaccacttatgtcaccatcgacccgagtaacggggcaatatacgctctgcgaatttttgaccacgaggaggtctcacagatcacgttcgtcgtggaagccagagacggaggctcccctaagcagcttgttagcaacaccacagtggtgctgacgatcattgatgagaacgacaatgtacctgtggtgattggcccggccttgcgcaacaatactgcagaaatcacaatccctaaaggcgcggaatctggattccacgtcacacggattcgagccatcgatagggattccggtgtcaacgcagagctgtcctgcgctatcgttgctggaaacgaggaaaacattttcatcattgatcctagatcctgcgacatccacacaaatgtgtccatggactcagtaccatacacagaatgggagctatcagtcatcatacaagacaaggggaatcctcagttgcataccaaggtgttactgaaatgcatgattttcgagtatgctgagagtgtcacatcgacggcgatgacatcagttagccaagcgtctctggatgtctcgatgattattatcataagcctcggggccatctgcgccgtactgcttgtgattatggtcctcttcgcaacaaggtgcaatcgggaaaagaaggatacccggtcttataactgtagggtggccgagtccacataccagcaccatccaaagcgtcctagccggcagattcataaaggagacataacccttgttcccaccatcaacgggacactgcccatcagatcacaccatagaagtagcccttcaagtagccccactcttgagcggggacagatgggtagtcgacagtcccacaactcccatcagtccttgaactcattagtcaccatctcgtctaaccacgtgccagaaaacttttcattagaattaacacacgccacacccgccgtcgaggtttctcaactgctttccatgttacaccaaggtcagtatcagcctcgaccaagcttccgggggaacaagtacagccggtcctatcggtatgccctgcaagacatggacaagttcagcctgaaggactcaggccgcggggacagcgaggccggcgatagtgattacgatctggggcgcgacagtccaattgacaggctgctgggtgaaggtttttccgacttgttcttaactgatggacgcattcctgcggccatgagactttgcaccgaggagtgcagagtattgggacattccgaccagtgttggatgccccctttgccctctccctcctcagattaccgctctaatatgttcatccctggggaagaatttcctacccagcctcagcagcaacatccccaccaatccctggaagatgacgcacagcccgccgactctggcgaaaaaaagaagagtttcagcacgttcggcaaagactcaccaaatgatgaggacactggcgacacttctacaagcagtctgttgtcagaaatgtcctcagtgttccagaggctgctgccaccatctctggatacttacagcgagtgttcagaggtggacagatcaaattcattagagagacggaaggggcccctccccgcaaaaactgttggctatccccagggtgtggcggcctgggcggcctccacccattttcagaatccgacaacaaactgtggacctccactggggactcattccagtgtgcagccgtcctcgaaatggctgccagctatggaagagatccctgaaaattacgaagaagacgacttcgacaatgtcctgaaccatctgaacgatgggaagcacgaactgatggacgctagcgaactagtggcggagattaacaagctgctgcaggacgtgcgtcagtcttag

SEQ ID NO: 201869 - DNA, 3306 bp, Artificial Sequence
  Description of Artificial Sequence: Synthetic coding sequence
atggagagcctgctgctgcccgtgctgctgctgctggccatcctgtggactcaggccgctgctctcatcaacttaaagtacagcgtggaggaagagcaacgtgccggcacagtgattgccaacgtcgcaaaagatgcccgagaagcaggatttgctcttgacccccgacaggccagcgcctttagggtggtcagtaatagcgcccctcatctagttgatatcaatccctctagcggcttattggtcactaaacagaagatagaccgcgaccttctgtgtagacaatccccaaaatgcatcatttccctagaagttatgtcctcttcgatggaaatttgcgtgattaaagttgagatcaaggatttgaacgacaatgctccgtcttttcccgccgcacagatcgagttagaaatcagtgaagcagccagtccggggacacgaatcccattggacagtgcctatgatccagattcgggttcatttggcgtgcagacatatgaactaacaccaaatgagcttttcgggctggagatcaaaacaagaggcgatggcagccggtttgctgagctggttgtcgaaaagtcgctcgaccgggaaacacagtcgcactattcgttccggataactgcactggatggcggtgacccccccaggctcggcactgttgggctgagcataaaggtgactgactcaaacgacaacaatcccgtcttttcggaatccacctacgccgtcagcgtcccggagaactctccacccaacaccccagtgattagattgaatgccagcgacccagacgagggaaccaacggacaggtggtgtactccttttacggctatgtcaatgacagaacacgcgaactcttccagatcgatccacacagtggactggtgactgtaactggagccttggattatgaggagggtcacgtctatgagttagatgtccaggccaaggacttgggccctaatagcatcccggcccactgtaaagtgactgtaagtgtgctagatactaatgacaacccccctgtgatcaacctgctgtctgtaaattcagaattggtcgaagtctccgaaagcgctccacccgggtacgtcattgcccttgtgagggtgtctgaccgggatagcggattgaacggcagggtgcagtgccgcctgctggggaacgtgcctttccgtctgcaggagtacgagtcattctccactatcttagtggacggccggttagacagagagcagcacgaccagtacaatctcacaattcaggcacgggatggcggtgttccaatgctccaaagtgcgaaatcgttcaccgtgctcattacagacgagaatgataaccatccgcactttagcaagccctactatcaggtcatagtccaggagaacaacacgcctggggcctacctcctgtccgtaagcgcccgtgaccccgaccttgggctgaacggcagtgtatcttatcagatcgtcccctcccaggtacgtgatatgccagtttttacttatgtttccattaaccccaattccggcgatatctacgctctccgctccttcaatcacgagcaaaccaaggcattcgagttcaaggtgctagccaaggatgggggactaccttcgctccagtcaaacgcaaccgtccgcgtcataatccttgacgttaatgacaatactcccgtaatcactgcacctccattgatcaatggcactgcagaggtgtacataccgagaaactccggcatcggataccttgtgacggtggtgaaagccgaagattatgatgaaggagaaaacggtcgggtgacgtacgatatgacagagggagacagaggattcttcgaaatcgaccaggtgaacggcgaagtccgaaccacacgcacatttggcgagagttcaaaatcaagctacgagctcattgtcgtggcgcatgatcacggcaagacttcccttagcgcatctgccctcgttctcatatacctgagtccagcactagacgctcaggaatcgatgggcagcgtaaacctgtccctgatcttcataatagccctgggttcaatagccggtatactctttgtcactatgatctttgtcgctatcaaatgtaagcgggacaacaaggagattcggacatacaattgtagaatcgcagagtactcctacggccatcaaaagaaatcctccaagaaaaagaagataagtaagaatgacatccgcctggtgccacgcgacgtggaggagaccgacaaaatgaacgttgtcagttgctcaagccttactagcagtctgaattacttcgactatcaccagcagaccctgccccttggctgtaggaggtctgaatctacttttctgaacgtggagaaccagaacacacgcaataccagcgccaatcatatttaccaccactcgttcaattctcaaggacctcagcagcctgatctcatcattaatggtgtcccattacccgagaccgagaattattcctttgactcaaattacgtgaactcgagggcacatcttattaagtcatcatcgacatttaaggatttggaggggaattccttaaaggactcgggacacgaagagtcagatcagaccgattctgagcacgatgtacagaggtccctgtactgtgataccgctgtgaatgacgttttgaataccagcgtgacttctatgggaagtcagatgccagaccacgatcagaatgagggcttccattgccgcgaagagtgtaggatcctcggtcactccgatagatgttggatgccaaggaacccaatgccaattcgctccaagagcccagaacatgtccggaacatcatcgcactttctattgaagctaccgccgccgatgttgaggcttatgacgactgcggcccaactaagcgtacgtttgccacttttggcaaggacgtgagcgaccaccccgccgaagagcgtcctacgctcaaggggaaaaggaccgtcgacgtaactatttgttccccgaaagtgaacagcgttatacgcgaagccggaaacggctgcgaggccattagcccagtcacttcccccctccatctgaagagctctctgccaaccaagccctccgtgagttatacgatcgccctcgctccccccgccagggatctggagcagtatgtgaataacgtgaacaacggccctacacgcccgtctgaggctgaaccgagaggtgctgattctgagaaagtgatgcacgaagtgagccctatcctgaaggaggggcgtaataaagagagtccgggcgttaagcgtctgaaagacatcgtgctttag

SEQ ID NO: 201870 - DNA, 3447 bp, Artificial Sequence
  Description of Artificial Sequence: Synthetic coding sequence
atggagagcctgctgctgcccgtgctgctgctgctggccatcctgtggacccaggcggctgcattaatcaatctcaagtactccgtggaggaggagcagcgtgctggaaccgtcattgcaaacgtggctaaagatgccagggaggctggatttgccctggaccctcgacaggctagtgcctttagagtagtctcaaactctgccccacatctggtggatatcaatccttcgagtggcctcctagtgaccaagcagaagatcgatagggacctgctttgtaggcagagtcccaagtgcattatctcgctggaggtgatgtccagctccatggaaatctgtgtgattaaggtcgagattaaagatctgaacgacaatgcccctagcttccccgctgctcaaattgagcttgaaataagcgaagctgcatcccccgggactcgcattcctctcgactccgcatatgatccagattccggatcttttggcgtgcaaacctacgaactgactccaaacgagctctttggactcgagattaaaaccagaggcgatgggtctagatttgcagaactcgtggtggaaaagtcactggatagggaaactcagtctcactactcgtttcgaattaccgcccttgatggcggcgacccgccacgcctggggacggtgggattaagtatcaaagttactgacagcaatgacaacaatcctgtctttagtgaaagcacatatgctgtcagcgtgcccgaaaactctccccccaacactcctgttatcaggctgaacgcctctgacccagacgaaggaaccaatggacaggtcgtgtactcattttacggatacgtgaatgacaggactcgagagctcttccagatagacccccacagcgggctggtaaccgtcaccggagccctcgattatgaggaaggccacgtgtacgagttggacgtgcaggctaaagacctgggaccgaacagcattcctgcgcattgcaaggtgaccgtcagcgtgctggacacaaatgataatccaccagtgataaacctcttgagcgtgaacagcgaattggtcgaagtgtccgaatctgcaccacccggctatgtaatcgccctggtccgggtttccgatcgagattccggtctgaacggccgagtccaatgtagactgctgggcaatgtgccgtttagacttcaagaatacgaatccttttccaccatcctggtggacggccgcttggaccgcgagcagcatgaccagtataacctgactatacaagcacgcgatggaggggtacccatgttgcagtccgccaaaagcttcactgttctgataaccgatgagaacgacaatcaccctcattttagtaaaccttattatcaggtcatcgtccaggaaaacaatactcctggcgcctacctcctatccgtatccgcccgtgacccagacctgggattaaacggcagcgtgagttaccaaatcgtgccttcccaggtgcgggatatgcccgtgtttacatatgtcagtattaacccgaactctggagacatctatgctctgaggtcattcaatcatgaacagacaaaggctttcgagttcaaggtgcttgccaaggatggtgggctgcccagtctgcaatctaacgcaacagtccgtgtgatcatcttggatgtcaatgataacacccctgtgatcacagcacctccacttataaacggcacagctgaggtttatattcccagaaactcagggatcggctatctggtcaccgtggttaaggccgaggattatgatgaaggagagaatggaagagtgacctacgacatgacagaaggtgatcggggctttttcgaaatagatcaggtcaacggtgaggtacgcacaacccggacatttggggagtcctctaagagctcctacgaactaatcgtggtcgcccatgaccacggaaaaacttcactgtctgcctccgcactggtgctgatctatctgagtccagctttggatgcccaggaatctatggggagcgtgaacctttcattgatctttatcattgctttggggagcatcgccggtatactgttcgtgactatgattttcgtcgccatcaagtgtaagcgtgacaacaaggagatccggacttacaactgctcgaactgcctcacaattacctgtcttttagggtgtttcattaaaggacagaattcgaaatgtctgcattgcatttccgtgtcccctatctctgaagagcaggataagaagactgaggaaaaggttagtcttcgtgggaagagaatagcggagtattcatacgggcaccaaaagaagtcgtcgaagaagaaaaaaatcagcaagaatgacatcaggctggtgcctcgcgacgtggaggaaaccgacaaaatgaacgtggttagttgttcctccctgacatcttcactaaactactttgattaccaccagcagacactgcctttggggtgtaggcggtctgaatccactttcctgaatgttgagaaccagaacactaggaatacctcagcaaaccacatataccaccactccttcaactcccaaggcccccagcaaccagacttgatcatcaacggcgtgcccctgccagagacagagaactactcttttgattctaactacgttaactcacgcgcgcacttgatcaagagctcttctacgttcaaggacttagagggtaacagcttgaaggatagtgggcacgaggaatccgatcagacagactccgagcacgacgttcagagaagtttgtattgtgatacagctgtcaatgatgtgcttaacacctcggtcacctcaatgggttcccaaatgcctgaccacgatcagaacgaaggctttcactgcagagaagagtgtcgcatcctcggccactccgaccggtgctggatgccccgcaaccctatgcctatccgcagcaagtcgccagagcacgtaagaaatatcatcgcgctgagcattgaggcaaccgcggccgatgtggaggcctatgatgactgtggccccacaaaacgtacattcgcgactttcgggaaggacgtgagcgatcatccagccgaggagcgcccaaccctgaagggaaagagaactgtcgatgttaccatatgcagccctaaagtgaattccgtcatacgggaggccgggaacggctgcgaggccatctctcctgtgaccagcccactccacctgaaaagttcactccctacaaagccatctgtgtcttacaccatcgccttagcgcctcctgcaagggatttggagcaatacgttaacaatgtcaataacggcccaacaaggccatcggaagccgagcctcgaggggctgacagcgaaaaggtgatgcatgaagtaagtcccattctgaaggagggacggaacaaagaatcaccgggagtgaagaggcttaaggacattgtcctctag

SEQ ID NO: 201871 - DNA, 3303 bp, Artificial Sequence
  Description of Artificial Sequence: Synthetic coding sequence
atggagagcctgctgctgcccgtgctgctgctgctggccatcctgtggacacaagccgccgccttaatcaatctcaaatattcagtggaagaagagcagagagcaggaacggtcatcgctaacgttgctaaggacgcaagagaggccggcttcgctcttgatccacgtcaagctagtgcttttagagtggtcagcaacagcgcaccgcacttggtggacattaatccaagctccgggctgctcgtcacaaaacaaaagatagaccgggacctgctgtgtagacagtctccaaaatgcatcatctctctggaggtcatgtcctcttcaatggagatttgcgttataaaggtggagattaaggacctcaatgacaacgctcctagttttcccgccgctcagattgagcttgaaatttccgaggcagcatcaccagggactcggatccctttggactcagcttatgacccagatagcggatccttcggtgtccagacctacgagctcacacccaacgaactattcggtctagagattaagacccgaggagatggatccagattcgccgaactggtcgttgagaaaagtctggaccgtgagactcaaagccattacagttttcgaattaccgcgttggacgggggcgaccctcctaggctggggacagttggactatcgatcaaggtcaccgactcaaacgacaacaatcccgtcttttcggagtccacatatgctgttagtgttcctgaaaattctccacctaacacaccagtcattcgtctgaacgcctccgatccagatgaagggaccaacgggcaggtggtttatagtttctacggctacgtgaacgaccggacccgggagcttttccagatcgacccccactcaggtctggttactgtgactggagctttagattacgaggaggggcatgtgtacgaacttgacgtccaggcaaaggacctgggtccaaactctatccccgctcattgtaaggtaaccgtgagtgtgctagacacgaacgacaaccctccagtcatcaaccttctatcggtgaacagcgaactcgtagaggtctcagaatctgctcccccaggctacgtgattgccctggtccgcgtctctgatagagactccgggctgaacggcagagtacaatgtcgattgcttggcaacgtgccctttagactccaagagtacgagagcttttcaacaattttggtggacggacgtctggatagagaacagcacgatcagtacaatctgaccatccaggctcgggatggcggagtgcccatgttgcaatccgcgaaaagttttaccgttctcatcactgatgaaaatgataaccaccctcacttctcaaagccctattaccaggtaattgtgcaggagaataataccccgggcgcctaccttctgagcgtcagcgctagggacccggacctaggcttaaatggctctgtttcttatcagatcgttccctcccaggtccgtgatatgccagttttcacttacgtctcaatcaacccaaacagcggcgatatttacgccctcagaagcttcaaccatgagcagacaaaggccttcgagttcaaggtactcgctaaagacggagggttgccgagcctgcaatccaatgcaaccgtgagagtaattatcctggatgtgaacgacaatacccccgtgattaccgctccgcctctgatcaatggaactgctgaggtgtatattcctcggaattccgggataggctacctggtaacggtggtgaaagctgaagattacgatgaaggtgagaatggccgagtgacctacgacatgactgaaggagatcggggctttttcgagattgaccaggttaatggcgaggttaggacaacgcgcacctttggcgaaagcagcaagagtagctacgaattgatcgtcgtagctcacgaccatggcaaaacttcgctgtcagcatctgctctggtactcatttacctatcgccggcccttgatgctcaagaatcaatggggtctgtgaatttatccctaattttcatcatagcattgggaagcatagcagggatcctgttcgtaacgatgatcttcgtagctatcaagtgcaaacgagacaacaaagaaatccgtacctataactgtcggattgctgaatactcctacggccatcaaaaaaagagtagtaagaagaagaagataagcaagaacgacatcaggttagttcccagggacgtggaggagaccgacaagatgaatgtggtttcttgtagctccctcacttcctcacttaactactttgattaccatcagcagaccctgccactggggtgtcgcagatcagaaagtacatttcttaatgtggagaaccagaatacacgcaatacaagcgccaatcatatctaccaccacagcttcaacagtcagggaccacagcaacctgatctcattattaacggggtccctctcccagagacggagaactatagcttcgatagcaactatgtgaacagcagagcgcatctgattaagagttccacctttaaggatttggaaggcaacagtctgaaggactctggccacgaggagtctgatcagactgattccgagcacgatgttcagcgatctctatactgtgatactgccgtgaacgacgtgttaaacacgagtgtgacgtcgatggggtcacagatgcccgatcatgaccagaacgaaggcttccactgtcgggaagaatgccggatcttgggccacagcgatcgttgctggatgccaagaaaccctatgcccattagatcaaagagtcctgagcacgtccgaaacattattgcgttgtccatcgaggctaccgcagctgacgtagaggcatatgatgattgcgggcccacaaaacgcacatttgccactttcgggaaggacgttagtgatcaccctgccgaggaaagaccaacactgaagggaaagcgcaccgtggacgtgacaatttgctcgccaaaagtgaattcggtgatcagggaggcgggaaatgggtgcgaggctatctctcctgttacttcgccactccacttgaagtcctccctgccaacaaagccgtctgtgagctacaccatagccctggcaccccccgctcgggatcttgagcagtacgtcaacaacgtgaacaatggcccaacaagaccctccgaggcagaacctagaggggctgattcagagaaggtcatgcatgaggtgagccctatcctcaaggagggcaggaacaaagagtccccaggcgtaaaacggcttaaggatatagtcctgtag

SEQ ID NO: 201872 - DNA, 2094 bp, Artificial Sequence
  Description of Artificial Sequence: Synthetic coding sequence
atgttcaccctggacgtggaggagaacgagaacggcgagcggaccccgtatctgatcgtcatgggagccctggatagggagacgcaggaccagtacgtatcaattattatcgctgaagacggcggctcgcctccattgctcggaagcgcgacactgaccattggcattagcgatattaacgataattgtcctctttttactgattcacagatcaatgtgacagtttatggtaatgctaccgtgggcacccccattgcagccgtacaagccgtggacaaagacctgggcactaatgcgcagatcacttattcatatagccagaaggtgccccaggcttctaaagacctttttcacctggacgagaatacaggagtgattaagttattctcaaagattgggggaagtgtgcttgagagtcacaagcttacgatattggcaaatggccctggatgtattcccgctgtgatcacagcgctggtaagcatcatcaaggtgatcttccgacccccggaaatcgtgccacgctatattgccaatgagatcgatggggtcgtttatctgaaagagctggagccagtgaacacgccaatcgcattctttactatcagggatcccgagggcaagtacaaagtcaactgctaccttgatggagaagggccattcagactttccccttacaaaccttacaacaatgagtacctgcttgaaaccactaagcccatggactacgaactccaacagttttacgaagtggctgtcgtcgcatggaattctgagggctttcatgtgaagagggtcataaaagtgcagcttctcgacgataacgacaacgcccctatcttcttgcagccactgattgaactgaccatcgaagagaacaacagcccaaatgcttttttgactaaattgtacgctaccgacgcagatagcgaagaaagaggccaagtatcgtatttcctgggtccggatgcgccaagttatttcagtctagatagcgtgaccgggatactgaccgtgagtactcagcttgaccgggaggagaaggagaaatataggtacaccgttagagcagtggactgcgggaagcccccccgcgagtccgtggcaacagtggcgctgacagttttggataaaaacgataactctcctcggttcataaataaagatttctccttttttgtgcctgaaaattttcctggctacggggagattggcgtgatatctgtaacggatgctgatgccgggcgaaacggctgggtcgctttgagcgtggtgaaccagagtgatattttcgtgatcgatactggcaaaggaatgctaagggcaaaggtgtctctcgatagggagcagcagtccagctacaccctgtgggtagaagccgtggatgggggggaacccgctctatctagcacggcaaagatcactatccttttgctcgatatcaacgacaatcctcccctggtcctctttccacaatctaacatgtcttacctcctagttttgcctagcacactgcccggatctccagtgacggaagtgtacgcagtcgacaaggacactggcatgaacgcggttattgcgtactctatcatcggcagacggggtcccaggcccgagagtttcaggattgaccccaaaacaggaaatattacactggaggaagctctcctacagactgactatgggctgcaccgtctgctcgttaaagtgagtgatcatggataccctgaaccactgcacagcactgtcatggttaacctcttcgtgaatgacacagtttccaacgaaagctacatcgagagccttctcagaaaagaaccagagatcaatatcgaggagaaggaaccacaaatatccattgagcccacccacagaaaggttgagagcgttagctgcatgccaacccttgtcgcgctcagtgtgatctccttaggatctattactttggtgacaggaatgggaatctacatctgccttaggaaaggggaaaaacacccaagagaggatgaaaatctcgaagtacagattcccctcaaagggaaaattgatctgcacatgcgagaaagaaaacctatggatatttcaaatatatag

SEQ ID NO: 201873 - DNA, 2856 bp, Artificial Sequence
  Description of Artificial Sequence: Synthetic coding sequence
atgcggggccggggcaacgcccggagcagccaggccctgggcgtgtcttggtgccccgctacctggcatccccgtctcgatatgggcaggctgcatcgaccgcgatcatccacttcttacagaaatctgcctcatctgtttctctttttcttgtttgttgggccattttcttgcttgggcagttactccagggcaactgagttgctgtattctctcaacgagggactgcccgcgggggtccttattggcagtctggcagaggatttgagactcctacccaggagcgccgggagaccagaccctcaaagccagttacctgaacgcacaggcgccgaatggaatcctccattgagcttctctctagcttctaggggcctgtctgggcagtatgttacactggataatcgctccggagagctccacacgtccgctcaggaaattgacagagaggcactgtgcgtggagggcggaggcggaaccgcctggtcaggctctgtgtcaatctcttccagtccctccgattcatgtctactgctgctggacgtgttagtgctgccccaagagtacttcagattcgttaaagtcaaaatcgcgatcagggacattaacgacaatgccccacagtttccagtttctcagatctccgtctgggtccccgagaacgccccagtcaatactaggctcgcaatcgaacatcctgccgttgaccctgatgtaggcattaacggcgtgcagacttacaggctgttggattatcatggcatgtttacactagacgttgaggaaaatgaaaacggagagagaacaccctacttgatcgtgatgggcgccctcgaccgagagacccaggaccaatatgtctcgattataatcgctgaggatgggggaagccctcccctcctggggtcagccaccctcactattggaattagtgatatcaatgacaattgtccactgttcacagatagtcagattaatgtgactgtctacggtaatgctacggtcggaacccccatcgcagccgtccaagccgttgataaggatttaggaacaaatgcccagattacctactcctattcccagaaggtcccacaggcatcaaaggatctctttcacctggatgagaacactggagtaataaagctctttagcaaaatcggtgggagcgtgctagagtcgcacaagcttacaatcctagctaatgggccaggctgcattccagccgtgatcaccgctctagtatctatcatcaaggtgatatttcgacctccagaaattgtgcctaggtatattgctaatgagattgacggcgtggtctatcttaaggagcttgagccggtgaacacacctatcgccttctttacaattagagatccagagggcaaatacaaggtgaattgttatctggatggggagggaccctttcgcctgagcccttataaaccatacaacaatgagtacttactggagaccacaaagccgatggattatgaacttcagcagttctatgaagtagccgtcgttgcctggaattccgagggattccacgtcaagagggtaatcaaagtacaacttctggacgacaacgacaatgctcccatcttcctgcagccgctgatcgaattgaccattgaagagaataactccccgaatgcgtttttaaccaaactttatgctacagatgctgatagtgaagagagaggccaggtatcctacttccttggcccggacgctccttcctactttagtttagacagtgtaacaggtattctcaccgtctctacacaactggacagagaagagaaagaaaaatacagatacactgtcagggccgtggactgcggcaaacctccacgggagtcagttgcgactgtggctcttaccgttctggacaagaacgacaacagtcctcgcttcattaacaaggacttctccttcttcgtgcctgagaactttcctgggtatggtgagattggcgtgatttccgttactgacgcggacgcaggacggaacggctgggtggcactgtccgtcgtcaaccaatctgacatctttgttattgacacaggaaaaggaatgttgagggcaaaggtgtctttggaccgcgagcagcaaagttcctacactctttgggtggaagcggtcgacgggggggaacctgctctctcatctactgctaagattaccatcttgttgctggacattaacgataacccacccctggtgctttttccccaatcgaacatgtcctatctcctcgtcttgccctcaactctgccgggctctccggtgactgaggtatatgccgtagataaggacacaggaatgaacgccgtgatcgcttactccattatagggcggagaggccctagaccagaatcgttcagaatcgacccgaaaactgggaatatcactttggaagaggctcttttgcaaacagactacggactgcatagactgcttgtcaaagtaagcgaccatggctacccggaacccctgcatagtaccgtgatggttaacctgtttgtgaatgatacagttagcaacgaaagttacattgagtcactgctgcgtaaggagcccgagatcaacattgaagaaaaggaaccacagatctcgatcgagcctactcataggaaagttgaaagcgtcagctgtatgcccacactcgtggccttgtctgtgatctcactcggttcgattacacttgtcaccggtatgggaatttacatctgcctgaggaagggtgaaaagcatcctcgggaagacgaaaacctggaggtgcagatccccctgaaaggcaaaatagatctgcatatgagggaacggaagcccatggacattagtaacatttag

SEQ ID NO: 201874 - DNA, 2856 bp, Artificial Sequence
  Description of Artificial Sequence: Synthetic coding sequence
atgcggggccggggcaacgcccggagcagccaggccctgggcgtgtcttggtgcccggcgacctggcaccctagactggatatgggtagacttcaccgcccaaggagctcaacaagttacagaaacttgccacacctcttcctcttttttctgtttgtgggtcccttctcctgtctgggctcctattcgcgggctacggaactcctctattccctgaacgaaggattgcccgccggggtactgataggatcattagccgaggacttgcgcttgctgccccgcagcgcaggaagaccagacccgcagtcacagttgcccgagcgtacaggagcagagtggaacccccccctgagctttagcctggcatcccggggactgagcgggcagtatgtgaccctagacaatcgctccggcgagctccacaccagcgcccaggaaatagatcgggaagccttgtgtgtcgagggcggcggtggtacagcatggtcaggttccgtgtcaatctcaagcagccccagcgatagctgccttttgctcctggatgtccttgtcttaccacaggaatatttcagatttgttaaagtgaagatagcgattcgggacataaatgacaatgccccacagttcccggtgtctcagattagcgtgtgggtgccagagaatgctcctgtcaacaccagactggcaatagagcaccccgctgtcgaccctgatgtgggcataaacggcgtgcaaacgtacaggctgctggattaccacggaatgtttacactggatgtagaagaaaacgagaatggagaacgaacgccatacctcatcgttatgggcgctcttgatcgagagacacaggaccagtatgtgagcattatcattgctgaggacggtggcagcccccccctgctggggagtgccacactgacaattgggatttctgacatcaatgacaattgccccctgtttaccgacagtcagatcaatgtgacagtgtacggcaatgcaacagtggggactccgatcgccgctgtccaggctgtggataaggacttgggcactaatgcacaaattacttacagttattcacagaaggtgccccaggccagtaaagacctgtttcatctggatgaaaatactggcgtcataaagctgttctcaaagataggaggtagcgttctcgaatcccataaactgacaatactggccaatggtcccggttgtatccccgctgttataaccgccctggtgagtattataaaagtgatcttccgtccacccgaaatcgtccctcgttacatcgccaatgaaatcgatggggttgtctacctgaaggagctggagcccgtcaataccccaatagccttctttacaatccgcgacccggagggaaagtataaagtaaactgttatctcgatggggaggggcccttccgattatcaccatataagccctacaataacgagtatctgttggagaccaccaagccgatggattatgaactacaacagttctacgaagtggctgttgtggcctggaactctgaggggtttcatgtcaagcgtgttattaaggtgcagctgttagacgataatgataatgccccaatttttctgcaacccctgattgaactcaccatagaggagaacaatagcccaaacgcattcctcaccaagctctacgcaacagacgcagactctgaggagcgtggccaggtctcctacttcctcgggcctgacgccccaagctactttagcttggacagcgttacgggcatcctgactgtgtcaacacagctggaccgcgaggagaaagagaagtatcgctatactgtacgcgccgtggattgtggaaaacctccccgggagtcggttgcaactgttgctctgacagttcttgataaaaatgacaactctcctaggttcattaacaaggactttagcttctttgtccccgagaacttccccgggtacggtgagatcggcgtcatctctgttactgatgctgacgcgggaaggaacgggtgggtagccctgagcgtcgtcaaccagagcgatatctttgtgatagataccggtaaaggtatgttacgagcaaaagtcagccttgaccgcgagcagcagagctcatatactctgtgggtggaagcggtcgatgggggcgagcccgcactgtctagcaccgctaagattacgattctcctactagacatcaatgacaatccccccctcgtgctgttcccacagtccaacatgtcttatctgctggtgctgcccagcaccctgcccggctcgccggtgacagaggtctatgccgtggacaaggacacaggcatgaatgccgtgatcgcgtattccatcataggccgaaggggccctcgacccgaatcattccgcattgaccctaaaactggtaatattacacttgaggaggctctgctgcagactgactatgggttgcatcgcttgttagtgaaggttagcgaccacggctaccccgaaccactgcatagcactgtcatggtcaacctcttcgtgaacgacacagtctctaacgagtcttatattgagagcctgctccggaaggagccagaaatcaatattgaggagaaggagccccagatctctatagagccaacgcataggaaggttgaatccgtgtcctgcatgcccactctggtagctctgagtgtgatcagtctgggcagcatcacattggtgactgggatgggcatttacatttgcctaaggaagggagagaagcaccccagagaggacgagaatctagaagtgcaaatcccactcaaagggaagatcgacctccatatgcgggagagaaagcccatggacatttccaacatttag

SEQ ID NO: 201875 - DNA, 3603 bp, Artificial Sequence
  Description of Artificial Sequence: Synthetic coding sequence
atgctgcggatgcggaccgccggctgggcccggggctggtgcctgggatgttgcttactgcttccactgtctctgtcactggcagccgctaagcagctcctacggtatagactcgctgaagagggcccggccgatgtgagaattggcaatgtggcgagcgatctcgggatcgtcacgggctccggagaagtcacgttctccctggaatccggatctgagtatctgaaaattgacaacctgacaggcgagctgagcactagtgaacgcagaatcgatagagaaaagttgccccagtgtcagatgattttcgatgaaaacgaatgctttttggacttcgaagtcagtgttatcggtcccagtcagtcgtgggttgacctttttgagggtcaggtgatcgttttagatataaacgataatacgcctacattccctagtcccgtcttaacactgaccgtggaagagaaccgaccagtggggaccctgtatctgctgcccacggcaactgatcgtgatttcggccggaacggcattgagagatacgaattgttgcaagaaccaggaggcggcggatctgggggggagtctcggcgcgccggcgcagcagattctgcaccttatcccggcggggggggaaacggtgcatccgggggtggctctggtggatctaagcgacggctggacgctagcgaaggaggcggcgggacgaatcctggtggccgatcatcagtgttcgagctgcaggtcgccgacacccctgacggagagaagcagcctcaattgattgtaaagggagtctatgaagctgacctcgccgaaaatagtgctcccgggactcctatccttcagttgcgcgctgccgatcttgatgtgggggttaatgggcagattgagtacgttttcggggctgccactgagagtgtccgtcgtcttttaaggctcgacgaaacttctggctggctatctgtgctgcatagaatcgatcgggaggaagtcaaccaactgcgcttcacagtgatggcaagagacagagggcagccacccaagactgataaggctaccgtggtcctgaacatcaaggacgaaaatgacaacgttcccagtattgaaatacgaaagattggcaggattccactcaaggatggggtggcaaatgtggcagaagatgtcctagtcgatacccctatagcgctcgtgcaagtctctgatcgagatcagggcgagaatggggttgttacatgcacggtggttggagacgtaccttttcagttgaagcccgcttcggacaccgagggcgaccaaaataagaagaaatatttcttgcacacctcaactccactggactacgaagccacccgggaatttaatgttgttatagtggcagtagactccggttccccctcactttcctctaacaacagcttgatagttaaggtaggagacactaatgacaacccacccatgttcggccagagtgtcgtggaggtgtattttccggaaaataacatacccggggagcgggtggccacagttttggccaccgacgcggatagcggtaaaaacgccgagattgcatactctttggatagcagcgtgatgggaatctttgctattgaccccgacagcggtgatattctggtgaacacggtgctggatagggagcagaccgatagatacgagttcaaggttaacgccaaagataaggggattcctgtactgcagggttctaccactgttattgtgcaagtggcagataagaatgacaacgaccctaaattcatgcaagatgtatttacattctacgtcaaggagaatctccagccaaatagcccagtgggaatggtgaccgtcatggacgcagataagggccggaacgccgagatgagcctctacatcgaagagaacaataatattttctcaatagaaaatgacaccggaacaatatattcgaccatgtcttttgatagagaacatcagaccacctacacattcagagtgaaagccgtggatggcggggaccctccaaggtcagctaccgccactgttagcctgttcgtgatggacgagaatgacaatgcccctactgtgacacttcccaaaaacatctcatataccctcctgccacccagtagcaacgttagaaccgtggtggccactgttctggccactgactccgacgacggtattaacgcagacctcaactactcgattgtcggggggaaccccttcaaactttttgaaatcgacccaacttctggagtggtgtccctggtcggcaagctgacacagaagcactacggcctgcacagactggtcgtccaggtcaacgattcaggacaaccctctcagtcaacaacgacactggtccacgtctttgtcaacgagtccgtgtctaatgcgactgccattgattcccagatagcgcggtcactgcatatccctctaacccaggacatcgccggtgacccttcttatgaaatttctaaacagagactgtctatcgtgatcggcgtggtggccgggattatgaccgtaattctgatcatccttattgtagtgatggctaggtattgcaggagtaagaataagaacgggtacgaggcgggcaaaaaagaccatgaagatttcttcactccgcagcagcacgataagtccaaaaagccaaagaaggataagaaaaacaagaaatctaaacagcctttgtatagtagcatcgttactgtggaagcctctaaaccgaacggccaacgatatgacagtgtgaatgaaaaactgagcgactcaccctcaatggggcgttatcgcagcgtgaatggcgggcccgggtcaccggaccttgcacgccattataagagtagctctcctctgccaacagtccaactacacccccagtctcccacagcaggcaaaaagcatcaggccgtccaggacctgccacctgcaaatactttcgtgggcgctggagacaacatctccatcggatctgaccactgtagcgagtactcttgccagaccaacaacaaatactccaaacagcccttccggcgcgtgaccttcagtgtggtgtcccaaccccaagacccccaccaggggagtctgcaaagctgctacgactctggcctggaggaatccgagacaccatcttccaaaagcagttccggacctagactgggcgccctacctctgccggaggacaactacgagcgcactacgcctgacgggtctgtcgactctaggcctctaccagacgttgcactgacagggaagtgcaccagagagtgcgacgagtatggccatagcgactcttgttggatgcccgtgaggacatctcctgagaggaagaagtcccagcctaagctgagtaccttcatgcccgtcgatgagagggggtcgcaggaaaagcttgcaaatggagaggcggctatcatgggagatcgcaatcgcaatttactgaacaaaaaactaacctctagttatgagaccttctcggccgctagcttctcaaagaacgaagaagccaaccccgaggacatacccctgactaagaccggtgaatacaagccatcccccgtaaacaccctcactcggcgggaagtttacctgtag

SEQ ID NO: 201876 - DNA, 3210 bp, Artificial Sequence
  Description of Artificial Sequence: Synthetic coding sequence
atgctgcggatgcggaccgccggctgggcccggggctggtgcctgggatgctgcttactgctgccgctctccttgtccctggctgcggccaagcaacttcttcggtacagactcgcagaggagggtcccgctgatgtacgaatcggcaatgttgcctcagacctgggcattgttactggctccggggaagtaacttttagcctcgaatccggaagtgagtatttgaagattgacaacctgactggagaactgtctacctcagaaagacggatagaccgcgagaagctcccccagtgccaaatgatattcgatgaaaacgaatgtttcctggacttcgaggtttctgtgatcggcccttcacagagctgggttgacctctttgagggtcaggtgatcgtgcttgacattaatgataatactcctaccttcccatctcctgtcttgacattaaccgtggaagagaatcgtccagttggcaccctgtatttattgcccactgctaccgatagagatttcgggcgaaacggaattgaaagatacgaattgttacaggaacccggaggagggggctcagggggggagtcgagaagagcgggagctgccgatagcgccccctatcctgggggtggcggcaatggtgcctctgggggaggtagcgggggaagcaaacgccgacttgatgccagtgagggaggcggaggaacaaaccctggcggtcgaagtagtgtgtttgagctgcaggtggcggacactccggatggggagaaacagcctcagctgatcgtcaaaggggccctggatcgtgaacagcgggacagctatgaacttacactaagggtgcgtgacggcggcgacccgccccgcagcagtcaggccatcctgcgcgtcctgattacagacgtcaacgacaactctccacgctttgagaagagcgtctacgaagccgacctcgctgaaaactcggccccaggaacccccatcttacaactgcgagccgcggacctggatgttggggttaatggccagatcgaatatgtgttcggggcagccacagagtctgtaagacggctgcttcgtctggacgagacctctggttggttatcggtcttgcaccgaattgatcgggaggaagtgaatcagttacgtttcactgtcatggcacgtgacagaggccagccgccaaagacggataaggcaaccgtagtgcttaatattaaggatgagaacgataacgtcccctccattgagattagaaagataggaaggatcccactgaaagatggggtcgctaatgtcgccgaggacgtccttgtggacacaccaattgctttagtccaagtgagcgatagagaccagggggaaaatggcgttgtgacctgcaccgtcgtcggtgacgtgccttttcagttaaagccagctagtgatacggaaggcgaccagaataagaaaaaatactttctacacacaagcacccctctagactacgaggcaacaagagagtttaatgtcgttatcgtagccgtggactctgggtccccaagcctatcctccaataactccctgattgtaaaagtgggcgatactaacgacaacccccccatgttcggtcagtcagtcgtcgaagtgtacttcccagaaaacaacatccccggtgagagagtggcgaccgtactggccaccgacgctgattcagggaaaaatgcagagattgcctacagtctggacagcagcgtgatgggaattttcgccatagatccagacagcggtgacatcctggtcaatacagtactggaccgggaacaaacggatcggtatgagttcaaagtgaatgctaaggataaaggaatccccgtgctccagggatccaccactgtcatcgtccaggtggctgataagaacgacaatgaccctaagttcatgcaggacgtgtttactttctatgtgaaagaaaatctgcagcctaacagtccggtgggcatggtgactgtaatggatgccgacaagggccgaaatgcggagatgtccttgtatatagaagagaacaacaacatcttttcaattgagaacgatacaggcaccatttacagcacaatgtcctttgatcgggaacaccaaactacctacacattccgcgtaaaggccgtggacggcggggatccgcctaggagtgccacagctacagtgagtctcttcgtaatggatgaaaatgataacgccccaactgtgacactccctaagaacatatcatacaccttgctaccccccagctccaacgtccggactgtggtggctaccgtccttgctaccgacagcgatgatggaatcaatgcagacctgaattatagcatcgtggggggtaatccttttaaactcttcgaaattgatcctacgagtggcgttgtctccttagtcggtaagttgacacagaagcactatgggctgcatagactcgtggtgcaggttaatgattccggccagccctcacagtctacgacaacactcgtgcatgtattcgtgaacgaatccgtgtcaaacgccacagccatcgatagccagatcgccaggtccctccatatccctctcacacaggacattgcgggtgatccttcctatgagataagcaagcagcggctctctatcgtgatcggcgtggttgcagggatcatgactgtcatactcatcattctgattgttgtcatggccaggtattgtcgctccaaaaataaaaacggatatgaggctgggaaaaaagatcacgaggacttcttcacgccacagcaacatgataagtctaagaagcctaaaaaggacaagaagaacaagaaatccaaacagccactgtattcatctattgtcaccgtcgaggcaagcaagccgaacgggcagcgttatgactcagtcaacgagaagctatctgattcgccttctatgggccgttataggagcgtgaatggaggcccgggcagcccagacctcgcgcgccactataaatcatcatcacccttgcctactgtccagttacaccctcaaagccctaccgcggggaagaaacaccaagccgttcaggacctcccccccgcgaacaccttcgtgggtgcgggcgacaacatcagcatcggatccgatcattgctctgaatatagctgccagacaaacaataagtactccaagcaaatgcgacttcacccctacatcaccgtgtttggctag

SEQ ID NO: 201877 - DNA, 3768 bp, Artificial Sequence
  Description of Artificial Sequence: Synthetic coding sequence
atgctgcggatgcggaccgccggctgggcccggggctggtgcctggggtgttgcctgttgctgccactctcactgtctctggcagctgccaagcagctgctaagataccggctcgctgaagaggggccagccgatgttcgtattggcaacgtggcctccgatctgggcatcgtcacgggatctggggaagtgacattctctctcgaatctggctctgagtacctgaaaattgacaatctgaccggagagctgtctacttctgagagacgcattgaccgggaaaagctgccccaatgtcaaatgatattcgacgagaatgagtgtttcctcgattttgaagtaagtgttattggtcccagtcaaagttgggtcgacctatttgagggacaggtcattgtgttggatatcaacgacaatacacctaccttcccttcccccgtgctgacactgaccgtagaggagaaccgaccagtcggaacattatacttgctcccaacagcaacagatagagattttggtcgcaatgggattgaacgttatgagctgctgcaagagcctggcggtggcggcagtgggggggagtcgcggagggctggagccgcagactccgctccataccccggaggtggcggcaacggcgccagcggaggaggatccggcggatcgaagcgaaggctagatgcgtccgaagggggcggcggaaccaaccctggaggacgaagttcagttttcgaactgcaagtcgctgacacccctgacggagaaaagcagccacagctcatagtcaagggggcattggatcgggagcagcgcgatagctacgagctgacactacgcgtgcgggacggaggtgaccccccgcgctcctcccaagcgattctcagggtgctgatcactgacgtgaatgacaacagtccacgctttgagaaatcagtgtacgaagcagacctggccgagaactcagctccagggaccccaatcctgcagttgagagctgcagacctggacgtcggggttaatgggcagatagaatatgtctttggcgcggcaacagagtctgtgagaaggctactgcggctggacgagacctctgggtggcttagtgtgctgcaccgaatcgatcgagaggaggttaaccagctgagattcactgtgatggcacgcgataggggtcaacctcccaaaaccgacaaggcaacagtcgtgctgaatatcaaagacgagaatgacaatgttccgtctatcgagattaggaagataggccgtattcccttgaaagacggagtggctaacgtggccgaggacgttctggtggatactcccattgcgttagtgcaagttagtgaccgggatcagggagagaacggcgttgtgacatgcacagtagtgggagacgtgccgttccaacttaaaccagccagtgacactgagggtgaccagaataagaagaagtacttcctgcatacttctacccccctcgactatgaagcaacccgagagttcaacgtcgtaatcgtggctgtggattctggctctccttctctttcctctaataactcactaatcgtgaaggttggcgataccaacgataacccaccaatgtttggccagtcggttgtggaggtgtactttcctgaaaataatattcccggggaacgcgtcgcaaccgtgttggccacagatgccgacagcgggaaaaacgctgagatagcctacagtctagattcatctgtgatggggatcttcgctattgaccctgattccggtgacatcctggtgaacacggtgctcgacagagagcagacagataggtatgagttcaaggtgaacgccaaggataagggcatccctgttctgcagggttccactaccgtgatcgtccaagtggccgacaagaacgacaacgaccccaagttcatgcaggacgtgttcaccttctacgtgaaggagaatcttcagcccaacagccccgtgggcatggtgactgtaatggacgcggataaggggcggaacgcggaaatgagcctgtacatcgaagaaaataataatattttctcaatcgagaacgataccggtacaatctacagcaccatgtctttcgatagggaacaccaaacgacctatacatttagagtaaaggctgtggacggtggagacccgccgaggtccgctacagccactgtcagtctgtttgtgatggatgagaatgataacgcccctaccgtaaccctgccaaaaaatatctcgtacaccctcttgcctccatccagtaacgtgagaacggttgtggcaactgtgctcgcaactgatagcgacgacggcataaatgccgacttaaattattcaattgtcgggggcaatccgttcaagctttttgagattgatccaactagtggggtggtaagtctcgtgggtaagcttacacagaagcattatgggttgcatcgcttggtggtgcaggtcaatgatagtggtcagccttcccagagcacaactacactcgtgcacgttttcgtgaatgagtccgtatccaatgcgacagccatagattctcaaattgcgcgttccctccacatccccctgacgcaagatattgccggtgatccatcatacgaaataagcaagcagaggttgtctatcgtcataggcgtcgtcgcgggtatcatgacagtgatcctgataatcctgatcgtggtcatggctcgttactgccgctcgaaaaataaaaatgggtatgaggccgggaagaaggaccacgaggacttcttcacacctcagcagcacgacaagtccaagaagcccaaaaaggacaagaaaaacaagaaatctaagcaaccactatattcctcaattgtcaccgtcgaagcaagcaaaccaaatggacagcgctacgactctgttaacgagaagctgtctgattccccttccatggggcgttatcgcagcgttaatggcgggcccgggtcgcccgacctcgctaggcactataaatctagctccccactgcccacggtgcagctgcacccacagtcccctaccgcaggcaaaaagcatcaagccgtgcaggatcttccacccgctaatacttttgttggagcgggtgataacatttcaatcgggagtgaccattgctccgaatacagttgccaaacgaataacaagtactccaaacaacccttcaggcgcgtgaccttcagcgtggtcagccagccacaggacccgcaccagggcagcctgcagtcttgctatgattcgggactcgaagaaagtgagacaccctcaagtaaatctagtagtggcccccgtctgggagccctgcccttgccagaagataactatgaaaggaccacccctgacggctcagtgggcgaagccgaacatatggagaatgatagccgacccttgcctgatgtcgctctgaccggcaagtgcacgcgagagtgcgacgaatacggccactcagattcatgctggatgcctgtgagaacttcacctgaaaggaagaaatctcagcctaagctctcaaccttcatgccagtggacgagagaggaagtcaggaaaagctcgccaacggagaagccgctattatgggtgacaggaatcgaaatctcctgaacaagaagcttacttccagttacgaaaccttctctgccgcctcctttagtaagaacgaagaggcaaacccagaggacatccccctgactaaaaccggggaatacaaaccttcacctgtgaacacactgacccgcagggaggtgtacctgtag

SEQ ID NO: 201878 - DNA, 2922 bp, Artificial Sequence
  Description of Artificial Sequence: Synthetic coding sequence
atgagccccgtgcggcggtggggcagcccctgcctgttccccctgcagctcttctccctttgctgggtcctgagcgtcgcccaaagcaaaacggtgcgctacagcacatttgaggaggacgcgccgggcaccgtaataggaacgctggccgaggatctgcacatgaaagtgtccggcgacacttctttcaggcttatgaagcagttcaatagttctttactccgagtccgcgagggcgacggacagcttactgtgggggacgccggtcttgatcgggagaggctgtgcgggcaggccccacagtgcgttctggcatttgatgtcgtgtccttcagtcaggagcagtttagactggttcatgttgaggtggaggtgagagacgttaacgaccatgccccccgttttccccgggctcaaatacccgtcgaggtaagcgagggcgccgctgtgggtacacgtatacccctagaggtgcctgtggacgaagacgttggggcaaatggtctgcaaaccgttagactggcggaaccacactctccattccgcgtggagctccaaacccgcgctgacggcgcgcagtgtgccgatctcgtgctgctgcaggagctcgacagagagtcacaggccgcttactccctggaattggttgctcaggacgggggccgccccccacggtccgccacggccgctctcagtgtgagggtgctcgacgctaacgatcattctccagcattcccacagggtgccgtggcggaggtggaattagctgaggatgccccagtcggatctctgctccttgatttggacgccgctgatccagatgagggtcctaatggagatgtggtgtttgcgtttggagcgcggacacctcccgaagctagacgcctattccgcctggacccacggagcggacggctcactctggctggccctgttgattacgaacggcaggatacgtatgagctggacgtgagggcacaagaccgtggccccggaccgcgagcagcaacatgcaaggtcattgtgcggatccgcgatgtgaatgacaatgctccagacatagccataacacccttggcagcacctggggcccctgcaacaagtccctttgccgcagctgccgccgccgctgctttggggggcgctgatgccagttctcccgctggcgcaggtacccctgaagctggagctacatctctggtgccagaaggagcagcaagagaaagcctcgttgcccttgtgtcaacctcagatagagactccggggcaaatggtcaagtgaggtgtgcactttacggccatgaacactttcggctacagcccgcctatgcaggttcatatctggtcgtgactgcggcttctctagaccgcgagcgaatcgcggagtataacctcacactcgttgcagaggatagaggcgctcctcctctgcggacagtgcgcccgtataccgtccgcgtgggtgatgagaacgacaacgctcctctcttcactcgcccagtgtacgaagtgtcagtcagggaaaataaccccccgggggcctacctggcgaccgtggctgccagagatcgcgacctgggccgaaacgggcaggttacctatagacttctcgaggccgaggtcggtcgcgcggggggcgccgtcagcacttatgttagcgtggatcctgctaccggtgccatctacgcgctgaggagctttgactacgaaacgctccgccagctcgacgtccggatccaagcaagcgatggtgggagtccacagttatcatcctctgcccttgtccaggttagagttctggaccagaatgatcacgctcctgtgctggttcacccagcacccgccaacggcagcttggaggttgccgtgcccggaagaactgctaaggacaccgttgtggcccgcgtgcaggcacgagatgcagacgaaggcgctaacggagagctggcctttgagctgcagcaacaggaaccccgcgaagcctttgccatcggtaggaggaccggagaaatcttgctgacgggtgaccttagccaagaaccgccaggacgagtgttccgggccctgctggttatttcggacggcggcaggccaccacttactaccacagcaactgtttctttcgtggtgactgccgggggtgggaggggtcctgcggctcccgcatccgctggttctcctgagaggagtcggccccctggttcaagattaggtgtcagtggctccgtgctgcaatgggatacccctctgatcgtaatcattgtgctcgcaggcagttgtaccctgttattggcggccattatcgccattgccaccacttgtaacagacgcaagaaggagccttatggcgctagtccaggatttggtaaagagccagctccacccgtcgccgtgtggaaagggcatagctttaacacaattagcggccgagaggccgagaagttttctggcaaggactcaggcaaaggagatagtgattttaacgacagcgactcagacatttccggggacgcactcaagaaagatttaatcaaccatatgcagtccgggctgtgggcttgcaccgccgagtgcaaaatcttaggacatagcgatcggtgctggagtccttcatgttctgggccaaacgcccacccttcgccacacccacctgcccagatgtccaccttttgcaaatctactagtctcccgcgggaccctctgcgccgcgataactattaccaggctcagctgcctaaaaccgtgggactgcaatccgtgtacgaaaaggtgttacaccgcgactacgacaggactgtcacgttgctgtcccccccccgccccggtcggctccccgatttacaagagataggggttccactgtatcagtcaccaccaggtcgctacttgagtcctaaaaagggagccaacgagaatgtgtag

SEQ ID NO: 201879 - DNA, 3213 bp, Artificial Sequence
  Description of Artificial Sequence: Synthetic coding sequence
atgagccccgtgcggcggtggggcagcccctgcctgttccccctgcagctgttctcactgtgctgggttctctctgtggcacagagcaagaccgtccgttacagcaccttcgaggaagatgcccctggaacagtgatcggcacactggccgaggatctccacatgaaagtctctggtgatacgagctttcgactcatgaagcagtttaatagcagcttgctgagggtacgtgagggcgatggccagctaacagtgggcgacgcgggcctggaccgggagcgcctgtgcgggcaggcacctcaatgcgtgttggccttcgacgtcgtgtctttctctcaggaacaattccgcctcgtccatgtggaggtcgaggtcagagacgtcaacgatcacgcacccagattcccgcgtgcccagattcctgtcgaggtctccgaaggcgctgcggtgggcactcgcataccgcttgaggtcccggtggatgaagatgtaggggccaacggtctgcagaccgttcgcctggccgagccgcacagtccattccgcgtcgagctgcagactcgagctgatggcgcccaatgtgccgacctcgtgttgctgcaggaactggatcgagagagccaagcagcctattcgctggagctcgttgcacaggacggaggccgaccaccgagaagcgccacggccgccctgagcgtgagggtgctcgacgcaaacgatcactctcccgcgttccctcaaggcgcagtggctgaagtggagcttgccgaagacgctccggtaggatctctgctgctggatctggacgctgcagatcccgatgaaggtcctaacggcgatgtggtgttcgctttcggcgctaggactcccccagaggcccgcagattgttccgcctcgatccacggagcggaagactgacactggcaggaccggttgattatgaacgacaggatacgtacgagttggatgtcagggcacaggaccggggacctgggcctcgtgcagcaacctgcaaggttatcgtgcgcatccgcgatgttaacgataacgcacccgatatagctataacacctttggcagcccctggcgcgccagccacatcaccattcgctgccgctgcagctgcagctgctttagggggggccgacgcatcatcacctgcaggcgccggcacgccagaggctggggctacaagcctagtccccgagggcgccgctcgcgagtctttggtcgctctggtctcaactagcgatcgggattctggagcaaatggacaagtacgttgcgctctgtatggccacgagcatttcaggttacaacctgcttacgcagggtcctatctagttgtaacagctgcatcactggatcgagagaggatcgccgagtataatctgactttagtcgcagaggaccggggggcccccccactgaggacagttcggccatacaccgttagagtgggagatgaaaatgacaatgcacctctttttaccagacctgtgtacgaggtgtctgtcagggagaacaatcctcccggagcatacctcgccacagtggccgccagggaccgggatcttgggcgcaatggccaagttacttatcgcctgctggaagccgaggtgggccgagccgggggagccgtgagcacttacgtctcagtggatccagcaacaggggcgatttacgcgctgaggtcgtttgattacgaaactcttcgtcagctggacgtgcgtatccaggcaagcgatgggggttcccctcagctctctagtagcgctctcgtgcaggttcgcgtgctggatcaaaatgatcatgcccctgtgctcgttcaccctgctcctgctaacgggtctctggaggttgcggttcctggcaggactgcaaaagatacagtcgtggccagggtgcaggctagagatgctgacgagggcgccaatggcgagctcgccttcgagctccagcaacaagaaccgcgggaggcatttgccatcggcagacgcacaggcgaaattctcctgaccggagacctctctcaggagccgcccggccgcgttttccgggcgctgttggtaatttccgatggtgggaggcccccgttaactaccacagcaacggtgtcatttgtcgtcacagcaggaggcggccgaggacctgccgcacccgctagcgccggaagtccagagagatcacgaccccctggtagcaggctgggcgtgtccggaagcgtcctccagtgggacacgcctttaatcgtcattatcgtgctagccggtagctgtacattgctgctggcggctataattgccatcgccacgacctgtaatcggaggaagaaagaagtgcggaagggaggcgctctccgcgaagagagacccggagccgccggaggcggtgcttctgctccagggtcacccgaggaggccgcccgaggcgccggcccgcgcccgaatatgttcgatgtcttgactttcccaggtactggcaaggcaccttttggcagcccggccgcagatgccccacctcccgccgtggcagccgccgaggtgccagggtcagaagggggtagcgctacaggcgagtccgcctgtcatttcgaaggccagcagaggctccggggagcacatgcagagccatatggcgcctccccaggatttggcaaagaaccggcccctcctgtggcagtatggaaaggccacagctttaataccatctctggtagggaagccgaaaaattctccggcaaagatagtggaaagggagatagcgattttaacgactctgattcggacattagtggagatgcgttgaaaaaagatttgatcaaccatatgcagagcgggctatgggcttgtaccgctgaatgcaagattctgggacactccgatcggtgttggagcccgagttgctcagggcctaacgctcaccccagtcctcatcctcctgcccaaatgagtacattctgcaaatccaccagcctgccccgggaccctctcagaagagataattactaccaggcacagctcccgaaaactgtaggcctacagagcgtgtacgagaaagtcctgcatagagattatgatcgtaccgtgacactgctgagtccaccccgacccggacgtttacctgatctccaggagataggagtgccgctttatcagagcccgcctgggaggtatctctcaccgaaaaagggggccaacgagaacgtgtag

SEQ ID NO: 201880 - DNA, 1791 bp, Artificial Sequence
  Description of Artificial Sequence: Synthetic coding sequence
atgagccccgtgcggcggtggggcagcccctgcctgttccccctgcagttattcagcctctgctgggtgctctcagtcgcacagtccaaaactgtgcggtactctactttcgaggaagatgccccgggcaccgtgatcgggaccttagccgaagatttgcacatgaaggtaagcggggacactagctttaggctaatgaaacaatttaactcatctttactccgcgtccgagagggggacggacagctgacagtcggcgatgcaggactggacagggagcgcctatgtggtcaggccccgcaatgtgtgcttgccttcgacgtcgtgtccttctctcaggaacagtttagactggttcatgtcgaagtggaggtaagggatgtgaacgatcacgctcccgtgctggtgcatccagcccccgctaatggcagtctcgaagtcgcagtgcccggccgaaccgccaaggataccgttgtcgcacgcgtgcaggctcgcgacgcagatgagggcgcaaatggggaactggcttttgagttgcagcagcaggaacctagggaggcctttgcaattggacgtaggaccggagagattttgttgactggagacctaagccaagagccgcccgggcgggtgttccgcgccctgctggtgatttcggacgggggcaggcctccactaacaaccacggctaccgttagcttcgtcgtgaccgctggcggcgggcgggggccagcagctcccgcttccgccggatctcccgaacgttccaggccccctggctcaaggctcggcgtgtctggttccgtgctgcaatgggatacaccgcttatcgtgatcattgtgctggcgggatcctgcacgcttcttctggcagccattattgccatagccactacctgcaaccgacgaaagaaggaggtcaggaaagggggcgcactgagagaggaaagaccaggcgccgccgggggaggtgcatctgccccaggcagtcctgaggaagccgctcgtggcgctgggccaagaccgaacatgttcgatgtgctgaccttcccagggactggaaaggcgcctttcgggagcccggctgccgatgctccccctcctgccgtcgctgccgccgaggtcccagggagtgagggaggaagtgctactggcgagagtgcgtgccactttgagggacaacagaggttgaggggcgctcatgccgaaccatacggggctagcccaggcttcggcaaagagcccgctcctcccgtggcggtgtggaaagggcattccttcaataccattagtggaagggaggccgaaaaattcagtggtaaagacagcggtaaaggggactcggatttcaacgacagcgattcagacatcagcggagacgctcttaagaaggatctcatcaaccatatgcagagtggcctttgggcttgcaccgcagaatgcaagatcctggggcactcagatcgatgctggtccccctcctgctccgggccaaacgcccacccttcgcctcacccccctgctcagatgtccaccttctgcaagtcaacttcccttccacgggatcctttgcggcgagataactattatcaggctcaacttcccaagaccgtaggactgcagtcagtatacgagaaggttctgcaccgcgattacgatagaactgtgacacttctgagcccgcctagaccagggcgtctcccggatcttcaggagatcggggtgccgctgtaccagtcacctccaggaagatatttaagtcctaaaaagggcgctaacgagaatgtgtag

SEQ ID NO: 201881 - DNA, 2742 bp, Artificial Sequence
  Description of Artificial Sequence: Synthetic coding sequence
atgagccccgtgcggcggtggggcagcccctgcctgttccccctgcagcttttttctttgtgttgggtgctaagcgttgcacagagcaagaccgtccggtacagtacattcgaagaagacgccccaggcacggtgatcggtaccctggctgaagaccttcatatgaaggtgtctggcgatacttccttcaggctgatgaagcagttcaacagcagcttgcttagagtgcgcgagggggacgggcagctcactgtgggcgacgccggcctggatagggagcggctgtgcggccaggctcctcagtgcgtgctggcatttgacgtggtgagtttttcccaagagcaattccgacttgtacacgtggaagtggaagtacgggatgttaacgatcatgcacctcgcttcccacgcgcacaaataccggtggaggtgtctgaaggagccgccgttggcaccagaattccacttgaagtgcccgtggatgaggacgttggtgcgaatggactgcagaccgtgaggctggcggagccccacagcccattcagggttgaactacaaactagggccgacggggcacaatgtgctgatctggtgcttcttcaggaactggacagggaatcccaggccgcttatagcttagagctcgttgcccaggatggtgggaggccacctagaagcgccacggccgccctttccgtgagggtccttgacgccaacgaccactcccctgcattcccacagggagccgtggcagaagtggagctggcagaggacgcccccgtgggcagtttgttgctggatcttgacgctgctgaccccgacgagggccctaatggtgacgtggtattcgcctttggagcccgcaccccgcccgaggctaggaggctttttcggttagaccctcgcagcggtaggctgacacttgcgggacccgttgactacgaaagacaagatacctacgagcttgacgtcagagcccaggacagaggacccgggccgcgggccgcgacgtgtaaagtcattgtccgaattagggacgtgaacgacaacgcccctgacattgccataaccccccttgccgcccctggggccgggaatttaactcttcgccgaaacggccaagtgacttacaggctgttagaggcagaagtgggcagggcgggcggggccgtgtctacatacgtgtcagtcgacccagccaccggcgccatctacgccctaaggagcttcgattatgagaccttgcgccagttggatgttagaattcaggcaagcgatggtggcagtcctcagttaagtagtagtgcactggtgcaggttagggttctggatcagaacgatcacgctccggtgctggtccacccggcccctgcaaatggctccttggaagtggccgtccccgggcgcacggctaaagatactgttgtggcacgtgttcaggccagggatgccgatgagggtgcgaatggggaattggccttcgaacttcagcagcaagagccaagggaagcgtttgccattggtcgcagaaccggggaaatcttgctgacaggtgatctaagccaagaacccccaggccgagtgtttagagcccttcttgtgattagcgatggaggcagaccccccctgactaccaccgcaacagtgagctttgtggtcaccgctgggggtggcaggggacccgcggcccctgcctctgcaggctcacctgaaagaagtcgaccacccggatcaagactaggcgtgtccggctcagtgcttcagtgggatacaccattgattgtaatcattgtcttggctgggagctgtacgttgctgctggctgcaattattgccatcgcaacaacatgcaaccgccgtaagaaagaagtgcgcaagggtggcgctctgcgggaagagcgcccaggagctgccggtggaggtgcctctgcccctgggtctcctgaggaggccgcgagaggcgccggcccacggcctaacatgttcgatgttctgacatttcccgggactggtaaagctcccttcgggtctcccgcagccgacgcgccgcccccagcggttgccgcagccgaggtcccggggtctgagggagggagcgccacaggtgaaagtgcatgccactttgagggccaacagaggctgagaggcgcgcatgccgagccctacggtgcctcaccaggtttcggcaaggagccggccccccctgtagccgtgtggaaaggccactcttttaacaccatcagtggtcgggaagctgagaagttcagtggcaaagactctggaaaaggagattccgacttcaatgacagtgattctgatatctctggtgacgcactgaagaaagatcttatcaatcatatgcagagcggattgtgggcgtgcacagccgagtgcaaaattctggggcattcagatcgctgttggtctccaagttgcagtggacccaatgcacatccaagcccccacccaccagcccaaatgtctactttctgtaagtctacaagcctgcctagagatccactgcggagagataactattaccaggctcaactcccgaaaactgttgggctgcagagcgtctacgagaaagtgttgcatcgggactacgatcgtacagtgacactcctgtcccccccaaggcccggaagattgcctgatctccaggagatcggggtgccgctttatcaatctccccctggtcgctacctgagtcctaagaagggtgccaacgagaatgtgtag

SEQ ID NO: 201882 - DNA, 3612 bp, Artificial Sequence
  Description of Artificial Sequence: Synthetic coding sequence
atggacctgcgggacttctacctgctggccgccctgatcgcctgcctaagattggacagtgctattgcccaagaactgatctacaccatccgggaggaactcccagaaaacgtgcccataggaaatattcccaaggatcttaatattagtcacatcaacgctgccaccgggacctcagcttcactagtttaccggttggtgtccaaggcaggggacgctcctctagtaaaagtctcctcatcaacaggagagattttcactacctctaaccggatcgacagggagaaactttgtgccggcgcaagctatgccgaggagaatgaatgtttctttgagttagaggtggtgatcctgccgaatgattttttccgactgattaagatcaagataatcgtgaaggacacaaacgataacgctcctatgttcccctcccctgtgattaatatctcaattcccgaaaatactctgattaactcccggtttcccatcccatccgccacggatcccgacacaggtttcaatggggttcaacactatgaattacttaacggacaaagcgtttttggtctggacattgtggagacccctgagggagagaagtggccacagctaatagtccagcagaatctcgatagggagcaaaaggacacctatgtgatgaagataaaggtcgaggatggggggacaccccaaaagtcatccaccgccatcctgcaggtcactgtctcagatgttaacgacaacagacctgttttcaaggagggacaggtagaggtacacatcccagagaatgcacctgtgggcacctctgttatacagctccacgctaccgacgccgatataggtagcaatgccgagatccggtatattttcggtgcccaggtggcccctgccactaagagattatttgcactcaacaacaccaccggtctgattacggttcagcgaagtctggacagggaagaaactgctatccacaaagtcactgttctagcatcagacggcagctcaacccctgcacgggccacagtcacaatcaacgtaaccgacgtgaacgataacccaccaaatattgacctgagatatatcatcagtcccatcaacggcactgtctacctctccgagaaggatcctgttaatactaagatcgctctgatcacggtgagtgacaaggacaccgacgttaatggcaaggtgatctgcttcatcgaacgggaggtgcctttccacctgaaggccgtgtacgacaaccagtaccttctggaaacctcctcactcctggactacgaaggcacaaaagagtttagtttcaagatcgtggctagcgacagcgggaaacccagtctgaaccagacagccttggtccgagttaaactggaggacgaaaacgataatccaccaatttttaaccagccggtgattgagctgtctgtaagcgagaataataggagaggcctctatctgacaaccattagcgccactgatgaagactctgggaagaatgccgacatcgtgtaccagttggggccaaacgcgagctttttcgatctcgaccgtaaaactggggttctaacagcctccagagtgtttgaccgagaagagcaggagcgattcatttttacagttaccgcccgcgataatggaaccccacccctgcagagccaggccgctgtgatcgtcacggtgctcgacgagaatgacaactcacctaaatttacacacaaccactttcagttcttcgtgtctgaaaatttgccaaaatacagcacggtgggcgtcataacagtcactgatgctgacgccggagagaacaaggcagtcaccctctcaatactgaatgacaacgacaattttgtgttggatccatacagcggcgtcatcaagtctaatgtgtcgttcgacagagaacagcaatcttcctataccttcgacgtcaaagccacagatggaggacagcctccccggagtagcacagcgaaagttactataaacgtgatggatgtcaacgacaactccccagtcgtgatctcccctccttcgaacacaagcttcaagctcgtgcccctatcagccatccctgggtcggtcgttgccgaggtctttgcagtcgatgtggataccggcatgaacgccgagctcaagtacactattgtatctggaaataataagggtctgtttcgcattgaccctgtcactggcaacattactctggaagaaaagcccgcccctacggacgtcgggctgcatcgcttagttgtcaatatcagcgacctggggtaccctaagagtctgcacactctggtgttggtgttcctgtacgttaatgatacagccggtaacgcctcttacatctacgatctgatacggagaactatggagacccctctagatcgcaacatcggagatagctctcagccgtatcagaacgaggattacctgaccatcatgatcgcaatcatagccggcgccatggtagtgattgtggtcatcttcgtaacggtactggtgcggtgtaggcacgcttcgagattcaaggctgcccagcggtccaaacagggggcagagtggatgagcccaaaccaagagaacaaacaaaataagaagaagaaaagaaaaaagcgaaaatcccctaaatctagcttacttaacttcgtgaccatcgaagaatctaagccggacgatgcagtacatgagcccattaacggcacaatcagcctccccgccgagctcgaggaacagtccatagggcgattcgactggggaccagcaccacctactacttttaagcccaactcccccgatctggccaagcattacaagtccgcctcccctcagccagcgttccatctaaagcccgatacccccgtgagcgttaaaaagcatcatgtgattcaggaactgccattagataatacatttgtggggggttgtgatacactatctaagcgatctagcacctcttcagaccacttttcggcgagtgaatgctctagtcagggtgggtttaagaccaaaggccctctgcatacacgacagagtcagcgccgggtcactttccacttgcccgatggcagtcaggagtcatgcagtgatagcggcctcggggaccatgagccagtcggcagcggcaccctgatctctcatccccttccactggtccagccacaggacgaattttatgaccaggcctctcctgacaaaaggacggaggccgatggcaatagcgaccccaactctgatggaccgctcggaccaaggggcctggctgaagccacagaaatgtgtactcaggagtgcttggtactgggccattccgataactgctggatgccccccggtctgggaccttatcagcatccaaagtcccctttatctacattcgcacctcagaaggagtgggtcaagaaggataagttggtgaatggccataccctcacccgggcttggaaagaagacagcaacagaaaccagttcaatgatcgcaaacagtatggtagtaatgagggccactttaataacgggagccacatgacagatattccgctagctaatctgaaatcctacaagcaagccgggggagccaccgagagcccaaaggaacaccagctgtag

SEQ ID NO: 201883 - DNA, 3099 bp, Artificial Sequence
  Description of Artificial Sequence: Synthetic coding sequence
atggacctgcgggacttctacctgctggccgccctgatcgcctgcctgcggctggacagcgccatcgcacaagaactgatttatacaatccgagaggagctaccggagaatgtacccatcggtaatattcctaaagatctgaatatcagccatattaatgctgcgaccggcactagcgcctcattggtttataggctggtatccaaagccggcgacgcccccctggtgaaagtgtcatcatctactggagagatcttcacaacttcaaataggatcgatagagagaagctgtgtgccggagccagctacgccgaagaaaatgagtgcttttttgagctggaagtcgtgattctgcctaatgatttttttcggctgattaagattaagatcattgtgaaagacactaatgataacgcccccatgtttccttctcccgtcattaacatctctatcccagaaaatactcttattaattcccgattcccaatcccatctgccacggatcccgatacgggcttcaacggggtgcagcattatgagctcctgaacggtcagtctgtgttcgggttggacatagtggagacccccgaaggagaaaagtggcctcaactcatcgtgcaacaaaatctagacagggagcagaaagatacctatgtgatgaagattaaggtggaggatgggggtaccccccaaaaaagctccaccgccatattgcaggtcaccgtgtctgatgtcaatgacaatcgccccgtgttcaaggaagggcaggtcgaagtgcatatccctgaaaatgcgcctgtgggcacatccgttatccaactacatgctactgatgctgatatcggttccaatgccgaaatccgatatatctttggcgcgcaagtggcccccgccaccaaacggctattcgctcttaacaatactacgggtctgattaccgtacagcgctccttagatagggaggagacagcaatccacaaagtgaccgtgctggcaagtgatggatcgtctactcctgcgagagccaccgtgactatcaacgtgacagacgtcaacgataacccacctaatatcgaccttcgctatatcatatctcccatcaatggcacagtgtatttaagcgagaaggacccggtgaataccaaaatcgcattaattactgtctcagacaaagatactgacgtgaacggcaaagtcatctgtttcatcgaaagggaggttccgtttcatcttaaagccgtttatgacaaccaatatctcctggaaacgtccagtctgctggattacgagggcacaaaggagttcagttttaagatagtggcatccgactctggaaagccttctctgaaccagacagccctggttagggtgaagctcgaagatgaaaatgataatccacctatatttaatcagcccgtcattgagctgagtgtgagcgagaataacaggcgcgggctgtacctgaccacaattagcgccaccgatgaggattcagggaaaaatgccgatattgtgtatcaacttggaccaaatgcatccttctttgatctcgaccggaaaacaggcgtcctgactgcctcgagagtgttcgaccgtgaagagcaagaacgattcattttcaccgtgaccgcacgggataacggcacaccacccttgcagtctcaggcagccgtcatcgtcactgtacttgatgaaaacgacaatagccccaaatttacccataatcacttccagtttttcgtttcggagaacctaccgaaatactcaaccgtcggggtcatcaccgtcactgatgctgatgctggagaaaacaaagctgtcacacttagtatccttaatgacaacgataatttcgtgcttgacccctactccggtgtgatcaagagcaatgtttcattcgacagggagcagcagagcagttacaccttcgacgtgaaagctaccgacgggggacagccaccacgatcatctaccgccaaagtgacaattaacgtgatggacgtgaacgacaacagcccagtggtgatctctcctccctctaacacctcatttaagttggtgccactgtccgctatcccaggatcagtggttgcggaagttttcgcagttgacgtcgacacaggaatgaatgctgagttgaaatatacaatagtctctgggaacaacaagggcctgtttcgcatcgaccccgtgacaggcaatataacgctggaggaaaagcccgcccctacagacgtggggcttcacagacttgtagtgaacattagtgaccttgggtatcccaagtcactgcacacactggtcctggtatttctctacgtaaacgacacagccggtaatgccagttacatctacgacttgatcagaaggacgatggaaaccccactggataggaatattggggatagttcgcagccgtatcagaacgaagactacctaactattatgatcgccatcatagccggagctatggtggtcattgtcgttatattcgtgactgtcctggtccgctgtcgacacgcttccagattcaaggcagctcagcgaagtaagcaaggagccgagtggatgtccccaaatcaagaaaacaaacaaaacaagaaaaaaaagcggaaaaagaggaaatcccctaagtcctcattgcttaactttgtcacaatcgaggaaagtaagcctgatgacgcagtgcatgaaccgatcaacggcactatctctctgccggcagagctcgaagagcagagtatcgggcgtttcgactgggggcccgctccccctaccacctttaaacccaattctcctgatctggcaaagcactacaagagcgcctcgcctcagccagctttccatctgaaaccagatactccagttagtgtgaaaaagcatcacgtcatccaggaactccctctcgacaatacctttgttggtggctgcgatacgttatccaagcggagctctacgtccagcgaccatttttccgcctctgagtgttcgtctcagggtggatttaaaacgaaaggcccactgcataccagacaggtcaacgaacatttttactggagcatctcaactgcctacaagtgtccggttaatcagtactag

SEQ ID NO: 201884 - DNA, 3714 bp, Artificial Sequence
  Description of Artificial Sequence: Synthetic coding sequence
atggacctgcgggacttctacctgctggccgccctgatcgcctgcctgcgcttggactcagccattgcccaggagctgatttacacaattcgggaagaactcccagagaatgtgcccataggtaacatccccaaggatctgaatatctcccatattaatgcggctaccgggactagtgcaagccttgtttaccgacttgtgtctaaggccggggacgcccccctcgtgaaggtgtcctcaagtacaggagagatctttacaacaagcaaccgcatagacagagagaaattatgtgcaggggcctcctacgctgaagaaaatgagtgctttttcgagcttgaggtcgtaattctgcccaacgactttttccggctcattaagataaaaatcatagtaaaggacacgaacgataatgctcctatgtttccgtcacctgtaatcaacattagcattcctgaaaacaccctgattaactctagattccctatccccagcgcaaccgatcccgacacaggttttaacggggtacaacattatgaattgctgaacggccaatccgtctttggcctggacatcgtagagactccagaaggagagaaatggcctcagctaatcgtgcagcagaacttagacagagagcagaaggatacttacgttatgaagattaaagtggaggacggcggaaccccccagaagtcctctacagccatcctgcaggtgacggtttcagacgtcaacgacaatcgacccgtcttcaaggagggtcaggtagaggtccacatccctgagaatgcgcccgtcgggacctcagttatacagctgcacgcaaccgatgccgacatcggatccaatgccgaaattcggtacatcttcggtgcacaggtggccccggctacgaagaggctctttgccctgaacaatactaccggcttgataactgtgcagcgctcattggatagggaggagacggcaattcacaaggtcactgtcctggctagcgatggttcttcaacaccagccagagctaccgtgactataaatgtaacagacgttaacgacaaccctccaaatattgatctgcgctacatcatctcccccatcaacgggacagtatacctctcagagaaggaccctgtaaatactaagattgccctgattaccgtgagtgataaggacacagacgtcaatgggaaagttatttgctttattgaaagagaggttcccttccatctgaaagctgtttacgataatcagtacctccttgaaacaagcagcctgctcgactatgagggcactaaggaatttagcttcaaaatcgtggcgagtgacagcggtaagccaagccttaatcagaccgccctggtgcgcgtaaagttggaggatgaaaatgataacccgccgatctttaaccaaccggttatcgagcttagcgtgtccgaaaataaccggcgaggcctttaccttacaactatctctgccactgacgaagactctggaaaaaacgctgatatcgtgtatcagcttggacctaacgctagttttttcgatctcgatcggaagactggagtgctcaccgcctcccgggtatttgaccgggaagagcaggaaagatttattttcactgtcactgctagagataacggcacaccccccctacagtcccaggcagctgtaatcgttactgtgctggatgaaaatgacaatagtccgaaattcacgcacaaccacttccaatttttcgtaagcgagaacctgccaaaatattcgacggttggagtgatcacggtcacagatgccgacgcgggcgagaacaaggcagtgacacttagtattctgaacgataacgataacttcgtgctcgacccatactccggggtgataaaaagtaacgtatcgttcgatcgggaacagcagagctcctacacattcgatgtaaaggccacagatgggggccagcctcccaggagtagcaccgccaaagtgacaatcaacgtcatggacgtgaacgacaactcgcctgtggtaatcagcccccctagtaacacttcatttaaactagtaccgttgagcgctatcccggggagcgtggtcgctgaggtgtttgcagttgatgtagacacaggtatgaacgccgagctgaaatacacaatcgtctctggaaataataagggtctttttcggatcgacccagtcactggaaacatcacactggaagagaaaccggccccaaccgatgtcggcctgcacaggctcgttgtgaatataagcgacctcgggtatccgaaatcgctgcatacactggtgctcgtttttctatatgtcaacgacactgccgggaacgcctcgtatatatacgacctgattcgcaggacaatggaaacgcccctggacaggaacattggagactcttctcaaccctatcagaatgaggattatctcactataatgatcgcaatcattgcaggagccatggtcgtcattgtggtgatctttgtgacagtgctggtccgttgccgccacgccagtaggttcaaggctgcgcagcgctccaagcagggggccgagtggatgagccccaaccaggaaaacaaacaaaacaagaagaagaagcggaaaaaacggaagtcccctaaatcttctctcctcaattttgtgacgattgaggagagcaagcccgatgacgcggtacatgaacccatcaacggcacaattagcctgcccgctgagctagaggaacaatccatcggccgcttcgattggggccccgcccctccaactacttttaagcccaattctcccgatctggccaagcattacaagtccgcttcgccccagcctgccttccatctcaaacccgacacacctgtgtccgtcaagaagcaccacgtgatccaggaactgcccctcgacaatactttcgtcggtgggtgtgatactctatcaaagcgatccagcacctcttccgaccacttctccgcctccgagtgcagctcccaaggcggcttcaagaccaaaggacccttacacacccgccaatgcaactcccatagcaagtctgataacatccctgtcacaccccagaagtgcccttctagtaccggcttccacatccaggaaaatgaggagtctcattacgaaagtcaaagaagggttacattccacctgccagatggatcgcaggaatcctgctccgattctggtctcggagaccacgagcctgtgggctctggcacccttatttcccacccacttccattggtccagccacaggatgaattttatgatcaggcttcacccgataagcgcacggaggccgacggaaatagcgaccccaattcagacggcccattagggcccagaggcctggctgaggcaactgaaatgtgtacacaggaatgcctggtgctcggccactccgacaattgctggatgccacctggactgggaccctatcaacacccaaaaagccccctttctaccttcgccccacagaaggagtgggtgaagaaggacaagcttgtgaacggccacacacttaccagagcgtggaaagaagacagcaatcggaaccagtttaacgaccgcaagcaatatggatcaaacgaaggtcactttaacaacggaagccacatgactgacattcctctggccaacctgaagagctataagcaggctggaggggcaacagagtcacccaaggagcatcagctgtag

SEQ ID NO: 201885 - DNA, 3612 bp, Artificial Sequence
  Description of Artificial Sequence: Synthetic coding sequence
atggacctgcgggacttctacctgctggccgccctgatcgcctgccttaggctggattccgccattgcccaggagttgatctacacaatccgggaggagctgccagagaatgtaccgatagggaatatcccaaaggatttaaatataagccacatcaatgccgcaaccggaacatctgcttctcttgtgtaccgtttggtctccaaagcgggggatgctccactggttaaagtaagctcatccaccggcgagatctttactacgtctaaccgaattgacagggaaaagctgtgtgccggcgcttcttacgccgaagagaacgagtgtttcttcgagctcgaggtggttatcctgccgaatgattttttccggttgatcaaaatcaagatcattgtgaaagatactaatgacaatgctccgatgttccccagtcctgtgattaacatctccattcctgaaaacaccctcatcaattcccgatttcctattccctctgccaccgatcccgacactggttttaacggcgtgcagcattacgagctcctgaacggtcagtcagtgtttgggttagacatcgtagaaacaccagaaggcgagaagtggccccagttaatcgttcaacagaaccttgatagggaacagaaggatacctacgtgatgaaaatcaaggtggaggatggaggcacaccacagaagtctagtactgccatcctgcaagtcacagtgagcgacgtaaatgacaaccggcccgtgttcaaggaaggtcaggtcgaggtccatatccccgaaaacgcaccggtggggacaagcgtaattcagctccacgcaacggatgcggatataggatcaaacgccgagatcagatatattttcggagcacaggtggcaccagcgaccaagcggctgtttgccttgaataatacgactggtttaatcacggttcagcggagtctggatcgagaggagaccgctatccacaaggtcaccgtcttagcgtccgacggctctagcacccccgctcgagccactgtgaccataaatgtaacagatgtgaatgacaatccccccaacatcgatctcaggtacatcatttccccgatcaacggcaccgtttacctgtcagaaaaggaccctgtgaataccaaaatagcactgattactgtgagcgataaggatactgacgtgaatggcaaggtgatttgtttcatcgaacgagaggtgccgtttcacttgaaggctgtgtatgacaaccagtacctgctggagacaagttctctgctggattacgaaggcaccaaggagttcagctttaagatcgtcgcctccgactctggtaagccaagcctaaaccagactgccctcgtacgcgtgaagttagaggatgagaacgataatcctcctatctttaatcaaccagttatcgaactgtcagtcagcgagaataatcgcaggggattatatctaacaacaatcagtgccaccgatgaagactccgggaagaacgcagatattgtgtatcagctcggacccaatgccagcttcttcgatctggaccggaagaccggcgtgctgactgctagccgggtgttcgaccgggaggagcaggaaaggtttattttcactgtgacagcaagggataatgggacccctcctctgcaatcgcaagcggcggtgatagtcactgtgctcgatgaaaacgacaacagccctaaatttacacataaccattttcagttcttcgtgtctgagaacttgcccaaatattcgacagtgggagtcatcacagtcacggatgccgacgccggggagaacaaagctgtaactttgtccatccttaacgataatgataacttcgttctagatccctactccggggtcatcaagtctaacgttagcttcgaccgcgaacaacaatccagttatacctttgacgtgaaagccacagacggcggtcagcctccccggagtagtaccgccaaagtgacgattaatgtgatggacgtaaacgataatagccccgtggttatctctccgccaagtaatactagtttcaaactggtgcccctgtcagccatcccgggatcagtcgtcgcagaggtctttgctgtcgatgtcgatactggcatgaacgccgaactgaaatataccatcgttagcggcaacaacaaaggcctgtttcggatcgaccctgtgactggcaacatcaccctggaggaaaaacccgctcccaccgatgtgggtctacaccggctcgtggtaaacatcagcgacctagggtatcccaaaagcctgcacacactcgtgctcgtgttcctgtacgtaaacgacactgctgggaatgcaagctatatttacgatctcattagaaggacgatggagaccccattagacaggaacattggtgattcaagtcagccttatcagaatgaagattaccttacaatcatgattgctatcatcgcgggcgccatggtggttatcgtggttatatttgtaaccgtgctagtgaggtgccggcacgcttcccggttcaaagcagcccagaggtctaaacagggggccgaatggatgagtcccaaccaggaaaacaagcagaacaaaaaaaaaaagcggaaaaaacgaaaaagcccaaagtcctctctgctgaactttgtcactatagaagagtccaagccagacgatgcggtacacgaacctatcaatggaaccatcagcctgcccgccgaactggaggaacagagtataggacgctttgattgggggccagctccccccacgactttcaagcccaattcccccgaccttgccaagcactataaatccgcctctcctcagccggcgttccaccttaagcctgacacaccagtaagtgtcaagaagcaccacgttatccaggagctgccactcgataacacgtttgtaggaggctgcgataccctctcaaaaaggtcctcgacttctagcgaccattttagcgcctccgaatgcagcagccagggaggttttaagactaagggtccgctccacactcgacagtcccaaaggagggtaaccttccacctccccgatggtagccaggaatcatgttccgattcggggctgggggaccacgagcctgtgggttctggaacattaattagtcaccccctcccactggttcagccccaggacgagttctacgaccaagcatctccagacaagcgtacggaggccgacggaaactcagatcccaatagcgatggccccctaggaccacggggtctggccgaggctacagaaatgtgcacgcaagagtgcttggttttaggtcattccgataactgttggatgccacccggacttggaccttaccagcatcctaaaagtcccctgtcaacatttgcaccccaaaaggagtgggtcaaaaaggacaagctggtcaacggtcacactctgacgagggcttggaaggaggactcaaacagaaatcagttcaacgacagaaaacagtacggatctaatgagggtcactttaacaacggatcacacatgacggacatccccttggctaacttgaaaagctacaaacaggccgggggcgctacagagtccccaaaggagcatcagttgtag

SEQ ID NO: 201886 - DNA, 3714 bp, Artificial Sequence
  Description of Artificial Sequence: Synthetic coding sequence
atggacctgcgggacttctacctgctggccgccctgatcgcctgcctgagactggattccgctatagcccaagaactcatttatactattagagaagagctccccgaaaacgtgccaattggcaatattcccaaggacctgaacatttctcacatcaacgcagcgactggcacatcggcttctctcgtgtaccgtctcgtttcgaaagctggcgacgcacctctcgttaaagtaagcagctcaaccggggaaattttcacaacgtcgaaccggatcgaccgggaaaaactgtgcgcgggggcaagctacgccgaggagaacgagtgtttcttcgagttagaggtggtaatcctgcctaacgacttttttcgccttataaaaatcaagatcattgtgaaagataccaacgataatgcccctatgttcccttcaccagtcatcaacatttccattcccgagaacacacttatcaatagcaggttccctatccccagcgcgacggacccagacaccggttttaacggagtgcagcattacgaattgctaaatggacaaagtgtgtttgggctagatatagttgagaccccagaaggcgagaagtggccgcagctgattgtacagcagaacctggacagggagcagaaggatacgtacgtgatgaaaattaaggtggaggacggcgggactccccagaaaagttccacagcaatcctccaggtgactgtgtctgatgtgaatgacaaccgacccgtatttaaggaaggccaggttgaagtgcacatccccgagaatgcacccgtgggaacatcagttattcagctccacgcgactgacgccgacatcggctcaaacgctgaaatacggtatatctttggtgcccaggtggcccccgcaacaaagagactgttcgcattaaataatactaccggattgattaccgtgcagcgctctctcgaccgggaagaaacggcgatccacaaagtgactgtgcttgcttcagacggttcttccacacctgcgcgcgccaccgtgacgataaatgtgaccgatgtgaacgataacccccccaatatcgatctgagatacatcatttctcccatcaatggaactgtctacttgtctgaaaaggacccagttaacacaaaaatcgccctgataaccgtgagtgataaggacacagatgtgaatggcaaggtaatctgcttcattgaaagagaggtcccatttcacctgaaggcagtgtacgataaccagtaccttctggaaactagttcacttctcgactatgaaggaaccaaggagttcagtttcaagattgtcgcttccgactcaggaaaaccctccttgaatcagaccgcacttgttcgggtcaaattagaagacgagaatgataatccaccgatttttaatcagcctgtgattgagctgtctgtgagcgaaaataacagaaggggattgtaccttaccaccatttctgccacagacgaagacagtggaaaaaacgcagacatcgtttatcagctcggccctaacgcctccttttttgacctggaccggaaaactggagtgcttacagcatctcgcgttttcgatagggaggagcaagagcgatttatatttaccgtcaccgccagagataacggcacaccacctctccaatcgcaagccgccgtgattgttactgtgctcgatgaaaacgacaattcccctaagttcacgcataaccactttcagttcttcgtctcagagaaccttcccaaatatagcaccgttggcgttatcacagttacagatgccgatgccggcgagaacaaggccgttacactctcgattctgaacgacaacgacaacttcgtactagacccatattctggagtcataaaatctaatgtgtctttcgacagggagcaacagtcaagctacacattcgatgttaaagccactgacggaggacagccaccacgctcttctactgctaaggtgacaatcaacgtgatggatgtgaatgacaactctcccgtggtcattagccctccaagcaacacctccttcaaactggtgcctctcagtgccataccaggaagcgttgtggccgaagttttcgccgtcgatgtggatacagggatgaacgcagaactcaagtacactattgtgtcagggaataataaggggctgtttagaatcgatcccgtgaccgggaatatcaccctcgaggagaaacccgctcctacggatgtgggactccatcggctagtggtcaatatatcagatctggggtatccaaaaagtctgcacaccctggtgctggtgttcctgtacgttaacgacactgctgggaatgcaagttacatctacgacctcatccggcgcactatggagacccctttggataggaacatcggagactcatcacaaccataccagaacgaggactatctgactattatgatcgccatcattgcaggcgccatggtggttattgtcgtgatattcgtgaccgtgttggtccgatgccgccacgcctccagatttaaggcggcccagcggtctaaacagggcgccgaatggatgtctccaaaccaggagaacaagcagaataaaaagaagaagcgcaagaagagaaagagtccaaaatccagtctgctaaactttgttacaatagaggagtccaagccagatgatgccgttcatgagccgataaatggaaccattagcctgcccgcagagctggaggaacagtccatcgggcggtttgattggggtccggcacctcctactactttcaagcccaactctcctgatctggcaaaacactacaagagtgcaagtccacaacccgcattccacctcaaaccagacactcccgtctctgtgaagaagcaccatgtgatacaagaactccccttggataacacttttgttggaggttgtgataccctaagtaagcgctcaagcacgtcctccgatcacttctcagcatcagagtgttcatctcagggcggcttcaagactaaggggcccctgcacacccgccagtgtaactcacacagcaaaagtgataacatcccagtgaccccccagaagtgcccctcaagcaccgggttccatatacaagagaatgaggaatcgcattatgagtcccagagacgagtaacttttcatctgcctgatggatcacaggaatcctgttcagatagtggtctgggagaccatgagccagtagggtcaggcaccctgatttcccacccactgccattagttcagccacaagacgaattttatgaccaggcatctcccgacaaaaggactgaagccgacggcaatagtgatcccaacagcgacggccccctggggcctcgtgggttagccgaggcgacagagatgtgcacgcaggaatgcctggtgttaggacatagtgataattgttggatgcctcctggtctgggcccatatcagcatccgaagagccccctcagtacgtttgccccacagaaggaatgggtcaaaaaggataaacttgtaaatgggcacaccctgacacgggcgtggaaggaagacagtaacaggaaccagtttaacgacagaaagcaatacggcagtaacgaagggcacttcaataacggaagtcacatgacagacatcccactggccaatttgaaaagctacaagcaagccgggggagccacagaatcccctaaggaacaccagctttag

SEQ ID NO: 201887 - DNA, 2424 bp, Artificial Sequence
  Description of Artificial Sequence: Synthetic coding sequence
atggtgttcagccggcggggcggcctgggcgcccgggacctgctgctgtggctcctccttctggctgcatgggaggttggcagcggtcagctacactacagcattccagaggaggctaaacacgggactttcgtgggtcgcgtcgcccaggacctagggctcgagctggctgaactggtaccccggttgttcagggtggccagcaagactcacagagatctcctggaggtcaacttacaaaacgggatcctttttgtgaacagcagaatcgatcgagaagagttgtgtcagtggagtgccgagtgttccattcacctggagttaatagccgataggcccctgcaggtattccacgtagaggtcaaagtaaaggacatcaacgataacccaccggtgtttagaggccgagagcagattattttcattccagagagccggctgctaaatagtcgtttccccatagaaggggccgctgacgcggatatcggagcaaatgccctccttacatacaccctgtctccttccgactacttttcgctggatgtggaggctagtgatgagctgagtaaatccctgtggcttgagctgagaaagtacttagacagagaagagactccggaactacatttactactgacggccactgacggggggaaaccagagctccaaggcacagtcgaacttctgattacagtgctagatgtgaacgataatgctcccttgttcgatcaagctgtgtaccgggtccatcttttggaaaccactgcaaatggcactcttgtcactactctaaatgcctcggacgcggatgagggtgtcaacggggaagttgtgtttagttttgatagcgggatctcccgggacatacaggaaaagtttaaggttgactcatccagcggggaaatacgactgattgacaagctagactacgaggaaacaaaatcctacgagattcaagtcaaagcagtagacaaggggagccccccaatgtccaatcactgtaaagtgctagtcaaggttttggatgtgaacgataacgcccctgagttagccgtgacctcactgtatctccctatcagagaagacgccccactctcaaccgtgatcgctctgattaccgtttctgaccgggactcaggggccaatggccaggtgacctgctccctgatgccccatgtgcccttcaagctggtctccacttttaagaattactactcactggtgcttgatagtgcactggacagagagtctctcagtgtctacgaactggtggtgaccgcccgcgacggtgggagtccgtccctatgggctaccgccagggtgagtgttgaggttgcagatgtgaatgataacgcccctgcctttgcccagcctgaatatacagtgtttgtcaaagagaacaatcctccgggatgccacatctttacggtgtccgcccgcgacgccgacgcccaggaaaatgcactggtttcatattcgctcgttgagagaagggttggggaaagggctctgagtaactacgtgtctgtgcatgcagagtctggcaaagtgtatgctctgcaaccattggatcacgaggagctagagcttctgcagtttcaggtttctgcgcgcgacgcaggcgtgcctccccttggctcaaatgtgacattacaggtctttgtcctcgatgaaaacgacaacgcccccgcactcctggcgccgagagtgggcggcactataggagcagtgtctgaactagtgccacggctggtgggtgccggacatgtggtggcaaaagtgagagccgtggatgcagatagtggatataatgcttggctgagttatgaactgcagcctgccgccggcggcgctcgcattccctttcgcgttgggctgtatactggcgaaattagcacaaccagggtgcttgatgaagccgacctgagtagataccgcctcctggtgctggtgaaggatcacggagagcccgccctcactgccactgccactgtgctagtgagcctggtagagagcggccaggcgcccaaggcgagcagtcgagctagtgtaggcgtcgctggccccgaggctgctttggttgatgtaaatgtttacctgatcattgcaatctgtgccgtctcgtctcttttagtgcttactttgctgctgtacacagctctccgctgttctgttccccctaccgagggggcctacgtgccaggaaagcctacactggtctgcagctctgcactgggatcttggagcaactctcagcaacggaggcagcgagtttgtagcagtgaggggccaccaaaaaccgacttgatggccttttctccgggattatctccaagtctaaatacttcagagcgcaacgagcagcctgaagcaaacctagatctctccggaaatgtttctccgacctttgagttctggctgtag

SEQ ID NO: 201888 - DNA, 2061 bp, Artificial Sequence
  Description of Artificial Sequence: Synthetic coding sequence
atggtgttcagccggcggggcggcctgggcgcccgggacctgctgctgtggcttttgctcctggccgcctgggaagtgggatcaggccagttgcactattcaatccccgaggaagccaagcatggaaccttcgttgggagggtggcccaggatctcggtctggagctagccgaactggtgccgagactgtttagggttgcctccaagacccatcgcgaccttcttgaggttaatctgcaaaatggaatcttgttcgttaatagcagaatcgacagggaggaactttgtcagtggagtgccgagtgttctattcacttggaacttatcgccgatcggcctctgcaagttttccacgtggaggtaaaggtgaaggatattaacgacaatccaccggtttttagaggcagggagcagattatatttatcccagaatcaagactcctgaactcaagattccccatagaaggagctgccgacgccgacatcggcgcaaacgctctgttgacctacaccctcagcccctccgattactttagcctagacgtcgaggcatccgatgagctcagcaaaagtctgtggctggagttaaggaagtacctggatcgggaggagacccccgagctccatctactgctaaccgcaacggacgggggcaagcccgagctacagggcaccgtcgaactgctgataactgtgttggacgtgaacgacaatgccccgttgtttgaccaggccgtgtatcgggtccatttactagagacaaccgcaaatggaactctagttaccacactgaatgcgagtgacgccgatgagggggtaaacggagaagtcgttttcagcttcgactcagggattagcagggacattcaggaaaaattcaaagtggactcatcttctggagagatccggttaatcgacaaattggattatgaagagaccaagagttacgaaatccaggtaaaggctgtagacaaggggtcacctcccatgagtaatcattgcaaggtcctggttaaagtgctcgacgtaaatgataatgcccccgagctcgcggtgacgtctctctatcttccaatccgtgaggatgccccgctgtccactgtcatcgcgctgatcaccgtctccgacagagactccggcgccaatggccaggtgacttgttccttgatgccgcatgtgccattcaagctcgttagtacattcaagaactactacagcttggtgctcgattccgcgcttgaccgtgagtcattgagtgtgtacgagttggttgtgacagcacgagacggggggtctccctccctctgggctaccgcaagagtctccgttgaggtcgctgatgtgaatgataatgcacctgcttttgctcagcccgaatacacagtattcgtcaaggagaataatccacctgggtgccatatcttcacggtgtcagcacgtgatgccgatgctcaggagaacgcgctggtaagttattcccttgtagaacgacgggtcggtgagcgggcactctctaattacgtcagcgttcacgccgaatccgggaaggtttatgccttacagccattggaccacgaggagctcgagttgctacagttccagccccggcagcccaaccccgactggagatacagcgcctcgctgcgcgccggaatgcacagcagcgtgcacctggaagaggcaggaatattgagagcaggcccaggaggtccagaccaacaatggcctactgtcagcagcgccacccccgaaccggaggcgggcgaagtgtctccgccagtgggcgccggggtcaactccaattcctggacctttaagtatggccccggcaatcctaagcagagtgggcctggcgaactcccggacaaatttataattcccgggtcccccgcaataatctctattcggcaggaacctactaacagccagatagacaaatctgattttatcaccttcggtaagaaggaagagacaaaaaaaaagaagaaaaaaaagaaagggaataagacacaagaaaagaaggagaaggggaactctactaccgataacagcgaccagtag

SEQ ID NO: 201889 - DNA, 2853 bp, Artificial Sequence
  Description of Artificial Sequence: Synthetic coding sequence
atggtgttcagccggcggggcggcctgggcgcccgggacctgctgttatggcttcttctccttgctgcctgggaggtcgggtccggccaacttcattattccatccctgaagaagctaagcacgggacatttgtgggacgagtggcccaggacctgggactggagttggctgagctagtgccccgactgttcagagtggcgtcgaagactcatcgtgatcttctggaagtgaacctgcaaaacgggatcctgttcgtcaatagccgcattgatagggaggaattgtgtcagtggagtgctgagtgttccattcacctggaacttattgccgataggccgttacaggtgtttcacgtggaggttaaggtcaaagacatcaacgacaatccccccgtcttcaggggccgtgaacagatcatcttcatcccggagagccggcttctgaatagccgctttcctattgagggtgcagcagatgctgacatcggagccaacgctctgctcacttacacactatcccctagcgattacttctcccttgacgtggaggcctccgacgagctgtccaagagcctttggttagaactcaggaagtacctggatagagaagaaactcctgagctgcatctcctgctcacagccacagacggcggaaagcccgagctccagggcaccgttgaactgctgataacagtgctggacgtcaacgataacgctccccttttcgaccaggccgtataccgggtccacctgctggaaacaacggctaatggcaccctcgtgacaactctgaatgcgagtgacgccgacgaaggggtgaatggcgaagtcgtattctcctttgacagtggaatcagcagagacatccaggaaaagttcaaagtagatagcagttccggtgagattagactgattgacaagttagactacgaagaaaccaaaagttatgagatccaggtcaaggccgtggacaaggggtcgcctccgatgagtaatcactgtaaggttctcgtgaaagttctcgatgtgaacgacaacgctcccgagctggccgtaactagtctgtacctgcccatacgggaggatgctcccctctccactgtcatagccttgattacggtgagtgacagggatagcggagctaacgggcaggtaacatgtagcttgatgccccacgtcccgttcaagttggtgagcacctttaaaaattactatagtctcgtgctggattctgccttagaccgagagtctctctctgtctacgagctggtggtgacggctagggatggtggatcccctagtctgtgggctactgccagagtgagcgtcgaagtagccgacgttaacgacaatgcacctgcttttgcccagccagagtatacagtgttcgtaaaggaaaacaatcccccgggttgccacatatttacagtgtctgctagggacgccgacgctcaggagaatgctctggttagctattctctggtcgagcggcgcgttggggaaagggcattgtcaaattacgtgagcgtgcatgccgagagtggcaaggtgtacgctctgcagccattggaccacgaagagctggagcttctgcagttccaggtaagtgccagagatgctggcgtgcccccactcggatccaatgtgaccctgcaggtgttcgtgctggatgagaatgataatgcacccgccctcctggccccaagagtaggcgggaccatcggtgctgtgtcagaactcgtcccccgcctagtgggcgccggtcacgtagtggctaaagtgagggccgtggacgccgacagcggttacaatgcctggctcagctatgaactgcagcctgcagccgggggtgctcgcatcccattccgcgtggggctctatactggagagataagcacaacacgcgttctcgacgaagcagacttgtcacggtacaggctgctggtcctggtgaaggaccatggagagcccgcactgacagctaccgctaccgtcctggtgtccttagtcgaatccggccaggccccgaaggcttccagcagggccagtgttggagtcgcgggcccggaggctgcactggtcgatgtcaatgtctacctgatcatagccatctgtgctgtttcttctcttctcgttctcacccttctcctctacaccgcattacgatgctcggttccaccgacagagggcgcctatgtgcccgggaagcctacattggtgtgcagcagcgcccttggatcttggagtaactcccagcagaggaggcagagagtgtgcagtagcgaagggccacctaaaaccgacttgatggccttcagccccggcctgtctcctagcctgaatactagtgaacgcaacgaacaacccgaggccaatttggacctgtccggcaatcctcgacaacctaaccccgactggcgttattccgcaagcctgcgcgccggtatgcactctagtgtccacttggaagaggctgggatcctccgtgcgggacctggcggccccgatcagcagtggcccacagtatcaagcgctacacccgaacccgaggctggcgaggtcagtccccccgtgggggccggtgtaaattctaattcatggacattcaaatacgggcctggaaaccccaaacagtccggacccggcgaactgcccgacaaatttattatccccggaagccccgccattatttcgatacgccaggagcccaccaattctcagatcgataagagtgatttcatcaccttcggcaaaaaggaagagaccaagaaaaagaagaagaaaaagaaaggaaataagactcaggaaaaaaaagagaaagggaattcaactacagataactctgaccaatag

SEQ ID NO: 201890 - DNA, 2847 bp, Artificial Sequence
  Description of Artificial Sequence: Synthetic coding sequence
atggtgagccggtgcagctgcctgggcgtgcagtgcctgctgctgagccttttgctgctggctgcctgggaggtcggctccgggcaactgcactactccgtctacgaagaagccaggcatggcaccttcgttgggagaatcgcacaggacctaggcctggagctggccgagctggtgcagcgcctcttcagagtggcaagcaagcgacatggagatctgcttgaggttaatctccagaacggtatcctattcgtaaactcacgcatcgatcgggaggagctatgtggtagatcagtggaatgtagcatccacctggaggtaattgtcgatcgacctctgcaggtttttcatgttgatgtggaagttaaggacatcaatgataatcccccccgatttagtgtcaccgaacagaaactcagtatccctgagagtagattgcttgatagtcgctttccactggaaggcgcttctgatgctgatgtgggagagaacgcactcctgacctacaagctgagccccaacgaatattttgtccttgacatcataaacaaaaaggacaaggacaaattcccagttttggtacttcgcaaactactggatcgggaagagaatcctcaacttaaactcttattgaccgccaccgatgggggaaagcctgagtttaccgggtcagtctcacttctgatcctggttctggacgcaaacgataacgcccctatcttcgatagaccggtttacgaggtcaagatgtacgaaaaccaggtaaatcagacattggttatcaggcttaatgctagcgattccgatgagggaatcaacaaggagatgatgtattcctttagcagcttagtgcctcccaccatccgccgtaaattctggataaacgaacgaactggcgagatcaaggtcaatgacgcgatagatttcgaggattcgaacacatacgagatccacgtcgacgtgaccgataaagggaacccaccaatggtaggacactgcacggtgctggttgaactgctggatgagaacgataattcccccgaagttatcgtaactagcctgtccctccccgttaaggaggatgcgcaggtggggaccgtgatagcattaattagtgtttcagatcacgatagcggtgcgaacggtcaggtaacatgttcattgacaccacacgttcctttcaaactcgtcagcacatacaagaactactactctcttgtacttgattcagcacttgatcgagagagagtgtccgcctacgagctggttgtgactgccagggacggtggctccccgcccttatgggcgactgctagcgtgtccgtcgaagtggccgatgtgaatgacaacgctcctgctttcgcccagtcagaatacaccgtgttcgtgaaggagaacaacccacccgggtgccacattttcactgtttccgcctgggatgccgacgcacaggaaaatgcactggtgagttatagtcttgttgaacggaggttgggagaacgctcgctctcttcctatgtgtctgtgcatgctgaaagtggcaaggtatatgccctgcagcctttagaccatgaggaactagagctgttgcagttccaagtgtcggccagagatggaggcgtgcctccactgggtagcaatctgacgctccaggtgtttgttttagatgaaaacgacaacgctcccgcattactggcttctcctgccgggtctgctggaggagcagtgagtgaattggtgcttcggagcgtcgtggctggccacgtggtggcaaaagtcagggccgtagatgctgatagcgggtacaacgcttggttatcttatgagctgcagtcagccgcggtgggggctcggatccccttcagggttggcctgtacaccggcgaaatatcaaccacacgtgcccttgatgagacagattccccaaggcagcgacttttggtcctcgtaaaggaccacggagagccttccctgacagccaccgcaacagtgctggtctccctagtggaagggtctcaggcaccaaaagctagctcacgggcaagtgtgggggtggccccagaagtagcattggtggacgttaatgtttatctgataattgcaatttgtgcagtgtcgagccttcttgtgctgaccttacttctgtatacagcactccgctgctctgcagctccaacagagggagcctgtgggccagtgaagcctactctggtgtgtagttctgcagtgggaagctggtcgtattcccagcaacgccgacaaagagtgtgttccggcgaaggcctacctaaggctgatctgatggccttctcaccctccttaccaccctgcccgatggttgacgtggatggagaggaccaatccattggcggggatcactcacggaagccgcgccaacccaaccctgactggcgatatagtgcatccctgagagcaggtatgcatagtagtgtgcatctggaagaggccggcatccttcgagcaggacctggcggccctgaccagcagtggcccacggtcagtagtgctacacccgagcccgaggccggggaggtgtcccccccagtcggagcaggagtgaattctaactcttggacatttaagtacggaccaggtaaccctaagcagtcaggtcctggagagcttcccgataaattcatcattcctggcagcccagctattataagcatccggcaggaacctactaattcccagattgataagtccgattttatcacatttggcaaaaaggaagagactaaaaaaaagaagaagaagaagaagggaaataagacccaagagaagaaagaaaagggcaattccaccactgacaatagcgaccagtag

SEQ ID NO: 201891 - DNA, 2058 bp, Artificial Sequence
  Description of Artificial Sequence: Synthetic coding sequence
atggtgagccggtgcagctgcctgggcgtgcagtgcctgctgctgtccctcctacttcttgctgcctgggaagtgggctccggccagctccattactccgtatacgaggaagctcgccacggcacgttcgtcgggagaattgcccaggacctggggcttgagctggccgaattggtccagaggctcttcagagtggctagtaaaagacatggagacttgctggaggtgaacctacagaacggcattctcttcgtcaatagcaggattgacagggaagaactgtgtggacggagcgtggagtgttccatacacttagaagtgatagtggataggcccctccaagtatttcacgtagacgtcgaggttaaggatattaatgataaccccccccgattcagcgtcacagagcaaaaactctccatcccggagtcaaggttgttggattctagatttccactggagggcgcttctgacgctgacgtcggagaaaacgctcttctgacctacaagctgagtcctaatgaatacttcgtgttggacatcattaacaaaaaggacaaagacaaatttcccgtcctcgtgctcagaaaactactagatagggaagagaatccacagctcaagctgcttctgaccgctactgatggggggaaacctgaatttacaggtagtgtgtcactgctcattcttgtcctcgacgcgaatgacaatgccccaatatttgataggccagtctacgaggtcaaaatgtacgaaaaccaagttaatcagacgctcgtgatcagactgaatgccagtgattctgatgaggggattaacaaggagatgatgtattccttcagtagcttggtgcctccaacgatccgccgtaaattttggataaatgagaggaccggggaaatcaaagtaaacgacgcaatagacttcgaagacagcaacacatatgaaatccacgtcgacgtgacagacaagggcaacccgcccatggtaggccattgtactgttctagtggagctgcttgatgaaaacgacaactctcctgaagtaatcgtgacaagcttgagtttacctgtgaaggaggacgcccaggtgggcacagtgattgctcttatatcagtgtctgatcatgacagtggggccaatggccaggtcacttgtagcttgaccccacacgtacccttcaagctcgtgagcacatacaaaaactactatagccttgtgctggactccgcacttgatcgcgagcgggtgtctgcatatgagctggtagtaacggcacgagatggaggcagccccccactatgggcaaccgccagcgtctcagtggaagttgccgacgtgaatgacaacgctccagcattcgcgcagagcgaatatacagtgtttgttaaggaaaacaacccacccggctgtcatatctttactgtgagtgcttgggatgctgacgctcaggagaacgctctggtgtcgtactcactagttgaaagacgattgggtgagaggtctctttctagttatgtgagcgttcatgcggagtccggtaaggtttatgcattacagccactggaccacgaggaactggagttgttgcagtttcagccaaggcagcccaatcccgattggagatactccgccagcttgagagcaggaatgcatagctccgtgcatctcgaggaagccggaatacttagggcgggccctgggggcccagatcagcagtggcccactgtgagctctgccacaccagagcccgaggccggcgaggtgtcccctccggttggggccggggttaatagcaatagttggacgttcaaatacggaccggggaatcccaagcaatccggcccaggggaactccccgataaattcattatccccggttcccccgcgattattagtatccgccaggagccaacaaacagccagatcgacaagtccgatttcatcacgttcggcaaaaaggaagagacaaagaaaaagaagaaaaaaaagaaggggaataagactcaggaaaagaaagaaaaagggaactcgactactgacaactcagaccagtag

SEQ ID NO: 201892 - DNA, 2850 bp, Artificial Sequence
  Description of Artificial Sequence: Synthetic coding sequence
atgttcggcttccagcggcggggcctgggcaccccccggctgcagctgtggctgctactgctcgaattttgggaagttgggagtggccagctccactactccgtgagcgaggaggctaaacatggcacctttgtgggtcggattgctcaggacctcggactcgaacttgccgaacttgtacaacgcctgttccgtgtggcaagcaaaacacacggcgatctgctggaagttaacctgcagaacgggattctgtttgttaactctagaattgacagggaggagttgtgcggccagagcgccgagtgctccattcatctggaggtgatcgtggatagacccttacaagttttccacgtcaatgtagaggtgaaggacatcaatgataatcccccagtgttcagcctgcgggaacagaagcttttgatcgccgaatccaaacagagcgatagtcgcttcccactcgagggagcctccgacgcggatattgaggagaatgcgctgctgacatatcgcctgtccaaaaatgaatacttctcactggactctccaactaatggtaaacagataaaacggctgtcactcatcctgaagaaatcgctagatcgtgagaagacgccagaactcaacctactgctcaccgctactgacggaggaaagccagagctcacaggcaccgttcgacttttggttcaggtgcttgatgtcaatgataacgatcccgaattcgacaaatccgaatacaaggtgtcactgatggagaatgccgcgaaagagaccctggtcttaaaattgaacgcaacggacagggatgaaggcgttaacggggaagttacgtacagtttaatgagcattaagccaaacggcaggcatctctttaccttagaccaaaataatggcgaggtccgggtgaatggtactttggactacgaggagaataagttctataagattgaagtgcaagctaccgacaaaggaactccccctatggccggccactgcacggtatgggttgagatcctggatactaacgataactcccctgaagtcgcagtaacgagcctgagcttgcctgtacgggaagacgcccaaccctcaactgtcattgcgctgatttcagtgtcagaccgggattccggagttaatggacaggttacctgttctctgacaccgcacgtgccttttaagcttgtcagtacatttaaaaattactactcattagtactcgacagcgctctggacagagagaacgtgtgggcatacgagctggtggttactgcccgcgacggtgggagcccctcattgtgggctacagctagagtgtcagtggaggtagccgacgtcaacgacaatgcccctgcatttgctcagcccgagtatacagtctttgttaaagagaacaatccacctgggtgccacattttcaccgtctctgctagggatgcggatgcccaagagaatgccctggtcagctacagtttggtggagagaagactgggagaccgcgctctatcatcttacgtatctgtgcacgccgaatccggtaaagtctacgcccttcaaccactcgaccacgaagagcttgaactcttacagttccaagtgagcgctcgtgacgcaggcgtcccaccactatcatccaacgtgactttgcaggtcttcgtgctggacgaaaatgacaacgcgcctgccttgcttgcaacccaggccggttccgccggcggagctgtgaacaaacttgtgccacgctccgtgggagccggacacgtggtggccaaagtgagagcggtagatgcggactcaggctacaacgcctggctttcgtacgaattacagcccgctgctggtgggagccgtataccctttcgagtcgggctctacaccggggaaatttctacgaccagggcactggacgaggcggactcaccgcgccaccgacttctggtattagtaaaggatcacggcgaacctgccttaactgccaccgctaccgtactggtctctcttgtcgaaagtggacaggcgcctaaagcatcttctcgaacgctggccggagccgcctctccagaggctgccctggtcgatgtgaacgtttacttgatcattgctatatgcgttgtctcatccctccttgtgctcactctgcttctgtataccgctctgtggtggagcgctacccctacggagggcgcctgcgcgcccgggaagccaaccttggtttgctctcgcgcagtggggagctggtcctattctcagcagcgaagacaacgggtttgtagtgaggagggaccgcccaaaaccgacctgatggccttctctccatcgctgccactagggctgaataaagaggaggagggtgaaagacaagagcccggttctaaccaccctggtcagcctcgtcaaccgaatccagactggagatatagtgcgtcattaagggccgggatgcattcatcagtccatcttgaagaggccggcatcctccgcgcaggccctggtggaccagatcagcagtggcccacagtcagtagtgccacaccagaaccagaggctggggaagtgagtcctcccgtgggagcgggagttaacagcaattcatggacctttaagtacggcccagggaaccccaaacaatccggtccgggcgaactgcccgacaagttcatcattcccggctctcccgccattatctcaattagacaggagccaactaattcccagattgacaagagtgatttcataaccttcgggaagaaggaggagactaagaaaaagaagaagaagaagaagggtaacaagactcaagaaaagaaggagaaaggcaacagtacaacagacaattccgatcagtag

SEQ ID NO: 201893 - DNA, 2826 bp, Artificial Sequence
  Description of Artificial Sequence: Synthetic coding sequence
atggtgatcatcggcccccggggccccggcagccagcggctgctgctttctttgctgttactggccgcatgggaagtgggaagcggccaactacattatagcgtctacgaggaggcaaagcacggcacttttgtaggccgcattgcacaagacttgggtctcgagctcgcggagctggttccccgcctgttccgggtggcaagtaagcgccatggagacctgctggaggtcaaccttcagaatggcatcctgtttgtgaactccaggatcgatcgcgaaaagctgtgtggccggagcgccgagtgctcgatacacctggaagttattgtagatcgacccttacaggtgttccacgtcgacgttgaagttaaagatattaatgacaaccccccggtgtttcgtgagcgtgagcaaaaagtccccgtgtcagagagtgcccccctggacagtcactttcccctggaaggcgccagcgacgccgatataggcgtcaattcacttctcacctacgcgctctccctgaatgagaactttgaacttaagataaagaccaaaaaggacaagagtatcctgcccgagctcgtgctgagaaagctgttggatagagagcagactccaaaactgaatctccttttaatggtcatagacggagggaaacccgaactcactggttcagtccagattcaaataactgttctggatgtgaatgacaatgggccggctttcgacaagccgagttataaggtcgtccttagcgaaaacgtgcaaaacgacactcgcgttatacagctgaatgcaagtgacccagacgaaggattgaatggcgagatttcttatggtatcaagatgatcctccctgtcagcgaaaaatgtatgttcagcattaatccggatacgggggaaataagaatctatggcgaacttgactttgaggagaacaatgcctacgagatccaagtgaatgcgattgacaagggcataccaagtatggctggacatagcatggtgttggtagaagtgctcgacgtgaatgacaacgtgcccgaagtaatggtaactagcctttcactacctgttcaggaagatgcccaagtggggaccgtcattgcgctgatatctgtcagcgacagagattcaggagctaatgggcaagtcatttgctctctcaccccccacgtgccctttaaattggtgagcacttataaaaattattattcacttgtattggactcggcacttgacagagagagcgtgagcgcctacgagctagtcgtcacagccagagatggagggagcccttctttgtgggctaccgcgagggtatccgtggaggtcgcagacgtgaacgataatgctccagcattcgcgcagcctgaatatacagtttttgtcaaagagaataatcctccgggatgccacatctttacagtcagtgcctgggacgcagacgcccagaagaatgcactagtcagctattcactagtcgaacggcgggtgggggagcatgccctgagttcgtatgtgtcagtgcacgccgagagcggcaaagtctatgcattgcaaccattagaccacgaagaacttgaactgctccaatttcaggtaagtgctcgagatgcaggtgtccctcccttgggatcgaatgtgactctccaggtgtttgtcctggacgaaaatgacaacgcccccgccctgctggccacccctgcaggttctgcagggggcgcagtctctgagctggtcccacggtctgtgggagctggccatgtagtggccaaggtgcgggccgtggatgcagactccggctacaatgcatggctgtcctacgagctgcagcccgccgccgtaggcgcgcacatcccattccatgtgggcctttatacaggagaaatttctactacccggattctcgatgaagccgatgctccacggcacagactgctggtgttggttaaggaccacggggaaccggcattaaccagcacagccaccgtgttagtctcactggtggaaaatggtcaggcccccaaaacgtctagtagagcaagcgtgggggccgtggaccctgaggccgccctggtggacataaacgtttacctaatcattgccatctgcgcggtgagctctctgctggtcctgacgctgctcttgtatacagctctgagatgttccgcaccacccaccgtttcacgctgcgctcctggtaagcctactcttgtgtgttcttccgctgtgggatcatggtcatacagccagcagcgtcgacagagggtgtgctcggccgagtcgccccctaagacggatctgatggcattctcgccctctttgcagctaagtcgggaggattgtctcaaccccccatccgaacctcggcagccaaatcccgactggcgatacagcgcttcccttcgcgctggcatgcacagttcggttcacctggaagaggcaggaatcctgcgggcaggaccaggggggcccgaccaacagtggcccactgtgagttcagccacccccgaacctgaggctggggaggtgtccccaccagtgggcgcgggggtgaattccaactcctggacatttaaatacgggccggggaacccaaagcagagcggccccggcgaacttcctgataaattcataattccaggctctccagccataatcagcattaggcaggagcctaccaattcccagatcgacaagagtgattttataactttcggaaaaaaggaggagacaaagaagaaaaaaaagaagaaaaagggcaataaaacacaggaaaagaaagagaagggaaattcaaccacagacaattccgaccagtag

SEQ ID NO: 201894 - DNA, 2853 bp, Artificial Sequence
  Description of Artificial Sequence: Synthetic coding sequence
atgctgagcagctggcagggcggcccccggccccggcagctgctgctatggctcctgatcctggccgcgtgggagaccggaagtggacagctgcattactccgtacctgaggaggcaaagcacggcacgtttgtggggagaattgctcaggacctggggctggagctggcagaactcgtacccaggctgtttagagttgcttccaaacgccacggggatctgcttgaggtcaatctgcagaatggtatcttattcgtgaattccaggattgaccgtgaagagctctgtggcaggagtgcggagtgttcgattcatctggaagtcatcgtcgatcgtccgctccaggtgtttcatgtagaagtgaaagtaagagacatcaacgacaaccctcccatattccctgagagcaagaaacgcatcatcatagctgaatcgaggccccctgagaccagatttcctctcgacggggcttccgacgccgatatcggggtaaattctgctctgacttatcgcctcgatcccaacgattatttcactctggatgcacagaactctttggaacagatgtctagcttgtctcttgtccttcgcaagaccctggaccgagaagagatccaagagcactccctactgttaaccgctagtgacggtggtaaacccgagctcactgggacagtccaattgttaataaccatcctcgatgtgaatgataatgccccagagttttatcagtcagtctacaaggttactgtcctggaaaacgcttttaacggaacactcgtgattaagctcaatgctaccgaccccgatgacgggactaatggcgacattgtgtacagttttagacggccggtctggccagccgttgtgtacgccttcactatcaaccctaacaatggggagattaggactaagggaaaactggacttcgaagaaaagaaactctacgagatttcggtggaagcagtagacaaaggcaatatccctatggcagggcactgtacgctgctggtcgaggtcctcgatgtgaacgataacgcacccgaggtcactatcacctcgctctctctgccaatccgcgaagacacacagccatctgctatcattgcgctgatttctgtaagcgaccgagatagtggtagcaatgggcaagtcacctgcactctgacaccccatgtgccatttaaactggtttccacttacaagaattattacagtctcgtactggattccgccttagaccgcgaatccgtctcagcatacgaacttgtcgtcacagctcgcgacggcggtagtccatcgttgtgggcaaccgcttctgttagcgttggagtggccgatgtgaacgacaacgcccccgccttcgctcagcctgaatacactgtcttcgtaaaggaaaacaacccacctgggtgccatatcttcacagtgagcgcgcaggatgcagatgcccaggagaatgctctcgtctcatactccctcgtcgagaggcgcgtgggcgagagagcgctgtctagttacgttagcgttcatgctgagagtggtaaggtttacgccctgcagcctctggatcatgaggagctagagctccttcagttccaagtgtctgcaagagacagcggcgttccaccactgggatctaatgtcactttacaggtatttgtcctggacgagaacgataacgcacctgcgctcctgaccccaggcgctggttctgccgggggcactgtttccgaattgatgccccgctctgttggtgcaggacacgtggtggcaaaggtgcgggcggtcgatgccgactccggttacaatgcctggttgtcttacgagctgcaactggccgctgtcggggcgcgcattcccttcagagtagggctctataccggggaaatctctacgacccggcctcttgacgaggtagatgccccacaccacagactgcttgtactggttaaggatcacggtgagcctgctctgactgctacggccaccgtgctgttaagcctggtcgagagtggtcaggccccacaagctagtagcagggcctctgccggagcagtggggcccgaagctgccctcgttgacgttaacgtgtatcttattatagccatttgtgctgtgtcttctttgctggtcctgaccttactcctctacaccgctttacgctgcagtgctccgccaaccgaaggcgcttgcgcccccgggaaacctaccctggtttgcagctccgccgctggaagttggagttacagccagcagcgccggcccagagtgtgttccggtgaagggccacacaagaccgacttgatggccttttccccttcactcccaccttgcttgggtagcgccgagggcactggacagcgggaagaagatagtgagtgccttaaggaacctcgccaacctaaccccgactggagatactctgcttcactacgcgcaggcatgcactcctctgttcatctcgaggaggccggcattttgagagctggacctggcggtccagatcaacagtggcctactgttagctccgccacccctgagccggaggcaggcgaagtgagcccccccgtgggagcgggcgtgaactccaattcctggacctttaagtacgggcccggtaatccaaaacaaagtggacccggagagctgccggacaaatttataattccaggctcccccgctataatctctatccgtcaggaacccactaactcccaaattgataagagtgactttattactttcggcaagaaggaagagaccaaaaagaagaagaaaaagaagaagggcaataagacacaggaaaagaaagagaaggggaactcaacaactgacaattcagatcaatag

SEQ ID NO: 201895 - DNA, 2715 bp, Artificial Sequence
  Description of Artificial Sequence: Synthetic coding sequence
atgctgagcagctggcagggcggcccccggccccggcagctgctgctgtggctcctgatcctggctgcatgggagactggctcaggccagttgcattactccgtcccagaagaagctaaacatggcacatttgtcggacgtatagcccaggatcttggccttgaactggctgagctagtaccacgcctcttcagggttgcttctaagcgacacggggatctcttagaagtgaacctgcagaacggaattctgtttgtgaattcccgaattgatcgcgaggaactttgcggacggagtgctgagtgcagcatccacctcgaagtcatagtggatcgacctcttcaggtctttcatgtggaggtaaaggtgcgagacattaatgataatcctcccattttccctgagtccaaaaaaaggattattatcgccgagtctcgcccgcccgagactagatttccccttgatggcgcctcagatgccgatatcggagtcaatagtgcactgacctatcgtctagaccccaacgattacttcaccctggacgcccagaacagcctcgagcaaatgagctctttatcccttgttctgagaaagactctggatcgcgaggagatacaggagcacagcctgcttttgaccgcgtccgatggtggcaaaccagagctgacaggtacagtacagttactgataacaatcttagacgttaatgataacgcccccgagttctatcaatctgtctacaaggtaacagtgctggagaatgcttttaacggtacgcttgtgatcaagctgaacgccacggacccagacgacgggactaacggcgacatcgtctactctttcagacggccagtatggccagctgtcgtttacgccttcaccattaaccctaacaatggggagattaggaccaagggcaaactggacttcgaggagaaaaaactgtacgaaatctctgttgaggcagtcgacaaaggcaacattccaatggccggccactgtaccctccttgtcgaggttttggatgtgaatgataacgctcctgaggtaactatcacatccctgagcctgcctattagagaagacacacaaccatctgctatcattgccttgatatctgtcagtgaccgcgacagcgggtctaatggtcaggtcacttgcactctgactccccacgttccatttaagctcgtgagtacgtataaaaactattatagcctcgtcctggatagtgctctcgaccgcgagtccgtgagtgcttacgagctggttgtgactgcccgcgacggcggcagtccaagcctgtgggcgaccgcctcagtttcggtgggtgtagcagatgtaaatgataacgcccccgccttcgcccagccggaatatactgtgtttgtgaaggagaacaatccgcctggctgccacatcttcaccgtttcagctcaagacgctgatgcgcaggagaatgctctggtatcgtattctctcgtggaacggcgggtgggggaaagggcactgtcctcttacgtgtccgtgcacgcggagagtggcaaggtgtatgcactccaacctctggatcatgaggagctagagcttctccaatttcaggtgtccgctagggactcaggcgtccctccactggggtctaacgtgactctgcaagtatttgtgttggatgagaacgataatgccccagcacttctaaccccaggcgccgggtcagctggcggtacagtttcagaattaatgcctagaagcgtgggagccggccacgtagtggccaaggtccgggcggtagacgctgattcagggtataatgcctggctctcatacgagctgcagctggccgcagtcggcgcacgcattccctttcgggtgggactctatactggagaaatcagcaccacccgccctctggacgaagtggacgcacctcaccacagactgctggtgctggtaaaagaccacggagaaccagcccttacagcgaccgctaccgtccttctgtccttagtcgaatcaggtcaggcgccccaagctagcagtagggcttcagctggcgccgtgggtccagaagctgcactggttgacgtgaatgtctaccttatcatagctatctgcgccgtttcatctctgttagtgctgacactgcttctgtataccgcactgaggtgtagcgcaccccctaccgagggcgcgtgtgccccgggaaagcccacactcgtgtgctccagtgcagctgggtcctggagttacagccaacagaggcggcctcgtgtgtgtagtggcgaaggtccacataagactgacttgatggccttcagcccctcactacctccttgtctcggaagtgcggaaggtaccggtcagagggaggaagattccgaatgccttaaagagccacggcagccgaatcccgattggcgctactctgcttctctgagggcagggatgcactctagcgtgcatctggaagaggcggggatcttgcgggctggccccggaggacctgaccagcagtggccgacagtaagctccgcaacacccgagccggaggccggggaggtcagccctccagtcggcgctggagttaatagcaactcctggactttcaagtatgggcccggcaaccccaagcagtccggacccgaacctaagaaacaaacgcaggtaagtttcctgcttcggcggaaaggcgaagcctctcagccgaggcagtag

SEQ ID NO: 201896 - DNA, 2475 bp, Artificial Sequence
  Description of Artificial Sequence: Synthetic coding sequence
atggccagcagcatccggcggggccggggcgcctggacccggctgctgtccctgctgctgttagccgcatgggaggttggctccggtcagctgcgctattctgtacctgaagaggcaaagcacggaacctttgtggggagaatcgcacaggatcttgggctggaactggaggagctcgttccccgtctctttagagtggcctccaagaggcacggagacctgttagaggttaatctccagaatgggatcctgttcgtgaattctcgaatagacagagaagaactctgtggtcgatcagcggaatgttctattcacgttgaggtcattgttgatcgacccttacaggtttttcatgtagaggtggaggtcaaggatattaatgacaacccccccatctttcctatgacagtgaagacaattaggtttcccgagagccgcctactcgattccaggtttcctctcgagggcgcctccgatgcagacatcggggtgaacgccttgctgtcttacaaattgtcatcaagcgaattttttttccttgatattcaggctaatgacgagctttccgagtcattaagcctggttctgggaaagtccctcgatcgagaagagactgccgaggtcaaccttctacttgtagccactgatggaggcaagcctgagctgacaggcaccgtacaaattctaatcaaggtgctagacgtgaacgataacgagcccacattcgctcagtcagtgtacaaagtgaagctgctggaaaacaccgccaacggcactctggtggtgaagctgaacgcctctgatgccgatgagggccccaattcggagatcgtgtattccctcggcagtgatgtcagttccactatccaaaccaaatttactatcgaccccatcagcggagagattcggaccaaggggaagctcgactatgaagaagccaaatcctacgagattcaggtgaccgctacagacaaaggcaccccaagcatgtctgggcattgcaagatctcattgaaactggtggatattaacgataacacacccgaggtaagcatcacttctctgtcattaccgattagcgagaatgcctcgctgggcacagtgatcgccctgatcaccgtatctgaccgtgattccggtaccaatggccatgtgacgtgctcattgaccccccatgtgccatttaagctcgtgtccactttcaagaactattatagcctggtactggacagcgctctggacagggaatcagtcagtgcgtatgagttggtcgttaccgcgagagatggaggcagcccatccttgtgggccactacgagtgtgtccatcgaggtggccgatgtgaacgataatgctcccgctttcgcccagccggaatatactgtgttcgttaaggagaacaatcctcccggatgccacatctttactgtctccgcctgggatgcggacgcacaagagaacgccctggtcagctactcattggtggagcgacgggtgggcgagagggcactgtccagctatgttagcgtccatgccgagtcaggcaaggtgtatgcgcttcagcccctggaccatgaggaggtcgagctcctccaatttcaggtaagcgcacgcgatgctggcgtgcccccactgggttctaacgttacactccaagttttcgttcttgatgagaatgacaatgctcctgccctcctggcgcccagggccggtacagctgccggggcagtaagtgaactggtgccctggtcagtgggagcggggcatgtcgtcgcaaaggtgcgcgctgtggatgccgactctggctacaacgcttggctctcctacgagctccagctggggactggatccgctcgcattccgttccgcgttggcctgtataccggcgaaatttcaaccacacgagctttggacgaggccgacagccctcgccacagactgttggtcttagtaaaagaccacggcgagcccgccctgaccgccaccgctactgtgctagtatcccttgtcgagtctgggcaagcccctaaggcttccagccgagcgtgggtgggtgccgccggctccgaagctactttggttgacgtcaatgtttatctaatcattgccatttgtgcagttagctccctgttagtcctgacggtcctgctgtacacagccttgcgatgttccgttccccctaccgaaggcgcgagagccccagggaagccaaccttagtctgtagctctgctgtgggctcttggtcctattcccaacagcgaagacagagggtgtgcagtggcgaggacccccctaagacagatctcatggccttcagtccatccttaagtcaggggcccgactctgccgaggagaagcagttgagtgaaagtgagtacgtgggtaaggttagcctgttactttttctggctaacagtaagatcgtactgtttaaaaaattttacatgatcagtacttcctacctcgattcctag

SEQ ID NO: 201897 - DNA, 2847 bp, Artificial Sequence
  Description of Artificial Sequence: Synthetic coding sequence
atggccagcagcatccggcggggccggggcgcctggacccggctgctcagtctgcttttactagcagcatgggaggtgggatccggacagttaaggtactccgtgcccgaggaagccaagcatggcacgtttgttggacgaatagctcaggatctgggtctggaattggaggaattggtgcctcggttgtttagggtcgccagcaagcgtcatggtgacctcctggaagtgaacctccagaacggaatactattcgtgaactcccgaatagacagagaggagttgtgtggaaggtccgctgagtgtagcatccatgtcgaagttatcgtggatcgtcctctgcaggtgttccacgtcgaggttgaagtgaaggacataaatgataatccacccatctttcctatgactgtcaagacgatccgattccctgagtcacgattattggattcccggtttcctctggagggagctagcgacgccgacatcggcgtcaatgcccttctgtcttacaaactctcctcctcagagtttttcttcctcgatatccaggctaatgatgagctgtccgaaagcctcagcctcgtgctgggtaagagtctggaccgtgaggaaactgcagaagtgaacctcttgctcgtcgctactgatggggggaaaccagaactgactggaaccgttcagattctgatcaaagttctcgacgtcaacgataacgagccaacttttgcccagagcgtgtataaggtcaagttgttggagaatacagctaacggaacactggtcgtcaagttgaacgctagtgacgctgatgagggtcctaactctgaaattgtgtacagcctgggctcagatgtctcgagtacaatacaaacaaaatttacaatagatcccatttctggagagattcgcaccaagggaaagctggattatgaagaggcaaagagctatgagattcaggtgaccgcaacagataagggcacacccagcatgagtgggcattgcaagatttccctgaaactggtggacataaatgataacactcctgaagtatcgatcacatctttgtctcttccaatcagtgaaaacgcatccctgggaacagttatcgccctgattactgtttctgacagggactcgggcacaaacggccacgtgacctgcagtctgaccccacacgttccattcaagctggtctcgacattcaaaaattattattcactggtgctggattcggccctggacagagagtccgtgtctgcctacgaactcgtcgtaacggcaagggacggtggcagtcctagtctttgggcaactaccagcgtgagcatcgaagttgctgacgtgaacgacaacgcgcctgcctttgctcaacccgagtataccgttttcgtaaaggagaacaacccccccgggtgccacatatttactgtgtcggcctgggacgccgacgcacaggagaatgcattggtgtcgtactcgctggtggagaggagggtgggggaaagggctctcagcagttatgtgagcgtgcacgccgagagtggcaaggtatatgccctccagcctttggaccacgaggaggtggagctgttacagttccaggttagcgcgcgggacgccggcgtacctcctcttggatctaatgtgacactgcaagtcttcgtactggatgaaaatgataacgcccccgcgctgttggcaccaagggcaggaaccgcagccggcgctgtgtcggaactagtcccatggtcggtgggagccggccacgtcgtggctaaggtgcgagctgtggatgccgacagtgggtataacgcttggctaagctatgagcttcagttgggaactggctccgcacggatccctttccgggttgggctgtacaccggagaaatctctaccacacgcgctttggacgaggcagattcgccgcgccaccggttgctagtgctcgtcaaggatcacggggaaccagccctgaccgccactgccaccgtgttagtttccctcgtggaatccggtcaagcccccaaggcatcttctagagcctgggtgggggcagccgggtctgaggccacccttgtcgatgtgaatgtctatctgattatagcgatttgcgcggtgtcaagcctgttagtgcttaccgtgctgctgtacacagctctccgctgctctgtaccgccaacagaaggagcaagggcccctggtaaacctaccttagtctgctctagcgccgtcggctcttggtcctattcccagcagagaaggcagcgtgtctgctctggcgaagatcctcctaaaactgacttgatggctttctctccttcattgtcccaaggacccgatagcgctgaagagaagcagctgtccgagagcgaatatgttggaaaaccacgccagccaaatccggactggcggtattcagcatctcttagggccggcatgcacagctccgttcatctggaggaggcagggatcctccgcgctggaccaggaggacccgaccagcagtggcccaccgtgtccagcgcaaccccagagccagaagcaggagaggtgtctccgcccgtgggagccggagtgaactctaatagctggacctttaagtacggacccgggaatccgaagcagtcaggccctggcgagctgccagacaagttcatcatcccaggatctcccgctatcatttccatccgacaggaacccacaaattctcagattgacaagtctgattttataaccttcggcaagaaagaggaaactaagaagaaaaaaaaaaagaagaaaggcaataaaacgcaggagaagaaggagaagggaaatagcactacagacaacagcgaccagtag

SEQ ID NO: 201898 - DNA, 2853 bp, Artificial Sequence
  Description of Artificial Sequence: Synthetic coding sequence
atgctgttcagctggcgggaggaccccggcgcccagtgcctgctgctttctcttttgctgcttgcggcgagtgaagtcggtagcggacaactgcattactcagtctctgaagaagctaagcacggcaccttcgtaggacggatcgcccaagatctggggctggagctggccgagctcgtgcctagactatttcgagtcgcctccaaaaggcacggagatctgctggaagtcaacttgcagaatggaattctgtttgttaactcccggatcgatcgtgaagaattgtgtggtagaagtgctgagtgctccatacaccttgaagtaatcgtggaccggcccctgcaagtgtttcacgtggaagtggaagtgaaggatattaacgacaatgctccagtcttcccaatggcagtgaagaatttgttcatctccgaatctcgccagccagggtcccggttctcactagagggggcctctgacgccgacattggcacgaactccctgctgacctattccctggattccaccgagtacttcactctggacgtgaagaggaatgacgaggagataaagtcgcttggattagttctcaaaaagaatttgaatcgagaagatacgccgaaacattacctcctaattactgccatagatggtggaaaacctgagttaactggtaccacccagctgaagattaccgtgctggatgtgaacgataatgcccccgccttcgaacggacgatatacaaggtaaggctgcttgaaaacgcgcccaatggcacactcgtcgtcactgttaacgcaactgatctggatgagggcgtcaacaaggacatcgcttattctttcaacactgatatgagtgctgatattctgtcgaaattccacctggaccccgtcaatggtcagatcagtgtcaaaggcaacattgattttgaggagagtaagtcatatgagattcaggtggaggctactgataaaggtaatccaccaatgagcgatcattgcaccgtccttctcgagatagtcgacattaacgacaatgtccccgaactggtgattcagtcactgtccttaccggtccttgaggatagccctttgtctacagtaatcgccctgatcagcgtgtctgatagggatagtggcgtaaacggccaggttacgtgttccctgaccccacatgtgccattcaagcttgtgagtaccttcaaaaactattacagcttggtgttagacagtcctttggatagggaatccgtgtctgcgtatgagcttgtcgtgaccgcacgcgacggggggtcgccaagcctgtgggccacggcctctgttagtgttgaggtcgccgacgtaaatgataacgcgcccgcattctcccagtctgagtataccgtgtttgtgaaagagaacaaccccccgggatgtcacatcttcaccgtgagtgctcgagatgctgatgcgcaggagaatgccttggtgagctacagcctggtggagcgtcgggttggtgaacgggctctttctagttacgtgagtgtgcatgccgagtcagggaaagtctatgccctacaacccctggaccacgaagaactggagcttctgcagtttcaggtatccgcaagagatgccggcgtgcctccacttggaagcaacgtgaccctgcaggtcttcgtgctggatgagaacgacaacgcccccgcccttctgatgccaagagtggggggcattgggggtgctgtgtctgaactggtaccgcgctccgtcggggccgggcatgtggtcgcaaaggttcgcgccgttgacgccgattccggctataacgcttggctgtcctacgagttgcaacccggtacaggcggggctaggataccattccgagtcgggctatacactggcgaaatcagcaccacacgcgccctggacgaggtcgatgcaccgcgtcacaggctactcgtcctcgtcaaggaccatggcgagccgtccctgactgcgaccgccactgtgctggtgtccctggtcgaatctggccaggcacctaaagcttcttcccaggccagtgccggcgcaactggccccgaagccgcactcgtcgacgtgaatgtttatttgattgtggctatttgtgctgtttcaagtctacttgtgctgacactgctgctttacacggctctgcgctgttccgcccctcccacagaaggcgactgtggccctggcaagcccacactggtgtgttctagcgccgtgggctcctggtcatactctcagcaacgacagcagcgagtgtgctcaggcgagggcctgcctaaaaccgatctgatggcctttagtccctctctcccaccctgccctatttccagagacagagaggagaaacaagacgtggacgtagacctgagtgcaaagccaagacagccgaatcctgactggagatactctgcaagcctgagggcaggaatgcattcatcagtgcatctggaggaggcggggattttgagagctggacccggaggccccgatcagcagtggcctacagtttcttctgcaacccctgagcccgaggctggcgaagtgtctccccctgtaggggctggtgtgaacagtaactcatggacatttaagtatggtccaggaaatccgaagcaaagtgggcccggagagctcccggataagtttattattcccggcagccctgccatcatcagcataagacaggagcctacaaactcacaaattgacaaaagtgactttatcacttttgggaagaaggaggagacaaaaaaaaaaaagaaaaagaaaaaaggaaataagacacaggagaagaaggagaaaggcaatagcactacagacaacagtgatcagtag

SEQ ID NO: 201899 - DNA, 2475 bp, Artificial Sequence
  Description of Artificial Sequence: Synthetic coding sequence
atgctgttcagctggcgggaggaccccggcgcccagtgcctgctgctcagtctcctgctgctcgcagcttccgaggtaggatctggccagctccactatagtgtttctgaggaggctaaacacggcaccttcgtcgggcgcatagcccaggatctgggactggaattggcggaacttgtcccccggctatttagggtggcgagtaaaagacacggagatttgctagaggtaaatctccagaacgggatactcttcgtaaactctagaattgatagagaggagttgtgtggtcggtctgctgagtgctctatacacctggaagtgattgtggatcgtccactccaggtgttccatgtggaagtggaggtaaaggatattaacgataatgcacccgttttccctatggcagtcaagaacttgttcatctccgaatctcgacagcctggatctcggttctccctcgagggggcttctgacgccgacatcggcacaaactcccttctcacttatagtttagacagcacagagtatttcactctcgacgtcaaaaggaacgatgaggagatcaaatccctggggctagtactgaaaaaaaatttgaaccgcgaggacactccaaaacactacctgctcataactgccattgacggaggtaagcctgaacttaccggaacaacccagctgaaaatcaccgtcctggacgttaatgataatgccccagcctttgagaggacaatctataaagtgcggttgctggaaaacgcccctaatggtaccttagtcgtgacagtgaatgctacagatttagacgaaggcgtgaacaaggacattgcatatagcttcaacactgacatgtctgcagatatcctctccaaattccatctcgatccggtgaacggccagatctcagtgaaggggaatattgacttcgaagaaagcaaaagctatgagatccaggtcgaagccactgataagggaaacccaccaatgtcagatcattgtacagtgctgctcgaaatcgtcgacattaatgataacgtgcccgaactggtaattcagtctcttagtctgcccgtcctcgaggatagcccacttagtactgtcattgcgctaatctccgtgagcgacagagattctggcgtaaacgggcaggtgacttgcagcctcacgcctcacgtgccctttaaactggtgtccacctttaaaaactattactctttagtcctggacagtcccctagacagggaaagtgtgagcgcttatgagctcgtggtcacagctcgggatgggggaagccctagtctgtgggcgaccgcaagcgtgagcgtcgaagtggccgatgtcaacgacaacgcgcccgccttctcacaaagcgaatacaccgttttcgttaaagagaacaacccccctgggtgccacatattcactgttagtgccagagacgccgatgctcaggagaacgcgctggttagctattctctggtggagcggagagtaggcgaacgcgccctaagcagctatgtcagtgttcacgctgaatccgggaaggtctatgccctgcagcccttggatcatgaagaattagaattattgcaatttcaggtctcagcccgagatgccggagtcccaccactggggtctaatgtcacacttcaagtatttgttcttgacgagaatgacaatgcgcctgccttgctgatgccgagggtggggggcatcggcggtgctgtgtccgaactcgtcccaaggtctgtgggagccggacacgtggtggcaaaggtgcgcgccgtggacgctgattcaggttacaacgcctggctgtcctacgaacttcagcccggcacagggggggccaggataccattcagagtcggtctgtacaccggcgaaataagcacgactcgcgctcttgatgaagttgacgctccccggcaccgactcctagttctcgtgaaggatcacggagagcctagtctgacagccactgccaccgttctggttagtttggtcgagtctgggcaggcgcctaaggcgtccagccaagctagtgcgggggcaacaggacctgaggccgcgctggtggacgtaaacgtatacctgattgtggctatttgtgccgtttcctcactcttagtgctgacgctcttactatacactgccctgcggtgttctgcccctcccacggagggcgattgcgggcctggcaaacccaccctggtctgctcttcagccgttgggtcctggtcttacagccagcagagacagcagcgggtgtgtagcggcgagggtctgcctaagacagatttaatggcattttccccctctctccccccctgtcccatctcacgggatagagaagaaaaacaggacgtcgatgtggatctgagcgcaaaggtgtcgaacttctatctgttctttccaaagtgtctgtgtttcagtttccttaacgtgagtacacccctcgagattcactag

SEQ ID NO: 201900 - DNA, 2451 bp, Artificial Sequence
  Description of Artificial Sequence: Synthetic coding sequence
atggtgtacagccggcggggcagcctgggcagccggctgctgctgttgtggctattattagcgtattggaaggcgggatcaggacagttgcactactccattcctgaggaggccaaacatggaaccttcgtggggcggatagcacaggacctgggcctcgagctcgctgaattggtcccgaggctgttccgggtcgcttcaaagggacgcggtgatctgctcgaagtcaatcttcaaaatgggatcctgtttgtgaattccaggatcgaccgggaggaattgtgtcgtagaagggcagagtgctcaattcacctagaggttattgtcgaccgccctctacaagtgttccacgtggaggtggccgtgaaggacattaacgacaatcctcctcgcttttctcggcaggagcagagactctttatcctggagtctcgaatgcccgattcacgcttcccactggagggtgcttcagatctcgatataggtgccaacgcgcagctgcggtaccgcttgaatcccaacgaatatttcgatctcgatgttaaaacaaacgaagaagagacgaacttcttggagctcgtgctgcgcaagtctcttgatagagaggaaactcaggaacacaggctgctggtgatcgctaccgacggcggcaagcccgaactgacaggaaccgtccagctgctgataaacgtgttagatgctaacgacaacgctcctgaatttgataagtcaatctacaatgtgcggcttttagaaaacgccccttcaggaacccttgtcatcaaattaaacgctagcgacgccgatgaaggcataaataaagagattgtgtacttctttagtaatcttgtgctcgatgacgtcaaaagcaagttcattattaacagcaacactggcgagatcaaggtgaacggcgagctggactacgaggactacaattcctatgaaatcaatatcgacgccatggataagagcaccttccccttatcggggcactgtaaggtggttgtgaaactgctcgacgtgaatgataacaccccggaaatggcgattactaccctgtttcttcctgtaaaggaggatgctcctctgtctacagtcatagccctgatttcagtgtctgaccgcgactccggggccaatggccaggtgacatgcagtttaatgccgcacgtgcccttcaagttagtgtctacctttaaaaattattactccctggtcctcgattcagccctggaccgtgagtccgtgagtgtatacgagcttgtagtaacagcccgtgacggaggcagtccatctctctgggccaccgcctcggtttctgtcgaagtggcagatgtgaacgataatgcccccgcctttgcgcagccccaatacactgtgttcgtaaaagagaataaccctccgggctgtcacatcttcaccgtgtccgctcgcgatgccgatgcccaggagaatgctcttgtgagctactctttagtagagaggcgagtaggtgaaagaccgctgtcttcctacgtgtctgttcatgctgaaagtggcaaagtctacgccctgcagccgctagaccacgaggaggttgagttgctgcagttccaggtgagcgcaagggacgctggggttcctcccttgggctcaaatgtgaccctgcaggtattcgtcctggatgaaaacgacaatgcaccggccctcctggtaccaagggtcggggggacaggaggcgctgtgagcgagctggttccacggtccgtgggggccggtcacgtcgtcgcgaaggtccgcgccgttgaccccgatagtggctacaacgcttggctgtcctatgagttacagccggccccaggatctgctagaattccattccgggtggggctgtacacaggtgagattagcaccaccaggagcttggacgagaccgaggctccacgccataggttgctggtgcttgtaaaagaccatggggagcccccacttacagctaccgcaacagttctcgtgtctctagtcgaaagtggccaagctcccaaggcctcttctagagcaagtgctggagcggtcggccctgaggctgcattagtcgacgtcaacgtttaccttataatcgcgatttgcgcggtctcctccctgcttgtgctcactctcctcctttacactgcactccggtgcagcgctcagcctaccgaggctgtctgtacacggggtaagccaactttactgtgttcttccgccgttgggtcttggagctactcccagcagaggcgtcagagggtttgtagtggcgaggccccccccaaaacggacctgatggccttttctccctctttacctcaagggcccacatcaacggataacgtatccttcctcatcctgacttccattttcccttcgcagttcagtaacataaagtgccacatccacccactgttcttgtatctcaaaatcatgagttag

SEQ ID NO: 201901 - DNA, 2673 bp, Artificial Sequence
  Description of Artificial Sequence: Synthetic coding sequence
atggtgtacagccggcggggcagcctgggcagccggctgctgctgctgtggctcttactcgcctattggaaagcggggagtggtcagttgcactatagcattccagaagaggctaagcacggcacctttgtcggtcgtattgcacaggatctgggccttgaactagccgagttagtgcccagattattcagagtcgcaagcaagggacgaggtgatctgctggaggtgaacctgcagaacggtatcctctttgtgaatagccgtatcgaccgggaagaactgtgcagacgacgggccgaatgtagcattcatttagaggtcattgttgaccggccacttcaggtctttcacgtagaggttgctgtgaaagatataaacgataatcccccccgtttctcacggcaggaacagagactgttcatcctggaaagtcggatgcctgacagtagattccccctagagggggcgagtgatctggacatcggtgcgaacgctcaactccggtacaggctcaatcccaatgagtattttgaccttgacgtgaagaccaacgaggaggagacgaacttccttgagctggtgcttagaaagtctctggaccgtgaagaaacgcaggaacataggttgctggtcattgctaccgatggcggaaagcctgaactaaccggaacagttcaactgttgatcaacgtgctcgacgctaatgataacgcccccgaattcgacaagtccatatacaacgtgcggctgttggaaaacgctccatcagggaccctggttattaagcttaatgcttcggatgcagatgaaggaattaacaaggaaatcgtctatttctttagcaacctggtcctcgatgatgtgaaaagcaagtttattatcaattctaacacaggggaaattaaggtcaacggtgagcttgattatgaggactacaattcctacgagatcaacatcgacgccatggacaagagcacgttccctctgagcggacactgtaaggtcgtcgtaaaactcctagacgttaatgataatactcccgagatggctattaccaccttatttttacctgtgaaggaagatgcaccactttctaccgtgatcgcccttatatccgtgagcgaccgagatagtggcgcgaatgggcaggtaacctgttcccttatgccgcacgtgccttttaagctggtttccacctttaaaaactattactctctagtcttggactccgccctcgaccgggaatcagtcagtgtctatgagttggtggtcacggcgcgtgacggaggtagtccctcactctgggccacagcttcagttagcgtggaggttgccgacgtcaatgataatgcacctgccttcgcgcagccacagtacacagtgttcgtgaaagaaaacaatccacctgggtgccacatcttcacggtgtctgcgcgagacgccgatgctcaggaaaacgctctggtcagctattcactcgtcgagcgaagggtaggcgaacgccctctttcgagctacgtgtctgtgcatgccgaatctggcaaagtctatgccctccaaccactggatcacgaggaggtggaattactgcagttccaggttagtgccagggatgctggggtgccgcctctcgggtctaatgtcacactacaggttttcgtcttagacgaaaatgataacgccccggccctgcttgtacccagagtcggcggcactggaggagcagtttctgagctggtacctcggtccgttggagccggccacgttgtggctaaagtgagagcagtcgatccagattctggctataatgcatggttgtcctatgagctccagcccgcaccaggatcagcgagaatcccatttcgcgtgggcctttacactggggagatcagcacaacccgctcattggatgagactgaagcccctagacaccggctactggttctagtgaaagatcacggcgaaccgccacttaccgccacagctaccgtgttggttagtctggtggagagtggccaggcccccaaagcgagctcacgcgcttctgctggcgctgtcggcccagaggctgcactggtggatgtgaatgtgtacttaattattgccatctgcgctgtgagttctctgctggttctaacgctcttgctatacaccgccttgagatgctccgcccagccaacagaagctgtatgtacgaggggtaagcccacattactgtgtagtagcgctgtgggcagctggtcttacagccaacagaggcggcagcgagtgtgttcaggagaagccccgcccaagaccgatctcatggcgttttccccttctctgcctcagggccccacatccaccgacaatccaaggcagcctaatccggattggagatattccgcaagtctccgggccggcatgcactccagcgtgcacctggaggaggctggaatcctgcgcgcaggtcccgggggccctgatcagcagtggcctacagttagctcagctacccctgaacctgaagctggcgaagtgtcacctcccgtaggagccggagttaactccaatagttggaccttcaagtacgggcctgggaatccgaagcagtcagggccagagcctaaaaagcagacccaggttagcttcctgctgagacgcaagggggaggcctctcagccacggcagtag

SEQ ID NO: 201902 - DNA, 2811 bp, Artificial Sequence
  Description of Artificial Sequence: Synthetic coding sequence
atggtgtacagccggcggggcagcctgggcagccggctgctgctgctgtggctgttactggcttactggaaggcagggagtgggcagctgcattactcaatccccgaggaagcgaaacacggcacatttgtcggacgtattgcccaggacctcggactggagctggccgagctggtcccgagactgtttcgggtggccagcaagggacgaggggatcttctcgaagttaatctgcaaaacgggatcctttttgttaactcacgtatagatcgggaggagttatgtagacgtcgcgccgagtgttcaattcatctggaggtgatagtggacagacctttgcaggtgtttcacgttgaggtagcagtgaaggacatcaacgataatcccccccgtttcagccgacaggagcaacggctctttatcctggaatcaagaatgcctgacagtcggttcccgcttgaaggcgcgtccgacttggatataggcgccaatgcccaattgagatatcgactgaaccctaatgagtactttgacttagacgttaaaaccaacgaagaagaaactaatttcctggaattagtattacgtaagtccctcgacagagaagaaacacaggagcacagactgctcgtaatagcgactgacgggggaaagccggaattgacaggcaccgtacagctgctaatcaatgtattagatgccaatgacaacgcacccgagttcgataagagcatctacaatgttcgcttgctggagaacgccccaagtgggacactagtgatcaaactgaacgccagcgatgctgatgaagggataaacaaggagatcgtctatttctttagcaacctggtcttagacgatgtgaagtcaaagttcatcatcaacagcaatacaggggaaataaaagtcaatggagagctggattacgaagattataatagctacgagataaacatcgatgcaatggataagtccaccttccccctgtcaggccattgcaaggtggtggtcaagctgctggacgtgaatgacaatacaccggagatggccatcacgacactgtttctccctgtcaaagaagacgctccgctctccacagtgatcgcgctcatctctgtgtcggatcgagactctggagcaaatggccaggtgacctgctcccttatgccccacgtcccattcaagttggttagcacgttcaaaaattactattctctggttctggactctgccttggatagagaatccgtgtccgtgtatgaactggtggtaacagctcgggatgggggtagcccaagcctgtgggccacggcctctgtgtctgtggaggtggccgacgtgaatgacaatgcacctgcatttgcccaacctcagtataccgtgtttgtcaaggaaaataaccctcctggctgtcatattttcaccgtgtccgccagagatgccgatgcccaggaaaatgctctggtgtcttatagtctcgtagaaaggcgggtgggcgagcgcccactgtccagttacgtttccgtccacgcggaatctgggaaagtctacgccctacagcccttagaccatgaggaggtagaacttctccagttccaagtgagtgcacgagacgccggtgtaccaccattaggctcgaacgttaccttgcaggtctttgtgctggatgagaacgacaacgcaccagcactcctcgtccccagggtcggtggaaccggaggggcggtctccgaactcgttccccgttccgttggagctgggcacgtggtggcgaaagtgagggctgttgatccagactctggttataacgcctggctttcatatgagttgcaacccgctcctggcagcgcccggattccctttcgcgtggggttgtacacaggtgaaatctctaccacgcggtcactggatgaaacagaggccccccggcacaggctactggtgcttgttaaagatcacggcgagccaccccttacagctaccgcaaccgtgctggtcagcctggtggagtcaggacaggcccctaaagcatccagcagagccagtgcaggcgccgtggggcccgaagccgctctagtggacgtgaacgtgtatctcattattgcaatctgtgctgtttcgtctctgctggttctcacacttctgctgtataccgccctgagatgcagcgctcagcctacagaggccgtgtgcacccgaggcaaaccaaccctattgtgcagtagcgctgtgggcagctggtcctatagccagcaacgaagacagcgcgtttgctccggcgaggccccacctaagacagatcttatggctttttctcccagcttgcctcagggacctacatccactgacaatcctagacaacccaatcccgattggcggtattctgccagtttgagggctggaatgcactccagcgtacaccttgaagaggccggaatcctccgagccggacctggaggtcctgatcagcaatggcccacagtatcctccgccacccctgaacccgaagctggcgaggtatctccacccgtgggggcgggcgtcaattccaattcttggactttcaagtacggccctggcaacccaaagcagagcggacccggagagctccccgacaaattcattatccctggcagtcccgcgatcatttctatccggcaggagcctacgaacagccaaatcgataagtccgatttcattactttcggtaagaaagaggaaactaaaaaaaagaaaaagaaaaagaagggaaataagactcaggaaaagaaggaaaagggcaattccaccacagataattcagatcagtag

SEQ ID NO: 201903 - DNA, 2061 bp, Artificial Sequence
  Description of Artificial Sequence: Synthetic coding sequence
atggtgttcacccccgaggaccggctgggcaagcagtgcctgctgctacctctcctgctgctggccgcctggaaggtgggcagcgggcagctacactacagcgtacctgaggaagctaagcacggtaccttcgtaggcaggatcgcacaggatctgggcttggaacttgccgagcttgtgccccggctgtttcgcatggcgagtaaggatcgtgaggatctgctcgaagtgaatcttcaaaacggcatcctgtttgtcaactcgcgaatcgatcgcgaggaactttgtggaagaagcgcggagtgtagcatccatcttgaagtgattgtggataggccactccaagtatttcatgtggacgtggaagtccgcgacataaatgataacccacctctgttccccgtggaggagcagagggtgttaatttatgaatcccggcttcctgactcagtcttccctctagaaggcgcctccgatgccgatgtgggatcaaatagtatcctgacctataagctgagctcttcggaatatttcgggctggatgttaagatcaatagtgatgataacaaacaaattggactcctgcttaagaagtcccttgacagagaagaggccccagcccataaccttttcttgaccgcaaccgatggcgggaagcctgagctgaccgggaccgtgcaattgctggtaacagtgttggacgttaacgacaacgccccaaccttcgagcagtccgagtatgaagtgcgcatcttcgagaacgccgataacgggactacagtgattagactgaacgctagcgatagggatgaaggcgcaaatggggccatatcctatagttttaactctctggttgccgcgatggtgatcgaccatttctcaattgacagaaatacaggggagatcgtgattcgcgggaatttggatttcgagcaggaaaacctgtataagattttaatcgacgcgacagacaagggacaccctcctatggccggtcactgcacagtactagtgagaatactagacaaaaacgacaacgtgcctgaaatcgctctcactagcctcagcctgcctgtgagggaagacgcgcaattcggaaccgttattgccctcatatctgtgaacgatctggattcaggagcgaacggccaggttaactgttctctcacaccacatgtgccattcaagcttgtttccacatttaaaaattattactccctggtcttggactccgcccttgatagagagagcgtgtctgcatacgagctagttgtgaccgcacgcgacgggggctctccgtcgttgtgggccaccgcctcgctgtcagtggaggtagcagacatgaatgacaatgcccccgcatttgcacagccagaatacacggttttcgtaaaggagaacaatccgccgggttgtcatattttcactgttagcgctagagacgccgatgcccaggaaaacgcattggtttcctactcactggttgaaagaagagtgggcgaaagagcactctcaagctacatttctgtgcatgccgagtccggaaaggtgtatgctcttcagcccttggaccatgaagagctggaactgttgcaatttcagccccgccaacccaatccagactggcggtacagtgcctccttgcgcgctggaatgcattctagtgttcatctggaagaggcgggaatcttgcgagccggaccaggcggccctgatcagcaatggcccaccgtaagctctgccacacccgaacccgaggcgggagaggtgagccccccggtcggtgctggcgtcaattctaatagttggaccttcaaatatgggcccggaaatcccaagcagtctggtcccggagaactaccagacaaatttatcattccgggtagccccgccatcatcagtattaggcaggagccaaccaacagtcagattgataagagcgacttcatcacttttgggaaaaaagaggaaacaaagaagaaaaaaaaaaaaaaaaaaggtaataagacccaggagaagaaagaaaaaggaaactctaccactgacaattctgatcagtag

SEQ ID NO: 201904 - DNA, 2853 bp, Artificial Sequence
  Description of Artificial Sequence: Synthetic coding sequence
atggtgttcacccccgaggaccggctgggcaagcagtgcctgctgctaccactgttgcttctggcagcctggaaagtgggctctggccagctgcactactccgtgccagaggaggcgaaacatggtacttttgtagggaggatcgcgcaggacctcggactggagctcgcagagttggtcccccggctgtttaggatggcttctaaagaccgcgaggatctgttagaggtcaatcttcagaacggcattttgtttgtcaactcacgcattgatagagaggagttgtgcggtcggagtgccgagtgctccatccatttggaggtcatagttgatcggcccctccaggtgtttcatgttgacgtggaggttcgtgacatcaatgataacccacccctgttcccggtcgaagagcagagagtgctcatctatgagtccaggctgccagacagcgtctttccattggaaggagcttccgacgcggacgtcggcagcaattcgatcctgacttacaaattatcttccagcgagtacttcggacttgatgtgaaaataaactccgacgataataaacagatcgggctcctgttgaaaaaaagcctcgacagggaggaggcacctgcccataacctgtttctcactgccacagacggaggtaaaccagaacttacagggactgtgcagctactggtgacagtgctcgacgtgaacgataacgccccaacatttgagcagtccgagtacgaagtcagaatcttcgagaacgccgacaacggtaccaccgtgatcaggcttaatgcgtccgaccgggacgaaggagccaacggcgccatctcttatagcttcaattccctagtagccgcaatggtgatagaccacttcagtattgaccggaacacaggtgagattgtcatcagaggtaacctcgattttgagcaggagaatttgtacaagatcctgatagatgccacagataagggccacccccccatggctggccattgtacggttctggtgcggattctcgacaaaaatgacaacgtgccggagatcgccctgacttccctgagcttaccagttagagaagacgcacagtttggcactgtcattgccctgattagcgtgaatgatttagattcaggcgcaaacggtcaggtcaactgttcactgacacctcacgtgcccttcaaactagtgtctacctttaagaattactacagtctggtgctcgattccgctctggatcgggagagcgtgagcgcgtatgagcttgttgtgacagcacgggatggaggatccccatccctgtgggcaaccgcatcccttagcgttgaggtggctgacatgaacgataatgctccggcatttgctcagccggaatacaccgttttcgtgaaggagaacaaccctccaggatgtcacatcttcacggtttctgccagggacgccgatgctcaggagaatgcgctcgttagctattcactcgtggagcgccgggtgggcgagcgtgccttgagctcttatataagcgtgcatgctgagagtggcaaggtttacgccctccagccactggaccatgaggaacttgagctcctgcagttccaggttagcgcacgagatgccggtgtccctccactggggagtaacgtgaccttacaggtttttgtccttgacgagaacgacaacgcaccagctctactggcaccacgcgttggaggcacgggtggagccgtgagcgagctggtcccacgttccctgggcgccggccaggtagttgctaaggtccgagccgtcgacgccgattctggttataatgcctggctgagctacgagctgcagcctccagcctcttctgcacgattcccgtttcgggttggtctgtataccggcgaaatctcaacaacccgggtgcttgatgaggctgattcaccgcgccacagacttctcgttctagtgaaagaccatggcgaacctgccctgaccgctaccgccaccgttctcgtgagcctggtggagagcggtcaggctcccaaagcctcgtcacgcgcaagtgtaggcgcagctggacccgaggctgcgctggtggatgtaaatgtttatcttatcatagctatttgtgccgtgtcatccctgctcgttttgacgctgctactctatactgcattaaggtgctcagccccacccacagaaggggcatgcacggcggacaagcccactctcgtatgttcatcagccgttgggagctggagctacagccagcagcgccgacagcgcgtctgcagtggagaggggccgcccaaaatggatttaatggctttttcaccttcattatccccatgtcccataatgatggggaaggccgaaaatcaggaccttaacgaggaccatgacgccaagcctcgtcagcctaacccagactggaggtacagcgcttccttacgcgctgggatgcactcttccgtccaccttgaggaggccggaattctgagagcaggccctggtggacccgaccaacagtggcccaccgtgagttcagccactcccgaaccagaggccggtgaggtatcccctcctgtgggggccggggtcaactcaaattcctggactttcaagtacggtcccggcaatcccaaacaatctggcccaggcgagctgccggacaaatttatcattcctggctcacccgctatcatcagcattcgccaggagccaacgaatagccagatagacaaatccgacttcattaccttcgggaagaaggaagaaacaaaaaagaagaaaaagaagaagaagggcaataagacacaagaaaagaaggaaaaggggaacagtacaactgacaactcagaccagtag

SEQ ID NO: 201905 - DNA, 2370 bp, Artificial Sequence
  Description of Artificial Sequence: Synthetic coding sequence
atggtgtgccccaacggctacgaccccggcggccggcacctgctgctcttcatcatcatactggctgcctgggaagctgggcgaggccagctgcattactccgtgccggaggaagctaaacacggaaactttgtgggccggatagcccaagatctgggcctcgaactggctgaactcgtaccacgattgttccgagcagtttgtaagttccgcggggacctcttggaagtgaatttgcagaacggcatcttgtttgtcaattcccgtatcgatcgggaggaactgtgtggtcgctccgccgagtgctctatacacctggaggtgatcgtggagaggccattgcaggtgtttcacgtggacgttgaagtcaaggatatcaatgacaatcccccggtgtttcccgccacacagcgcaatctgttcatcgctgagtcacggccactggacagtcggttccctcttgagggggcgtctgacgccgatatcggggaaaatgctctgctgacatacagactcagccccaacgagtactttttccttgatgtccccacatccaaccaacaagtgaagccgttggggctagttctgcggaaactgctggatcgagaagaaaccccagagctacacctcctcctcacagcgacggatgggggaaagccagaacttacaggaacagttcagctgttgatcacagtgctagacaataatgacaacgctcctgtctttgacaggacactgtatactgtaaaacttcccgagaacgtctcaattggcacacttgtaattcatccgaacgcatctgatttagatgagggcttgaatggagatattatatactccttcagctcggacgtctcgcccgatatcaagtccaagtttcatatggaccctttgagcggggcaattacggttatcggccatatggatttcgaggagtccagggcacacaagatcccagtggaggccgtggacaaaggtttccccccactagctgggcattgcacagttttagtagaggtggtcgacgtcaacgacaacgccccccaactcacactgaccagcttgtcccttcccattcctgaggatgcgcagcccggcacagtcatcactcttatttcggtgtttgatcgggactttggggttaacgggcaagtgacttgcagtcttaccccaagggttcccttcaaacttgtatccacgttcaagaactattatagtcttgtgctggattcagcccttgaccgggaaagcgtgtctgcatacgaactcgttgtgactgcccgagatggcggatctcctagtctgtgggcgacagcttccgtttctgtggaggtggccgacgttaatgacaacgccccagcttttgcacagcctgagtacaccgtgttcgtgaaggaaaataacccccctggctgccatatcttcacagttagtgctggtgacgccgatgctcagaagaacgcgttggtcagctattccctcgttgaactgagggtgggcgagcgagctctctcctcatacgtgtcagtgcacgctgaaagcggcaaagtttacgccctccagcccctggatcatgaggaactggaactgctccagttccaggttagtgccagagatgctggagtacctccgctcgggtctaacgtaaccttacaagtatttgtgcttgacgaaaacgacaacgcccccgctttactggccccccgggtggggggaacaggaggcgcggtcagggaattggtgcctaggtcagtgggcgccggccatgtggtggctaaagtgcgcgctgtcgatgctgactccggttataatgcttggctctcttatgagttgcagccggttgctgcgggcgcgtcaatcccctttcgcgtcgggctttacacaggagagatatccactacgcgagcgctggatgaaaccgacgccccgcgccatcgcttactcgtgctggtgaaggaccacggcgaacccagcttaaccgctaccgccactgttttagtctcacttgtagagtccggacaggcccccaaagccagttcccgcgcttctctgggcatcgcaggacctgagacggagctggtggacgtcaacgtttatcttatcatcgccatttgcgcagtgagttcgctcctggtacttacgttactcctgtatactgccctgcgttgctcagctccctctagtgagggagcttgttccctggtgaagccgaccttggtgtgtagtagcgctgtcggtagttggagtttctcacaacagcggagacagcgcgtctgctctggagagggccccccaaagacagatcttatggccttctccccttcacttcctcagggtcccagttccaccgataatgtgtctcacaaatag

SEQ ID NO: 201906 - DNA, 2814 bp, Artificial Sequence
  Description of Artificial Sequence: Synthetic coding sequence
atggtgtgccccaacggctacgaccccggcggccggcacctgctgctttttatcattatcctcgccgcttgggaagccggtaggggccaactacattatagcgtgcctgaggaggctaaacacggaaacttcgtggggcgcatagcccaggatttggggttggaacttgctgaactggtccccagactattccgtgccgtttgcaagtttcgcggcgatttattagaagtcaacttgcagaacggtattctgtttgttaactcgagaatcgacagagaggaactgtgcgggcggtccgctgaatgtagtatccacctggaggtgatcgtggagaggccacttcaggtgtttcacgtggacgtagaagtgaaagatataaacgataaccccccagtcttccctgctacacaacgcaacctgttcatcgctgaaagtcggcctctggactcacgcttccctctggaaggcgcttctgacgctgatattggggagaatgctcttctaacttacagactgtcgcctaatgaatactttttccttgatgtgcctacgtctaaccagcaagttaagccactcgggcttgtgctgagaaagctcttggatcgagaggagacacccgagttgcatctgctgctgactgcaaccgatggcgggaagcccgagttgaccgggacggtgcagctcctgattacagtgttggataacaacgacaacgccccggtgttcgaccggactttgtacaccgtaaaacttccagagaatgtgagtatcggaacgctggtgatccaccccaatgcaagtgatttggacgaaggccttaatggcgatatcatctattcctttagtagcgacgtatctcccgacatcaaatctaagttccacatggatccactctccggcgcaatcacagttattggccatatggacttcgaagagagccgggcgcataaaatcccagtagaagctgtagataaggggtttcctccattggccggccattgcactgtcctcgtcgaggtggttgacgttaacgataacgctcctcagctgaccctgacaagcctttccctgccaattcccgaagatgcgcagccagggacagtgattactcttattagtgttttcgatagagactttggcgtaaatggccaggtcacctgctctcttacccctcgcgtgccctttaaactcgtgtcaacatttaagaactactatagtctcgtgctcgactcggcattggatagagaatccgtttcagcttacgagttggtggtgaccgcgcgagacggaggatccccctctctctgggctaccgcctcagtgagcgtggaagttgcagacgtgaacgataatgctccagccttcgctcagcctgaatacacagtgttcgtgaaggaaaacaaccccccaggctgtcatatctttacagtcagtgcaggggatgcggacgcccagaagaacgccctcgtgagctatagcctggtggagttaagggtgggtgaaagagcactgtcatcatacgtgtcagtgcacgccgagtctggcaaggtgtacgcgcttcaacccctggaccatgaggagctggagttgctgcagttccaagtgtccgctcgcgacgctggggtgccacccctagggagcaacgtgactcttcaggtgttcgtcctcgatgaaaacgacaacgcacctgcccttctcgccccaagagttgggggcacaggaggcgccgtcagagagttagttccccgcagcgttggcgcaggtcacgtagtcgctaaagttcgagcggtcgatgctgactccgggtacaatgcgtggttatcttatgaactgcagcccgtggctgccggagctagtatcccttttagagttggcctctacaccggagaaattagcaccacgcgggcactggacgaaaccgatgctccgcgacatcggctccttgtcttagtcaaggaccatggggaaccctcactgacagcaacggctacggtgctggttagtctcgttgagagcgggcaggcgcccaaggcaagctcccgggcttctctgggcatcgctggcccagaaaccgagctggttgacgtcaatgtgtatctgattatcgccatatgtgcagtaagttccttactagttctgaccctattgctgtatacagctcttcgctgtagcgcaccttcctctgagggggcttgttctctcgtaaagcctactctggtgtgtagctccgccgttggatcatggtcctttagccagcagagacgccaacgtgtatgctccggggaaggtccacccaagacggatctgatggcattctcgccttcactgcctcaggggccctcgtctaccgacaacccccgccagcctaatcccgactggcggtattcggcttccctgagggctggcatgcactcgagcgtccacctggaggaggccggaattctccgcgcgggcccgggaggcccagaccagcaatggcctacagtgtcatcggccacccccgagccggaagcaggggaggtgagcccacctgtcggggccggggtaaactctaatagctggactttcaagtatggccccgggaatcccaagcagtcaggcccaggcgagcttccggataaatttatcataccagggagcccggctattatcagtattagacaggagcctacaaactcccaaatcgataagagcgatttcattacgtttgggaaaaaggaagagaccaagaaaaaaaaaaagaagaagaaaggaaataaaactcaagagaaaaaggagaaaggcaattccacaacagacaattccgaccagtag

SEQ ID NO: 201907 - DNA, 2445 bp, Artificial Sequence
  Description of Artificial Sequence: Synthetic coding sequence
atggactaccactggcggggcgagctgggcagctggcggctgctgctcttgctgttactgcttgccgcatggaaggtggggagcggtcagctgcactactcagtgcccgaggaggccaagcacggcacctttgtcggcaggattgcacaggacctcggacttgaactggccgaactggtaccccgtctgttccgggtcgcttccaagagacacagagacctcctggaggtgagccttcagaatgggattctgttcgtgaactctcgaatcgaccgcgaagagctatgcggccggtccgccgagtgcagcatccatctcgaagtgatagtagatagaccactgcaagtattccacgttgacgtggaggtaaaagacgtgaacgacaatccaccagttttcagggtgaaggaccagaagttgttcgtttcagagtcacgaatgccggattccagatttccactggaaggagcctctgacgcagacgtcggtgctaatagcgtcttgacctaccgtttgtcgtctcatgactattttatgttagacgtcaactctaaaaacgatgaaaacaagcttgtggaactggtactgcggaagagtttggacagggaggacgcacccgcacaccacctgtttctcactgccacagacggcgggaaaccggagcttactggaaccgtgcagttactcgtaacagtgctagacgtcaatgacaacgcaccaacttttgagcagtccgagtacgaggttcgtatcttcgaaaacgcagataatggaaccaccgtgattaagttgaatgcctctgatccagacgagggcgcgaatggtgccatttcatattccttcaattcgctggtggagaccatggtgatagaccatttttctattgaccgaaacactggcgaaatagtgatccgggggaatctggacttcgaacaggagaacctctataagatattgatagatgctacagataagggccacccgccaatggcagggcactgcactgtcctggtgagaatcctcgataaaaatgacaacgtgcctgaaatcgctttgacttccctgagcttgccagtgcgggaggacgcacaattcggtactgtcatcgcactcatcagtgtgaatgacctcgattcaggtgctaacggccaggttacctgctctctgatgccccatgtgcccttcaaactggtctccacttttaagaactactactccctcgttctggactcagcactggatcgtgagcgagtatctgcctacgagctcgtggtcaccgcccgggacggcgggtcgccaagcctatgggccactgcgtccctgtcagtggaggtggccgatgttaatgacaatgcacctgccttcgctcagccagagtataccgtgtttgtgaaagaaaataaccccccggggtgtcacatttttaccgtctctgctcgggacgccgatgcacaagagaacgctctggtgagctactcattagtggagcggcgcgtcggcgaaagaagcctgtcctcctatatctctgtgcacactgagagcggcaaagtgtatgcccttcagcccctggaccatgaggaactggagcttctgcagttccaagtgtcagcgagggatgctggggtgcccccccttggcagcaacgtgacacttcaggtcttcgttctggacgaaaatgataatgccccggccctgctcgagcctagagtgggcgggaccggtggggcagcctccaaactggtgcctcgcagtgtaggtgccggccatgtggtggccaaagttagggcggttgacgcggacagcggctataacgcctggttgtcttacgaattacagccagctgcttcctcccccaggattcctttccgagtcggactgtataccggagagatctccactactcgcgtattagacgaggcggactctcctcgtcaccgactcctcgtccttgtgaaggaccacggcgagcccgccttaactgcgaccgctactgtgctggtctcactggtagagagtgggcaggctcccaaggcctcatcacgtcaatccgctggcgtcctcggccctgaggccgcactcgtggatgtgaacgtctatctgattattgccatttgcgctgtgtcgtcactactcgtgctcaccctgttgctgtacacggccctcagatgctccgccttacccaccgagggaggttgtcgggcagggaaaccgacgttggtgtgctctagcgctgtgggctcctggtcttacagtcaacagcagccacaacgagtgtgctcgggtgagggtccacccaagactgaccttatggctttttcaccatgcctgccccctgacttggggtcagtggacgtcggcgaggaacaggacttgaacgtggaccatggtctcaaggtgtcccctttcaaattccggacgcataagttctatttgtggaaactgtag

SEQ ID NO: 201908 - DNA, 2853 bp, Artificial Sequence
  Description of Artificial Sequence: Synthetic coding sequence
atggactaccactggcggggcgagctgggcagctggcggctgctgttgcttctgctattacttgctgcctggaaagtgggctctggacaactccattacagcgtgcccgaggaggctaaacacggaactttcgtcggccgtattgcccaggatctgggccttgagttggccgagttggtcccacggcttttcagagtcgcttcaaaacgccaccgcgacctgctggaggtgtcgcttcagaacgggatcctgttcgtgaatagccggatagatagagaggagctctgtggacggagtgctgagtgttctatacatctcgaagtcattgtggacaggccactacaggtgttccacgtcgacgtggaggtcaaggacgtcaacgataatcccccggtgttccgagtaaaggatcagaagctctttgtgtccgagtccaggatgccagatagtagatttcccctggagggagcctccgacgctgacgtcggcgccaattccgtgctcacataccggttaagtagccacgactactttatgctggatgtcaattcaaaaaatgacgagaataaactcgtggagttggtcttaaggaagagcttggacagggaagatgcacccgcccatcacctttttctcaccgcgactgatggcggaaaacctgagctgacggggaccgtgcaactcctggtgactgtgctggatgttaacgacaatgcacctacattcgagcagtcggagtatgaggtgcggatttttgaaaatgccgataacggtactactgtcattaagctgaacgcatctgaccccgatgagggcgctaatggcgctattagctacagcttcaactcactcgtagaaaccatggttatcgaccacttttccatcgatagaaacacgggcgagatcgtcatcagagggaacttggatttcgaacaagagaacctgtataaaattttaattgatgccactgacaaaggtcatcctccaatggctggccactgtaccgttctagtccgcatactggataagaatgataatgtcccagagatcgctcttacaagtctatctttgccagtgcgggaggacgcccagttcggaacagttattgcactgattagtgtcaacgaccttgatagcggcgcgaatggtcaggtaacctgctccttgatgcctcacgtcccgtttaagctagtatctacttttaagaactattacagtctcgtcctggacagcgccctggacagggagagagtgagcgcttatgaacttgtggtgaccgcaagggacggcggaagcccttcactttgggctaccgcttcactctctgtggaggtcgccgatgtgaacgacaatgccccagctttcgctcaaccagaatacacagtgttcgtcaaggaaaataatccccctggatgccacatctttactgtgtccgcacgtgacgctgatgcacaggaaaatgctctggtgagctattccctggttgagcgaagagtcggagagcggtctctttcgtcatacatcagcgtacataccgaatctggtaaagtgtatgctctgcaaccactcgatcacgaggaactggaactgctgcagttccaggtctccgcaagagacgcgggtgtgccccctctcggctcaaatgtgacactacaggtgtttgtgttggacgagaatgacaacgcccccgccctgctggagcctcgcgtggggggaaccgggggtgccgcctcaaagctggtccccaggtcagtgggagcaggacacgtggtggctaaggtgcgtgccgtggatgctgactctggctacaacgcatggctgagctacgaactgcagccagctgcatcttctccacgcattcccttcagagtaggactgtatacaggagagatatccacaacaagagtcctggacgaagctgatagcccacggcatagactgctggtgttggttaaagatcacggcgaaccagcactgacagctacagctaccgtcctggtcagtctggtggagtccggccaggcccctaaggcctctagccggcagtcagccggggtactgggaccggaggcagcactggtggacgtgaacgtgtacttgatcatcgcaatctgcgccgtgagctctttgctcgtgctgaccttgcttctgtacacggccctaagatgctcggcattaccaacggaaggcgggtgtagagccggaaagccaaccctggtctgctcgagcgcggtgggctcgtggagctatagccagcagcagccacagagggtgtgcagtggtgaaggacctccgaagaccgatcttatggcattttcgccttgtctgcctcccgatcttggctcagtggatgtaggcgaggaacaggaccttaacgtcgatcacgggttgaaacccaggcaaccaaatccagattggcggtacagcgcatcgttgcgcgccggcatgcactcatcagtgcatcttgaggaggccggaatcttgcgcgccggccctggtgggcctgatcaacagtggcccactgtgtctagcgctacacctgaacctgaagccggggaggtctcccctcccgtaggagccggtgtaaactctaattcctggacattcaagtacgggcccgggaatccaaagcagtccgggccaggggagctgccagataagtttatcattccaggatcaccagctatcataagcatcagacaggagcctacaaattctcagattgacaagtccgatttcattacattcggtaagaaggaagaaactaagaagaagaaaaagaagaagaaggggaacaagacccaggagaagaaagagaagggcaatagtactacagacaattccgatcagtag

SEQ ID NO: 201909 - DNA, 2529 bp, Artificial Sequence
  Description of Artificial Sequence: Synthetic coding sequence
atgctgtacagcagccggggcgaccccgagggccagcccctgctgctgagccttctcattctagccatgtgggtagtcggctcaggccagcttcattactcagtgcccgaagaggccgagcacggtaccttcgtgggaagaattgcccaggacctggggctggagctggctgagttagtgccaagattgttccagttggacagcaaaggcagaggcgatctcctcgaagtcaacctgcaaaatgggattttattcgtgaatagccgaatcgatcgcgaggaactgtgtgggcgcagcgcagaatgctctattcatctggaagtcattgtcgatagaccactccaggtgttccacgtagacgtcgaagtgaaagatatcaacgacaatcctccagtttttcctgctacgcagaagaacctctttattgctgagagcagacccctcgactcaaggttccctctggaaggtgcttctgatgctgacataggggagaacgccctcctgacctaccgcttatcgcccaacgaatacttcttcttagacgtaccaacatccaaccagcaggttaaaccactaggcctggtgctcaggaaattattggatcgggaagagacacctgagctgcatctccttctcaccgctacagacggaggaaagccagaactaaccgggactgtgcagctgctaataaccgtcttagataacaacgacaatgcccccgtattcgacagaaccctctacaccgtaaagctgcccgagaacgtctctatcggtacattggtgattcacccaaacgcctctgacctagatgaaggattaaacggggatatcatctattcgttttcaagcgacgtgagccctgatatcaaatccaagttccatatggaccccctgagcggtgccattactgttattggacacatggattttgaagagtcacgggcccataaaatcccggtagaagccgttgataagggttttcctcctctggcaggccactgcacactgctggtcgaggtagttgatgtgaatgataacgcacctcaactgaccatcaaaacgctgagtgtgccggtgaaagaagacgcgcagctcgggacagttattgcactcatttctgttattgacctagatgcagacgccaacggccaggttacctgttccctgacgccacacgtgccttttaaactcgtgtcaacatacaagaattactacagcctggttttggaccgggcccttgatcgggagagtgtgtcagcctacgaactagtggttaccgcgcgcgatgggggctccccgagcctgtgggccactgcacgtgtctctgtcgaagtggctgatgtaaacgataacgcaccggctttcgcacagagtgagtacactgtgttcgtgaaggagaataacccccccgggtgtcatatatttacggtgagcgcaagggatgcagacgcccaagagaacgctctggtctcgtattccctcgtggagagaagattgggcgaacggagcctttcttcctacgtctctgttcacgccgagtcgggaaaggtttatgctctccagccactcgatcacgaggaacttgaactactccaattccaagtctctgcgagagacgcgggagtaccacccctgggctccaatgtcacactacaagtgtttgtcctggacgagaacgataacgccccagcgttgctaactccacgtatgcgcggtaccgatggagctgtgagcgaaatggtgttgagatcagttggagctggggtcgtagttggcaaggtaagggctgtggacgccgattcaggatacaacgcatggctgtcttatgaacttcagcctgagacagcatctgcaagcatacccttcagggtaggtctctatactggcgagataagcacgactcgcgcgttagacgagaccgatgcacctcgccaaaggctgttggttctggttaaagatcacggcgagcccgccctcacagcgaccgccaccgtgcttgtgagtcttgttgaaagtggccaagcgcccaaatcttcctctcgcgccagcgtaggcgcaacaggccccgaagtgaccctagtggacgtaaatgtgtatctgatcattgccatctgcgcagtgtcctccctcctcgtcttgacgcttcttctctatacagttctgcgctgctccgccatgcccaccgaaggagagtgcgctccgggaaagcccacactcgtttgttctagcgccgttggctcttggagctactcacaacaaagacggcagcgagtatgcagtggagaggggaaacagaaaacagacctcatggcattcagcccaggcctcagcccctgcgctggaagtactgaacggaccggcgagcccagcgccagtagtgatagcactggaaaagtgggcttcagctcaattctgtttatctacatcattttcttcctggagcggtattacagactgctccccggagccgtgcagatcgtgctgtttatctttttagaaattcagcaaatcttcttcctcattaaatag

SEQ ID NO: 201910 - DNA, 2853 bp, Artificial Sequence
  Description of Artificial Sequence: Synthetic coding sequence
atgctgtacagcagccggggcgaccccgagggccagcccctgctgctatccctgctcatcctggccatgtgggtagttgggtcaggccagctgcactacagcgtgcctgaagaagctgagcatggtactttcgtagggcggatcgctcaggacctgggtttggaactcgcagaactggtaccacggttgtttcagctggactctaaaggacggggggatctccttgaggtgaacttgcagaatggtatcctttttgtgaactctagaatcgaccgggaggaactctgtggtcggtccgcagaatgctctatccacctggaagttatcgttgatcgtccattgcaagtattccatgttgacgtggaggtgaaggatattaatgacaaccctcctgtgttccctgcaactcagaagaacttattcattgcagagagccggccactcgactctcgctttccactcgaaggcgcttctgacgcggatatcggcgagaatgcccttctgacatacaggttgtctccaaatgaatacttcttcctcgatgtccccacaagtaatcagcaggtaaagccactggggttggttctcagaaaattgttggatagggaagagactcccgaactgcacttgctgttgacagctacagatggaggaaagccagaactgacagggaccgtgcagctcctcatcactgtactggacaataatgataacgctccagtgtttgatagaacactttataccgtaaaactgccagaaaatgtgtctattggtacattggtcatacacccaaacgcttccgacctcgatgaaggactgaatggagatatcatttattcgttctcatctgacgtgtctccagatatcaagtctaaattccatatggatcccctgagtggcgccattacagtgattggacacatggatttcgaagaatcccgtgcgcataagatccccgtggaggcggtggacaaagggtttccgccactggccgggcactgcaccctcctagtggaagtggtcgacgttaatgataacgcccctcaactgacaattaaaaccctttcagtgccggtcaaggaggacgcccagctggggacagtaatcgcacttatcagtgtcattgacctcgatgctgatgccaacggccaggtgacctgcagcttgaccccccacgtgccctttaaattggtctctacctacaagaactactactctctcgtgctggatcgagcccttgatagagagtcggtgtccgcatatgagcttgttgtgaccgcacgagacggtgggtcgcctagcctatgggcgacggcacgggtctctgtcgaggtggccgatgtaaatgacaacgctcctgcctttgctcagagtgagtacaccgtgtttgttaaggaaaataatcccccaggttgccatattttcaccgtgtcagcacgagacgccgatgcccaggagaacgccctagtgagctacagcttggttgaacggcgcttgggcgaacggtccctctcttcttatgtctcagtgcacgctgaatcaggaaaagtgtacgctctgcagcctttggatcacgaagaactggaactattacaatttcaagtgtcagctcgcgacgccggcgtgccaccactgggatccaacgtaacactgcaggtcttcgttctcgatgagaatgataacgcccctgcattgctgactccaagaatgcgggggacagatggagcagtctctgaaatggtgctgagatcggtcggagccggcgttgtggtcggcaaggtaagagcggtcgatgctgactctgggtataacgcctggttaagctacgaattacagcccgagacggcatctgcttccattcctttcagagtgggactctacaccggcgaaattagcaccaccagagccctggacgaaactgatgccccccggcagcgtttgctcgtgctggtcaaagaccacggggaacccgctcttactgcaacagctactgtcctggtctccttagttgaaagcggccaggccccaaagtcctctagtagagcctccgtcggggccacgggccccgaggtgacactagtggacgttaacgtatacctaatcatcgccatatgtgctgtctcaagcttactggtgctgacgttgttactctacacagtcctacgctgcagcgcaatgccaaccgaaggagagtgtgccccgggcaaacccacactggtgtgcagcagtgccgtaggatcatggagttattcacagcagcggagacagcgggtgtgttcaggagaggggaaacagaaaaccgacctcatggcgtttagtccaggcctctcgccctgtgctgggtctaccgaaagaacgggagaaccctccgctagtagcgactccaccggaaaacccagacagccaaacccagattggaggtacagcgccagcctgagagccggcatgcactcttcagtgcacctggaggaagccgggatcctgagagccggtccaggtgggccagaccaacagtggccaactgtatcttcagctactcccgagccagaggccggggaagtttccccgccagtaggagccggcgttaactccaactcttggacatttaagtatggacccggaaatcccaagcagtctggccccggggaactgcccgataaatttatcattcccggctcacccgccataatctctatcagacaggaaccgactaacagccagattgataaaagtgacttcattacgttcggaaagaaggaggaaaccaagaagaagaaaaagaagaagaagggtaataaaacacaggagaagaaagaaaaaggtaacagtactacagataacagtgatcagtag

SEQ ID NO: 201911 - DNA, 2892 bp, Artificial Sequence
  Description of Artificial Sequence: Synthetic coding sequence
atggtgggctgcggcgtggccgtgctgtgcctgtgggtgagctgcggcgccgctgctggccaactggagtactccgtcccggaagaaacagaacgcggagtggcggtgggaaatctgagcgcagacctgaggcttccagctgccgcaatgagctctcggaatttccgattcctctcgtcccatcgtgagctgtattttggggttgatctgccctctggcaaccttgttgttcgcgagccagcagatcgggagcagctgtgcagggctaaggcggcttgtgtgctcacatacgaccttgtcctggaagatccactcgagttgcacaaaatccgtattcatgtgctggataccaatgacaattctccactcttccccgctggcgacgtgcagctgcacatcccggagtttctgacacccggggctagattcacgctccctaatgcccaggacgatgatgaaggatccaacggcatcctcagctatagccttagccctagccagcactttcgtctcgacatgggaagcagagtcgatggctctgaatatcctgaactggtacttgaaaaagccctcgatcgggagcagagggctacacatctactggtgcttaccgctcgcgacggggggcttccggccagatcaggtgacgctcaggtcactatcatcgtcgtggacaccaacgataacgcccccgttttcgaaagatctgtatatcgaactaaggttcctgaaacagcccccaatgggacagtcttgttcagggtgcaggcactggatcccgatgagggatctaacggagaggtgcagtactctttatcgaattctacacaagctgagttgagacatcgtttccatgtccaccccaagagcggggaagtacaggttgcagcctctctcggccccccagagacactcctggaggcctatatcgaggcccgcgacgagggtgtgttcggcctcgcttcaactgcgaagctgctagtagaagtcactgatgtgaacgatcatgcgccagaactggatttcctcacattatcaaaccccgtacccgaggatgccgcacctggtacagtgatagccctcttttcggtgaaagatgaagatcttgatagtaacggcagagtgatctgcgggatgagtagtgcaggcccattccagctgaccgccagctttgataactactactctctccttatcgatggccccttggaccgagaacaaatctctgagtaccaagtgctgattacggccagcgattctggatcgccgccattgagcacaaggagaacaataaccgtttccgtggccgacgtgaacgacaatacccctaactttcctcagccccagcaggagttgtttgtcgctgagaataacggccccggggcctcattaggtagggtctttgcacaggacccagacctggggaaaaatgggctcgtgtcctatgagttgttggatgtcattagcgaggggcctagtgcctcaagcctcttagccgtagagagcagttccggggccataacggctaaaaccagctttgacttcgaacagctccgtggctttcatttccaagtggaagggagagacggcgggatccccccacgatccgccactgtgaccattaacctttttgtggtggacagaaacgacaactatccagttatactctttccattaccacggaatgggagcgtgccagttgagatcgtccctaggagcgccaggaccggtcatttggtgacaaaagtcgtcgcggaagatgctgactctggttccaatgcgtggctctcctatcacatttcgagagcttccgacagctctctatttcggatttccgctaacatcggagagctgcggacagcccgattagtgctacccactgatgccgtcaaacagagagtggtggtggtggtccgtgaccacggcgacccacccctgagttcctccgtgactctgggggtgttgttgagcaattctgtcccccagctgttacctgatttcgaggatgtttgggaaccagggggccagttgtctgcccagaacctatatctggtcatcgctctcgcctgcattagctttctctttcttgggtgcctgctgttttttgtttgtaccaagctgcaccagtcgcccggctgttgcgcgcaatcttgctgtagatccactgaagacctccggtatggctctaagatggtatccaacccttgcatgaccagcgcgactattgacgtaacaaccgttgagcgccttagccagacttatctgtatcgagcctctctcggtcttgggtcagacaataattctctcctcttgagaggtgagtataacgccgcagatctaagaaaccttgcgacgggagtggggctgaacttgcctatctcctgtatccagataaggaatagaaaaggggaccacgccaatgtcaacgcaatgcccaggcagccaaacccagactggagatacagcgcaagcctccgggccggcatgcactctagcgtccacctggaggaagcaggcatccttcgagctggaccggggggccccgaccagcagtggccaacagtatcatctgccacgcccgagccagaagctggcgaggttagtcccccagttggcgcgggcgtgaactccaactcatggaccttcaaatatggtccaggaaaccctaagcagagcgggcccggcgagctgcctgacaagttcattattcccggatctccagctattattagcatcagacaagagcctacaaattcacagatcgataaaagtgacttcatcacattcggtaaaaaggaagaaacaaaaaaaaagaaaaaaaaaaaaaagggcaacaagacacaggagaaaaaagagaagggaaattctaccacggacaatagtgaccagtag

SEQ ID NO: 201912 - DNA, 2457 bp, Artificial Sequence
  Description of Artificial Sequence: Synthetic coding sequence
atggtgggctgcggcgtggccgtgctgtgcctgtgggtgagctgcggggccgccgctggccagctggagtacagcgttcccgaggagactgagaggggcgtggccgtcggcaatctgagcgctgacctgcgtctcccagccgcagcaatgtcatcccgaaatttccgcttcctgtcttcacatcgagagctgtacttcggggttgacctccctagtggcaatctggtggtccgggagcctgctgaccgagagcagttatgtcgagccaaagccgcttgcgttctgacttacgatctggtattggaggacccattggaacttcataaaattagaattcacgtgctagataccaatgataactcacccctttttccagcaggcgatgtgcaactccacatccccgagttcctgactccgggggccagattcacactgcctaacgctcaagacgacgatgaggggtccaatggcatcctgtcatattccctgtccccttcacaacactttagactggacatggggtcacgggtagacggctctgagtaccccgaactggtattggaaaaggcactggatcgggaacagagagcaacccacttactcgtcttgacagcccgagacggaggcttgcctgcccggtcaggcgacgcacaggtaaccatcatcgttgtggatacaaatgacaacgctcccgtcttcgagcggagcgtctaccgtactaaggttccagaaacggcaccaaacggcacagtgctcttccgcgtgcaggctttagaccctgatgagggcagcaatggcgaggtgcagtacagcctctccaactctacccaagccgagctacgccacagatttcatgtccatccaaagagcggcgaggtgcaagtagctgcgtctctgggacctcccgagacactgcttgaggcctatattgaggctcgggacgagggagtttttggactggcttccaccgctaaactcctggtagaggtcaccgatgttaacgaccacgcaccggagctcgacttcttgactcttagcaacccagtccctgaggacgctgcacctggcacagtgatcgctctcttttccgtgaaggacgaggatcttgactctaatgggcgcgtgatatgcggcatgtcgtctgccgggccttttcaacttactgccagcttcgacaactactactctcttttaatcgacggtccattggaccgcgaacagatctccgagtatcaggtgctgattaccgcatccgactctggatcacccccactgtctacccgacgtacgatcacagtttctgttgctgacgtgaatgataacacacctaattttccgcagccacaacaggagctcttcgtagcagaaaataatggtcccggcgcttctctgggccgggtgtttgcccaggacccggacctgggcaaaaatggcctggtgtcctatgagcttctcgatgtaatctcggagggccccagtgcgtcctcactgctcgccgtggagagttccagcggagcgatcacagcaaagaccagtttcgactttgaacagttacgcggattccactttcaggtagagggcagagacgggggaattcccccccgctccgcaaccgttaccattaacctcttcgtcgtggaccggaacgacaattatcccgtgattttatttccactgcctaggaatgggtcggtgcctgtcgagattgtgccgcgatctgcacgcactggacatctggtgacaaaagtagtggccgaagacgcggattcgggctctaacgcctggttaagttatcacatctctagagcttctgactcatctctgtttcgaatcagtgctaatataggggagctgcgaactgcgcgactggtgcttccaacggacgccgtgaaacagcgggtggtggttgtcgttcgtgatcacggcgatccccccttgagttcctccgtgacactgggggtgctgttgagcaattccgtcccacagttgttaccggatttcgaggatgtgtgggagcctggcgggcagctctcagcccagaacttgtacctggtgatcgccctcgcctgtatatcctttcttttcctgggatgcctcctattctttgtgtgtacaaaattacatcaaagccccggttgttgcgcgcaatcatgctgtcgctcaaccgaagatcttcgctatggatccaaaatggtgtcaaatccttgtatgacaagcgccaccatagacgtgactaccgtagagcgactcagtcagacatacctgtacagagcctccctgggattgggttcagataataacagcttgttgcttcgcggtgaatataatgctgccgacctgaggaatcttgccacgggcgttgggcttaacttgcctatttcatgcatccagattaggaatagaaagggggaccacgcaaacgtgaacgccatggtgtctaaattctatggtatatag

SEQ ID NO: 201913 - DNA, 3024 bp, Artificial Sequence
  Description of Artificial Sequence: Synthetic coding sequence
atggagcaggccggcacccggcccgccgccaccgagcacccccggctgaggcggcccatgccctggttgctactcctgcctctacttctgctgctgcttcttctgctccccggccccgccgcctcccaacttcgatatagcgtacccgaggaacaggctccgggtgccttggtgggcaatgttgcacgggctttagggctcgaactgcgccgactcggtcctggatgcttgcgaattaatcacttaggtgctccgagcccacgctatctcgagctggacctcactagcggggcattgttcgtaaatgagaggatcgatagggaggctctgtgcgagcaacgcccacgttgcctcctctcactggaggtgctggcccataaccctgtggctgtgagcgctgttgaagttgagatacttgatatcaatgacaattctcctcggttccccagaccaaattaccagctccaagttagcgaatctgttgcccctggggctaggttccatatagaatctgcccaggaccctgatgtcggcgccaattcagttcagacttatgaattgtccccctctgagcattttgagctggatcttaagccattgcaggaaaactccaaggttcttgaactggttctgcgtaagggcctggaccgggaacaggctgccctacatcatctggtgcttaccgctgtggatggcggtatccctgcacgatcaggcacagcccagatcagcgtgagagtcctggataccaacgataacagtcccgcatttgaccagtccacataccgtgtgcagctccgcgaggattccccgcccggaaccctggtggttaagctaaatgcaagtgatcctgacgaaggtagcaacggcgaactgcggtacagtctgtcttcatacaccagcgatcgggagcgccagctctttagcatagatgcctcaactggagaagtgagggtgattggtggcctggattatgaagaggcttcgtcgtaccaaatttacgtgcaagccactgaccgaggaccagttcctatggccggtcactgcaaggtcctggtcgacattgttgatgtcaatgacaatgcccccgaggtcgtgttgactgacctctactctccagtgccagaaaacgctacccctaacaccattgtggcagtgctgtctgtgaacgaccaggatagcggccctaaccggaaagtgtcgttaggcctagaagccacacttccgttcagactcaacggattcggcaactcttacaccttggtagtctctgggccactggatcgggaacgggtcgccgtctacaacatcaccgttacagccaccgatggcggaatcccccagctgacaagtctgaggacactgaaggtcgaaatttccgatattaatgacaacccgccatcctttctggaggactcatacagtatctacattcaagagaacaacctcccgggtgtgttgctgtgcacagtacaggctacagatcccgatgagaaagaaaatgcggaggtgacttactctcttctggaacgtgagattcagggcctgccagtcaccagctacgtcagcatcaattccgcctccgggtcactttacgcagtgaattcgtttgattacgagaagtttcgggaattcttcgtgactgtggaagcccaggataagggctcacctcccttgtcctctaccgttaccgctaacgtgtacgtggtggatatgaatgatcacgctccacatattctgtacccaacatcaacgaattcaagcgccgcctttgagatggtgcctcgcaccgcacccgccgggtatctcgtgaccaaggtcatcgctatggacagtgactccggccagaacgcatggctgttttatcaccttgcccagaccagtgatttagacctgtttaaggtggagttgcacacgggagagattaggactacgcgtaagatgggcgatgaaagcgggtctacctttaatctgaccgtggtggtgcgggacaacggagaacccagcctctccgcctcagtggcaatcaccgtagcagtagtggaccgcgtgtccaaaattctgccggacactcagagacatgtcaagagcccccggacctatagcgagatcactctctacctgatcatcgccttgtccacggtttcatttatcttcctattgaccataattatcttaagcattatcaagtgctaccgctacactgcctacggaaccgcctgttgtggcggcttctgtggtgtccgggaacgaagccccgccgagctgtacaagcaggccaataacaacatcgatgcccgaattccgcacggattaaaggtgcaaccccatttcattgaggtgagaggaaacggaagcctgacaaagacgtactgttacaaagcatgtctcaccgccggttccggttcagacacatttatgttttataatacaggcgcacagacagggccaggcccaagcggggcccaggccgcagtgaccgacagtcggaatttgaccggacaatctggccaaaacgcgggaaacctgataattcttaaaaatgaagccgtgtcgcagaatgaacctcgccagccaaatccagactggaggtactccgcaagcctgcgcgccggaatgcacagctcagtgcacctggaagaggcggggattctcagagccggccccggtggacctgaccaacaatggccaacagtgagctccgcgactccggagccagaagctggagaggtctccccgccagtcggcgctggggtgaattccaacagctggactttcaagtatgggcctggaaacccgaagcagtccggacccggagagttacccgataaatttataatccccggatccccagcgattatcagtatcagacaggagcccaccaacagccagatagataagtctgactttattactttcggaaaaaaagaagagaccaagaagaaaaaaaagaaaaagaaaggtaataaaactcaggaaaaaaaggagaagggaaactcaacgactgacaattccgaccagtag

SEQ ID NO: 201914 - DNA, 2457 bp, Artificial Sequence
  Description of Artificial Sequence: Synthetic coding sequence
atggccggcacccggcggaagagcctgcagaaccggcaggtgggctcccttctaatcttcctttgcattagtgttggcgacgctacaactatccggtattcggtcgccgaagagatggaaagtgggtcctttgtagccaacgtggcaaaggatctgggactggaggtggggaagctggcggcgcgcggggcacgcctcgtgagcgagggtaataaaatgcacttcagactgcacagaaagacaggcgacttgtttgtgaaagagaagttggatcgggaatccctgtgcggcaaagccgacccttgcgtgctgcactttgaggtggtcctagtggagcccctccagagttttagagccgaggttcgcgtgttcgatattaatgataatgcgcccgtgttcctgaacaaggagccactgctgaaaatcccagaaagcactccactgggcagtaggtttccgctgcagagtgcccaggacctggacgtagggctgaacgggctgcagaattacacacttagtgctaacggctatttccacctgcatacacggttctgcagtcatggccccaaatatgccgaactggtgctgaataagcctctcgatcgcgaggagcaaccagaagttaatctaacaataacagccgtcgacggagggagtccaccaaaatccgggactgcacatatccacgtggtcgtgctggacgttaacgaccacgtgccccaattcagccgcctggtgtatagagcccaagtctccgagaactcacctaacgggagtctggttgccactgtcacggcagttgacctggacgaagggacaaacaaagcaatcacctattcgctggcccagaacccggaggcgattctgaaaacgtttcagatcgacccccaaaatggggaagtgcgcctccgcggccccctcgacttcgaagcaattgagacctacgatatcgatatacaagccacagacggaggaggtctcagcgcgcactctaaggtgctggttgaagtcgtcgacgtcaatgataacccccctgaagtcatggtatcatctgttagctcccccctgcctgaagactccccacctcaaaccgttgtcgcactgttcaccatcagagaccgcgacatccgtgtcgggggcaaggtgacctgttttctcagggaggaccttccatttgtgatcaaacctactttcggtaatagttactctctggtgaccgacagaagtctggaccgcgaggaggtgtcaggctataacatcacaatcgtggccatggacactgggccaccctcgctgagtgcagagactatgattgaagtgctgatttctgacgttaatgataatccaccaatctttagagaggattcttatatcctgacggtgagggagaacaactcacctgccgtgtttatcggaaaggtgcatgcggaagatctggatttaggcgaaaacgctcagattacttacagtctgctgccacccaaaaatggcgacttatccgtgtttgcctacatcagcatcaattcgggtaacggcaaactgtacgcactcagaactatggactatgaggccatccaggatttccagttcgtggtcaaggcaactgatggaggctttctcagtctgtcttctcaagtgacagtgcgcgtagtggttctggatgacaacgataatcggcccatgattctgtaccctctgcagaacggcacactcccctgtaacgacctggtaccacggtcagccgaggctggctatctggtcaccaaggtggtggctgtggatggcgatagcggtcaaaatagttggctctcatatcacctgctgaaagctacggatctgggtctcttctcagtgcagagacagaacggggagattcatacccttcggcagatctctgaaagggacccgatgatgcagaagctgatcatcctcgtccaggatcatggccagcccgctctctccaccacagtgagcctcaacattctcctagtggacggcttttcagaaccctatctgcagttccaagatcccactaagcactcacgaaaagtgaacccctctaccaagtacttagtgatttcattagtgattctctcattccttttccttctttccgtgatcgtgatctttatcattcatgtgtaccagaaaattaagtatagggagaagtttacaattcaggagcatttctacgatgactgtaacttcagtaacaacctggtgcagggtcaaggcaatggctccctgtctagaccatgtccctacgaaatgtgcagcgccaccggaacaggaaacagcgaattcagatttctgaagcgctttatgcccaacttcccctttccccacgcaaccggcgagattaagatggaagcaggatcctcgctccctccaaactctgaccggaacaagtcccaaaggctcgaagggcacgaccaagtgtctgacgattacatgtag

SEQ ID NO: 201915 - DNA, 2394 bp, Artificial Sequence
  Description of Artificial Sequence: Synthetic coding sequence
atggagaaccagggcacccggacccagcagatccggcaggtgctgctgctgttcgtgctgcttgggatgtcccaagccgggagcgagacctggtctttttctgtagccgaggaaatgcagtcaggctcatttgtgggaaatttggcaaaggatctcggtctcaaggttcgggaattgagctcccgcggcgctcgggtagttagcaacgataaaaaacagagattgcaattggatatcaatactggtgacttacttctgtctgagacgctggatcgggaggaactttgtggaagtatagaaccctgcgtgctgcacttgcaggtcctgatgcagaatccgacacaatttcttcaaatcgagttacaagtgagagatatcaacgaccacagtcctattttcagcgaaaagcagatgcttttagagatccccgagaacagcccggtcggagctgtgttcctgctggagagcgcgaaagacttagatgtcggtatcaatgccgtgaagagctacacgattagtcctaactcccacttccacataaagatgcgcgttattccagataatcgaaaataccccgagctggtgcttgacaaggccctggattatgaggagctccctgaactgtccttcatcctgagcgctctggatggcgggtcacccccccgttctggaactgctctggtgagggttgtggttgtagatataaacgataattcccccgaatttgagcaagcgttctatgaggtaaaaatccgggagaattcaattctcgggagccttattctaatagtgagcgcctgggatctcgactctggcacaaacggggaaatttgctatactttctcccacgcctcagaagacattcgaaaaaccttcgaaattaatcagaaatctggagaaattacacttcgagcccccttggactttgaaacaattgagtcctattctataatcattcaggctaccgacggcggcgggctgttcggtaagtccacagtcattattcacgttatagatgttaacgataatgcccccgagatcacagtgtcttctataactagtccaatacctgagaacacacccgaaaccgtagttatggtattcagcatccaggacattgacagtggagacaacgggcggatcgtgtgttctatcccagaagacctgccgttcgtgcttaagagttccgtggagaactattacacactggagactgagagacccctggacagggaatcaacggctgaatacaacataactattaccgtaaccgatctcggaattcctcgactaaaaactgagcacaatactaccgttttagtcagcgacgttaacgataatgcccctactttcacccaaacatcttatacactgtttgtgcgcgagaataactcccctgccctgcacattggaagtgtgagtgccactgaccgcgactcaggcactaacgcacaagttaactattccctgctgcccccccaggatctgcatttgcccctcgcctccctagtttccataaacaccgataacggacatttattcgccctgaggtcccttgattacgaggccctacaggcttttgattttagagtgggagctacagacagggggagccccgctctgtcctccgaagcacttgtaagagtcttagtgcttgatgcaaatgataattcgccatttgtattgtacccgctccagaacggatccgcaccatgcacggaactggtcccgagagcagcagagcccggatatctggtaacgaaggtggtggctgtagatggtgacagtgggcagaacgcctggctgagctaccaactgcttaaggcaacagaaccaggactctttggagtgtgggctcacaacggtgaagtgcgtaccgctcgcctcctcagtgagagggatgctgccaaacacagactggtggtgttagtcaaagataacggcgaaccaccacgctcagccaccgcaaccctgcaggttctccttgttgatgggtttagccagccttatctgccactgccggaagccgctccagcccaggcccaggccgatagcctaaccgtgtacttggtcgtcgcactagccagtgtgtccagtctgttcctcttcagcgtgctactcttcgtggcagtccgattgtgtcgaaggagcagggccgcctcagtgggctcttgttctgtcccaaaaggcccatttcctggccatctggtggatgtgtccggcactggaactttgtcccagagttaccagtatgaggtttgtcttacgggcgggtccgagacaaatgaattcaagtttttaaaaccagtgattccaaatatccaagccaagggtctagggaagaactcggaggaaaatagcacttttcgtaacagcttcgggttcaacttctag

SEQ ID NO: 201916 - DNA, 1299 bp, Artificial Sequence
  Description of Artificial Sequence: Synthetic coding sequence
atggtgttcagcatccaggacatcgacagcggcgacaacggccggatcgtttgcagcatccccgaagacctgccttttgtgctcaagagtagcgttgagaattattatactctcgagactgagcgccctctcgaccgtgagtcgaccgccgaatacaatatcacgataacggtgacagacttgggcatcccaagactgaaaactgaacacaatacgaccgtgctggtgagcgacgtcaatgacaatgccccgacattcacacagaccagctacaccttgttcgtgagagaaaacaatagccctgccctgcacattggttcggtttccgcgaccgatcgcgacagtggcactaatgcacaggttaactatagtctcttgcctccacaggatttacacctgccgctcgcctctttggtaagtattaacaccgacaatggacacctctttgctctgaggagcctagactacgaggccttgcaggcatttgacttccgtgttggtgccacggataggggcagccccgcactcagctccgaggctctcgtacgcgtgctggtgctcgacgcaaacgacaactcgccttttgtactctaccctctgcaaaacgggtcagctccttgcactgaactcgtcccccgagccgccgagccaggatacttggtgacaaaagtagtagcagtggacggcgattctgggcaaaatgcctggctctcctaccagttgctgaaggccaccgagcccggactctttggtgtatgggctcacaacggcgaggtgagaactgctaggttgctgtcagagcgcgacgcagcgaagcaccggctcgtggtgttggtgaaggacaatggagagcccccgcgcagcgctactgcaacacttcaagtactcttggtcgatggattcagtcagccatacctgcccttgccagaggcggccccagcacaggcccaggcggactcactcactgtttatctcgttgtagcgctagctagcgtgagtagcctattcctcttttctgtgctgttgttcgtggctgtgagattgtgtaggaggagccgcgctgcgtctgtcggtagctgctccgtgccgaagggccccttccccggccacctggtcgacgtaagcggaactggcacgctctcccagagctatcagtatgaggtgtgccttactggcggaagcgaaacgaatgaatttaagtttttaaaacctgtgattccaaatatccaggccaaggggctcggaaagaatagcgaggaaaatagtaccttcagaaacagcttcggttttaacttttag

SEQ ID NO: 201917 - DNA, 399 bp, Artificial Sequence
  Description of Artificial Sequence: Synthetic coding sequence
accatcgagagctacagcatcatcatccaggccaccgacggcggcggcctgttcggaaagagcacagttataattcatgtcatcgatgtcaatgataatgcccctgagatcacagttagtagcataacaagtccaatccccgaaaacacgcctgaaactgtcgtcatggtttttagcatccaagacatcgatggtactaccgaagaactgttcgtgccattccgcaagacgagtcacgttctcaaaagtagtgtggaaaactattataccttggagactgaaagacccctagacagagagagtactgccgagtacaacatcactatcacagtgaccgatctgggcatcccacgactcaaaactgagcataacaccacggtgctcgtctcagacgtgtag

SEQ ID NO: 201918 - DNA, 2388 bp, Artificial Sequence
  Description of Artificial Sequence: Synthetic coding sequence
atggagaacggcggcgccggcaccctgcagatccggcaggtgctgctgttcttcgtcctcctgggcatgtcccaagctggctctgaaactgggaacttcctggtgatggaggaattgcagtcaggtagttttgtgggcaacctcgcaaaaactctcggattggaagtctccgaactcagttcgcgaggggcaagggtggtgtcaaacgacaataaggagtgccttcagcttgacaccaacacgggcgatttgctgctccgggaaatgttagatcgagaggagctgtgtggttcaaatgagccttgtgtgctctactttcaagtactgatgaaaaacccaacacagttcctccagatagagttgcaggtcagggatatcaacgaccacagtcctgtgttcctggagaaagaaatgctgttggaaatccccgaaaactcccctgtcggcgctgttttcctgttagaatccgctaaagatctagacgtggggattaacgccgtaaagtcgtacaccataaatcctaattcacattttcacgtgaaaatccgggtcaaccctgataacagaaaataccccgaactggtgcttgataaggccctcgattatgaagagagacccgaactgagctttattctgaccgcccttgacggcggtagtccccctcgtagcggcactgcattagtgagggtcgtggtcgttgatattaacgacaacagtcctgagtttgagcaggccttttacgaggtaaagattctggagaacagcatcctcggcagcctcgtcgtgaccgtatcggcctgggatctggactccggcacaaactctgagttatcttatacgttcagtcacgcctccgaggatatccgcaagacctttgaaatcaaccaaaagagcggcgacataaccctgaccgcaccgctggattttgaggccatcgaatcttactccatcatcattcaggctacggatggcggggggctgtttggtaagtcgacagtgaggatacaggtcatggatgttaatgacaatgcgccggaaatcacagtatccagtataactagccctatccctgaaaacacacctgagacagtggtcatggtgttcaggatccgagaccgggacagcggggacaacggtaaaatggtatgcagtatccctgaggatattccatttgttctcaaaagttccgtgaataactactacaccctagaaactgaaaggcctctagaccgggagtcacgggccgaatataacataaccatcacagtgactgatttgggaactcctagactgaagacagaacacaacatcaccgtgctggtgagcgatgtgaatgacaacgcccccgcgttcactcagacgagttacgccctgttcgtcagggagaataattctcccgcactgcacattggcagcatcagtgccacagacagagattccggcactaacgcacaggtcaattacagtcttctcccttcacaggacccacatctccccttagcatctctcgtgagcatcaatgcagacaatggccatctgtttgcgctgaggtccctggattacgaagcactgcagggattccaatttagggtgggtgccaccgatcacggcagccctgctctgtccagcgaagccctcgtgagagtcttggtgcttgatgctaacgataattcgcctttcgttttgtatccactgcaaaatggttccgctccctgcactgagctggttccatgggctgccgaaccaggatatctggtgacgaaagtggtcgccgtcgacggggacagcggccaaaacgcatggttgtcatatcagctgctcaaagccactgaaccgggtctgtttggcgtatgggctcacaacggcgaggttaggaccgctcgcctgttgagcgaacgagatgctgccaaacacaggctggtggttttggtcaaagataatggagagcccccccggtctgcgaccgctacattgcatgttctgctcgtggacggtttttctcagccttacctgcctcttcccgaagctgcccccgcacaggcccaggcagacagcctgactgtatatctggtcgtggccctagcctcggtctctagcctatttctcttctccgttctgttgttcgtggccgtgaggttatgtagaaggtcgagggcagcaccagtgggtagatgttctgtgcctgagggtccattcccgggccatctggtggacgtgtctggcactgggaccttgagtcaatcataccattacgaggtgtgtgtcacaggtgggagtcgcagcaacaaattcaaatttcttaagccaatcattcccaacttcctgcctcaaagtacgggctctgaagtcgaggaaaaccccccgttccagaataacctcggattctag

SEQ ID NO: 201919 - DNA, 1257 bp, Artificial Sequence
  Description of Artificial Sequence: Synthetic coding sequence
atggtgtgcagcatccccgaggacatccccttcgtgctgaagagctcagtgaacaattactacaccctcgagactgaaaggccgttggaccgcgaatctagagcggaatacaatattaccatcactgtcaccgacctgggtacgccacgacttaaaaccgagcataatataaccgttctggtgtcggacgtgaatgataatgcgccagccttcactcagacctcttatgccttattcgtccgcgaaaataactccccagccctccatattggcagtattagcgccacagacagggattcaggaactaatgctcaggtgaactacagcctcctgccttcccaggatccacatctacccctggcatccctcgtaagtatcaacgctgataatgggcatctgtttgctttgagaagtctggactacgaggcactccagggttttcaatttcgcgtgggcgccacagatcatggatctcctgcgctgtcgtcggaagcgttggtgcgcgtgctggtgcttgacgctaatgataattcccctttcgttctttatcccctgcaaaacgggagcgctccttgtaccgagctggtgccttgggcagctgagcctggatatctggtaaccaaggttgtggccgtggacggggattctggtcaaaatgcctggttgagctaccagctactgaaggccacagaacccggactattcggggtgtgggcccacaacggcgaggtgcgtaccgccagactcctaagcgagagggacgctgctaagcataggcttgtggtgcttgttaaagacaacggcgagccccctaggtctgccaccgccactctgcacgtcctgcttgtcgacggattcagtcaaccctacttgcccctgcctgaagctgcaccagcccaagcacaagcagattcgctgacggtttacctggtagtggcactcgcctccgtgagcagtttgtttctgttttccgtactcctttttgtcgctgtacgcctatgtcgacggtctcgggctgccccagtgggtcggtgctctgttcctgagggaccctttccaggccatctggtagatgtgtcaggtaccggaacgttaagtcagtcttatcactatgaagtgtgtgtgactggaggatcccggagcaacaaattcaaattcctcaagcctattatccctaacttcctcccccagagcaccggtagtgaggtcgaagagaatcctccttttcagaataacctcgggttttggatccagtag

SEQ ID NO: 201920 - DNA, 1377 bp, Artificial Sequence
  Description of Artificial Sequence: Synthetic coding sequence
atggacgtgaacgacaacgcccccgagatcaccgtgagcagcatcaccagcccaatacccgagaacacacccgagactgtggtgatggtcttccgtataagggacagggactccggcgacaacggaaagatggtgtgcagtatccctgaagacatcccgttcgtgctcaagagcagcgtaaataattactacacactggagactgagcggcctctggatagggaaagcagagcagaatacaacatcaccatcacggtgacagacctgggaactccccggttgaagaccgagcataacatcactgtgctcgtgtctgatgtcaatgacaacgcacctgcgtttacccagacatcgtacgcattattcgtgcgggagaacaatagccccgcacttcatatcggctccatctccgctactgaccgcgattcagggacaaacgcccaggtgaattactctcttttgccgtctcaggaccctcatctgccactcgccagtcttgtgtcaattaatgcagataatggccacctgtttgctctgcggtccctggattatgaggccctgcagggcttccagttcagagtcggggcgacagatcacggctcccctgctctcagctccgaagcactcgtgcgtgtcctggtgcttgatgctaacgacaactctcctttcgtattgtacccgctgcaaaatggctccgcgccctgcaccgaactggtaccctgggccgcagagcctggatatttagttacgaaggtggtggccgttgacggagactccgggcagaatgcatggcttagctatcagctgctgaaggctacggagccagggctgttcggagtctgggcccacaacggtgaggtcaggaccgctcgcttgctatccgaaagagatgccgccaagcatcgactagtggtgctggtgaaagacaacggggaaccaccccggagtgcgacagctacactgcatgttctgctggtagacggtttttctcaaccctacctacctctgcccgaagccgccccagcgcaggctcaggctgacagcctgacagtctatctcgttgtcgcgttggcttcagtgtcatcactcttcctgttctctgtgttgctctttgtggccgtccggctatgtcggcgcagcagggctgcacctgtagggcgatgttctgtccctgaggggccctttccgggccacctggtcgatgtcagtggaaccggaacactctcacagtcctaccactatgaagtctgtgtgaccggcggttcccgctctaacaagtttaagtttctgaagcccatcatccctaactttctcccccagagcacaggaagcgaagtcgaagaaaacccaccttttcagaataatctcggcttctag

SEQ ID NO: 201921 - DNA, 2397 bp, Artificial Sequence
  Description of Artificial Sequence: Synthetic coding sequence
atggaggccagcggcaagctgatctgccggcagcggcaggtgctgttctcattcctcctcctgggtttgtccctggcaggggcagcagaaccaagatcatacagcgtagtggaggagactgagggaagctctttcgttacaaatttagccaaagacctgggacttgagcagcgagaattttcccggagaggcgttagggttgttagcaggggtaataagttacatttacaactgaatcaggaaaccgctgacttgctcctgaatgagaagctggacagggaagatctgtgtgggcatactgagccgtgtgtgcttcgttttcaagtgttacttgagagtccttttgagttcttccaagccgaacttcaggtcatcgatattaatgaccactccccggtttttttggataaacagatgctcgttaaggtgagtgaatctagcccaccaggtacgactttcccacttaagaacgccgaggacttagacgtgggccagaataatatcgagaattatatcatcagtccaaacagctacttcagagtccttacacgaaaaagaagtgacggcaggaagtatcccgaacttgtgctcgataaggcactggaccgggaggaggaagccgaactccggttgactctgacagcccttgatggcggatcaccaccacgctctggaaccgctcaggtatatatcgaggttttggatgtgaatgataatgcgccagagttcgagcagcctttttatcgcgtgcaaattagcgaggattcccccgtcggcttcctggtggtgaaagtcagcgccacggatgtggacaccggagtgaatggcgagattagctacagcttgtttcaggctagtgaagagatcggaaaaacctttaaaatcaacccactcaccggagagatagagttgaaaaagcaactcgattttgaaaaactccagagttatgaggtgaatatcgaagccagagatgccggtacattctcaggaaagtgtactgtgctcatacaagtgattgacgtgaatgatcacgcccccgaggtcactatgagcgccttcacctccccgatacctgaaaatgctcccgaaaccgtggtagctctgttttctgtgagtgacctcgacagcggcgaaaacggtaaaatttcttgcagcattcaggaagatctcccttttctgctaaagtcagccgaaaacttctatactctacttactgaacgaccattagatcgagagtctcgcgccgaatacaacataacgatcacagtcaccgacttggggactcctatgctcatcactcagctcaacatgaccgtgctgatcgcggatgtgaacgacaatgccccggcctttacccaaacttcttatactctgttcgtcagagaaaataatagtccagcccttcatatacgctctgtctccgccacagaccgcgatagcggtacgaatgcccaggtgacctattccttgctccccccccaggatccccaccttccgctgacatccctggtctccatcaatgctgataacgggcatctgtttgcactacgctctttagattacgaagcactgcagggcttccaattcagggtgggcgcttcagatcacggaagcccagccctttccagtgaagctctggtgagggtcgttgtgctcgatgctaacgataactcaccatttgtcctgtatcccctgcagaatgggagcgctccttgcacagagctggttccaagagctgccgaaccagggtatctcgtgactaaagtcgtggccgttgacggcgatagtggtcagaatgcctggctgtcttatcagctcctgaaagcgacagagctcggactgtttggcgtctgggcccacaatggcgaagtaaggacagcacggctgttatccgagcgtgacgcagccaagcatcgcctggtcgtactggtaaaggacaatggggagcctccacgaagcgctaccgccacactgcatgtcctgctggtggatggctttagtcagccctatctccctttacctgaagccgctcctactcaagcccaggctgacctcctgaccgtgtatctcgtggtcgcactggcttcagtgtcatcactctttctgttctctgttctcttattcgtcgccgtgcggctgtgtagaagaagtcgtgcggcgagcgtgggacggtgcctggtgccagagggacctctaccgggccacctcgtagacatgtccggaacccgtacactctcacagtcttatcaatacgaggtgtgcctggccggggggagtggtacaaatgaatttaaattcctgaaacctatcataccaaacttccccccacagtgtccaggtaaggaaattcagggcaattcgactttccccaacaacttcggctttaacatacagtag

SEQ ID NO: 201922 - DNA, 2235 bp, Artificial Sequence
  Description of Artificial Sequence: Synthetic coding sequence
atggaggccagcggcaagctgatctgccggcagcggcaggtgctgttctcttttctgctcctaggactgtctttagcaggtgccgccgagcctagaagctattccgtggtggaggagacagaagggtcctcctttgtgaccaatttagccaaggatttgggattagagcagagagagttttcccggcgaggagtccgggtcgtgagccggggcaacaagctgcatttacagttaaatcaagagacagccgaccttctgctgaatgagaagctggatagagaggatttatgcggacatacagagccttgtgttcttagattccaggtgctcctagagtctcccttcgaatttttccaagctgaactccaggtaatcgatattaacgatcactccccagtattccttgataagcagatgctcgttaaggtctccgaaagtagtcccccggggaccacattcccgctgaaaaacgccgaggacctggatgtgggtcaaaataacattgaaaactatatcattagtccaaattcctactttagggtgctgacgcgtaagagatctgacgggcggaaatatccggaacttgtactggacaaagccttggaccgcgaggaggaggcggagctaagactgacgctcaccgctctggacggggggtctcccccgcgctcagggacggctcaagtttatatagaggttctggatgttaacgacaacgctccagaattcgagcagcctttttaccgcgtccagatttctgaagatagccccgtggggttcctcgtcgtcaaggtgtcagctaccgacgtggacacaggggtaaatggggagatctcttacagcctcttccaggcaagtgaggaaatcggaaagacctttaagatcaatccactgacaggcgagatcgaattaaaaaagcagctcgactttgagaagttgcagtcatatgaggttaatatagaggcaagggatgccggtaccttttcaggcaaatgcacagtcctgatccaagtgattgatgtgaacgaccacgccccagaagtgaccatgtctgcattcactagtccgataccggagaatgcccccgagacagtggtggcactgttctctgtatccgacctcgattcaggtgagaatggcaagatatcttgcagtatacaggaggatctaccattcttgttaaagagtgctgagaacttttatacactgctgaccgaacgtcctctcgacagagaatcgagggccgagtataatatcactattaccgtgaccgatttgggaacccctatgctgatcacccagcttaatatgacagtgttgattgctgacgtgaatgacaatgcccctgctttcacccaaacaagctatactctgtttgtgcgcgagaacaatagcccagccctccacatccgcagtgtaagtgctaccgatcgtgatagcggcacaaatgctcaagtcacatactcactcttgcccccgagagtggtggtgcttgacgcaaatgacaatagcccgttcgtgctgtacccactccagaatggttccgccccttgtacagaactcgtcccgagggccgccgaacccggctacctggtcaccaaggtggtggccgtcgacggtgattctggccagaacgcctggctctcgtatcagctgctcaaggcaacagaactggggttgtttggtgtgtgggcccacaacggcgaggttagaaccgcacggttactctccgagagggatgcggccaaacataggttggtggtgcttgtgaaggataatggtgaaccacctcgctcagctaccgcaacactccacgttttgctggtcgatggcttctcacaaccttacctgccattgccagaggccgcaccaacacaggcccaagcagacttactcacagtgtatcttgtcgtcgccctagcatctgtctcgtccttattcttattcagcgtgctgttgtttgtggcggtcagactgtgccggaggtcccgcgcagctagtgtgggtcgctgcttagtccccgaaggacctctgcccggccatctggtggacatgtctggtacccgtacattatcccagtcctaccagtacgaagtgtgtctcgcaggcgggtccggaactaacgagtttaagtttctcaagcctatcattcccaacttcccaccgcagtgccctggaaaggaaatccagggaaactctacattccctaataatttcggttttaacattcagtag

SEQ ID NO: 201923 - DNA, 2409 bp, Artificial Sequence
  Description of Artificial Sequence: Synthetic coding sequence
atggaggccagcggcaagctgatctgccggcagcggcaggtgctgttctcattccttctgctaggcttgtctctggctggggctgcggaaccaagaagctactccgtcgtagaagaaactgagggctcctcatttgtgacgaacctcgcaaaagatctgggactagagcagagggagttttcccgccggggcgtgcgtgtggtgtctaggggaaacaagttgcatttacagttgaaccaggagactgccgatcttctgctgaatgagaagctggacagggaagacttgtgcggacacacggaaccttgtgtgctgcgctttcaggtgctgctggaatccccgttcgaatttttccaagccgagcttcaggtgatagacattaatgatcattctcctgtgttcttggacaagcagatgttagtgaaagtgagtgaaagctccccaccaggcaccactttcccactgaagaacgcggaggacctggacgtcggccagaacaacattgagaactatattatttcccctaattcttattttagagtgctaaccaggaagagatccgatggacggaaataccccgaactggttctggataaggccctcgaccgagaagaggaggctgagctgcgcctcactctgactgctctcgatggaggatcccctcctcgatctggcacagctcaggtgtatattgaagtgctcgatgttaatgacaacgcccccgaattcgaacagccattttatagagtccagatcagcgaagatagtccagtgggctttcttgtggtgaaagttagcgccactgatgtggataccggagtgaacggagaaattagctacagtctcttccaggcttcagaggaaattggtaagacattcaagattaaccctcttactggcgagatcgagctcaagaagcagctggatttcgagaagttacagtcttacgaagttaatattgaagccagggatgcaggcacatttagcggtaagtgtacggtgctgattcaggttatcgatgtgaacgatcacgccccggaggttaccatgagcgcatttaccagccccatccctgaaaatgcccccgagactgtggtcgcactcttctcagtcagcgacctcgactccggggagaacggtaagatttcctgtagcatccaagaagacctgccttttctgctgaagagcgctgaaaatttttatactctcctcacagaaaggcccttggacagggaatctcgggccgaatataacataactatcaccgtcactgacctcggtacacccatgcttatcactcagctcaatatgacagtcctgatcgccgacgtgaatgataacgctccggcgttcacacagacatcatacacactctttgtgcgcgagaataacagcccggccttacacataaggtcagtcagtgcaacagacagagactcgggaacgaacgcacaagtgacatactctcttcttcccccgcaggacccgcatctgcctttgacctctctggtgtcaatcaatgccgacaacggccatctgtttgctctgcgcagcttagactacgaggcgctgcaagggttccaattccgtgtgggagcttctgatcatggaagtcccgcattgtcgagcgaagcgctggtcagagtcgtggtcctggacgcaaacgataactcacctttcgtgctgtacccgctgcaaaatggatcagctccatgtaccgaactggtgccccgggccgcggaacctgggtaccttgtgaccaaggtggtcgccgtggatggagattctggccagaatgcctggttatcctaccagctgctcaaggccaccgagcttggactttttggcgtttgggcccacaacggagaggtcaggactgccagactgctcagcgagcgcgacgcggccaagcatagattggttgtattagtgaaggacaacggcgaacctccaaggagcgccactgcgacactgcatgtactgctggtcgacgggttctctcagccctatcttcctcttcctgaagcagctcctacccaagctcaggcagacctgctgaccgtgtatctagtggtagccctagcctcagtctcttctctattcttattttcggttctcctatttgtggctgtgagactttgtcggcggagccgtgccgcttccgtaggccgatgtctcgtaccagaggggccacttccgggacacctcgtggatatgagtggtacacgtaccctgtcccaaagttatcaatatgaggtgtgcctcgctgggggcagcgggacaaatgaatttaaattcctgaagcctatcattccgaacttcccaccacagtgcccaggtaaggagatccagggcaacagtaccttccccaatttatgtgtgtgtaatatcgtaagaatttatagctag

SEQ ID NO: 201924 - DNA, 2397 bp, Artificial Sequence
  Description of Artificial Sequence: Synthetic coding sequence
atggagatccggggcgccctggacctgcggaagcggcaggtgctgatcttcctagtgctcctgggcttgtcacgcgccggcaccgagtcagcccactactccgtggctgaggaaacagaaattgggtctttcgtggccaatcttgcccgggacctcgggttgggagtggaggagctgtcttctagggaggcccgggtggtgtctgacgacaataagaagtatctgcacttggacctccttaccggcaacttgctgctgaacgaaaaattggatcgagatgagctttgcggatcgaccgagccatgcgttctacactttcaggttgtgctagagaaccccctgcagttctttaggtttgaactctgcgtgaaagacatcaacgatcatagccccaccttcctggataaagaaatcctgataaaaatctcagagggtaccactgttggcgccacttttctaatggaaagcgctcaggacttggatgtcggttccaatagtctccagaattacacaatctcacctaattcccatttttacattaagatacccgatagttccgatcgtaagatatacccagaattggtgctagatagggccttggattacgagcaggaggcggaactgcgtttgactcttacggcggtggacggaggctcaccgcccaagagcggcaccactctcgtcctgatcaaagtgctcgacattaatgacaacgcccccgagttcccacagagcctctacgaagtgcaggtccccgaagataggccactcggatcatggatcgcaacgataagtgccaaggacctggatgctgggaattatggcaagatctcatacaccttttttcatgccagcgaggatatccggaaaactttcgagataaaccccatctcaggggaagttaatttgcggagtccactggatttcgaagtgattcaaagttacactataaatatccaggccacggatgggggggggctgtccggcaaatgtaccttactggtgaaggtgatggacataaatgacaacccgcccgaggtgaccataagtagcattactaaaaggattcctgagaacgcctccgagaccctagtggctctcttctcaattctcgaccaggatagcggggataatggtcgcatgatttgttccatccaggacaacttaccattttttttgaagccgaccttcaaaaacttttttacgctcgttagcgaaaaggctttggatcgagagtcccaagccgagtacaatatcactatcaccgtgaccgatctgggtacccctagattgaagacagagtacaatattacagtcctcctttctgacgttaatgacaatgctccaacattcacacagacaagctatacactctttgtgagggaaaacaatagcccggctcttcatatcggtagcgttagcgctacagatcgcgattcagggactaacgcccaggtgaactatagccttcttccgccacaggatcggcacctccctttagcctcccttgtctccattaacgccgataacggacatcttttcgcacttagaagcctggattatgaggccctgcaggagttcgaatttcgggtcggagcaaccgaccgcggctctccagctctcagcagtgaggctttggtgcgtgtgctcgtgcttgacgcaaatgacaattccccttttgtcctgtatcctctgcagaacggcagtgctccgtgcacagagctggtgccacgagctgctgagcccggctatctcgtgaccaaagtggtcgccgttgatggtgacagtggccaaaacgcatggttatcttatcagctgttgaaggctaccgagccagggctgttcggcgtttgggctcataacggggaagttcggactgctcgcttactgagtgaacgagacgccgcaaagcacagactggttgtcctcgtgaaggacaatggtgaaccaccacgttctgctaccgcaacgctgcatgtgctcctcgtcgacgggttttcccaaccatacctccctctcccagaggccgctccagcacaggcacaggccgacagcctgacggtgtacttagtcgttgcactggcatctgtgtctagtcttttcctgttctcagttctgttatttgtggctgtgcgactgtgtcgtaggtcaagggcggcctcagtaggtcgctgcagcgtgcccgagggccccttccctggacaccttgtggatgtgtctggcaccggcaccttgtcccagagctatcagtacgaggtgtgcctcacaggtggatctggaacaaatgaatttaagttcctcaaacccattatacctaattttcaggtgcacgatactggaagaaacatgggggagattgaaaattttcgaaactctttcggtctgaatattcagtag

SEQ ID NO: 201925 - DNA, 1938 bp, Artificial Sequence
  Description of Artificial Sequence: Synthetic coding sequence
atggagagcgcccaggacctggacgtgggcagcaacagcctgcagaattataccatatctccaaattcacacttctacatcaaaattccagatagcagcgaccgcaagatttaccccgaactggtgctcgatagagccctggactatgaacaggaagccgaactcagactgacactgacagctgtagacggagggagccctcctaagagtggcaccacactggtactcattaaggtgcttgatatcaacgacaacgcgcccgagtttccccagtccttatacgaggtccaggtcccggaggatagacccctgggatcctggatagccaccataagtgctaaagacctggacgctggcaactatgggaaaataagctacaccttctttcacgcctcagaagatataagaaaaacctttgaaattaatcctattagtggcgaggtcaacctgcgcagtccactcgatttcgaggtcatccagtcctacaccatcaatatccaagccactgatggcgggggtttgtcaggcaagtgtactttattggttaaggtgatggatatcaacgacaaccccccagaagtgacgatcagtagtataaccaagagaatcccagagaatgcctccgaaacactggtcgcattgttctcgatcctggatcaggattccggtgacaatggcaggatgatctgttcaattcaggataacctgcctttcttcctgaaacccacgtttaaaaatttcttcacattagtaagtgagaaagccctcgaccgcgagtcacaggccgagtataacattacaatcacagtgacggacctcggtacacccaggctgaagacagaatacaacataaccgtcctgttatcagatgtaaatgataacgcccccacctttacccaaaccagttatacgctgtttgtacgggagaacaatagtccggcactacatattggcagcgtctctgccacggaccgggactctggtaccaacgctcaggttaattattctctgcttccccctcaggatcgccacttgccactggcctcccttgtgagcatcaacgccgataatggacatctcttcgccctcagaagcctggattatgaagcacttcaggaatttgagttcagagtgggagcgaccgaccgagggtcccccgctttgtccagcgaggccttagtgagggtgctggtcctcgatgccaacgataactcccctttcgtcctatacccattacaaaacggctctgccccgtgtaccgagctggtgccaagggccgcagaacccggctatctcgttacaaaagtcgttgctgtggatggagatagcggccaaaatgcctggctgtcctatcagctgctcaaagcaacagaaccaggcctattcggtgtgtgggcccataacggtgaggtgaggactgcccggctgctgagtgaacgcgatgcggcaaagcaccgccttgttgtgttggtgaaggataatggtgagccacctcgatccgctactgctacactccacgtgctactggtcgatggcttctcacagccctatcttccactccccgaggccgcccccgcacaggcccaggcagattctcttaccgtgtacttggtggtggcgcttgccagcgtgtcgtctctctttctgttctccgtcttgctctttgtagccgtccgtctgtgcagaaggagccgggccgcaagcgttggccgatgcagcgttcccgaagggccattcccgggacacttggtggatgtgagcggtacaggcactctgtcacagagttatcagtatgaggtctgcctgacaggcgggagtgggacgaatgaatttaaattccttaaacctatcatcccgaacttccaggtacatgatacagggcgcaacatgggggagattgagaatttccgcaattcttttggtttaaatatccagtag

SEQ ID NO: 201926 - DNA, 2382 bp, Artificial Sequence
  Description of Artificial Sequence: Synthetic coding sequence
atggaggcccgggtggagcgggccgtgcagaagcggcaggtgctgttcctctgtgtcttcttgggtatgagctgggcaggggcagagcctctgaggtactttgttgcggaggagacagagaggggaactttcttaaccaatctggctaaagacttagggcttggggtgggagagctccgcgcccgcggaacccgtattgtcagcgaccaaaacatgcagattctgttgctgagctcactgacaggcgatcttctcttgaacgaaaaattggaccgtgaggaattatgtggtcccagagaaccctgtgtgctgccctttcagctgctgctcgagaaaccattccagatttttagggctgaactgtgggtgcgcgacatcaatgaccacgcccctgttttcttggaccgggagataagccttaagattctggagtccaccacacccggcgccgctttcctacttgaaagtgctcaagatagtgacgtgggaaccaactctctctctaattatacaatctctccaaacgcatactttcatattaatgtccatgatagcggcgaagggaacatttacccagagctcgtgctgaatcaggtgctggatcgggaagaaattccagagttctccctgacactgaccgcattggacggaggcagccccccgcgtagcggtacagccctagttcgaattctggtgttggacgtcaacgataacgctcctgatttcgtgaggtcactgtacaaagttcaagtaccagagaactccccagtcgggagcatggtagtgtcggtgagcgctcgtgatctggacactggtagcaacggagagatcgcatatgcgttttcctacgccacagagcgtatcctaaaaacctttcagataaacccaacctcaggctctcttcatctgaaagcacagctcgactacgaagcaatccagacatacacactcaccatacaagcgaaggatggtggtgggctgtcgggcaaatgcactgtggtggtggacgtgaccgacataaacgacaatcgtccagaactgctgctgtctagcctgaccagtccaattgctgagaattcaccagagactgtcgttgctgtcttccgcattagggatcgggatagcgggaataatgggaagacagtgtgcagtatacaggatgacgtgcccttcattctcaagcctagtgtggaaaacttttacacactggttactgaaaaacccctggacagggaaagaaatacggaatacaatattacaatcactgtcactgacctcggaaccccccgtcttaagactgaacataacatcactgtgctggtgagtgacgtcaatgataacgcccctgcattcactcagacaagctacacactgttcgtccgcgagaataacagtcctgccctacctattggcagcgtgagcgcaactgacagggatagcggcaccaatgcccaggtgatttatagccttctgccctcacaggacccacacttaccgctggctagcctggtgtctattaatgcagacaatggtcacctattcgccttgcggagcctggactatgaggcactgcaagcctttgagttccgggtgggagctacagacagagggagccccgccctctcctccgaggctctcgtgcgcgtcttggtactggacgccaatgataactcgcccttcgttctctacccactccaaaattcttcagctccttgcacagaaccattgccacgcgcagccgaacccgggtacctggtcacaaaggtcgtagccgtggatggggattctggacagaacgcttggctgtcgtatcagctgcttaaagcaaccgagccggggctcttcggcgtgtgggcccataacggcgaggtgagaaccgctagactgctgtccgagagagacgccgccaaacagcgcctggtggtgctcgtgaaggacaacggcgagccacctcgcagtgccactgccactctgcacgtgctcttagtggacggcttcagtcaaccgtatctgcggctcccagaggccgctcccgatcaggccaacagtctgacagtctatttagtagtcgcgctggcgagcgtgtcctccttattcttgctgagcgtgttgctattcgtggctgtaagactctgccgccgatctcgcgctgcccctgtcgggcgctgcagtgtgcccgagggcccgttcccgcgccatctcgtcgatctgagtggaaccgggacactttcacaaagctatcagtacgaggtttgcttgaccggggggagcggcacgaatgagtttaagttcttaaaacctataatccccaacctcctgccccaatcaactgggcgggaagtggaggagaacaggccatttcagaataatctgggtttctag

SEQ ID NO: 201927 - DNA, 2331 bp, Artificial Sequence
  Description of Artificial Sequence: Synthetic coding sequence
atggagatcggctggatgcacaaccggcggcagcggcaggtgctggtgtttttcgttctgctgagcctgtctggggccggggccgaattgggaagctactccgtagtggaggagacagagaggggctctttcgtagccaacctgggcaaggacttgggcctgggtctgactgaaatgagcacccgcaaggctcgtatcattagtcaaggcaataaacaacacctgcagcttaaagcacagactggtgatttgcttattaacgagaaattggaccgagaggagctctgcggccctacagagccctgtattttgcactttcaggttctgatggagaacccccttgaaatcttccaggccgagctgcgggttatagacataaatgatcattctcctatgttcacagaaaaggagatgatactcaaaatcccagagaactccccccttggtacagaattccccctgaatcatgccttggatctggacgtgggatctaacaatgtgcagaattacaaaatatccccatcctcccactttcgcgtattaatccatgaattcagagacggtcgcaagtaccctgaattggtgctcgataaggagctggaccgggaggaggagccccagctgcgtctgactttgacagctctggacgggggttcccctcctaggtccggaactgctcaagtccgtatcgaagtcgttgatatcaacgataatgccccggaattcgagcagcccatttataaagtgcagattccggaaaactccccattgggtagtctcgtagctacagtgagcgcacgggatctggacgggggtgcgaacggaaaaatcagttatacactgtttcagccttctgaagatatcagtaaaacactagaagtcaatcccatgactggagaagtgcggctgaggaagcaggtcgatttcgagatggtgactagctacgaggtgcgcattaaggcaactgatggggggggactgtctggcaagtgtaccctcctgctgcaggttgtcgacgtgaacgataatccaccccaggtgactatgtctgccctgacatcccccatacctgagaacagccccgaaatcgttgttgcagtctttagcgtgtctgatccagacagtggcaataacggaaaaaccatttccagtatccaggaggatttgccctttctgctaaaaccatccgtgaagaatttctacacccttgtgaccgaacgcgccctggatagagaagctcgagccgaatataatataacactcaccgtaacagacatgggcaccccaaggctgaagacggagcacaacatcacagtgcagatatctgatgttaatgataatgccccaacatttacccaaacgtcctatacactgtttgtgagagaaaataatagcccagcccttcacattggctcagtgtctgcaaccgatagagactctgggactaacgctcaggtcacctattcactgctcccaccacaagacccccatctgcctttggccagtctggttagtattaacgccgacaacggccatttgtttgctttaagatccctcgactatgaggccttacgcgagtttgagtttagggtctccgctacagacaggggtagtcccgctctctccagtgaagccctggtgcgggtcttagtgctcgacgcaaacgacaatagcccatttgtcctctaccccttacagaacggatctgcaccatgtactgaactcgtgccccgcgctgccgagcctggttacctggtcactaaggtggtcgccgttgatggcgactccggacagaatgcatggctcagctatcaactgttaaaggctacggaaccgggccttttcggcgtgtgggctcacaacggggaagtcaggacagctcgcctgctgagcgaacgggacgccgctaaacagcggctagttgttttggtgaaagacaatggagaaccccctaggtctgccaccgctacactacacgtactcctggtggatggattctcccagcctttcctgccactccctgaagcggcccccgggcagactcaggctaattctttgactgtgtacctcgtggtggccctggccagcgtgtcaagcctgttcttgtttagcgtactgctgttcgtagccgtcagactttgtcgtcggtcccgtgccgcaagcgtcggtagatgtagcatgccagaggggccttttccgggcagattagttgatgtgtcaggaaccggaacattatctcagagttatcagtatgaagtatgtttaactgggggctcggaaacctccgaatttaaattcctcaagcccatcattcccaatttttctccctag

SEQ ID NO: 201928 - DNA, 2397 bp, Artificial Sequence
  Description of Artificial Sequence: Synthetic coding sequence
atggaggccggcgagggcaaggagcgggtgcccaagcagcggcaggtcctgattttctttgtgctgctcggaattgctcaggcatcgtgtcagccaaggcactactctgtggccgaggagacagaatcggggtctttcgtggccaatctcctcaaagacctggggcttgagatcggcgagctagctgttagaggtgcccgagtggtaagcaagggcaagaagatgcatctgcaatttgatcgtcagaccggcgacttgctactgaatgagaaactggacagggaggaactgtgtggcccaactgagccatgtgtgcttcccttccaggtgctgctggaaaatcccctacagtttttccaggccgaactgaggatacgcgacgtcaacgatcacagcccagtctttctcgataaggaaattctgctgaagatacctgaatctatcacacccggcacaacatttctgatcgaacgcgcgcaggatctggacgtgggcaccaactcactgcagaattacaccataagcccaaatttccactttcatcttaatttgcaggatagtcttgacggtatcatcctcccccagctggttttgaacagggcacttgatagagaagagcagccagaaatccggttgaccttaactgccctggacggcggatccccacctagatccggcacggccctcgtaagaatcgaagtagtagacattaacgataacgtccccgaatttgccaaactgctgtacgaggtgcaaatccctgaggacagccccgtcggcagtcaggtggcgatcgtgagcgctagagatctcgacataggtacaaacggggagatctcctatgcgttctcccaggcatctgaagatatccggaaaacttttcggctgagtgctaagagcggagaacttttgcttcggcagaaacttgacttcgagagtatccaaacttacacggttaacatacaggctacagatggcggcgggctgtcaggaacgtgtgtggttttcgtgcaggtgatggacctgaatgataatccccctgagctgacaatgagcacactgattaatcagatcccagaaaatctacaagacacattgattgcagtgttctcggtctcagatccagactctggcgataatggaagaatggtgtgtagcatccaagacgacctcccttttttcttgaagcccagtgtggaaaatttttacacacttgtgatttcaaccgcattggacagagaaacaaggtctgagtacaatatcaccatcactgtgaccgattttggaactcctaggttgaaaaccgagcacaacatcaccgttctggtgtccgatgtgaatgacaatgcacccgcattcacacagaccagctataccctctttgttcgggagaacaatagccccgccctgcatatcggttcagtatctgcaacagatagagattccgggactaatgctcaggtcacatactcattactgccaccgcaagatccccacctcccattggcctctctggtttctataaatgccgacaatggacatctcttcgcgctgcagagcctggactacgaggccttgcaggcattcgaattccgggtgggtgccgccgaccggggtagccctgccctttcctccgaggcactggttcgtgtcctggtgctcgatgcgaatgataactcccctttcgtgctttatcctcttcagaacggctccgccccctgtacagaactggtgccgcgagctgcagaacccggctacctggtaacgaaggtggtagcggtggacggtgactctggccagaatgcttggctttcatatcaacttctcaaggcaacagagcccgggctgtttggggtctgggcccataacggagaggttcgtacggcaagactgctcagggagagggatgccgccaaacagcgcttggtcgtgcttgttaaagacaacggcgaaccccctagaagcgcaacagccactttgcacgttctactcgtggacggattctcacagccttatttgctgctgcccgaggccgcaccagcccaagcacaggccgatcttctaacagtttatctggtggtagccctggctagtgtgagcagcctctttctgttcagcgtcttactcttcgttgccgtaaggctgtgtcgaaggtctagggctgcctccgttggacgatgtagcgtccccgaagggcccttcccaggccagatggttgacgtctctgggacgggtacgttaagccagtcttaccagtatgaagtctgcctgactggagggtccggaacaaatgagtttaagttcctaaagcctataatcccgaattttgttgcccaaggagcggagcgtgtgagcgaagctaaccccagtttccgtaaaagtttcgaatttacatag

SEQ ID NO: 201929 - DNA, 648 bp, Artificial Sequence
  Description of Artificial Sequence: Synthetic coding sequence
atgaacctggtgggcagctacgcccaccaccaccaccaccaccacccacacccagcacaccctatgctccatgaaccattcctgttcggccccgcctccaggtgccaccaggagaggccatacttccagtcctggctgctgagtccagccgacgctgctcccgacttccctgccggaggaccgcctcctgccgccgccgctgccgctacagcttacggccctgatgctcggcccggacagagtcccgggagacttgaggcactgggtgggagacttggtaggcgcaagggcagcggcccaaaaaaagagcggagaaggactgaaagcattaacagcgctttcgcagagctgagggagtgtatacctaacgtgccggctgatactaaactctcgaagatcaaaacccttagactagctacctcttatatcgcctacctgatggacgtactagccaaggatgctcagtccggagatcccgaagcattcaaggctgagcttaagaaagcagacggaggccgcgagagcaaaaggaaacgggaactccagcagcacgagggcttccctcctgccctgggtccagtggaaaagagaataaagggtcggactgggtggcctcagcaggtttgggcactagagctgaaccaatag

SEQ ID NO: 201930 - DNA, 2388 bp, Artificial Sequence
  Description of Artificial Sequence: Synthetic coding sequence
atgaagaagctgggccggatccaccccaaccggcaggtgctggccttcatactcatggtcttcctgagccaggtgagactggagccaattcgctattctgtgctcgaggaaactgagtcgggcagcttcgtggcccacttagccaaagacttgggcttggggatcggagagctggcctcccggtccgccagagtgttaagcgacgatgacaaacagcgcctgcaactcgacaggcagaccggagatctcctcttaagggagaagttagatagagaagagctctgcgggcctattgagccctgcgtgctgcatttccaggtatttctcgaaatgcccgtgcagttttttcagggggagctgctgatccaggacatcaatgatcactcacccatattccctgaaagagaagtgctcctcaaaattctggaaaacagccagcctgggacactcttcccattgctgattgcagaggacttggatgtgggctctaatggcctgcagaagtacaccattagccccaacagccatttccacatcttaacacgcaaccattccgagggaaaaaagtatcctgatctggtgcaagacaagccgctggacagagaggaacagcccgagttttccctgacactggttgccctggacggcgggagcccccctagaagcgggacagtgatggtacggattctgatcatggacattaatgataacgccccagagtttgtgcacacaccttatggggtccaggtgttggaaaattccccactggattccccaatagtgcgtgttctggcgcgcgacatcgacgcaggaaatttcgggtcagtctcatacggcctgttccaggcctccgatgaaatcaagcaaactttctctataaatgaggttaccggcgagatcctcctcaaaaaaaagttggatttcgagaagatcaagtcctaccacgtcgagatcgaagctacggatgggggtggactgagcggaaagggaaccgttgtgatcgaagttgtggacgtaaatgacaatccacctgagctgatcattagtagcctgacatcttcaattccagagaacgcacccgagacagtggtttcgatcttcaggatccgagacagggactccggggagaacggcaagatgatctgttcaattccagataaccttccgtttatcctgaagcccactctcaaaaatttctacacactggtcaccgaacgccctctggatcgcgaaactagtgccgaatacaacattaccatcgcggtgaccgatctcggcacaccacggttaaaaacccagcagaatatcactgtgcaggttagtgacgtcaatgacaatgcgccggctttcacacaaacttcttacaccttgtttgtgagggagaataacagccctgcgcttcatataggaagcgtgtccgccaccgatagagacagcggcactaatgcccaggtgacatactcgttactccctccccaggatccacacctgcctctggcctcacttgtgagcatcaatgccgacaacggtcatctcttcgcccttagatctcttgactacgaggccttacaggccttcgagttcagagttggagcttcagaccgcggctcgcctgcactgagttctgaagccttagtccgggtgctggttctagacactaacgataatagccctttcgttctctaccccttgcagaacggctccgcgccttgcacggagttggtacctcgtgcagcggagcccggttacctcgtgacaaaagtggtggccgtggatggggactcaggccaaaacgcttggctatcttaccagttgctgaaagctacagaaccaggcctttttggcgtgtgggcgcataatggcgaggtccgtaccgcacggctgttaagtgaacgagatgccgctaagcatagactggtggtcctggtgaaggataatggggaacccccaaggagcgccaccgccaccctgcacgtgctgttagttgatggattcagccaaccctacctgccactaccagaggccgcacctgctcaagcgcaggctgatagccttacagtttacctggtggtcgccctggcatctgttagcagcctgtttttattttccgtgctgctgttcgttgccgtccgcctatgccgtcgatcccgggctgctagcgtggggaggtgctctgtcccagagggccccttccctggtcacctcgtggacgtgagcgggacaggaaccctcagccaatcataccagtatgaagtatgcctgaccggcgatagcgggacgggggagtttaagtttttgaaacctatattcccaaacctcttagttcaggacacggggagggaagtcaaagaaaatcctaagtttaggaatagcctggtgtttagctag

SEQ ID NO: 201931 - DNA, 2391 bp, Artificial Sequence
  Description of Artificial Sequence: Synthetic coding sequence
atggaggccggcggcgagcggttcctgcggcagcggcaggtgctgctgctctttgtgtttctcggaggcagcctggccggttccgaatctaggcggtatagcgttgcagaggaaaaggaaaagggatttctgattgctaacctcgccaaggacctcggccttcgcgtcgaggaactcgcggcaaggggagcccaggtcgtaagcaaaggcaataaacaacacttccagctgtcacaccagactggtgatctgcttctcaacgagaagctggacagggaagagctgtgcggccccaccgagccatgcatacttcactttcagatcctgttacagaaccccctacagttcgtgacaaacgagctacggattattgatgttaacgatcactcacctgttttctttgagaatgaaatgcacctcaagatattggagtcgaccctccctggcaccgttattcctctgggtaacgctgaggatctggacgtgggtcgtaattctttacaaaactatacaatcacccccaattctcatttccacgtgctgactcggtctcgaagagacggaaggaagtatcccgaactggtgctggacaaggctcttgacagagaggagcaaccagagctttccctgaccttgacagcactggatggtggctcgccgcctagaagtggaaccgcacagattaatatccaagtactggatattaacgacaatgcccccgagttcgcccagcctctgtatgaagtggccgtgcttgagaacacccctgtgaattcagttattgttactgtgagcgccagtgacctggatacaggatcattcggcactatctcatacgccttcttccatgcctccgaggaaattcgtaagacattccagttgaatccaatcaccggggacatgcagcttgtgaagtacctgaacttcgaagctattaactcttatgaggtggatatagaggccaaagacggcggcggcctttccggtaaaagcaccgtgattgtgcaagtggttgatgtcaacgataacccaccagaacttacactttcatcagtgaattccccgatccctgagaattcgggtgagacagtcctcgcggtgttttcagtttcagatctggactctggagacaatggacgcgtaatgtgctctatcgagaacaacctgccattttttcttaagccctctgtggaaaacttctacacattagtctctgagggcgctctagatagagagaccagaagtgaatataatattactattacgattaccgatctgggcacccctaggcttaagacgaagtacaatatcaccgtactagtttctgacgtgaatgacaatgcgcccgctttcacgcagataagctacactctgttcgtgcgggagaacaactccccagcccttcacattggaagcgtgtcagcgactgatcgggatagtgggactaatgctcaggtcacttacagcttactaccgccccaggatccacaccttccactgagtagtcttgtgagcataaatgccgacaacggacacttgttcgccctgcgctcactggactacgaagcattgcaggcattcgaatttcgagtgggcgcaacagatcgcggatcaccggcactgtcatctgaggctctggtaagagtccttgtccttgacgccaacgacaactcaccattcgtactgtaccccctgcaaaatggaagtgcgccatgcaccgagctcgtgccgagagccgcagagccaggatacttggtcaccaaagtcgtagcggttgacggggacagtggccaaaatgcctggctcagttaccagctcttaaaggctacagagcccggcctatttggagtgtgggcccataacggtgaagtgcgcacggctcggctgctcagtgaaagagacgctgcaaaacatcggcttgtcgtgttagtcaaagacaacggcgagcctcctaggtcagcgaccgccacactgcatgtattgctggtggatggtttttcccagccctatttaccactgcctgaagccgcaccagcccaggcgcaggcggaccttctgaccgtgtatctcgtggtggccctagcctctgtttcatctctgttcttgttctctgtgttgctgttcgtcgctgtgagactatgccggaggagccgtgctgcaagcgttgggcggtgttctgtgccagaaggtcctttccccggccagatggttgacgtgagcgggacagggactcttagtcaatcctatcagtatgaagtttgcctcacgggcggctcgggtactaacgaattcaagttcctgaaacctataatccctaatttcgtggcccagggggccgaaagggtcagcgaggcgaatccatcgttccggaagagctttgaattcagctag

SEQ ID NO: 201932 - DNA, 1107 bp, Artificial Sequence
  Description of Artificial Sequence: Synthetic coding sequence
ggcggcgcccccccccggagcggcaccaccaccatccggatcgtggttttggataacaacgataatgcaccagagtttctgcaatccttttacgaagtgcaggtgccagaaaattctcccctgaactcattagtggttgtggtttctgctagagacttggacgccggggcgtacggttctgtggcgtatgccctctttcagggtgatgaagtcactcagcctttcgtcattgacgaaaagactgcagagattcgcctgaaacgagctctggactttgaggccacaccttattacaatgtcgagatcgtcgcaacagacggtggaggattgtccggcaagtgcactgtggctatagaagttgtggacgtaaacgataacgccccagaactcacaatgagcacccttagttccccaacaccagagaatgcaccagagaccgtcgtcgctgtgtttagcgtgtccgatcccgattctggggacaatggccgcatgatctgcagtatccaaaacgacttgccctttctgttgaagcctaccctaaagaatttttatacgctggtgacccaacgaaccttggatagggagtctcaggctgagtataacattacaattaccgtgaccgacatgggcacccccaggctgaaaactgaacataacattactgttctggttagtgacgtaaacgacaacgctcctgcatttacccagacttcctacactctctttgtaagagagaataattctcctgcattgcacattggttcggtgtctgctaccgatcgcgactctggcactaatgcccaggtgacatacagtctcctgccaccccagaatccgcatcttagattggcctccctagtaagtatcaatgccgacaacgggcatcttttcgccctccgaagcctggattatgaagcactgcaggcatttgaatttagagtaggagctacagatcgaggctcacctgctctgagtagtgaggctcttgtgagagtgctatgctggacccccaccaccacccgaccgagttgttgtataaggtgccgcaccgcacggcgcttggcgccttcttggtgtccaggaaggcctagtagagctacatggtag

SEQ ID NO: 201933 - DNA, 2388 bp, Artificial Sequence
  Description of Artificial Sequence: Synthetic coding sequence
atggagaccgccctggccaagaccccccagaagcggcaggtgatgttcctcgccatacttctacttctctgggaggccggcagcgaggctgtgcgatattcaattcctgaggagacggagagcggctactctgtcgctaatctcgcaaaggacttaggcctcggggtgggggagctcgcaactaggggggctagaatgcactacaagggcaacaaagaactcttacagctggatattaagacaggcaacttgctgctgtatgagaaactggatcgagaagtcatgtgcggtgctaccgagccttgcatcctgcacttccagctgctgctggaaaaccccgtgcagtttttccagacagacctgcagcttaccgacataaatgatcatgcccccgaatttccagagaaggagatgctcctcaagatccccgagagtacacagcccggcaccgtgtttcccctcaaaattgcccaggactttgacattggctctaataccgtgcagaactacaccatttcacccaatagccattttcacgtcgcgactcacaacagaggcgatggtaggaaataccctgagctggtgttagacaaggccctagaccgggaagaaagacctgagctgtctttaaccctgacagctctggatggcggtgcacctcccaggagcggaacaaccactatcagaatcgtggtgctagacaacaatgacaacgcacctgagtttcttcagtctttctatgaagtacaagtaccagaaaattcaccactgaatagcctagttgtggtcgtgtcggcccgcgacctcgatgccggggcttatggctccgtagcctatgcactctttcagggggacgaggtgacacagccattcgttattgacgagaaaaccgcagagatccgactgaagcgtgctttggactttgaggctacaccctattacaacgttgaaatcgtcgcgaccgacggcggaggcctttccggtaagtgcaccgtcgctatcgaggtggtcgatgtgaatgataatgccccagaactgaccatgtcgacactctcctcacccacacctgagaacgcacccgaaacggttgtggccgtgttctcggtatctgaccctgactcaggggataacggcaggatgatctgcagcatccaaaatgaccttcctttcttactgaagccaaccttgaagaatttttatacactggtaacccagcgtaccctggatagagagtcccaggctgagtacaatataactatcaccgttactgacatgggcactccacggctgaaaactgagcataatataactgtcctggtatctgatgttaacgacaacgccccagcattcacccaaactagttatacccttttcgtgcgtgagaacaatagcccagccctgcacattggcagcgtcagcgcaactgacagagatagcggcacgaacgcccaggtgacgtattcacttctccccccccagaacccccacctccgcctggcctccttggtttctataaacgcagacaatggacacctgtttgccctccgttcacttgattatgaagcattacaagcctttgagtttagggtgggcgccactgaccgtgggtccccggccctgtcatcagaagccctggtgagggtactggttctggacgccaacgataactcacctttcgtactgtacccgttgcagaacggttccgccccatgcacggagctcgtgccacgggccgctgagccggggtacctggtgaccaaagtggtcgccgttgacggggattccggccaaaacgcctggttgtcctaccagttgctaaaggccactgagccgggacttttctccatgtgggctcacaacggggaggtgcgaactgcgcggctgttatcagagcgggacgctgccaagcaccggctcgtggtgctggtcaaggataacggggagcccccccggtcagccaccgctacattacacgtgttgctggtcgacgggttcagtcagccctatctccccctgccagaggccgcaccagctcaagctcaggcagattccctgaccgtgtatttggtcgtagccctggcgtccgtgtctagcctatttctgttcagcgttcttttgttcgtggccgtccggctctgcaggcgatctagagccgctagcgtgggacgatgctccgtcccagaggggccattccctgggcaccttgtcgatgtgtccggcactggcaccctttctcagtcttaccactacgaggtctgcctaactggagacagcggcgcaggcgagtttaagttcctcaaacctataatccccaatcttctcccacagggagcaggagaagaaattgggaaaacagccgcctttcgcaacagcttcggattaaactag

SEQ ID NO: 201934 - DNA, 1107 bp, Artificial Sequence
  Description of Artificial Sequence: Synthetic coding sequence
ggcggcagccccccccggagcggcaccagcgagatccagatccaggtactggacattaacgataacgtgcccgaattcgcccaggagttatacgaagcccaggtgcccgaaaataaccctctgggaagccttgtgatcaccgtgagcgcacgggatctggatgctggaagtttcggcaaggtctcttatgccttatttcaagtggatgatgtaaaccaacccttcgaaattaacgccatcaccggggagatccgattacgcaaggcattggacttcgaagaaattcagtcctacgacgttgacgtcgaagctactgacggaggagggctgtcagggaagtgttccctggttgtcagagtgttagacgtaaacgacaacgccccagaactcacaatgtcttttttcatctcccttattcctgagaaccttccagagattaccgtggcagtgttttctgtcagcgatgctgatagcggacataaccagcaagtgatttgctccatagagaacaacctgcctttcctattaaggccttctgtagagaacttctatactcttgtcactgaaggcgctctggaccgagaaagcagagccgagtacaacatcaccatcacggtgaccgacctggggacgcctcgacttaaaacacagcagagtatcactgtccaagtgtcagacgtaaacgataacgttcccgcatttacccaaacatcatatactctcttcgtcagggagaataatagccctgccctccatatcggatctgttagtgccaccgatcgtgacagtggtatcaacgcacaagtgacctacagtctcctgccaccccaggacccacacctgcctctgagcagcctcgtctcaattaacgcagataatggacatcttttcgccctgcgctccctggactatgaggctcttcagagctttgagttccgggtgggtgcaacggatcgggggtcccctgcgcttagctccgaagccctcgtcaggctcctgtgttggacaccaacaactacaaggcccagttgctgtaccaggtgtcgaactgcccccagacctgctccctcatggtgtcctggacgcccttccagagcgacctggtag

SEQ ID NO: 201935 - DNA, 1977 bp, Artificial Sequence
  Description of Artificial Sequence: Synthetic coding sequence
atgctgctgaagatcagcgagatcaccatgcccggcaagatcttccctctgaagatggcccacgatctggacactgggtcaaacggcttacagcggtatactatttcaagtaaccctcactttcacgtcctgaccaggaaccggagcgagggacgcaaatttcctgaactagttctggacaaaccacttgatcgcgaagagcagccacaactgagactcacactcattgccctcgatggtgggagtcctccgcggtccggcacaagtgagatccaaatacaggtgcttgatatcaacgataatgttcccgagttcgcacaggagctttacgaggcccaggtgccggagaataatcctttggggtcactggtcatcacggtgtctgcccgcgacctggatgctggctccttcggcaaggttagctacgccctgtttcaggttgacgatgtaaaccagcccttcgaaatcaacgctatcaccggggaaatcaggcttcgcaaggctttggactttgaggaaattcaatcctacgacgtcgacgtcgaggcaacagatgggggagggctatccgggaagtgctctctggttgtaagggtgcttgatgtgaacgataacgcaccggaactgacaatgagtttctttatttcccttatccccgaaaatcttcctgaaatcacggttgcagtattttctgtgtctgacgctgattcagggcacaatcagcaggtgatctgtagcattgaaaataaccttccctttctgctgcgtccaagcgtcgaaaacttctataccttggtcactgaaggtgcactggatagggagagccgcgctgaatataacattacgatcacagtgaccgatttgggaaccccacgactgaaaacacagcagagcataaccgtacaggtgtccgacgtgaatgacaatgtgcccgcctttactcaaacgtcatatacactgtttgttcgggagaacaacagtccagcacttcatattggctcagtcagtgccactgaccgggatagtggtattaacgcgcaagtgacttatagtctacttcctcctcaggaccctcatctccctctgagcagtttagtatcaatcaacgccgataatggccatctgttcgcacttagaagcctggactatgaagcccttcagagcttcgagtttcgagtgggcgccaccgaccggggcagccccgccctctcctcagaagcgctggtgcgtttgttggttctcgacgccaacgacaactcccctttcgtgttgtaccccctgcagaacggcagcgcaccctgtaccgagctcgttcctcgcgccgcagaaccaggctacctggtcacaaaggtcgtggctgtcgacggcgactcaggtcaaaacgcctggctgagctaccagttgctaaaggctactgaacttgggttgtttggggtgtgggcacataacggggaagttagaactgcacgcctcctctctgagagggatgctgccaagcacaggttggtcgtgctggttaaagacaacggcgaaccccccaggagcgccactgcaacactccacgtgcttctggtggatggctttagccagccgtacctgcccctcccagaagccgccccagcacaggcacaagccgacagtctgactgtatatctggtggtggcccttgcatcggtgagctccctttttctgtttagcgttctcctctttgtggccgtgcgcctgtgtagacgatctcgggccgccagtgtcggtcggtattccgtccccgagggccctttcccaggacatttggtagacgtgtctggaacgggaaccctgtctcagtcctaccagtacaaggtgtgtttgactgggggctccgagaccaacgagttcaagtttttgaaacctatcatgccgaacttccctccgcaaggcacagagcgcgaaatggaggaaacgccaacaagcagaaattccttccccttcagctag

SEQ ID NO: 201936 - DNA, 2385 bp, Artificial Sequence
  Description of Artificial Sequence: Synthetic coding sequence
atgatgcagaccaaggtgcagaacaagaagcggcaggtggccttcttcatattactgatgttatggggtgaggttggctcggaaagtatacagtactctgtcttggaagaaaccgagtctggcaccttcgtagccaacttgactaaagacctgggacttcgagttggcgagctggccagccgcggagccagagttgtgtttaaaggcaacagacagcacctgcagtttgatcctcagacacatgatttactcttgaatgagaaactggatagagaggaactgtgcggaagtactgagccatgtgttctccctttccaggtgctcctggaaaacccactgcaattctttcaggcatctttgcgggtgagagacatcaatgatcatgcccctgagttcccggcccgtgagatgctactgaagatctccgagataacaatgcctggaaagatattcccactgaagatggctcatgatttagacaccggaagtaacggactgcaaaggtacacaatcagcagtaatccacacttccacgtgctgactaggaacaggagcgaaggcaggaaatttccggagctcgtcttggacaaaccactggatcgagaagagcaacctcagctgagactgacccttattgcactcgatggaggtagcccgccaagatctggcaccagcgagatccagattcaggtgctcgatatcaatgacaacgtgccggagtttgcgcaggaactgtacgaggctcaggtacccgagaataaccctctgggatctctggtcattacagtgagcgcccgggatctggacgccggatcatttggaaaagtgtcatatgctctgttccaggtggacgatgtgaatcagcccttcgagataaatgccataacaggtgaaatacgcctgcgaaaagccctcgacttcgaagagatccagtcctatgacgtcgatgtggaggctaccgacggaggcggcctgtcgggcaaatgctctcttgttgtccgagtgttggatgtcaatgacaacgcaccggaactcaccatgtcattctttatcagcctgatccccgagaatcttcccgaaattaccgtggcggtcttctcagtgtcggacgcagacagcggtcataaccagcaagtcatttgttctatcgaaaacaatttaccttttctgctaaggccaagcgtagagaacttctatactcttgtgacagagggagccctagaccgggaaagcagggcagagtataatataaccattacagtgactgatctgggcacacccagactaaagacccaacagtccattacagtccaggtgagcgatgtcaacgacaacgtccccgctttcacacagaccagctataccctgttcgtgcgggagaacaattctcctgccctgcatattggatcggtgagcgccaccgatcgcgattcaggcattaacgcacaggttacatactcactcttgccaccacaggatcctcacctgccattaagcagcctggtttcaattaacgctgacaacgggcatctgttcgctcttagatccctggattacgaggccctccagagctttgaatttcgcgtgggcgcgaccgatagaggatcacccgctctctctagtgaggccctggtgcgcttattagtcctagatgccaatgacaacagcccctttgtcttatatcccctccagaacggcagtgccccatgtactgagctggtgccccgggctgccgagcctggatatctggtgacaaaagtggtcgccgtcgacggagattccggccagaacgcctggctgagctaccaattgctcaaagctacagaattgggcctattcggggtgtgggcgcataacggtgaagttaggaccgcccggttgctgtctgaacgggatgctgctaagcatagattagtggtgctagtgaaggataacggcgaaccaccaagaagcgccaccgccaccctgcacgtcttactcgtagacggcttttcccagccttatctgccactgcctgaggccgctcctgcccaggcgcaagcagactctctgaccgtgtatctggttgttgccctggcatctgtgtccagcttatttctctttagtgtcctgcttttcgtcgccgtgcgcttatgtcggaggagccgagccgcatctgttggacgctattccgtccctgagggaccctttccgggtcacctggtagacgtctcgggcaccgggactctttcacaatcttatcaatacaaggtatgtctgacgggcggctcagagaccaatgaattcaaatttttaaaacctatcatgcctaacttccccccgcagggtaccgaacgcgagatggaggagacaccaaccagccggaactcatttccattctcttag

SEQ ID NO: 201937 - DNA, 1107 bp, Artificial Sequence
  Description of Artificial Sequence: Synthetic coding sequence
ggcagccccccccggagcggcaccgccctggtgcggatcctggtgctcgacgttaatgacaacgccccagactttgtacgttccctgtacaaggtgcaagtacctgagaattcacccgtcggaagtatggtggttagtgtgtccgctagagatctggatacaggttctaacggggagatcgcctacgccttctcatacgctaccgagcgaatattgaagacattccagataaacccgactagtggatcgttacatcttaaagcacagctggactacgaggctattcaaacatatacacttactatccaggccaaagatggaggaggcctgtcaggaaaatgtactgtggtggtggatgtaactgatatcaatgataaccgcccagaattgctccttagtagcctgacctccccaatcgctgagaactctcctgagaccgtggtggccgtctttcgcatcagagaccgggacagcgggaataatggaaagaccgtgtgttcaatacaggacgatgtgccatttatattgaagccctccgtggaaaatttctacactctagtgaccgagaaacccctggatcgcgagcggaataccgaatataacatcacaattacagtgactgacctcggcactccccggctgaagactgagcataacattacggtgctcgtaagcgacgttaacgataacgcccccgccttcacccagacctcctacacactttttgtgagggagaacaactcccccgccctgcctatcggttcagtcagcgcaacagaccgagactcaggcaccaatgcacaggtaatatattccttgctcccctcccaggatcctcacttgcctttggccagcctggtttccatcaacgctgacaacggacatttgttcgcattgcgctcccttgactacgaggcactgcaggctttcgaattccgggtgggagccaccgaccgcggttctccagccctttcttcagaggccctcgtccgggttctctgctggactccgaccacaacccggccgagctgctgtactcggtgtcgcaccgcccctagacctgcacctagccgatgccccggtcggcccagcagagctacatggtag

SEQ ID NO: 201938 - DNA, 2406 bp, Artificial Sequence
  Description of Artificial Sequence: Synthetic coding sequence
atggaggccagcggcaagctgatctgccggcagcggcaggtgctgttttcctttctcctgcttgggttaagtctcgctggcgcagcagaaccaagatcgtatagtgtggtggaagagaccgaagggtccagtttcgttaccaatcttgccaaggacctgggcctggagcagagggagttcagccggagaggtgtgagggtggtgtcaaggggtaataagctccacctccaactgaatcaggaaactgccgacctcttgttgaatgaaaaactggacagagaggatttgtgtggtcacaccgagccatgtgtgctgcgcttccaagtgctgctcgaatcgccattcgagttttttcaggctgagttgcaagtgatagatatcaacgatcactcaccagtattccttgataaacaaatgctcgtcaaagtgtcggagagttctccgcccggtaccgccttcccactcaagaacgccgaggacttggatattggtcaaaataacattgagaactatatcatctctccgaactcgtatttcagggtgctcactcgcaagcgcagtgacgggagaaaatacccggaattagtgctggataaagcattggatagggaggaagaggccgagctgaggctgactttgaccgccctcgatggcggttcgccgcctcgcagcggtaccgctcaggtgtatatcgaagtggtcgatgttaacgacaacgctccagagttcgaacagcctttctacagggtccaaatctcagaagacagccctatctcattccttgtcgtgaaggtttccgctaccgacgtggacactggcgttaacggtgagatcagttactcacttttccaagcatcggatgaaatatcaaaaactttcaaagtggacttcctcacaggcgagatcagattgaagaaacagcttgactttgagaagtttcagagctatgaggtgaacatcgaggccagggatgctggagggttctccggaaaatgcacagtgctaattcaggtcatcgatgtgaacgaccacgcccctgaggtcacaatgtccgccttcacaagccctattcccgagaacgcaccagagactgtcgttgctctcttttccgtgtcagacttggactccggcgagaatggcaagatctcatgttccatacaggaagatctgccgtttctcttgaagtcaagcgttggtaacttttacaccctgcttactgaaaccccattggacagggagagcagagctgaatacaatgtcaccatcacagtcacagatttgggtacccctcgattgactacacacctcaacatgacagttcttgttagcgatgtgaatgacaacgcacctgcatttactcagacatcatacacattgttcgtaagggagaacaattccccagccctgcacattggatcggtaagtgctaccgatcgcgattcaggaaccaacgcacaggtgacatactctctgctcccgccccaggatccgcatctgcccctagcctctctggtgagtatcaataccgataacggacatctgtttgcactccgatctttggattatgaagccctccaggcgttcgaattccgagtgggtgctagtgatcgagggtcacctgctctcagttctgaagctctggtccgagtgttggtgctggatgccaatgacaattctcctttcgtgctctacccactgcagaacggctctgctccttgcactgaattggttcctcgagcggccgagcccggttacctggtgaccaaggtggtcgcagtggatggggactcagggcagaacgcgtggctctcctatcaactgttgaaggcaacggaaccaggactattcggggtgtgggcccacaacggcgaggtgcggaccgcccgtttgctaagcgagagggacgccgccaaacaacgcctcgttgttttggtgaaggataatggggaacccccatgctcagccacagccactctgcacctcttactcgtagatggattctcacagccgtacctcccccttccagaagctgcccccgctcaggggcaggcagacagcctgacggtctacttggtcgtggccctcgccagcgtctctagtcttttcctattttccgtgctactgttcgtagctgtgcttctgtgcagacgttctagggcagcgtctgtcgggcggtgtagtgtgccggagggccccttcccgggtcacctcgtggacgtgcgcgggacaggtagtttgtctcagaactaccagtacgaggtatgccttgctggcggttccggaaccaacgagtttcagtttctcaaacctgttcttcccaatattcagggacactcattcggacctgagatggaacagaatagtaatttccgaaacggattcggattcagcctgcagctcaaatag

SEQ ID NO: 201939 - DNA, 2472 bp, Artificial Sequence
  Description of Artificial Sequence: Synthetic coding sequence
atgaagatccagaagaagctgaccggctgcagccggctgatgctgctgtgcctctccctagagttgctgctggaggcgggcgctggcaatatccattactctgttccggaggagaccgataagggcagctttgtggggaacattgcaaaggacttaggcctccagccacaggaattggcagatggtggggtgagaatcgtttctcgtggcaggatgccactgttcgctctcaaccctagatccggctcactcatcaccgcccgtagaattgatagagaggaactctgtgctcagtcaatgccttgcctggtcagttttaatattcttgttgaggacaagatgaaactgttccccgtggaggtggagattatagacattaacgataacacgccacaatttcagctggaggaattggagtttaagatgaatgaaatcactacccccggcacgagggtgagccttccgttcggccaagacctggatgtgggaatgaactccctccagtcctatcagctctcttccaacccccactttagcctggacgttcagcaaggggctgatggaccacagcatcccgagatggtgttacagagccccctggaccgggaggaggaagcagtgcaccacttgatactcaccgcgtccgacggcggggagcctgttcgctcaggtacgctgaggatctatatacaggtcgtggacgctaacgacaaccctcctgctttcacccaggcccagtatcacattaatgtacctgagaacgtgccattaggcacacagctcttaatggtcaatgccactgaccccgatgaaggtgccaacggtgaggtcacttatagcttccacaacgtggaccaccgggtcgcccaaatttttcgactcgatagctacaccggcgagatttcaaacaaggagccgttggacttcgaggaatataaaatgtactctatggaggtgcaggcacaggacggagcaggactcatggcaaaagttaaggtcctaattaaggtcctggatgtcaacgataacgcccctgaggtgacaattaccagcgtgacaactgcagtgcctgaaaattttccccctggtactattatcgcccttatctcagttcacgaccaagactcgggcgacaatggatacacgacttgctttatcccaggaaaccttccttttaagttggaaaaactcgttgataactattaccgtctcgttactgagcgtaccctcgacagagaacttatctccgggtacaacatcaccatcactgctattgaccagggtaccccagcgctatcgacggagacccacatcagcctcctcgtaacggacattaacgataactcgcctgtgtttcaccaggattcatattctgcatacattcctgagaataacccaagaggggctagcatatttagcgtgcgggcacacgacctggatagtaacgagaacgcccagatcacttactcccttatagaggataccatccagggagctcccctgtctgcctacctttccattaactctgatactggggttctctacgcactgagatccttcgattatgagcagttccgggacatgcagctcaaggttatggcacgcgactctggtgacccacctttgtcgtcgaacgtgtctctgagcttatttctgcttgatcaaaacgataatgcccccgaaattttgtacccagccctccctactgacgggagtactggggtggagctggcacccttgtccgctgagcccggctacctggtgaccaaggtggtggctgtcgatagagattcaggccagaacgcatggctgagttacaggctgttgaaagcctctgagccaggactgttcagtgtggggctccacactggggaagttcgcacagctcgtgctttacttgacagggatgcccttaaacaatctctcgtggtggccgtccaagatcacggccagccgccactgtcagctaccgtcactttgacagtcgccgttgccgatcgtatttccgatatcctcgctgacctgggctcccttgagccttcggccaaacctaacgattccgacctcaccttgtacttagtagtggccgctgctgccgtgtcttgtgtcttcctagcattcgtgatcgttctgttagcccacagacttcgacgctggcataagtctagacttctccaggcatccggcggcggcctcgcttcaatgcccggctctcactttgtgggggttgacggcgtgagggccttcttgcagacttattcccacgaagtgagcctgacggcggattcacggaagagtcacctcattttcccccaaccgaactatgcagacacattgatttcacaggaaagctgtgagaagaaagggtttctgtctgccccgcagtcactacttgaagacaagaaggagcctttcagccaggtgaacttttgtgacgaatgtatttcctatctcgagaagaataattcttag

SEQ ID NO: 201940 - DNA, 2796 bp, Artificial Sequence
  Description of Artificial Sequence: Synthetic coding sequence
atgaagatccagaagaagctgaccggctgcagccggctgatgctgctctgtttgtctctggaacttctgcttgaggccggagccgggaatatccactattcggtgccagaggaaacagacaagggcagcttcgtgggcaacatagctaaggatttggggctgcaaccccaagaactggcagacggcggagttcgcattgtctctcgcggcaggatgccgttatttgccctgaaccctcgaagtgggtccctaataacagcacgacggatcgaccgggaggagctatgcgcacaatcaatgccctgtctcgtgtcctttaacatactggtagaggataagatgaagctattccctgttgaggtagaaattatcgacatcaacgacaataccccccagttccagcttgaggaacttgagtttaaaatgaacgagattaccactcccggcacacgcgtgtctctgcccttcgggcaggacctggacgtcggcatgaactcccttcagtcttatcagctgtcatccaatccacactttagtttggatgtacaacagggcgctgacggacctcagcaccctgagatggttctgcaaagcccacttgatcgcgaggaggaggccgtccaccacctgatcttgaccgccagtgatgggggagagccggtgcgcagtggaacgctgcggatttatatacaggtggtcgatgccaacgacaatcccccagccttcacacaggctcagtaccatataaatgtgccggagaatgtcccactcggcacccaactcctgatggttaacgcaaccgatcccgacgagggcgctaatggagaggtaacatactctttccacaacgtggaccatcgcgtggcccagatcttcaggctcgactcatataccggtgagatcagcaacaaggaaccactggactttgaagagtacaagatgtattctatggaggttcaagcacaagacggtgcggggctgatggcaaaggtcaaggttttgattaaagttttggatgtcaatgataacgcccccgaagttaccatcacttctgtcacgactgctgtccctgagaacttccctcctggaactattatagcgcttattagtgtacacgatcaggactcgggcgataatggttataccacctgtttcatccctggcaatctgccgtttaaattggagaagctggtcgacaattactacaggctggtgaccgagcgaactctcgatcgggaattgatttcaggttacaacatcacaattacagccatcgaccagggtactcccgctttaagcactgagacacacatcagcctcctcgtgactgacattaatgataatagcccagtttttcaccaggactcctactcagcttacattcccgaaaataaccctcgcggcgcctctatcttctcagtacgagcccacgatctcgattcgaatgaaaacgcccaaatcacatactccctgatcgaagatacaatccaaggggcaccactctcggcctatctgtctattaatagcgacaccggcgttctttatgcgttgcggtcattcgactatgagcagtttcgtgacatgcagctgaaggtgatggcccgagactctggcgatcccccactttcatctaacgtaagtctttctctctttcttttagatcaaaatgataacgcaccagaaattctttatcctgctttgccaaccgatgggtcaacaggcgtcgaactggcgcctttatctgctgagcctggctacttggtgaccaaagtggtggccgtcgatagggacagcggccagaacgcatggctgagctacagactcctgaaggcctcggagccagggctgttctcggtcggactccatacgggagaggtgagaactgctcgggcgctgcttgatcgggacgccctgaaacagagcctggtggtggcagttcaggatcatggtcaaccaccactgtcggctactgtgacactgacagtagccgtggcagataggataagtgacattcttgccgacctgggcagtctggagccttctgctaagcctaacgacagcgacctcaccctgtacttggtagttgccgcagccgctgtgtcctgtgtcttcttggcttttgtaattgtgctactcgcccatagactacgcaggtggcacaagtctaggctactccaggccagtggcggaggtcttgcatcgatgcctggcagccactttgtgggagtggatggggtaagagcctttcttcagacctacagccatgaggtgtcactcaccgccgactctcgcaagtcacatctgatctttccacagccaaattatgccgatacgttgatctctcaggagtcctgcgaaaagaaaggattcctgagtgcacctcagtctctgttagaagacaaaaaagagccgttctcccagcaggcacctcctaacacagactggcgcttctcacaagctcagcgcccaggtacctccggctcacaaaatggggatgatacgggaacctggccgaataaccaatttgacaccgagatgttgcaggcaatgatacttgccagcgcctccgaggctgccgacggctcttcgacccttggcgggggggcgggcacaatgggattgtccgcccgatacggcccccagtttacgcttcagcacgtgcccgattataggcagaacgtgtatatccctggctcgaacgccaccctaaccaacgcagcaggaaagagagatggaaaagctccggcgggcggaaatggaaataagaagaaatccggaaagaaagagaaaaagtag

SEQ ID NO: 201941 - DNA, 2811 bp, Artificial Sequence
  Description of Artificial Sequence: Synthetic coding sequence
atggccgcccagcggaaccggagcaaggagagcaaggactgcagcggtctggtgctgctgtgcctcttcttcggcattccttgggaagccggagcccggcagatctcttattccattccagaagaattggaaaaagggtcatttgtgggaaacatctcaaaagacctggggttggcccctagagaactggccgagcggggagtgaggatcgtcagccgcggtcggacacagctgttttcccttaatccaaggagcggtagcttgatcacagctggaaggattgatcgtgaggaactgtgcgctcagagtgccaggtgtgttgttagctttaacatcctcgtggaggatcgcgtgaaattgtttggtatcgagattgaagtgaccgatattaacgacaatgcaccaaagtttcaagctgagaatctcgacgtgaagataaacgaaaatgtcgccgctggaatgcgctttccgctgccggaagcaattgatccagatgtcggcgtgaactccctgcagtcataccagctgagccctaataaacatttttcgctccgtgtgcagtctagggcaaacggggtcaaataccccgagctcgtacttgagcacagtctcgatcgagaggaggaggctattcatcacctagtgcttacagcatcggatggtggtgatcctctaagaagcgggaccgtgctcgtctctgtgacggtttttgatgccaatgacaatgcccctgtgttcaccttaccggagtatcgagtgagcgtgccagagaatcttcccgttggcactcagcttctaactgtcacagctaccgatcgagacgaaggagcaaacggcgaggtgacttactcatttagaaagctgcctgatacccagctcttaaaattccagctaaataagtacacgggtgagatcaagatcagcgagaacctcgactatgaagaaaccggcttttatgaaatcgaaatccaggctgaagatggcggagcctacttggcaacagccaaggtgctaattacagttgaggatgtcaacgataacagcccggagctaacaatcacctccttattctccccggtgacagaggactctccactgggaacagtggtggccctgctgaacgttcacgacctcgactctgagcaaaatggacaggttacctgtagtatcctggcttaccttccgttcaaactggagaaaagcattgattcatactacagattggtgatccacagggctctggaccgcgagcaggtgagctcttataacatcactgttacagcgaccgatggagggtctcctccgttgtctactgaggcacattttatgctacaggttgccgacattaacgacaatccacccaccttctctcaagtgtcttacttcacctatatcccagaaaataacgcaaggggcgcaagtattttttctgtcaccgcactcgatccagatagcaaggaaaacgcccagatcatctattccctggccgaagataccatacagggcgttccgctgtcctcctacatctccatcaactccgacacaggtgtactttatgccctgaggtcattcgactacgagcagttccacgagcttcaaatgcaggtgactgcgtccgacagcggcgatccgcccctatccagcaacgtgtcactgtctttgtttgtgctggaccaaaatgacaatgcccctgaaatcctctatcccgccctcccgactgatggcagcaccggcgtggagcttgcaccaagatcggccgaacctggctatctcgtcactaaagttgttgcagtcgatagggactcaggccagaatgcctggttgagctaccggctgcttaaagcctcagagcctggtctgtttgccgtcggcgagcataccggagaagtgagaacagcccgcgctttgctcgatagagatgccctgaagcagtccctcgtagttgccgtgcaggatcacggccagccccccctgagcgctaccgtgaccctgaccgtagcagtcgctgatagtatcccgcaggtgctggcggatcttgggtccttcgagtcaccggctaattccgagacgagcgatctcactttatatttggtggttgccgtggccgctgtaagctgcgtgttcctggccttcgtgattgtcttgctggcgcacagattgcgccgctggcacaaatctcgtctcttacaagcctctggaggaggcctgactggcgtgagcgggtcccacttcgtgggcgtcgacggagtcagggcatttctgcagacatactcacacgaagtgagccttactgccgattccagaaagtcccacctgatttttccccagcccaactatgcagacacactgatatctcaggaaagctgcgagaagaatgatcctctttccctgttggacgactccaagttccccatagaagacacacccctggtcccacaggcaccccccaatactgactggcggttttcccaagctcagcggcccggcaccagcggctcacagaacggcgacgatactgggacctggccaaacaatcagtttgatacagaaatgttgcaggccatgatcctggcctcagcttctgaggcagccgatggcagcagtacattgggcggaggagctggaactatgggcctgtcagcgcgctacgggccacaattcactctgcagcacgtccctgattatcgtcagaatgtctacattcccggtagcaacgctaccctgactaatgccgccggtaaacgcgacggcaaagcccctgcaggtggtaacggtaacaagaaaaaaagcggcaagaaggaaaagaagtag

SEQ ID NO: 201942 - DNA, 2808 bp, Artificial Sequence
  Description of Artificial Sequence: Synthetic coding sequence
atggccaaccggctgcagcggggcgaccggagccggctgctgctgctgctgtgtatcttcctgggaactctccggggcttccgcgccaggcaaatcaggtattccgtgcctgaggaaactgagaaaggcagtttcgtcggcaacatctccaaggaccttgggctcgagcccagggagctggccaaacgaggcgtgcggatagtgtctcgtgggaagacccaactgttcgcagtcaaccctagatccgggtcacttatcactgctgggagaattgatagggaggaactatgcgagacagtctcgagttgcttcctgaacatggagttacttgtagaggatacattaaagatttacggcgttgaagtggagatcatcgacattaatgacaatgctccttcttttcaagaggacgaggtggaaattaaagtctcagagcacgctataccaggcgcgaggttcgccctccccaacgctcgcgatccagatgtcggcgtgaactctcttcagtcataccaacttagtcccaataactatttttccctccagttgaggggaagaactgatggcgctaagaatccagaacttgtgctggaaggttcactggacagggagaaggaggccgctcacttgctgctgctgactgctcttgatggcggcgatccaataagaaaaggcgccgtaccaatcagagttgttgtgttagacgtcaacgaccatatccctatgttcactcaaagtgtctacagagtgagtgtgccggaaaacataagctctggaacccgcgtgttaatggttaatgccacagacccagacgaagggattaacggggaagttatgtactcgtttcggaacatggagtctaaggcgtcagagatttttcagcttgactctcagactggggaagtccaagtgcgcgggtcccttgactttgagaaatacagattctacgagatggagattcaggggcaggatggcgggggtctcttcactacaacaactatgctgatcactgtcgtggacgtgaatgacaacgctccagaaatcactataacaagctccattaattccatcttggagaatagcccgcctggtacagtgatcgctttactgaacgtacaggatcaggacagcggagaaaacggccaggtcagctgctttattccaaatcacttgccattcaagttggagaaaacctatggcaattattacaagttgattaccagccgcgtcctggatcgtgagctggtacagagttacaatataacactgaccgcaaccgatcagggcagtcctcccttgtcagccgagacccacgtgtggcttaatgttgcagacgacaacgataatccacctgtgttccctcattcttcatattcagcgtatattcccgagaataaccctagaggtgcttccattttctctgtgacggccctggatcccgatagcaaacaaaatgcgttggtgacttattctctgactgatgatactgttcagggcgtgccgctttccagctacgtatctatcaatagtaatactggcgtgctctatgcactccaatcattcgactacgagcaattccgtgatctggagttacgagtaatcgcccgagactcaggcgatccccctttgtcatccaacgtcagtctgagtctgttcgtactggatcaaaacgacaatgcccctgagatactctacccggcattgccaaccgatgggagcactggggtggagctcgctcccagatctgctgagcccgggtacctcgtcaccaaggtggtagccgtcgataaggattccggccagaacgcctggctcagctatcgacttttaaaagccagcgagcctggactgttcgctgtgggagaacataccggagaggtcagaaccgcccgagcactgctggatagagacgcattgaaacagagtcttgttgtggccgtgcaggaccacgggcagcccccactttcggccactgtgacgctgaccgttgctgtggccgactcaattcctgaagttctggctgatctggggagcctggaaagtctggccaactccgaaacttctgacttatccttgtacttagtggtagccgttgccgctgtgtcctgtatctttctagtgttcgtgattgtccttttggccctgcggctgtggcgctggcacaaaagccgtctactgcaggcttccgaaggagggctggcaggcatgcctaccagtcatttcgtgggggtcgatggcgtgcaagcttttctccagacgtactcgcatgaagtgagcctcattgcggactctcagaaatctcatctaattttcccccagccaaactatggggataccctaatcagccaggagagctgcgagaaatccgagcccttacttattgccgaggatagtgccattattctgggaaaatgcgatcctaccagtaatcagcaagcccctcccaacaccgactggagattcagtcaggcacaaaggcccggcacctctggatctcaaaacggtgatgatacaggtacctggccaaataaccagttcgacaccgagatgcttcaggccatgattttggccagcgcaagtgaggctgcagatggatcttctacgctgggcgggggcgccggcaccatgggactttcagcccgttacggcccacaattcactctccagcacgttcctgattatcggcaaaatgtgtatatacctggatccaatgccaccctcactaacgccgcaggaaagagagacgggaaagcacctgctggtggaaacggtaataaaaaaaagagcggaaagaaagaaaagaaatag

SEQ ID NO: 201943 - DNA, 2253 bp, Artificial Sequence
  Description of Artificial Sequence: Synthetic coding sequence
atggccaaccggctgcagcggggcgaccggagccggctgctgctgctcctgtgtatcttcctaggaacgctgaggggatttagggctaggcaaatcaggtactcggtaccagaggaaactgaaaagggatctttcgtgggcaatataagcaaagatctggggcttgaaccacgggagctagctaagcggggcgtcaggatcgtaagccgaggaaagacacagctgtttgccgtgaatcctagatcagggagcctgattaccgccggccgtatagaccgtgaggaactctgcgaaaccgtgtccagttgcttcctgaatatggaactcctggtggaagataccctgaagatctacggagtggaggtggagattattgacatcaacgacaatgcgccttcgttccaggaggacgaagtggagatcaaggttagcgaacacgctatcccgggggctcggttcgcactgccaaatgcacgggaccccgatgttggagtgaacagtttgcagtcataccaattaagtcccaataactacttctccttgcagcttagaggtcgaaccgacggggctaagaatccagagctcgttctggagggtagcctcgatcgggagaaggaggccgcgcacttgttgcttctgaccgccctggacggcggcgacccaataaggaaaggagcagtgccgatccgggtggtggtgctcgacgtcaatgaccacatccccatgttcacccagtctgtttacagggtctcagtgcctgagaatatctcaagtggtactcgcgttcttatggtgaatgcaactgaccctgacgagggaattaatggggaagtaatgtatagcttcagaaatatggagtctaaggcttccgaaatctttcagctagacagtcagacaggagaggtacaggtgagggggtcattggactttgagaaataccggttttacgaaatggaaatccaaggacaggacggaggcggactgttcacgaccaccaccatgttgatcaccgttgttgacgtgaatgacaacgctcccgagatcactataacttcatcaataaacagtatccttgagaattccccacccggaaccgtgatagcgctactgaacgtccaggatcaggactctggcgaaaacggccaagtctcctgcttcatacccaatcacttaccttttaaactcgaaaagacttatggtaactattataaactgatcacttctcgggtgctcgacagagaattagtgcaaagctacaacatcacattaaccgccaccgaccagggatcccctccgttgtctgcagagactcacgtctggctgaacgtggcagatgataatgataatccccctgttttccctcactcatcttattcggcatatattcctgagaataaccctaggggagcctccattttttccgtgacagctttggaccccgacagtaaacagaatgcccttgtcacatactcactgacagacgatacagtacagggggtacctctcagcagctatgtttcaatcaattcaaacacaggtgtcctttatgcactccagtcttttgattatgagcaatttcgggatctcgagctgagagtcattgctcgcgacagcggcgaccctcctctgtcatcaaacgtgtctttaagtttgttcgtgttagaccagaatgacaacgctccggaaatcctgtaccccgccctgcctacggacggcagcacgggagtggagctggctcccagatccgctgagccgggataccttgtaactaaggtagtcgccgtagataaggactcaggacagaacgcttggctgtcatacagactccttaaggcttcagaaccagggcttttcgccgtgggtgaacacacgggagaacaagcccctcccaacacggactggaggtttagccaggctcagagacccggcacctcaggaagtcagaatggggacgacacagggacatggcccaacaatcagttcgacacagagatgctccaggctatgatcctggcgtccgcctctgaggccgctgacggttcgagcaccctgggagggggggctggtactatgggactatcggcccgttatggtccacaatttaccttgcagcacgtacctgattaccgtcaaaatgtttacattccagggagtaatgcaacattgactaacgctgccggtaaacgcgacgggaaagcgcccgccggaggtaatggaaacaaaaaaaagtcaggcaaaaaagagaagaagtag

SEQ ID NO: 201944 - DNA, 2799 bp, Artificial Sequence
  Description of Artificial Sequence: Synthetic coding sequence
atgatccccgcccggctgcaccgggactacaagggcctggtgctgctgggtatcctgctggggaccctgtgggagacgggctgcacccagattagatactcagtcccagaagagctggaaaagggcagccgagtgggcgacatcagcagggatctgggactggaacctagggagctggccgaaaggggtgtcaggataattccacgcggaaggacacaactcttcgcacttaaccctaggagtggtagcttggttacagcaggccgcatcgatagggaggagctgtgcatgggggccatcaagtgtcagctcaatctggatattcttatggaagacaaggtcaaaatctacggggtggaagtggaggtccgagacataaatgataatgcaccatactttcgggagtccgagctcgagataaaaatcagcgaaaatgcagcaacagagatgcggttccccctgccacacgcctgggatcctgacatcgggaagaacagcctgcagtcatatgagctgtcacccaatacgcatttcagccttatcgtccagaacggtgcagatgggagcaaatatcccgagctcgtactgaagcgagccctcgatcgcgaggagaaggctgcccaccatctcgtactcactgcttctgatggaggcgaccccgttcggactggaaccgcccgcatacgggtcatggtcctggatgccaatgacaacgcaccggcatttgctcaaccggagtatcgggcttcggtacccgaaaatctggcgttgggcacacagttactagtggtcaatgcgactgacccagatgaaggagtcaacgccgaggtgagatactcgtttcgctatgtggacgacaaggctgctcaggtgttcaagctggactgcaattcaggcacaatctctacaattggcgagctcgatcatgaagagagtgggttttaccagatggaggtccaggccatggacaacgccggatattctgcccgcgctaaggtgctgatcactgtgctggacgtgaacgataacgcacccgaagtggttctgacttccttagcttcgagcgtcccagagaacagcccccggggcaccttgattgccctcctcaacgtgaacgatcaggactccgaagaaaatggccaggtaatctgtttcatacagggaaatctgcccttcaagctggagaagagctatggaaattattactcgctggtcactgacatcgttttagatagggaacaggttccaagttacaatatcacagttacagcgacagacagggggaccccaccgctcagtactgaaacccacatctccctgaatgtagcggataccaacgataatcctccggtgttccctcaggcctcttacagtgcctacataccagagaataacccaaggggggtgagtctcgtgagcgtgacagcccacgaccctgattgtgaggagaatgcgcaaattacgtattctctcgcagagaacacaatccagggggcaagcctatccagctacgtcagcatcaattctgatactggcgtgctgtatgccctttcctcttttgattatgagcaattccgtgacttacaggttaaagtgatggctagagataatggccaccctccactcagctcaaatgtgagtctgtcactgtttgttttggaccaaaacgacaacgcgcctgagattttgtaccctgccctgccgaccgatggcagtactggcgtggagctcgcacctcgcagcgcggagcccggatacctggtcacgaaggtcgttgccgtcgaccgagattcagggcagaatgcctggctgtcatatcggttgctgaaggcttcagagcccggccttttctccgttggactgcacacaggggaggtgcggactgctcgggcactgcttgaccgggacgccctcaagcagagtcttgtggttgccgttcaagatcacggccaaccacctttatctgctaccgtgaccctcactgtcgccgtggcagacagcattccccaagtgcttgctgatctgggctcattggaaagccccgccaactcagagacctcagatttgaccttatacctcgtggtggctgtggccgcggtgagctgtgtctttctggccttcgtgattttgctcctggccctgcgcctgcggcgttggcacaagagtcggctcctgcaggcttctggggggggcctgactggcgcacccgccagccactttgtgggagtagacggcgttcaggctttccttcagacttattcccacgaagtgtctctcaccaccgattctcggaaaagccatttgattttccctcagcccaactatgcagatatgctggtgtcccaggagtcattcgagaagtccgaaccactgctgctgtcaggcgattccgtattttccaaggattcacacggccttatagaacaggcgccccctaacaccgattggcggtttagccaagcacagaggcccggtaccagtggatcccagaatggtgacgatactggaacctggcccaacaaccagttcgacaccgaaatgctgcaggccatgattctcgcctctgccagtgaggccgccgacggctcatccactctggggggcggagccggcacaatggggctgtctgccaggtacggaccccagtttaccctgcaacacgtgcctgattaccgccagaacgtgtacattcccgggagcaacgcgacccttacgaatgctgcgggaaaacgggacggtaaggcccccgctggcggaaatggaaacaagaaaaagtccggaaagaaggaaaagaaatag

SEQ ID NO: 201945 - DNA, 2799 bp, Artificial Sequence
  Description of Artificial Sequence: Synthetic coding sequence
atggccgccctgcagaagctgccccactgccggaagctggtgctgctctgcttcctgctcgcaactttgtgggaggcacgcgccgggcagataagatattccgtcagagaagagatcgatcgtggctccttcgttggcaatatcgccaaggatctgggactggagcctctggcactcgctgaacagggtgtcaggattgtatctcggggaaggtctcagctcttcgctttgaatcctaggtctggttctctggtgaccgccaatcggatcgaccgagaggaactctgcgctcaaagcgctccatgtctcctgaattttaacatactgctagaggacaagctgactatctactctgtggaggtcgaaattaccgacatcaatgacaatgcacctcgctttggggtcgaggagttggagttgaagatctccgagaccactacacctgggttcagaattcctctgaagaacgcgcatgacgccgacgtgggcgagaacgccctgcagaaatatgccttgaacccaaacgatcactttagcttagacgtacgtcgcggcgctgatggcaacaaataccccgaactggtgttggagcgaagcttagatcgagaggaggaggccgtgcaccacttagtactggtcgcaagtgacggtggagatccagtactaagtggcacctcccgcatctgcgtcaaagtcttggatgcaaacgacaacgcccctgttttcactcagccggaataccgcattagcatcccagagaatactctcgttggaacccggatccttacggtgaccgctactgatgccgatgagggctactatgcccaggttgtctatttccttgagaaatcgcctggggagacatctgaagtcttcgagctaaagtccacaagcggagagctgactattatcaaggacttggattatgaagatgccacctttcacgagatcgacattgaggcccaggatggacctggattgctaactagggcaaaagttatcgtgacagtgctggacgtcaatgacaacgcccccgaattttacatgactagtgccaccagcagtgtgtccgaggactctttacccggaacaatcattggcttgttcaacgtgcacgatcgagactcgggccagaacgcattcactacttgttctctccccgaggacctgccgttcaaactagaaaagagtgtggacaactactacagacttgtcaccacacgggcactcgaccgtgaacagttctcattttataatattactctgacagctaaagacggcggcaaccccagcctgtcaacagatgcccatatccttctgcaggttgctgacattaatgacaatgcacctgcgtttagccgcactagctatagtacatacatacccgagaacaatccacgcggcgccagtgtgttctccgtcacagctcatgaccctgattctaacgataatgcacacgttacctatagcttcgcagaagacaccgtccagggcgccccgcttagtagctatatcagcattaattccgataccggcgtgttatatgcactcaggagcttcgattacgagcagctgagagatctgcaagtatgggttattgctcgtgacagcggcaatcctccgctgtccagcaatgtgtccctgagtctgttcgtgctggatcagaatgataacgctcccgagattctgtaccctgccttcccaacagacgggtccaccggcgttgagctcgccccaagaagcgccgagcctggctatctcgtaacaaaagtagtagctgttgatcgcgattctgggcagaacgcctggctgtcgtatcacctgctgaaggcttcagaaccgggactatttagcgtgggactgcataccggtgaggtcaggaccgcgcgagcgctgctggacagggatgccttgaaacagtcacttgtcgtcgcgatccaggaccatggacagcccccactcagtgccactgtgactctgactgtcgcagtagccgacagaattcctgacatcctggctgacctcgggtcgttggaaccttctgctatccctaatgacagcgacctgactctctacctggtggtcgccgtggccgcggtgtcctgcgtgttcctggcgtttgttatcgtgttactggcgcatcggctccgtaggtggcacaagagtagacttctccaggccagtggcggctccctcaccggtatgcaaagctctcactttgtgggcgtggacggagttcgcgctttcctacagacctactcccatgaagtgtctctaacggctgattccagaaagtcacacctgatttttccccagcctaattatgcggacacactcatctcgcaagaaagctgcgaaaaaaaagattttttatctgccccacagtcccttttagaggaggagcgtgaggagacattctcccaacaggcgccaccaaatacagattggaggttctcccaagcacagagacccgggaccagtggctctcagaacggggacgatacaggcacttggccaaacaaccagtttgataccgagatgctgcaggcaatgatcttggcctccgcatccgaggccgcagacggctcttcaactctcggagggggagccggcaccatgggcctgtccgcacgctacggccctcagttcactttgcagcatgtaccggattacagacagaacgtttatataccagggtctaacgccacactgaccaatgctgctggtaagagagacggcaaggcccctgcgggtggaaacgggaacaaaaagaagagcggaaaaaaggagaagaagtag

SEQ ID NO: 201946 - DNA, 2799 bp, Artificial Sequence
  Description of Artificial Sequence: Synthetic coding sequence
atgaccaactgcctgagcttccggaacggccggggcctggccctgctatgtgctctcctgggcacactgtgtgagacgggttctgggcagatcaggtacagcgtgagcgaagaactggataaaggctccttcgtgggcaatattgctaacgatctaggtttagagcccagagagcttgcggagagaggagtccgcattgtaagcaggggtcgaacccagctgttcagtttaaaccctcagtccggatctctggttacagccgaaaggattgatagggaagagctttgtgcccaaatccctctgtgtttagtcaagataaacatactagtcgaggataagctcaagattttcgaagtggagatcgagatcaaagacatcaacgacaatgctccaaactttcccaccgaggaactcgagatcaaaatcggggaactgacggttccagggactcggtttcctataaagaccgcgttcgaccccgacgttggtattaacagtcttcagaactataagttgtcacccaacgattacttttcccttgccgtgaactccgtgtcagaaggggctaaataccctgagctggtgctagaacgggcactagatcgggagaaaaaggaaatccatcagctcgtgttggtagcatccgacgggggggaccctgtacacagcggtaatttgcacatacaggtcattgtcctggatgcaaacgataacccccccatgttcacccagccagaataccgagtgtctgtatgggaaaacgttccggtgggcaccaggctgctgactgtgaacgctacagatccagacgagggttttaatgcccaggtctcttatatcctggataaaatgcccgggaagatcgccgaaattttccacctgaacagcgtttccggcgaggtgagcattctaaagtcactggattacgaggacgcaatgttctatgagattaaaatcgaggcccaggacggccccggccttctcagcagagctaagattttggttacagtcctggatgtgaacgataatgcccctgagatcactataacaagcttaacttcttccgtgccagaagaggggacggtgggccgcgaaatagccctgatcgatgttcatgatcgcgattctggacagaatgggcaggtagaggtgttcgtcctaggtaacctgccctttaagcttgaaaaatccatcgaccaatactaccgactggttactgctacatccctggatcgcgaacaaattagcgaatacaacataagccttcgtgcgtctgatggcggcagccctcccctgtccacagaaacgcacattactctgcacgtaatcgatattaatgataatcctccaacttttccccacttgtcttacagtgcatatattccagagaacaacccaaggggcgcgtctattttcagtgttactgcccaagaccctgactccaataacaacgctcgtattacctacgccttgacagaggacaccctccaaggtgctcccttatccagtttcgtgagtatcaactctaacaccggggtcctgtatgcccttcgctcatttgattacgagcaatttcgggaccttaaactattggtaaccgcttcagatagtggcaacccacctctgtcatccaacgtgagtctgaatctgttcgtgctggaccagaatgacaatgcccctgaaatcctgtatcccgccctgccaacagacggtagtactggggtggagctggctccacgtagcgctgagcccggttacctcgtgaccaaggttgtcgctgtcgaccgagactcagggcaaaacgcctggctctcttatcggctgctgaaggccagtgagcctggtctcttcagcgtcggcctgcataccggcgaagtgcgaactgctagagctctgcttgatagggatgcactaaagcagagcctggttgtcgcagtgcaagaccacggacagcccccgctgtcggccacggtcacactcacagtcgctgtcgccgatagaatcccagatatcctcgcagatttgggatcactggagccctcggccaagccaaacgacagcgatctgactctgtatctcgtggtggcagtggcagccgtgtcatgcgtgtttctagcctttgttattgtgttgctggcactccgacttaggcgctggcataagagtcggcttctccaggcatcgggaggggggctggcaagcacccctggatctcacttcgtgggcgccgatggagtccgtgcctttcttcagacatacagccacgaagtgtccctgactgctgactccagaaagtcccatctgatatttccccagcccaactacgccgacaccctgattagtcaggagtcctgcgaaaagagcgagccactgcttatcacccaggacttattagaaatgaagggggattcaaacctgctacagcaggctcctccaaataccgactggagattcagccaggctcagcgaccgggcacctctggcagccaaaacggcgacgataccggaacttggccaaacaatcagtttgacaccgagatgctgcaggcgatgatcctggcaagcgcatcagaggctgccgatggatcaagcaccctcggtggcggggcaggtacgatgggactgagcgcacgatatggccctcaattcaccctacagcatgtcccagattatcgccagaacgtttacatcccaggtagcaacgcaactcttactaatgccgctggcaaacgggacgggaaagcgccagccggagggaacggcaataagaaaaaatccggcaagaaggagaaaaaatag

SEQ ID NO: 201947 - DNA, 2796 bp, Artificial Sequence
  Description of Artificial Sequence: Synthetic coding sequence
atggccagccccccccggggctggggctgcggcgagctgctgctgccttttatgcttctggggaccttatgcgagcccggctccggccagattcgctactccatgcctgaggagctggataaggggtcgtttgtgggcaatatcgccaaggaccttggactggaacctcaggaactggctgaacgcggggtgcgtatcgtttctcggggaagaacccagctgttcgctctgaatcctcggtcagggagcctggtcaccgccggccggatcgatcgggaagaactgtgtgcccagagccctttatgtgtggtcaatttcaatatactggtcgaaaacaagatgaagatttacggcgtggaggttgagatcattgacattaacgataatttcccgaggttccgagacgaggagctcaaggtgaaggttaacgagaacgcggccgccggtacaaggcttgtcctgccttttgccagagacgcagacgttggtgtgaactcacttcggagctaccaactgtcatccaatctgcacttctccttagatgtcgtctccggaacagacggtcagaaatacccggagttggtcctggagcagcctctggacagggaaaaggagacggtgcacgatctgctcctgaccgccctcgacggtggcgatcccgtgctgtctgggacaactcacataagagtgacggtgttggatgcaaacgacaatgccccactcttcactccatccgagtattcagtttcagtgcctgagaatatccccgtaggtaccagattgttgatgctaaccgcgactgatcccgacgagggcattaatggtaagctgacatatagcttccggaatgaggaagagaaaatttccgaaactttccaactagattcgaatctgggtgaaatcagcacattgcagtctctagattacgaggaatcgaggttttatctcatggaggtcgttgcccaggacggaggcgccctggtagctagcgcaaaagtggtggtgaccgtgcaggatgtaaatgacaatgcgcccgaggtcatcttaaccagtctcacttcatctattagcgaagattgcctacccggtaccgtcatcgccttgttctccgtgcatgacggtgatagcggagaaaacggagagatcgcttgtagcatccccaggaaccttccatttaagttagagaagtccgtcgataactattaccacctgttaacgacccgggacttagatcgcgaggaaacttcagattacaacattacactgactgtaatggatcacggaacacctccgctctccaccgagtcccatatccctcttaaggtcgccgatgttaatgataatccccctaatttcccacaggcttcttactctacttctgtaactgagaacaaccctagaggtgtgtctatcttctctgtgacggcccacgaccctgattctggggacaacgcccgcgtaacctattccttggctgaggacacgttccagggagcacctctcagctcgtacgtgtcaatcaacagtgataccggggtgttgtatgccttgaggtctttcgactacgaacagttgcgggatttacagctctgggtgaccgccagcgactcaggcaatcctcccctgtctagtaacgtgagcctgtctctgtttgtgttggaccagaacgataatactcctgaaattctgtatccagccctcccaactgatggttctaccggagtggagctggctcctaggagtgccgagccagggtacttggtgacaaaagtggtcgccgtagacaaagattccggccaaaatgcttggctgtcttacagactcctaaaggcaagcgaaccaggattgttcgcagtcggactccatactggcgaggttcgtactgctagggcccttctggacagagacgcccttaagcaatctttggtggtggctgtggaagaccacggccaaccccctctaagcgccactttcactgtgacagtggctgtggccgatcggattccagacattctggcagacctgggcagtataaaaacccccatcgaccccgaggatctcgacttgacactctatctggtggtcgccgtggccgctgtgtcctgtgtcttccttgcgttcgttatagtgttactcgtgctgaggcttagaagatggcacaagtcacgtctgctgcaggctgaagggtcccggctggcaggggtgccagcatcccacttcgttggcgttgacggcgttcgggcgttcctgcagacctatagtcatgaggtgtcactgactgcagactcacgcaagagccacctgatctttccccagccaaactacgccgacacactgctctccgaggaatcatgcgagaagagcgagcctctgttaatgtctgataaagtggatgccaacaaggaggagcggcgggttcagcaggctcccccaaacacggattggcggttcagccaggcccaaaggcctgggacttctgggtcccagaacggtgatgataccggaacctggccaaataaccagtttgacactgagatgctgcaggccatgatcctggcctcagcgtcagaagccgcagacggatccagcacccttgggggaggagcgggtaccatgggcttatctgcccgttatggaccacagttcaccctccagcacgttccggactaccggcaaaacgtctatatcccagggtccaatgccactcttaccaatgccgctggaaagcgcgatggtaaagctcccgctggggggaacggaaacaagaaaaaatccgggaaaaaggaaaagaagtag

SEQ ID NO: 201948 - DNA, 2799 bp, Artificial Sequence
  Description of Artificial Sequence: Synthetic coding sequence
atggcccccccccagcggcacccccagcggagcgagcaggtgctgctgctgacactgctgggtaccctttggggtgctgcagcggcccagatccggtattctatcccggaggagcttgaaaaaggatccttcgtggggaacattgtgaaagacctcgggctggaaccccaggagcttgctgagcatggagtcaggatagtcagcagaggacgcatgcagctgtttagtctgaaccctcgaaatggcagtcttgtgactgccggcagaatcgatcgggaagaactttgtgcacaatcacctcgatgtctggtttcattcaacatcttggtcgaggacaagctgaatttgtatcctgttgaggtggaaattgttgatattaacgataatactcctcgtttcctgaaagaggagctagaggtgaagatcctggagaatgcagcgccaagctctcgatttccattgatggaagtatacgacccagatgttggaatgaactctctgcagggctttaagctcagtggcaacagtcatttcagcgttgacgtccaatccgaagcacacggaccaaagtatccagagctcgtcttagaaggcactttagaccgggaaggtgaagcagtctacagactcgtcctcactgcaatggatggcggagatcctgtgaggtcttctgtcgcacagattctggtgaccgtccttgatgttaatgacaacacccccatgttcacacaacctgtgtaccgggtgtctgttccagaaaacctgcctgtggggacgcccgtactcgcggtgaccgcaaccgaccaggatgagggagtacatggagaggtgacatattcatttgtgaagataaccgagaagattagccagattttttgcctcaacgtactcaccggcgaaatttccacatcagccaacttggactacgaggattcctcattttacgaactgggcgtcgaggcccgcgacggtcctggcctccgagatagggctaaggtactgatcactatcctggacgtgaatgataatgttcctgaggtggtcgttaccagtggaagccggactattgctgagtctgccccgcctggcactgtaatcgccctcttccaagtctttgaccgggatagcggtcttaacggattggtaacttgttcaatcccaagatctctgccatttgaacttgagaagagcgtgggaaactattatagattagtaactaatgcagctctggaccgggaagaggtgttcctgtacaacataacagttacagctacagataagggaacaccaccactctctactgaaacaattattagtcttaacgtagcggataccaacgacaacccaccaacttttcctcactcatcatactccgtttacgtgctggagaacaatccacgtggcgcgtccattttctcagtaaacgctctggaccccgatgtagaccagaatgctcaggtgtcgtattcgctggccgaggacacccttcaaggcgcccccttatctagttacgtctctatcaacagcgacaccggcatcttgtatgcattgcggtcctttgattacgaacaattgagagacctccagttatgggtcaccgcctccgatagcggagatcccccattatccagtaatgtttccctgtctctattcgtgttggatcagaacgacaacgcacccgaaatactataccccgctctgcccactgatggatccacgggagtcgaactggcaccgcgatccgcggagccagggtacctggtcacgaaggtggttgctgtagaccgtgattccgggcagaatgcgtggctgagctatcggcttctaaaagccagcgagcccggattgtttagtgtgggtctccataccggagaagttcgaaccgctcgggcgctgttggaccgtgatgcactgaaacaatccctggtcgtggctgtgcaggatcatgggcagccacctctctcagccacggtgactttgacggtcgctgtggcggacagaataccagatatactggctgatctaggcagcctcgagccttcggccaaacccaacgactctgatctgacgctgtacctggttgtggccgtggcagccgtgtcatgcgtcttcctggcgttcgtcatcgtgcttctggcactgcgactgcagcgttggcacaaatcgcggctgctgcaggcctcagggggcggcttggcttccatgcctggcagtcatttcgtgggggtcgagggagtccgggctttcctccagacctactcccacgaagtcagcctgacagccgacagtaggaagtcccacctgatcttccctcagccaaactacgccgacacactgatcaaccaggagtcatatgagaaatcagagcccctcttaataactcaggatttgcttgaaacaaagggcgagccacggcaactacaacaggccccacctaatactgactggagattttcccaggcccagaggccgggcacttccggttcccagaatggagacgacaccggaacttggcccaacaaccagttcgacacagagatgctgcaggccatgatactggctagcgcatccgaagccgcggacggctcctccacactgggaggcggggctgggacaatggggttaagtgccaggtacggtccacagtttacactgcagcatgtccctgactaccggcagaacgtgtacattcctggctccaatgcaaccctgacaaatgccgcgggcaaaagagatggtaaggccccagccggtggtaacgggaacaagaagaaatctggcaagaaggagaaaaaatag

SEQ ID NO: 201949 - DNA, 2799 bp, Artificial Sequence
  Description of Artificial Sequence: Synthetic coding sequence
atggccgcccagccccggggcggcgactaccggggcttcttcctgttaagcattcttctgggtacaccctgggaagcttgggccggccgaatcctgtactcagttagtgaagagacggataaaggatcatttgtaggcgacatcgcgaaggacctcggtctagaaccacgggagctcgccgagcggggtgtacgtataatcagcagggggcgcacacagctctttgcgcttaaccagagaagcggaagcctggtgacagccgggcgcattgatagagaagaaatttgcgcacagagcgcccgttgtcttgtgaactttaacattctgatggaagataaaatgaatctgtaccccattgacgtcgagataattgacatcaatgacaacgtacccaggtttctgaccgaagagatcaacgtgaagatcatggaaaacacagccccaggagtacggttccctctgtcggaagctggcgaccctgatgtgggaacgaacagcctgcagtcttatcaactgtccccaaacaggcacttttccctggccgttcagagcggagatgatgagacaaaataccccgagctggtgttggagcgtgtgctggaccgggaggaggaaagggtgcaccatctggtcctgacagcatcagacggcggcgacccaccacggtcctcaaccgcgcacatacaggtcactgtggtcgatgtgaatgatcacactcccgtgttttctctgccgcagtaccaggtgactgtgcccgagaacgtccccgtgggcacccggctgcttacagtgcatgctattgatctcgatgagggagtgaatggcgaggtcacatattctttccgtaagataaccccgaagcttcctaaaatgttccatttgaatagcctgactggggaaatttctaccctggaaggcctggattacgaagagacagcgttttacgaaatggaggtccaggcacaggatgggccaggctccctgacaaaagcgaaagttctcatcacagtccttgatgtcaacgacaatgcacccgaggttactatgaccagcttgtccagttcaatccccgaagacactccgctgggaacagttatagcactcttttacctccaggacagggacagcggcaagaacggggaggtcacctgtaccattcccgaaaacctgccgtttaaacttgagaaatcgattgataattattatcgtctggttactactaagaacctggatagggaaaccctctcattatacaacattactcttaaggccacagacggggggactccacccctcagtagggaaacccacatctttatgcaagtagccgatacgaacgataatcctccaaccttcccgcactcatcctatagtgtgtacatagctgagaacaacccccgaggagcttccatttttcttgttaccgctcaggatcacgattctgaggataatgcccaaatcacctactccctggccgaggacacgattcaaggtgctcccgtgagctcctatgttagcatcaattccgataccggcgtgctgtatgcccttcaatccttcgattatgaacagctgcgcgaactgcagttacgagtgaccgcccatgacagtggtgacccgccactgtcatctaacatgtcccttagtctgttcgttttggaccagaatgacaatcctccagaaatcctgtatcccgccctgccaacagacgggagtaccgggatggaactggctcctagatcagcagaacccggctatctggtgaccaaagttgtggcggtggataaagattcgggtcaaaatgcctggttgtcctatttgcttcttaaggcttcagagcctggactcttcgccgtggggctgtacacgggggaggtccggacggctcgggccttgttggaccgggacgccctcaagcagtccctggttgtagctgtgcaagaccacggccagcctcccctgagcgcaaccgtgacccttactgtagccgtagccgatagcattccggaggtactagcagaccttgggagtttggagccctccgatgggccatacaattatgatctcactctgtatctcgtagtcgcagtcgctacagtgagctgcgtgtttctggccttcgttctcgtcctcctggcacttcgcctaagaagatggcacaaatcccgactactgcaggcatccgaaggtggtctcgctaatgtcccaacgtcacatttcgtgggaatggatggggtccaagctttcctgcagacatacagccacgaggtatctttgaccgcagacagtagaaaaagccacctgatctttccccaaccaaattacgtagacatgttaatttcccaggaatcttgcgaaaaaaacgactcgcttctgaccagcgttgacttccaggagtgcaaggagaacctgccatcaatccagcaggcacctccaaatactgactggcggttctcacaggctcagcgtcccggtacaagtggtagtcagaatggagatgacaccggcacctggcccaataatcagtttgataccgagatgctgcaggcaatgatcctcgcgtctgcgagcgaagccgccgacggttccagcaccctgggaggcggcgccggcaccatgggtctgagcgcaagatatggccctcagttcacactgcaacacgtacccgactatagacaaaatgtctacatccccggctccaacgcaaccctgacaaatgccgccggaaagagggacggcaaagcccctgccggaggaaatgggaataagaaaaaaagtggtaaaaaggagaaaaagtag

SEQ ID NO: 201950 - DNA, 2799 bp, Artificial Sequence
  Description of Artificial Sequence: Synthetic coding sequence
atggccgccccccagagccggccccggcggggcgagctgatcctgctctgcgccctactagggacattgtgggaaattgggagggggcagattaggtatagtgtacccgaggagactgacaaaggcagttttgtgggcaatatctccaaggatctaggactagaccctcgcaaactggcgaagcatggagtgaggattgttagccgggggcgcacccaactgttcgcgctcaatcccagatccgggtctctgatcacagcggggcggatcgatcgggaggagctgtgtgcgcagagtccacgatgcctgataaatataaacacactagttgaagataagggaaagctgttcggcgtcgagattgagatcatcgatatcaatgataataatcccaagtttcaggtcgaagatctggaggttaagataaatgagatagcagttccaggggctcgctatccattgcccgaggctgttgatccagacgtgggcgtcaattccctgcagtcctatcagctgtctccaaaccaccacttttcgctcgacgtgcagacgggcgacaacggtgccattaatcccgagctggtgctggagagggcgctggatagagaagaagaagctgctcatcatctggttttaaccgcatccgatggtggaaaacctccccgctcctcaaccgtgcgaatccatgtcactgtccttgacaccaatgacaacgctcccgtctttccccacccgatttatcgcgttaaagtcctcgagaatatgcctcctggaaccaggctgctgaccgtcaccgcttccgacccagacgaggggatcaacgggaaggtggcttacaagttcagaaagatcaacgagaagcagacacctctgttccagcttaatgagaataccggcgaaatctccatcgctaaatctcttgactacgaggagtgcagcttctacgagatggagatacaagcggaagacgtgggggccctgctcggcagaactaaactcctgatctcggtggaagacgtcaacgataaccgacccgaggttatcatcacgagcttgttttctccagttctcgaaaactctttgcccggaacagttatcgcttttctgtccgtccatgatcaggactctggcaagaatggacaggtggtctgctacactcgcgacaatcttccttttaagctcgaaaagtcaattgggaactactacaggctggtaacacggaagtacctcgatcgggagaacgtgagcatctacaatatcaccgtgatggctagtgacctcggcacacccccattatccactgaaacgcaaatcgcactgcatgttgcagacattaacgataaccccccaacctttccccacgccagttacagtgcctacatccttgagaataacttgcgaggcgcctctattttcagcctgactgcgcatgatcctgactctcaggaaaatgcccaggtcacatactctgtaaccgaggacactctgcaaggggcaccattaagctcctacatctctatcaatagcgatacgggtgtactatacgccctgcagagttttgattacgaacagattagggacctgcagcttctggtcaccgccagcgattcgggtgatcctcccctgtctagcaacatgtcgctcagcctcttcgtccttgaccaaaacgacaacgcgcccgagatcctgtatccagctcttcctaccgatggcagcaccggcgttgagctcgccccacggtccgccgaacgcgggtacctcgtgaccaaggttgttgctgtggatcgggactccggtcagaatgcatggctgagctacagacttctgaaggccagcgaaccggggctattttccgtcggcctacatacgggggaggtacgcactgcccgggccctcctggacagggatgctctcaagcagagcctggtggtcgccgtccaggatcacggtcagcctccgctgtctgcaaccgttaccctaaccgttgccgtggcagactcaatccccgaagtgctaactgaactcgggagcctcaaaccctcggttgaccctaacgattctagtctgacgctatacctggtcgtggctgtggcagcgatatcctgtgtctttctggcgttcgttgcagttctgttggggttgcgcctccgcaggtggcacaagtcacggctcttgcaagattctggcgggcgtctcgttggcgtcccagcttcccactttgtgggggtcgaagaggtccaggcattccttcaaacctactcacaggaggtctcacttacagccgacagtcgcaagagccatctgattttcccacagccgaattacgcagatatgctgatctcacaggaaggatgcgagaagaatgatagtctgctgacttcagtggattttcacgagtacaaaaacgaggccgatcatggacagcaggcccccccgaataccgactggagattcagccaggctcagcgacctggaacaagtggcagccagaacggtgacgacacgggaacatggccgaataatcagtttgacaccgagatgctgcaggcgatgatcctggctagtgcgtccgaggcagcggacggttcgtccaccctagggggaggggctggaaccatgggattatccgctcgctatggcccccagttcactctgcagcatgttcccgattatcgtcaaaatgtgtatattccaggcagcaatgcaacactgaccaacgcggcagggaagcgggatggaaaggcccccgcggggggcaacggaaacaaaaagaagtctggaaagaaggagaaaaaatag

SEQ ID NO: 201951 - DNA, 2784 bp, Artificial Sequence
  Description of Artificial Sequence: Synthetic coding sequence
atgcagcgggcccgggaggccgagatgatgaagagccaggtgctgttcccttttttgctttcccttttctgcggagccattagccagcaaatccggtataccatccccgaggaactggcgaatggctcacgtgtaggaaagcttgcaaaggacctggggctgagcgtgagggaactcccaacacgtaagcttagggtttcggcggaggactattttaatgtctcgctggaatccggtgaccttttggtgaacgggaggattgatagggagaagatctgcggacgtaaactggaatgtgcactcgaatttgaaaccgtggcggagaacccaatgaatgtgttccacgtggtcgtagtgatccaggacatcaacgataacgcaccgcggtttgtggccaaaggaattgatttggaaatttgcgagagtgcgcttcccggggtcaaattttccctggactctgcccaggacgcggacgtcgagggaaattcgttgaaactgtatacaatcaaccctaaccaatacttcagtcttagcaccaaggagtcccccgacgggagtaaataccccgtgttattactagagaagcccctcgatcgggagcaccagtctagtcatcgcttgatcttgaccgcaatggacgggggcgatcctcctctaagtgggactacccacatctggatccgcgtgacagacgccaacgataacgcccccgtattttctcaggaagtctatagggtgtctctgcaggagaatgtgccctgggggacaagcgtgctgcgagtcatggccacggaccaagatgagggcatcaatgctgagataacttacgcatttctcaattcaccgatttccacatcactgttcaacctcaatcctaataccggcgatatcacaacaaatggtacgcttgatttcgaggagaccagcagatatgtactgtctgtggaggcaaaagatggcggggtccacactgctcattgcaatgtgcagatcgagattgtagatgagaacgataacgcgccagaagtaacttttatgagtttctccaaccagataccagaggactccgacctgggcacagtgatcgccttgattaaggtgcgcgataaggacagcggccaaaacggcatggtcacctgctatacccaggaggaagtcccattcaagctcgaaagtaccagcaaaaactattataagctcgtcatcgcaggagccctcaaccgggagcagaccgctgactacaacgtgactatcatcgccactgacaaaggtaagcctgccctgtcttctcgtaccagtatcacattacatattagcgacattaatgacaacgcgcccgtcttccaccaggcatcatacgtcgttcatgtgtctgaaaataaccctcctggcgcttccattgcacaggtttccgcttccgatccggacctggggcctaatggccgagtgtcttattccattctggcctcagacttagagccaagggagctgctgtcctacgtgagcgttagcccgcagtctggagttgtgtttgcacagagagcttttgaccatgagcagctccgcgcctttgagttaacactgcaagcacgggatcagggatctccagctctgagcgccaacgtctcactccgggtacttgtgggagatcttaatgataacgccccccgcgtcctgtaccccgctttgggcccggacgggtcggccctcttcgacatggtgcctcgcgccgccgaaccaggatacttggttacgaaagtggtggctgtagatgccgactccgggcacaatgcatggttaagttatcacgtgctgcaggcctctgagcccggcctgttcagtctcggtctgcgaacaggggaagtgagaacagcaagagccctaggcgatcgggatgcagcccgccagcgcctgctggtggcagttcgagatggaggacagccacccctcagtgcaacggctacgcttcatttaatattcgctgattcactgcaggaagtactgccggatctttccgaccggcccgaaccctctgacccacagactgagcttcaattctacctagttgtggccctggcacttatttcagtcctgtttctcctcgctgtgattctggctattgcactacggctgcgtcgtagcagctcgctcgataccgaaggatgcttccagaccgggttgtgcagcaagtctggccccggtgtacccccaaatcatagtgaggggactctaccctattcttataatctatgtatcgcctctcatagcgctaagaccgaatttaattccttaaacctaacaccagagatggctccacctcaggacctcctctgcgatgatcccagtatggtggtgtgcgcctctaacgaagatcacaagatcgcatatgatccttctctttcatcccatcaagcccctccaaacacagactggcgattttcccaggcccagcgtcctggaactagtggatcccagaacggggatgacaccgggacgtggcccaacaaccagtttgatacagagatgcttcaagccatgattctcgccagtgccagtgaggcggctgacggctcatcgacactagggggcggggccggaacaatgggactttcagctcgctatggcccccagttcacccttcaacacgttcccgattacagacagaacgtatacatccctggcagcaacgccacgcttaccaatgccgctgggaaacgggacggaaaggcccccgccggagggaacgggaacaaaaagaaatctggaaaaaaagaaaagaagtag

SEQ ID NO: 201952 - DNA, 2796 bp, Artificial Sequence
  Description of Artificial Sequence: Synthetic coding sequence
atgaaggccagcagcggccggtgcggcctggtgcggtggctgcaggtcttgctgccttttctcctttcattgttccctggtgcactccccgtgcagattcgttactccatacccgaggagctcgcaaagaactccgtggtggggaacctcgctaaagaccttggcttatccgttcgggacctgccagcgcgcaaattacgggtgtcagcagagaaggagtacttcactgtcaatcctgaatctggagacctcttagtttctgatagaattgatcgcgaacagatatgtggaaagcagcctttatgcgtgctggacttcgatactgtcgccgaaaatccccttaatattttttacatagcggtgattgtacaagacatcaacgacaacacccctctctttaaacagaccaagattaaccttaaaattggcgagagcaccaaaccagggaccacgttccctctcgacccggccctggactctgacgtcgggcctaattccctgcaaagatatcatctgaacgacaacgaatactttgatctggccgagaaacagacccccgatggcagaaagtatcccgaattaattttgaaacattcgctcgatcgcgaggagcacagtttgcaccagcttgtgctaacagcagttgatggtggagatcctccccagagcggcacaactcagattcggattaaagttaccgacgctaacgacaatccacctgttttttcccaggatgtctacagagtcactcttcgcgaggatgttccgccaggcttttttgtgctgcaggtcacagccactgaccgcgatgaagggatcaacgcggagattacctacagcttccataatgtggacgaacaggtgaagcattttttcaacctgaacgaaaagacaggcgagattactaccaaagacgaccttgactttgaaattgcatcctcctatactctgagcatcgaggctaaggaccccggtgaccttgctgcccattgctccattcaggttgagattcttgacgataacgactgtgcacctgaggtaattgtgacctcagtatccaccccattgccggaggatagtcccccaggtaccgttatcgctctgatcaagacgagagacagggatagcggagagaacggtgaagtttattgtcaagtgctcggcaacgctaaatttatcttaaagtcatcatctaagaattactacaagttggtgactgatggtgcactggacagagaggagataccagagtataatttgactatcacagcgactgatggcgggaagccaccactgagcagcagcatcattgtgacactgcacatttctgatgtaaacgataacgcaccagtgtttcagcaaaccagctacatggttcatgtagcggagaacaatccccctggcgcctcaattgcccaaatcagtgccagcgatccagatctcggtccatccggccaggtctcctatagtatagtcgcttctgatctgaagccgagagagattttgtcttacgtgtcagtctccgcccagtcgggtgtggtcttcgcacagcgggctttcgatcacgagcaactccgggccttcgagctgactctgcaagcccgtgaccagggctcccctgccctgtccgctaatgtgtcattgagagtgctggtcggggacctgaacgataacgccccccgcgtgctgtatccagctttagggccggacggatccgcactgtttgatatggtccctcgagcagccgaacctggttatctggtgacaaaggtagttgcagttgacgccgacagtggacacaatgcctggttatcctatcacgtactccaggcttctgagccaggcctgttcagtctgggactgcgaaccggagaggtgcgtactgctcgcgcccttggggaccgtgatgccgcgcggcagcggctactggtggccgttagagatggcggccagccgccgctttcagctaccgcgaccctgcatttgatctttgccgactctctgcaggaggtactacctgacctctctgaccgccgtgaacccagtgatccccaggccaagctgcagttttacctagtggttgccctagcattgattagtgtgctgttttttttggcagttatcctcgccatctccctcaggctcagacttagctcacgtagcgacgcctgggattgttttcagccggggctctccagtaagcccgggcccggtgtcttgcccaattattcagagggtactctcccctacagctataacctatgtgtggcatcccaatcagctaaaacagaatttaacttcctgaacattacacctgaattggtgccggcccaggacctagtgtgcgacaacgccagctgggaacagaacaccaaccacggagctgccggagtcccatttgcctctgacacaatcctgaagcaggcccctcctaatacagactggcggttctcccaagcccaacggcctggcacgagtgggagccagaatggagatgacactggcacatggccaaacaatcagtttgatacagaaatgctgcaggcaatgattctggccagtgcatccgaggctgcggacggctcttcaactctcggtggcggggcggggaccatggggctaagtgcacggtatggaccgcaattcacactgcagcacgttccggactacagacagaacgtatatatccccgggtccaacgcgaccttaacaaacgcggcagggaagagagacggcaaagctccagcaggcggaaatggtaacaagaagaagtctggaaagaaagagaaaaaatag

SEQ ID NO: 201953 - DNA, 2772 bp, Artificial Sequence
  Description of Artificial Sequence: Synthetic coding sequence
atgggcagcggcgccggcgagctgggccgggccgagcggctgcccgtgctcttcctatttctgctgtccctattctgccctgctttgtgtgagcaaatacgctatcgcatacccgaggaaatgccgaagggctccgtcgtgggaaatttggcgaccgatttgggttttagcgtgcaagaactgccgactaggaaacttcgtgtatcatccgaaaagccatacttcacggttagcgccgaaagtggagaacttctggtctcttctagattggatagagaagagatttgcgggaaaaagcccgcctgcgccctggagttcgaggccgtagctgaaaatccgctgaacttttaccacgttaatgtggaaatcgaagacattaatgaccacacgcctaaattcacccaaaatagcttcgagttgcagatctccgaatctgcccagcctgggactaggttcatccttggttctgcacacgatgcggacattggaagcaacacactgcagaattatcagctaagcccatcggaccatttctctctcattaacaaggagaaaagtgatgggagcaagtaccccgagatggtccttaaaaccccgttggaccgtgagaaacagaagtcctaccacctgacattgactgccctggatttcggggcgccaccactgtcttccactgcccagattcacgttcttgtcactgatgctaacgataatgctccggtgttcagtcaggacgtatacagggtgtccctctctgagaacgtgtatcctggaacaaccgtactccaggtaaccgccaccgaccaggatgagggcgtgaacgcggagattaccttttcgttcagcgaggccagtcaaattacacagttcgatctcaactcgaatactggtgagattacggtgctgaataccctcgactttgaagaagtcaaagagtatagcattgtgttggaagccagggatggaggaggtatgatcgcacagtgcaccgtcgaggtggaggtgatcgatgagaacgataacgcccctgaagttattttccagtccctccctaatcttattatggaagacgctgaactgggaacacacatcgcattactgaaggtgagggataaggacagcagacacaatggtgaggtgacatgtaaactggaaggtgatgtaccatttaagatccttacttcatctcgtaacacatataaattggtgaccgacgccgtgctcgaccgtgagcagaatcccgagtataatataacagtgacagccaccgatcgtggcaagccaccacttagttccagctcctcaatcactctccatataggagacgtcaatgataacgcgcctgttttctctcagtcttcatacattgttcacgtggctgagaacaatcctcccggcgcttcaatttcgcaggttcgggccagtgacccggaccttggtccgaacggacaggttagctactgtattatggcgtccgacctggagcaaagagagctgtcatcttacgtgagcatttccgccgaatcaggcgtcgtattcgcccagcgagcgtttgatcacgagcagttgcgggccttcgaacttactctgcaggcacgcgaccagggctctccagcgctatcagccaatgtgtcactgcgagtgctggtagacgatagaaatgataacgcgcccagggtgctgtaccctgcgctggggcccgatggttcggcattattcgacatggtgcctcacgcggccgagcccggatatttggtgacaaaggtagtagcagtcgacgctgacagcggacataatgcatggctgagctatcacgtattacaggcctctgagcctggcttgttcagcctcggcctccggacaggagaggtgagaacagcacgggccctcggcgaccgggacgccgtgaggcagaggctgctggtcgccgttcgggatggcggacagccccctctgtccgccactgctactttacacctggtctttgctgatagcctgcaagaggtgctgcccgatatcaccgacaggcccgacccatctgatttacaggcggaattacagttttatctggttgtggccctggccctgattagtgtcttgttcctcgtggctatgatcttggcgatagctctgcgactgcggcgcagcagctccccagccagttggtcgtgctttcagcccggcctgtgcgtgaaatccgaaagcgttgttcctcccaattattcggagggcacgctcccgtatagttataatctctgcgtggcgcataccgggaaaaccgaattcaacttcctaaagtgctcagagcagctaagcagcggccaagatatactgtgcggcgactcttcgggggcactcttcccattgtgcaattctagtgaactaacttcacatcagcaggctccaccaaacactgattggcgtttttcccaggcacagcgcccagggacgagtggctcgcagaacggagacgatacaggaacgtggcctaacaatcaattcgataccgagatgttacaagcaatgatactcgcttccgccagtgaagcagcagacggcagcagtacacttggcggtggtgcagggacaatgggcttaagcgcccggtatggacctcagttcactctgcaacatgtgccagactaccgacagaatgtctatatccccggctcaaacgccacattaacgaatgcggcaggcaaaagagatgggaaggcaccagccggagggaatggaaataagaaaaaatccgggaaaaaagaaaagaagtag

SEQ ID NO: 201954 - DNA, 2793 bp, Artificial Sequence
  Description of Artificial Sequence: Synthetic coding sequence
atgggcggcagctgcgcccagcggcggcgggccggcccccggcaggtgttgtttcctctccttctgccactgttttatcccacactgtctgaacccatccggtacagtatccccgaggagcttgctaaggggtctgtggtaggcaacctggccaaagatcttggactgtcagtactggatgtttctgctagaaagctgagagtaagcgcagaaaagctgcattttagcgtagatgcagagtcaggagatttgctagtcaaaaatcgtatcgatcgcgagcagatctgcaaggaaagaagaaggtgcgagctacagttggaggccgttgtggagaaccctcttaacatttttcatgtaattgttgtgatcgaagatgtaaatgaccacgcccctcagtttgacaagaaggagatccatcttgagattttcgagagtgcctcagctggaactcgtctgtccctggaccctgccacagatcccgatattaacatcaattccatcaaagactacaagataaattcaaatccctatttcagcttaatggtgagggtgaatagtgatggaggaaaataccccgagctgtccttagagaagctgctggaccgcgaggaacagcgatcccacagtttaatccttacggctttggacggaggcgacccaccacggagcgccacagcccatatcgagatctccgtcaaggacacgaacgataaccctcccgtgttttcacgcgacgaatataggatttccctctccgagaacctgcctcccggtagtccagttctccaggtaaccgctacggaccaggacgaaggagtgaacgcggaaatcaactactacttccggagcactgctcagtccaccaagcacatgttctctctcgatgagaagactggcatgattaagaacaatcaaagctttgacttcgaagatgttgagcggtatacaatggaagtggaggcgaaggacggaggggggctgtcaactcagtgcaaagttatcattgaaatcctggatgagaacgataactcacccgagatcatcattacttccctctctgaccagatcctggagaactccccccctgggatggttgtcgccctgtttaagactcgcgatctagatttcggcgggaatggtgaagtgcggtgtaacatcgagacggatatcccgttcaaaatatattcaagctcaaacaattactataagctagtcactgacggagctctggatagggagcagaccccagagtacaatgtcacaatagtggccaccgatagaggtaaaccccccctctcatcctcacgttccatcactctctatgtagctgacatcaacgataacgctcccgttttcgaccagaccagttacgtggttcatgtggcagaaaacaacccacccggggcctctatcgcacaggtgtccgccagtgaccctgacctgggcttgaatggacacatctcttacagcatcgtagcaagtgacttagagccactggccgtctcaagctatgtatcagtatcggctcagtccggggtcgtatttgcccaaagggctttcgatcacgagcagctgcgcgctttcgcactcacattgcaagctcgcgatcacggttctcctaccctgtctgctaatgtgagccttagggttcttgtgggggatcggaacgacaatgcacctcgtgttctgtatcctgcgctcggccccgacgggtcagccttctttgatatggtccctcgctccgcagagcccgggtacttagtaacaaaggtcgttgccgtagacgccgatagcggccacaatgcctggctttcatatcatgtcttgcaggcctctgaaccgggcctgttttccctcgggctcagaaccggcgaagtgagaacagcccgggctctcggggatagagatgctgcccgacagcggctgcttgttgccgtccgtgacgggggccaaccaccgctgagcgcaactgccacgcttcacctggtgtttgccgataacctccaggaaattctgcccgatctctcagaccgccctgtattgtcagatccccaagcggagctgcagttttacttggtagttgccctggcgcttatctccgtgctattcttgttggctgtgatccttgccatcgcccttaggttacgaagatcactgtctcctgccacttgggattgtttccaccccggtctctgtgtgaagtcgggtcctgtcgtaccacctaactacagcgagggcacgttgccttactcttataacctgtgcattgcccataccgggacaaaggaattcaacttcctaaaatgcagcgtgcccctccacagcaatgaggacatggtttgttccgtgtcacccggagctctgatccctccacacggcggagaggatctcacatcccaccccgaaaccctgacttcacaagccccccctaatacagattggcgtttctctcaggcacagagaccaggaacttcgggtagccaaaatggggatgacaccggaacgtggcccaataaccaatttgatacggaaatgcttcaggccatgatacttgcttcggcctcggaagcagctgacggatcctcaaccctaggggggggggctgggaccatggggctttccgccaggtatggtccacagtttaccctacagcatgtgcctgactatagacagaacgtgtacatccctgggtcaaacgccactctgaccaacgcggcaggaaagagggacgggaaggcacctgctggaggcaacggaaacaaaaagaagtctgggaaaaaagaaaaaaaatag

SEQ ID NO: 201955 - DNA, 2790 bp, Artificial Sequence
  Description of Artificial Sequence: Synthetic coding sequence
atgggcggcagctgcgcccagcggcggcgggccggcccccggcaggtgctgttccctttgctgttgcctctgttctacccgaccctgtgcgaacccattcggtacagcatccctgaagagttggccaaagggtctgttgtgggaaaccttgctaaggacctggggctctctgttttagacgtaagcgctcgcgaactgcgcgtaagcgcggagaaactgcattttagcgtggacgcccagtccggagacctgctggtcaaggataggatcgacagggaacaaatttgcaaagagagacgaaggtgcgaactccaattagaggccgttgttgagaacccgctgaacatcttccatgtgattgtcgtaatcgaggacgtcaatgatcatgctccacagttccggaaggacgaaattaacctcgaaatcagcgaatccgtttcactcggaatgggtaccatcttggagagcgccgaggaccctgatatctccatgaactcgctgagtaagtaccaactgagtcccaatgagtatttcagccttgttgagaaggataatcctgatggtgggaagtatccagaactggtgctgcagaagaccctggacagagagactcagtctgcgcatcatctcgtactgaccgcactggatggcggcgatccaccccggagcggcaccgcacagatacggattttggtgatcgatgcaaatgacaacccacctgtttttagccaagacgtttatagggtcagtcttagggaagacgtaccacccgggaccagcatcctgagagttaaggctaccgaccaggacgagggaattaatagcgagattacctatagtttttttggcgtcgcagacaaagcccagcatgttttttcgcttgattatacaacagggaacatcctgacccagcagcctctggactttgaagaagtggaacgctacaccattaacattgaggccaaggatcgtggctccctttccacaaggtgtaaagtgattgtggaggtcgttgacgagaatgataattctccagagatcatcatcaccagcttgagtgaccagataatggaggattctcctccaggcgttgtcgtcgcgttgtttaaaacacgtgaccaggacagcggtgaaaacggcgaggtgaggtgctctctctctagaggagtgccctttaaaattcattccagctcaaacaattattacaaactggtcactgatgaggcactggaccgcgagcaaacacccgagtacaatgtaactattgccgccaccgatcggggcaaaccaccgctttccagttctaaaaccatcacgctgcatatcactgatgtcaatgataatgcaccagtgtttggccagagcgcttatctggtgcatgtcccagaaaataatcagcccggcgcatcgatcgcccaggtatctgctagcgatccagatttcggcctgaatggacgggtctcttatagtcttatcgctagcgatcttgagagccggactctttcaagctacgtgagtgtttcagcccagtccggcgtggtttttgcccagcgagcctttgatcatgagcagctacgtacatttgagctgaccttgcaggctcgagaccaaggctcacccgctctgtccgccaacgttagtctgcgagtgctcgttggcgatcggaacgataacgcacctagggttttgtacccagctctggggcccgatggctcagcgctgtttgataccgtgcctcgggctgcgcagccggggtacttggtgaccaaagtagttgcagtagacgcagattctggacacaacgcttggctgagttaccacgtagttcaggcaagcgagcctggcctcttctctctgggactcagaacaggcgaagtgcgcatggtccgcgcacttggggacaaagacagcgttcggcaacgtcttctggttgctgtcagggatggtggccagccgcccttgtccgctaccgccacgctgcaccttgtgtttgcagatagcctgcaggaagtccttcccgacttttcggaccaccccacaccctccgactctcaggcagagatgcagttttatttggtggtagcactcgccctgatctcggtcctgttcttgctggctgtgatcttggcaattgctctgcgccttaggcagtccttttcacctaccgcaggcgactgcttcgagtcagttctgtgttccaaaagcgggccagtgggtccacccaactatagtgagggcaccctcccatatgcttacaatttctgtgtgcccggagaccagatgaatcccgagtttaatttttttacgagtgtggaccattgtccagccactcaagacaatctcaacaaggattctatgctgctggccagcatcttaacgccaagcgtggaagctgacaagaagatccttaagcagcaagctccacctaatacggactggcgattctctcaggcccagcggcccggtacatctgggtcacaaaatggtgacgacaccggcacttggcccaacaaccagtttgatacggagatgctccaagctatgatcctcgcctctgcctctgaagctgcagatggctccagcaccctgggtggaggcgcaggcacaatgggccttagtgcccgctatggacctcaatttaccctacagcacgttcctgactacaggcagaacgtgtacatccctggatctaacgccaccctcacgaatgccgcaggtaaaagggacgggaaagcaccggcgggcggcaacggcaataagaaaaagtcaggcaagaaggagaaaaagtag

SEQ ID NO: 201956 - DNA, 2805 bp, Artificial Sequence
  Description of Artificial Sequence: Synthetic coding sequence
atggtgcccgaggcctggcggagcggcctggtgagcaccggccgggtcgtgggagttttgctcttacttggcgctctgaataaagcctccactgtaattcactacgaaatcccagaggaaagagagaagggttttgctgttggcaacgtagttgcgaacttaggactggacctcggttcactgtcagctcgaagatttcgcgtggtgtccggggcctctaggagattctttgaggtgaaccgcgagaccggagagatgtttgtaaacgaccgacttgatagagaggagctctgcggcaccttaccttcatgtaccgttacacttgaactggtcgttgagaaccccctcgaactgttctccgtggaggtggttattcaggacattaacgacaataaccccgctttccccactcaggagatgaagctggagatctctgaagctgttgcccccggcaccaggttccctcttgaatccgcacacgatcccgacgttggatccaacagcctgcagacttatgagctgtctagaaacgaatacttcgcgctgagagttcagacccgggaggactccaccaaatacgcggagctcgtcctggagcgcgctctcgaccgagaacgagagccttccctacagctggtgcttactgctctggatggtggcacgcctgcgctgagcgcctctcttccgatccacataaaggtcctggacgctaacgacaacgcacccgtttttaaccaatcactttacagggctagggttctcgaagacgccccatctggcacacgggtggtgcaagtgctggccactgacctcgatgaaggacctaatggagaaataatatactccttcggaagccacaaccgcgccggcgtgagacagttattcgccctagacctcgtgactggcatgctgaccataaagggaagattagactttgaggacaccaagctgcatgagatctatatccaagccaaagacaagggagctaatcccgagggagctcattgtaaagtccttgttgaagtcgtggacgtgaatgacaatgccccagagatcacagttacctctgtgtacagtccagtcccagaagacgctccccttggtaccgtcattgccctgctttcagtaacggatctcgacgcgggcgagaatggcctcgtaacctgcgaggttccgccggggctgccattctctctcacatcatcactaaaaaactacttcacgcttaagacgtctgctgaccttgatcgtgaaacggtgccagaatacaacctatccatcacagctagagatgcaggaacaccttcgctgtctgccctgacgattgtcagggtacaggtgagcgatatcaacgataatccccctcagagttcccagagctcctacgatgtgtatatagaagagaacaacctccccggggcaccaattctgaatttgtctgtgtgggatcccgatgcaccacagaatgctaggctgtcgttcttcttgctcgagcagggcgccgaaactggattggttggacgctatttcacaattaatagagataatggcatcgtctcttcccttgtgcctcttgactatgaggaccgacgagagtttgagctgactgcccacattagcgacggtggtacccctgtgctcgccaccaatatctcagtgaatatatttgtaaccgaccggaatgacaatgcgccccaggtgttgtatcccaggcctggggggtccagcgtggagatgctgcccaggggcacttccgctggacatctcgtgagccgggtcgtcggctgggacgcagacgccggccataacgcttggctctcatattctctgctcgggtcaccaaaccagtcattatttgcgattggccttcatactggccagatcagtacagcaaggccagtccaggataccgatagcccaagacagactttgacggtgctgatcaaagacaatggagaaccttccctgtctacaactgcgacactgacagtgtctgtgaccgaagactcccccgaagctcgtgcggagtttcctagcggcagtgcccctcgcgagcagaagaagaatctgacgttttatctactgctttcacttatactggtttccgtgggctttgtcgtaaccgtgtttggggtgataatctttaaggtgtacaagtggaagcagtccagagatctgtaccgtgccccggtgtccagcttatatcgtacgcccggcccgagtttacacgctgacgcagtcagggggggcctgatgtccccccacttgtatcatcaggtatacctgaccactgattctcgacgctctgatcctctactaaagaagccaggcgccgcctcaccactcgccagcagacagaatactcttcgctcctgtgaccccgtattttacagacaagtgctcggtgccgagtcagcaccacctggccaacaggcaccccctaacacggattggcgattttcacaagcccaacggcctggaacctcaggatcacagaacggagacgatacgggtacttggcccaacaaccagtttgatacagagatgctgcaggccatgatcctggcttccgcgtctgaagccgcagatgggagttcaaccctggggggaggcgccggcaccatgggtctgagtgcaagatatggtccgcagtttacgctccagcacgtccctgactatcgccagaatgtctatatccccggctccaacgccactctgacgaatgccgccggcaaaagagacgggaaagctcccgctggcgggaacggcaataagaagaagagcggcaagaaggaaaaaaagtag

SEQ ID NO: 201957 - DNA, 2817 bp, Artificial Sequence
  Description of Artificial Sequence: Synthetic coding sequence
atgctgcggaaggtgcggagctggaccgagatctggcggtgggccactcttttgttcttgttctaccatctagggtacgtttgtggacaaatccgctaccccgtcccggaggagagtcaggaaggaacattcgtgggaaacgtggctcaggacttcttactagacacagattctctcagcgcacgaaggctgcaggttgcaggcgaggtgaaccagagacacttccgggttgaccttgactccggggccctattgatcaagaatccaatagaccgcgaggctctgtgcggcttgagcgccagctgcattgtgcccttggagttcgtgacagaagggccactcgagatgtatagagctgaggtggagatcgtcgacgtgaatgatcatgctccacgatttcccagacagcaactggatctagagatcggcgaggctgcaccacctggccagaggttccccctggaaaaagcccaggatgcagacgtgggatctaactcaatatccagttatcgactgagctccaacgaacacttcgccctggatgtgaagaagaggtcagacggctcattagtccccgagttacttttagaaaaacccttggatagggagaaacagtcggattaccgcttggtgctgactgcagtggacggcgggaacccgccgagaagcggcacggccgagctccgcgtgtctgtgctcgacgtgaacgacaatgccccagctttccaacaatcctcatatagaatctcagtactggagagcgctccggcgggtatggtcctgattcagttaaacgcatctgacccagacctgggaccttctggaaacgttaccttttacttttcaggtcacacccccgaccgagtcaggaatctattcagcctgcaccctacaactggaaaactgacgttgctaggccccctggatttcgagtccgagaactactacgagttcgatgtaagagccagagatggcggcagccctgctatggaacagcattgtagccttagggtcgatctgctggacgtgaacgacaacgcgccctacatcactgtgacaagcgaactcgggacattgcccgagagtgccgagcccgggacagtggtagccctcattagcgtacaagatcccgacagtgggagcaacggtgacgtctcgctgagaattcctgaccaccttcctttcgccctcaagtccgcttttcgcaaccagttttctttggtgacggccggcccccttgacagagaagctaagtccagctatgacatcatggtcactgcctccgatgctggcaacccacccctcagcactcaccggaccattttcttgaacattagtgatgtcaatgacaaccctcctagcttctttcagcgtagtcatgaggtgtttgttccagagaacaacaggccgggagaccttctctgttccctagccgcctctgaccctgactccgggctgaacgcactgatttcttactctctgctggaaccacggaatcgtgatgtgtcggcaagtagtttcatatctctaaatccgcagacaggcgcagtgcatgctactagatcttttgactacgagcaaacacagaccctgcagtttgaagtacaggcgcgcgacaggggcaatcctccgttatcatccacagtcaccgtacgcctgtttgttctcgatctcaacgataatgctccagccgtgctccgcccacgggcccggcctggctccctgtgccctcaggccttaccacccagcgtgggggccggacaccttatcacgaaggttacggccgtagacctggattctggatataatgcctgggtgagttaccagttactagaagctcctgatcccagtctctttgctgtgtcacgatacgcgggggaggtgaggaccgccgtacccattcccgccgaccttcccccacagaagttggtcatcgtggtgaaagactctgggagcccccctttgagtactagcgttactctgctagtgtccctggaagaggacacccaccccgttgtgcccgacctcagagagtcaagcgcgcctagagagggggaatccaggcttacattgtaccttgcagtgtcattggttgctatctgcttcgtcagcttcgggagcttcgtcgcattactgtctaagtgtttacgcggtgctgcctgcggcgtcacctgtttccctgctggcacctgtgcctgtctgactaggagcaggcgcagagagggactgcctccatccaatggtatcctgagaattcaattgggatccgacgatccaatcaagtttgttgacgtgggcggacactcacatgggtgcactcccctggccagcgcacccaccaggagtgatagcttcatgatggttaagagcccgtccgctccaatggccggggagccagtaaggccgtcctgtcctcctagcgatctgttatacggactcgagcaagcccctcccaataccgattggagatttagtcaggcccaaagaccaggcacttcaggctctcagaatggcgatgatacagggacttggcctaataatcagtttgacaccgagatgctccaagccatgatcctggcctctgcatctgaggcagccgatggcagcagcacgctaggcggtggcgcaggcactatgggcctgtccgcacgctatggtccacaattcacactgcaacatgtacccgactaccgacagaatgtgtatattcctggtagcaacgctacactgaccaatgctgctgggaagagggatggtaaagcccccgctggcggtaatggtaacaaaaaaaaatctggtaagaaagaaaagaaatag

SEQ ID NO: 201958 - DNA, 2835 bp, Artificial Sequence
  Description of Artificial Sequence: Synthetic coding sequence
atgggccccaagaccctgccccagctggccggcaagtggcaggtgctctgcatgctgagtttgtgttgttggggttgggtgtctgggcagctgaggtactccgtggtagaagagtccgagcctggtacactggtgggcaatgtggcccaagatcttgggcttaaaatgaccgacttgctgagtagacgcctgcaattgggaagcgaggagaatggccgatacttttcactctcacttatgagcggggcactagctgtgaaccagaaaattgatagggagtccttatgcggtgcttcaactagctgccttcttcccgttcaagttgttacggagcatcctctggaactgattcgagttgaagtagagatcctggacctgaatgacaacagccctagttttgcgacaccagagcgtgaaatgcgcatatccgagtccgcggcttcgggggcacggttcccattggactccgcccaggaccctgacgtcggtactaacacagtgtccttctatacgttgtcaccgaattctcatttttcccttaatgtcaaaacactgaaagatgggaagccattccctgagctggtgctggaacagcagcttgacagagaggcccaggcaaggcatcagttggtcctaaccgctgttgatgggggaaccccagccaggtctggaacaacactaataagcgtaatcgtgctcgatattaacgataatgctcccacgttccagtctagtgtgctgcgggtgggaatccctgaaaacgctcccatcgggacattgctcctacgcctgaacgcaacagatcctgacgagggcacaaatggtcaactcgactactcttttggtgatcacacatcggaggccgtccggaatctgtttggacttgaccctagcagcggggctatacacgtactgggtccaatcgacttcgaagagagccgtttttatgaaattcacgcccgagcccgggaccagggccagcccgctatggaggggcattgcgtgatccaggtagatgtgggtgacgtgaacgataatgcacccgaagtgcttttagcctcgctggccaacccggtactggaatccacccccgtaggaacagtcgttgggttgttcaatgtgcgcgatagggatagtggacggaacggcgaagtgagtttggacatctcgccagatcttccatttcagatcaagccatctgagaatcactactccctgctgacgtcgcaacctctggaccgggaagctacctcacactatattatcgagttgctggcatccgacgctggctctccgtctctgcacaaacacttgactattagactgaatatttctgacgttaacgacaacgcgccacgattcaatcagcagctgtataccgcttacatcttagaaaataggcccccaggctccttactatgcactgtggctgcttccgaccccgatacaggcgacaacgccaggcttacatattccattgttgggaaccaggtgcagggcgcccctgcatctagctttgtgtacgtcaaccccgaggacggacgaatttttgcacaaaggacgtttgattacgaattgctgcagatgctccaaatcgtggttggcgtgagggatagtggctcaccaccacttcacgctaatacctcactgcacgtgtttgtgctggatgaaaatgacaatgcacccgcagtgctacaccctcggcccgactgggagcatagtgctccccagcgacttcctcgatccgccccaccaggctcactggttacaaaggtaaccgctgtcgacgccgacgcaggacacaatgcctggctgtcatatagcctgctgccacagagtactgctcccggtctgttcctggtgtccacccacactggagaagtgcggactgcgagagctctcctggaggacgattctgacacccagcaggtggtagtccttgtgagagacaatggtgacccctctctctcgtctacagcaacagtgctcctggttctagaagatgaggatcctgaagaaatgccgaagtcctcagatttcttgattcatcctccagagcgaagcgatttaaccctgtacctcatcgttgctctggctactgtttccctactcagcttagtgacctttacattcctgtctgccaagtgtttgcagggtaatgcagacggggacggggggggagggcaatgttgtcgcaggcaggactcaccatctccggatttttacaagcaatccagccctaatctgcaagtcagctcagatggcactttgaaatatatggaagtgacactgcgacccactgattctcagtcccattgttatcggacttgtttttccccagctagcgacggcagcgatttcaccttcctgcggcccttgtctgtgcagcagcctacagccctcgccctagagcccgatgcgattaggagccgttccaatactctgcgcgagcgatctcagcaggcgccgcccaacacagattggcgattctcacaagcccaaaggccgggcacctccggttctcagaacggagacgacacgggcacatggcctaataatcaattcgacaccgaaatgctccaagcaatgatcttggcttctgcctccgaggcagccgatgggtcatcgactttgggcggaggggccggcaccatggggcttagtgcccggtacggaccccaatttaccctccagcacgtgcccgactacaggcagaacgtctacatcccaggcagtaatgctaccttgacaaacgccgcagggaagagggatggaaaggctccggccggggggaacggcaacaagaagaaatcaggcaaaaaggagaaaaaatag

SEQ ID NO: 201959 - DNA, 5868 bp, Artificial Sequence
  Description of Artificial Sequence: Synthetic coding sequence
atgttccggcagttctacctgtggacctgcctggccagcggcatcatcctagggtccttgtttgagatatgcctgggccaatatgacgatgactgtaagctagcgagaggaggccccccagctacaattgtggccattgacgaggagagcaggaatggtaccattctggtggataacatgctgattaagggaaccgcaggcggccctgatcctactattgaacttagcttaaaggataatgtagactactgggtgttgatggaccctgtgaagcagatgctgtttctgaattctacagggcgtgtccttgatagagacccccctatgaatatccactcaatcgtggtacaggtacagtgcatcaacaagaaagttgggaccatcatatatcacgaagtcagaatcgtcgtgagggacagaaatgacaactcacccacatttaaacacgagtcctattacgccactgtgaatgagctgactccagtcgggactacaattttcaccggatttagcggcgataatggcgctacagatatcgacgacgggccgaacggccagattgagtatgtgatccagtacaatccagatgaccctacatccaatgacacctttgagatccccctgatgcttacagggaacattgttctcaggaaacggctcaattatgaggataaaacgaggtattttgtgattatacaggccaacgatagggcccagaatttgaatgagcggcgtaccacaacaacgaccctcactgttgacgtattggatggggacgacctgggacctatgttcctcccctgcgtgctggttccgaatacgcgggattgtagacccctcacttaccaggctgccatacctgagctgcgcacaccggaggagctgaatccgatcattgtcactccccccattcaggctattgaccaggatcggaatatccagcctccctcagacaggccaggcatcttgtattctatcttagttggaactccagaagattatccaaggttctttcacatgcaccccaggacggccgaactgtcactcctggaaccagttaacagagattttcaccagaaattcgatttagtcatcaaagccgaacaagataatggacacccacttccagccttcgccggcctacacatagagatactggacgagaacaatcagagcccttatttcacaatgccatcttatcaggggtacatcttggagtcggctcctgtaggtgctacaatctccgatagtttaaacctcacctccccgctccgcattgtcgctctggataaagacatagaggatactaaggaccccgagttacacctgtttctcaatgactataccagcgtgttcaccgttacacaaaccggaatcactcgttaccttaccctattgcagcccgttgatcgcgaagagcagcagacttacaccttttccataacggccttcgacggcgtccaagagagtgagcctgttatcgtcaatatccaagtaatggatgccaacgacaacacgcccaccttcccagaaatctcatacgacgtttacgtctacaccgacatgcggccaggcgatagcgtcattcagttaaccgctgtggacgcagatgaaggaagcaacggtgaaatcacatatgaaattctggttggagctcagggtgattttatcatcaataaaacaacaggcctgatcactatcgcacccggtgttgagatgatcgtgggcagaacttatgcactgacggtgcaggcggcagataatgccccccccgcagaaaggagaaactccatttgtacagtctatatcgaggttctgcctccaaacaaccaatctccaccgcgcttccctcagctgatgtattcactggagatcagcgaagcaatgagagtgggggccgtgctcctcaatcttcaggccacggatagggagggggactcaattacatatgccattgagaatggtgatccccagagggtattcaacctgtcagaaacgacaggtatcttgacgctaggcaaagcactcgacagggagtcgacagacaggtatatactgatcattactgcttccgacggcaggcccgacgggaccagtaccgctacagtcaacatcgtggttacagacgtaaatgataatgcacctgtctttgacccgtaccttccgagaaacctgtcggtggtggaggaagaggccaatgcattcgtagggcaggtgaaggcaacggacccagacgcaggaattaatggccaggtgcactattccctcggtaactttaacaatctttttcggatcaccagcaacgggagcatatacacggctgtgaaactgaatcgagaagtgcgcgattattacgagctcgtagtcgtggcgaccgacggggccgtccatcccaggcattccactctgacgctcgccataaaggtgctggatattgacgacaattctcccgtattcacgaatagcacttacaccgtcctggtggaggaaaacctgcctgccggcaccaccatactgcagatcgaagcaaaggatgttgatctcggggccaacgtgtcctaccgcatcaggagtcctgaggttaaacactttttcgctctgcatccattcacaggcgaactgagtctcctgcgctctctagactacgaggcttttcctgatcaggaggcctccatcaccttcttagtggaggccttcgacatttatgggaccatgcccccaggcatagccaccgttactgttatcgtgaaggacatgaatgattacccaccagttttttcaaaacggatttacaaggggatggtggctcccgatgccgtaaagggtactcccattactaccgtgtatgccgaagacgcagatccacccgggctgcctgcatccagggtacggtaccgcgtggacgacgttcaatttccataccccgcatcaatcttcgaagtggaggaagactcaggcagggtcattactcgggtgaatttaaacgaagagccaaccacaatatttaaactggtggtggtggcttttgatgacggagagccggtgatgagctcgtctgcaactgtgaagatcctagttctgcacccaggtgagatcccaagatttactcaagaggaatatcgccctcctccagtatcagaacttgctactaaaggcaccatggtcggagttatttcagctgcggccattaaccagagtatcgtttactccatcgtgagcggaaacgaggaagacaccttcggcatcaacaacatcaccggcgtgatttatgtaaatggcccgctggactacgagacaagaactagctatgtgctgcgggtgcaggcagattcgctggaggtcgtgttagccaacctccgggtgccttctaaatcaaacactgcaaaggtgtatattgagatccaggatgaaaataaccatccaccagtgtttcagaaaaaattctatattggaggcgtgagtgaagacgcccgtatgttcacatctgtcctgcgtgtgaaagccaccgataaggacaccggaaactactccgtgatggcttacaggctgattattcctcctataaaggaaggaaaagaaggtttcgtggtggaaacatatacaggattaattaagaccgccatgctgttccataacatgcgtagatcctattttaaattccaggtgatcgccacggatgattacggcaaaggtctgtccggtaaagccgacgtgttagtttcggtggtgaaccagctggacatgcaagttatcgtatcgaacgtaccaccaactttagtggagaagaagatcgaggatttgaccgaaattctcgataggtacgtgcaggagcagattccgggcgctaaagtggtcgtggagtccattggcgcaagacgccacggcgatgcattttcattggaagattacacaaaatgtgacctgacagtctacgccatagacccccaaacaaatcgagctattgaccgcaacgagcttttcaaattcttggacggcaagctcctagacatcaacaaggactttcaaccttattatggagaggggggaagaatactggagattaggacgcccgaagcagtgacgtccattaagaaacgcggtgagtcactgggatataccgagggtgctctgttagctcttgctttcattatcattctctgttgtattccggccatcctcgtggttctggtgtcttatcggcaatttaaggtgcggcaagccgaatgtacaaagactgcacggattcaggctgcgctgccagccgccaagccagccgttcctgcacccgcccccgtggccgcgcccccgccacccccgccacctcctcccggcgcacacctctacgaggaattgggggattcatccatccttttcctcctgtaccacttccaacagtctcggggcaataattctgtcagcgaggatagaaaacaccaacaggttgtcatgccttttagctcgaacaccatcgaagcccacaagagtgcacatgtcgatgggagcctgaagtctaataagcttaagtccgctagaaaattcacctttctctctgacgaggatgatctctccgcacacaaccctctttataaagaaaatataagccaagtttctaccaattccgacatctcccaacgaacagatttcgtggaccctttctcccctaaaatccaggctaaatcgaaatccctacgtggccccagagaaaaaattcagcggctatggtcccagtctgttagcctccctcgtaggctgatgaggaaggtgcccaacaggccagagatcatcgacctccagcaatggcaggggactcggcagaaagctgaaaatgagaatactggcatctgcaccaacaaaagaggtagttcaaatcccctcctcactacagaagaagctaacctgaccgaaaaggaggaaataagacagggcgaaactttaatgattgaaggaaccgagcagttgaagtccctgagcagcgactcttccttctgtttcccgcgcccccactttagtttctctacgcttccaacagtgtccagaacagtggagctgaagagcgaacccaacgtgatctctagccctgccgagtgcagcctcgagctgagtccctctagaccctgcgtattacactcttctctttctcggagagagaccccaatatgcatgctgccaattgagactgagaggaatatattcgagaatttcgcacatccaccaaacataagcccgtctgcttgtccattgccgccgccgcccccgatcagtcccccttctcccccaccagcccccgctcctttggccccaccacccgacattagtccattttcactgttctgtcctcccccaagtccaccgtcaatcccgttacccctccccccaccaacgtttttccccttgagcgtgtcaaccagtggcccccctacacctccccttctgcccccatttccaaccccattacctccaccaccgccatccatcccttgtccaccgccaccttccgcctcattcttgtctactgaatgtgtgtgtattactggggtgaaatgtaccactaacctaatgcccgcagagaagataaaaagcagcatgactcaactttccactaccacagtttgcaagacagatccccagcgggaacctaaaggcattctcaggcatgtcaaaaacctggctgagctggagaaaagtgtcgcaaatatgtactcccaaatagagaaaaattatcttcgtaccaatgtgagtgaactccaaacaatgtgtccgtctgaggtgactaacatggaaattacatcagaacagaataaaggtagcctgaataacatcgtagaaggaaccgagaaacagagccatagccagtctacctcactgtag

SEQ ID NO: 201960 - DNA, 5874 bp, Artificial Sequence
  Description of Artificial Sequence: Synthetic coding sequence
atgttccggcagttctacctgtggacctgcctggccagcggcatcatcttaggctccctctttgagatttgtttaggacagtacgatgatgattgcaagctggcccgcggagggccaccagccaccattgtggccattgatgaggagtcccgcaatggcacgatactagtggataatatgcttattaaggggaccgctggtggtcctgacccaacaatcgagctatccctaaaggacaacgtggattactgggtgctcatggatcccgtaaagcagatgttatttctgaactccaccggccgtgtcctggaccgggacccccccatgaatattcattccattgtggttcaagtgcagtgcattaacaaaaaagtgggcaccatcatttatcacgaagttagaattgtcgttagagaccgaaatgacaacagtccaacattcaagcacgagagctattatgccactgtgaacgagctgactcccgtaggcacaaccatttttaccggcttttccggcgacaacggggccacagatattgatgatgggccaaatgggcagatcgaatatgtgattcagtataacccagacgatccaacttcaaacgatacatttgaaataccactgatgctgaccgggaatatcgtgcttcgtaaaagactcaactatgaagataagacaagatacttcgttattattcaggccaacgatagagcgcagaaccttaacgagcgaaggaccactaccacaacactgaccgtggatgtgttggatggagatgacctgggccccatgtttttgccttgtgtgttggtccccaatacccgggattgcagaccccttacgtaccaggcggcaatccctgagctccgtactcccgaggaattgaatccgataattgtaacaccccctatacaggcaatagaccaagaccgaaatatccagccaccatcggaccggccagggatcctctacagcatactcgttggaacccccgaagattacccccggtttttccatatgcatccccgaaccgctgagttgtctctgttggaaccagtgaatcgtgactttcaccagaaattcgatttggtgatcaaggctgagcaagacaatggccatcccctgcctgccttcgctgggctgcatatcgagatcttagatgagaacaaccagtccccctactttactatgccatcctatcaggggtatatactcgagtctgcaccagtcggagcgactatatccgattccctgaatctgactagcccgctccgaattgtcgcactcgacaaggatatcgaagacacaaaggaccccgagctgcatctgtttctgaacgactatacaagcgtctttacagtcacccagaccggcatcactaggtatctgacccttctgcagcccgtcgatagagaggagcagcaaacttacaccttctctataaccgcattcgatggggtgcaagagtccgagcctgtgattgtaaatatccaggtcatggacgcgaacgacaacacaccaacatttccagagatctcctacgatgtctatgtctacaccgacatgaggccaggcgattccgtcatccaactgaccgcagtcgacgcagacgagggttcaaatggtgagatcacttatgaaatcctcgtgggagcccaaggagattttattattaataagaccaccggcctgatcacgatagcccccggtgtcgaaatgattgttggtcgaacttacgcactgacggttcaggcagcagacaatgcccctccagctgagagaagaaactctatctgcacagtctacattgaggtcctgccccccaacaatcagagccctccacgtttccctcaactgatgtattccttggagatctctgaagctatgcgagtcggtgctgtgcttcttaacctgcaggccacggacagggaaggtgacagcataacatatgctatagagaacggtgatccccagagagtatttaatctgtctgagaccacaggcatcctcaccctgggtaaagctttagacagggagtctactgaccggtatatactgataatcacagcctccgacgggcggcccgatggcacctctaccgcaactgttaacatcgttgttaccgatgtaaacgataatgctcccgttttcgatccttacctgcctaggaacctatctgtggtggaagaggaggctaacgcctttgttggccaggtgaaagccaccgacccagacgccggaattaatgggcaggtacactatagcctcgggaactttaacaatttgtttagaataaccagcaacggcagcatttacacagcagttaagctaaaccgcgaagtgagagactattatgagctggtcgtggtggcaacggacggcgccgtgcaccctagacactcaactctgacccttgcgatcaaagtgctggatatcgatgacaattctccagtatttacgaatagtacgtacaccgtgctcgtggaagaaaatttgccagcaggaaccaccattttgcaaatcgaggccaaggatgtggacctaggagcaaatgtctcctacagaatccgtagccctgaagtaaaacacttcttcgcccttcaccctttcacgggtgaattgtcgcttctgcgaagtctggattatgaggcttttccagaccaggaggcctccattaccttcctggtagaggctttcgatatttacgggacaatgccaccaggaatcgctactgtcaccgttatagtcaaagatatgaatgactaccctcctgtgttttccaaaagaatttataagggcatggtcgcccctgacgctgtgaagggaacacccattacgactgtttacgcagaggacgcagacccaccgggactgccagcttctagggtcaggtatagagtagacgacgtccaatttccctaccctgccagcatcttcgaagtggaggaggattctgggcgagtgatcacacgagttaaccttaatgaggaacctacaacaatcttcaaacttgtggttgtggcctttgacgatggagaacctgtgatgtcgtcatccgcaaccgtgaagatcttggttttacaccctggggagatccctcggttcacccaggaggagtaccgaccccccccggtgtccgaactggctactaaaggaacgatggtaggcgtcatctccgcggcggcaatcaaccaaagcattgtttacagcatagtaagcggaaatgaagaggatactttcggaattaacaacattacaggagttatctatgtcaacggccctcttgattacgaaacaagaacaagttacgttctgagggttcaggccgactcactcgaggtggtcttggccaaccttagagtcccaagcaaaagcaatacagccaaagtttatatagagattcaggatgagaataaccatcccccagtattccagaagaagttctatattggcggcgtgagcgaggatgcacgcatgttcaccagtgtgttgagggttaaggccacagacaaggacaccggcaattattccgtgatggcatatcgcctgattatcccccccatcaaggagggcaaagaaggtttcgtggtagaaacctataccgggctgattaagacagcaatgcttttccataacatgcggcgctcttactttaagtttcaagtcattgccacagacgattacggaaaaggtctctctggcaaggcagatgtgctggtcagtgttgtcaaccagctggatatgcaggttattgtttcaaatgtgccgcccaccctggttgagaagaaaatcgaagacttgactgagatcctggacaggtatgtgcaggaacagatccccggggctaaagtggtcgtggagtccattggcgctcggcgccacggggacgcctttagtcttgaggactacacaaagtgcgacctgacggtctacgcaatcgacccacagactaaccgcgcaatcgaccgtaacgagttgttcaagttcctggacggaaagttacttgacatcaacaaggactttcagccgtactatggagagggcggacggattttggaaatccgtactcctgaagcagttacctctatcaaaaaaaggggcgagagtctgggctacaccgagggagctcttttagccctcgccttcatcattattttgtgttgcattcccgcgatcttggtcgtgctggtgagctatagacagttcaaggtccgacaggcggaatgcaccaagacagccaggatccaggcggcactgcccgctgcaaaacccgccgtgcctgcacctgccccggtagcagctccaccccccccacccccaccccccccaggagcacacctgtacgaggagctcggcgattcttccatgcacaatttgttcctactctaccatttccagcagtctcgaggcaacaactccgtatccgaagacaggaagcatcaacaagtggtgatgcctttttcatccaacaccattgaggctcacaagagcgcgcatgtagatggatccttaaaatctaacaaactcaagtcagcaaggaagtttacattcctgagcgacgaggatgacctctctgcccacaatccactctataaggaaaacatttcacaggtctctaccaacagcgatattagccagcgtacggactttgtggatcctttttctcccaagatccaggccaagagcaaaagtctaaggggtccccgcgaaaagatccagaggttgtggtctcagtctgtgagcctgcccagacgtttgatgagaaaagtgcccaaccgccctgagattatcgatttgcagcagtggcaaggtaccagacagaaagcagagaacgaaaacactggcatctgcaccaacaaacgaggttcctccaaccccctgctcaccactgaggaagctaacctgaccgaaaaagaagaaatcaggcagggcgagaccctgatgatagaaggaaccgagcagctgaaatcactgtccagtgattcctccttttgttttcctagaccccacttcagcttttctaccctgccaaccgtatctcggaccgtggaactgaagtctgagcccaatgtgatttctagtccagccgaatgcagcctggagctttcaccctccaggccctgcgtgttgcattcatcgctgagtaggagagagacacctatctgtatgctgcccattgagaccgaacgaaacatcttcgaaaactttgctcacccccctaatatcagccctagtgcctgtccgctgcccccaccccccccgatctcacctccctctccacctcccgcaccagccccactagccccaccacccgatatcagcccattttcccttttctgtccacccccatctcccccatccatccccctccctctgccaccccccacatttttcccactgtcggtttcgacaagcggaccccctacacctcccttgctgccccctttcccaacgcccctgcccccccctccgccttcaataccctgtccaccccctcccagtgccagcttcctcagcacggagtgcgtgtgcattaccggcgtgaaatgtacaactaatctcatgcctgcggagaagatcaagagctctatgacccagctctctactaccacagtgtgcaagaccgaccctcagcgggagccgaagggcatcttgaggcacgtgaaaaacctggccgagcttgagaaatcagttgccaacatgtactcccagattgaaaagaactatttacggacaaacgtctcggagctgcagactatgtgtccatcagaggtcaccaatatggagatcacaagcgagcagaacaagggttctctgaacaatattgttgaagggaccgagaagcagtcacacagccagagcacctccctatag

SEQ ID NO: 201961 - DNA, 2886 bp, Artificial Sequence
  Description of Artificial Sequence: Synthetic coding sequence
atgttccggcagttctacctgtggacctgcctggccagcggcatcatccttgggtccttgtttgaaatctgcctgggccaatatgatgatgattgcaagctcgccaggggaggccccccagccactatcgttgctatcgacgaggagagcaggaatggaacaatcctggtcgacaacatgctcattaaagggaccgccggcgggccagaccccactatagaactgagtctgaaggacaatgtcgattattgggttctaatggaccccgtgaaacaaatgctgttcctcaactccacgggcagggtgctcgatagagacccaccgatgaacatccatagtattgttgttcaggttcaatgtattaataagaaagtgggcacaataatttaccacgaggtgcggatagtcgttcgtgaccgtaacgataactcacctacctttaagcacgagtcatattacgccacagtgaatgagttaacacccgtgggtacgaccattttcaccgggttttccggtgacaatggggcgaccgacatagatgatggccccaacggacagattgaatacgttattcagtataatccagatgatcccacatcaaacgatacctttgaaattcctcttatgctgaccggcaacatagtgctcagaaaacgattgaattacgaggacaaaactaggtacttcgttattatccaggctaatgaccgggcacagaatctaaatgagcggcgaacgaccaccaccaccctgacggtggatgtgctggatggggacgacctcgggccaatgtttctcccatgcgtgctcgttcctaatacccgggactgtaggccccttacctaccaagcagccatccccgagctgcgcactccagaagagctaaatccaataatagtgacgccccccattcaggctatcgatcaagaccggaatatacaacctccttccgacaggcctggaattttatactccattctcgtaggtactccagaggactatccaaggtttttccacatgcaccctcgcacagccgagctatctctcctcgaacccgtgaatagagattttcaccagaagttcgatttggtcatcaaggccgagcaggataacggccacccactgccggctttcgccgggctacatatcgagatcctggatgagaataatcagagcccttactttaccatgccctcctaccaagggtacattctggagtcagcacctgtgggggccacgatctccgattcattgaacctgacctctcctcttagaatcgtggccctcgataaagacatagaagatacaaaagatcctgagctgcatctgttcctgaatgactatacgtccgtgtttactgtgacccaaaccggaattactaggtacctcactttactgcagcccgtggatagggaggagcaacagacctatacgttctctatcactgctttcgatggcgttcaggaatcagagccagttatcgtgaatattcaggtgatggatgctaacgacaatacaccaaccttccctgagatcagttacgatgtgtatgtgtatactgacatgcgacctggcgactccgtgattcagctcactgccgttgatgccgacgaagggtctaatggcgagatcacttacgaaatcctggtcggtgcacagggcgacttcatcatcaacaagacaacagggctgataacaatagcccctggtgttgagatgattgtcgggcggacgtatgccctgaccgtgcaggccgcagataacgctccacccgccgagcggagaaactcaatttgcactgtgtatatcgaagtgttgcccccgaataatcagtctccccctcggtttccccagctgatgtattcccttgagatctccgaggccatgcgcgtgggggcagtgttgctgaatttacaggctaccgatagggaaggtgacagcataacctacgctattgagaatggtgatcctcagcgggtcttcaacctgtctgaaaccacgggcatcctgaccctaggtaaggcattggacagggaatctacagaccgatatattctgattattacggcatcagatgggcgccccgatggtacctcgactgccacagtgaatatcgttgtgacagatgtgaatgataacgctccggtgttcgatccttacctgccaaggaacctgagtgtggtcgaagaggaagctaatgctttcgtgggacaggttaaggcaacagaccccgatgcaggcataaacggccaggttcactactcactcggtaattttaataacttattcaggattacctcgaatggatctatctacaccgccgtcaaactgaatagggaggttcgcgactattatgagctagttgtcgtagccactgacggagcagtgcacccgaggcacagtactctgacattagccattaaagtgttggatatagacgataacagccccgtcttcactaatagcacatatacagtgctggttgaagagaacctgccagctggcacaacgatccttcagattgaggctaaggatgtagatctgggcgccaacgtgtcctacagaatcaggtcgcctgaggtcaagcactttttcgcgctccacccatttaccggcgaactatctctgttgcggtctctggactacgaggcctttcctgatcaggaggcctctataacctttctggtagaggcattcgacatctatggaaccatgccccccggtatcgccactgtgaccgttatagttaaagatatgaatgattacccccccgtgttctcaaaacggatatataaagggatggtcgccccagacgcagtgaaaggaacccctatcaccacagtttatgctgaggatgccgacccccccgtttctcgcagacactag

SEQ ID NO: 201962 - DNA, 2430 bp, Artificial Sequence
  Description of Artificial Sequence: Synthetic coding sequence
atgttccggcagttctacctgtggacctgcctggccagcggcatcatcttggggtcattatttgaaatctgcctgggacagtatgacgatgggactattttggtcgataatatgttaattaagggcacagccggcggacctgatccaaccattgagctgtccttgaaggacaacgtagattactgggttctcatggatccggtgaaacaaatgttgttcctcaatagcacaggtagggttcttgatcgtgatccgccaatgaacattcacagcatagtggtgcaggtccagtgcatcaataagaaggtgggcacaatcatttaccacgaggtgcggattgttgtgcgcgaccgcaacgataatagtccaacctttaaacacgagagttactacgcaacggtgaacgaactcacacccgtggggaccaccattttcactggtttctcaggagataatggggccactgatatcgacgacgggccaaacggtcagatcgagtatgtgatccaatataatcctgatgaccctacatcaaatgatactttcgagattccactaatgcttacaggaaacattgtactgcgtaagaggctaaactacgaagataaaacccgttacttcgtgattatccaggccaacgaccgcgctcaaaatctgaatgaacgcaggacaaccacaaccacattgacagtggatgtgttggacggcgacgatcttggccctatgttcctcccttgtgtattagtccctaatacacgcgactgtcgcccccttacctaccaggccgctatccctgaactccgaacaccagaggaactgaaccccatcatcgtcacacccccaatccaggccatagatcaagaccggaatattcaacctccaagcgatcgcccaggtatactttattccatcctcgttggaaccccagaggactacccacgcttcttccacatgcacccaagaactgcagagttatccttgctcgaacctgtcaatagagattttcaccagaaatttgatctggtgatcaaagcagagcaggacaatgggcaccctttgcctgcgttcgccgggctccatattgagatactggacgaaaataatcagagcccatactttactatgccatcataccaaggctatattctggagtcagctccagtcggcgctacaattagtgactccctcaatttgaccagccccctcagaattgtggctctggataaagatatcgaagacacgaaagacccagagttgcatctgttcctaaatgattacacctccgtgttcaccgtgacacaaaccggaataactagatatctgactctgctgcaacctgtagatcgggaagaacagcaaacatatacattctcaattacggcttttgatggggttcaggagtcagaaccagttatcgtgaatatccaggttatggatgctaacgataacacaccgacattccccgaaatcagttatgacgtctatgtctataccgatatgaggcccggagatagtgtaatccagctgacagccgtggacgccgatgaaggatcaaacggcgagattacctacgagattcttgtgggcgcccaaggagacttcattataaataaaaccaccggtctcatcactattgcacctggagttgaaatgattgtgggtagaacctatgctttaactgtacaggcggccgacaacgcgcctccagccgagaggagaaattctatatgtaccgtgtacatagaagtgctccctccaaataaccagagcccaccaagatttcctcagctgatgtacagcctggagattagcgaggccatgcgcgttggtgccgtcctcctgaacctgcaagctacggacagagagggcgatagtatcacttacgctatcgagaacggcgacccccagcgtgtctttaacctatctgaaacaaccggaatcctcacgctgggcaaggccctcgaccgggaatccacagacaggtacatactcatcatcaccgcttcagacgggagacctgacgggacctcaacggcgactgtgaacatcgtggtgacagacgtgaacgacaacgccccagtgtttgatccctatttgccacggaacctgagtgttgtggaagaggaggccaatgcctttgtgggccaggttaaactgagcaccacgacggtgtgtaagacagacccacagcgcgagccaaaggggatcttgcgccacgtcaagaatctggccgaattggaaaagtcggttgcaaatatgtatagccaaatagagaagaactaccttcggacaaacgtgagcgaactgcaaaccatgtgtccatcggaagttacaaatatggaaattacctcggagcaaaacaaggggtctttgaacaatatcgtggaaggaactgaaaagcagtcgcacagccaatctacctccctgtag

SEQ ID NO: 201963 - DNA, 5055 bp, Artificial Sequence
  Description of Artificial Sequence: Synthetic coding sequence
atgttccggcagttctacctgtggacctgcctggccagcggcatcattctcggttcgctgtttgaaatctgtttgggccaatatgatgacgattgtaaactggctaggggcggccctccagccacaatagtggccattgacgaggagtcccgaaatgggacaatcctcgtcgataatatgctcatcaaaggtactgccgggggccccgatcccacaattgaactttccctgaaagacaatgtggattactgggtgttgatggacccagtgaagcagatgctgtttttaaactccactggtcgtgtgttagatcgcgatcccccaatgaatattcattccatagtcgtgcaagttcagtgcattaataaaaaagtgggtacaattatctaccatgaagtgcggattgttgtgagggaccggaacgataattccccaacattcaagcatgagtcttattacgcaaccgtcaacgaactcactcctgttggtacaaccatattcacaggcttttccggggacaacggagctactgacattgatgacggtccaaatggccagattgagtatgtgatccagtacaacccggacgacccaacatcgaatgatacgtttgagatcccgctgatgctgactgggaatatcgtactgcggaaacgcctcaactacgaggacaagactaggtatttcgtcatcatccaggccaatgatcgggctcagaacctcaacgagcgcagaacgacaacaactactctgacggtggatgtattagacggggatgacctgggacctatgtttctgccttgcgttcttgtgccaaacacacgcgactgcagacccctgacatatcaggcagcgatacctgagttaaggacgccagaggagctgaatcccattattgtgactcccccgattcaagctattgatcaggatagaaacattcaaccacctagtgaccgacccggtatactctactcaattctcgtgggaacgcctgaggattatccccgttttttccatatgcacccgcgtacagctgagctgtctttgttggagcccgtgaacagggactttcaccaaaaatttgacctggtgattaaggccgagcaggataacggacatcccctccctgcttttgcaggcctgcatattgaaatcctggacgagaacaatcaaagtccatactttactatgccttcttaccagggatatattttagagtccgcccccgtaggcgctacaatttccgattccctgaatctcacatcaccattgaggattgttgccctggataaagacatcgaagacgtcccacctagcggagttccaaccaaggatcccgaactgcacctattcctgaacgactatacatctgtatttaccgtgacgcagacaggtataacccgttacctgacgctactgcagcctgtagatcgggaagagcagcagacctatactttttcaatcaccgccttcgatggcgtacaggagagcgaacctgttatagtgaatatccaggtgatggatgcaaacgacaatacccccaccttccccgaaatctcttatgacgtctatgtatacacggatatgaggcctggggactctgtaattcaactcacagccgtggacgctgatgaaggatctaacggagagataacctatgaaatcctcgtaggggcacaaggagatttcattataaataagactacagggctcatcacgatcgctcccggagttgaaatgatcgtggggagaacctacgcactgaccgtgcaggctgccgacaatgcccctccagcagagcgcagaaactctatatgcaccgtgtacatcgaggtgcttccacccaataaccagtcgccccctaggttccctcagctgatgtatagcttggaaatatccgaagctatgcgcgtgggtgcagtcttactaaatcttcaagctactgatagggagggcgactctatcacttatgccatcgaaaacggcgatccacagagggtcttcaacctgagcgaaaccaccggaattctaacactgggcaaggcgctcgatcgggagagtactgatcgatacatcctgatcatcacagcatcagacggcaggcctgacggtacgtctacagctaccgtgaacattgttgtgaccgatgtaaatgacaatgccccagtatttgacccctacctgccgcggaacctttctgtggtggaagaagaagccaatgcattcgtgggacaggtgaaagctacagaccctgacgctggtataaacgggcaggtgcactacagtctcggcaactttaataatctgtttcgtatcaccagcaacggctcaatctataccgcagtaaaattaaaccgagaggtacgcgattactatgagcttgttgtggtggctacagacggcgccgtgcatccacggcactccaccctgacactggcaataaaggtgctggacattgacgacaactctcctgtgtttacaaactcgacctatacagtccttgtggaagagaatctgccagccgggaccactatactacagatcgaagctaaggacgtggacctcggtgccaatgtgtcataccggattcgatcacccgaagttaagcacttcttcgcccttcacccatttaccggcgaactgtcgctgctccgctcactcgattatgaggccttcccagatcaagaggcaagtataacgtttctggtggaggcctttgatatatatggaactatgccacctggcatcgctaccgtaaccgtcattgtgaaggatatgaacgactacccacccgtcttcagtaagcgtatttataaaggcatggtcgctcccgatgccgtcaaaggcaccccgattactactgtctatgcagaggatgctgatccgcccggtcttcccgccagcagagtccgctatcgggtagacgatgtgcagttcccctaccccgctagtatctttgaggttgaggaggacagcggccgagtaataacacgcgttaacctgaacgaagaaccaaccaccatattcaaactggtggtggtcgcttttgacgatggggaaccagtgatgtcctcgtctgctacagtgaagatactcgttctccaccccggagaaatccccagattcacccaagaggaataccgtccacctcctgtatcagagctggccactaaagggaccatggtgggggtaatttcagcagccgcgattaatcagtctattgtgtactccatcgtgtctggaaatgaagaagacacttttgggatcaataatattaccggtgtcatttacgttaatggcccactcgattacgagacgcgtactagctacgtactgagagtgcaggccgacagcctcgaggtagtattagctaatctgcgggtgccttcaaagtccaatacagctaaggtctatatcgagatccaggacgagaacaaccaccccccagtgtttcagaaaaagttctacatcggaggcgtgagtgaagacgcacggatgttcacatcagtattgcgggtgaaggctacggataaggacaccggcaactactctgtcatggcttaccgcctcataataccgcctatcaaggagggtaaggaaggtttcgtcgtcgagacgtataccgggctgattaagaccgctatgctgttccacaatatgaggagatcatattttaagtttcaagtgattgcgaccgatgactatggtaaaggcctaagcggcaaggcagacgttttggtctctgtggtaaaccagttggacatgcaggtgattgtgtcaaacgtaccaccaacacttgtcgagaaaaaaattgaagatctgacggagattcttgatagatatgtacaggaacagatcccgggcgccaaggtggtggtggagtcgatcggggcaagaagacacggggacgccttcagcctagaagattacactaaatgcgacctcacagtatacgccatcgacccacagacgaatcgcgcgatcgatcggaacgagctctttaaattcttggatggcaagctcttagatattaacaaggactttcagccctattatggtgagggagggcgtatcctggaaatccgcacaccagaggccgtgacttccatcaagaagagaggagaaagccttggatacactgaaggcgccctcctggccttagccttcattataatcttatgctgtatccccgctatcctggttgtattggtgtcctacaggcagtttaaggtgagacaagcagaatgtacaaagaccgctaggatccaggctgcattacctgccgctaaacctgcagtgccagctccagctcccgtagctgccccccctccgcctccacccccacctcccggcgcgcacctctatgaggaacttggagacagctcaatgcataaatatgagatgccccagtacggctcacgcagacgcctgctcccaccagctgggcaagaggaatacggggaggttgtgggcgaggccgaggaagaatatgaggaggaagagtgggcccgaaaaagaatgataaaactggtggttgatcgggagtacgagacgagttctactggagaggatagcgcccctgagtgccagcggaatagactgcatcacccatccatccacagcaatatcaacgggaacatctacatcgcgcaaaacggtagcgtggtgagaactaggcgcgcttgtttgacagataacttgaaggtcgcttctccagtgcgtctgggcgggccatttaaaaaacttgataagctcgccgtgacccacgaagagaacgtgcctttgaacaccctcagcaaggggccgtttagtaccgaaaaaatgaatgcgcggccaacactggtgaccttcgccccctgccctgtcggcaccgataacaccgctgtaaagcccctgcgcaaccgtctgaagtctactgtggaacaggaatcaatgatcgacagcaaaaacataaaggaagctcttgagttccactccgaccatacccaaagcgacgacgaagaactgtggatggggccatggaacaatctgcacatccccatgactaaactgtag

SEQ ID NO: 201964 - DNA, 5859 bp, Artificial Sequence
  Description of Artificial Sequence: Synthetic coding sequence
atgttccggcagttctacctgtggacctgcctggccagcggcatcatcttaggatctttgtttgaaatttgcttgggccagtatgacgatgattgcaagctggctcggggcggacctcccgcaaccattgttgcaattgatgaagaaagcagaaacggcacaattttggttgataatatgctcatcaagggtacagccggcggccccgacccgactatcgagctgtcccttaaggacaacgttgactactgggtcttgatggacccagtgaagcaaatgttgttcctcaattctacaggaagagtgctggaccgcgacccccccatgaatatccactcgatcgtggttcaggtgcagtgcattaacaagaaagtcggaaccataatctatcacgaggtccgtatcgtggttagggacaggaacgacaattcccccacgttcaaacatgagtcctattacgctaccgtgaacgagttgacccccgtggggaccactatcttcactgggtttagcggcgacaatggagccacagacatagatgacgggcccaatggacaaatagaatatgtcattcagtataacccggacgaccctactagcaacgataccttcgagatccctttgatgttgacgggaaacatcgtcctccggaaacgattaaactacgaagataagacgcggtacttcgtgatcatccaggccaacgaccgggcccagaatcttaatgaaagacgaaccactacaaccacccttaccgtggacgttctggacggtgatgacctgggccctatgttcctgccctgtgttctggtccctaatacacgcgattgtagacccttaacataccaggccgcaatccccgaactgcgaactcctgaggaattgaatccgataatcgtgacgccaccgatccaggcaatcgaccaagaccgcaatatccagccaccctccgaccgccctggcatcctctatagcattctcgtagggacccctgaggactatccaagattcttccatatgcacccccgaactgccgagctttcgctgctcgaaccggtgaatcgcgacttccatcaaaagtttgacctggtaattaaagctgaacaggataacggccaccccctgcctgctttcgctggactgcatatagagatcttggacgagaataatcagtcaccgtatttcactatgcctagttaccagggttacattctggaaagtgctcccgttggggctaccataagcgatagtctgaaccttacgagcccgttaagaattgtagctctggataaggatatcgaggacaccaaagatccagaacttcatctgttccttaacgactatacttcagtgtttaccgtcacgcaaacaggcataactaggtatctcaccctgctacaacccgtggatagagaggagcagcagacatatacattctctattactgcattcgacggagtccaggaatcagagcccgttattgtaaatatccaggtgatggacgcaaatgacaatacacctacatttccagaaataagttatgatgtgtacgtctataccgacatgaggcctggagattccgtgatccaactaaccgcagtagacgctgatgaaggcagcaatggagaaattacatacgagatcctggtgggtgcccaaggcgatttcataatcaacaaaaccactggcctgattacaatcgcccctggggtggagatgatcgtgggtagaacgtacgcattaacggtgcaggccgcggataacgcacctcccgcagagcgccgaaacagtatctgcactgtgtatattgaagtgcttccacccaacaatcagagccccccccgattccctcagcttatgtacagcctcgaaatcagcgaagccatgcgagttggtgcagttctgttgaacctgcaggcaaccgatagggaaggtgactcaatcacatacgcgatcgagaacggggatccgcaaagagtgtttaatctgtccgaaacgaccggcattctcaccctagggaaagcccttgatcgggagtctaccgacaggtatattcttatcattacagccagcgatggccgccctgatgggacttctactgctaccgttaatattgtggtgacagatgtcaacgacaacgcgcctgttttcgacccctacttgcccaggaatctgagtgtggtagaagaggaggcgaacgcatttgtgggccaggtcaaagctaccgatcccgacgctggtatcaatggacaggtgcactattctctgggtaatttcaataatctattcagaatcaccagcaacggctccatctacaccgcagttaagttaaacagagaggtccgcgactattacgagttagtagtggtcgccacagacggtgctgtgcatcctcggcactcaaccctgaccctggcgatcaaggtgcttgacattgatgacaattcacccgtgtttacgaactccacctatactgtgttggtggaggagaacctacccgccggcactacgattttgcaaatcgaagccaaagacgtggacttgggcgctaatgtttcatataggattaggtccccagaggtgaaacatttctttgctctgcatccctttacaggagaattatccctgctaaggagtcttgactacgaagcatttcctgatcaggaggcaagtattactttcttagtggaggcgttcgatatctacggaacgatgccccctggaatcgcaaccgtgactgtcatcgtgaaagatatgaacgactacccaccagtcttttctaagcgcatttacaagggaatggttgcgccagacgccgtcaagggcacgcctataactacagtttacgccgaggacgctgatccgcctggactacctgccagtcgggtgcgataccgcgtcgatgacgtgcagttcccctaccccgcttccatctttgaagtagaagaggattctgggcgggtgattaccagagtgaacttgaacgaggagcctaccacaattttcaaattagtggtggtggcctttgacgacggagaacccgttatgtcctcgagtgccacagtcaaaattctagtcctccatcccggggagataccaagatttacccaggaggagtacaggcccccgccggtgtcagagctcgcaactaaagggacaatggtcggtgtgatatcagctgcagccatcaaccaatctatagtctatagcatcgtgtccggcaacgaagaggacactttcgggattaataatatcacaggcgtgatctacgtaaatggacccctcgactacgaaaccagaactagctatgtgctcagagtccaggctgacagcctggaagtcgtgctcgccaatcttcgagtgccttctaaaagtaacactgccaaggtatacatcgagatccaggacgagaataatcacccccccgtcttccaaaagaaattctatatcggcggagtatcagaggacgctaggatgttcacctccgttctgcgcgtgaaagccactgataaagataccggaaattattccgtgatggcctatcggcttatcattccccctatcaaagagggaaaagagggatttgtggtagagacttacacaggactaatcaaaaccgcaatgcttttccacaacatgcggcgctcctatttcaagttccaggttattgctactgacgattacgggaagggactgtctggcaaagctgacgttttggtgagcgtggtcaatcagctggatatgcaggtgatcgtgtccaacgtgcctcctacactggttgaaaaaaaaatagaagatctgaccgaaatcctcgatcggtatgtgcaagaacagatccccggcgctaaggtagtggtggagagcattggggcacgccgacacggagacgccttctcactggaggactataccaaatgcgaccttacggtctacgccattgacccacagactaatagggctatcgacagaaatgaactgtttaaatttttagacggaaaactactcgatatcaacaaggatttccagccatattatggtgaaggtggtcgaattctcgagatcagaacccccgaagccgtcaccagtatcaaaaagcggggtgaatcgcttggatacaccgaaggagccctcctggctctcgcgttcataataatcctctgttgcatacctgcaattttagtggttttagttagttacagacagagacaggcggagtgcacgaagactgctaggattcaggcagcactgcccgctgccaagccggccgtcccagccccagccccagtagctgccccaccaccccctcctccccctcctcccggcgcccacttgtacgaggagttgggagatagcagcattctgtttctcctgtatcacttccagcaatcacgtggcaacaacagtgttagcgaagatcgaaaacaccagcaagtggtgatgccttttagcagcaatacaattgaggcacataagtcagctcacgtggatgggagcctaaaaagtaataagctcaagtcggctaggaaatttacgttcttgtctgatgaggatgacctgagcgcccacaaccctttgtataaagagaacattagccaagtcagcaccaacagtgatattagtcagcgtactgattttgtggatcctttttctcctaagatccaggcaaaatccaagtctcttcgcggcccacgcgaaaaaattcagaggctgtggtcacagagcgttagccttccccggagattaatgaggaaagttcccaatcgtccagaaatcatagatctccagcaatggcagggaacacgccagaaagccgagaacgagaataccggtatttgtactaacaaacggggatcatctaaccccctcctgactaccgaagaagcgaaccttacagaaaaggaagaaatcaggcagggagagacgttgatgattgaggggaccgaacaactaaaaagtttgtcttccgatagttccttctgttttcctcggcctcacttttcattttcaaccctgccgactgtttcgaggaccgtggagcttaagagcgagcctaacgttatctcctctcccgcagagtgctctttagagctgagccccagcaggccctgcgtgctgcactcttctctgtctcggagagaaaccccgatttgcatgctgcctatcgaaaccgaaagaaatatctttgagaactttgctcatccacctaatatctctcctagtgcgtgccccctacccccccccccccccatttccccaccgagtcccccgcccgctccagccccactggcacctccacctgatattagccccttctcacttttttgcccaccacccagccccccaagcatacccttacctctgcccccgcctacttttttcccactcagcgtgtcgacctctggcccgccaactccccctctgctgcccccctttcccactcctttgccacccccccctccttcgataccatgccctccacctcccagcgcttcctttttgagcacagagtgtgtttgcatcacgggagtcaagtgcaccacaaatctcatgccagccgagaagatcaagagcagtatgactcagctgagcaccaccacagtgtgtaagaccgatccgcagcgcgaacctaaaggaatacttcgtcatgtcaaaaaccttgctgaacttgaaaagtccgtcgccaatatgtatagtcagattgagaagaattaccttaggaccaatgtctccgagctgcagactatgtgccccagcgaagtcaccaacatggagatcacatccgaacagaacaaggggagtctgaataatatagtggaaggcactgagaaacagagccacagtcagagcacctcgctgtag

SEQ ID NO: 201965 - DNA, 5748 bp, Artificial Sequence
  Description of Artificial Sequence: Synthetic coding sequence
atgttccggcagttctacctgtggacctgcctggccagcggcatcatccttggcagcctatttgagatctgcctcggccagtacgatgacgactgcaaactcgcccgtggaggcccacccgcaactatcgtggccattgatgaggagtcacgcaacgggacaatcttagtcgataatatgctgataaaagggactgcaggcggaccagatcccacaattgagttatctctgaaggataatgtcgattattgggtcctgatggacccagtcaaacagatgctctttctgaatagtactggaagggtattggaccgggaccctcctatgaatatccatagtatcgtggttcaggtccagtgcataaataagaaagtaggaactatcatataccatgaggtccggatcgtggtacgagatagaaatgacaacagccccacgtttaaacacgagtcttactacgccactgtcaatgagctcactcccgtgggaaccactatcttcacaggcttctccggcgataacggcgcgacggatatcgacgacggcccaaacggccagatcgagtatgtcatccaatacaatcctgacgacccagatagagcccagaatctgaacgagcgcagaaccaccaccacaactctgaccgtagacgtgctggacggggacgaccttggcccgatgttcttaccctgtgtgctggtgcccaacacccgggattgtaggcccttaacgtatcaggccgccattcctgaattgcgaacacctgaggaactgaacccgatcattgtcacgcctcccattcaggctatcgatcaagatcgtaacatccagcccccaagtgacagacccggtatcctgtatagcatcttggtaggcacacctgaagattatcctagatttttccatatgcatccgcgaaccgccgagctgtccctgctggagcctgttaatagagattttcaccagaagttcgacctagtgataaaagccgagcaggacaacggccatccactgcccgcgtttgccggtctgcatatcgaaattctggacgagaataaccagagtccttacttcacaatgccttcttaccagggatatatactggagagtgcccccgtaggcgcaacaatttctgactctctgaacctgacaagccccctcagaatcgtggccctcgataaagatattgaagacacaaaagatcccgagctacatctcttcttgaacgattataccagtgtgtttaccgtgacacagacgggcattacacggtacctgactctcttgcagccggtggatagggaagagcaacagacgtatacattctccatcacagcctttgatggtgttcaggaatcggagccagtgattgtcaatatacaggtgatggatgccaatgacaacactcccacatttcccgagatctcttacgatgtgtatgtgtacacagatatgcgaccaggggacagcgttatccaattgacagctgtggatgctgacgaggggtccaacggtgagattacgtacgagatcttggttggagcgcagggagattttattatcaataagactacagggttgatcaccatcgcccctggggttgagatgatcgtgggcagaacttacgccttgacggtccaggccgccgataatgccccgccggccgagaggaggaatagcatttgtacagtctacatcgaggtactgcctcccaataaccaaagtccaccgcgattcccacagctgatgtacagcctagagattagtgaggcgatgcgagtgggagcagtgcttttaaatcttcaggcaacagatcgcgagggagacagtatcacctacgcaatcgaaaatggagacccccagcgcgtttttaacctttctgagactactgggatcttaacacttggtaaggcgctagaccgtgagtctacagacaggtatatcttgataatcacagcctcagatggaaggcccgacggaacaagtacggcaactgtgaatatagtggtcaccgatgtcaacgataacgctcccgtttttgacccgtacctcccaaggaacctatcggtcgtcgaggaagaagcaaatgctttcgtgggccaggtgaaggctacagatccagatgcgggcatcaatggccaggttcattatagccttggaaatttcaataatttgtttaggatcacttccaacggatccatctacaccgcagttaagctcaacagagaggtgagagattattacgagctcgtagtggtcgctactgatggtgcagtgcaccctcgccacagcactcttaccctggcaataaaggtcctcgatatcgatgataattctcctgtgttcacaaacagcacctataccgttcttgttgaagaaaatctgcctgctggaactactatcttgcagatcgaggctaaggacgtggacttaggggccaacgtgagttataggatacgctcccctgaggtgaagcattttttcgcactgcacccatttacaggtgagctgagccttctgcgatctcttgactatgaagcttttcctgaccaagaggcatccataacctttctggtggaagccttcgatatctatggcaccatgccgcccggaatagccacggtgactgtgatcgtgaaggacatgaatgattatcctcctgtgttttccaaacgcatctacaagggcatggtcgcacctgacgcagttaagggcacaccaataacaaccgtctacgccgaggatgccgacccccctggcctgccggcctcacgcgtgaggtaccgcgtggatgatgtccagtttccatatccagccagtatctttgaggtcgaggaggattcaggacgtgtcatcaccagagtgaacctcaacgaagaacccacaacgatcttcaagctcgtggtagttgcgttcgatgatggggagccagtgatgagctcaagcgccactgtcaagatccttgtcctccaccctggggagattcctaggttcactcaggaagaataccgtccacccccagtttcggaactggccaccaaggggactatggtgggcgtcatctctgccgccgcaattaaccagtccattgtttactcaatcgtgagcgggaatgaagaggatacatttggaatcaacaacatcactggcgtgatctacgtgaacggacccctcgactacgagaccagaaccagttacgtgctccgcgtacaggctgacagcctggaggttgtcttggccaacctgagggttcctagcaaatctaatactgccaaagtctacattgagatacaggacgaaaataaccatccacctgtctttcaaaaaaaattctatataggcggcgtgtccgaggacgccagaatgttcacaagtgttctcagagtaaaagcgactgataaagatactggcaactacagtgttatggcgtaccgactcatcattccaccaatcaaagaaggaaaggaaggattcgttgtggaaacctacaccgggctcataaagaccgcaatgctctttcataatatgagacggtcctactttaaatttcaggtgatcgccactgatgattacggtaagggcctgagtgggaaggcggacgtgctggtttccgtcgtgaatcagttagacatgcaggttatcgtcagtaacgtgcctcctacactggtcgaaaaaaaaattgaagacttgactgaaattcttgaccgatacgtccaggagcagatccctggcgcaaaagtcgtcgtagaatccattggggcaagaaggcacggtgatgccttttcactcgaggattataccaagtgcgatctgacagtgtatgctatcgatccccaaactaaccgggccattgaccgtaacgagcttttcaaatttctcgatggaaagctgcttgatattaacaaggatttccagccatactatggagagggaggtcggatcctggagattcgaacccccgaggcagtgacgtcaataaaaaagagaggcgagagcctgggttataccgaaggagcgctcctcgccctggcattcatcattattctctgttgtataccagccattctggtggtgcttgtttcctatcggcagcgccaggcagagtgcactaagacagcaagaatacaggccgcccttcccgccgctaaaccagcagtaccagccccggctcccgtcgctgcacctcctccccccccccccccaccacctggggcacacttatatgaggaactgggcgactcctccattttgtttctgctctaccacttccagcaatctcgggggaacaattccgtctccgaggacaggaagcaccagcaggtcgtgatgccattctccagcaatacaatcgaggcacataagagcgctcatgtcgacggctccttaaagagcaataagttaaagtccgcgaggaaattcacctttctctccgacgaggatgacctgtcagcccataatcccctgtacaaggagaatattagtcaggtgtctactaattcagatatatctcagaggaccgatttcgtggacccatttagtccgaaaatacaggcgaagagcaagagcctgcgcggcccaagggaaaagatccagaggctttggtcacaatcggtgagtctccctcggaggctgatgagaaaggttccaaataggccagaaatcattgatcttcaacagtggcagggcacccgtcagaaggccgaaaatgagaacaccggcatttgtaccaacaaacgtggctctagtaatccactattgacgactgaggaggccaacctcaccgaaaaggaagagataagacagggagaaacactgatgatcgaagggactgagcagctgaaaagcttgtccagtgacagctccttttgcttcccaagaccccattttagtttctcaacgctccccacggtgagtcgaacggttgaactgaaaagcgagcctaacgttatatcttccccggcagagtgtagcctggaactgtctccatcccggccctgtgtgcttcactcctctctttccaggcgggaaacccccatctgtatgttacccatcgagaccgagagaaacatctttgagaacttcgcccacccaccaaatatctccccctcagcctgtccccttccccccccacctcctattagccctccatcccccccccctgcccctgccccgctcgcacctccaccggacatcagccccttctccctgttttgcccacccccttcacctcctagtattccccttccactgccaccccccacctttttccctttgtctgtttccacctcaggccctccaaccccccccctcctacctcccttccccacccccctcccgccacccccaccatccatcccttgcccacctccgcctagcgcctccttcctgagcaccgagtgtgtttgcatcaccggtgtgaaatgtaccaccaacctaatgcccgccgaaaagataaaaagctctatgacgcagctgtctacaacaaccgtttgcaaaaccgaccctcagagagaacctaaaggaattcttaggcatgtaaagaatcttgctgagttagaaaagagtgtggctaacatgtactctcagatcgagaaaaactaccttcgcacgaacgttagcgagcttcagacaatgtgtccgtctgaagttacaaacatggagattacatcggaacagaacaaggggagcctcaacaacattgtcgagggtaccgaaaaacagtcacattctcagagcacttccttgtag

SEQ ID NO: 201966 - DNA, 5799 bp, Artificial Sequence
  Description of Artificial Sequence: Synthetic coding sequence
atgttccggcagttctacctgtggacctgcctggccagcggcatcatcctgggatccctgttcgagatttgtctcggccagtatgacgacggcaccatcttagttgacaatatgctgattaagggcacagcggggggccccgaccctactattgagctgagcctcaaagataatgtggattactgggtactcatggatcccgtgaagcagatgctctttctgaattcaacaggtcgggtgcttgatcgcgacccaccaatgaatattcattcgatcgtggtccaggtccagtgcataaataaaaaggtcggaaccattatctaccacgaagttcgaattgtggtcagggatcgcaacgacaacagtccaacattcaaacacgaatcttattacgcaaccgtgaacgaactcacccctgtagggactactatcttcaccggatttagcggcgacaacggagccaccgatatcgacgacggacctaacgggcagatcgagtacgtgatacagtacaatcccgatgatcctacgagtaatgacacgttcgagatcccactgatgctgactggaaatatagtcctgcgtaaacgccttaattatgaggataaaacaaggtactttgtgattatccaggctaatgaccgagcccagaatctgaatgagcgacgaacaactacaaccacattgaccgtagatgttcttgacggcgatgaccttggccctatgttccttccatgtgtactggtgcctaatacaagagactgcaggccacttacctaccaagcagcgataccggagctgcgaacacccgaagaacttaacccaatcatcgtgactccccctatccaagctatagaccaggacagaaatattcagcccccctctgatcgtccaggcattctttactcaattttggttgggacccctgaggactaccctcgtttcttccatatgcaccctcgcactgcagaactgtcgttactagagcccgtcaatagagatttccaccagaagtttgaccttgtgatcaaggctgaacaagataatggacaccccctccccgccttcgccggcctacacattgagattctcgacgagaacaatcagtccccatactttacaatgccttcgtaccaggggtatatactggaaagtgctccagtgggtgcaacaatctccgacagcctgaatctcacctccccactacgaatcgtggcgttggacaaggacattgaggatactaaggatcctgagctccacctttttctgaacgattatactagtgtatttactgtcacccagactggcataacccgatacttgacccttctgcaaccggtggatcgggaggaacagcagacctatactttttccatcaccgcgttcgatggggtgcaagagtcagagcctgtgattgtgaatatccaggttatggatgccaacgataacactcctactttcccagagatctcatacgatgtgtacgtctacaccgacatgaggcccggcgactccgtcattcaactcaccgcagtcgacgccgacgaagggtcaaatggtgagatcacatacgagatcctggtcggtgcccagggcgactttataattaataagactacgggcctcattactatcgcccccggggtggaaatgattgtcgggcgtacctatgcattaaccgtccaagctgccgacaacgcaccgccagccgagaggcgtaattccatctgcaccgtgtatatcgaggtgctgcctccgaacaaccagagcccccctcggtttccgcagctgatgtacagtttggagatcagcgaagcaatgcgcgttggcgctgtcctgttgaatcttcaggctaccgatcgagaaggagattccattacctacgcaatcgaaaatggagatcctcagagagtttttaatttatccgaaaccacgggaatactgactctaggaaaggccctggacagggaaagcaccgacagatatatcctcatcattactgcgagcgatggcagacccgatggaacgtcaactgcaaccgtaaatattgttgtgacagatgtaaatgataatgctcccgtgtttgatccttatctcccacggaaccttagtgtggtggaagaggaagccaacgcttttgtgggccaggttaaagccaccgatccggatgctggtattaacgggcaggtacactattcactcggcaattttaataatctcttccgcattacctctaacggctctatctacactgccgtgaagctcaaccgcgaggtcagggactactacgagctcgtagtggtggctacggatggcgcagtccaccctcggcattctacgttaaccttggcaataaaggtcttagatattgatgacaattctccagttttcaccaatagtacatacaccgttctagtggaagaaaacttaccggctggtactacaatcttacagatcgaggccaaagatgtcgatctaggagccaatgtaagttatagaattaggagccctgaagttaaacacttttttgcactacatcctttcaccggcgagttgagtctcctgaggagccttgattatgaggcgttcccagatcaggaggcgagcatcacctttctggtggaagcatttgatatttatggcactatgccacccggcatcgcaacagtgactgttattgtcaaggatatgaacgattacccgccagttttttccaagagaatctacaagggtatggtggctcctgatgctgtgaaagggaccccgattactacagtatatgctgaggatgccgatccgcctggcttgcccgccagccgagtgcgttatcgggtggacgacgtccagttcccttaccctgcaagcatcttcgaggtggaggaagacagcgggcgcgtgatcacacgcgttaacctaaacgaggagccaaccactatatttaaactcgtcgtggtggctttcgatgatggtgaacccgtgatgtcctcaagcgccactgtgaagattctcgtgttgcacccaggagagatccctcgcttcacccaagaggagtacaggcccccccctgtttctgagttagccacaaaagggactatggtaggtgtgatcagtgcagccgccattaatcagtctatcgtttactccatcgtcagcgggaatgaagaggatacattcggaattaataacatcactggcgtcatctacgtcaacggtccactcgattatgagaccagaaccagctacgtgctccgggtacaagctgattcacttgaagtggtgcttgccaacttgcgtgtgcctagcaaatcgaacacggccaaggtatatattgaaatccaagatgaaaacaaccatccaccagtctttcagaagaaattttatataggaggcgtatccgaagatgcaagaatgttcaccagcgtgttgagggtcaaggccaccgacaaggacacaggaaactattctgtgatggcttataggctgataatccctccaattaaggagggcaaggaaggcttcgtggtggaaacgtatactggattgatcaagactgcgatgcttttccacaatatgaggagatcctacttcaagttccaggtgatagccacggacgactacggtaagggcctaagcggcaaggcagatgtgctggtcagcgtggtgaaccaactcgacatgcaagtaatcgtgagcaacgtgcctcccactctggttgaaaaaaagatcgaggacctcaccgaaatcctggacagatacgtgcaggagcagattcccggcgcgaaggtggtggtggaatcaatcggagcacggcggcatggcgatgccttttctctagaggattacaccaagtgtgacctgaccgtgtacgcaatcgaccctcagaccaaccgcgccattgatcggaatgagctgtttaagttcctggacgggaaactgctcgatattaacaaggatttccagccttactatggggagggcggtagaatcctggaaatccggacacctgaagccgtgactagcattaaaaagagaggagagtccctcggatatacagaaggcgccctgctggcactggctttcatcattattctgtgctgcattcccgcaattcttgtggtgctggtgtcttacaggcagcgtcaagcagagtgtacaaagaccgcgcggatccaagcagcgctgcccgcagcgaaaccagcagtcccagcaccagcccccgtcgccgcaccaccacccccccccccccctccacccggagcccatctgtatgaagaacttggcgatagtagcatgcataatctgtttctcctctatcatttccagcagtctcgcgggaacaatagcgtgtcagaggataggaaacatcagcaggtcgtgatgccattttcaagtaacacgattgaggcccataagagcgcccatgtcgacgggagtctgaaatctaataagctgaaaagcgcaaggaaattcactttcctcagcgacgaagacgacttatctgctcacaacccgctctataaggagaacatctcacaggtgagcactaacagcgatatatcacagcgaacagatttcgtggacccattcagccccaaaattcaggccaaaagcaagtctctccgcggtccgagggagaaaatacagcggctgtggtcccagagtgtctcgttgccccggaggttgatgcgcaaggtgccgaaccgacccgaaattatcgatttgcaacagtggcaaggcacgcgtcagaaagccgaaaacgaaaatacaggaatttgtactaacaaacgcggaagctccaaccctctattgacaactgaggaggctaacctgactgaaaaagaagaaatacgccagggggagaccttaatgatcgagggcaccgagcagttgaagtcactttcaagtgatagcagcttctgctttcctcggcctcatttttctttctctaccctgccgaccgtcagccggactgttgagctaaaatccgagcccaatgttatcagttcacctgccgaatgctctctggagttgtccccgagccgtccctgtgttctgcactcaagtctgtcgcgaagggagactccaatttgtatgctgccaatcgagaccgaacggaacatctttgagaacttcgctcaccccccaaacatcagcccatcggcttgccccctgccaccaccaccacctattagtcccccgtcccccccacccgctcctgcacccttggcacccccaccagatatcagtccattcagcctcttctgcccgccccctagccccccctccattcctctcccactgccccctccgactttctttccactctcagtgtctacctcaggacccccaacacccccacttctccctccttttccaaccccacttcccccacccccgccatcgataccttgccctccccccccatccgcatcatttttgtcgactgaatgtgtatgtatcactggcgtgaagtgtactactaacctcatgccagctgagaaaataaagagttctatgacgcagctctccactacgacggtgtgtaaaactgaccctcaacgggagccaaagggcatcctccgccatgttaagaacttggccgagcttgagaagtctgtggctaatatgtatagtcagatagaaaagaattaccttaggaccaacgtgagtgagcttcaaacgatgtgcccttccgaagtcacaaacatggagatcacctccgaacaaaacaaaggaagcctaaataacatcgtggagggcaccgaaaagcagagtcattcccagagtacctcactgtag

SEQ ID NO: 201967 - DNA, 4620 bp, Artificial Sequence
  Description of Artificial Sequence: Synthetic coding sequence
atgttccggcagttctacctgtggacctgcctggccagcggcatcatcctcggttccctattcgagatatgccttgggcagtatgacgatgactgcaagcttgccagaggcggcccgccagccactatagtggccatagacgaagagtccagaaatggaacaatcctcgtggacaatatgctgatcaaaggcacagcgggcggtccagacccaaccatcgagctgtcactgaaagataatgtcgattactgggtcttaatggatccagtgaagcagatgctattcttgaatagcaccggacgtgtgcttgacagggacccacccatgaatattcactccatcgtcgtgcaggtccaatgtatcaataagaaagtgggaaccatcatctaccatgaggtacggatcgtagtgagagatcggaacgacaatagccccaccttcaaacatgaaagttactatgcaacggttaacgagctcacacccgtgggcaccactatctttaccggcttcagcggcgataacggagccacggatatcgatgacggccccaatggacaaatcgagtacgtgattcaatacaatcccgatgaccctacctcgaacgatacatttgagatcccactgatgcttactggaaacatagtgctgagaaaacgcctcaattatgaggacaaaacgagatacttcgtcatcattcaagcaaacgaccgcgcccaaaacctgaacgaacgccggacaaccaccaccaccctgacagtggacgttctcgacggcgatgatttgggtcctatgttcctcccctgtgttctagttccgaacaccagagactgtcgcccacttacgtatcaggcggccattccagaattgcgtacgccagaagaactgaatcccatcatcgtgacgcctccaatccaagccattgatcaggataggaacatacagcctcctagcgaccggcctggaatcctctactcaatcctggtcggtaccccagaggattaccctaggttttttcacatgcatcccagaaccgccgaattgtcgcttctcgaacctgtgaatagggactttcaccagaaattcgatctggttatcaaggccgagcaagataacgggcacccattgccagcgtttgccgggctgcatattgagattcttgatgagaataatcaaagcccatacttcacaatgccctcataccagggatatatcctagagtccgcccccgtgggagctacaatatcggacagcctaaatctgacgtcgcccctgagaatcgtggcgctggataaggacatagaagataccaaggatcccgaactgcacctttttctgaacgattacacctcagtcttcaccgtgacccagaccggcatcacaaggtatctgactctgctacaacccgtagacagggaagagcaacagacctacactttctccattaccgcattcgacggcgtgcaggagagtgagcctgtcatcgtcaacattcaggtcatggacgccaacgataacaccccaacattccctgagataagctacgacgtgtacgtttataccgacatgcgaccaggtgatagtgtgattcagctgaccgcagtcgacgcggatgagggtagcaacggagagattacctatgaaattctagtgggagctcagggtgatttcatcatcaacaagacgacaggacttatcacaatcgctcccggagttgagatgattgtgggccggacctatgcactgacagtacaggcggccgacaacgcacctcctgccgaacgcagaaacagcatttgcaccgtgtatatcgaagtactgccgccaaataatcagtctcctccgcgctttcctcaactaatgtacagcctggaaatatctgaggcaatgcgcgtcggcgctgttctgctcaatttacaggccacggatagggagggcgatagcataacctatgcaattgaaaacggcgatccccagagggtgtttaacctatccgagacgacagggatcctgacactgggaaaagctctagatcgcgagtctaccgaccgatacattctgattattaccgcatctgacggtaggcccgatggaacctcgactgccactgtcaacattgtcgtgaccgacgtcaacgacaatgcccccgtattcgacccctatctcccgagaaacctgagtgtcgttgaggaggaggcgaatgcgttcgtcgggcaggtgaaggctactgatcctgacgccggcatcaacggccaagtgcactacagcctggggaactttaataatctttttcgtattacctccaatggaagtatttacacagcagtgaaactcaacagggaggtacgtgattactacgagttagtggtagtcgccactgacggcgcagtgcaccccaggcacagtacactaactctggctatcaaggtactggacatagatgacaactctccggtatttaccaacagtacttataccgttttagtcgaggagaatctcccagctggtactacaatattacagattgaggccaaggatgtcgacctcggcgcaaatgtgtcttatcgcatcaggtcccctgaggtcaagcacttctttgcgctgcacccctttacaggagaactgagtttattaaggtcactggattatgaagcatttccagatcaagaggcctctataaccttcttggtggaagcctttgacatctatggaacaatgcctcccggcatcgccactgtgacggtgattgtcaaagacatgaacgattaccctccagtgttctcaaagcgaatttataaggggatggtcgcccccgacgccgtgaaggggaccccaataacaactgtctacgctgaggacgccgatcccccgggcctgcccgcatctcgggttcgctatagagttgatgatgtccaatttccctaccccgcctctatatttgaagtggaggaagatagtggacgggtcattacccgagtcaatctcaacgaggaacccaccacaatattcaagctggttgtggttgcatttgatgacggcgagcctgtcatgagtagcagtgccacggtcaagattcttgtactgcaccccggcgaaatcccccgcttcacacaagaggaatacaggccgccacccgtaagcgaactggcaacaaagggtaccatggttggagtgatttcagctgccgcgatcaaccagagcatagtttactctatcgtgagcgggaatgaagaagacacttttggaattaataatataaccggcgtcatctatgtcaatggaccattggactacgagacaagaaccagttatgtgttaagagtgcaggctgacagtttggaggtggttcttgccaatcttcgggtcccctctaaaagtaatactgccaaggtgtatatcgagatccaggacgagaataaccacccacccgtatttcagaagaagttctacattggcggcgtgtcagaagatgcaagaatgttcacatccgttctccgggtgaaggcaaccgacaaggatactggtaactattccgtgatggcttatagactcattattccacctataaaggaagggaaggagggattcgtcgtggaaacgtacacagggttaataaagacagctatgctatttcacaacatgcgcaggtcctattttaagttccaggtgattgcaacggacgactacggaaaaggtctgtctgggaaggccgacgtactggtctcggtcgtgaaccagctagacatgcaagttatagtgagcaatgtgccacctaccttagtcgaaaagaagatcgaagacctcactgagatcttagatagatacgtccaggagcagatacccggtgcgaaggtggtcgtggagtccattggagcccgtcggcatggggatgcctttagccttgaggactacacaaaatgcgacctcacagtatacgctatcgaccctcagacaaaccgggccatcgacagaaacgaactgttcaagttcctggatggcaagctcctggacatcaataaggatttccagccttactacggcgagggaggacgaatactagaaatcagaacccctgaggctgtgacatcaattaaaaagcgcggggaatccctgggatacacggagggagcgttgcttgccttagcttttatcatcatcctgtgctgcattcctgcaattcttgtggtgctcgtctcctacagacagtttaaggttcggcaggctgaatgcacaaagactgcccgtattcaagcggccctgcccgccgccaagccagctgtccccgcacccgcgcccgtggcagcacccccccctcctccgccccccccccctggagcccatctgtacgaggaactgggggatagcagtatgcacaagaactacccttggtccctggagcttatactggccagaaacatggacaaaattattaccgtgatgtctatggggatgaagtgtctaaacatgggagtcgccgtagactgctatcatcagctagaccggagaaatatggttaggtggctggtaaaactccggaaaaacatgcgccgaaaaagaaagagtcagcggaaattaaagaaccaaaggctcaagcttgagtcactggttcggagaaagaagtag

SEQ ID NO: 201968 - DNA, 2160 bp, Artificial Sequence
  Description of Artificial Sequence: Synthetic coding sequence
atgttccggcagttctacctgtggacctgcctggccagcggcatcattcttggatccctttttgagatatgtctgggccagtatgacgatgattgtaagctggctcgcggtgggccacccgcaaccattgtagccatcgatgaggagtcacggaacggaactatcctggtggacaatatgttgatcaagggcactgcaggtggccccgaccctacgattgagctgtcacttaaggataacgtcgattactgggtccttatggatcccgtaaagcaaatgctttttttaaattcgaccgggcgggtgttggaccgggacccccctatgaatattcacagcattgtagttcaggtgcaatgcatcaacaaaaaggtgggcaccatcatataccacgaggtgcgtatcgtcgtgcgcgacaggaacgataattcacccactttcaagcatgaatcatactacgccaccgtgaatgaactaacaccagtgggtacgactattttcacagggttttcgggggataatggcgcaaccgacatagatgatggccctaacggtcagatagagtacgttatccagtacaatcctgacgatcctaccagtaatgacacgttcgagattcccctgatgctaacagggaatatagtcctcagaaagagactaaactatgaagataaaacaaggtactttgttattattcaggccaacgacagggcacagaacttgaacgaacgtcgaacaaccacaaccaccctcacagtggatgttctcgacggggacgacctcggcccaatgttcctgccctgcgttctagtgcccaatacaagggattgtagaccattgacctaccaggcagcaatacccgaacttcgtactccagaggagcttaatccaatcatagtaaccccccctatccaggccattgaccaggatagaaatatacagcctcccagtgatcgccccggtattttgtactccatactcgtcggcactcccgaggattatcctcgctttttccacatgcatcctcgcacagccgagctgtcactgctggaacccgtgaacagagactttcatcagaagttcgacctcgtcataaaggccgagcaggacaatggacatcctctccctgccttcgctgggctgcatattgagatcttagatgagaataatcagtccccatactttacaatgccctcataccaaggatacatactggagtctgcaccagtgggggctaccattagcgacagtctgaatcttactagccctctcaggatagtggcgcttgataaggacatagaggatgaggagcccaagaagatcaaaaagcccaaagttgagatacgggagcctagcgaagaggaggaggtggtagtgacaatagagaaaccacctgcagcagaaccaacctacaccacatggaaacgtgctcggatatttcccatgatctttaaaaaagttaggggactagctgataaacggggaatcgtcgatctggagggtgaggagtggcagcgccgactggaggaggaggacaaagattacctgaaactgaccttggatcaggaggaagcaacagaatctaccgtcgagtctgaggaggagagcagtagtgactataccgagtacagcgaggaagaatccgaattcagtgagtcagagacaacagaagaggaaagcgagtctgaaacaccctccgaggaggaggaaagtagcacacctgagtcagaagaaagcgagtctactgagtcagaaggcgagaaagcccggaaaaatatcgtgcttgcacggaggcggcccatggtggaggaggtgaaagaggttaagggacggaaggaggaaccccaggaggaacagaaagaacccaagatggaggaggaagaacactccgaggaggaagagagcggtcccgcccccgtggaagaatctactgatcccgaggcacaagatattcctgaagagggatctgctgagagcgcctctgtggaaggcggagtagaatccgaggaagagtccgaatctggctccagctcctccagcagcgagtcacagagcggaggcccttggggctaccaagtgcctgcgtacgacagatccaaaaatgctaaccagaagaagtctcccggagcgaattctgaaggatacaataccgcattatag

SEQ ID NO: 201969 - DNA, 1953 bp, Artificial Sequence
  Description of Artificial Sequence: Synthetic coding sequence
atgttccggcagttctacctgtggacctgcctggccagcggcatcatactgggaagcctgtttgaaatttgtcttggccagtacgacgatgattgcaaactagcacgtggaggccctcccgctacgatcgtggccatcgatgaggagtctcggaatggcaccattctcgtggacaatatgctaattaaaggtacagctgggggccctgatccaacaatcgagctgagtctgaaagacaacgtagattactgggttctgatggaccctgtcaaacagatgctatttttaaattcaaccgggcgcgtgcttgacagggatccaccaatgaacatccactctatcgttgtgcaggtgcagtgtattaataagaaggtggggactatcatttaccacgaggttcgcattgtagtccgtgaccgaaatgataacagtcctaccttcaaacacgaaagctattacgctactgtcaacgagttaaccccagtggggactactatttttacagggtttagtggggataacggagctaccgacatagacgatggccctaacggacagattgagtacgtcatacagtacaaccctgatgatcctacaagcaatgatacttttgagatcccactgatgctaaccggcaatatagtgctgcgcaaacgcctgaactacgaggataaaacccgctactttgtcattatccaggcaaacgatagagcccagaatttgaatgagcggcggaccactaccactactctgaccgtggatgtgttagacggggatgatctcggccctatgttcctgccatgtgtgttggttcctaataccagagactgcagacccctgacctaccaggctgcaatccctgagctgcgcacccctgaagagctgaatccaattatagtcacacccccgatacaagccattgaccaggatagaaacattcagcctccgagcgatcgacctggcatcctgtactctatcctcgtgggtactcctgaagattacccccggttttttcacatgcatcctcgcactgccgagttatcactgctggaacccgtaaatagggatttccatcagaaattcgatctggttattaaggaagagcctaagaaaatcaaaaagcctaaagttgaaattcgagagcccagcgaggaagaggaagtggttgtcactattgaaaaacccccggcagccgagccaacatacacgacctggaagcgtgccaggatattccctatgatattcaagaaagtaagaggccttgccgataagcgggggattgtggacctggagggcgaagagtggcagcgtaggcttgaagaggaggacaaagactatttgaaactgacgctggaccaggaagaggccacagaatccacggtggagtctgaagaggagtcaagtagcgattataccgaatactctgaggaggaatctgaattcagcgagtccgagaccactgaagaagaatcagagtcggagacgccgtccgaagaagaggagagcagcaccccggagagtgaggagtctgagagcactgaaagcgaaggcgaaaaggcgaggaagaatatcgtcctggcaagacgccgacccatggttgaggaagtgaaagaagtgaagggccgtaaagaggagcctcaagaggagcagaaggagcctaagatggaggaagaagagcactctgaagaagaggagtccggacccgcacccgtcgaggagagcacagaccctgaggcccaagacattcctgaggaggggtctgccgagagcgcctcagtagagggtggagtagagtccgaggaagagtcagagtctggctcctcctcaagttcatcagagagtcaatctggtggcccctgggggtaccaggtgcctgcatatgataggtctaagaatgccaatcagaaaaagagccccggagctaatagcgagggctataatacagctctttag

SEQ ID NO: 201970 - DNA, 5358 bp, Artificial Sequence
  Description of Artificial Sequence: Synthetic coding sequence
atgttccggcagttctacctgtggacctgcctggccagcggcatcatcctgggttctttatttgaaatctgccttgggcagtatgatgatgattgcaagttagctcgtggaggaccccccgctacaatcgtggcaatcgatgaggaatctcgcaatggaaccatcttagttgacaatatgctgatcaagggtactgccggtggccccgacccaaccattgaactgtcactcaaggacaacgtggactactgggtgcttatggatcccgtgaagcaaatgctgttcttaaacagcactgggcgcgtcctcgatcgagaccccccaatgaatatacactctattgtggtccaggtccagtgcattaacaagaaggtgggaaccatcatataccacgaggtgcggatagtggtgcgcgaccgcaacgacaacagtccaacatttaaacatgaaagttactacgctaccgtgaatgagctgactcccgtcggaactacaatttttacgggcttcagcggggataacggcgcaacagacatagatgacggtcctaacggacagatcgaatatgtcatccagtacaaccctgacgaccccacctctaatgataccttcgaaatcccgttgatgttaactggtaacatcgtgctccggaagagactgaactacgaggacaagacaagatactttgtgatcatccaggctaacgacagggcacagaatctgaacgagaggcggactaccaccaccaccttgacagttgatgtgttggatggcgacgacctcggcccgatgttcctcccctgcgtacttgttccaaacacgagggattgtcggccgcttacctaccaagccgccattcccgaattacggacaccagaagaattaaatcctatcatagtcacccctcccatccaggccattgatcaagaccggaacatccagccccccagcgataggcccggcatcctctactctattctggtgggtactcccgaggattatccacgattcttccatatgcaccctcggacagccgaactctctcttctcgagcctgtcaaccgagatttccatcagaagtttgacttagtgattaaggcagagcaggacaatggtcatccattgcccgcatttgccggcctacacatagagatattagatgagaacaatcagtctccctacttcactatgccctcctatcaggggtatatactggagagtgcgccagtgggagcaacgatctctgatagtctcaatctgacgtcaccactccgtatagtcgcacttgacaaagatatcgaagacgtgcccccgagtggcgtgcccacgaaggaccctgaacttcacctgtttcttaacgactatacctcggtgtttactgtcactcagaccgggattacgagatacctcactctgctccagcccgtggaccgggaagagcaacagacttacacattcagtatcacagccttcgacggtgtgcaggaaagcgagcccgttattgtgaacatccaggtaatggacgcaaatgataatacccccacttttccagagatatcctatgacgtgtatgtctacaccgacatgcgccccggggactcagtgattcagctgacagcggtggacgctgatgagggctctaatggggagatcacatatgagatcctcgtgggggctcagggcgacttcatcattaacaagacaacagggctcatcacaatcgctcccggggtcgaaatgatagttgggagaacctacgcgctgactgttcaggccgccgataatgccccgcccgcagagcggcgcaatagcatttgtacagtttatatcgaagtgcttcctccaaacaaccagagcccccctcgattcccacaactgatgtacagcctcgaaattagcgaagctatgcgggtaggggctgtgcttctaaatctccaggcaaccgacagggagggcgatagcatcacctacgccattgaaaatggcgatccccagagggtgttcaacttgtccgagacgactggaatcctgacacttgggaaagctcttgatcgcgagtcaacagatcggtacatcctcattataacagcctcagatgggcgcccagatggcacttcgactgccaccgtcaacatcgtcgttacggatgtgaacgataatgcacctgtattcgacccgtatttgcccaggaatctgagcgtcgtggaggaagaggcgaatgcgttcgtgggccaagtgaaggcaacagatcccgacgcaggcattaatgggcaagtgcattactccctgggaaatttcaacaatttgttccgcataacttccaacggctctatttacaccgccgtcaaacttaaccgggaagtgagagactactacgagctggtggttgtggcgactgatggtgccgtgcatcctcggcactctaccctgaccctggctatcaaggtcctggatatagacgacaatagtccggtgttcactaactctacatacaccgtgctcgtcgaggaaaacctgccagccggtactacaattctccagatcgaggctaaggacgtcgacctaggggcgaatgtatcctataggatccggagccctgaggtgaaacatttcttcgctctgcacccattcacaggtgaactctcactgctacgctctctggactacgaggcgtttcccgaccaggaagcctcaattacttttctcgttgaggcttttgacatttatggcactatgcctcctggcatcgctacagttaccgtgattgtcaaggatatgaacgactatcctcctgtgttctcaaaaagaatttataaaggaatggtggcgccagatgctgtcaagggaactcctattactacggtctacgcggaagacgcagacccacccggtttgcctgcctccagggttcggtaccgcgtggatgacgttcagtttccttatcccgcctcgatcttcgaagtcgaggaagacagcggcagggtcatcacaagggtgaacttgaatgaagagccaaccaccatttttaaattagttgtggtcgccttcgacgatggagaaccagtcatgtcgagcagcgcgactgttaagattctggtgctgcatcctggagagatcccccggtttacccaggaggaataccgacccccccccgtgtcggagctggctactaaagggacaatggtgggcgtcatcagtgcggccgccatcaaccagtcaatcgtgtactctattgtatcggggaatgaggaggatacctttggaattaacaacattaccggcgtcatctacgtgaatggacctttggactacgagaccaggacctcatatgtattaagggtgcaggccgactcactggaagtcgtgctggctaacctcagggtgccatcaaaaagcaacacggcgaaagtttatattgagattcaagatgagaataatcaccctcccgtgttccagaaaaaattttatattggcggcgtctctgaggatgcccgtatgttcacttccgttctcagggtgaaggcaacagacaaggataccgggaactatagtgtgatggcatacagactgattatccctcctataaaagaagggaaggagggtttcgtggtggaaacatacaccggcctgatcaaaacagctatgctgtttcacaatatgcggcggtcctattttaagttccaagtcattgcaaccgacgattacggaaagggcctcagcggcaaggctgatgtgctggtgtctgtggttaaccagctggatatgcaggtgatcgtgtctaatgttcctccgaccctggtggaaaagaaaatagaggacctgacagagattctggataggtatgttcaggagcagattcccggcgccaaagtagtcgtcgagtccatcggagccagacgacatggagacgcattcagcttagaggactatactaaatgcgaccttaccgtatacgccatagatccacagaccaatagagccattgaccggaatgaactcttcaagtttttagacggtaagttactagatataaacaaggatttccagccatactatggggagggcggacgcatcctggaaattcgcacaccagaggctgtgacaagcattaaaaagcgaggtgaatctctgggatacaccgagggcgcgcttctcgctctagcgttcatcattatcctgtgttgcatccccgccatcctggtagtcctggtcagctataggcagttcaaagttcgccaggctgaatgtacaaaaaccgcccgtattcaggctgcgcttcctgccgcgaagccggctgttccagcccccgcacctgtggccgctccaccacctccgccacctcctccacccggcgcccatctgtacgaagaactgggagattccagcatgcataagtatgagatgccacaatacggatctcggaggcggcttctccccccagcgggtcaggaagagtacggggaagtggtgggtgaagctgaagaggagtacgaagaggaggaagaagagcctaagaaaattaagaaacccaaagttgaaattagagagccctcagaggaggaagaagtagtggtaaccattgaaaagcccccagcggctgaacccacatatacaacatggaagcgcgctcgcatctttccaatgatcttcaaaaaagtgagaggcctagctgataagagggggatcgtagaccttgaaggggaagagtggcagcggcgattggaagaagaggacaaagactacctgaagttaactttagaccaggaggaagccactgaaagcaccgtggagagcgaggaggagtcctcctccgattacacggagtattcagaggaagaatcagagttctctgaaagcgagacgacagaagaggaaagtgaatctgagaccccaagcgaggaggaagagtcatccaccccagaaagtgaggagagcgaaagtacagaatctgagggtgagaaagcccggaagaatatcgtgttagccaggaggcggcctatggtggaggaggtcaaagaggtgaagggtagaaaggaggagccccaagaggaacaaaaggaaccaaagatggaggaggaggaacactcggaggaggaagagagcggacccgcccctgtcgaggagtctacagatcccgaagctcaagatatccctgaagagggctcggcggagtctgccagtgtggagggcggtgtggagtctgaagaagagagcgagtcgggttcttcctcatctagctccgagtctcagagtggcggaccatggggctatcaggtaccagcctacgacaggtctaagaacgcgaatcaaaagaaaagtccaggggccaacagtgagggatacaacacagctctttag

SEQ ID NO: 201971 - DNA, 2946 bp, Artificial Sequence
  Description of Artificial Sequence: Synthetic coding sequence
atgttccggcagttctacctgtggacctgcctggccagcggcatcatcctcgggagcctatttgaaatttgcctcggccaatacgacgatgattgcaaattagcgaggggagggcccccagccacgatagtggcaattgacgaagagagccgtaacggtactatcttggtcgataacatgctgataaaaggcaccgctggaggccccgaccccactatagagttgagccttaaggataacgtcgactactgggtgctcatggatcccgtcaagcagatgctctttttgaatagtaccggccgggtgctggaccgggacccccctatgaacatacacagcattgttgtccaggtacagtgtatcaacaaaaaagtaggcaccatcatatatcatgaggtccgcatagtcgtccgggacaggaatgacaactcccctaccttcaagcacgagtcttattacgctacggttaacgagctaactccggtgggcaccaccatctttactgggttctctggtgataatggagccaccgacatagacgatgggccaaacggacagatagagtatgttatccagtacaaccccgatgatcctactagtaacgatacattcgagatacccctgatgctcaccggcaacatcgtgctcagaaaacggctcaactacgaagacaagaccaggtacttcgttataatccaggcaaatgatcgagctcagaaccttaatgagagaaggactacgaccacaaccttgaccgtggatgtgctagacggagatgacttaggtccgatgttccttccctgcgtcttggtccctaacacaagggactgtaggcctctgacctaccaggccgctatcccagagcttaggacacctgaggaactgaatcctatcatagtgactcccccaatacaggctatcgatcaggaccggaatatccagcctcccagcgaccggcccgggatcctatactccatcctggtcggtacccctgaagattacccgagattttttcacatgcacccaaggacagccgagctgtctttactcgagcctgttaatagagatttccatcagaagttcgatctcgtcataaaagctgagcaggataacggccacccacttcccgcctttgccggcctccacattgagattttagacgagaacaaccagtctccatatttcaccatgccctcctaccagggctacatcctcgagtctgccccggtcggcgcaacgattagcgattctctgaatcttacctccccgctccggatagtggccctggataaggacatcgaggataccaaagaccccgagcttcatctgttcctcaacgattacaccagtgtcttcacagtgactcagacaggcatcacacggtatctgacactgctgcagcctgtagacagagaagagcagcagacctatacattttcaatcaccgcgttcgatggagtccaggagagcgagcccgtgatcgtaaacattcaggtcatggacgctaatgataatactccaacctttcctgagattagctacgacgtttacgtgtacactgacatgagaccgggagatagtgtgatacagctgactgccgtagacgctgacgaagggtccaatggggagattacatacgaaattctggtgggagcgcagggtgactttattatcaataaaacgaccggattgatcacaatcgcgccaggagttgagatgatcgtgggtcgaacctacgctctgacagtgcaggcggctgacaacgctcctccagcagaacgcaggaacagtatttgtaccgtttacatagaggtgctcccccccaataaccagagtcccccaaggtttccccagttgatgtacagtttggagatttctgaggctatgcgtgtaggagctgtccttctgaatctgcaggcaacggatcgcgagggcgactcaatcacatacgccatcgagaacggcgacccccaacgagtgtttaacttgtccgagaccactggtattttgactcttgggaaagcattagatagagaatctaccgatcgctatattcttatcattactgccagcgacggaaggcccgacggcgaggaacccaaaaagatcaagaagcctaaagtggagatccgggagccctcagaggaggaggaggtagtggtaacaattgagaagccacccgccgcagagcccacttataccacatggaagcgcgccaggatctttcccatgatttttaaaaaggtgagagggctggcagataaaagggggatagtagatctcgaaggtgaggagtggcagcgacgtctggaggaggaggataaggattacctaaaattaacactagaccaggaggaagccacggaaagcaccgtcgagtctgaagaagaaagctccagcgactacacagaatacagtgaagaggaatctgaattctcagagagcgagacaaccgaagaagagtccgaatcagagacaccctcggaagaagaggaaagctcgacaccagagtcagaagagtcagaaagtactgaaagcgagggcgaaaaggctagaaagaacattgtccttgccagacggcgtcctatggtggaggaggtcaaggaggtgaagggccggaaagaggagcctcaggaagagcagaaagagccaaagatggaggaggaggagcattcagaggaggaggaaagcgggccggcacccgtggaggaaagtaccgatcccgaagcgcaggacattccagaagagggcagtgccgagtctgcctctgttgaaggtggcgtagaatccgaagaggagagcgagagtggatcatcttccagttccagcgagtcccagagcgggggtccatggggctatcaggttccagcttacgaccgctcaaagaacgcaaaccaaaagaaaagccccggtgccaacagcgagggatataacacggctctgtag

SEQ ID NO: 201972 - DNA, 3453 bp, Artificial Sequence
  Description of Artificial Sequence: Synthetic coding sequence
atgcccagctaccagggctacatcctggagagcgcccccgtgggcgccacgatcagcgacagcctgaatctcacaagccccttacgcattgtggcactcgataaagacattgaggacgttcccccctcgggcgtaccgacaaaagatcccgagcttcatttgtttctgaatgactatacttccgtgtttactgtgacacaaaccggaataactaggtaccttacactccttcaacctgtggatagagaggaacagcagacatatacattcagcatcaccgcctttgatggcgtacaagaatccgagcccgttatcgtgaacatccaagttatggacgcaaatgacaataccccaacattcccggaaatctcctacgatgtgtacgtgtataccgacatgcgacctggcgactccgtgatacagctcactgccgttgacgccgacgagggtagcaacggcgagattacctacgagattctcgttggcgctcagggcgactttattatcaacaagacaacaggcctcatcacaattgccccaggtgtagagatgatagttggccgcacatacgcactgactgttcaagctgcggataacgcgccccccgcggaaaggcgtaacagtatctgcaccgtatacattgaggttttaccccccaataaccagagtccaccacggttcccccagctgatgtacagtctggagatttctgaagccatgagggtgggggcagtccttttaaatcttcaggccactgacagagaaggtgactcaattacatacgctatcgagaacggcgacccgcagcgagtgttcaatttgtcggaaactaccggaattttaacccttgggaaggctctggaccgggaaagcacagatagatatattctgatcatcacggcttctgatggacgtcccgatggtacaagcacagcaaccgttaacatcgtggtgaccgacgttaacgacaatgcacctgtgttcgatccttatcttccgaggaatctctcagtggtggaagaagaagccaatgcctttgtgggccaagtgaaggccaccgacccagatgcaggtattaatgggcaggtccattattcccttgggaactttaacaacctgttccgcatcactagcaacggatcaatatataccgctgttaaacttaatcgtgaggtccgcgattattacgaactggtcgtggtcgccacagatggggcagtccacccccgtcactcaaccctgacgctggctataaaagtactggatatcgatgataattcgccagtcttcacaaactccacatacactgtgcttgtagaggaaaatctgcctgccggaaccacaatcctgcaaatcgaggccaaagatgtcgatttaggggccaatgtgtcttaccgcatacgatctccagaagtgaaacattttttcgcactccatccattcacaggcgagctctctctactcagatcccttgactacgaggctttccccgaccaagaggcctccatcacttttcttgttgaggcttttgacatttacggaacgatgccacccgggatcgctaccgtgacagtgatagtgaaggatatgaatgattatccccccgtgtttagtaagcgaatatataaaggcatggtcgcgcctgacgcggttaaaggcactcccatcaccacagtgtacgcagaggacgctgacccccccggcctccccgcaagcagggtgagatatagggtcgacgacgtacagttcccctatcctgcctcaatttttgaggtggaggaggactcagggagagtgataacaagggttaacttgaacgaagagccaaccacgattttcaaactcgtcgtggtggccttcgacgacggcgaacccgtgatgagctcaagcgctactgtgaaaatactggttctccacccgggggaaatacctaggttcacccaagaagagtatcggccaccccccgtgtccgagctggccaccaaagggacaatggtcggggtaatcagtgcggcggccataaaccagagcatcgtctattcgatagtcagcgggaatgaggaggacacttttggtatcaataacataactggcgtaatttacgtgaatggccccctcgactacgagacgcgcacatcctatgtcctccgtgtacaggccgactcattggaagtcgtactggccaatctaagagtcccatcaaaatctaacaccgccaaagtgtacatcgaaatccaagatgaaaataatcatcctcccgtatttcagaaaaagttctacatcggaggcgtcagtgaggacgcccggatgtttacctcagttctgagggtcaaagccacagacaaggacaccggcaattatagcgtgatggcttaccggctgataataccccccattaaggaaggcaaggagggctttgtggtcgaaacatatacaggactaatcaagacggccatgctctttcacaacatgcgtaggagctactttaaatttcaggtcattgccaccgacgactacggcaaaggcctgtccggcaaggccgacgttctggtcagcgttgttaatcagctcgatatgcaggtaatcgtatctaatgtgcccccaactttggtggaaaaaaagatcgaggaccttaccgagattctcgacagatatgtgcaggagcagattcccggggccaaggtggtcgtggagagcatcggggccagacgccatggagatgcattttcacttgaagattatactaaatgcgacctgacggtgtatgctatcgatccgcaaacaaatagggctatcgatcgaaatgagctttttaagttcctggacgggaaactgctggatatcaataaggactttcagccatactatggcgagggaggaaggattttggagatcagaacacctgaagctgtcacctcgatcaagaagagaggtgaatcattgggctacacagagggcgcactgttagcgttagccttcatcatcatattgtgctgtatccctgccatactcgtggttttggtgagttacaggcaattcaaagtgaggcaggcggaatgcaccaaaaccgccaggattcaggcagccttacccgctgccaaacccgcggtacccgccccagctcccgtggcggcccctccacctccgccaccccctcctcccggagcccatctgtacgaggagttgggggacagctccatgcacaagaactacccatggtctctcgagctcatcctcgcccggaacatggacaaaattattactgtgatgtcaatgggcatgaaatgtctcaatatgggcgtggctgtcgactgctaccatcagctggacagaagaaatatggtccgctggctggtcaagttaaggaagaatatgagaaggaagcgcaagagccagaggaagctaaaaaaccagagattaaagctcgaatccctggtgcgccggaagaagtag

SEQ ID NO: 201973 - DNA, 990 bp, Artificial Sequence
  Description of Artificial Sequence: Synthetic coding sequence
atgttccggcagttctacctgtggacctgcctggccagcggcatcattctggggtcgctctttgaaatctgtctggggcaatatgacgatgactgcaagctcgcgcggggagggcccccggccacaattgtggctatagatgaagagtctcggaatggaaccattttggtggacaacatgctcataaaagggactgctggtggccctgaccctacaatcgagctgtctttaaaggataatgtggattactgggtcctgatggacccggttaagcagatgctttttctgaactctacaggaagggtgctcgacagggatcccccgatgaatatccattctattgtggttcaagtacaatgcatcaataaaaaagtcggcaccatcatttatcatgaagtgagaattgttgtgcgagaccgcaacgacaactcccccaccttcaaacacgaatcatactatgctactgtcaatgagctgactccagtgggaactaccatcttcaccggatttagtggggataacggagccaccgacattgatgatggacccaacggccagattgagtatgtaattcaatacaacccagacgaccctacctctaatgatactttcgaaatcccactcatgttaaccggcaatatagtcctaaggaagagactgaattatgaggataagacgagatattttgtgatcatccaggctaacgaccgggctcagaaccttaacgagcgacgtaccacaacaactacactgaccgtcgacgtgcttgatggggacgacctgggccctatgtttctgccatgtgtgttggtcccaaatactagagattgccgacccttgacatatcaggccgctatccccgagctgcggaccccggatctgggaagtctctgctcaggcaccaattcatggtgtcaggggcgttctggcgtgcactggagctcccctgcttggcggtgtctatttccgcgccggctgcatcagatgtag

SEQ ID NO: 201974 - DNA, 5046 bp, Artificial Sequence
  Description of Artificial Sequence: Synthetic coding sequence
atgttccggcagttctacctgtggacctgcctggccagcggcatcatcctggggtcgctcttcgagatctgtctcggccagtacgacgacggctggcggtatatgtattgtaaactagccagagggggtccaccagcgacaatcgtagctattgatgaagaaagccggaatgggaccatccttgtggataacatgttaattaaggggactgctgggggaccagatcccacaatcgagttatccctgaaggataatgtcgactactgggtgctcatggaccccgttaagcagatgttgtttttaaattcgaccggacgtgttctggaccgggatccgccgatgaatattcacagtatagtggtgcaagtgcaatgcattaacaaaaaagtggggaccatcatctaccacgaagtacgcatcgtggtgcgtgatagaaatgataattctccgactttcaaacacgagtcgtactatgccaccgttaacgagctgacaccagttggtactacgatcttcacaggcttttctggagataacggggccactgacatcgacgacgggcctaacggacagatagaatatgtgatacaatataaccccgacgatcccacttcgaatgatacttttgagatcccactcatgctgactggtaatatcgttctccgcaaaaggctaaactacgaagacaaaacacgctacttcgtaataatccaggctaacgatcgcgctcagaaccttaatgaacgaaggacaacgaccactacactcaccgtggacgtgctggatggtgatgatctggggcccatgtttcttccttgcgttctggtccccaataccagagattgcagaccattgacttaccaggccgctattcccgagctcaggacccctgaagagttaaaccccatcatcgtcaccccgccgatccaggcgattgatcaggatcgcaacatccagcccccttcggacaggcctggcatactatattctatcctggtggggacaccggaggattacccccggttcttccacatgcaccccaggaccgcggagctcagcctcctcgagcccgtcaatcgagacttccaccagaagttcgatttggtaatcaaagccgagcaggacaacggccaccccctgcccgcttttgccggactgcacattgagattctggatgagaacaaccagtccccctatttcacgatgcccagttatcaggggtacatcctggaatccgcccccgtcggcgctaccatctcagattcgctgaacctcaccagccccctgaggatcgtagcgttggacaaagatatagaggatactaaggatcccgaactacacctctttctcaatgactacactagtgtctttaccgtgacccagactgggatcacacggtacctgactttactgcagcccgtcgatcgggaagagcagcaaacatataccttctctatcaccgcttttgatggtgtgcaagagtcagagccagtcatcgttaacatccaggtgatggatgccaacgataatactcccaccttcccagagatcagttacgatgtgtatgtttatactgatatgcggccaggcgactccgttatccagttgacagctgtggatgctgatgagggctctaatggcgaaattacctacgaaatccttgttggcgctcagggcgattttatcatcaacaaaaccacgggcctcattaccatcgcgcctggtgtcgaaatgatcgttggcaggacctatgccttgaccgtccaggcggctgacaatgccccgccagcagagaggcgcaattccatctgcacagtatacatcgaagtgctcccacccaacaaccaatctccgcctcgattccctcaacttatgtatagcctggagatctccgaggctatgagggtcggagctgttcttctcaacctgcaggctacggatcgggagggtgatagcatcacttatgctattgaaaatggagatcctcagcgagtgttcaaccttagcgaaaccacaggaatcttgacattagggaaagcactcgatcgagagtccacagatagatatattcttatcatcaccgcgagcgacgggaggccagacggaaccagcacagccaccgtgaatatcgttgtgacggacgtgaatgacaatgcccccgtatttgacccatatctgccacgcaacctgagcgttgtggaagaggaagccaatgcctttgtgggacaggttaaggccaccgatcctgatgccggtattaatggtcaagtgcattatagtctgggcaatttcaacaatctttttaggattactagcaacggctcgatctacacagcagtcaagcttaaccgggaggttagggactattatgagttggtggttgtggccactgatggagccgtgcatcctcggcattccacattaacccttgcaattaaggtcctagacatagacgacaatagccccgtattcacgaatagtacatacacagttctcgtggaagaaaatctgcctgccggcactaccatactgcagatagaagccaaggatgtggacctcggagcaaatgtgagctatcgcatcagaagcccagaagtcaagcacttctttgcacttcacccatttaccggggagctgagcctcttaagatccttggattacgaggccttcccagaccaggaagcaagcattacattcctcgttgaggcttttgatatctacggcaccatgccccccggcattgcaaccgtcacagttatcgtcaaggacatgaatgattacccccctgttttcagtaaacggatatataagggcatggtcgctcccgatgctgtcaagggcactccaatcactactgtgtacgccgaagacgccgaccctcctggcctccccgcctctagagtccggtatcgagttgatgacgtccagttcccgtaccctgccagtatctttgaagttgaggaggattcaggtagagtgattacacgtgtgaacctcaatgaagaaccaaccacaatcttcaagcttgtggtcgtggcctttgacgacggggagcccgtcatgagcagtagcgctactgtcaaaattttggtactgcaccccggggagatcccccgttttacccaggaggagtacaggccaccccccgtatctgagcttgctacaaagggtaccatggtgggcgtaatctccgccgctgctattaatcaatctatagtgtactctattgtatctggtaacgaggaagacactttcggaattaacaacattactggcgtcatctacgtgaatgggcccttggattatgagacgaggacatcatacgtgctccgtgtgcaagccgactctctggaggtggtactggccaacctgagggtgccgagtaaatctaacaccgctaaagtgtacatcgaaattcaggatgagaataaccaccctccagtcttccagaagaaattctacatcggcggcgtctccgaggacgccaggatgtttacctcagtcctgcgagtgaaggcgactgataaggacaccggtaattatagcgtaatggcttatcgcctaattataccaccaattaaggagggaaaggaaggatttgtggtggagacttacacaggcctgatcaagactgcgatgctctttcacaacatgcggagaagctacttcaaatttcaggttattgccaccgacgattatggtaaggggttgtctgggaaggcggacgtcctagtgtctgtcgttaaccaattggacatgcaggttatcgtgagtaatgtgcctcctacgctcgtcgagaagaaaattgaagacctgacagaaatccttgacagatatgtccaggagcagatcccaggcgccaaagttgtggttgagtccataggcgctagacggcatggggatgcttttagcctggaggattatacaaaatgcgacctgacggtttacgctatcgatccgcagacaaaccgggcgattgatcgtaacgagctgttcaagtttctcgatggaaagttgctggacataaacaaggattttcagccttattatggagaggggggaagaatcctcgaaatccgcaccccagaagctgtgacttctattaaaaaacggggagagagcctcggttatacggagggggcgctgctggcactggcctttatcattatactctgctgcatcccggccatcctggtggtgctggtgtcttataggcagcgacaagcagagtgcacaaagactgcgagaattcaggctgcccttcccgcagcaaaaccagctgtccctgctcccgcgcccgtggccgcaccccccccccccccacctccacctcccggtgctcatctatacgaggaactcggcgattcatcaatcctgtactaccgatatgagatgcctcagtacggaagccgtaggcggctgcttccacctgcaggccaggaagagtacggggaagttgttggcgaggctgaggaggaatacgaggaagaagagtgggccaggaagcggatgatcaagctggttgtggatagagaatatgagacgagctcaacgggagaagactccgcacccgaatgccagagaaatagactccaccatccttcgatacattcaaacatcaacgggaatatatatattgctcagaatggttctgtggtacggacccgaagggcatgcctgacagataatttgaaggtcgcttctccagtccgcttggggggcccctttaaaaagctggacaagctggcagtaacacacgaggagaatgtgcccttaaacactctctctaaaggcccattttccaccgagaagatgaacgcgcggccaacattagtaactttcgctccttgccctgtgggcaccgacaacaccgcagtgaagcccctgaggaacagactgaaatcaacagtggagcaggaaagtatgatagactcaaaaaacataaaagaagctctggagtttcattccgatcacacccaaagcgacgatgaagagttatggatgggaccgtggaataaccttcacattcccatgactaagctgtag

SEQ ID NO: 201975 - DNA, 5889 bp, Artificial Sequence
  Description of Artificial Sequence: Synthetic coding sequence
atgttccggcagttctacctgtggacctgcctggccagcggcatcatcttaggcagtctgtttgagatttgcttaggccagtacgatgacgcatatagctacgaggattgcaagttggctcggggtggccccccagccacgatcgtagctatagacgaggagtcaagaaacggcacgatcctggtcgataatatgcttataaaggggacagctgggggaccagatcctacgatagagctgagccttaaagacaacgtagactattgggtccttatggacccagtgaagcagatgctatttttgaattccacaggccgggtgctggatcgcgacccaccaatgaacatacacagtatagtagtccaggtgcagtgcatcaacaaaaaggtcggtaccatcatctatcacgaggtgagaatcgtcgtgcgagatcggaatgataattcacccacgttcaaacacgaaagttattatgctaccgtgaacgaactgacccctgtggggaccacaatcttcacagggttctccggagataacggcgcaaccgacatcgacgatgggcccaacggacagatagagtacgttattcaatacaatcctgatgaccccactagcaacgatacatttgagatcccactaatgttaacaggaaatatcgtcttacgtaagcgcttaaactatgaagataagacaagatatttcgtgatcatccaggcgaacgatcgcgcccagaaccttaacgagcgacgaacaaccacaacaactctgactgtggatgtgttggatggagatgatctcggccctatgtttctaccttgcgtcctcgtgcccaatactcgggactgcagaccgttaacctatcaggctgctatccctgagctgcggacccctgaggagttaaatcccatcattgtcaccccccctatacaagcaatagatcaggatcgaaatattcagcctccatccgacaggcccggcattctgtacagtattctcgttggaaccccagaagactatccccgattctttcatatgcacccaagaacggcagagttatccttactggagcccgtgaatcgggatttccaccagaagttcgaccttgtgattaaggctgagcaggataatggtcaccccttgcccgcctttgcgggactacacatagaaattcttgacgaaaacaaccaatccccatacttcacaatgcccagttatcagggctatattctggaatctgctcccgtcggtgccacgatttctgactccctgaaccttactagccctctccggattgttgcgttggacaaggacattgaggataccaaggatccagagcttcatttgttcctgaacgattacactagtgtgtttacggtgactcaaacaggcatcacccggtacctgaccctgctgcagccagtcgaccgcgaagagcagcagacctacaccttcagcatcacggcttttgatggcgtgcaggagtctgagcctgtgatcgtgaacatacaggttatggatgccaacgataacacacctactttcccggaaatttcctacgatgtgtacgtctacaccgacatgcggcctggcgactccgttatacagctcactgctgtagacgcagacgaaggctccaatggtgagataacttacgagattctggttggggcacagggcgacttcataatcaataaaacaacgggcttgattactattgccccaggggtcgagatgattgttggaaggacctacgcgcttacggttcaggcggccgacaatgcccccccagccgagaggagaaactcaatctgtaccgtctatatcgaggttctgccccccaacaatcagtccccccctcggtttcctcaactgatgtactccctagagatcagtgaagctatgcgcgtgggggccgtgctgctaaacttacaagcaacagacagagaaggggattccatcacctatgctatcgagaacggcgacccccaacgcgtgttcaatctcagcgagaccacaggaatcctgacccttggcaaagccttagacagggagtctacggacaggtacatcctgattatcactgccagcgacgggcggcctgatggtacaagtacagcaaccgtcaacatcgtagttacagacgtgaatgataacgcacctgtattcgacccttacttacccagaaatctctcagtggtggaagaagaggcgaacgctttcgtcggacaggttaaggccaccgaccccgatgcgggcataaatggtcaggtccattattccctggggaatttcaacaatctctttcgcattacctcaaatgggagcatctacaccgcggtgaagttgaaccgcgaagtccgtgactattacgagcttgtggtagtggccacagatggagcggtccaccctcggcattccacacttacacttgccatcaaagtcttggacatcgacgataactcccccgtattcactaattccacatacacagtactggtagaggaaaacctaccagcgggtaccacaatcctgcagatcgaggcgaaggacgtcgatctgggcgccaacgtaagctaccgcatcaggagtcccgaggtgaagcacttcttcgctctgcacccctttaccggcgagctttccttgttaagaagccttgattacgaggcttttcctgatcaggaagcctccatcacctttctggtggaggcattcgatatttatggcacaatgcctcccggaatcgctaccgtaactgttatcgtgaaagatatgaacgactaccccccagttttctccaagcggatctacaagggcatggttgcccccgatgccgttaagggaacacccatcactaccgtgtacgcagaggacgccgatccgcctggcttacccgcatcacgagtgaggtacagagtcgacgacgtacagttcccctacccagcctcaatttttgaagtggaggaagatagcggaagagtcatcacccgcgtgaacctgaatgaggagcccactactatctttaagctggtagtcgtagccttcgatgatggagaacctgtgatgtccagctctgcaactgtaaaaattctggtgctacacccaggcgagattccaagatttactcaggaggaataccgaccgccacctgtctccgaactcgccaccaagggcactatggtgggtgttatctcggctgctgctataaatcaatccattgtttattccatcgtgagtggcaacgaggaagacacatttgggataaacaatatcacaggcgtcatttacgtaaacggtccactagactacgagacacgaacaagctacgtcctgagggtacaggccgattccctcgaggtggtgctagctaatctgcgcgtgcccagcaaaagtaacactgctaaggtgtatatagagattcaagacgaaaataaccatccacccgtgtttcaaaagaaattctatattggtggcgtgtctgaggacgcaaggatgttcacaagtgttctgcgagttaaagcgactgacaaggatacaggtaactactcagtaatggcataccggctcatcatcccacccatcaaagagggcaaagaaggattcgtggtggaaacctatactggtctgataaagaccgcaatgttgttccacaacatgcggcgttcatactttaaatttcaggtgattgccactgacgactacggcaaggggttatccggtaaagccgatgttctcgtctccgtggtgaatcagctcgacatgcaggtcatcgtgtccaacgtgcctccgacgctagtcgagaagaagattgaggatctgacggagatcttggatcgctatgtgcaggaacaaatcccaggtgccaaggtggtcgtcgaaagcatcggagcccggaggcacggtgacgcattttccctggaagactacaccaagtgcgacctgaccgtgtacgcaattgacccgcagacaaaccgagctatcgaccgaaacgagttgttcaagtttctggatggaaagcttctggacatcaacaaagacttccagccctactacggcgaaggtggaagaatcctggagatcagaacgcccgaggccgtcacatccatcaagaaacggggcgagtctctggggtatacagagggagccttgcttgcccttgcgtttatcatcatcctttgttgcatccctgccatcctggtcgtgttggtcagctaccggcacttcaagcgccgccaggcggaatgcactaagaccgctagaatccaggcagctctgcccgcagctaagcctgccgtgcctgctccagcaccagtggctgcgccacccccccccccacctcctccacctggggctcatttgtacgaggaactgggggacagctctatgaaggggctcttcctcctgtatcacttccagcaatcaagaggtaataactccgtatctgaagaccgtaagcatcagcaggttgtgatgccattttccagcaatactatcgaggcacataagtcagcccatgtcgatggttcactgaaaagtaacaagctcaaatctgccaggaagttcaccttcctctccgatgaggacgatctttctgcgcataatccattatacaaggagaacatctcccaggtatccaccaactctgacatctcccagcgaactgactttgttgaccccttctccccaaaaatccaagcgaagtccaaatcactgcgcggccctagagaaaagatccagcgactgtggtctcagagtgtttctcttccccgacgcttaatgaggaaagtacctaatcgccctgagataattgacctccaacagtggcagggcacccggcagaaggcagaaaacgagaacacagggatttgtaccaacaaacgtggaagcagtaaccctctccttaccactgaagaggccaacctgacggaaaaggaagagattcggcagggagaaacactgatgattgaaggtaccgaacagcttaagtctttgagctcagatagttcgttctgttttccacgcccgcactttagcttctctacacttcctactgtgagcagaacggttgaacttaaatctgagcctaacgtgatctcttctccagcagagtgtagcctggaactcagcccctccaggccttgcgtccttcacagtagcctatctaggagggagactcctatctgcatgttgccaattgagaccgagcggaatatcttcgagaatttcgctcatcccccgaatatctccccttccgcctgcccgcttcctcctcccccccctatctcacccccttcaccgccgcccgcccctgcacccctggctcccccaccggacatttccccattcagtttattctgtcctcccccatccccgccctcgattcccttgccattgccaccccctaccttttttcctctcagcgtgagcacgtccggacccccgacccccccgctgctgcctccttttcccacccctctgcctccaccgcctcccagtattccatgcccccccccgccctccgcgtcattcctgagcaccgaatgtgtctgtattaccggtgtaaagtgtactaccaatctcatgcccgctgagaagattaagtcctctatgactcaactcagcaccacaactgtgtgtaagactgatcctcagagagagccaaaaggcattttaaggcatgtgaagaatttagcagagctcgagaaatctgtggccaacatgtattcccagatcgaaaagaattacttgcggaccaacgtgtccgaactgcagacaatgtgtccttctgaggtgacaaatatggaaatcacttcggaacagaacaagggatccctcaataacatcgtcgaaggaaccgagaagcagtcccacagccaaagtacttccctgtag

SEQ ID NO: 201976 - DNA, 5661 bp, Artificial Sequence
  Description of Artificial Sequence: Synthetic coding sequence
atgttccggcagttctacctgtggacctgcctggccagcggcatcatactggggtccctgtttgaaatttgtctggggcagtatgacgacgactgtaagctcgcgcgcggaggccctcctgccacaattgtggcaatcgacgaagagagcagaaacggaactatactcgtagataatatgcttattaaaggaacagccgggggcccagatcccaccattgagttgtcactgaaagataacgtagactactgggtcctgatggatcctgtaaaacagatgctcttccttaatagcaccggtagagtgctggatagggaccctcctatgaacattcactccattgtcgtgcaagtacagtgtattaacaagaaggtgggcactataatttaccacgaagtgaggatcgtcgtcagggatagaaatgataattctcctacgtttaaacatgaatcctactatgccactgtcaatgagctaacccctgtgggaactacaatcttcactgggttctctggcgacaatggagccaccgatattgatgacgggcccaatggccagatcgaatacgtgatccagtacaaccctgatgatccgacatccaatgacacattcgaaatcccgctgatgctaactggtaatattgttctccggaaacgcctgaattacgaggataagacgcgctatttcgttataattcaggccaatgaccgcgcacagaatttaaatgaaaggagaactaccacaacaacgctgactgtggatgtgttagatggggatgacctgggcccaatgtttctgccttgtgttttagtgcctaacactagagattgccgacctctcacatatcaggcggctatcccagaacttcgcaccccagaggagttgaatcccatcatagtcactccccccatacaggctatagaccaggataggaatatccagcctccgagcgaccggcctggcattctgtattcaatcctggtgggtaccccagaggattacccccgattttttcacatgcacccaaggacggctgaactaagcctgctggagccagtcaatcgcgatttccatcagaagtttgatctcgtgattaaggccgaacaggacaacggtcaccccctgcccgcattcgccgggctgcacattgagattttggatgagaacaaccaatccccctatttcacaatgcctagctaccagggatatatactggaatccgcacctgtgggtgcgacaatttcagacagcctgaatctgactagccctctgcgtattgtggctctggacaaagacattgaagacaccaaggatcccgaactacatttattcttaaatgattatacctctgtgtttaccgtgacccaaaccggcattactagatatcttactctcctgcaaccagttgatcgtgaagaacagcagacgtacacctttagtatcacagcctttgatggtgtccaggaatcggaacccgtgattgttaatattcaagtcatggacgccaacgacaacactcccacctttccagagataagttacgacgtgtatgtgtataccgatatgcgccctggcgacagtgtaatccagctcacggccgtagatgctgacgagggaagcaatggtgagataacctatgaaattctggtgggtgcacagggggattttattatcaacaaaacaacgggtctgataaccattgccccaggggtggaaatgattgtgggcagaacctatgctctgactgtccaggctgcagacaatgcaccccccgctgaaagaagcacaggaattttaacattagggaaggccctcgacagagaatctactgatcggtacatactaatcatcacagctagtgatggacgcccagatggtacctccaccgctacagttaatatagttgtgaccgacgtcaacgataacgcaccggtgttcgacccctatctgccccggaacctgagcgtggtggaagaggaggccaatgcattcgtggggcaggtgaaggccactgatcccgatgctggaattaatgggcaggtgcattactccctgggaaactttaataacctatttcgaatcacctcaaacggctccatttacaccgctgtcaaattgaaccgggaagtgagagactactatgaattggtagtggtggccacagacggcgccgtccatcctcggcactctacgctgacgctggctataaaggtgctggacattgacgacaatagtcctgtgttcactaacagcacgtatacagtcctggttgaagagaacctgcccgccggaacaaccattttacaaatcgaagccaaagacgtggacctgggcgcaaatgtgtcctataggatcagaagccccgaggttaagcatttctttgcgctgcaccctttcactggggagctgtctctgctcaggtccttagactatgaagcatttcctgaccaagaagcatcgataaccttccttgtcgaagcatttgatatctatggcactatgccacctggcatcgccacagtcaccgtgattgtcaaagatatgaacgactatccacctgtcttttcgaagcgcatctacaagggtatggtcgctccggacgcagtgaaaggaactccaataacaacggtgtacgctgaagatgcagacccccccgggctccctgcctcaagggtaaggtaccgggtcgatgacgtccagtttccataccccgcttccatttttgaagtggaggaagattccggtcgggtgatcacccgggtgaatttgaacgaggagcccacaaccatctttaaattagtggtggtcgcttttgacgacggcgagcctgtgatgagctcatcagctaccgttaagatcctggtattgcaccctggtgagatccctcgctttacccaggaggaatacagaccgccaccagtgtctgaattagcaaccaagggcaccatggtaggcgttatatctgcagccgccatcaaccagtcaatcgtctactctatcgtctctggcaacgaggaggatacatttgggatcaataatatcacaggagtaatctacgtgaatggccccctagattacgagaccaggacttcttatgtgctccgagtacaggctgattctcttgaagtggtgctagccaatctgcgcgtgccttcgaaatccaatacagcgaaagtttacatagagatccaggatgaaaacaaccacccgcctgtgttccaaaagaagttctacattggaggggtatcagaagatgctcgtatgttcacttctgtgttgagagtaaaggctacagataaagacactggcaactacagtgttatggcatacaggcttatcatcccccctatcaaggaggggaaagaaggcttcgttgtggagacttataccggacttattaagactgccatgctgtttcacaacatgagacggagctacttcaagttccaggtgatcgcaaccgatgattacgggaaaggcctcagtggtaaagcagatgtgctggtaagtgttgtgaaccaattagacatgcaagtaatcgtgtcaaacgtgcccccaaccctggtggagaagaagattgaggatctgacggagatcctggatagatatgtacaggaacagatcccaggagcaaaggtagttgttgagtcaatcggagcccgtcgccacggcgatgccttttctctggaggactacacaaaatgtgacttaacggtctacgcaatcgatccacagacaaatagggcaatcgacaggaatgagctatttaaattcctggacggaaagcttctggacatcaacaaagatttccaaccctactatggggagggagggagaattctggagatccgcacgccagaagccgtgacgtcaataaaaaagcgaggagaatcccttgggtacaccgagggagccctgttagcactagccttcatcattatactatgctgcattccagctattttggtggttctcgtgtcttataggcactttaaaagacgacaggccgagtgtacaaagactgctagaatccaggcggcactgccggccgctaagccggctgtccccgccccggctcccgtggccgccccccccccaccgcctcctccaccacccggggcacatctgtatgaggaactgggggactcatcgatgaaggggctgtttctattatatcacttccaacagagcagggggaacaatagcgtgagcgaggatagaaagcaccagcaagtggtaatgccatttagctctaatacgatcgaggcacataaatccgcgcacgtggatgggtctctgaagtctaataaattgaagtcggcccgcaagtttactttcctgtctgacgaggacgatctttcagcacacaatccactttataaggagaacatatctcaggtctcaaccaattctgatatcagccagaggacagacttcgtagaccccttctctccaaagatacaagcaaagagtaaatctctgcgcggtcctcgagagaaaattcaacggctgtggtcacaatcagtctcattaccccgtcgactgatgaggaaggttccaaaccggcctgagataatcgatctccagcagtggcaggggaccagacaaaaggcagaaaacgagaacactgggatttgcacaaacaagagagggagcagcaaccctctactgaccactgaagaggccaatctgacggagaaagaggagatcagacagggggaaaccctgatgatcgagggcacagaacagttgaagtctctctccagcgatagctcgttctgttttcccagacctcatttttcatttagcacactgcccaccgtaagtagaaccgtcgaactcaaaagcgaaccgaatgtaatcagttccccagccgaatgcagtctagagctttcgcccagcaggccttgtgtgctgcactcttctctgagtcgtcgcgagaccccgatctgcatgttacccatcgaaactgagagaaatatatttgagaattttgcccacccaccaaatatcagcccatcggcttgcccccttccacccccgccacccatttcccctccttcacccccccctgctcccgccccactcgctccacctcccgacatctcccccttttccttattttgccctcctccttcaccaccgtctattccgctaccgctccccccccctactttttttcctctgtccgtctcaacaagcggtcctccaaccccacccctgcttcctcccttccccacacctcttcctccaccaccacctagtatcccctgtccacctccccctagcgcctctttcctctcgacagagtgtgtgtgcatcacgggagtgaagtgtacgaccaacctgatgcccgcagaaaaaatcaagtccagcatgacccagctgagtaccacaacagtatgtaagacagaccctcagagggagcccaagggtatcctgagacacgtgaagaatctggccgagctggaaaaaagtgtggcaaatatgtattcacagattgagaaaaactacttgaggacaaacgtgtctgaactgcagaccatgtgtccgtcagaggtgactaacatggagattaccagtgaacagaacaagggcagcctcaataatatcgtcgaaggaacagagaagcagagtcactcccagagtacatccttgtag

SEQ ID NO: 201977 - DNA, 1965 bp, Artificial Sequence
  Description of Artificial Sequence: Synthetic coding sequence
atgttccggcagttctacctgtggacctgcctggccagcggcatcattctcgggtctctttttgagatttgccttggccagtacgacgatgactgtaagctggcccgcggcgggccccccgcgacaatcgttgccattgacgaggaaagtcgtaacggcacaattctggtggacaatatgctaattaaaggtacagctggaggacccgatcctaccatagagctgagcctgaaagacaatgtggactactgggtgcttatggaccctgtgaagcagatgctttttctgaatagcaccggaagggtgctcgaccgggatcctcccatgaacatccactctatcgtagtgcaagttcagtgcattaataaaaaggtaggtacaatcatctatcacgaggtccggatcgtcgttcgtgataggaacgataactccccgacttttaaacatgaaagttattatgcgactgtgaacgaactcactcccgtgggcaccactatctttacaggattcagcggggacaacggggcaactgacatcgacgacgggcctaacgggcaaatcgagtatgtgatccagtataatcccgatgatcctacctccaatgacaccttcgaaatccccctcatgctaactggtaacattgtacttcgcaagcggttgaactatgaggataagacacggtacttcgtgatcatacaggcaaatgatcgcgctcagaatctgaatgagcggcgcactactacaactacactaacagtcgacgtgttggacggcgatgatttgggccctatgtttcttccatgtgtgttggtgcccaacacaagggactgtcgcccattaacatatcaagctgccatcccagagctgaggacacctgaggagctcaatcccattatcgtgacgcccccaatacaggcaattgaccaagatcgaaacattcagcccccatctgatagacctggaatattgtactccatactggtcggcacaccagaagattatcccagattcttccatatgcatccccgaacggcggagcttagcctgcttgagccagtgaacagagacttccaccagaaatttgaccttgtaataaaagcagagcaagacaacggccacccactccctgcctttgctggattgcacattgagattctcgacgaaaacaaccagtctccatactttacaatgccttcgtaccagggctatattctggagtccgcccccgttggcgccacgatctctgattcgttaaaccttacatctccactgagaattgtcgccttggataaggacattgaagacacaaaggaccccgagttgcatctcttcctgaatgactataccagtgtcttcacggtgacgcagactggaatcaccagatacttgacactactgcagccagtggaccgagaagaacagcaaacttacacattctcaatcactgcctttgacggcgtgcaggagagcgaaccagtgattgtgaacattcaggtaatggatgcgaacgataacacgccgacttttccagaaattagctatgacgtgtatgtgtatactgacatgcggcccggagactccgtaattcagctcaccgctgtggatgcagacgaaggttcaaacggggagataacttatgaaatcttggtaggtgcccaaggcgattttatcatcaataagacgactggcctaatcaccatcgctcctggcgtggagatgattgtgggtcgcacctacgcgcttacagtccaggcagcggataatgccccacctgccgagcgacggaacagcatttgcactgtgtatatcgaagtgctgcccccgaacaaccagagtccccctagatttccgcaattgatgtactccctggaaatctctgaggccatgagggttggcgccgtgctactgaatctgcaacacggcgattcaaatctgcgcgagagtaccggacagggtaagcactag

SEQ ID NO: 201978 - DNA, 5034 bp, Artificial Sequence
  Description of Artificial Sequence: Synthetic coding sequence
atgttccggcagttctacctgtggacctgcctggccagcggcatcattctgggttcattgttcgagatttgtctgggccagtacgatgatgattgtaagctggccaggggagggcctcccgctacgatcgtagcaatcgatgaagaatctaggaatggcacgattctcgtagacaatatgttgatcaaggggactgcaggtggtccagaccctacaatcgagctatcactgaaagacaacgtcgattactgggtcctgatggatccagtcaagcaaatgctctttcttaatagtaccggtcgggttctggaccgagaccctcccatgaacatacattccatcgtggtgcaggtgcagtgcatcaacaaaaaggtgggcaccattatctaccacgaagtacgcatcgttgtgagggacagaaatgacaactctcccacttttaagcacgagtcatactatgccaccgtgaatgagctgacccctgtgggtacaacaatctttacaggcttctcaggcgataacggggcaactgacattgatgacggccctaatggccaaatcgagtacgtaatacagtacaatcccgacgatcccacttccaatgacacattcgaaatcccacttatgctgactggcaacatcgtactacgaaagcgcctgaactatgaggataaaaccagatactttgtgatcatccaggccaacgatcgtgcacagaatctgaatgaaagacgtacaacaacaacgaccctaactgtagacgtcctagacggtgatgacctcgggcccatgttcctgccatgtgtattggtgcctaacacgcgtgactgcaggcctcttacataccaagccgccattcccgagctaaggacccccgaagagttgaaccccattattgtgacaccgcctattcaggcaatcgaccaggacagaaacatacagccccctagtgatcgccccggaatcctctactcaattctggtgggaactccggaggactacccacgtttttttcacatgcacccacgaacagcggagctgagcctcttggagcccgtcaaccgcgacttccatcagaagttcgacctggtgatcaaagccgaacaagacaacggccatcccctcccagcgttcgccggactccatatcgagattctcgacgagaacaaccaatccccttactttacgatgccgagttatcaaggctacatcctggaaagcgctcccgtgggagccaccattagcgatagcctgaacctgacttctccccttcgtatcgtagctttggataaggatatcgaggacaccaaggatccagaactgcacctgtttctaaatgactatacctccgtgttcacagtcactcagaccggcattactagatatttaacccttttacagcccgtcgacagggaggaacagcaaacatacacattttcgattaccgctttcgatggagttcaggagagtgagccagtgatagtaaatatccaagttatggatgccaatgacaatacacccacattcccggagattagctacgacgtgtatgtgtacaccgatatgaggcccggagattctgtgatccagctgaccgccgttgatgccgacgaaggaagtaacggcgagattacgtacgaaatcctcgtgggcgcacaaggtgacttcattatcaataagacgaccggtttaattactattgcacccggcgtggaaatgatcgttggccgcacctacgcgcttaccgtgcaagccgctgacaatgctccgcccgcggaacgccggaattccatttgcaccgtctacatcgaagtgctccccccgaataaccagtctccccctcggttcccccagctgatgtacagtcttgaaataagcgaagcaatgagagtgggtgctgtgctgctgaaccttcaggcaactgaccgggaaggagatagcatcacatatgctattgagaatggggacccgcagcgtgtgtttaatctgagtgagactaccgggattttgacactcggcaaagcccttgatcgtgagtccaccgataggtatatacttatcatcactgcttccgacggtcgtcctgacggcacgtccaccgccacggttaacattgtagtgaccgatgtcaacgataacgccccagtttttgatccatacctgccacggaacctgagtgtggtggaagaagaagccaatgccttcgttggtcaagtcaaagctactgacccggatgctggtattaacggtcaagtgcattatagtcttggaaatttcaacaatctttttagaatcacgtccaacgggtccatctacacagccgtgaaacttaatagggaagttcgggattactatgaattggtcgttgtcgctacggatggcgctgtccaccctagacatagcaccctcaccctcgcgatcaaagttctcgatatcgacgataactcaccagtgtttaccaattcaacatataccgttctcgtggaagagaacctccctgccggtacaactatcctgcaaatcgaggctaaggacgtggatttgggagccaatgtctcttatcgcatccggtcgcccgaggtgaagcacttctttgcactccatccgttcacaggcgagctgtctctcctaaggagtttggactacgaggcttttccagatcaggaggcatcaattaccttcctggttgaagcctttgacatctacggaacaatgccacccggtattgccacagtaacagttatagtgaaagacatgaatgactacccccccgtgttctcaaaacgcatttacaagggcatggtcgccccagatgccgtgaaggggacaccaattactacagtttatgctgaagacgccgatccacccgggctccctgcaagcagggttcgataccgcgtggacgacgtccaattcccataccctgcttctattttcgaagtcgaggaagatagcggtcgggtcataactcgggtcaatcttaacgaggagccaactaccatcttcaagctggtcgtggtggctttcgacgatggagaaccagtaatgtcatcatctgctactgtcaagatcttagtgctgcacccgggggaaattcctcgcttcacccaagaggaataccgacctccaccagtcagtgaactcgctaccaagggcaccatggtgggagtgatttccgctgctgccataaaccagtccatagtgtatagcattgtctccggcaatgaggaggatacctttggcattaataatataacaggagtgatttacgtaaacggcccgctggattacgagacacgcacgtcgtacgtcctgagagtccaagctgactccctcgaggtggtgctggctaacctgagagtcccatccaagtctaacaccgccaaggtgtatattgagatacaagacgagaataatcaccctccagtgtttcaaaagaagttctatatcggcggcgtgagcgaagatgccaggatgtttacctccgtgctccgggtcaaggctacggataaggataccggtaactactcagtgatggcttaccgactgatcattccaccaattaaggaaggaaaggagggtttcgtggtggaaacttacactggtctgattaagaccgcaatgttgttccataacatgagaagaagctactttaagtttcaggtcattgcaaccgacgactacgggaagggtctcagcggtaaggctgacgtcctggtctctgtagtgaatcaactcgacatgcaggtcatcgtgtccaatgtgcccccaactctggtagagaagaagatcgaggatctcactgaaattttggaccgttatgttcaggaacagattcccggagcgaaggttgtggttgagtccattggtgctcgaaggcatggcgacgccttctcccttgaagattacaccaagtgcgacttaactgtgtatgcaatagatcctcagactaatagggcaatagatcgtaatgaactttttaagttcctggacggaaagctactggacatcaacaaggactttcaaccctactacggtgagggaggaagaatacttgagatcaggactcccgaagccgttacaagcatcaagaaaagaggggagtcactggggtacactgagggggcgctgcttgccctggcatttatcattattctctgttgcattccagccatcctggtggtgcttgtctcatacaggcacttcaagaggcggcaggccgagtgcaccaaaacggccagaattcaggcagcactgccagcagccaaacctgctgtaccggctcccgctcctgtggccgctccaccccccccaccacctcccccccctggcgctcacttgtatgaggagttgggggatagttcgatctatcgatatgaaatgccccaatacggcagcagacgccgcctgctgccccccgcgggtcaggaggaatatggagaagtggtcggtgaggccgaggaggagtacgaggaagaagaatgggcacggaaacgcatgatcaaactggtagtcgaccgagaatacgagaccagctcaaccggggaagattccgcccccgagtgccaacgaaatagactgcaccatccttcaatccactcaaacattaatgggaatatttacatcgcgcagaacgggtcggtcgtgcggacccggcgagcctgtttgacggataaccttaaggttgctagccctgtaaggctgggtggcccattcaagaagcttgacaagctcgctgttacacatgaagagaacgtgcctttgaacacactgtcaaagggacccttcagtaccgagaagatgaatgccaggcccactctggtcacgtttgccccctgtcccgtgggcacagacaatactgctgtcaagcctctgcggaatagactcaagagcactgtggagcaggaatccatgattgactctaaaaacattaaggaggctctggaattccatagcgatcatacccaaagcgacgatgaggaactctggatggggccatggaataatctgcacatccctatgactaaattatag

SEQ ID NO: 201979 - DNA, 279 bp, Artificial Sequence
  Description of Artificial Sequence: Synthetic coding sequence
atgttccggcagttctacctgtggacctgcctggccagcggcatcattttggggagcttgttcgaaatatgcctggggcagtatgacgatgattgtaaactggcccgcggcggcccacctgccacgattgtggcgattgatgaggagagccggaatgggacaatactcgtggataacatgctcatcaaaggaacagctggcggccccgaccccaccattgagctcagcctgaaagataatgtggactactgggtgctgatggatcctgtgaaacaatag

SEQ ID NO: 201980 - DNA, 3453 bp, Artificial Sequence
  Description of Artificial Sequence: Synthetic coding sequence
atggccccccccctgcggcccctggcccggctgcggccccccggcatgcttctccgagccctcctcttactgctgctgctatcccctctcccaggcgtgtggtgtttctctgagttatcatttgtgaaagaaccccaagatgtcacagtgacgcggaaggaccctgtggtcctggactgccaggcacacggcgaagtcccaattaaagttacctggttgaaaaatggcgctaagatgtctgaaaacaaaagaattgaggtactgtctaatggctcactatatatttcagaggtcgaaggacggaggggagaacagagcgatgaagggttctaccagtgtctggctatgaacaagtatggcgctattctctcacagaaggcccatttggccctgtctaccatttcagcgtttgaggtgcagcctatatcgacggaagtgcatgagggcggagtggcaaggtttgcatgcaagatctctagccacccgccagcagttattacttgggaattcaatagaacaactcttccaatgactatggacagaatcaccgcgctgccaaccggagttctccagatttatgacgtgagtcagagagatagtggcaactaccgatgcatagctgcaacggtcgcccaccggagaaaaagtatggaagcgagcctgactgtcatccccgcaaaggaatccaagagctttcacacccctactatcatagccggcccccagaacataacgacctccctgcaccagactgtggtcttagagtgcatggcaaccgggaatccgaaaccaatcatatcgtggtcacggctggatcacaagtcaatcgatgtttttaatacccgggtcttgggaaatggaaatctgatgatttccgatgtgaggctgcagcatgctggcgtgtacgtgtgcagagctacaacacctggaacccgtaattttacagttgccatggccacactgacagtgctagcccctcctagttttgtcgaatggcctgagtcactgacgcggccacgggcgggaaccgcccggttcgtttgtcaggccgaaggaatcccttctcctaaaatgagttggctcaagaacggccgcaagatccactccaacgggcgtatcaagatgtacaattcaaagctagttatcaaccagatcattcctgaagacgacgccatttaccagtgtatggctgagaattcccagggaagtatcctgagtagagctagactgactgtggttatgagcgaagatcggcccagcgctccttataatgtgcacgccgagaccatgtcatcgagtgccatcctcctggcctgggagcgccctctgtacaactccgataaggtgatcgcctatagcgtgcactacatgaaggcggagggtctgaataatgaagaataccaggtggtgatcggcaatgacacaacccactacatcatagacgatttggagcccgcaagcaactataccttctacatcgtcgcctacatgcctatgggagcttcccaaatgtcagaccatgtcacacagaacaccctggaggacgtgcctttaagaccgcctgaaatcagtctcaccagcaggagtcccacagatatcttaatcagctggctgcctattcctgccaaatatcgccgtggacaggtggttctgtaccgactgtctttcaggcttagtacagaaaattctattcaggtgctggagctcccaggaacaacccacgagtacctactggagggactcaagcccgatagcgtctacctggtaaggatcaccgcagctacaagagtgggcctcggagaatcttcagtctggactagccatcggacaccaaaggccacgtcagtgaaggctcccaagtccccagagcttcacctggagcccctgaactgtacaaccatctccgttagatggcaacaggacgtggaggatacagcagctatccaagggtacaagctgtattataaggaagaagggcagcaggaaaacggaccaatttttctcgacacaaaagatctcctgtacacactctcaggcttggacccgcggcgaaaataccatgtgagactgctggcctacaacaatatagacgacggatatcaggctgaccagactgtctcaacaccaggctgcgtgagcgtccgggatcggatggttccccccccccctcccccccaccatctttatgccaaggccaacaccagctctagcatttttctgcattggaggagacctgcatttaccgctgcccaaataattaactacaccatacgctgcaatccagttgggctgcaaaacgcaagccttgtcctgtacctgcagacatccgagacccatatgcttgttcagggactcgagcctaatacaaagtatgagtttgccgttagattgcacgtggatcagctgtccagcccctggagccccgtggtctatcactctaccctgcctgaagcaccagccggccctccagtcggagtcaaggttacactgatcgaggacgacaccgccttggtgtcctggaaaccgccagacggtcctgagactgtggtcacgaggtacaccattctgtacgcctcaaggaaggcatggatcgccggggagtggcaagttctgcacagagaaggggctattacaatggccctcctggaaaacctcgtagctggcaatgtttatatagtgaagattagcgcgtcaaacgaggtgggagaaggtccattctccaatagtgtggaactggccgttctgccaaaggaaaccagcgagtctaatcagagacccaaacgcctagacagcgccgacgccaaagtatactccggttactaccatctcgaccaaaaatccatgaccggcatcgcagtgggagttggaatcgcccttacgtgtattctgatctgtgtcttgatcctgatctatcgaagtaaagctcgcaaatcctcagcctcaaagactgctcaaaatgggacacagcagctccctaggacatctgcaagcttggctagcggcaacgaggtaggcaaaaatctggagggggctgtggggaatgaggagagcctaatgccaatgatcatgcctaactctttcatcgatgccaagggtggaactgatctgattattaattcatacggtccaatcattaagaacaattcaaagaaaaagtggttcttctttcaggactcaaaaaagatccaggtggaacagccgcagagaaggtttacgcctgcagtttgcttttaccagcctggcaccacggtacttataagcgatgaggattcacccagttcgccagggcagactacctcattctccaggccattcggagtggccgccgacaccgaacactctgccaatagcgaagggtctcatgagaccggggattcgggccgcttctcacacgagtcgaacgacgagattcacctatcaagcgtgatttcgacgaccccccccaatctgtag

SEQ ID NO: 201981 - DNA, 1434 bp, Artificial Sequence
  Description of Artificial Sequence: Synthetic coding sequence
atgggccggaccgtggtggtgctgggcggcggcatcagcggcctggctgctagctatcacctgagccgcgctccctgtccccctaaagtcgttctcgtggaatcttccgagcgcctcggcggttggatcagatccgtgcggggacctaacggcgccatatttgagttgggcccccgcggaatccgaccggctggggctctcggagcccgaaccctgctgctagtgtctgaactcgggctggactccgaagtgttaccggtacgaggagaccacccagccgctcaaaatcgattcctgtacgtcggcggggccctgcacgccctgcccacagggcttcggggcctactccgccctagcccgccattctcgaaaccactgttctgggccggtttgcgggaactgaccaaaccacgcgggaaggaacccgatgagacagtgcactcctttgcccagcgccggctcggccccgaggtggcctcactggctatggatagtctctgtcgcggggtgtttgctggaaatagcagagagctgagcatcaggagctgctttccatcactctttcaggctgagcagacacaccgctcaatccttttggggctactgctgggcgccggccggactcctcagcctgacagcgctctcatcaggcaggctctggctgagcgttggtcgcaatggtctttgcgtggcggcctggaaatgctgccacaggctcttgaaacccacctgacttcgaggggcgtctctgttctgaggggccagcctgtctgtggattatctcttcaagcagagggccgttggaaggtttccttgcgagattcatcccttgaagccgaccacgtgatctcggcgataccagcgagcgtgctcagcgaactgctccctgccgaggctgctccgctggctcgagccctgagcgcgattaccgctgtgagtgtggcagtagtgaatctacagtatcagggagctcacctgcctgtccagggttttggacacctcgtgccatcgtccgaggacccaggcgtgctcgggatcgtttatgacagcgtggccttccccgagcaggatggcagcccacccggccttcgagtgaccgtcatgctcgggggcagttggttgcaaaccctggaagcctcaggatgtgttctatcacaggaactgttccaacagagggcccaagaggcagcagcaacccagctgggactcaaggaaatgccctcgcactgcctggtgcacctgcataagaactgcatccctcagtacactttaggccattggcagaagctggagtccgcccgacaattcttgaccgcgcatcgtttgcctttgactttggctggtgcaagctatgaaggggtagcggtgaatgactgcatagagagcgggcgtcaagcagcggtgagcgtgctagggaccgagccgaacagttag

SEQ ID NO: 201982 - DNA, 1434 bp, Artificial Sequence
  Description of Artificial Sequence: Synthetic coding sequence
atgggccggaccgtggtggtgctgggcggcggcatcagcggcctggcagcaagttaccacttaagccgcgcaccttgtcctccgaaggtcgtgctggtcgagtcatctgaaaggctaggaggctggattagaagcgtgcgggggccaaatggcgctattttcgaactgggcccacggggaattaggcctgccggcgcattaggcgcccgaacgcttctgctggtctccgagctgggcctggatagcgaagtcctcccggtgcggggcgatcaccctgccgcccagaatcgattcctgtatgtggggggagctctgcatgccctgccgactggtttgcgtgggctcctgcggcctagtccacctttcagcaagccgctgttctgggctggcctgcgagaactgacaaaaccgcgcggcaaagagcccgatgagacagtgcactctttcgctcagagacgtttgggacccgaagtcgcctctctggcgatggactccctatgccgtggtgttttcgccgggaatagcagagaattatcaatccggagctgcttccctagccttttccaagctgagcagactcatcgtagtattctgcttggcctcctgcttggcgcgggccggacaccccaacccgacagtgcgctgattcgccaggctctagccgagagatggagccagtggtctctgcggggaggattagaaatgcttccacaggcacttgaaacacatctaacaagccggggtgtctcggttttgcgcggccagcctgtgtgcggattgtctctgcaagccgagggacgctggaaggtttcactgcgggatagcagtctggaagctgaccatgttattagtgcaattcccgcatcagttctgtcagaattactccccgccgaggccgcaccgctggccagggccctgtctgccattaccgctgtcagcgtagcagttgttaacttgcagtatcagggtgcccatctgccagtccagggattcggtcacttggttccttcaagcgaagaccctggagtgctaggtatcgtgtatgatagtgtcgcctttcccgagcaagacggctcacctcccggcctcagagtgacggtgatgctaggaggatcatggcttcagactcttgaggcaagtggatgcgtactgagtcaggaattatttcagcaaagagcacaagaggccgccgctacgcagcttggacttaaggagatgccaagccactgtctggtgcacttacacaaaaactgcatcccccaatatactttagggcattggcagaagctcgaatctgcgaggcagttcctcaccgctcatagactgcccctgaccttggctggggcatcatacgagggagtcgcagtgaatgattgtatagaatcgggcagacaggcagcggtaagcgtgctgggaaccgaaccgaattcttag

SEQ ID NO: 201983 - DNA, 717 bp, Artificial Sequence
  Description of Artificial Sequence: Synthetic coding sequence
atgggccggaccgtggtggtgctgggcggcggcatcagcggcctggccgcttcttatcatttgagtagagctccgtgtcctcccaaggtagtcctcgtggagtctagtgagcgtctgggaggctggattaggtctgtgcggggaccgaacggcgcaatatttgagctgggacctagggggatcaggccggcaggggctctcggtgctagaacgctactgcttggatttgggcatctggtcccaagttctgaagatcccggagttttaggaatcgtgtatgatagtgtggcgtttcccgagcaagacgggagccctccagggctacgggtgacagtcatgctgggagggagctggctgcagactctggaggcctctgggtgtgtattatcacaggagttgttccagcagcgggcacaggaagctgccgcgactcaactgggtcttaaagagatgcctagccattgtctcgtgcacctgcataaaacaaaaaatcagcttaaatggaggcagtcccacgataggacagtggaatggccaaaagaataccctgggaggtctcggaaacaggccccatccatcttgcatgtgccagggtgtcagttgcttagatgtagggaccgagatcaccttggggccgtttccgaacaaccaaggtcctccgccgagagccgcgtgggtgtggcgagtagcacttttagcacctttcctctgttttag

SEQ ID NO: 201984 - DNA, 1335 bp, Artificial Sequence
  Description of Artificial Sequence: Synthetic coding sequence
atgggccggaccgtggtggtgctgggcggcggcatcagcggcctggccgcgtcttaccacctctctcgggcaccttgcccccctaaggtggttctcgtggaatctagcgagaggttgggtggttggatcagaagcgtgcgggggccaaatggggcgatttttgaactgggcccacgcgggattcgccctgcgggcgctctaggcgcaagaaccttgctgctcgcttgcggtgaacaggtgtctgagctcggattagatagcgaggtcttgccggtgcggggagatcaccctgcggcgcagaaccgcttcctgtatgtgggcggcgctctgcatgcacttccgacggggctttccccttcgctgacacttaaagtggcctcccttgcaatggatagtctctgcagaggggtgtttgccggtaatagtagagaattatccatcaggtcctgctttccttctctgttccaagctgaacaaactcacaggagcatcctgctggggctgttactgggggcgggtaggactccacagccggatagtgcgctgattagacaggccctcgccgagaggtggtctcagtggtctttgagagggggattggaaatgttgcctcaggctctcgaaacccacctgacctctcggggagtgagtgtgttgagagggcagcctgtgtgtgggttgtcgctgcaggcagagggtaggtggaaggtctcgctccgtgatagctcactggaggcagatcatgtgatctcggccattccagcctcagtgctgtcggagttgcttcctgctgaagccgcccctctcgctcgtgctctgagtgcaataacggccgtatcagttgcagtggtcaatcttcagtaccagggcgcccatctgcctgtgcagggattcgggcacctggtacccagcagcgaggatcctggcgtgctggggattgtgtatgattcagtggccttcccagaacaggatgggagccctccaggtctccgggtcaccgttatgctcgggggcagctggctacaaacactagaagcctcaggctgcgtactgagccaagagctctttcagcaacgcgcccaagaagccgccgctactcaactgggtcttaaagagatgccctctcattgcctggtccaccttcacaaaaactgtattcctcagtatacactcgggcactggcagaaactggagtcagcccgccaatttctgacggcccacaggctgccactgactctcgccggtgctagctacgaaggagtggccgtgaatgattgcatcgaatcgggacgtcaggcagccgtgtccgttctggggacagagcctaatagctag

SEQ ID NO: 201985 - DNA, 144 bp, Artificial Sequence
  Description of Artificial Sequence: Synthetic coding sequence
atggacatcctgaagagcgagatcctgcggaagcggcagctggtggaagaccgcaaccttttgagtgaaagcatgtgcgccaatgatgcctatcttcaaatggccataggtaacgccccctggcctattggggtcacgatgtag

SEQ ID NO: 201986 - DNA, 504 bp, Artificial Sequence
  Description of Artificial Sequence: Synthetic coding sequence
atgatccggaccttccccggcgagaacaagaagtacttcaagcggtccgagctggccaagaaagaagaagaggcgtactttgaaagatgcgggtacaagatccagcctaaggaggaagatcagaaacccttgactagctcaaatcctgtgctggagttggaactcgcagaagaaaaattacctatgacgctctccaggcaggaagttatccgccgtcttcgagagcggggagagcctattcggctcttcggggaaaccgattatgacgcctttcagcgccttcgcaaaatagaaatcctgacacccgaggttaacaaaggactgcgaaacgatttgaaggcagcccttgataaaattgaccagcagtatctgaatgaaattgtcggaggacaggagcccggtgaggaggacacgcagaacgatctgaaggtacacgaagaaaacacgacgatagaggaactcgaggccctgggagagtcacttggcaaaggggatgaccactag

SEQ ID NO: 201987 - DNA, 750 bp, Artificial Sequence
  Description of Artificial Sequence: Synthetic coding sequence
atgatccggaccttccccggcgagaacaagaagtacttcaagcggagtgagcttgcaaaaaaggaagaggaggcatacttcgaaagatgtggatataaacctattaatgaaaagccaagtggcgaaatccagcctaaggaggaagatcagaaacctcttacctcaagcaacccagtgctcgaattagagttagccgaagaaaaactaccaatgacgctgagcagacaggaggttatcaggcgactcagagagcggggcgaaccaatcagattatttggggaaaccgattacgacgcttttcaacgcctgagaaaaatagagattctgaccccagaggtaaacaaagggttgagaaacgatctcaaagctgcgcttgataagattgatcaacagtacctgaatgaaattgtggggggtcaagaaccgggcgaggaagacacacaaaatgatctgaaggttcacgaagagaataccactatcgaagaacttgaagccctcggagaatccctagggaagggagatgaccacaaggacatggacattatcaccaagttccttaagtttctgctaggcgtgtgggccaaagaactgaacgcaagggaagactacgtgaaacgctctgtgcaggggaaacttaactcggcgacccaaaagcagacggagagttacttgagacctctgtttagaaagctgaggaagcgcaatctgccggctgacatcaaagaaagcatcactgatatcatcaagtag

SEQ ID NO: 201988 - DNA, 1029 bp, Artificial Sequence
  Description of Artificial Sequence: Synthetic coding sequence
atggacatcctgaagagcgagatcctgcggaagcggcagctggtggaggatcgtaacctgctggtcgagaacaagaagtactttaagcgctcagaactggccaaaaaagaagaagaggcctatttcgagcgttgtgggtataaaatccagcctaaggaggaggaccaaaagccactaactagttcgaatcccgttttagagctggagcttgccgaggagaagctccctatgacactctcccgccaggaggtgatacgacggctacgcgaaaggggagaacctatccggctctttggggagacggactacgatgcttttcagcggctgaggaagattgagattttgacacctgaggtaaataagggtctgcgaaacgaccttaaagctgccctcgataaaatagaccagcaatacctcaacgagatcgtcggcggacaagaacccggcgaggaagacacacagaatgacctgaaagtgcacgaagaaaacactactatcgaagagctcgaagctctgggcgagagtttaggtaaaggcgacgatcataaagacatggatatcataacaaaattccttaagtttctgctgggggtatgggctaaagaactcaacgctagggaggattacgtaaagagaagcgttcaggggaagctgaactccgctacacagaagcagacggagagctacctgaggcctctatttaggaaattaagaaagcgtaaccttcccgccgatataaaagagtctattacagatattattaaattcatgctgcaacgagagtacgtaaaggctaacgacgcctatttgcaaatggctataggtaacgccccctggcctatcggggtaacaatggttggaattcatgcgagaaccggcagagagaaaatattttccaagcatgtggcgcacgtcctgaacgatgaaactcagaggaaatatatacagggcttgaaaaggctgatgacaatctgtcagaagcatttccccactgatcctagcaaatgcgtggagtataatgcgctttag

SEQ ID NO: 201989 - DNA, 750 bp, Artificial Sequence
  Description of Artificial Sequence: Synthetic coding sequence
atgatccggaccttccccggcgagaacaagaagtacttcaagcggtccgagttggccaagaaagaggaagaagcatactttgagcgctgtggctataagccaataaatgagaagccaagtggtgaaatacaaccaaaagaggaggaccaaaaacccttgacttcttctaatccagtacttgagctggagctggccgaagagaagctgcccatgactctgagtaggcaggaggtgattcgccgcttgagagaacgaggggagcctattcggctcttcggtgagacagattatgacgctttccaaagactgcgcaaaattgagatactgacccctgaagttaataagggtttgcggaacgacttgaaagccgccctggacaagattgatcaacaatacttaaacgaaatcgtcggagggcaggaacctggcgaagaagacacccagaatgacctgaaagtccacgaagagaacacgaccatcgaagaacttgaggccctgggagagagcctcgggaaaggagatgaccacaaggacatggacattataactaagtttcttaagtttttgttgggagtctgggcaaaagaattgaatgcacgggaggactatgtgaagaggagtgtgcagggtaagttgaatagtgcgacccaaaagcagaccgaaagctatcttaggcccttgtttcggaagctgcggaaacgaaacttgccggccgacatcaaggagagcattactgacataatcaagtag

SEQ ID NO: 201990 - DNA, 1083 bp, Artificial Sequence
  Description of Artificial Sequence: Synthetic coding sequence
atggacacccccctgcggcggagccggcggctgggcggcctgcggcccgaaagccccgaaagcctgacaagcgtctcaaggacccggcgggccctggtggagtttgagtctaaccctgaggagactagggaaccagggtcgccccctagcgtgcagcgcgcaggtctcgggagccccgagaggccaccaaaaacctcccctggcagtccacgtctgcagcaaggcgccgggctggaatctccacagggacagcctgagcctggcgcggctagtccccagaggcagcaagacctccatctggaaagtcctcagcgacagcctgagtactcccctgaatctccgcggtgtcaacctaaaccatctgaagaagcccccaagtgctctcaagatcagggcgtgctagccagcgagcttgcccaaaataaagaggaactgacgccaggcgctccgcagcatcagcttccacctgtgcccgggagccctgagccttatccagggcagcaggccccaggtccagaaccttcccagccgctcctggagctcacgcctcgggcccctggatcccctaggggacagcacgaaccttccaagcccccacccgccggagaaacagtcactgggggattcggggctaagaagaggaagggcagctccagccaggcccccgccagtaaaaagctgaacaaagaagaactgcccgtgataccgaagggtaagcctaagagtggccgagtatggaaagaccggagcaagaagaggttctcccagatgcttcaggacaagcccttaagaacatcctggcagaggaaaatgaaggaacggcaggaaaggaaactcgctaaggatttcgcacggcacctcgaggaagagaaggagaggcgccggcaggagaagaagcagaggagggctgaaaaccttaaaagaaggttggaaaatgaacggaaggcggaggtggtccaagtgatccgcaatccagcgaagcttaaacgagccaaaaaaaagcagctgagaagcattgagaagagggacaccctggctctactccagaagcagccaccccaacagcctgctgccaaaatctag

SEQ ID NO: 201991 - DNA, 1095 bp, Artificial Sequence
  Description of Artificial Sequence: Synthetic coding sequence
atgagcctggccgacgagctgctggccgacctggaggaggccgccgaggaggaagagggcggctcatacggcgaagaagaagaagagcctgccattgaagatgtccaagaagaaacacagctcgatttgagcggcgactccgtgaagaccatcgctaaattatgggattctaaaatgttcgcagaaatcatgatgaagatcgaagagtatattagtaagcaggccaaagccagcgaggtgatggggccagttgaagccgcccccgagtaccgcgtgattgtggacgccaataatctcactgttgagattgagaacgagctcaatatcattcacaagttcattcgcgataaatactcgaagaggttcccggaattggaatcacttgtacccaatgctctggattatattaggaccgttaaagagttaggaaacagcctagacaaatgtaagaacaacgagaatcttcagcaaatccttaccaatgcgacaatcatggtggtttctgtcacagcctcaactacgcagggccaacaactgagcgaagaggagctggagcgcctggaagaagcttgtgatatggccctggaactgaatgcaagtaagcaccgtatttatgagtacgtggaatctaggatgtcattcatcgcacctaatctgagcattattatcggcgctagcaccgcagcaaaaattatgggcgttgcaggcggtctgactaatctcagcaaaatgcccgcgtgcaatataatgttgctgggtgcccagcgcaaaaccttatctggattctcttctacctcggttctgccccatactggctacatttaccattccgatatcgttcagagtcttccaccagatctcaggaggaaggcagcccgacttgtggcggccaagtgcaccctcgccgccagggtcgatagtttccacgaaagtactgaaggtaaagtgggctacgaactgaaggatgagatagagcgtaagttcgacaagtggcaacggagaaggtggttgcgccccaccaggtcaattagtccggcctggttaagctcatccagaagccgggccagaagggtcgcactatgtcctcctgaatag

SEQ ID NO: 201992 - DNA, 1500 bp, Artificial Sequence
  Description of Artificial Sequence: Synthetic coding sequence
atgagcctggccgacgagctgctggccgacctggaggaggccgccgaggaagaggagggggggtcatacggagaagaagaggaggagccagcaattgaggatgtgcaagaggagactcagctagatttgtccggggattcggtgaagacgattgcgaagctgtgggatagcaagatgttcgctgagatcatgatgaagattgaggagtacattagtaagcaggccaaagcttcagaggttatgggcccagtcgaagcagcgcccgaataccgagtcatcgtagatgccaataatttgacagtggaaatagagaatgaactgaatattattcacaagttcattagggacaagtattccaagcgcttccccgaactggagtctctcgtgccaaacgccttggattacatccgcaccgtgaaagagttagggaattcattggacaaatgcaaaaataacgagaatctccagcagatacttaccaacgcgactataatggtggtgtccgtcactgctagtaccacgcaggggcagcagttatccgaagaagagctggagcgactcgaggaggcatgcgatatggctctcgaacttaacgcaagcaagcaccggatttatgaatatgtagagagcagaatgtccttcattgcccctaatctgagtatcatcatcggggctagtaccgccgccaagatcatgggcgtggccgggggactgacaaacctttctaagatgccagcgtgcaacattatgttactcggggcacagaggaagaccttgtctggattctcatccacgtccgtactccctcatacaggctatatctaccatagcgacatagttcaaagtctgcccccagacctccgacgtaaggctgctcgccttgtcgccgcaaagtgtacactagcggcacgcgtcgattcattccatgagtcgacagaaggcaaagtaggctatgaactgaaggatgagatagaacggaagtttgataagtggcaggaacccccccccgtgaagcaggtgaagcctttgcccgctcccctcgatggacagagaaaaaagcgcggaggacgtaggtatcgcaaaatgaaagagcgccttggtctgactgaaatccgcaaacaggccaatagaatgtcgttcggggaaatcgaggaggatgcataccaagaagatttaggattttcgctaggccatctgggcaaatccggaagtgggagagtgcggcagacccaagtcaacgaggccaccaaagctcggatctcgaaaactctccaacggacactccagaagcaatctgttgtttacggaggaaagtcgacgattcgggaccggagtagtggcaccgctagtagcgtggcttttactcctctgcaaggtctggagatcgtcaacccccaggctgctgagaaaaaggtggcagaagccaaccaaaaatatttctctagcatggcggagttcttgaaggttaagggcgagaagtccggtctgatgtctacatag

SEQ ID NO: 201993 - DNA, 1353 bp, Artificial Sequence
  Description of Artificial Sequence: Synthetic coding sequence
atgagcctggccgacgagctgctggccgacctggaggaggccgccgaggaagaggagggtggaagttatggggaggaagaggaggagcctgccatcgaagatgttcaggaagaaacacaacttgatctgtccggggacagtgtcaagactatagccaagctctgggattctaagatgtttgcagagatcatgatgaaaatagaggagtatatcagtaagcaagctaaggcctccgaggtgatgggaccagtggaggcagcccccgaataccgtgttattgttgacgccaataatttgacagtggagattgagaacgaactgaatattattcataagttcatccgagacaaatatagcaaacgcttccctgagctggagtcactcgtgcccaacgcgctggactacattcggaccgtaaaagagctgggtaattccctcgacaaatgtaaaaataacgagaatctgcagcagattctgacaaatgccaccataatggtagtgtcagtgacggcctctaccactcaaggacagcaactgtcagaggaggagctggaacggttagaggaagcatgcgacatggctctcgagttgaatgcttctaagcatcgcatatacgaatacgtggagtccaggatgtcctttatagcgcccaacctgtctattattataggagcatccactgccgccaaaatcatgggagttgcgggcggcctcactaatttaagcaagatgccagcgtgcaacatcatgttgctcggagcccaacgtaagacactttccggtttctcttcaacctccgtcctccctcacactggctatatataccatagcgatatagtgcagagcctgccaccggatctccggcgaaaggctgcccgcctggtggctgccaaatgcactctggccgcacgcgtggattcattccatgagagcacagaggggaaagtgggctacgaacttaaagatgaaatcgagcgcaaattcgacaagtggcaggaaccgccgccagtcaaacaagtcaagcccctcccagccccccttgatggacaaagaaaaaaaagaggcggccgacgctacaggaagatgaaagagagactgggtctgacggaaattagaaagcaggcgaatagaatgagtttcggggagattgaggaggatgcttaccaggaggatcttggattttcacttggccacctcgacgctgccgcggatcccgccgaagcagagcgcaggatatggagagaagtacaccatcccaggcctctgcttggtcatggactccagcgaggactacatcctacacccggaccaggcgattgcgaaccaacgggtggccgagaggagggcgggtag

SEQ ID NO: 201994 - DNA, 831 bp, Artificial Sequence
  Description of Artificial Sequence: Synthetic coding sequence
atgagcctggccgacgagctgctggccgacctggaggaggccgccgaggaggaggagggaggcagttatggggaggaggaggaggagccagcaatcgaggacgtgcaggaagagactcagcttgatctgtcaggagacagcgtgaaaacaatcgccaaattatgggattcaaagatgtttgcagagattatgatgaagatcgaagaatatatctccaagcaggcgaaggcctctgaagtaatgggtcccgtggaggccgctccagagtaccgcgtcattgtcgatgccaataacctgaccgtggagatagagaacgagcttaatatcattcataaatttatccgcgataagtactctaaaagatttcccgaactggagagtctcgtcccgaacgctctggactacattcgcactgtgaaggaactcggtaattcattggataagtgcaagaacaacgaaaatctgcaacagattctgaccaacgcaactatcatggtcgtcagcgttacagcttctactacccagggccaacagctgagtgaggaggagctagagaggcttgaggaagcttgcgatatggccttagagctaaatgcttcaaagcatagaatttatgaatacgtggaatctcggatgtctttcatcgcacctaacctgtcgatcatcattggtgcatcaacagctgcaaagatcatgggggtggcaggtggattaacaaatctcagtaaaatgcctgcatgtaacataatgctgttaggcgctcaacggaagaccctctctggctttagctcaacatccgtacttcctcataccggatatatttaccactag

SEQ ID NO: 201995 - DNA, 855 bp, Artificial Sequence
  Description of Artificial Sequence: Synthetic coding sequence
atgagcctggccgacgagctgctggccgacctggaggaggccgccgaagaggaggagggggggtcatacggcgaggaggaagaggagccagccatcgaagatgtgcaagaagaaacacagttggacctatctggggattcagtgaaaacaatcgccaagctgtgggacagcaaaatgttcgccgagatcatgatgaagatcgaggagtacatatcaaagcaggcaaaggctagcgaagtaatggggcccgtagaggctgctccagagtatcgcgtgattgtggatgctaataacctgaccgttgagatcgaaaatgagctaaatattatccataagtttattcgggacaaatactccaagcggttccctgagttggaatccctcgtccccaatgctctcgactatatccgaactgtcaaagagttggggaactctctcgacaagtgtaaaaataatgagaacctccaacagattcttactaacgcaaccataatggtggtgagtgtgaccgcaagcaccacccaaggccagcagctgtccgaggaggagctggagagactggaagaagcctgcgacatggctctggagttaaacgcctccaaacaccggatctatgagtacgtggagtcccgtatgtcttttattgcccctaacctatccatcattatcggggcctccactgcagcaaaaattatgggggtcgctggaggcctcaccaatctgagcaaaatgccagcatgtaacatcatgctgcttggagcccagaggaagactctgtcaggatttagtagtacctcagtgcttccacatacaggatatatttaccattctgatatcgtgcagagccttccctag

SEQ ID NO: 201996 - DNA, 786 bp, Artificial Sequence
  Description of Artificial Sequence: Synthetic coding sequence
atgagcctggccgacgagctgctggccgacctggaggaggccgccgaagaggaggaaggcgggtcttatggggaagaggaggaggagccagccattgaagatgtgcaggaggagacccaactggatttatctggggattccgtcaagaccatcgcaaagctgtgggacagcaaaatgtttgccgagattatgatgaaaatcgaagagtatatctctaagcaggccaaagcctcagaggtgatgggccccgtggaggctgcaccagaataccgcgttatcgttgacgctaacaatctcaccgtagagattgagaacgaattgaacattatccataagttcattcgggataagtatagcaagcgcttccctgaactggagagcctggtccctaacgcgctggattacatccggaccgtgaaggaactggggaattcgctggacaagtgtaaaaataacgagaatctgcagcagatcttaacaaatgctacaatcatggtagtctctgtcaccgcctctactacacagggccagcaactaagtgaagaggaactagaaaggctcgaggaagcctgcgatatggcgctcgaattgaatgcgtccaagcacaggatctacgagtacgtggagagcagaatgtccttcatcgccccgaatctgtccattatcattggtgccagcacggctgcgaagatcatgggagtcgctggtggcctaactaatctgagtaaaatgcccgcatgcaatattatgctcttgggagcgcagcggaaaaccctcagcggatag

SEQ ID NO: 201997 - DNA, 1569 bp, Artificial Sequence
  Description of Artificial Sequence: Synthetic coding sequence
atggccagcagccgggccagcagcacccaggccaccaagaccaaggcgccagacgacctcgttgcccccgtggtaaaaaagccacacatctattacggatccctcgaggagaaggagcgagaacgactagccaagggggaaagtgggatactgggtaaggatggattgaaagcgggcattgaagcaggaaacatcaacatcaccagcggggaggtttttgaaattgaagaacacattagcgagcggcaggccgaggtgctcgcagaattcgagaggcgcaaaagggcgcggcagataaacgtaagcactgacgatagcgaggtgaaggcatgtctcagagctcttggggaacctataaccctgtttggcgagggcccagcggagaggagagagcggttgcggaacattctgagtgtggtcggcactgatgccctgaagaaaaccaagaaagacgacgaaaagtccaaaaaaagcaaagaggagtaccaacagacctggtatcatgagggacccaactcattgaaggtggctcgcctttggatcgcaaattactcactgccgcgagccatgaaaaggctggaggaggctagattacacaaggaaatacctgagactacaaggacatctcagatgcaggagctccataagtccctcaggtctttaaacaacttttgcagccagatcggagatgaccgtcctatcagctactgccacttctcacctaatagcaaaatgctggccactgcttgctggtctggactttgcaagctctggtctgtacctgactgcaatctgctgcacactctcaggggccacaacactaatgttggggctatagttttccaccctaagagtactgtaagtcttgacccaaaggacgtgaacctggcatcgtgcgctgccgacggctctgtcaaactgtggtcccttgactcggatgagccggttgccgatatagaaggccacaccgtgcgcgtcgctcgggtgatgtggcaccctagtggcagattcctgggaaccacttgctacgatcggtcctggaggctttgggacctcgaggcccaagaggaaatcctccatcaggaggggcattctatgggcgtctatgacatcgcttttcaccaggacggatccctggctggaactggcggcctggatgccttcggtcgcgtctgggacctgaggactggccggtgtatcatgttcctagaagggcacctgaaggagatatacggaatcaactttagtcccaatggctatcatatcgccaccggcagcggtgacaacacttgcaaggtatgggatctgcgccagaggagatgcgtgtacacgatcccagcccatcaaaacctcgtcaccggagttaagttcgaaccaatccacggtaactttctactcaccggagcgtatgataacacagcgaaaatctggacgcatcctgggtggagccccctcaaaacactggcgggtcacgaggggaaggtgatggggctggacatatcatcggatggacaattaatagccacatgcagctacgacaggaccttcaaactgtggatggccgagtag

SEQ ID NO: 201998 - DNA, 1566 bp, Artificial Sequence
  Description of Artificial Sequence: Synthetic coding sequence
atggccagcagccgggccagcagcaccgccaccaagaccaaggcccccgacgatcttgtagcacccgtcgtgaaaaagcctcacatatactacgggtccctggaagagaaagagcgtgagaggctcgctaagggggagagtgggattctcgggaaggatggcctgaaggccggcatagaggccgggaacatcaatatcaccagtggtgaagtctttgagatcgaggagcacatctccgagagacaggcagaggtgcttgcggagttcgaacggagaaagagggctaggcagatcaacgtgagtacagatgacagcgaagtgaaagcctgtctccgagccctcggggagcccatcactctgttcggagaggggcctgccgaacgcagagaacgcctccgaaatatcctgtccgtggtcggaaccgatgccctgaagaagacgaagaaagacgacgagaagtcaaaaaaatccaaagaagagtaccaacagacctggtatcacgaagggcccaattcactgaaagtggctagattatggattgccaactattctctccctcgagccatgaagcgactcgaagaggcacgcctgcataaagagattcccgaaactactcgcacttctcagatgcaggagctccataaatcgttgcgcagtttgaacaacttttgtagccagattggcgatgatagacccatttcatactgccactttagccctaattctaaaatgctcgccaccgcttgttggtcagggttatgcaagctgtggagtgttccagactgcaacctattacacaccctgcgcgggcacaatacaaacgttggtgccatagtgtttcatcccaagagcacagtcagtttagatccgaaggacgtgaacttagcttcatgcgctgcagacggctccgtgaaactgtggtccctagattccgatgagccggtcgcagatattgaagggcatactgtcagagtggccagagtgatgtggcacccaagcggaaggttcttgggtaccacttgctatgatcggtcttggaggctttgggatctcgaggctcaggaggaaatcctgcaccaagaggggcatagcatgggagtgtacgatatcgctttccaccaagacgggagtcttgccggcacaggaggcttagacgccttcggccgcgtctgggatctgcgcaccggaagatgtattatgttcctggaggggcatctcaaggagatatacggaattaatttctctcctaacggatatcatattgcaacgggctctggtgataacacctgcaaggtgtgggatctgcgccagcggcggtgcgtctataccatacctgcccaccagaacctcgtaacaggcgtgaagttcgaaccgatccatggcaactttctgctgactggcgcttacgacaatacagctaagatatggacacaccctggctggagcccccttaagacactggcaggccacgagggcaaggtgatggggctggatattagctcagatgggcagctgatagctacttgttcttatgatagaacgtttaaactttggatggcagaatag

SEQ ID NO: 201999 - DNA, 3024 bp, Artificial Sequence
  Description of Artificial Sequence: Synthetic coding sequence
atggccgccgccgagacccagagcctgcgggagcagcccgagatggaggatgctaactctgagaaaagcatcaacgaagagaatggagaagttagcgaggaccaatcccagaataaacattctaggcacaagaaaaaaaagcacaagcatagaagtaagcataaaaaacacaaacactccagtgaagaggacaaggataagaagcacaagcacaaacataagcataagaaacacaaaaggaaagaaatcatcgatgcctccgataaggagggaatgtcaccggctaagagaacgaaactggatgatcttgcgctcctggaagacctggaaaagcagcgtgcccttatcaaggctgaactggataatgagctgatggagggaaaggttcaaagcggaatgggtctaatcctgcaaggatatgaatctggttctgaggaagagggggaaattcacgaaaaggccaggaacgggaatcgttcctccacgcgcagcagttccaccaagggcaagctggagctggttgacaacaagattaccacaaagaaacgatcaaaaagcaggagcaaagaaagaacacggcatcggtcagataagaaaaagtcgaaaggcggcattgagatcgttaaggagaaaacaacaagaagtaaatccaaggaacgcaaaaagtccaagtccccaagtaagcgctccaaatcacaggaccaggcacgcaaatcaaagagccctactttgagacggcgcagccaagagaagatcgggaaagcacgtagcccgacagatgacaaggtgaaaatcgaagacaaatccaagtctaaggatcggaaaaaatctccgattatcaacgaatcgcggtcgcgcgaccgcgggaagaagagtagatcgcccgtggacctgaggggcaagagcaaagacaggaggagccggagcaaggagaggaagagtaagcgctcagaaactgacaaggaaaaaaaaccaataaaaagtccatccaaagacgcctcatccgggaaagaaaatcgatctccatctcggcgccccgggcgtagtcctaagcggagatccctgagtccgaagcctagggacaaatctagaagatctcggtctccactgttaaatgatcgaagatcaaagcaatccaagagtccctctcggaccctctctcccggccgaagagctaaatcacgctctctggaaaggaagaggagagagcccgagagacggagacttagttcacccaggacacgaccccgcgacgatattctatctaggcgggagagatctaaggacgcaagcccgatcaataggtggtctccgacacgccggcgaagcagatcacctattaggagacgatctaggagccccttgcgccgttctcgtagcccccggcggcgtagcagatcaccacgaagaagggaccgcggtaggcggagccgcagccgtttgcgtaggcggtcgcgttcccggggaggccgccggaggcggtccagatctaaggtaaaggaggacaaattcaagggatccctttctgagggcatgaaggtggaacaagagtccagttccgacgataaccttgaggacttcgatgtcgaggaggaggatgaagaggcccttattgagcagcgcagaattcagcggcaggccattgtgcagaagtacaagtatctggctgaagattcaaatatgtctgtaccatctgaacccagttcccctcagtccagcacccgcaccagatctccctctccggatgacatccttgaacgtgtagccgctgatgtcaaagagtacgaaagagagaacgtagatacatttgaggctagcgtaaaagctaaacacaacctcatgaccgttgaacaaaataacgggagtagtcagaagaagctgctggcacctgacatgttcactgaaagcgatgacatgttcgcagcctactttgactctgctagattacgtgcagccggcattggcaaggacttcaaagaaaatcctaacctcagagataactggactgacgccgagggttactatcgggtcaatattggcgaggtccttgacaaacgatacaatgtctatgggtacacggggcaaggagttttctccaatgtcgtgcgcgcgcgggacaacgcacgcgcgaaccaggaggtcgctgttaaaatcatccgtaataacgagctgatgcagaagactggtcttaaagagttagagtttcttaaaaagcttaacgatgccgaccccgatgataagttccactgtttacggctgttcaggcatttctatcacaaacagcacctgtgcttggtgtttgagccattgtcaatgaacctgcgggaggtgctgaagaaatatggtaaagacgtcggacttcacataaaagcggttaggagttactcacagcagctcttcctggctttgaaacttctcaaacggtgcaacatactgcacgcagacataaaacccgataatatcctggtgaacgagtcgaaaactattctgaagttgtgcgactttgggagcgctagtcacgtcgcagacaatgatattacgccttacctggtaagccggttttacagggcacctgagataatcatcggtaagtcctatgactatggaattgatatgtggtcagttggctgtactctctacgagctctacaccggtaaaatcctctttcccggtaagactaataatcacatgcttaaattagccatggatctcaagggaaaaatgccaaataaaatgatcaggaaaggcgtgttcaaagaccagcacttcgaccagaatctgaactttatgtacattgaggtcgacaaggtaaccgaaagagagaaagtgacagtgatgagcactattaatccaactaaagatcttctggcagacttaattgggtgccaaaggttacccgaggatcagcgaaagaaagtccaccagctcaaggacttgctggatcagattttaatgctggacccagccaagcgcatctccatcaaccaggcactgcagcacgcttttatacaggagaagatttag

SEQ ID NO: 202000 - DNA, 3024 bp, Artificial Sequence
  Description of Artificial Sequence: Synthetic coding sequence
atggccgccgccgagacccagagcctgcgggagcagcccgagatggaggacgctaatagtgaaaagtcaatcaacgaggaaaacggagaggtgagtgaggaccagagccaaaacaagcacagtaggcataaaaaaaagaagcataaacataggagtaaacacaagaaacacaagcattcaagtgaagaggacaaggataagaaacataagcacaagcacaaacacaaaaagcacaagagaaaggaaataatcgacgcctccgacaaggaggggatgtcgcctgccaagaggactaaactggacgatctggcgctcctcgaggacctggaaaaacaacgagccttaatcaaggccgaactcgataacgaactgatggagggaaaggttcagtctgggatggggcttatcctgcaggggtacgagtccgggtcagaagaggagggcgagattcacgaaaaggctcggaacggcaatcggtccagcacaagaagttcatccactaaggggaaacttgagcttgtggataacaaaattaccactaagaaaaggtccaaatcacggtctaaggaaaggacccgacataggtccgacaagaagaaatcaaagggcggaatcgaaattgtgaaggaaaagaccactcggagcaagtccaaagagagaaagaaatcaaagtctccttctaaacgctcaaagtcccaggaccaagcaaggaagtcaaaatccccaactctccggaggcgctctcaagagaagattggcaaggctcggtcccctacagacgacaaagtgaagatagaggacaaatcgaaatctaaagatcgcaagaaaagtcctatcattaatgaatcccggagccgggacaggggaaaaaagagccgaagcccggtggatctccgaggtaagtccaaagaccggagaagcagatcaaaagaacgcaaaagcaaaagatccgagaccgataaggagaaaaaacccattaaaagccccagcaaagacgcctcatctggtaaagagaatcgctctccctcgcgccggccaggacggagccccaagagacggagcctgagccccaaaccccgtgacaaaagccggaggtcacgaagccctctgctcaatgatcggcgtagcaagcaatctaagtctccaagccggacactctcgcctggaaggagggctaagagtagatccttggagcggaagcgccgcgagcctgagcgaaggaggttgtcaagccctcggaccagaccacgggacgatattttaagccggcgggaaaggagcaaggacgcttctcctatcaacagatggtcaccgacaaggaggcggtcacgctccccaattaggagaaggtcccggtcaccattacggcgaagccgtagtccgcgtcgcaggtcacgctcccctcgtcgccgtgataggggccggaggtcccgcagcaggctgagacgcagatccaggtcccggggaggtagaaggcgtcggagccggtccaaggtgaaggaagacaagttcaagggatcgctctctgagggcatgaaagtcgaacaggaatctagctccgacgacaacctcgaggactttgacgtggaggaggaagacgaagaggctcttatagagcagcgtcgaatccagagacaggctatcgtgcagaaatacaagtacctcgcggaggattcaaacatgtctgttccttcagaaccctcctccccacagtcctcaactcgtactaggtctccgtctcccgatgacattcttgaacgcgttgcggcagatgtcaaggaatatgagcgagagaacgttgatacattcgaggcaagtgttaaggcaaaacacaatctgatgactgttgagcagaacaatgggagcagccagaaaaaactactcgctcccgacatgttcactgaatctgatgatatgttcgcagcgtacttcgatagcgcaaggctcagggctgctggaatcggtaaggattttaaagagaaccctaatctcagggacaactggaccgatgctgagggttactatagggtgaacatcggggaggtgctggacaaaaggtacaacgtatacggctacacaggtcagggcgtctttagtaacgtagtacgagcaagagataacgctagggccaaccaggaggtcgcggtgaaaatcatcagaaataatgagctaatgcagaagaccggtctgaaagaacttgagtttctcaagaaattgaacgatgccgaccccgacgacaaattccattgtctgcggctgtttaggcacttttaccacaagcaacatctctgtctggtcttcgagcccctgtcaatgaacttacgggaggtgctgaaaaaatacggcaaggatgttggcttgcatatcaaagccgtgcggtcgtatagccaacagttgttcttggctctgaagctgctgaagagatgtaatattctacatgctgatatcaagccagacaacatacttgtgaacgagtccaaaacaatcctgaaactgtgcgatttcgggtctgcttcacatgtggccgataacgatattactccctatctcgtttctaggttctaccgagccccagagatcatcattggaaagtcatatgattatggcattgacatgtggagcgtcggctgcactctctatgaattgtatacaggtaaaattttgttccctgggaagactaacaatcacatgttgaaactcgccatggacctcaaagggaagatgccaaataagatgatcaggaagggggtttttaaggatcagcacttcgaccaaaatctgaacttcatgtacatagaggtagacaaggtgactgaacgcgaaaaggtgaccgtaatgtccactatcaaccctacaaaagacctgctcgccgatctgatcggctgtcaacggctcccagaggaccaacgcaagaaggtccatcagctcaaggatctgttggatcagatcctcatgctggacccagccaaacgcattagcatcaatcaagcactgcagcacgcttttatccaagagaaaatttag

SEQ ID NO: 202001 - DNA, 2982 bp, Artificial Sequence
  Description of Artificial Sequence: Synthetic coding sequence
atggaggacgccaacagcgagaagagcatcaacgaggagaacggcgaagtgtcagaggatcagtcccagaataagcacagtcgccacaaaaagaagaaacataagcaccgcagcaagcataagaagcacaaacacagttccgaagaagataaggacaagaagcataaacacaagcacaagcacaaaaaacacaaaaggaaggagattattgatgcatccgacaaagaaggcatgtcaccggctaaacgaactaagttggacgacctcgcattacttgaggacctggaaaagcagagggcactgattaaagctgagctcgataatgaattgatggaaggtaaagtgcagtctggcatggggctgatccttcaaggctacgagtcaggctccgaagaggaaggggaaatacatgagaaggcccggaacggcaataggagcagcacccgcagctcttcaacaaagggtaagctggagcttgtggataacaagatcacaacaaagaagaggtccaagtcccgttctaaagagagaacccgacacaggagcgacaaaaagaagagtaagggcggtattgaaattgtaaaggaaaagactactagatctaaaagtaaagagaggaagaaatcgaagtccccaagtaagcggagtaaaagccaagaccaggcacggaaatctaagtcccccactttgcgtaggcgatcacaggaaaagatcggaaaggcccggagtccaacagacgataaagtcaagatcgaggacaaatcgaaatcaaaggacagaaagaaaagccccataattaatgaatcaagatccagagacagaggcaagaaaagcagatctcccgtagacttaagaggaaagagcaaagatagacgatcccggtccaaagagcgaaagtccaagagatctgagactgataaggagaagaagcctatcaagtcaccctctaaggacgcctcttccggtaaagaaaacaggtccccttccagaaggcccggccggtcaccaaaaaggcggagcctctcgccaaaaccgcgagacaagtctcgacgcagccgatcacccctgctcaatgataggcgctccaagcagagcaaatctccttcaaggaccctgagccccggccgtcgcgcaaagtctcgctctcttgagcggaaacgccgtgagcctgagaggcgccgcctatcctcaccgcgtactcgccctcgtgatgatattttgtctagaagggaaagaagtaaggatgcgagcccaattaaccgctggtccccaacccggaggcggtctagaagtcctatccggagacgttctcggtcacccctacgccggtccaggtcacccagaaggcgtagtaggtctcctcgcagacgcgacagaggccgtagaagtcggagccgtctccggcggcggtctcgatcgagaggaggaagacgcaggcggtcacgatccaaggtcaaggaagacaagtttaagggaagcctaagtgaggggatgaaggtggagcaggagtcatctagtgacgataatctggaggatttcgacgtggaggaagaagacgaggaagcccttatcgagcaaaggagaattcaacgccaggccatagtacagaagtacaaatatctggccgaggactctaatatgtcagtgccaagcgagccttcatcaccgcagtcatccacccgaacccgatctcctagtccagacgacatcctggagcgtgtggccgccgacgtgaaagagtacgaacgggaaaatgtcgacacatttgaagcttctgtaaaggctaagcataacctcatgaccgtggaacaaaacaatggctccagccagaaaaagttgttggcacctgatatgtttacagagagcgacgacatgttcgctgcctatttcgatagcgcccgcttgagggccgcaggcatcggtaaggactttaaggagaatccaaacctccgggacaactggaccgacgccgaaggctactaccgcgtaaacattggcgaagttctggacaaacgttacaatgtctatggctacacagggcaaggggtttttagcaacgtggtccgagcgagggataatgctcgagctaatcaagaggtggccgtcaaaataattaggaacaatgagcttatgcagaaaaccggcctgaaggagttggaattcctaaaaaaacttaacgatgccgatcccgatgataaatttcactgtctaagattgttcagacacttctaccacaaacagcacctgtgtctggtgtttgaaccactctctatgaacctgcgggaggtcctgaagaaatacggaaaggacgttggcctgcatattaaagccgtcagaagctatagccagcaattattcctcgccctgaagctccttaagcgttgtaacattttacatgccgacatcaagccagataacatcctggtgaacgagagtaaaactatcctgaaactatgtgattttgggagcgctagccacgtggccgacaatgatatcactccatatttagttagcaggttctacagagccccggaaatcataattggaaaaagctatgactacggcatcgacatgtggtcagtcggctgtaccctgtacgaactgtatactggaaaaattctgtttcccggaaaaactaataatcatatgctgaagttggctatggacctgaaaggcaagatgcctaataagatgataaggaagggggttttcaaggaccaacattttgatcaaaacctgaatttcatgtatattgaagtggataaggtgaccgagagggagaaagtgaccgtcatgtcaaccataaatccgacaaaggacctgctcgccgatttgatagggtgtcaacgtctccctgaagaccagaggaagaaggtgcatcaacttaaggatctgctcgaccagattctgatgcttgatcccgctaagagaatttccatcaatcaagcgctccagcacgcattcatccaggagaagatctag

SEQ ID NO: 202002 - DNA, 2820 bp, Artificial Sequence
  Description of Artificial Sequence: Synthetic coding sequence
atgcggcccggcaccggcgccgagcggggcggcctgatggtgagcgagatggagtcccatcctcctagccagggaccgggggacggggaaagacggctctcaggcagcagtctgtgttccggatcctgggtttccgcagacggcttcctcaggagaagaccctccatgggtcaccccgggatgcattacgcccccatgggcatgcacccaatgggacagcgtgctaacatgccgcccgttccacacggaatgatgccgcagatgatgccaccaatgggcggcccacccatggggcagatgcccggcatgatgagctcagttatgcctggaatgatgatgagccatatgagccaggcttccatgcagccagcactgcccccaggcgtgaacagcatggacgtggctgccggtacttataccctgtataagtctatgtggactgagcataagtcccctgacgggaggacgtactattacaacacagagactaaacagtctacctgggagaagcccgacgatttgaagacccccgcagagcagctgttgtctaagtgtccttggaaggagtacaagtcggattccggcaaaccatactattataatagccagacgaaggaaagtcggtgggccaaacctaaggaactagaggacctggagggaaagatgggaaagattaaatactccaaacaggaggagtgtacaacaaccagcaccgctcccgttccaaccactgagatcccaactaccatgagtacaatggctgcggccgaagcagccgccgcggtggttgctgccgctgccgccgccgccgcagccgcggcagccgcaaacgctaacgcgagtacctcagcctcaaacacggtgagcggcaccgtgcctgtggtacccgaacccgaagttaccagcatagtcgcgacagtggtagacaatgaaaacaccgtgaccataagcacagaagaacaggctcagttaactagtacacctgcaatccaggatcagtccgtcgaggtctcctccaataccggcgaagagacttctaaacaggagaccgtggcagattttacccctaagaaggaggaagaggagtcccagcccgcaaagaaaacttacacctggaacacgaaggaagaggcaaaacaggcttttaaggagttgttaaaggagaagcgagtacctagcaacgcatcttgggagcaggcaatgaagatgatcatcaacgatcctcgctacagcgctctggcgaagctctccgagaagaaacaggcatttaacgcgtataaggtgcaaaccgaaaaggaggagaaggaggaagctagatctaaatataaagaggcaaaggaatctttccagaggttcttggagaatcacgagaaaatgacttcgactacacgctacaaaaaagctgaacagatgtttggggagatggaagtgtggaatgccatctccgaaagagaccgcctcgagatttacgaagatgttctgttctttcttagtaaaaaagagaaagagcaggcgaagcaactgaggaagcggaattgggaagcgttgaaaaacattctcgataatatggccaatgttacctacagtacgacatggtctgaagcgcagcagtacctgatggataatccaacttttgccgaagatgaagaactgcagaacatggacaaggaggacgcacttatttgttttgaggagcatattcgagcactcgagaaagaagaggaagaggaaaaacagaagtccttgttacgtgaaagaaggagacagaggaagaacagggaatcatttcagatcttcttggacgagttacatgaacatggccagctccatagcatgtcttcctggatggagctgtatcccacaattagcagcgacattagattcactaacatgctcgggcagcctgggtccacagccctcgacctgtttaaattttacgtggaggacctgaaggcccgataccacgatgaaaagaaaattatcaaagacatcttaaaggataaagggtttgtggtcgaagttaacacaactttcgaagacttcgtcgctattatcagttcaaccaaaagatctactaccctggacgccggcaacattaaactagctttcaacagccttctggagaaagcagaggcccgggagcgggagcgcgagaaagaggaggcacgaaaaatgaaaaggaaggaaagcgctttcaagtccatgctgaaacaagcagcacctccaattgagcttgatgcggtctgggaagatatccgggagcgctttgtcaaggagccagccttcgaggatattacgttggagtctgaacgaaagcggatctttaaagatttcatgcacgtcctcgaacatgaatgccagcaccatcacagtaagaataaaaaacactcaaaaaagtcaaaaaagcaccataggaaaagatctcgatcccgttctggatccgactccgacgatgatgacagtcactctaagaaaaaaagacagcggtccgagtctcgatcagcctcagaacactcaagtagcgcagagagcgaaaggagttacaaaaagagcaagaaacataagaagaaatccaagaagcggcgacacaaatcagactcacccgaaagcgacgccgaaagagaaaaggataagaaagagaaagaccgagagtctgaaaaagaccgcacacggcagcgatctgagtcgaaacataagagtcccaagaaaaaaactggaaaagatagtggcaattgggacacctctgggagcgagctaagtgaaggggagttggaaaagagacgcaggactcttctggaacagctcgacgatgaccagtag

SEQ ID NO: 202003 - DNA, 2451 bp, Artificial Sequence
  Description of Artificial Sequence: Synthetic coding sequence
atgtgcagcggcagcggccggcggcggagcagcctgagccccaccatgagacccggaaccggggccgaaagaggcgggttgatgatgggacatcccgggatgcattacgcccccatgggtatgcatcccatgggccagcgggccaatatgccccctgttcctcacgggatgatgccacagatgatgcctcctatgggcggaccccccatgggacagatgcccgggatgatgagcagcgtgatgcctggcatgatgatgtcccatatgtcccaggcctctatgcagcctgccctcccacagctccttagcaaatgcccctggaaagaatataagtctgactccggtaagccttattactacaacagccagacaaaagagtccaggtgggctaagccaaaagagcttgaagatctggagggctaccagaataccattgtggcagggtctctgatcacaaagtctaaccttcacggcatgctcacggaactgaaatactctaagcaagaggagtgcaccactacctcgactgctcccgtgcccactaccgaaattcccacaacgatgagtacgatggctgccgcagaggctgccgcagcggtggtcgcagccgcagccgctgctgctgctgctgccgccgctgctaacgccaatgctagtacttcggcctccaatactgtttccgggaccgtgcccgttgtccctgagcctgaggtgacctcaatcgtcgctacagtggttgataacgagaacaccgtaacaatatcaacagaggagcaggcacagcttacctccacccctgccatccaggaccagtctgtggaagtaagctcgaataccggcgaggagacctccaagcaagaaacagttgcagactttactcctaagaaggaggaggaagaaagtcagcccgccaagaagacttacacatggaatactaaggaagaagcaaagcaggcttttaaagaactactaaaggagaagagggtgccaagcaatgcttcatgggaacaggcaatgaagatgatcataaatgatccccgctattctgcactggccaaactgagcgagaagaagcaggccttcaacgcatataaagttcagaccgagaaagaggaaaaggaagaagcaagaagtaagtataaagaagccaaagaatcctttcaaaggttcctcgagaatcacgagaaaatgaccagcaccacaaggtataagaaggccgaacaaatgtttggagaaatggaagtctggaacgccatttctgagcgagataggctggagatctatgaggatgtgctctttttcctgtccaagaaagaaaaagagcaagctaagcagttacgcaaacgcaactgggaggctctaaagaatatactagacaacatggccaatgttacatacagtaccacttggtcagaggcacaacagtacctcatggataaccccacctttgcagaagatgaggagttgcagaacatggacaaggaagacgccctcatttgttttgaggagcatatccgagccctagaaaaggaagaggaggaggagaagcagaaaagcctactgcgcgaaagacgaagacaacggaagaacagagaatccttccagatctttttagatgagctgcacgaacatgggcaattacatagtatgtcttcgtggatggaactgtaccctaccatttcctcagacatccggtttactaatatgctgggacagccagtatttagtctaggctctaccgcgttagacctattcaagttttatgtcgaagacttaaaagctcgctatcacgatgagaaaaagattatcaaggacattcttaaagacaaggggttcgtggtggaagtaaatacaaccttcgaggactttgttgccattatcagcagtacaaagcggtctacaacactcgacgctgggaacataaagctcgcctttaattccctgctggaaaaggccgaggctcgggaacgggaacgcgagaaggaagaggcccgcaaaatgaagaggaaggagagcgccttcaagagcatgctgaaacaggcggctcctcctatcgagctcgatgcagtgtgggaggacatcagggagcgatttgtgaaggagcccgcatttgaggatatcaccttggagagcgagaggaagaggatattcaaggatttcatgcacgtactcgaacatgaatgccagcatcaccattcgaagaacaaaaagcactccaaaaaatccaaaaaacatcaccggaaacgttctaggtccagaagtggtagtgacagcgacgacgacgactctcatagcaagaaaaaacgccagagatccgagagcaggtccgcctctgagcactccagtagtgccgagagcgagcggtcttacaagaaaagtaagaagcataagaagaaaagtaagaaacggcgacacaagtctgactccccagagtcggatgccgagaggtag

SEQ ID NO: 202004 - DNA, 2793 bp, Artificial Sequence
  Description of Artificial Sequence: Synthetic coding sequence
atgtgcagcggcagcggccggcggcggagcagcctgagccccaccatgaggcccggcaccggagctgaacggggcggcctcatgatgggccatccagggatgcattacgcccctatggggatgcatccaatgggccaacgcgctaatatgccccctgtaccccacggtatgatgcctcagatgatgcccccgatgggggggcccccaatgggccagatgcctggtatgatgagttctgttatgccgggcatgatgatgtcccatatgagccaggcgagcatgcaacccgcattgccccctggagtgaacagtatggatgttgccgcggggacagcctctggagccaaatcgatgtggacagaacacaagagtcctgatgggcggacctactactataataccgagacaaagcagtcaacgtgggagaagccggatgacttgaaaacaccagcagaacagcttctgtctaagtgtccatggaaagaatataaatcggactcagggaagccctactactacaactcacagacgaaagagtctaggtgggctaaaccgaaggaattggaggatctggagggctaccagaacactatcgtggccgggtccctcattactaagtccaatttgcacgcaatgattaaagcggaggagagttctaagcaggaagagtgcacaacgaccagtactgcccctgtgccgactaccgagattccaacgaccatgtccactatggccgctgccgaagcagcagccgcggtggtcgcagccgcagccgctgcagctgccgccgccgcagcggctaatgccaatgcctctacatctgccagtaacacggtctccgggacagtgccggtggttcccgagcctgaggttacctccatagtagctacagtcgtcgataacgaaaatacagttactattagtaccgaagaacaggcacagctgacaagcactccggcgattcaggaccagagtgtagaggttagctccaataccggggaagaaactagtaaacaggaaacagttgccgattttacgcctaagaaagaagaagaagagtctcaacccgctaaaaagacctacacttggaacaccaaggaagaggctaaacaggcttttaaggagctcctcaaggagaagagagtgccgtccaacgcctcctgggagcaggccatgaagatgatcatcaatgaccctaggtatagcgccctcgccaagctatccgagaaaaagcaggcattcaatgcatacaaagtgcagactgagaaggaggagaaggaagaagccagaagtaagtacaaggaagccaaggagtccttccagagatttcttgaaaatcacgaaaaaatgacttctacaacgcgctacaagaaagcggagcagatgttcggcgaaatggaagtgtggaacgcaattagtgagagagatcgtctggaaatatacgaagacgtgctgttcttcctttcaaagaaagaaaaagagcaggctaaacagctgagaaaaagaaactgggaggcgcttaagaacattcttgacaatatggctaacgtaacttactctacaacatggtcagaggcacagcaatacctgatggataatcctacattcgccgaggatgaggagctgcagaacatggataaggaggacgctctgatatgttttgaagagcacattagagccctggaaaaagaggaagaggaggagaagcaaaagtctctgctccgcgagcgcaggcggcaaaggaagaaccgagagtcatttcaaatcttccttgacgaattgcacgagcatggtcaactccactccatgtcttcctggatggaactctaccctacaatctccagtgatattcggttcactaacatgctgggacaacctggatccactgctctcgatctgtttaagttctatgtggaagacctaaaggctagataccatgacgagaaaaagataatcaaggacatattgaaggataagggattcgtggtagaggtgaatactacctttgaagactttgtcgcgatcatcagctccacgaagcggtcaaccaccctggacgccgggaacattaagctagccttcaattctctcctagaaaaggccgaggcccgagagcgcgagcgggagaaggaggaagctcggaaaatgaaaagaaaggaaagtgcattcaaatctatgcttaagcaggctgccccacccatagagttagacgcagtttgggaggatatcagagagcgctttgtgaaggagcctgcgttcgaggacatcaccctcgagtctgagagaaaacgtatctttaaagatttcatgcatgtcctcgaacacgaatgccagcatcatcattcaaagaataaaaaacattctaagaaatcgaagaaacaccatagaaagagaagccgctctcgttcaggtagcgacagtgatgacgatgattctcactctaagaagaagaggcagagaagcgaatctaggtccgcttccgagcattcgagcagcgccgagagcgaacggtcatataaaaagtctaagaaacataagaagaaatcaaagaaacggcggcacaagtcagatagcccagaatctgatgcagaacgggagaaggacaagaaagagaaagaccgggaatcagaaaaggaccgcacccgccagcgttcggaaagtaagcataagtcccccaagaagaagacgggcaaggattccggcaattgggacacctctggttccgaactctccgagggagagctggagaaaagacgccgtacgttgctggagcagttggatgatgaccagtag

SEQ ID NO: 202005 - DNA, 2481 bp, Artificial Sequence
  Description of Artificial Sequence: Synthetic coding sequence
atggacgtggccgccggcaccgccagcggcgccaagagcatgtggactgaacacaagtccccagacggtagaacctactattataatacagagacgaaacagagtacttgggaaaaaccagatgatctcaagactccagcggagcaactcttgagtaaatgcccgtggaaggaatataaatcagacagtggcaaaccctattactacaattcccagaccaaagagtccaggtgggcaaaacccaaagaactcgaagacctggagggctatcagaacactatcgtcgcagggtctcttattactaagagcaacttgcacgggatgctgacagaactgaagtactcaaagcaggaagaatgtaccactacctctaccgccccagtccccactaccgagattccaacgacaatgagtactatggcagctgctgaggcagccgcggctgtagttgccgctgccgccgctgccgccgcagctgcagccgctgcaaatgccaatgcgtcgacttccgcatcaaataccgtatctgggacggttcccgtagtgcctgagcccgaagtaacgagcatcgtggcaaccgtcgtggacaatgagaacaccgtaacaatctccacagaagagcaagcacagctgaccagtaccccagctattcaggaccagagtgtagaggtgtcctcaaacacaggggaagagacctccaagcaggagacggtggcagattttacgcccaagaaagaggaggaggaatctcagcccgccaaaaagacatacacctggaacaccaaagaggaggctaaacaggccttcaaggaattactgaaagaaaaaagggtgccctccaatgcctcttgggaacaggcaatgaaaatgattatcaatgatcccaggtacagcgcgctcgccaaattaagcgaaaaaaagcaggcttttaatgcctataaagtgcagaccgagaaggaggagaaagaggaggctcgcagcaagtacaaggaagcaaaggagtcctttcagcggtttcttgagaatcacgaaaagatgacttccactactcgatacaagaaagccgaacagatgtttggcgaaatggaagtgtggaatgccattagtgagcgggaccggttggaaatctatgaagacgtgctgttttttttgagtaagaaagagaaagaacaagctaagcagttaagaaaaaggaactgggaggccttaaagaatattctcgacaacatggcgaatgtgacatattcaacgacttggagcgaggcgcaacagtacctcatggacaatccaacatttgccgaggatgaagagctccagaatatggacaaggaagacgcattaatctgtttcgaagaacacataagggcgctggagaaggaggaggaagaagagaagcagaaatctcttctgagagaacgtcgtcggcagagaaaaaatcgggaatcctttcagatttttcttgatgagctccatgaacatggacaattgcatagcatgtcctcctggatggaattataccccacaatttctagtgatatacggttcacaaacatgctgggacaaccaggaagcaccgctctggatctgtttaagttctacgtcgaagatttgaaggcacgctaccatgatgagaaaaagatcatcaaagatattctgaaggacaagggcttcgtagtggaggtaaacactaccttcgaagactttgtggccattatttcctcaacaaagcgctcaacaaccctcgacgccggcaatataaagctggctttcaacagtttactggaaaaagctgaggcaagagagcgagaacgcgaaaaggaggaggccagaaaaatgaagcgcaaagagtctgcgttcaagagcatgctcaagcaggcagcccctcctatcgagctggacgcagtgtgggaggatattcgcgagcgcttcgtgaaggaacctgccttcgaggatataaccctggagagcgaaaggaagaggattttcaaagatttcatgcatgtccttgagcatgaatgtcagcaccaccattcaaagaataaaaagcactccaagaaatctaaaaagcaccatcgcaagaggtctagatcgcgtagcggctccgactccgatgacgacgactcccattcaaagaaaaagcgacaaagaagcgagtctcgttccgcatctgaacacagcagttccgccgagtctgaacgatcctataaaaaatctaaaaaacataagaagaaatctaaaaaaagacgccacaagagcgatagcccagaaagtgatgctgagcgtgagaaggataaaaaggaaaaagatcgggaatcagaaaaggaccgtacaagacagagatcagagagtaaacacaagtcacctaaaaaaaagaccgggaaggattcggggaactgggacacatcaggaagcgagcttagcgaaggggaactggagaaaagaaggcgaactttattggaacagcttgatgatgatcagtag

SEQ ID NO: 202006 - DNA, 1347 bp, Artificial Sequence
  Description of Artificial Sequence: Synthetic coding sequence
atgcggcccggcaccggcgccgagcggggcggcctgatggtgagcgaaatggagagccacccccccagccagggccccggggacggcgagcgaaggctatctggcagctccctctgtagcggcagttgggtaagcgctgacggctttctaagaaggaggccgagtatgggccatccaggaatgcactacgcccccatggggatgcatcctatgggccagagggcaaacatgcctcccgtaccacacgggatgatgccacagatgatgccaccaatgggcggacccccaatgggtcaaatgcccggcatgatgtccagcgtgatgcctgggatgatgatgtcacacatgtcacaggcgagcatgcaaccagctttacctcctggagtgaattctatggatgtggccgcgggcactgcttctggggccaagagcatgtggacggagcacaaaagtcccgacgggagaacatattactataacaccgagacaaaacagtccacctgggagaaacctgatgatttgaagactccggctgagcagctgttaagcaagtgcccgtggaaggaatataagtctgattctggcaaaccctattattacaatagtcaaaccaaagagtccagatgggccaagcccaaagagctggaggacttagaaggatatcagaatacaatcgttgccggtagcctgatcacaaaaagtaatctccacgctatgatcaaagcagaggagtctagcaaacaagaggagtgtaccaccaccagtactgcccctgtgcccaccacagaaatacctaccaccatgagtaccatggcggctgccgaggcagccgccgctgtggtagctgcagccgcagccgctgccgctgcagccgccgcagctaatgccaatgcaagcactagtgcatccaatacagtgagcggaacggtgccagttgtgcctgaacccgaggttacatcaatagtggctacagttgtcgacaatgaaaacaccgtcaccatttctactgaggagcaagcacagctgacatctactcccgctatccaggaccagtctgtggaggtctcatccaatactggcgaggagacctccaaacaagaaaccgttgcagatttcacccctaaaaaagaggaggaggagtctcagccagcgaaaaagacttatacttggaacactaaggaggaggccaaacaggccttcaaagagctcctgaaggaaaagcgagtccctagtaacgcatcatgggaacaggccatgaaaatgatcatcaatgatccgagatactccgcccttgccaagctcagcgagaagaagcaggcctttaacgcctacaaagttcagacctag

SEQ ID NO: 202007 - DNA, 2826 bp, Artificial Sequence
  Description of Artificial Sequence: Synthetic coding sequence
atgaacaagaagaagaagcccttcctgggcatgcccgcccccctggggtacgttcccggtctcggtagaggggcaacaggattcacgactcggtcagatatcggtccagcccgagatgcaaatgatcccgtggatgaccgccatgctcctccggggaagagaactgttggagaccagatgaaaaagaatcaagctgcagatgacgacgatgaggatctcaatgatacgaattatgacgagttcaacggctacgccggctcgctgttctcgtccggaccctatgagaaagacgatgaggaggctgacgctatatacgccgcactggacaagagaatggacgaaaggagaaaagagcgacgcgagcagcgcgaaaaagaagagatcgaaaaataccggatggagaggcccaagatccagcagcagttctcagatctgaaacgcaaactggccgaggtgacggaggaggaatggctgtccattcccgaagtgggggacgcgaggaacaagaggcagagaaaccctagatacgaaaagttgacacccgtgcctgatagcttttttgctaaacacctgcagacaggcgaaaaccacacctctgtagatccgcgtcagactcaatttggtggactcaacactccttaccctggaggactgaacaccccatatcccggaggcatgacaccaggtttgatgactcctggaacaggcgagctggacatgcggaagatcgggcaggctagaaatactctcatggacatgaggctctcacaggtatccgacagcgtatccggccagaccgtggtggaccccaagggctacctcaccgatctcaactcaatgatccccacccacgggggcgacatcaatgacattaagaaggcacgtttactgctgaagagtgtgcgagagaccaatccacaccaccccccggcctggattgcgtcagctcgtcttgaggaggtgacagggaaactgcaagtggcccgcaacttaataatgaaggggacagagatgtgccctaagtccgaagatgtctggttggaagccgctcgcctgcagcctggcgacactgcaaaggccgttgttgctcaggccgtccgacatttgccccagtccgtgcgtatctatatccgggctgccgaactagaaaccgacatccgcgcaaagaagagagtgctgcggaaagcccttgaacacgttcccaattctgtccgtctctggaaggcagccgtcgagctcgaggagcccgaggatgcaagaataatgctcagccgcgctgtcgaatgctgtccgacttccgttgagttatggctggcactggctcgtttggaaacctacgagaatgcacgaaaagtactcaacaaggctagggaaaacattccgactgacagacatatttggatcacagccgcaaaactggaggaagctaatgggaatacacagatggtcgagaagattatagaccgcgccataacctcactccgcgcaaacggtgttgagattaatagagaacagtggatccaggacgccgaagagtgtgatcgcgccgggtctgttgcaacctgccaagcggttatgcgcgccgtgatcggcataggcatcgaagaagaggatagaaaacacacatggatggaggacgctgattcatgtgttgcccataacgccctcgaatgtgcccgcgctatatatgcatatgccctgcaagtttttccctccaagaaatctgtgtggcttcgggcagcatactttgagaaaaaccacgggactcgcgaatcactggaggcactgcttcagcgcgccgtggcccactgtccaaaggcagaagtgttgtggcttatgggcgcgaagtcgaagtggctcgcaggagacgtacctgccgctcgctccattctggccctggccttccaggccaacccaaactccgaagagatctggctggcagcagtcaaactggaatctgaaaacgatgaatatgagcgcgctaggcggctactagccaaagccagatccagcgcacccacagccagagtgtttatgaaatccgtcaagctagagtgggtgcaggataacatcagagcagctcaggacctttgcgaggaagcattgagacattatgaagacttccctaagctgtggatgatgaagggtcagatcgaagaacagaaggaaatgatggaaaaggcccgcgaggcctacaaccagggcctgaagaaatgcccccattctacacccctatggctcctgttgagcaggctggaagaaaaaattggacaactgactcgggcccgcgcaatactcgaaaaatcgagactcaaaaatcctaagaaccctggcctgtggctcgagagtgtgcggctggagtaccgcgccgggctcaagaacattgcaaacacattgatggctaaagcactgcaggagtgccccaactccgggatactgtggtcggaagcaatctttctggaggcaaggcctcagcggaggaccaagagtgtggacgccctaaaaaagtgcgagcatgatccccatgtgttgctggccgttgctaagcttttttggagccagagaaaaatcacaaaagcaagagaatggtttcaccgcactgtcaagatcgatagtgacctcggagatgcatgggccttcttttataagtttgaacttcagcacggaactgaggaacagcaagaggaagtgagaaagcgctgcgaatcagccgaaccgcggcacggggagctgtggtgtgccgttagcaaagatattgcaaattggcagaaaaaaattggggacatacttcggctggtagcaggcagaatcaagaacacgttctag

SEQ ID NO: 202008 - DNA, 2706 bp, Artificial Sequence
  Description of Artificial Sequence: Synthetic coding sequence
atgaacaagaagaagaagcccttcctgggcatgcccgcccccctgggttacgtcccaggacttggtagaggtgctaccgggtttaccacgcggagcgatataggtcctgcacgtgacgccaacgaccctgtagacgatcgccacgctcctcccggaaagcggactgtcggagatcagatgaaaaagaaccaggccgccgacgacgatgatgaagacctcaacgatactaattacgatgagttcaacggatacgccgggtctctgttttcatccggaccttacgagaaggacgacgaggaagcagacgcgatctatgctgccctggataagcgcatggatgagcggcgcaaagaaaggcgcgagcaaagggagaaagaagaaatcgagaaatatagaatggagaggcctaagattcaacaacagttttcagacctgaaaagaaagctggcggaagtgaccgaagaggaatggctgtccatcccagaagtgggtgatgcacggaacaagagacaacgtaatcctaggtatgaaaaactgacgccagtgcccgacagctttttcgcaaaacatctgcagactggggagaatcatacctctgtagatcctcggcagacacaattcggcggcttgaacaccccctatccagggggtctgaataccccttatcccggaggtatgacgccgggcctgatgactcccggtaccggcgaactggatatgcgtaagatcggacaggcccgcaatactctgatggacatgcggcttagtcaagtgagcgattccgtgtcagggcaaacagtggtggaccccaagggctacctaaccgatttaaatagtatgatccccactcatggtggcgacattaacgatattaagaaagcacggttgctgctcaagtccgtgcgagaaacaaatcctcatcacccgcctgcatggattgcttccgcgcggctggaagaggtgactggaaagctgcaggtggctaggaatctgataatgaagggtaccgaaatgtgcccaaaatccgaagacgtgtggctggaagcagcacggctccaaccaggcgacaccgccaaggccgtggttgctcaagccgttcggcacctgccacaatccgtgagaatttacatccgggctgcagagctcgaaacagacataagagcaaagaagcgggtgctgaggaaagcactagagcacgtccccaattctgtacgcctctggaaagctgcggtggagcttgaggagcctgaagatgcacggattatgttgtctcgggccgtggagtgctgtccaactagcgttgagctttggctggctttggctcgactcgagacatacgaaaacgcccgtaaggtgctcaataaggccagagagaacatccccacagacaggcatatttggataaccgctgccaaattagaagaagcaaacgggaatactcagatggtggagaagataattgatcgtgcaattacctctctccgcgcgaacggtgtggagattaacagggagcagtggatacaggatgctgaggaatgcgaccgtgcaggttcagttgccacttgccaagcggtgatgagagccgtaataggaataggcattgaggaagaagataggaagcacacctggatggaggatgcggacagctgcgttgcccataatgcattggaatgtgcccgagccatctatgcctatgctctccaggtcttcccctctaaaaagtccgtatggctgcgcgccgcctacttcgaaaaaaatcacggcacccgcgaatccttggaagccttgctacaacgcgcagtcgctcattgtccaaaagccgaggtgctctggctcatgggcgccaagagcaaatggctagccggagacgtcccagctgccaggagtatcctagctttggcatttcaagtttttatgaagtctgtgaagctcgagtgggtgcaagataacataagagctgctcaggacctgtgcgaggaagcactcaggcactatgaggatttccctaagctgtggatgatgaagggtcagattgaggagcagaaggaaatgatggaaaaggctcgagaggcctacaatcagggactcaaaaagtgcccccactctacaccattatggctgttgttgtccaggctcgaagagaaaattggccagctgacgcgagcacgggcaattttggagaagtcacgattgaaaaaccccaaaaacccgggcctctggttagagtctgtgagactcgagtatagggccggtctgaaaaatatcgccaacacattgatggccaaggccctgcaggaatgtcccaattctgggatcctctggagtgaggccatctttctcgaggctcgacctcagagaagaaccaaaagcgtcgacgcactcaagaagtgcgagcacgacccacacgttcttctggccgtggctaagctgttctggagccagagaaaaatcacaaaagcaagagagtggtttcatcgcactgtcaaaatcgactcggacctgggcgatgcgtgggccttcttctataagttcgaattacagcacggcaccgaggaacagcaggaggaagttaggaaaaggtgtgagagtgctgagccccggcacggggagctctggtgtgctgtgtcaaaagacatcgccaactggcagaagaagattggagatatcctgagactggtagctgggagaatcaaaaacaccttctag

SEQ ID NO: 202009 - DNA, 7008 bp, Artificial Sequence
  Description of Artificial Sequence: Synthetic coding sequence
atggccggcgtgttcccctaccggggccccggcaaccccgtgcccggtccccttgctccattaccagattacatgtccgaagaaaagctgcaagagaaagccaggaagtggcagcaactccaagctaagaggtacgccgagaaaagaaaatttggcttcgtggatgcacagaaggaagacatgcctccggagcacgtgagaaagattatccgggaccacggcgatatgactaatcggaagttcaggcatgataagcgggtgtatttgggtgccctcaaatatatgcctcatgcggtgctcaaactgctcgagaatatgcctatgccctgggaacaaatcagagatgtccccgttctttaccacattaccggggccatcagttttgtgaatgaaatcccatgggtcatcgaacccgtatacatctcgcagtggggctcaatgtggatcatgatgaggcgtgagaagcgcgataggagacattttaaacggatgcgttttccccctttcgatgacgaagaacctccgctggattatgctgacaacatcttagacgtcgagccccttgaggcaatacagctggaattggatcctgaggaggacgctcctgtgctggactggttttacgatcatcagcccttgagggactctcggaaatacgtgaacggatccacttaccagcgctggcagttcacgttaccgatgatgagcacgctttataggctggccaatcagttgttaaccgacctagtggacgacaattacttctatctgttcgacctcaaagccttttttacctcgaaggcccttaatatggctattccaggcggaccgaagttcgaacccctggttcgggacatcaacttgcaggatgaagattggaacgaatttaatgatataaacaagattattataaggcaacccattagaaccgaatataagatcgcgttcccatacttgtataataacttacctcaccacgtgcatctaacttggtatcatactcctaacgtagtgttcatcaagaccgaggatccagacttgcccgccttttacttcgaccctctgataaatcctattagccaccgccatagtgtgaagagtcaggagcccctaccagacgacgacgaggagtttgaactgcctgagtttgttgagccgtttctcaaggacactccgctgtacaccgacaacactgcgaacggcatagcactcttatgggctccccgacctttcaacttgagatcaggaagaacccgccgcgctctggatatccctctggtcaaaaattggtatcgggagcactgccctgcaggtcagcccgtgaaggttcgggtgtcgtaccaaaaactgctcaagtattatgtccttaacgcattgaagcaccgacctcctaaagctcaaaaaaagcggtacctgtttagatcattcaaagcaacgaaattctttcagagcacgaaactggattgggtcgaggtcggactgcaggtgtgtagacaagggtacaacatgctaaacctgctgatccaccggaaaaacttgaactatcttcacctggactacaatttcaacctgaaacccgtgaagaccctgactacaaaagagcggaaaaagagtcgatttggaaatgcctttcatctatgtcgcgaagtgctcagacttacgaagctcgtggtggacagccacgttcagtatcgacttggaaacgtggatgcctttcagctggcggacggattgcagtatatcttcgcccatgtaggacaactgaccggcatgtaccgttataaatacaaactgatgcgtcagatcagaatgtgtaaagacttgaagcatctcatctactaccggttcaacaccggccctgtgggaaaaggacccgggtgtggtttctgggccgcggggtggcgagtctggttattctttatgcggggcatcactcctttgctggaacgttggttgggaaacctgctggcaaggcagttcgagggcaggcactccaaaggcgtcgccaagacagttactaagcagcgggtcgaatcacattttgatcttgagctcagagccgccgttatgcatgatatcttggacatgatgcctgaagggataaagcagaataaggcacgcaccatcctccaacacctgtccgaagcctggagatgctggaaggccaacattccttggaaggtacctgggctcccgacacctatagaaaacatgatccttaggtatgtgaaagctaaggctgactggtggacaaacacggcacattacaatcgggagagaatccgccggggtgccaccgtggacaaaactgtgtgtaaaaagaatctcggcagactcactaggctgtacttaaaggcggagcaggagaggcagcacaattacctcaaggatgggccgtatatcacggctgaggaagccgttgccgtgtacacgaccactgtccattggctagagtccagacgtttctctcccattccatttcctccgctcagttataagcacgatactaaactgctgatcttggccttagaaaggctaaaggaggcttactccgtaaaatccagactaaatcaatcccagcgtgaagaactgggtctgattgaacaggcctacgacaaccctcacgaggccctcagcaggataaagagacatctgttgacccagagggcattcaaggaggtggggattgaatttatggatctatattcacacctagtgcccgtgtatgatgtggagcctttagagaaaatcaccgatgcttacctagatcaatacttgtggtacgaagcagacaagcgcagattgttcccaccatggattaagcctgctgatacagagcctcctcccctcctggtatacaagtggtgtcaagggataaataatctgcaggacgtgtgggagacgtctgagggcgagtgcaatgtgatgcttgagtcccggtttgagaaaatgtacgaaaagattgacctaacgctgctgaatcggctgctgcgcttaatcgtcgatcacaatattgcagactacatgaccgcaaaaaacaacgtggtgattaactacaaggacatgaaccatactaactcttacgggattattcggggtttgcaatttgctagtttcattgtgcaatattatggcctcgttatggatctgctggtgctgggactgcatcgtgcctcagagatggccggtccccctcagatgcccaacgacttcctatcattccaggacatcgcgacggaagccgcgcacccaattaggctcttttgccggtacattgatcgcattcacatattctttcgctttacagcagatgaagcgagggatctgatccagcgatatctgacagagcacccagacccaaataatgaaaacatcgtcggatataacaacaaaaaatgctggccccgggacgcccggatgagactgatgaaacatgacgtgaatcttggccgggctgtgttttgggacatcaaaaatcggctgccacgttcggttactactgttcagtgggaaaacagcttcgtctctgtctacagcaaagacaacccaaacctgctttttaatatgtgcggatttgaatgccgcattttaccaaagtgtcggaccagctatgaggagtttacccacaaggatggcgtgtggaatttgcagaatgaagtgactaaggaacgcaccgctcagtgtttcctgcgggtggacgacgagtccatgcagcgtttccacaatagggtgcgtcagattctgatggcgtcagggtccaccaccttcaccaaaattgtgaacaaatggaataccgcactaatcggtttgatgacgtattttcgggaagcagtcgttaacactcaagagctcctggatctcttagtgaagtgcgaaaataagatacagactaggataaagatcggtctcaattcgaaaatgccatcacgttttccccctgttgtcttttacacgcccaaggagctagggggcttggggatgttgtcaatgggtcacgtgctgatcccacagtcagatcttagatggtctaagcagaccgatgtcggaattacccatttcagatcagggatgagccacgaagaggatcagcttattcctaatctttacaggtatattcagccgtgggagtccgagtttattgactctcagcgcgtgtgggcagagtacgctcttaagaggcaggaagccattgcccaaaacagaaggctgaccctggaggacctggaggactcttgggaccgaggaattccgagaataaacacgcttttccagaaagacaggcacaccctggcctatgacaaagggtggagggtgcggactgactttaagcagtatcaagtactgaaacaaaatcctttttggtggactcaccagaggcacgacggcaagctatggaacctcaacaactataggaccgacatgatccaggcattggggggcgtagaaggtatcctcgaacacacgctgtttaaaggaacctattttcctacctgggagggactgttctgggaaaaggcttctggtttcgaggagtctatgaagtggaagaaactgactaatgcccaaaggagtggattgaatcaaattcccaataggcgcttcactctctggtggtcaccaaccattaacagagccaacgtgtacgtcggttttcaggtgcagctggatctgactggcatctttatgcacggtaagattcctaccttgaaaattagtctcatccagatctttcgtgcccacctttggcagaagatccatgaaagcattgtgatggacttgtgccaggtgtttgaccaggaactcgatgcccttgaaatagagacagtccaaaaggagacaattcacccccgcaagagttacaagatgaattctagctgcgccgacatccttctctttgcatcctacaagtggaacgtctctagacccagcctgctggcggactccaaggacgtcatggattcgacaactacacagaagtattggatagatatccaactgaggtggggtgattatgattcacacgatatagagcgttacgcacgtgctaagtttcttgactatactaccgataatatgtcaatttacccttcgccaactggcgtcctcatcgctatcgatctggcctacaatttacacagtgcttacggcaactggtttcctggttccaagcctcttatccagcaggctatggcgaaaattatgaaggctaatcccgccttgtacgttttgagagagcgaattcggaaaggactccagctgtatagcagcgagcctacggagccttacttgagctcacaaaactacggcgaactcttcagcaaccaaattatctggttcgtcgatgacaccaatgtgtacagggtgacaatacataaaacctttgaaggcaaccttaccacaaaacctatcaacggagctatctttattttcaatcccagaacagggcagttgttcctcaagattatacatacctcagtatgggccggtcagaaacgtctcggacaattggcaaagtggaaaacagcagaagaggtggccgccctaatcagatcactgccagtagaggaacaaccaaagcaaattatcgtaacacggaaaggaatgctcgatcctcttgaggtgcatctcctcgacttcccaaacattgttattaagggatcagaattgcagctgcctttccaggcctgcctcaaagtcgaaaagtttggcgatctgatcttaaaggctaccgaaccccagatggtgctctttaacctctacgatgactggctcaagactatttcaagctataccgccttttccaggctgattctgatcttacgtgctttgcacgttaataatgacagggcaaaggtcatcctgaagcccgataaaactaccattacggagcctcatcacatttggcctacgctgacggatgaggaatggattaaggtggaggtgcagcttaaggatctcattctggccgactatgggaaaaagaacaacgtgaacgttgcatctctcacccagtcagagattagagacatcatcctggggatggagatatctgccccgtcacaacaacgccaacagattgcagagattgagaagcaaactaaggaacagagccagctgaccgcaacacagacacgaacggttaacaaacatggtgatgaaatcattacctccactacctcaaattatgaaacccaaaccttcagctctaagacagaatggcgggtccgagccatctcggctgctaacttacacctgcgaacgaatcacatctacgtttccagtgatgatatcaaggagaccggctacacctatatcctgccaaagaatgtcctaaagaagttcatctgtatctcagacctgcgcgcacagatcgcagggtacctgtatggcgtatcccccccagataatcctcaggttaaggagattaggtgcattgtgatggtgccacagtggggcacacaccagacagtgcacctgcctggacagttgccccagcacgaatatctgaaagaaatggagcctcttggctggatacatacgcaaccaaatgagtccccacagctatctccgcaggatgtcaccacccacgccaagataatggccgacaatccgagttgggatggagagaaaactatcatcattacttgcagttttaccccaggaagttgcaccttgactgcatacaagctaactcccagcgggtatgaatggggacggcagaacaccgacaagggtaataatcctaagggatacctgccctcccactatgagcgagtgcagatgcttctgtccgaccgatttctgggtttcttcatggtgcccgcgcaatcctcgtggaattacaattttatgggtgtgagacacgaccccaacatgaaatatgagctccagctcgcaaaccctaaagaattttatcacgaggtccaccggccatcgcactttttgaacttcgctctgctgcaggagggcgaagtctactccgctgatcgcgaagacttatatgcttag

SEQ ID NO: 202010 - DNA, 1392 bp, Artificial Sequence
  Description of Artificial Sequence: Synthetic coding sequence
atgatccaggccctgggcggcgtggagggcatcctggagcacaccttgttcaagggcacgtattttcccacctgggaggggctgttttgggagaaagcgtcaggcttcgaggagagcatgaaatggaaaaagttgaccaacgcccagcgcagcgggcttaaccagatccctaatcggcgattcactctatggtggtccccgaccatcaacagggctaatgtctatgtaggattccaagtgcaactggacctgaccggcattttcatgcacggcaagattccaactcttaaaattagtcttattcagattttccgggcccacttatggcagaagatccacgaaagtatcgtcatggacctgtgtcaggtcttcgatcaggaattagatgcactcgaaatagagactgtacaaaaagagacaattcacccccggaagtcttataagatgaatagctcctgtgcagacatcctcctttttgcgtcttacaagtggaatgtgagtcggccgagcctcctggccgactcaaaggacgtaatggattctactaccacccagaaatactggatcgacattcagctgaggtggggagattacgactcccacgacatcgagagatatgctcgggcaaagttcttagactacactactgacaacatgtccatctatccctccccaactggggtgctaatcgctatcgacctcgcctacaatctgcacagctactccgaggtcggtagtctgcaacaagcctcccatacaactggcgctaagataatgaaggccaaccctgccctatatgtgctgagagaacggattaggaaaggcctccagctgtactcctccgagcccaccgagccgtacctgagttcacagaattatggggaactcttcagtaaccaaattatctggtttgtggacgacaccaacgtgtaccgggtaaccattcacaagacgtttgaaggaaatctgactacaaagcccattaacggggctattttcattttcaacccacggacggggcaattgttcctgaaaataatccatacatcagtctgggccggacagaaaagactggggcagctggctaaatggaagaccgccgaagaggtagctgcactgatcaggtcactgccggtggaggagcagcccaaacaaatcatcgttacaagaaagggaatgttggacccccttgaggtgcacttgctggactttcccaacatagtcataaaggggtctgaactccaactccctttccaggcgtgcctgaaagtagaaaaatttggggacctgatcttaaaagctaccgagccgcaaatggtcctcttcaatctgtatgatgattggttaaagaccatatcctcatacaccgccttctcgagacttattttgtag

SEQ ID NO: 202011 - DNA, 2727 bp, Artificial Sequence
  Description of Artificial Sequence: Synthetic coding sequence
atggccgacggcggcggccccaaggacgcccccagcctgcggagctccccaggcccagccccccgggtaccccgtgctgtgggcccatccggcgggggtggcgaaacgcctcggacagctgccttggcgctccggtttgacaaacctatcaagcaggccttttataataccggtgctgtattatttgtgtgtctttgttgcggcgcagccgtgctcgtttacttcattctcgaggccttcctgaggcctcttctttgggccgttttgtgcggaacgtttctgcaccccttcaaatcatccttaacccggctcggcaggcattggctccagaggctgcacagagctcatactcccatcgtgctggctgctctgctcctgccactgtgttttgtggattacggggttgaggcactcggtgaacaagcactgcgccgtcgaaggttgcttctcctcttaggtgccggaggaccactcctatacggcctgtattgcctcggaagctatctgggtgtgcaggtcttgctcgtccatgcagctaccctcatttgccgcggccttgattattttagttccttgtggatatggaccctggtggtgggctacgtgctcacagtctcctttaagtggaacgccagtactgaaaggtatctcagggcagtgtcgatccctgtttggattatacttctctttcatttagccagcttagccgggagctggcggattccagtcttcctcgttatagtgttcctgatgtccgtgggaaccttgtacgaaaagcagaacggaaaagagtcgtccggtgccgagttacctgggcaagtgatttccatggctgcgtccactctggccaatcttgctatttccataactggatatgagagctcgtctgaagaccaaccaagtacccagcctgcagaggccgtggatcgcggcgagagcgcccctacactcagtacgagcccgtctccttcttcaccatcccccacgtccccctcaccgaccttagggcgtcggcgccccgagatcgggaccttcctgcggaagaaaaaaacttccgacatctattttgttagtcttgtgtgggccatagtggtgatgcagatatggctcaatctgtggatcgtgcaacttctgcctgtccctatcgctgtgtggattcttaaaaagcttgtcatccattttggagtcgtcgacttcctggagaaacggtatcatgtgtggtgggggattatcgagtcatttctaaaagagcgacagggcgctctggcaccatggccgatcgtcggtcttggaaagtttctgctgaaggttgatagtaagctttggcactggttgaataagaagatgattatctggctggagaaaatgctagacaaaattatctcaatcttcattatattcctgttggtgatcggcacattgctgctggccctgctgctaacggccaaggttcatcaagaaagcgtgcatatgatcgaagtgacctctaatctcattaatgagacccttgctaatcatcccgagtgggctaactggctcccagaagcccaagtggtccagagggcactcaattctgcagcaaacaacgtctatcagtacggccgcgagtggataacgcacaagctccataaaattttgggtgacaaagtcaataataccgccgtgattgagaagcaggtccttgaactctgggacagactctatcacagttggtttgtcaagaacgtgacccactctggacgtcataagggccagaaattgcatgtgtctaggcagaattcttggttgggggatatactcgactggcaggatatcgtgagtttcgtgcacgagaacatcgagacattcctctcaatcctggaaagcctgtggatcgtcatgtccaggaacgtttcactgctatttaccactgtcactacactgcttacgatcctcttttattccggtactgccctgctaaatttcgttctgtcgttgatcatcttcctgacgacactgttctacctgttgagtagcagcgacgaatattataaacctgtaaagtgggtcattagcctcactccactgtcgcagccgggaccaagcagcaatatcattggacagagtgttgaggaagcgatacgtggagtttttgacgcgagtctcaaaatggcaggcttttacggcctgtacacttggttaacacatacaatgttcggtatcaacattgtgttcattcctagcgctctcgcagctattttgggagccgttcctttcctgggaacttactgggctgccgttcctgccgtactggatctttggcttacgcagggcctcgggtgtaaagcaatcctgctattgattttccatctactacccacctactttgtggataccgccatttactccgatatatccgggggtggtcacccttaccttaccggcctggctgtggctgggggtgcctactacctgggcttggagggagcgatcatcggtcccatacttctctgtatcctagttgtcgccagcaatatctacagcgctatgctggtatctccaactaattcagtacccactcccaatcagacaccctggcccgcccagccacagcggaccttcagagacatcagccgcagtgaaatcttctctgtggatgtagtcagcagtgccgtgatttttaggaagtttaaattcgattcagagttctcctccgccgtggccctctgtccatcctcctgtgcttag

SEQ ID NO: 202012 - DNA, 1062 bp, Artificial Sequence
  Description of Artificial Sequence: Synthetic coding sequence
atgctgaagagctgcagccgggccagcttcagccccagcgtgcggaagccgcctctgatactgcggagacttctgtctgaggacgtcgggatggatattcctttcgaggagggagtgcttagcccatccgcagccgacatgcgaccggaacccccgaactctctcgacctgaatgacacgcaccccaggaggattaaattgactgctcctaatataaacctctctctagatcagtctgagggaagcattcttagtgacgacaatctcgattctcctgacgagatagatattaacgtcgatgagctggatacccccgatgaagcagatagtttcgaatacacaggccacgaagacccgaccgcgaataaggatagcggccaggaatccgaatccatcccagaatataccgccgaagaggagcgcgaagacaatcgcctctggcgcaccgtcgtcatcggggagcaggaacagcgaatagacatgaaggtgatcgaaccttacaggcgggttattagccacgggggctactatggagatggcctgaatgccattatagtgtttgctgcttgctttcttccagactcctcacgagcggactatcattatgttatggagaatctgtttctgtatgtgatttcaacactggaacttatggttgccgaggactacatgatcgtgtatctgaacggggccactccacgccgcagaatgccaggcctcggatggatgaaaaagtgctaccagatgatagatcgccgcctcagaaagaacctgaaatcattcattatcgtacatccaagttggttcatcaggactatactagccgtaacacggccattcatctcctccaaattctccagtaagatcaaatatgtgaacagtctgtcagagctttcagggctcatacccatggactgtatccatatacccgagtccattatcaagctagatgaggaactgcgggaagccagtgaggctgcaaaaacatcttgcctgtataatgacccagagatgtcctcaatggagaaggacatagacctgaaattgaaggagaaaccctag

SEQ ID NO: 202013 - DNA, 9267 bp, Artificial Sequence
  Description of Artificial Sequence: Synthetic coding sequence
atggaggagttcctgcagcgggccaagagcaagctgaaccggagcaaacggctcgaaaaagtacacgtggtcataggccctaaatcttgtgatctggacagcctgatcagtacctttacctacgcatactttctggataaggtgtcaccacccggggtgttatgcctcccggtgttaaatataccaagaacggagttcaactatttcacagaaactcgattcatcctggaggaactgaacattagtgagtcatttcatattttcagggacgagatcaacttgcatcagttgaacgatgaaggaaaactgtctatcacactcgtgggcagctcagttctggcttcagaggacaagactttggagagcgctgtcgttaaagtcattaaccccgtcgaacagagcgatgccaatgtagagttccgcgaaagctcgagttccttagtgttaaaagaaattctgcaggaggcaccggagctaataactgagcaactggctcatcggctgaggggcagcattctatttaagtggatgacgatggaaagcgaaaagattagcgagaaacaggaagagatcttgagcatactcgaagagaaatttccgaacttacctccgcgcgaggacatcataaacgtgctgcaggagactcagttcagtgctcagggcctgagcatagaacaaaccatgcttaaagaccttaaagaactaagcgacggggaaatcaaggttgctatcagcaccgtgtccatgaatctagagaattgtctctttcactccaatattacgtccgatctgaaggcattcacagacaaatttggctttgatgtcctgatcctgttttctagttacctctctgaagagcagcaacctcgcaggcaaatcgccgtgtactctgagaatatggaactatgtagccaaatctgttgcgagcttgaagagtgtcagaacccctgtctggaattggagccattcgattgcggttgcgacgagatcctggtataccagcaggaagacccgtccgttacatgcgaccaggtggttttggtggtgaaggaggtaatcaacagacgatgccccgagatggtttccaattctcgcacatctagcacagaagccgtagctggctcggctcctctatcccaggggagttccggaatcatggaactctacggctcagacatcgaacctcagccctcgtctgtcaatttcatagagaacccacctgatctcaacgacagtaatcaggcccaggttgacgcgaatgtggaccttgtatccccagactcaggacttgccaccatcaggagcagcaggagctccaaagaatcatcagtgtttctgtccgacgatagtcccgtgggcgaaggcgcagggccccaccataccttactacctggcctcgactcttacagccctatccccgaaggggccgtagctgaagaacatgcgtggagcggcgaacacggcgaacacttcgacctgtttaattttgaccctgcacccatggcaagtggccagagccagcagagttcccattccgcagattatagccctgctgatgacttctttccaaattccgaccttagcgaaggtcagctgcctgcaggacccgaaggtctggacgggatgggaaccaatatgtctaactatagctcatcctctctactcagcggtgccgggaaggacagcctggtggagcatgatgaagaattcgtccagcgacaggacagtccccgggataacagtgaacggaacttgagcctcacagactttgtgggcgatgagtcaccatcgcctgaacgactcaagaacaccgggaagaggatcccgccaactcccatgaactctctagtggaatcttccccatccaccgaggaaccagcgagcctgtacactgaggacatgacccagaaagctactgacacagggcatatgggccctcctcagacccacgcacgatgctcttcatggtgggggggtctcgaaatcgattcaaagaacatcgcagatgcctggtcatcgtccgaacaggagtcagtgtttcagtcccccgaaagctggaaagagcataagccctcttcaatcgatcgacgcgcttctgatagtgtcttccagccaaagtctctcgagttcaccaagtccgggccttgggaaagcgagttcggacagccagagctcggctctaatgacatccaggacaaaaatgaggaatccctgcctttccagaacctaccgatggagaaaagccctctgcccaacacttcccctcaaggcactaaccatctgatcgaggatttcgcatccctatggcactctgggaggtctccgacagcaatgccagaaccctggggcaaccctaccgatgatggagaaccagccgctgtggctccattcccagcctggagtgcctttgggaaggaggaccatgatgaggctctgaagaacacctggaacttgcatcctactagttctaaaaccccttcagtacgggacccaaatgaatgggccatggcgaagtctggattcgcctttagtagctctgagctccttgataactccccgtcagagattaataacgaggccgccccagaaatatggggtaaaaaaaataacgactctcgagaccatatttttgcccccggtaatcctagttccgacctcgaccatacttggacgaactcaaaaccgccaaaggaggatcaaaacggtctagttgatcccaaaacccgcgggaaggtttatgaaaaagtggatagttggaatttgtttgaggaaaacatgaaaaaagggggctcagatgtcctggtcccatgggaggattccttcctgtcgtataaatgctccgattacagcgcttccaatcttggagaagacagtgtgccctctcccctggataccaactacagtacatccgatagctacacttctcccacgttcgccggcgacgagaaagagactgagcacaaaccctttgctaaggaagagggctttgagtccaaggacggaaactccaccgcggaggagacagatatcccccctcagagtttacagcagtcatcacgtaatagaatcagcagcgggcccggaaacctggacatgtgggcttccccccatacagacaattctagtgagatcaacactacacacaatcttgatgagaatgagttgaaaactgagcatacggatggcaagaacatctctatggaagatgacgtcggagaatcatcacagtcctcctatgacgacccaagcatgatgcagctgtacaatgaaacaaacagacagctgactctactgcattcttcaaccaattcacgacagactgctcctgactccctcgatctatggaacagggttattcttgaggacacacagtccaccgctacaatttccgacatggacaacgaccttgattgggatgattgtagtggtggcgccgctattcccagcgacggtcagactgagggttacatggccgaggggtccgagccggaaaccagattcacggttcggcaactggaaccctgggggctcgagtatcaagaagcaaaccaggttgactgggagctgccagccagcgatgaacacacaaaagattccgccccatctgagcaccacactctgaatgagaagagcggtcagttaattgccaactcgatatgggattcagtgatgagagataaggatatgtcgagttttatgctgcccggctccagccacattacagatagtgagcagcgcgaactcccaccggagatcccatcccacagcgccaacgtgaaggatactcactcccccgatgcaccagccgcaagcggcacctccgagtcagaagccttgatctcacatctggacaagcaggacacggaacgcgagactctgcaatcggacgctgcctccctagctacacgcctggagaatccaggctatttcccacatcctgacccttggaaaggacatggagacggccagtccgaaagcgaaaaagaggcgcagggggccaccgacagggggcatctggacgaggaagaggtaattgcttcgggggtcgagaacgcatcagggatctccgagaagggccagtccgatcaggaactcagttctctagtagcatccgagcaccaagagatctgtattaagtcaggtaagatatcttcgcttgctgtgacattcagccctcaaactgaggagcctgaagaagtcctagaatacgaggagggcagctataacctggactccagggatgttcagactggaatgagcgcagataatttacagcctaaagacacacatgagaagcaccttatgtctcagaggaacagcggtgagacaactgaaacatccgacgggatgaattttacaaagtatgtctcagtccctgagaaggacctggaaaagactgaggaatgcaactttctggagccggagaacgtaggcggcggcccaccccatcgtgtgccacggagcctggattttggggacgtgccaattgatagtgatgtgcatgtgtcatcaacctgttcagaaatcaccaaaaatctcgatgtgaaggggagcgagaacagcctacccggtgctggcagcagcggtaatttcgaccgggacacaataagctcagagtatacgcattcctcggccagttcgcctgaactgaacgacagcagcgtggcgctgagcagttggggccaacagccatcttcggggtaccaggaagagaaccagggcaactggtccgaacagaaccatcaagagtcagagctgatcacgacagatggccaggtggaaattgttaccaaggtgaaggatttagaaaaaaaccggatcaacgaattcgagaagagctttgatcgcaagacaccaaccttcctggagatttggaatgactctgtggatggagacagtttttcctcgctctctagtcctgagaccggaaaatacagcgagcactcaggcacacaccaggagagcaatctgattgcctcctaccaggagaagaacgagcacgatatctctgctacagtgcagcccgaggacgcacgtgttatttctaccagtagtggatctgacgatgattccgtaggcggagaggagagcatcgaggaggagattcaggtcgctaattgtcacgtcgccgaagacgagtcacgggcctgggattcactgaatgagagtaataagttcttggtaactgctgaccctaagagcgagaatatttacgattacttagactcctctgagcctgccgagaatgagaacaaatcaaaccccttttgcgataaccagcagtcttccccagacccatggacattctctcccctaactgagactgagatgcagatcacagctgtggaaaaagaaaagcgctcaagcccagaaacaggcaccacgggagatgtagcgtggcagatctcgccgaaggccagtttcccaaaaaatgaggataacagccaactggagatgctggggttcagtgcggatagtacagaatggtggaaggccagtccccaggaaggtagactgatcgaaagtccattcgagagggagctgtctgacagtagtggcgtgctggaaatcaactcttcggtgcaccagaatgctagtccttggggcgtgccagtccagggagatatcgagcctgtagaaacccactacactaatccgttttccgataatcaccagagcccgtttctggaagggaacggcaagaacagtcacgaacaactgtggaatatccagcctcgacagcctgatccagacgccgacaagttcagtcagctggtgaagcttgaccagatcaaggagaaagactccagagaacagacgttcgtgtcagctgccggggacgaactgacacccgagactcctactcaggaacagtgccaggatactatgctccctgtctgcgatcatcccgataccgcttttacgcatgcggaagagaactcctgcgtgacaagtaacgttagtaccaacgaagggcaggagactaaccaatgggagcaggagaaaagctacttgggcgaaatgactaactcaagcatcgcaaccgaaaattttcccgctgtaagcagtccgacccaactgatcatgaagcctggcagcgagtgggatggaagcacaccgtccgaagacagccgcggtacattcgtgcccgatatcctgcatggtaacttccaggagggcggacaactggccagcgctgctcctgatctgtggatagatgccaaaaagccttttagtctgaaggccgacggggaaaatccagacattctaacccattgtgaacacgattcaaactcccaggccagcgattcccccgacatatgtcacgattccgaagccaagcaggaaacagagaaacatctcagcgcctgcatggggcccgaggtggaaagctctgagctttgtctcacggagcctgaaattgatgaggaacccatctacgagcccggccgcgagttcgttcccagcaacgccgaactagattccgagaatgcaaccgtgctgccgcctattggataccaggcagatatcaaagggtcaagtcagccagcttctcataagggaagccccgaaccttctgagatcaatggtgacaactccactggtctacaagtgagtgagaaaggtgcctccccagacatggctcctatactggaacctgtggacagacggattcctaggattgaaaatgtggccacgtctatatttgtgacgcaccaggagcccacccccgagggcgatggcagttggatatccgattcctttagtccagaaagccagcccggggccagagccttgttcgacggagacccgcacttatcgaccgaaaatcctgcactggtgccagacgccctcttggcatctgacacctgtcttgatattagtgaggccgccttcgatcatagcttctccgatgcgagcgggcttaataccagcacaggaacaatcgacgatatgagtaagctgactttgtcagaaggccacccagaaacaccagtggacggagacctgggtaaacaggatatatgctcttcagaggcttcttggggtgactttgaatacgacgttatggggcagaacatcgacgaggatctgctccgtgagcccgaacactttctttacggcggcgacccacccttggaagaggattctctcaagcagagcctggcgccatacactcccccgttcgatctgtcatatttaactgaaccagctcagtccgccgagactatcgaggaagccggaagccctgaagacgaaagtttaggctgtcgtgctgccgagattgtccttagcgcactcccagaccgcaggagtgagggtaaccaagccgaaacgaaaaatcgcctgcctgggagtcagcttgccgtcctccacatcagggaggatcctgagagtgtgtacttacctgttggcgcaggctctaatatcctctccccttcgaatgttgactgggaggtggagacagacaactctgacctgcccgccgggggcgacatcggaccgcctaacggcgcttcaaaggaaatttctgagctggaggaggagaagactatacccactaaggagcccgaacagatcaaatccgaatataaagaggagcgttgtaccgaaaaaaatgaggatagacacgctctccacatggattatatcctggttaaccgcgaagaaaatagtcacagcaaaccggagacgtgcgaggagcgcgagtccatcgcagagttggaactgtatgtggggtccaaggaaaccggcctgcagggtacccaactggcttcgtttccggacacatgtcaaccagcatcactgaatgaacgtaagggtctgtccgctgaaaagatgtcaagcaaaagcgatactcggtcatctttcgagagccctgcccaggatcagtcttggatgtttctggggcactcggaggtaggtgacccaagtctggacgctcgggacagcggtccaggttggtccggaaagaccgtggagcctttctccgaactggggctcggagagggaccacaactccagatacttgaggaaatgaaaccgttagagagcctcgccctggaggaggcatctggaccggtttcccagtcccagaagagcaaaagccgagggcgggcagggcccgatgccgtcactctccaggccgtcacacacgataacgagtgggagatgttatccccacagccagtccagaaaaacatgatcccagatacagagatggaagaagagaccgaattccttgagctgggaacccggatatcaagacccaacggcttactcagtgaggacgtggggatggacattcccttcgaggaaggggttttatccccctcagcagcagatatgcgaccggaaccccctaattctctggacctgaacgacacacacccgagaagaataaagttaaccgcccccaacatcaacctgagtctggaccagagtgaaggctccatcctcagtgacgacaatttggattcacccgatgagatagatattaacgtagacgaactggacacccctgatgaggccgatagcttcgagtacactggtcacgatcccactgccaacaaagatagcgggcaagagagcgagagtatcccagagtacactgctgaagaggagcgagaggacaatcggttatggaggacagtcgttatcggcgagcaggagcaacgaattgacatgaaggtcattgagccctataggcgggtaatcagccatggtggatactatggggacggccttaacgccatcatcgtctttgcggcctgttttttacctgactcttccagagccgactaccactacgtgatggagaacctcttcctttacgtgatttcaactttggagctgatggttgccgaggattacatgatcgtgtacctaaacggcgccacccctcgaaggagaatgcccggactggggtggatgaagaaatgttatcagatgattgataggagattgaggaagaatcttaagtcatttattattgtacaccctagctggtttatcagaaccatacttgccgtcactaggcctttcattagctctaagtttagctctaagattaagtacgtgaacagcctctctgagttgagtgggcttattcccatggactgtatccatattccagaatccattatcaagctggacgaggagctacgggaggcgagcgaagcggcaaagacatcttgcctatataacgaccccgaaatgagttccatggaaaaagacattgatctcaaactgaaggaaaagccatag

SEQ ID NO: 202014 - DNA, 9165 bp, Artificial Sequence
  Description of Artificial Sequence: Synthetic coding sequence
cggaacctgatgcaccggatgaaggagagcgagaaccggagcaagcgattggaaaaggtccacgtggtgatcggtcccaagtcttgcgatctggactccctgatcagcaccttcacatacgcgtattttttggacaaagtgtcgccgcctggggtactgtgtctaccagtactgaacattcccaggacagagtttaactattttaccgagactaggttcatactcgaagagcttaacatttccgaaagtttccacatcttcagggatgagataaacctccatcagcttaacgatgagggtaaattatccattaccctcgtagggtcgtctgtattggccagcgaagacaaaactctagagagcgctgtggtgaaggtcatcaaccctgtcgagcaatccgacgcgaacgtcgaattcagggaatcctcgagcagtcttgtgctcaaagaaatcttacaggaagctccagagttaataacagagcagctggctcaccggctgcggggctccatcttgtttaagtggatgaccatggagagcgagaaaattagcgaaaagcaagaggagatcctgtcaatcctagaggagaaatttccaaatctgccccctagggaggacattatcaatgtacttcaagagacccagttctccgctcagggcctgagtatcgagcagacaatgttgaaggatttgaaggagcttagcgacggtgagattaaggtggcaatttcaaccgtgagcatgaacttagagaactgtctctttcatagcaacattacatccgatttaaaggcttttacagacaaatttggtttcgatgttctcatcctgttcagctcctacctgagtgaagagcaacagccaaggaggcagatcgcagtttattcagagaacatggagttgtgttcacaaatctgctgcgagcttgaggaatgccagaatccttgtctcgaactggaaccgttcgattgcggatgtgatgagattttagtttaccagcaggaggaccctagtgtgacatgcgaccaagttgttctcgtggtgaaggaagtgatcaatcgccgctgccccgagatggtctctaactcccgcactagctctacggaagcagttgccggatcagcgcccctgtctcagggttcgtccggcattatggagttatatgggagtgatatcgagccgcagccttcgtccgtgaacttcatcgagaaccctcccgatctcaatgactcaaatcaggctcaggtagacgctaacgtggaccttgtcagccctgacagcggcctggccacaattcgtagttccaggagtagtaaagaaagcagtgtcttccttagtgacgactccccggtgggggaaggagccggacctcaccacacgttacttcccggcctggacagctacagcccaattcccgaaggcgccgttgccgaagaacacgcatggagtggagagcacggtgagcatttcgacctgttcaacttcgatccggctcccatggcatcaggtcagagccagcagtcctctcattctgccgactactctcctgcggacgactttttcccaaatagcgacctatctgagggacagctgcccgccggcccggagggactcgatggcatgggcaccaatatgtctaattattctagttctagcctcctaagtggcgctggaaaagattccctggttgagcatgacgaggagtttgtgcagagacaggattcaccaagagacaactccgaacgcaacctgtccctgaccgactttgttggtgatgagtcaccttcgccagagagattgaagaacactgggaagcgcattccccccactccaatgaacagcctggtcgagtccagcccatctacagaagagccagcttctctttataccgaagatatgacccagaaagccactgacaccggccacatgggcccccctcaaacccatgctaggtgctcctcatggtggggcggcctggaaatcgattccaaaaacatcgcagacgcttggagctcatccgagcaagagagtgtgttccagtcacccgaatcttggaaagaacataagccgtcgagtatcgaccgcagggcctctgattcggtattccagcctaagagtctggaatttacaaaatcaggcccttgggaaagtgaatttggccagccagaattgggatcaaatgacatccaagataaaaacgaagaaagtctgccattccaaaatttgcctatggagaagtcccctctccctaacacatccccccagggaaccaatcatctgatagaagacttcgctagcctctggcactcgggcagatcaccaaccgcgatgcctgagccatgggggaatccgactgacgatggagagcctgcggccgtggcgccctttcctgcgtggtctgctttcggcaaggaagaccacgatgaggcactcaaaaacacatggaatctccatcccaccagttcgaaaaccccatcagtaagagaccccaacgagtgggctatggctaagagcggttttgccttctcaagctctgaactgctagacaacagcccctccgaaatcaataatgaggcagccccagaaatctggggcaaaaagaacaatgactcacgagatcacatatttgctcctggaaatccatcctctgatttggatcatacctggactaacagcaaaccaccaaaggaggaccagaacggactcgtggatcccaagacccgagggaaagtgtatgagaaggtcgactcttggaatctttttgaagagaacatgaaaaaaggaggctccgatgttctggtgccctgggaggatagcttcctgagctataagtgtagtgactactctgcgtctaacctcggagaagacagtgtgcccagccccctcgatactaactatagcacaagcgactcttatacttcaccaacctttgcaggtgacgaaaaggagacggaacacaagccttttgctaaagaggaggggttcgagagcaaggacgggaattccactgctgaggagacagacattccaccccaatccctgcagcagagttctcggaaccgcattagctccggtccaggcaacttagacatgtgggcctccccccacacagacaacagttcagagattaataccacccacaacctggacgaaaatgaactgaaaacagaacataccgacggcaaaaacatcagcatggaggatgatgtaggcgagtcttcgcagtcaagctatgacgacccatccatgatgcagttgtacaatgaaacaaatcggcagctgacactgctgcactcctctaccaacagccgccagactgccccagactctttagatctgtggaatagggtgatcctggaggacacgcaaagcactgcaacaatcagcgacatggataatgacctcgactgggatgactgcagtggaggggccgcaatcccctcggatggacagactgaaggctacatggctgagggctccgaacccgaaacacggtttactgtgcgtcagctcgaaccgtggggtttagagtaccaggaagcaaaccaggtagattgggaactgccagcaagcgatgagcacaccaaagacagtgctccttcggaacatcacactctaaatgagaaatccggccagctgattgccaatagcatttgggattccgtaatgcgagataaggatatgtcgagctttatgctccctggctcaagtcatatcacggattctgagcagcgggagttacccccagagataccatcccacagcgctaacgtgaaggacacccactcaccagacgcaccggctgcctctggaacctctgagagcgaagcacttattagccatttagacaagcaggatactgagcgggagactctccagtccgatgccgcgtcgctggctactagattggagaatcctggttatttccctcaccccgacccatggaaaggccacggagacgggcagagcgaatcagaaaaagaagctcaaggagctacagacaggggacatttggatgaagaagaagtgatcgctagtggcgtggagaacgcctcgggcataagtgagaaggggcagtctgaccaggagctctcatccctcgtcgcatcagagcaccaggaaatttgcataaaaagcggtaagatttcttccttggcggttaccttctctccacaaactgaagagccggaggaggttctggagtatgaagagggttcctacaacctagactcacgtgatgtgcaaactgggatgtccgccgataacctgcagcccaaagatacacatgagaagcatctcatgtcccaaaggaacagcggcgaaaccaccgagacttctgacggcatgaattttacaaagtacgtttcggtccctgagaaggatctggagaaaactgaggagtgcaactttctggagcctgagaacgtgggtggagggcccccccaccgggtcccacgttctttggactttggggatgtgcctatcgatagtgacgtgcacgtgtcctctacctgttctgaaattacgaaaaatctagatgtcaagggcagcgagaacagccttcccggcgccgggtcctccggaaacttcgatcgtgatactatttccagtgagtacacccatagcagcgcttcttctcctgagcttaatgacagtagtgtagctttaagttcctggggccagcagccctcgagtggctaccaggaggagaaccagggaaattggagtgaacagaatcaccaggaaagcgagttgattacaactgacggtcaggttgagattgtcaccaaggtaaaagacctcgagaagaacaggatcaacgaattcgagaagagtttcgacagaaagacacctacatttctggaaatctggaatgactctgtggatggggactccttctcttcactctccagccctgagaccgggaaatacagtgagcactcgggaactcatcaggaatccaatttaattgccagttatcaggaaaagaacgagcatgatattagtgcaacggttcagccagaggacgctcgcgtgatctctaccagcagtgggagtgatgacgactctgtggggggggaagaatctatagaagaggagattcaggttgcgaactgtcacgttgcggaagatgagtctcgagcctgggattctcttaatgagagtaacaagttcctggttactgctgatcccaagtctgaaaatatttacgattatttagatagttcggagccagcagagaacgaaaataagagcaacccattttgtgataaccagcagtcctctcctgacccttggacttttagccctctgacagagacggagatgcagatcaccgcagtggagaaagagaaacggtcatccccggagactgggacaacaggagatgtagcgtggcagatttctcccaaggcatcctttccaaaaaacgaggataactctcaactggaaatgctaggctttagcgcagatagtactgagtggtggaaagcttccccacaggaggggaggctgattgagtctcctttcgaacgcgaactgtctgactcctcaggtgtactagagattaattcgtctgtgcatcagaacgcttctccttggggcgtacctgtgcaaggcgacatcgagccggtcgagacgcattatactaatcccttcagcgacaatcatcagagtccttttctcgaaggcaacgggaaaaattcccacgaacagctgtggaacattcaacctaggcagcccgatccggacgccgacaagttttctcaactcgtgaagttggatcagatcaaggagaaggacagccgggaacagactttcgtgtctgcggccggagatgagctcactcccgagacaccaacccaggagcaatgtcaagatactatgctgcctgtctgcgaccaccccgatactgcttttacccacgccgaggagaatagttgtgtgaccagcaatgtcagcacaaatgaggggcaggagacgaaccagtgggagcaagagaagtcatacctgggtgagatgacaaattcttctatcgctaccgagaacttccccgccgtgagctccccaacccagttaattatgaagccgggttccgaatgggatggctccaccccatccgaagattcccgaggcacatttgttcctgatattctgcacggtaactttcaagagggcggacagctggcctccgcagcccccgatctctggattgacgcaaagaagcccttttctttgaaagccgatggcgaaaatcctgacattctaacccactgtgagcacgatagcaacagtcaagcttccgacagtcctgatatctgtcacgattctgaagccaaacaagagacagagaaacatttatccgcctgtatgggaccagaagtagagtcctccgaactgtgtcttacggagcctgagatcgatgaggagcccatctatgaacccggccgagagttcgtcccgtccaatgccgaactggacagcgagaacgctaccgtcctgccccccatcgggtaccaggctgatattaaaggcagctcacagcccgccagtcacaagggcagcccagagccttccgagataaatggcgataactctactggactacaagtgagcgagaagggcgccagcccagatatggcccccatcctcgagcctgtagacaggcgtattcccaggatagaaaacgtcgccacctctatatttgtcacgcaccaggaaccaacccctgaaggcgatggatcatggatatccgactcgttctcaccggagtcccagccgggcgctagagccctctttgatggcgatccacacctatctacggagaaccctgctttggtgcccgatgcgctgctggcttccgacacatgtctggacatctcagaagccgcattcgaccacagcttttctgacgcttctggcctgaatactagtaccgggaccatcgacgacatgtcaaagctgaccctgtcagaagggcatccagagacacccgtagacggcgacctgggaaaacaggatatctgttcgagcgaggcatcctggggtgacttcgaatatgacgtgatgggccagaacatcgacgaggatctgctgagagagcctgagcatttcttatatgggggggatcctcctctggaggaagattcccttaaacaaagtctggcgccgtacacccctccattcgatctctcttacctgactgaaccggcccaaagtgccgagacaattgaagaagccggctcacccgaagacgaatccctgggatgccgggccgctgagatcgtattgtccgccctcccagacagacgcagcgagggtaatcaggccgagactaaaaaccgactgcccggatctcagctggcagtcctacacatccgagaggatcctgagtcagtctacttgcctgtcggcgctgggtccaacattttaagtccgtcaaacgtcgactgggaggtagaaactgataattccgatctgccagctgggggcgatataggcccaccgaacggagccagtaaggagatctcggagttagaggaggagaagaccatcccaacaaaggagccagagcagatcaaatccgaatacaaagaggaacgttgtacagaaaaaaacgaagatcgccatgcgctgcacatggactacatccttgtcaatcgcgaagagaatagccacagcaagcccgaaacttgcgaagagagagaaagtatagctgagctcgagctgtacgtgggctcaaaggagacaggtttacaggggacccagctggcttcttttcctgatacctgccagcccgcctcactgaacgaaaggaaaggcctgagcgccgagaaaatgtcaagtaaatcagacacccggtcgtcattcgagtctccggcacaggatcagtcttggatgtttctaggacactcagaggtaggtgaccccagtctggacgccagggactcaggccccggctggagcgggaagacggtagagcccttctctgaactcgggctgggtgaggggccccaactacagatcctggaggagatgaagccactggagagcttggctcttgaggaggcctctggcccagtatctcagtcccagaagagcaaatctcgtggccgggctggacccgacgccgtcaccctccaggcagtcacccatgacaacgagtgggagatgctgtccccacaacccgtgcagaaaaatatgattcccgataccgagatggaagaggagactgagtttctagagcttgggacccgaataagtcggccgaatggcctgctttccgaggatgtggggatggacattccttttgaagaaggcgtgctctcacccagcgcggctgatatgagacccgaaccacctaactcattggacctcaatgacacccaccccagaagaattaaacttacggcacctaacataaatttgtccctggatcaatccgaggggtctatcctctctgatgacaatttagactcgccagatgagatcgacattaacgtcgacgaactggatacacctgatgaggcggactcctttgagtatactgggcatgaagatccaacggccaataaggactctggccaggagtcagagtctattccggaatacacagctgaggaagaacgcgaggataaccgcctgtggcgcactgtcgttattggggaacaggaacagcgcattgacatgaaggtgattgagccataccgtagagtgatttcacatggaggaagccgagggtattatggcgacggcctgaatgctataattgtctttgctgcgtgttttcttcctgactctagtagggccgactatcactatgttatggaaaatctgtttctgtatgttatctcaacactggagctcatggttgctgaagactacatgatcgtgtatctgaatggcgccactcctcggagaaggatgcccggactcggctggatgaagaagtgctaccagatgattgacaggaggcttcggaaaaaccttaaaagtttcatcatcgtccacccttcctggtttattcggacaatcctggccgtaacaaggccctttatcagtagtaagttctcctctaaaatcaagtacgtgaattctctgtccgagctcagtggccttattcccatggactgtattcatattcctgaatctatcatcaactactag

SEQ ID NO: 202015 - DNA, 783 bp, Artificial Sequence
  Description of Artificial Sequence: Synthetic coding sequence
atcgacatcaacgtggacgagctggacacccccgacgaggccgactcctttgagtacaccgggcatgatcctactgcaaacaaggatagtggacaggaatcagagtctatccccgaatataccgccgaagaggagcgtgaggacaatagactgtggagaaccgtggtaataggagaacaggaacagaggatcgacatgaaggtaatcgaaccctaccggcgcgtaattagtcacggtggggactccggctactacggagatggactgaacgcaataattgtctttgctgcctgtttcctgccagatagttctcgggcggactatcactacgtgatggagaacctgtttctgtatgtcattagcacgcttgagttgatggtggccgaagactacatgattgtttacttaaacggggccactcccaggcggagaatgcctgggttggggtggatgaagaagtgctatcaaatgatagaccgccggctacgcaaaaatttaaaatcctttattatcgtacatccttcgtggttcatccgtacgatcctggcggtgacccggccttttatttccagcaagttctcctccaaaataaaatacgtcaacagtctgagcgagctcagtgggcttatccctatggattgcattcatatccccgaatcaatcattaaatatgacgaggagcgcagttacaaacggagtgtgaggactagttgtctatacaacgatcccgagatgtcctcaatggagaaggacatagacctcaagctcaaggaaaagccgtag

SEQ ID NO: 202016 - DNA, 7155 bp, Artificial Sequence
  Description of Artificial Sequence: Synthetic coding sequence
tgattccagagccccgagagctggaaggagcacaagcccagcagcattgatcgccgcgccagcgactctgtcttccaacctaagtcactggaattcaccaaatctggtccgtgggaaagtgaattcggtcaaccagagcttggctccaacgatattcaggataaaaacgaggagagtctcccatttcagaacttgcccatggagaagagtccactgccaaacacctctccccaaggcaccaaccacctgattgaagactttgcatccctgtggcatagcggaaggagtcctacggcaatgcctgaaccctggggcaacccgaccgatgatggagagcctgccgcggtcgcacccttcccagcctggtctgcattcgggaaggaagatcacgatgaggcccttaagaacacttggaatttgcatccaaccagtagcaaaactccatcggttcgagatccaaatgagtgggctatggccaagtcaggatttgcattttcatcttctgaactcctggataatagcccctccgaaataaacaacgaagccgccccagaaatttggggaaaaaaaaacaacgatagcagggaccatatctttgcccccggtaatcctagctcagatctggatcacacttggacgaactcaaagccccccaaggaagatcagaacggattagtcgatccaaagacccgaggcaaggtgtacgagaaggtggactcctggaacctgtttgaagaaaatatgaagaaaggcggctctgacgttcttgtgccatgggaggatagcttcctcagttataaatgtagcgactatagcgctagtaatctgggagaagacagcgtgccctctccacttgacaccaactattccactagcgactcctatacgtccccaacatttgccggggacgaaaaggaaaccgaacataaacccttcgctaaagaagaaggatttgagtcaaaagatggtaacagcacagctgaggagacggatatcccaccccagtccctacagcaaagcagcagaaaccgtatctcctcgggtcccgggaatctcgatatgtgggctagtccccacaccgacaatagctccgagattaacacaacacacaacctggatgagaacgaactgaagacagagcacaccgatggaaaaaacatctcaatggaggacgacgtaggagaaagtagccagagcagctacgacgacccctccatgatgcagctctacaatgagactaaccggcagcttaccctcctccattcttctaccaatagcagacagaccgctcccgatagtttagatctgtggaacagagtgattcttgaggatacacaaagcacggctacaatcagcgatatggacaatgatctcgactgggatgattgcagcggcggcgcagccatcccctctgatggacaaactgagggatatatggccgagggaagtgagccagagactcgcttcactgtgcggcagctggaaccatgggggctagagtaccaggaagccaaccaggtggattgggagctgccagcaagtgacgagcacactaaggactccgctccctctgagcatcatacgctgaatgagaaatccgggcagctgattgctaacagtatctgggactcggttatgagggacaaagacatgagtagtttcatgcttccaggcagtagtcacattaccgatagcgagcagagagaacttccgcccgaaataccatcgcattcagcaaacgtgaaggacacccactcccctgatgctcccgcagctagtggaacatcagaatccgaagccctaatcagtcacttagacaagcaggacacggagcgcgagacacttcagtctgacgccgcaagccttgctacccgtctggaaaaccctggatacttcccacaccccgatccatggaagggacacggcgacgggcagtccgagtctgaaaaggaggcccagggagctaccgatcggggacatctggatgaagaagaggtaatcgcctcaggcgtcgaaaacgcgagcggcattagcgagaaggggcagtccgatcaggagctctcctccctggtggcttccgaacaccaagagatctgtattaagagcggcaagatcagttccctcgccgtgacattctcaccacaaaccgaagaacctgaagaagtgctagagtacgaagaaggatcatataatctagacagtcgggacgtccagactgggatgagcgcagataacctgcagcccaaggacacgcacgagaagcatttaatgtcccagagaaactccggagagactaccgaaaccagtgacggtatgaatttcactaagtacgtctctgtgcccgaaaaagacctggagaagacagaagagtgcaacttcctggaaccagagaacgtaggaggcggtcctcctcaccgtgtgccacgatctcttgacttcggagatgtgccaattgacagtgatgttcacgtgtcatcaacttgttcggaaattactaaaaacctcgacgtcaaaggaagcgaaaacagtcttccgggagctggaagcagcggaaactttgacagggacaccatctcttcagagtatactcactcaagcgcgtcctcaccagaactgaacgacagtagtgtcgcgctgagttcctggggccagcagccctccagtgggtatcaggaggaaaatcagggcaactggtcagaacagaatcaccaagagtcagagctgatcacaactgatggccaggtcgagatcgtcaccaaggtgaaagacttggaaaaaaatcgcatcaacgagtttgagaaaagtttcgatcgcaagactcctacttttttggagatctggaacgatagcgttgatggtgactcattcagcagcttatcaagcccagagaccggaaagtacagtgaacactctggcacacatcaggagagtaacctgatagcatcctatcaggaaaagaacgagcatgacatcagcgctacagtccagcctgaggacgcacgagttatttccacgtcctccggttcggatgacgacagtgtcgggggggaagagtctatcgaggaggaaatccaggtcgccaactgtcacgttgcagaggacgaatcacgcgcttgggattctctgaacgagtccaataaatttctggtaaccgcagaccctaaatctgaaaacatctacgactatttagatagcagtgagcccgccgagaatgaaaacaaaagcaatcctttctgtgacaatcagcagtcgagccccgatccctggactttctccccacttactgagaccgagatgcagatcacggcggtcgagaaggagaaacggtctagtcccgagactggaaccaccggtgacgtcgcctggcagatcagtcctaaagcctctttccctaaaaatgaggataattcgcagctggaaatgctgggctttagtgctgactcaactgaatggtggaaggcgagtccccaagagggcaggttaattgaatctccgtttgaaagggagctgtccgatagctctggtgttctcgaaattaactcgagcgttcaccagaatgcaagcccttggggcgtccctgtgcagggggacattgagcccgtcgaaacccactacactaatccgttttccgacaaccaccagtcaccttttctggaggggaatggaaaaaattcacatgagcaactctggaatatccagcccagacagcccgatcctgacgcagataaattttcacagctggtaaaacttgaccagattaaggagaaggacagtagagaacaaactttcgtgagtgcagccggcgatgagctgactcccgaaaccccgactcaggagcagtgccaggacactatgctacccgtgtgcgatcaccctgacactgcttttacacacgccgaggagaattcctgtgtgacttcaaatgtcagcaccaatgagggacaggaaacaaatcagtgggaacaggagaagagttacctgggggaaatgacgaactcctcaattgccaccgagaacttccctgctgtgtcctcacctacacagctgattatgaaacctggatccgaatgggacggctcgaccccgagcgaagacagtaggggtactttcgttcctgacatactccacggtaatttccaggaaggaggccagctcgcatctgcagcccccgatctttggatcgatgcgaagaaacctttctcacttaaggccgacggggagaaccctgacattctgacacattgtgagcacgattcgaactcccaggcctccgactcgccagacatctgtcacgactcagaggccaagcaggagaccgagaagcacctgtccgcttgtatgggccctgaggttgagtcgagtgaactgtgcctcactgaacccgaaattgatgaggagcctatatacgagcccggaagggaattcgtgccctctaacgcagagctggacagcgagaacgccactgtcctaccacccatcgggtaccaggccgacattaagggcagttcccagcctgcttcccacaaaggatctcccgaacccagtgaaataaacggggacaactccaccggtctgcaggtgagtgaaaagggggctagcccagatatggccccgatcttggagcctgttgacagacggatcccacgcatagagaacgttgcaaccagtatatttgtcacgcaccaagagcctacccctgagggcgacggctcttggatatccgactctttctcgcccgagtcccagcccggcgctcgtgccctcttcgacggagacccgcacctttccacagagaatccagccctggtgcctgatgctctgttggccagcgatacttgtctggacataagcgaggctgcattcgaccattcattctctgacgccagtggcctcaataccagcactggaactatagacgacatgtcaaaactgactctctctgagggccatccagagacacccgttgacggagacctcgggaagcaggacatttgttcttcagaagcaagctggggtgacttcgaatatgacgttatgggccagaacatcgatgaggaccttctgcgagagccagagcactttctgtatggtggtgatcctccactggaggaagactccctgaagcaatctctagccccgtacacacctccatttgatctttcttacctaacagagccagcgcagagcgctgagacgattgaagaggccgggtcgccggaagacgaatcgttgggctgtagagcggcagagattgtgcttagcgccctgcctgaccgtcgctccgaaggtaaccaggccgagactaagaaccgcctgcccggtagccaattagcagtcctgcatatcagggaagatcctgagagcgtttatctgccggtcggtgctggctccaatatactctcgcctagcaacgtggattgggaggttgagacagataactccgacctcccggccggcggggacattgggcctccaaacggagccagcaaggagatcagtgagttggaggaggagaagacgatccccacaaaagagccagaacagattaaatccgagtacaaggaggagcgatgcactgaaaagaatgaggatcggcacgctctgcatatggattacatcctcgtgaaccgggaggaaaatagccattcgaagccagaaacttgtgaggagagagagtccatcgccgagcttgagctgtatgtcggttctaaggagacaggacttcaggggacacagctagccagctttcccgacacttgtcagcccgcaagtctgaacgaacgcaaggggctgtcagcagagaagatgtcctccaagtccgatacccgaagttctttcgagagtcctgcccaggatcagtcttggatgtttttaggccactccgaagtgggggatccatccctggatgctagagattccgggcccggctggtccggcaagaccgtcgaacccttctccgaactggggctgggtgaagggccccagctccagattttggaagagatgaagcctctagagtccttggcactggaggaggcaagcggacccgtgagtcagtctcagaaatctaagtccagggggcgagccggtcccgatgctgtgactctccaggctgtaacacatgataacgaatgggaaatgctctctcctcaaccagtgcagaagaacatgatcccagacaccgagatggaggaagagaccgagtttttggaactggggaccaggatttcgcgtccgaacggcctcctgtccgaggacgtgggtatggacattcccttcgaagagggagtcctgtctcctagcgctgccgatatgcgaccggagccacccaattctctggacctcaatgatactcacccaagacggattaaactgaccgcgcccaacattaatctgtccctggatcagtccgagggctctattctatctgatgacaacctggactctccagatgagattgacatcaacgtggacgaactggatactcccgatgaagcagatagctttgagtatacaggccatgatccaacggccaacaaagattcagggcaggagtctgaatcaatccctgagtatactgctgaagaggaaagggaggacaatagactctggagaacagtcgtcatcggagaacaggaacagcgtatagacatgaaggtcattgaaccttaccgcagagttattagtcatggaggagattcaggatactacggcgatggcctgaatgccatcatcgtgtttgctgcttgttttctccccgattccagccgcgccgattatcactacgttatggaaaatttgttcctatacgtcatttcaactctggaactcatggtggctgaggactatatgattgtgtacttgaatggcgctacgcctcgcaggagaatgcccggtctaggatggatgaagaaatgctatcagatgatcgatcggcggctgcggaaaaacctcaagagtttcataatcgtgcacccgtcttggttcattcgaacaatcctggcagtaactaggccgttcatttctagtaaattttcatcgaagattaaatacgtgaatagcctctccgaactatctggattaattcctatggactgtattcacataccagaatcaattatcaatatagacttaaagctaaaagagaaaccgtag

SEQ ID NO: 202017 - DNA, 8193 bp, Artificial Sequence
  Description of Artificial Sequence: Synthetic coding sequence
atggtgagcaacagccggaccagcagcaccgaggccgtggccggctcggctccactttcccagggcagtagcggaatcatggagctgtatggatccgatattgaacctcaaccatcctccgtcaacttcattgagaacccgcccgacttgaatgacagcaatcaggctcaagtggacgccaacgtagatcttgtgtctcctgactccggactcgccactatccgttcaagcagaagctctaaggaatcttctgtgttcctttctgacgactctcccgtcggcgaaggcgccggaccccaccacaccctcctgcccggactcgactcctactcccctatccctgaaggtgcagtggccgaggagcacgcatggtcaggtgaacatggtgaacacttcgatttattcaattttgatccggccccgatggcaagtggacaatctcagcagagctcccactccgctgactattccccagctgatgatttcttcccaaattctgatctgtctgagggccagctccctgccggcccagaaggactcgacggtatgggaaccaatatgtcaaactattcttcaagcagtctgctgagcggggctggcaaagactcactcgtggagcatgatgaggaattcgtgcagaggcaggacagtcctcgtgacaattcagaacggaatttatcactgaccgacttcgtgggcgacgagagcccctctcctgaacgcctaaaaaacactggcaagagaattcccccaactcccatgaactcacttgtggaatcttccccgagcacggaggaaccagcatctttgtataccgaggacatgacacagaaggccacggacaccggccacatggggcccccacagactcatgcccggtgctcctcctggtggggggggttagagattgattcaaagaacatcgccgacgcctggtctagcagtgagcaagagagtgtgtttcagtcacccgaaagttggaaagagcacaagccctcgtcgattgacagaagggcttctgatagcgtgtttcagcccaagtctctggaattcaccaagtccggcccgtgggaaagcgaattcgggcaaccagaactaggcagcaacgatattcaggataaaaatgaggagtcgctgccgttccaaaatctgccgatggagaaaagtccattgccgaacactagtccccaggggaccaaccacctgattgaagactttgcctctctgtggcactctggtcgctcccctacagctatgcccgaaccctggggcaatcccacagacgacggagagccagctgctgtggcgccgtttcctgcatggtcagcttttgggaaggaagaccacgatgaggccctgaaaaacacgtggaatttgcaccccacatcttctaaaaccccttcagtccgcgaccctaatgaatgggcaatggccaagtcgggctttgccttctccagcagtgaacttttagataattcaccaagcgagataaacaatgaagccgcccccgagatctggggcaaaaagaataatgattcccgcgaccatatctttgcacccggtaacccttccagtgacctggaccatacctggacaaattctaagccccctaaagaggatcagaatggcttggtggaccctaaaactcgaggaaaggtctacgaaaaggtcgattcttggaacctgttcgaagaaaatatgaaaaaagggggttccgatgtgctggtcccgtgggaggactcctttctgtcttataagtgttcagactactccgcctccaatttaggagaggattccgtgcccagtcccctggataccaattactccactagcgactcttacacctcaccaacctttgcgggcgatgaaaaggagacggaacataaaccattcgccaaggaagagggatttgagtccaaagatggaaattcaactgctgaggagacagacattcccccgcaatctttgcagcagtcctcacggaaccgtatttcaagcgggccaggaaacttggatatgtgggcatccccacatactgataactcctcagagatcaacactactcacaacctggacgagaacgagctcaagactgagcacaccgacggtaaaaacatttctatggaggacgatgtgggcgagagcagtcagagctcctatgacgacccctccatgatgcagctgtacaacgagaccaacagacagctgactctgctgcacagcagtaccaactcgcgccagactgcacccgatagcctggacctctggaatcgcgtaatcctcgaggatacccaaagcacagccaccatctctgatatggacaacgacctggactgggatgactgctcaggtggcgccgccattccatccgacggtcagaccgagggttacatggcagaaggatccgagcctgagacaaggtttacagtgaggcaattagaaccctggggtctggagtatcaggaggctaatcaggtggactgggagctgccggcttccgatgagcacaccaaggattcagcgccatcagaacaccacacccttaacgagaagagcggccagctcatagcaaatagtatctgggactctgtgatgagagacaaggatatgtctagctttatgctcccaggctctagtcacattaccgacagcgagcagcgggagctgccccccgagatcccctctcactccgccaacgtgaaagacacgcactcgccagacgcacctgccgccagtgggacttctgagtccgaggctctgatctctcatctggacaagcaggacacagagagagaaacactgcagtcagatgccgccagcctggccacccgccttgaaaacccagggtatttcccacatccggacccatggaagggtcacggggatggccagagcgaaagcgagaaagaggcccagggcgctacagaccgaggacacctggatgaagaagaggtgattgcaagtggcgtcgagaacgcttccggaatttccgagaagggccagtctgatcaagagttgtcttctttggtagcctccgaacatcaggagatctgcatcaaatcaggaaagatcagtagcctggctgttacattttccccccagaccgaagagcccgaggaggttctggagtacgaggagggttcatacaacttagattcccgtgatgttcagactggtatgagcgccgataatctgcagcccaaagatactcacgagaagcacttgatgagtcagaggaactcaggagagactacagaaacgagcgatggcatgaacttcactaagtacgtcagcgtccctgagaaagatctcgagaagaccgaggaatgcaactttttggagcctgaaaacgtgggcggcggcccaccccatagagtgcccagaagcctggatttcggagacgtgcctatagactccgatgtgcatgtctcatcaacatgttctgaaattacaaaaaatctggatgttaaaggttccgaaaatagcctgcctggagccgggagcagtgggaatttcgaccgcgacaccatctcatctgagtatactcattcaagcgcttctagccccgaattaaacgattctagcgttgcccttagttcctgggggcagcagccttcttctggctaccaagaagaaaaccagggcaactggagcgagcaaaatcaccaagagtccgagctcattacgacagatggccaagttgagattgttaccaaggtaaaggatctggagaaaaataggattaatgaattcgagaaaagcttcgacaggaaaaccccgaccttcctcgaaatctggaacgattcggtggacggcgactctttcagctcgctctcttctccggagacagggaaatactccgagcactcagggactcaccaggagagcaatctcatcgcttcctaccaggaaaaaaacgagcacgatatctccgccaccgtccagcctgaggatgcaagagtcatcagcacctctagcgggagtgacgatgatagcgttgggggcgaggagtccattgaagaagaaatacaagtagctaactgtcatgtggcggaagatgagtcaagagcctgggatagtctaaatgaatctaataagttcctcgtgacggccgatccaaagtcagagaacatctacgattacctggacagttccgagcctgccgagaacgagaacaagtccaatcctttttgcgataatcagcaatctagcccagatccatggaccttttcacccctcaccgagacagaaatgcagattactgccgtggaaaaagaaaaaaggtctagccccgaaactgggacgacaggggacgtggcttggcagatctctccgaaagcctcctttccaaagaatgaggataatagccaacttgagatgctcgggttctctgccgattctacagaatggtggaaggcttcacctcaggaagggaggctgattgaatcccctttcgagagggagctgagtgatagcagtggggtgctggagattaacagcagcgtgcatcagaacgcttccccttggggggtccccgtgcagggagatatcgagccggtggaaacacactacactaacccttttagcgacaaccatcaaagtcccttcctggaggggaacggaaaaaatagtcacgagcagctgtggaacatacagccaaggcagccagatcctgacgctgacaagtttagccagttggtgaagctggatcagataaaagagaaggactcccgcgagcagacattcgtcagtgccgcaggcgacgagctgactcctgaaacaccaacccaggagcagtgtcaggatactatgctacctgtctgcgaccatcctgacacagccttcacccatgcagaggagaatagctgcgtgaccagtaacgtaagcacaaacgagggacaggagacaaaccagtgggagcaggaaaagtcttacctgggtgaaatgaccaattcctctatcgccacggagaacttcccagcagtctcctctcctacacaattaataatgaaaccagggtcagaatgggacggttccactcccagtgaggactcacggggcacctttgtccccgacattctgcatggtaattttcaggagggcggtcagctggcctctgctgcccctgatctgtggatagatgccaagaaaccatttagcctgaaagctgatggggaaaatcccgatattttgacacattgcgaacacgattctaatagccaagcctccgactcaccagacatttgccatgactccgaggcgaaacaggagacggagaagcatttgagtgcctgcatgggtcccgaggtagagtccagcgagctgtgtctgaccgaaccagaaatagacgaagagccgatttacgagccaggaagagaattcgttccatcaaatgcggagttagattctgagaatgccacagtgttgcctcccattggttatcaggcagacatcaagggaagttcccagcccgcaagccataaaggtagcccagaaccttcagaaatcaacggcgataattcgactggactgcaggtgtccgagaaaggggcctctcccgatatggctcctatcctcgagccggttgacagacgcatccctcggatcgagaacgtggccacctctatttttgtcacacaccaggaaccaacccctgaaggagacgggagttggatctctgactccttctccccggagagccagcccggagccagagcgctgttcgatggcgatccgcatctatcgacagagaacccagctcttgtgccagacgcccttttggcatcggatacatgtttggacattagtgaggcagcgttcgaccacagtttttcggacgcttccggactgaatacaagcacgggaacgatagacgacatgtccaagctcacactctctgaagggcacccggagactcccgtggacggcgatctgggtaagcaggatatctgttcttcagaagcctcctggggcgattttgaatacgatgttatggggcagaacattgacgaggatttgctccgtgagcctgaacactttttgtacgggggggacccccccttggaggaggacagtctgaaacaaagtctagccccgtacacgccccccttcgacctatcctatctcactgaaccggcccagtcagccgaaacaattgaggaggcgggaagtccggaggatgaatccctcggctgccgagcggccgagatcgttctttctgccctaccagatagaaggtctgagggcaaccaggcagagacaaagaaccggctccccggctctcagcttgcagtgttacacatccgcgaggaccctgagagcgtgtatctgcctgtcggggcaggaagcaacatcttgagtcctagcaacgtggattgggaggtggagaccgacaattctgatctcccagcaggcggcgacatcggcccacctaacggggcttctaaggagatttcggaactcgaggaggagaagactatcccaacaaaggagcccgaacaaatcaagtccgagtataaggaagagcggtgtacagaaaagaacgaggataggcacgcattacacatggactatatcctcgtgaaccgggaggagaacagtcacagcaagccagaaacgtgcgaggagagggaaagcattgcggaattggaactgtatgtagggagtaaagaaaccgggctgcagggaacacagctggcaagctttcctgacacctgccagcccgccagtcttaacgagagaaaaggcctgtccgctgagaagatgagcagcaagtctgatacacgctccagtttcgagagtcccgcacaggatcaatcttggatgtttctgggacacagcgaagtaggtgatccaagcctcgacgcgcgcgacagcggtccggggtggtccgggaagacagtcgaacctttctccgagcttggtctgggagaaggtccccagctgcagatcctggaggagatgaaacctttggaatcgctcgccttggaggaggcatctggcccagtcagccagtcacagaagagcaagtcacgaggcagggctggcccagacgccgttaccctccaggccgtcacccacgataacgagtgggagatgctgagccctcaaccagtgcaaaagaacatgatccccgataccgagatggaggaagagacagaatttctcgagttgggcacccgaatctccaggccaaacggcctgctgagcgaggacgtgggcatggatattccctttgaggagggagttctgtcaccctctgcagccgacatgaggcccgaacctcctaattcgctggacctgaacgatactcatcctcggcgcataaagttaacagcccccaatattaaccttagcttggatcagagtgagggctcaatcttgtcagacgataatctggatagccccgacgagatcgatattaacgtcgatgagttagacactcctgacgaggcagacagttttgaatacactggccatgaggaccctaccgcaaataaggattcaggtcaagagagcgagagcatccccgagtacacggccgaggaagagagagaagacaatcggctatggaggaccgttgtgattggtgagcaggagcaacgcattgatatgaaagtaattgagccttataggagggtgatcagccatggtggttactacggagatggtctcaatgcgatcatcgtctttgcagcctgttttttgccagatagttccagggctgactaccattatgtcatggaaaacctattcctttacgtgattagcacccttgagctaatggtagccgaggattacatgattgtgtacctgaacggggctacaccccgccgaagaatgcccggcctcggttggatgaaaaaatgctaccagatgatcgatcggcggctccggaagaatctgaaatcttttataatcgtacatccatcctggtttatcaggacaattctggcggttacaagaccatttatctcgtccaaatttagtagtaagattaaatatgtgaatagcctcagcgagctctccgggttgattccgatggattgcatacatattccagaatccattattaagcttgatgaggaactgagggaagcatcagaagctgcaaaaacaagctgcctgtacaacgaccccgagatgagttctatggaaaaagatatcgacctgaagctgaaagaaaaaccgtag

SEQ ID NO: 202018 - DNA, 927 bp, Artificial Sequence
  Description of Artificial Sequence: Synthetic coding sequence
atgcggcccgagccccccaacagcctggacctgaacgacacccaccctagaagaattaagctcacagccccaaatatcaatctctctctggaccagtcagaagggagcatactgagcgatgataacctagacagcccagacgaaatcgacatcaatgttgacgagctcgacaccccggatgaagctgactcgttcgagtacacaggacacgacccgacggcgaataaggacagtggacaggaatcagagtctattccagaatacacagccgaggaggaaagagaggacaacaggctgtggaggaccgtggtcatcggcgagcaggaacaaagaatcgacatgaaggtgatcgagccgtaccggagagtaatctctcacgggggtaagctccgatactatggcgatgggctcaacgccatcatcgtgtttgctgcctgcttcctgcctgattcctctcgggcagactatcattatgtgatggaaaatctcttcctgtatgtaattagtaccttggagctgatggtagcagaggactacatgattgtatatctgaatggagctactcccagacgccgcatgcccggcttagggtggatgaaaaaatgctaccagatgatcgaccggaggctcaggaaaaatttaaaatccttcattatcgtccatccttcttggtttattagaacaatcttagcggtcactaggccatttatttcatccaagttttctagtaagatcaagtatgtgaattccctctcagaattgagtggactcattcccatggactgcatccatattccggaatccatcatcaagtatgacgaagagaggtcctacaagcggtccgtgcgaacatcgtgcctctataacgaccccgagatgtcttccatggagaaagatatcgatcttaaacttaaagaaaagccatag

SEQ ID NO: 202019 - DNA, 1014 bp, Artificial Sequence
  Description of Artificial Sequence: Synthetic coding sequence
atgaacggcctgcggaacaagcagctgctgagcgaggacgtgggcatggatatacccttcgaggaaggagtgctttccccctcagccgccgacatgcgaccagagccccctaattctctggatctgaacgatacccacccgcgacgaataaagctcactgcccctaacattaatctgtctctggaccagtccgagggatccattctctcagatgacaatttagattccccggacgagatagacatcaacgtggatgagttggatacccccgatgaagcagacagcttcgaatacactggccatgaccccactgccaacaaggactcaggtcaagaatctgaatctatacctgagtatacagcggaagaggagagagaagacaaccgactctggagaaccgtcgtaattggtgaacaggaacagcggatcgacatgaaagtgatcgagccctatcggagagtaattagccatggcgggtactatggggacggcttaaacgctatcattgtgtttgccgcttgttttctcccagattcaagtagagctgactaccattatgtgatggaaaatctatttctgtacgtaatcagcacactagagctaatggtggctgaggattacatgattgtctacctcaacggggcaaccccccgcagacggatgcccggactggggtggatgaagaaatgctaccaaatgatcgaccggcgcttaaggaaaaacttgaagtctttcatcatcgtgcaccctagttggtttatcagaacgattcttgctgttactcgcccctttatctcaagcaaattttcctctaaaatcaaatacgtcaactcactcagcgagctgtcaggcctgatacccatggattgcattcacatcccggaatctatcatcaagctggacgaggaactgcgggaggctagtgaagccgcaaagacgtcttgcttgtataacgacccagagatgagctccatggagaaggatatagacctgaagcttaaggagaagccgtag

SEQ ID NO: 202020 - DNA, 1155 bp, Artificial Sequence
  Description of Artificial Sequence: Synthetic coding sequence
atggccggcaacgccgagcccccccccgccggcgccgcctgcccccaagatcgtcgatcttgctcggggagagctgggggagacagggtgtgggaagacggggagcatcccgccaaaaagctgaagtccgggggcgacgaggaacggagagagaaaccaccaaaacgcaagatcgtgcttttgatggcttactccggcaaaggctaccacggaatgcagcgaaacgtgggctcttctcagttcaagaccatagaagacgacctcgtatccgccctggtcagaagcggctgtattccagagaaccatggcgaggacatgagaaagatgtcctttcagcggtgcgcccgtactgataagggtgtctcggcagccggccaggtggtgtccctgaaggtatggctgattgacgatattctagaaaagatcaattctcacctgccttctcatatacgcattctggggttaaagcgtgttacgggaggatttaattcaaaaaacaggtgcgacgctcgcacctattgttacttgctgccgacatttgccttcgctcacaaggaccgcgatgtgcaagacgagacatacaggctctccgccgaaaccttgcagcaggtgaaccgcctgttggcctgctataaagggacacacaacttccataacttcacatcacaaaaggggccacaggatccctccgcttgccggtatatcctggaaatgtactgtgaagaaccatttgtcagggagggcctggaatttgcagtgattcgggtcaagggccagagtttcatgatgcatcagatccgaaaaatggtgggactcgtagtggcaatcgtcaaggggtatgcacctgaatctgttctggaaagatcttggggcacggagaaggttgatgtgcccaaagcccctggcttagggcttgtgctcgaaagggtccatttcgaaaagtataaccagagatttggaaacgacggcctccatgagcccctcgactgggcccaggaagaagggaaagtggctgccttcaaagaagaacacatctacccaactataatcggtacagagcgcgacgagcgaagcatggctcagtggctgtccacactgcccattcataacttttccgctacggctcttaccgccgggggaaccggcgctaagtag

SEQ ID NO: 202021 - DNA, 1284 bp, Artificial Sequence
  Description of Artificial Sequence: Synthetic coding sequence
atgggcctgcagctgcgggccctgctgggcgccttcggccggtggactttgcgtcttgggccaagaccctcttgctctcccaggatggccggaaatgccgagccccctccagctggcgctgcatgtccacaggatcgtcgctcatgttctggacgggctggtggcgaccgcgtctgggaggacggggagcatcccgcaaaaaagctgaagtctggaggggatgaggagcgccgcgagaaacccccaaagagaaagatcgtgttgctgatggcttatagcggtaagggatatcacggcatgcagagaaacgtcggatcttctcaattcaagaccattgaggatgatcttgtgtcagccctggtgcggtccggctgcatcccggagaatcacggagaagacatgagaaagatgtccttccaacgatgcgccaggactgataaaggagtcagtgctgccggccaggttgtgtccttgaaagtctggctgatcgacgacattctggaaaagataaactcccacctgccatctcacataaggatcttgggcctgaaacgagtaaccgggggctttaattcaaaaaacagatgcgacgcccgaacctattgctacctgttgccaactttcgccttcgcccacaaagaccgtgacgtgcaagatgagacttaccggctctctgcagagaccctgcagcaggtaaatcgactgctagcctgttataagggtacccacaactttcataacttcaccagtcaaaagggacctcaggacccctcagcctgtagatacatccttgaaatgtattgcgaagagccattcgtccgagaaggcctcgagtttgctgtgatccgtgtcaaaggtcaatccttcatgatgcaccagatccgcaaaatggtgggcctggtcgtcgctatcgttaaaggttatgcaccagagtccgtgttggagcgaagctggggtacagagaaagtggatgttccgaaggcccctggactaggactcgtgctagaaagagttcacttcgaaaaatacaatcagcgattcggcaatgacggactgcacgaacccctggactgggcgcaggaggaggggaaggtggccgcttttaaagaggaacacatttatccgaccataatcgggactgaacgggatgaacggagcatggcgcagtggctaagtacactgcctattcataatttttctgctaccgccttgacggccggaggtaccggcgccaaggtgccatcccctctggaggggagcgaaggcgacggagatactgactag

SEQ ID NO: 202022 - DNA, 1200 bp, Artificial Sequence
  Description of Artificial Sequence: Synthetic coding sequence
atggccggcaacgccgagcccccccccgccggcgccgcctgcccccaggatcggcggtcttgttccggccgggccggaggggacagggtctgggaggacggcgagcaccctgccaaaaaactgaagtcgggaggagacgaggagcggagagaaaaaccccctaaaaggaaaatagtgttattaatggcctattcaggaaaaggctatcatggaatgcaaaggaatgtgggttcttcccaatttaaaacaattgaggacgaccttgtgtctgcattggtccgcagtgggtgtattccggagaaccacggggaggatatgagaaagatgtcatttcagaggtgcgcacgcactgacaagggtgtgtccgcagcaggccaagtggtgagcctaaaggtctggctaatcgacgatatcctggagaagataaattcccacctcccaagtcacatcagaattctgggactgaaaagggtgactggaggattcaactctaagaacagatgtgatgctagaacctattgttatctcctccctacgttcgctttcgcccataaggatagagatgtgcaggacgagacatatcggctgtccgcagagacacttcagcaggtgaatcggttgttagcctgttacaaagggacacacaactttcacaacttcacatcccagaaagggccccaagacccctccgcctgtaggtatatcctggagatgtactgcgaagagcccttcgtcagggaaggattagagttcgctgtgatccgggtgaaaggacagagctttatgatgcatcagatcagaaagatggttggcttggtggtcgctattgtgaaagggtacgcccccgaatccgtgctggagaggtcttggggcaccgagaaagtggatgtgccaaaagctcctggcttggggctcgttctggagagagtgcacttcgaaaaatacaatcaacgcttcggcaatgatggcctccatgagccactggattgggcccaagaggaaggtaaagttgcagccttcaaggaggaacacatctaccccactatcataggcaccgagagggatgaacggagcatggcacagtggttgtctacgctccctatacataactttagcgctaccgctctgaccgcaggcggcactggcgccaaagtgccgagcccgcttgaaggttctgaaggggacggagacacagattag

SEQ ID NO: 202023 - DNA, 1200 bp, Artificial Sequence
  Description of Artificial Sequence: Synthetic coding sequence
atggccggcaacgccgagcccccccccgccggcgccgcctgcccccaggacaggagaagctgcagtggacgcgctggaggggatcgcgtctgggaggatggagagcaccccgccaaaaagctcaaatctgggggtgatgaggaaagaagagagaaaccgccgaaacgcaagatcgtgttactaatggcttattccggaaaagggtaccatgggatgcagagaaatgtgggctccagccagttcaagacaattgaggatgaccttgtctcggcactggtacgctcaggttgcattcccgaaaaccacggagaggacatgcgcaagatgtccttccagagatgcgcaaggaccgacaaaggggtctcggccgccggccaggtcgtgtcattaaaggtatggctgattgacgatatactggagaaaatcaactctcacctgccatcccatataaggatcctcgggttaaaacgagtgaccggcggatttaatagtaaaaatagatgcgatgctaggacttactgctatctgctaccgaccttcgctttcgctcacaaagaccgggatgtgcaggatgaaacatatcggctgtccgccgaaaccctccagcaagtaaaccgcctcttggcctgctataaaggcacacataacttccataactttacatcccagaagggcccacaggatccaagcgcctgccgctacattctggaaatgtattgcgaagagccttttgtgagagaaggtctggagttcgccgtaataagggtgaagggtcagtcatttatgatgcatcagattaggaagatggttgggctggtggtggcaatagtcaagggttacgcccctgagagcgtgctggagcgtagctggggaaccgagaaagtggacgtgccaaaagctcctggactcggactggtgttggaaagagtccacttcgagaagtataaccaacggtttggcaatgatgggcttcacgaacctcttgactgggcccaggaagagggcaaagtggctgcattcaaggaggagcacatatatccgacaattattggcacagaaagggatgaaaggagcatggcacagtggttgagcactctgccaatacacaatttcagcgcgacagctcttacagcaggcggcacgggcgctaaggtcccctcgcccctcgagggcagcgagggggacggtgataccgactag

SEQ ID NO: 202024 - DNA, 465 bp, Artificial Sequence
  Description of Artificial Sequence: Synthetic coding sequence
atggccggcaacgccgagcccccccccgccggcgccgcctgcccccaagataggcgatcatgttcaggcagggccggcggggacagagtgtgggaagacggggagcatccagccaaaaagttaaagtccggtggggacgaggagagacgggaaaagcccccaaagcgaaagatagtgctccttatggcctatagtggaaaaggctaccacggaatgcaaaggaacgtgggcagctcacagtttaagaccattgaggacgatctggttagtgccctcgtgaggtctggatgcataccagagaaccatggggaggatatgcgaaaaatgtctttccagagatgcgcccgaactgacaaaggcgtctctgctgctgggcaggtggtgtccctaaaagtctggctgatcgacgacattctcgaaaagattaacagccacttgcccagtcatatccgaatcctggggtag

SEQ ID NO: 202025 - DNA, 618 bp, Artificial Sequence
  Description of Artificial Sequence: Synthetic coding sequence
atgagcaagggccgggccgaggccgccgccggcgccgccggcatcctcctacgctatcttcaggaacagaaccgaccatactcaagtcaggacgtcttcggcaacttgcagcgggaacacggattgggcaaagccgtcgttgtcaaaaccctcgaacagttagctcagcaaggtaagataaaggaaaagatgtacggtaaacaaaaaatctattttgccgatcaagatcagttcgacatggtctccgatgctgatctccaagtccttgacggaaaaattgtcgctctcactgccaaagtgcaatccctgcagcagagctgcagatacatggaagcagagatgcagaaggaaattcaggaactgaagaaagagtgcgccggctatagagagcgtcttaagaacattaaggccgcgaccaaccacgtgactcctgaggagaaggaacaagtgtaccgcgagcgccagaagtattgtaaggagtggcgcaagcgaaagaggatggccacagagctaagcgacgccatactcgagggctacccaaaatcaaagaaacagtttttcgaggaggtgggaattgagacggacgaagattacaacgtaactctgcctgacccatag

SEQ ID NO: 202026 - DNA, 654 bp, Artificial Sequence
  Description of Artificial Sequence: Synthetic coding sequence
atgagcaagggccgggccgaggccgccgccggcgccgccggcatcctccttagatatctgcaggaacagaaccgaccctattcctcacaggatgtgttcgggaaccttcagcgggagcacggcctgggtaaggccgtggtcgtcaagaccttggagcaacttgcccagcagggtaaaataaaggagaaaatgtatggcaagcaaaagatttacttcgccgaccaggatcagttcgacatggtgagtgatgcagacctgcaagtgttggacggtaagatcgtggctctcaccgcaaaggttcagtcgctccaacaaagctgtcggtacatggaggctgaacttaaagagctttccagtgcacttaccacgccagaaatgcaaaaggagatccaggaactcaagaaagaatgtgcggggtacagggaaaggctcaagaatatcaaggctgctacgaaccatgtcaccccagaagaaaaggagcaagtttacagggagaggcagaaatactgcaaggagtggcggaagagaaaacgcatggctacggagctgagtgacgctatcctcgaaggttacccaaagtcaaagaaacagtttttcgaggaggtcggaatagagaccgatgaggattataacgttactctcccggatccatag

SEQ ID NO: 202027 - DNA, 465 bp, Artificial Sequence
  Description of Artificial Sequence: Synthetic coding sequence
atgtacggcaagcagaagatctacttcgccgaccaggaccagttcgatatggtgtcagacgccgaccttcaagtccttgacggcaaaatcgtggctctgaccgccaaggtgcaaagtcttcagcaatcctgtcggtacatggaggcagagttgaaggaattgtcgagcgcgctcacaacacctgaaatgcaaaaagaaatccaagagctgaaaaaggagtgcgctggctacagggagcgccttaagaatattaaagccgccacaaaccatgtcactcctgaggagaaagaacaggtttaccgcgagaggcaaaagtactgtaaagaatggagaaagcggaaaaggatggccaccgaactgagtgacgcaattctggaggggtaccctaaatcaaaaaagcagttcttcgaggaagtaggaattgaaacggacgaagactacaacgtaacactgcctgacccatag

SEQ ID NO: 202028 - DNA, 915 bp, Artificial Sequence
  Description of Artificial Sequence: Synthetic coding sequence
atgttcagcgtgctgagctacggccggctggtggcccgggccgtgctgggcggcttatcccagaccgacccacgagccggtggggggggcggaggcgattatggtcttgtgactgcagggtgtggctttggaaaggatttcaggaagggcctgctcaagaagggagcttgttatggcgatgacgcctgcttcgtggcccgccaccggtccgccgatgtgctgggcgtggctgacggggtcggagggtggagagactacggcgttgatccaagccaattctcaggaaccctaatgagaacctgtgagaggttggtaaaggagggcaggttcgtgccttctaaccccattggaatattaaccacttcttattgtgagttgctccagaacaaggtcccattgctgggcagctcaaccgcgtgcatcgttgtcctggaccgaacatcccacagactgcacaccgccaaccttggggacagcggttttctcgtggtgaggggaggagaagtggtgcaccgttctgatgagcagcagcattatttcaatacaccattccagctgagtatcgcccccccggaagcggaaggtgtggtgctgtccgacagccctgatgctgctgacagtacctcctttgacgtccagttgggcgacataatcctcactgccactgacggcctgttcgacaacatgccagattatatgattctgcaagaacttaaaaagctcaaaaattctaattacgagtctatccaacaaaccgccagatccattgccgaacaggcccatgaactggcatacgatcccaactatatgtctccctttgcccaattcgcctgtgataacgggctcaatgtgcggggtggcaaacctgatgacattaccgtacttctgagcatcgttgcagaatatacagactag

SEQ ID NO: 202029 - DNA, 1746 bp, Artificial Sequence
  Description of Artificial Sequence: Synthetic coding sequence
atggccgtgcggcaggccctgggccggggcctgcagctgggccgggctctcctactcaggtttactgggaaaccgggccgtgcctatgggctcggcaggccaggcccggccgctgggtgcgtgcgcggagaacgcccagggtgggccgcaggtccaggagctgagcctaggagggtgggcttgggcctcccaaatcggctccgctttttccgacagtctgtcgccgggctggccgctcggctgcagagacaattcgtcgttcgcgcttggggttgtgctggcccatgtggccgggcagttttcctagccttcggcctgggactgggtctaatcgaggagaaacaagcagagtcccgaagggccgtgtcagcgtgccaggaaattcaggccatttttacacagaaatctaaacccggtccggaccctcttgatacccgccgcctgcaagggttcagactggaagagtacttaattggacagagtatcggtaaagggtgttccgcagctgtttacgaggctacaatgcctactctgcctcaaaatctggaagtgactaagtcgactggtctgcttccaggtcgtggcccaggaaccagtgcccctggcgaagggcaagaacgcgctccaggcgctcctgccttccccttggcgatcaagatgatgtggaatatttctgcgggttcttcatcagaggccattctcaataccatgtctcaggaactcgtgcctgcgtcaagggtggccttggccggcgagtacggtgcggttacttacaggaagtcaaagagaggacctaaacagcttgccccacacccgaatataatacgggtgttaagggcatttactagttctgtgccactccttccaggggccctggtggactacccagatgtgctgccatcgcgcctccaccccgaaggattagggcacgggaggacactcttcctggtgatgaagaactacccatgcacactccggcagtatctgtgcgtgaacacgcccagtccacggttggcggctatgatgctcttacaactcctggaaggcgtagaccatttggtacagcagggcatagcacacagagatctgaagtccgacaacattctggttgaactggacccagatgggtgcccatggctagtcattgccgatttcgggtgctgcctagccgatgagtctataggcctccagctacctttcagtagttggtatgtcgacaggggagggaacggttgcctaatggctccagaagtcagcacagctcgtccaggcccccgggccgtcattgactatagcaaagctgatgcatgggcagtgggcgctatcgcctacgagatcttcggtctggtgaatcccttctacggccaaggcaaagctcacctagagagcaggtcctatcaggaagctcagctgccagccctgcctgagtcagttcctccagacgtgaggcagctggttcgggcccttcttcaacgggaggcctctaagaggcccagtgctagagtggctgcaaacgttttgcatctgtccctatggggtgagcacatccttgcccttaaaaacctgaaattggataagatggtgggttggctacttcagcagtccgcggctacactccttgccaaccgattgactgagaaatgctgtgtagaaacaaaaatgaaaatgctgttcctggccaatctcgaatgtgagacattgtgccaggcagctctactactgtgcagctggcgcgcagcactgtag

SEQ ID NO: 202030 - DNA, 393 bp, Artificial Sequence
  Description of Artificial Sequence: Synthetic coding sequence
atggccgccgtgctgggcgccctgggcgccacccggcggctgctggctgcccttagaggacaaagtctggggttggccgcaatgagcagcggcacccatcgcctgacggccgaggaaaggaatcaagcaattctggatctcaaggctgcaggatggtctgagctcagtgaaagggatgctatttataaggaattcagttttcataacttcaatcaggcctttggatttatgagtcgggtggcccttcaggcggagaagatgaaccaccacccagaatggtttaatgtgtacaataaggtccagattaccctaacgtcccacgattgtggagagctaacaaaaaaggatgtgaaactggccaagttcatagaaaaagcagccgcctccgtctag

SEQ ID NO: 202031 - DNA, 393 bp, Artificial Sequence
  Description of Artificial Sequence: Synthetic coding sequence
atggccgccgtgctgggcgccctgggcgccacccggcggctgctggcggccctgaggggtcagtctttaggcctggccgctatgagcagtggcacgcacagactgacagctgaagagcggaatcaagcgatcctcgatctaaaggccgcgggctggagcgagctctctgaaagagatgctatttataaagaatttagcttccacaattttaaccaggcttttggttttatgtcacgggtggcactccaggccgagaagatgaaccatcaccccgagtggttcaatgtctataacaaagtacaaattacgctgacatcccatgactgcggagagctgactaagaaagatgtgaaactcgctaagtttatcgagaaggcagccgcaagcgtctag

SEQ ID NO: 202032 - DNA, 1041 bp, Artificial Sequence
  Description of Artificial Sequence: Synthetic coding sequence
atggccctgctgaaggtgaagttcgaccagaagaagcgggtgaagctggcccagggcctgtggcttatgaactggttctcggtccttgccgggattatcattttttcgctcggtctgttcctgaagatcgagttgcgcaaaagatcagacgtcatgaataacagtgagtcacacttcgtcccaaactccctgattggcatgggtgtcctgagttgcgtatttaattcgctggctgggaaaatctgctacgatgctctcgatccagctaagtacgcaagatggaaaccctggctcaagccttacttggcaatctgtgtgctgttcaatattatcctcttcctggtggccctgtgttgctttttgctgagaggaagccttgagaacaccttgggccagggcctgaagaacggcatgaaatattacagagataccgacacaccagggcgctgttttatgaagaaaaccatagatatgctgcagatcgaattcaagtgctgtggtaataacggttttcgggactggttcgagatacaatggatctcgaaccggtacttagacttttcctctaaagaggtaaaagatcggattaaaagtaatgttgacggacggtacctcgttgacggagtaccattttcttgctgcaatccaagcagcccgagaccgtgtattcaatatcagataactaacaatagtgctcattatagttacgaccaccagactgaagagcttaatctgtgggtgcgcggttgtagagcagcgcttttatcctattactcctctctgatgaacagtatgggcgtcgtaaccttattgatttggctttttgaggtgactataactatcggtctacgctatttgcaaacgtctctggacggcgtgtccaatcccgaggagagtgagtctgaaagtcagggttggctcttggagcggtcagtgccagagacatggaaagcattcctggagtccgtaaagaagttaggaaagggcaatcaagtggaggcggaaggcgcagacgctggtcaagcccctgaggcaggatag

SEQ ID NO: 202033 - DNA, 1191 bp, Artificial Sequence
  Description of Artificial Sequence: Synthetic coding sequence
atgcccctgttcgagccccgggtgttcaccgccggcagcgaggagcgagtgacctgcctccccccaaaaggacttcccgaaccctccgtatggtgggagcatgcaggggtacgccttcctacacatggacgcgtctaccaaaaaggtcacgaattagtactcgcgaatatcgccgaatcagatgcaggagtctatacttgccacgcagccaatctggccggacagcggaggcaggacgtcaacatcacagttgctacggtaccttcttggctcaagaaaccccaagattcacagcttgaggaaggcaagcctggatatctggattgtctgactcaggccacccctaagcctacagtggtgtggtaccgtaaccagatgctgatctcagaggactcaagatttgaagtgtttttggctaaagcccaaggactggaagaaggtgtggctgagaccctcgtactggtcaagtccctgcagagcaaggacgagcagcagcagttggacttcaggagagagctggaaatgttcggaaaattgaatcacgctaacgttgtccgcctcctcggactatgtagagaagctgagccacactacatggtgcttgaatatgttgatctcggagatcttaagcagtttctgagaatctcaaagtccaaagatgagaagctaaagtcacagcctttaagcaccaagcagaaggttgctctgtgtacgcaggtcgctctgggaatggagcacctctcaaataatcgctttgttcataaggacctagctgcaaggaattgcctggtttctgctcaaagacaggtgaaagtgagtgctctggggttgtccaaggacgtctataactctgagtactaccacttccgccaagcctgggttccccttcgatggatgtcccccgaagcaatcttggagggggacttttcgacaaagtccgacgtgtgggctttcggggtgttaatgtgggaggtattcactcacggagaaatgcctcacggtggccaggcggacgacgaggtgttggccgatctgcaggcagggaaggccaggctgccccaaccagagggctgcccatccaaattgtaccgcctcatgcagcgatgctgggccctcagccctaaggatcgcccaagctttagcgagattgcctcagcactgggggacagtacagtggactctaagccatag

SEQ ID NO: 202034 - DNA, 3093 bp, Artificial Sequence
  Description of Artificial Sequence: Synthetic coding sequence
atgggcgccgcccggggcagccccgcccggccccggcggctgcccctcctgagtgttctgctgctacccctgctggggggtactcagaccgcgatcgtgttcattaagcaaccatcgagccaggatgcgctgcagggtcggagagcccttctgaggtgcgaggtggaagcccctgggcctgtccatgtctactggttactggatggcgcacctgttcaggataccgagagacggtttgcccaagggtcatctctcagctttgccgcagtggataggctccaggatagcggcaccttccagtgtgtagcaagagacgatgtcaccggcgaggaggcacggagtgccaatgccagtttcaacattaaatggattgaggctggccccgtggtgcttaagcatcctgcttcggaggctgagatccagcctcagacccaggtcaccttgagatgccacattgatggccacccaaggcccacgtatcagtggtttcgagacggcactccactgtctgacggacagagtaaccacactgtgagcagcaaggaaagaaacttgactcttaggcctgctggacctgagcatagtggcctttactcctgctgcgcacatagcgcctttggccaagcctgctcatcccaaaattttacgctctctattgccgatgagtcttttgcccgggtggtcctggcaccgcaggacgtggtcgttgcacgatacgaagaggcaatgtttcattgccagtttagcgcgcagccaccaccctctttgcagtggctattcgaagacgagacaccgatcacaaaccgctcccgcccccctcacctccgccgtgccaccgtctttgctaatggcagcctgctattgactcaggtgcgcccccgaaatgccggtatatatagatgtattggacagggacagagaggaccccccattatcctagaagctacgctgcacttggctgagattgaggatatgcccttgttcgaaccaagggtttttacagccggctcggaagaaagggttacctgtcttccgccaaagggactcccagaaccatcagtgtggtgggaacacgccggcgtgagactgccaacgcatggtagggtataccagaaggggcacgagctggtgttggctaatatcgcggagagcgatgctggggtgtacacgtgtcacgctgcaaatctagctggccaacgcaggcaagacgtgaatataactgtcgctacagtgcccagctggctcaagaagccgcaggacagccagttggaagaaggcaagcctggctaccttgattgtctcacgcaggccactcccaagcccactgtcgtctggtatagaaatcagatgttaatttctgaggattctcgctttgaagtgttcaaaaacggcactctgcggatcaattccgtcgaagtctacgatggcacttggtacagatgcatgtcaagcacccctgcaggcagcatcgaggcccaggcaagggtgcaggtgcttgacggcagtagcctgcccgagtgggtgaccgacaatgctgggacattgcacttcgcgcgcgtaaccagagacgacgcaggaaactacacttgcatcgcaagcaatggacctcaggggcagatccgcgcgcacgtacaactcacagtcgccgtcttcattactttcaaggtggagccggagaggaccactgtgtatcagggtcataccgccctgctgcagtgcgaagcgcagggcgacccaaaacctctgatccagtggaaaggaaaagaccggatactggatcccacgaagttaggccctcgcatgcatattttccagaatgggtcgctggtcatccatgacgtggcaccggaggactctggacgctatacttgtattgctggaaattcatgcaacatcaaacatacagaagcacccctctacgtcgtagacaagccggtccctgaagaaagtgagggcccgggctctccccccccttacaaaatgatacagaccatcggcttgagcgtgggagctgcagtcgcttacattatcgcagtgctcggcctgatgttttactgcaagaagcgttgcaaagccaagaggctgcaaaagcaacctgagggagaggagcccgaaatggagtgcctgaacggaggcccccttcagaacggtcaaccttcggctgaaatccaggaagaggtagctctgacatctctcggatcaggaccggctgctacaaacaagagacattccaccagcgataagatgcactttcccaggtcctctcttcagcccattaccaccctcggaaagtcagaatttggagaggtcttcctcgctaaagcccagggcctggaggagggtgtggccgagacacttgtcctagtgaagtcgttgcagtccaaggatgaacaacagcaacttgacttccgcagggaactagagatgtttggcaagcttaatcacgccaacgtggtcagacttttaggactctgcagagaggccgagcctcactatatggtgcttgagtacgtggacttgggagatctgaagcagttcctgaggatcagtaaatctaaggacgagaagttgaagagtcaacctctcagcactaaacagaaagtagcgctgtgtactcaggttgctcttggaatggaacatctttcaaacaacaggttcgtgcacaaggatctggcggccaggaattgtttagtgtccgcgcaacgccaggttaaagtctctgcgttaggattgagtaaggacgtctacaacagcgaatattaccattttcggcaggcttgggttcctctgcgttggatgtccccggaggccatcctggagggcgactttagcacaaagtcagacgtctgggcttttggagtcctaatgtgggaggtgttcactcacggggagatgccccacgggggtcaagctgacgatgaggttctcgctgacctgcaggccgggaaagctagactgccccaaccagaaggatgcccgtcgaagctctatagactgatgcagcgctgctgggcgctttctccaaaagaccggccttctttcagcgagattgcctcagctctgggtgatagtactgtggactcaaaaccatag

SEQ ID NO: 202035 - DNA, 2823 bp, Artificial Sequence
  Description of Artificial Sequence: Synthetic coding sequence
atgggcgccgcccggggcagccccgcccggccccggcggctgcccctgctgagcgttttactcttaccattactgggcggaactcaaaccgccatcgtctttatcaagcagccaagttcccaagatgcactacagggacgacgggcattgctccgctgcgaagtggaggcccccgggcctgttcatgtctattggttactggatggggcacctgtgcaagataccgagcggcgatttgcccagggctcaagcctcagctttgctgccgtcgatcggcttcaggattcagggacctttcagtgcgtcgcaagagacgacgtgacaggcgaagaagccagatccgctaacgccagttttaatattaaatggatagaagccggtcccgtcgttctcaagcaccccgcttctgaagccgagattcaacctcagacccaggtaacgcttcgatgccacatcgatggacaccctaggcctacataccagtggttccgagacggtacacctcttagcgatgggcagagcaatcacacagtgtccagcaaagaaagaaacctgacactgcgcccagcaggtccagaacactcagggctttacagttgctgcgcgcactccgctttcggacaggcttgttcaagccagaatttcaccctttctattgcagacgagtctttcgcccgtgtcgtgctggctccacaagacgtggtggtggcacgctacgaagaggcaatgttccattgtcagttctcggctcagcccccacctagcctgcagtggctctttgaggatgagacccctattaccaataggtcacgtccccctcatttaaggagggccactgtgttcgctaatggatcgctcttattaacacaggtgcggccccggaatgctggcatttaccggtgcattgggcaggggcaacgagggccccctatcattcttgaagccaccctgcacctggccgagatagaggatatgccgctctttgagccacgtgtatttacagccggcagcgaagaacgggttacgtgtcttcctcctaaaggccttcccgagccctccgtttggtgggagcacgctggcgtgcgactgcctacacacggcagagtctaccagaaagggcacgagcttgtccttgccaacattgcggaatctgacgccggggtatatacatgccatgcggcaaaccttgcaggtcagcgcagacaggacgtcaatatcacggtcgccaatgggagcagtctacccgagtgggtgaccgacaatgcgggcacacttcattttgctagagtcacgcgggacgatgccggaaactatacgtgcatcgcttctaacggcccccaagggcagatccgcgcacatgtgcaactgacagtagccgtatttataacgttcaaggtcgaaccagagaggactacagtataccaaggacatacagctttacttcaatgcgaggcgcagggtgatcctaagccgttaattcagtggaagggaaaagaccggatccttgatccaacgaaactggggccacgcatgcacatctttcaaaacggctcccttgtgatccatgatgtggcccccgaggacagcggacgctacacatgtattgcagggaatagttgcaacatcaaacatactgaggcacccctctatgtggtcgacaagccagtgcccgaagagagcgagggccctggctctccgcccccctacaaaatgatacaaaccatcggcttatcagtcggagcggctgttgcatacatcattgcagtgttaggcttgatgttctattgtaaaaagcgctgtaaggctaaaaggctccaaaagcaacccgagggcgaggagcccgagatggagtgtctcaacggggggcccttgcagaatggccagccgtcagcagagattcaggaggaggtggccctgacaagcctggggtcggggccagccgctactaacaaaagacattcaacttcagataagatgcacttccccagatcttcgcttcagcctattaccacactgggtaaaagtgagtttggggaagtatttcttgctaaggcgcagggactggaagagggcgtagccgagaccctcgtgctagtgaaatcgctgcagtctaaggacgaacaacagcagctcgacttccgacgcgaacttgaaatgttcgggaaactcaatcacgccaatgtcgtccggctgttgggcctgtgccgagaggcagagccacactatatggtgctggaatatgtcgatctgggcgacctgaagcagtttctgcgcattagtaagtccaaagacgagaagctgaagtctcagccactttccaccaaacagaaggtagctctttgtacccaggtggccttaggcatggagcacctgagcaataatcgattcgttcataaagacctggctgcaagaaactgcctcgtcagcgcgcagcgccaggtgaaggttagcgcacttggcctcagcaaggacgtgtacaatagcgagtattaccacttccggcaggcctgggtgcccctcagatggatgagtcccgaagcgatattggagggggatttttctaccaagagcgatgtgtgggcattcggtgtgttgatgtgggaggtgttcacccacggtgaaatgccgcacggcgggcaggccgacgacgaggtcctcgctgatctgcaagccggtaaggcaaggctgccacaacctgagggatgcccgtctaagctgtacagacttatgcaacgctgttgggctctgtcacctaaggatcggccctccttttctgaaatcgcatctgccctgggagacagtaccgttgatagtaaaccctag

SEQ ID NO: 202036 - DNA, 3045 bp, Artificial Sequence
  Description of Artificial Sequence: Synthetic coding sequence
atgggcgccgcccggggcagccccgcccggccccggcggctgcccctgctctctgttttgctgctgccactgctaggcggcactcaaacagccattgtgttcattaagcagccctcttctcaggacgctctgcagggaaggagagccctgctgagatgtgaggtggaggcaccaggtccagttcatgtatattggctcctcgatggcgcccctgttcaggataccgagcgaagattcgctcaggggtcatcccttagctttgccgctgtggatcgcctccaggatagtggtaccttccagtgcgtcgcccgagacgatgtgactggcgaggaagccaggtcagcgaacgcgtcatttaatatcaagtggatagaggctggccccgtcgtactaaagcatcccgccagtgaagcggagattcaaccccaaacgcaggtgacactaaggtgtcatatcgacggccaccctcgcccaacctaccagtggttcagagacggcacccctctttctgacgggcaatcgaatcacacggtctcttccaaagagagaaacctgactctgcggcccgccgggccggagcactccggcctatacagctgctgcgctcacagtgcgtttgggcaggcctgttcgagccaaaatttcactttaagtattgccgatgagagcttcgctagagtggtgttagccccacaggacgtcgttgtcgcccgatatgaggaagcaatgttccactgtcaattctcagcacaaccccccccctccctgcagtggcttttcgaagacgaaacccccatcacaaaccgtagtagaccccctcacctgaggcgagccaccgtgtttgccaacggcagcctgctcttgacccaagtgagacccaggaatgcagggatatacagatgcattggccagggccaaagaggtcctcctataattttagaagccacactgcacttggccgagattgaagacatgccgctgtttgaacccagagtatttacggccggtagtgaagaacgtgttacgtgcttgcctcccaaaggcttgcctgagccctccgtgtggtgggaacatgcaggcgtaaggcttcccacccacggcagagtgtatcaaaaggggcatgagctggtgctcgccaacatcgccgagtcagacgccggcgtctatacctgtcacgctgccaatttggccggtcagaggcgtcaggatgtgaatattactgtagctacggttccgtcatggctgaagaagccccaagattcacagctcgaggaaggtaagcccggatatttggattgtttgacacaggccacccctaagcccactgtggtctggtataggaatcagatgttgatttccgaagacagtcggtttgaagtgtttaagaatggaactctccgaatcaactctgtggaagtctatgatggcacctggtatagatgcatgagcagtacccccgctggctcgatcgaagctcaggcaagagtacaagtccttgaaaaattgaagttcaccccaccccctcagcctcagcaatgtatggaatttgacaaagaggccaccgtgccctgttcagcgacaggacgggagaagcctaccatcaaatgggaacgggctgacggtagttccctccctgagtgggtgactgacaacgctggcactcttcatttcgcgcgggtcacaagggatgacgccgggaattacacctgtatcgccagcaatgggcctcaggggcagatccgagcccatgtgcagctgacagttgcagtttttattacgtttaaagtggagccagaacggacaacagtctatcagggacacacggctctgcttcaatgtgaggcgcagggagatcctaagccactgatccagtggaaggacaagccggtccccgaggaatccgagggcccgggctctcctcccccctataaaatgatccagactatcgggctgagcgtgggtgcggccgtagcttacatcattgccgtgctcggtttaatgttctactgcaaaaagaggtgtaaagccaagcggctccagaaacagcctgagggcgaagagcctgagatggagtgtctgaacggcgggcctctgcagaacggacagccttctgcagaaatacaagaagaggtagctctcacaagcctgggatccgggcctgccgcgacaaataagcgacattcgacaagcgacaagatgcactttccgcgttccagcttgcaaccgattaccaccctgggaaaatctgaatttggcgaggtttttctggccaaggcccaagggctggaagaaggggtcgctgaaacgctggttttggtgaagtctctgcagagcaaggatgaacaacaacagttggatttcaggagggagctggaaatgttcggtaagctgaaccacgctaatgtggttaggttactcgggttatgtcgagaagcagaacctcactatatggttttggagtacgttgatcttggggatctcaagcaattcttgcgaatctctaagtctaaagacgaaaagctaaagagccagccattgtctaccaagcagaaagtcgctttgtgcactcaggttgccttggggatggagcatctgtccaacaatcggtttgtccataaagacctggccgccaggaactgtctggtgtcagctcagagacaggtgaaagtttctgctttaggtctgtctaaggatgtatacaactctgagtattaccacttcagacaggcctgggtgccacttaggtggatgtctcccgaagccattctggaaggagacttcagtactaagtccgatgtgtgggcattcggagtactgatgtgggaggttttcacccacggcgagatgcctcatggcggccaggccgacgacgaggtactggccgacttgcaggccggaaaagcaaggctcccgcaacctgagggctgtccttcgaaactgtaccgtctgatgcagcgctgttgggctctctcacccaaagatcgtccctctttctcggagatagcctctgcactgggagactctacagtggatagtaagccatag

SEQ ID NO: 202037 - DNA, 1212 bp, Artificial Sequence
  Description of Artificial Sequence: Synthetic coding sequence
atgggcagcttcctgagcggcgagaagcggcccagcgcccccaccgtgggctctgccatggagaaaaaagaattccccacccctccagggcgggttggccccggaacgcaaactgcaatcgtatttattaagcagcccagttcacaggatgcactgcagggcagacgcgccctgcttagatgcgaagtggaggcccctggcccagtccacgtgtactggctccttgacggggcccctgttcaggataccgaacgtagatttgcccagggctctagcctttcctttgccgcagtggaccgcctgcaggactccggcaccttccaatgcgtcgcccgggacgatgtgaccggcgaggaggctcggtccgcgaacgccagcttcaacattaagtggattgaggcaggccccgtggtgcttaagcacccagccagcgaagcggaaatccagcctcagacgcaggtgaccttgaggtgccacatagacggccatccccggccaacctatcagtggtttcgggacggcaccccgctgtccgacggccagtccaatcacaccgttagcagtaaagaaaggaacttgacgctccgaccagccggacctgaacattccggactttattcgtgttgcgcacactcggcctttggccaggcttgctcttctcagaactttaccttgtctatcgctgatgagtccttcgcgcgtgtggtactggcccctcaggacgtggttgttgcacggtatgaggaagccatgtttcattgccaattctcagcccagcctcctccatctctgcaatggttgtttgaggacgagacccccattaccaaccgctctcgcccacctcacctccggagagccactgtgttcgcgaacgggagcctgcttctgacccaggtccggcctcgcaatgctggaatttacagatgtataggccaggggcagcgcggccctcctatcatcctggaggctactctccacctggctgaaattgaagacatgcccctcttcgagccccgggtgttcacagctggatcggaggaaagggttacctgtctcccccccatggccggcagcacacgaagagccaccagctggtgctggcccatcctgctgaaagttatgcttgtatctacccctgcaactaggccaacatggcttgtttcaggagaccggatgtccactagcctatggccactgtgcccacccggatag

SEQ ID NO: 202038 - DNA, 810 bp, Artificial Sequence
  Description of Artificial Sequence: Synthetic coding sequence
ttcagcgcccagcccccccccagcctgcagtggctgttcgaggacgaaacgcctatcacaaatcggagcaggcccccacacctcagacgtgccaccgtctttgcaaacggatcactgctactgacacaggtcaggccaaggaatgcagggatttatcgctgtatcggccagggtcaacgaggacctccgattattctagaggcaactctgcacctggcagagatcgaagatatgcctctgttcgaaccaagagtgttcacagctggctctgaagaacgcgtaacctgcctgcctcccaaaggtctccctgagcctagtgtttggtgggaacacgctggtgtgcggctccccacccatggacgagtgtaccagaaaggccatgaattagttctggctaatatagccgagagcgacgcgggggtatatacatgccatgccgctaatcttgcgggacagcgccgccaagatgtgaacattacagtggccagcgaacacctgtgccctgagggccagggggaagtcgagggaaacaccggccttggcgtaatggatcgcggcttccctgccgtccccagctggcttaagaagccacaggattcacagctagaagagggcaagccaggctacctggactgtctcacccaggccaccccaaaacccaccgtggtctggtatagaaatcagatgttgatatcagaagattctagatttgaagtgttcaaaaatggaaccctcagaattaattccgtggaggtttacgatggcacatggtaccgctgcatgtcgtctacacccgcgggcagcatttag

SEQ ID NO: 202039 - DNA, 444 bp, Artificial Sequence
  Description of Artificial Sequence: Synthetic coding sequence
atgggcgccaccggcctgggcttcctgctgagctggcggcaggacaatttgaacggcaccgattgtcaggggtgcaatatcttgtacttctccgaaaccaccggcagtatgtgctctgagctctctctgaaccggggactggaagctcgcagaaagaaggatctgaaagatagctttttatggcgttacgggaaagtgggctgtatctcgctgccacttagggaaatgacagcatggatcaatcctcctcaaatttccgaaatcttccaggggtaccatcaacgagtacacggcgcggacgctctctctttgcagaccaactccctacgctcgagattgtccagccagtgcttaggccagtcgttcttacttagaactcttgaacggggcaggggcttccgtgcactcggcgatatttgtggtcacgtgcacgaggaagattag

SEQ ID NO: 202040 - DNA, 216 bp, Artificial Sequence
  Description of Artificial Sequence: Synthetic coding sequence
atgggcgccaccggcctgggcttcctgctgagctggcggcaggacaatttaaatgggactgattgccagggctgcaacatcctgtatttctctgaaacaaccgggtcaatgtgctcagagttgagtttaaatcgtggacttgaggcaagaagaaagaaggacttgaaggactcctttctctggagggacggagtgtccccttgtctgccgtgctag

SEQ ID NO: 202041 - DNA, 444 bp, Artificial Sequence
  Description of Artificial Sequence: Synthetic coding sequence
atgggcgccaccggcctgggcttcctgctgagctggcggcaggacaaccttaacggcacagactgtcagggttgcaatatcctgtacttttcagagacgactggcagcatgtgttccgagctgtctctcaatcgaggtttagaagctagaagaaagaaggacctcaaggattcatttttgtggagatatgggaaagtcggctgtatctcccttcctctgcgcgagatgaccgcatggattaatccgcctcaaatatctgagatttttcaggggtatcaccagcgggtccacggcgcagacgcactgtcccttcaaacaaatagtttgagatctaggcttagctcccagtgcttgggccagtcattcctgttaagaactcttgaaagaggacgcggattccgtgccctcggcgatatttgcggtcacgttcacgaggaggattag

SEQ ID NO: 202042 - DNA, 216 bp, Artificial Sequence
  Description of Artificial Sequence: Synthetic coding sequence
atgggcgccaccggcctgggcttcctgctgagctggcggcaggacaacctaaacggaacagattgtcagggttgcaatatcctttacttctccgaaactacgggctctatgtgcagcgagctatcgctgaaccgtggactagaagcgaggcgcaaaaaagatttaaaagatagcttcctgtggagagacggggtgtcgccatgcttgccgtgttag

SEQ ID NO: 202043 - DNA, 3561 bp, Artificial Sequence
  Description of Artificial Sequence: Synthetic coding sequence
atgagcgtggcctgcgtgctgaagcggaaggccgtgctgtggcaggactcgtttagccctcacctgaagcaccaccctcaggaaccggctaaccctaacatgcctgtcgtgctgactagtggtactggctcccaggcccagcctcaacccgcagctaaccaggcgctggcagccggaacccatagcagccccgtgcctggttctatcggagtggccggaaggtcccaggacgatgcaatggtggactactttttccagcgacaacacggcgaacaactcggcggcggcggcagcggcggaggcggatacaataattccaagcaccgatggccaaccggggacaacatacatgccgagcaccaagttcggtctatggacgagctgaaccacgactttcaagctctcgccctggagggaagggctatgggcgagcaactgttgccggggaagaagttttgggaaacagacgagtcaagtaaagatggcccaaaaggtattttcctcggagatcagtggcgggactctgcatggggcacatcagatcattcagtcagccaacccataatggtacaaaggcgtccagggcagtcatttcacgtgaacagtgaggtcaattctgtcttatccccacggagcgagagtggtggtctaggagtgagtatggtggagtatgtactttcaagcagtcctggagactcctgcttgcgaaaggggggattcggcccgagagatgccgactccgacgagaacgataaaggtgagaaaaagaataaggggacatttgatggtgacaagttaggagacctcaaagaggagggtgatgtgatggataagacaaatgggctgcctgtacagaacggaattgacgcagacgtcaaggatttttccagaacccctggaaattgccagaacagtgctaacgaggtcgatctcctcggccccaaccaaaatgggtctgaaggcttggctcagttgacaagcactaatggcgcaaaaccagtagaggacttctcaaatatggagtctcagtccgtgccgctggatcctatggaacatgttgggatggagccactccagtttgattatagtgggactcaggtcccggttgatagcgccgccgccactgtgggccttttcgactacaattcgcagcagcaactcttccagcgtccaaacgcactggcagtgcagcaattaacggcagcacagcagcagcagtatgcgctggctgcagcgcaccaaccccacattggtctggctcctgccgcattcgtaccaaacccctatatcatcagtgccgctcccccaggcaccgatccctataccgctgggctggctgccgccgccaccctgggtccagccgtagtgccacaccagtactacggcgttacaccttggggcgtgtaccccgctagcctgttccaacagcaggccgcggcagccgccgcagcaaccaacagcgcaaatcagcagactacccctcaggcacaacaaggtcagcaacaagtcctgcgtgggggtgccagtcagagacccctgactccgaatcagaaccagcagggtcagcagactgaccccctggtagctgcggccgctgtcaattcggccctggcattcgggcaggggttggctgcaggaatgccaggatatcccgttttggctcccgctgcctactacgaccagaccggcgcactggtcgtgaacgccggagctcgcaacggactcggcgcacctgtgagactcgtcgcgcccgctccggttatcatctctagttctgctgctcaggccgccgtggcagcagctgcggcctccgccaatggcgccgcaggtgggctggccgggactaccaacgggcccttcagaccccttggaacccaacaaccccagccacaaccacagcaacagccgaacaataaccttgcgtcgagttctttttatgggaataacagtctgaacagcaattcacagagctcttccctgttcagccagggatctgcccagcctgccaacacttccctcggcttcggatcctcgtccagcctaggtgctaccctaggctctgctctcgggggctttggtacagctgtggctaattccaataccggatccggaagtcgtcgcgacagcctgacgggatccagcgacctgtacaagcgcacaagttcctccctgacaccaattggccactctttctataatggcctgagcttttcctcgagccccgggcccgttggaatgcccttgccatcccagggccctggacattctcagacacctccgcctagcctgtcctcgcatgggtctagctctagcctgaacttaggagggctgacaaatgggagtggacgctacatctccgccgccccgggagccgaggctaagtacaggtctgcctctagtgcaagctctttgtttagcccctccagcaccctgttcagctcgagcagactgcggtatggaatgagcgatgtaatgcccagtggtcgatccaggctcttagaggattttaggaataatcgttatcctaacctacaattgcgtgaaatcgcaggccacatcatggagttctcacaggaccagcacggcagcaggttcatacagctcaagctggagcgcgccacgcccgccgaacgccagctggtgtttaacgaaattctgcaggcagcctaccagctgatggtagacgtatttggaaattatgttatccagaaattctttgaattcggaagtctggaacagaagttagctctggcggaaaggatccgtggccacgttctatcgcttgctttgcagatgtatggctgcagggtcatccaaaaagcgctggagttcatccccagtgaccaacagaacgaaatggtcagggagctggacggtcatgtgctgaaatgtgttaaagaccagaatggcaaccatgttgttcagaagtgcatagaatgtgtgcagcctcagtctctgcagtttatcatagatgcattcaaaggacaggtgtttgcactgtcaactcacccctacggttgcagggtaatacagcgaatcctggaacactgccttcctgaccaaaccctgcccatcctcgaagaactgcaccaacacacagagcagctcgtccaagaccaatatggcaattacgtgattcagcacgtcttggagcacggccgcccagaggacaaatcgaagattgtggcagaaatacgcgggaatgtgctggtattatcccagcacaagttcgctagtaatgtggtggagaagtgcgtgacacatgcttcacgtacagagagagctgtcctgatcgatgaggtctgtacaatgaatgatgggccccattccgccctttacactatgatgaaggatcaatatgcgaactacgttgtacagaagatgatcgacgttgccgagcccggacagaggaagatcgtcatgcataagatccgcccacatattgccaccctgagaaaatatacctacgggaagcatatcctggcaaagctggaaaagtattatatgaaaaacggagtggacttgggaccaatctgcgggccacccaatgggattatctag

SEQ ID NO: 202044 - DNA, 2781 bp, Artificial Sequence
  Description of Artificial Sequence: Synthetic coding sequence
atgagcgtggcctgcgtgctgaagcggaaggccgtgctgtggcaggatagtttcagtcctcatttgaaacaccatccccaggaaccagcaaacccaaacatgccagtggtcctgaccagcggcacggggtcacaagcccagccacaacctgctgctaatcaggcccttgctgcaggtacccacagcagccctgtcccgggaagcattggtgtggccggtaggtcacaagatgatgctatggtggactatttcttccagaggcaacatggagaacagctcggcggtggaggaagtggagggggaggctacaataattctaagcacagatggcctactacggtgggtctgttcgattacaactcacagcagcagctctttcagaggccaaacgctttggcagtgcagcaattgactgcagctcagcagcaacaatatgctcttgccgccgcccaccagccacatatcggcttggctcccgctgcgtttgtacccaacccttacatcatctccgccgcaccccccggcaccgacccttataccgctggactggccgccgctgctaccctcgggcctgccgtagttcctcaccagtattacggtgtcaccccatggggagtctatcccgcctcactgtttcagcagcaagccgccgccgctgcagctgccaccaatagtgccaaccagcagaccacaccacaggctcaacaaggccagcagcaggtgctgagaggaggcgccagccagcggccattgacgcccaatcagaaccaacaaggacagcagactgatccgctggtggctgccgcggccgtaaacagcgcactggcgttcgggcagggtttggcagcgggcatgcccggctaccctgtcctggcacccgctgcctactacgaccaaactggggcacttgtggtgaacgccggagctaggaacggcctcggtgctccagtacgcctcgtggctcccgcccccgtgatcatctcatccagtgccgcacaggccgctgttgcggcggctgccgcttctgcgaacggcgcagctggaggcctcgccggaactaccaacggtcccttcaggccactggggactcagcagccacagccccagccccaacagcaaccgaacaataacctggcctctagttctttttatggtaataacagcctgaactctaactcacagtcctccagtctgttttctcaaggctcagcccagccagccaacacctccctcggttttggctccagctcttcgctcggagccacactgggtagcgcactcgggggcttcggcaccgcagtcgctaattcgaatacaggtagcggatcccgacgtgactcgttgaccggaagttccgatctctataagcggacttcatcgagtcttacacccatcggacactccttctacaatgggctctcttttagttctagcccaggtccggtgggcatgccactgccgagccagggtcccggtcactctcagactcctccgccctctctgtcctcacatgggtcgagtagtagtctcaatcttggtggcttgaccaatggaagcggtcgatatatatctgccgcgccaggagccgaagcgaaatatcggagcgcaagcagcgcgagctccctgttctcccctagctcaactttgttcagctcatcgcgactgcggtacggcatgagtgatgttatgccttcaggtcgaagccgcctgctggaggatttcagaaacaaccggtatcccaacctgcaacttagagaaatagcgggacacataatggaatttagccaggaccagcatggctccaggttcatacagttgaaattggagagagctactccagcggaacgtcagctcgtctttaacgaaatcttgcaggccgcgtatcagttgatggtggacgtctttggtaactacgtgatacaaaaattcttcgaatttggaagtttggagcagaaacttgccttggccgaacgaattagaggacacgttttatcgcttgcgctgcagatgtatggatgtagggtgatacagaaggcactggaattcatcccttccgaccagcaagttattaatgaaatggtgcgcgagctggacgggcacgtgctgaaatgcgtgaaggatcaaaatggcaaccatgtggtccaaaagtgcattgaatgcgtacagcctcagtccctgcaattcatcattgacgcattcaaaggtcaagtttttgccttgtctacccacccttatgggtgccgggtcattcagaggatcttggagcactgcctgcccgatcagacgctccccatactagaggaactccatcagcacaccgagcaattagtgcaggaccagtacgggaactacgtgatccaacatgtgttagagcatggccgccccgaagataaatccaagatcgtggccgaaattcgagggaacgtgctggtgctatcacagcataagttcgccagcaatgtcgtggaaaaatgtgtaacacatgccagtaggacagagcgggctgttcttattgacgaggtctgcacgatgaacgacggtcctcacagtgccctatatacaatgatgaaagatcagtacgctaattatgtggtccagaaaatgatagacgtagcggagccaggccaaagaaaaatcgtgatgcataagatcagaccccacattgctactctgagaaagtatacatacggcaaacatatccttgccaagctggagaagtattacatgaagaacggagtagatctaggcccaatctgtgggcctccgaatggcattatatag

SEQ ID NO: 202045 - DNA, 3135 bp, Artificial Sequence
  Description of Artificial Sequence: Synthetic coding sequence
atgagcgtggcctgcgtgctgaagcggaaggccgtgctgtggcaggatagctttagcccacacttgaagcatcaccctcaggaacccgctaatcctaacatgcccgtggtgcttaccagcggtaccggatcccaagcccagcctcagccggccgccaatcaggctctggccgctgggactcatagctcacctgtgccaggatcgattggtgttgcaggtcgctctcaggatgatgccatggtggactatttcttccagcggcagcatggcgaacaactggggggtggcggaagtggcggcggagggtataacaactcgaaacaccgctggcccactggggacaacatccacgccgaacatcaggtacgcagtatggacgagttgaaccatgactttcaggccttggctctagaaggccgcgccatgggggagggcccacgcgacgccgactctgacgaaaatgataagggggagaagaaaaacaaagggaccttcgacggcgataaacttggggatcttaaggaggagggcgacgttatggacaagactaatggattacctgtccaaaatggcatcgacgctgacgttaaagattttagcaggaccccaggcaactgccaaaacagcgcgaatgaggtggaccttttgggccctaaccagaacggcagtgaggggttagctcagctcacgtctacgaacggagccaagcccgtggaggacttttcgaatatggaaagtcagagcgtcccattggaccccatggaacatgtgggcatggagcccctgcagttcgactatagcggcacccaggtgcccgtcgactccgccgcagcaactgtaggcctgttcgactacaactcacaacagcagctgttccaacggcctaatgcgctcgccgttcaacaactgaccgccgcccagcagcagcaatatgccctggcagctgcccatcagcctcacattgggctcgcacccgccgcctttgttccaaacccatatatcatttccgcagcccctccagggacggacccctatacagcgggcctggctgcagccgctacgctgggcccagccgttgtgccccaccagtattatggcgtcaccccatggggggtgtatccagcatcgctgttccagcagcaggctgccgctgcagccgctgctaccaattccgccaatcagcagactactccccaggctcagcagggacaacagcaggtgctgcgcggtggtgccagccagagaccccttactcccaaccagaaccagcaaggacagcagactgatccactcgtcgcagccgccgctgtcaactctgctctggcctttggacagggcctggcggctggcatgccagctgtagccgccgcagcggcatcggcaaacggagcagctggtgggctcgctggcactaccaatggcccttttcggcctctgggaacacagcagccacaaccacagcctcagcagcagccaaacaataaccttgctagcagttcattctacggaaacaacagtctcaacagtaatagtcagagctcaagtctgttctcccagggtagcgctcaacctgcaaacacaagcctgggcttcggatcttcttccagcctgggcgccactctgggaagcgctctgggggggttcggaacagcagttgcaaattcaaatactggctccgggtcacgccgggactcccttaccggttcctccgacctctataaacgaacttctagctccctgacacccattggacactcattttacaacgggttaagtttctcgtcatctccaggacctgtgggcatgcctctacccagccagggccctggccactctcagaccccgcccccaagtctttccagccacggctccagcagtagcctgaacttgggaggactgacgaatggcagcggacggtacatctccgccgcccccggcgctgaggccaagtacaggagtgcgtctagcgccagctcgctgttctcgccatcctctactctgtttagctcatcacgactccgctacgggatgtctgacgttatgccatcgggtagaagcaggctgttagaggactttcgtaataataggtatcccaacctccagttgcgcgaaattgccggtcatatcatggaattctcacaggaccagcacgggagccgatttatccagctaaaactggaaagagccactcccgctgaacgccagctcgtttttaacgaaatactacaggccgcttaccaactaatggtggacgtgttcggcaactatgttattcaaaagttcttcgagtttggctcattagagcaaaagctggctctggctgaacggataaggggacacgtgttgtccctggctttgcagatgtacgggtgccgcgtgatacagaaggctctggaatttatcccgtcagaccaacaggtaattaatgagatggtcagagaattagatgggcacgtcctaaaatgcgtcaaggaccaaaatggcaatcacgtcgtccagaagtgtatcgaatgtgttcagcctcagtcattgcagtttattatcgatgccttcaaaggtcaggtgttcgcactctcgacacacccttacggttgcagggttatacaaaggatactagagcactgtctgccagaccagacactgcctatcctagaagagttacatcagcacacagaacagctggtgcaggaccaatacgggaattatgtcattcagcacgtacttgagcatggccgtccagaagacaagtccaaaatcgttgctgagatacgcggtaacgtgctggtactgtctcaacacaagtttgcgagcaacgtggtcgaaaaatgtgtcacccatgccagtaggactgaacgggccgtgctgatagacgaagtctgcacaatgaacgacggaccccacagtgcgctgtacactatgatgaaagaccagtacgccaactacgtggtgcagaaaatgattgatgtggccgaacctggacagcgaaaaatagtaatgcacaagatacgaccccacattgccacgctgaggaagtacacctacggaaagcacatcctggctaaactggaaaagtactatatgaagaatggcgtcgacctggggcctatctgtggacctcccaacggcatcatctag

SEQ ID NO: 202046 - DNA, 3567 bp, Artificial Sequence
  Description of Artificial Sequence: Synthetic coding sequence
atgagcgtggcctgcgtgctgaagcggaaggccgtgctgtggcaggatagcttttcccctcacctgaagcaccatcctcaggaacccgctaatccgaacatgcctgtcgtactgacttctggcactgggtcccaggcacagccacagcccgctgccaaccaggcattggccgccggcacacactcctcacctgtcccaggtagcattggagtggctgggcggagccaggatgatgcaatggtggattatttctttcagaggcagcatggagaacaactgggaggggggggatccgggggcggcgggtataacaactcaaagcacagatggccaaccggcgataacatacacgccgagcaccaggtaagaagcatggatgagcttaaccacgactttcaggcattagcactggagggacgagctatgggggagcaattgctgccaggaaagaaattttgggagactgatgagtctagcaaagacggccctaagggcatctttcttggggaccagtggagagactcggcctggggcacatctgaccacagtgtgtctcagccgattatggtgcagcgacgccctggccaaagttttcacgtaaattccgaagtgaacagcgtgctgagtccgaggtcagaatccggaggtctcggcgtgagcatggtggaatatgtactaagttcttccccaggcgacagctgcttacgaaaaggtgggttcgggccccgggatgccgattctgatgagaatgacaagggcgagaagaaaaataaggggacttttgacggcgataaacttggagatctgaaagaggagggggacgtaatggataaaacaaacggcctgccggtgcagaacggaattgatgccgatgtgaaagatttttcacgcaccccaggtaattgccagaattcagcaaatgaggtggatctcctgggaccaaatcagaatgggtctgagggactggcccagctgacttcaaccaatggtgccaagcctgtagaagatttttcaaatatggagtctcagagtgtcccgttggaccccatggagcatgtggggatggaaccactacaattcgactacagtggaactcaggtgccagtggacagcgcggccgccaccgtagggctgttcgattataacagtcaacagcaactgttccagaggcccaacgcgctagctgttcagcagctcactgcagcacagcagcagcagtacgcactggccgccgctcaccagcctcatattggcctcgctcccgcggcctttgttcctaatccctacatcattagcgctgcacctcccgggactgatccatataccgctggcttggcagccgcggctaccctgggccccgctgtggtgcctcaccagtactatggcgttacaccttggggcgtgtatccagcctccttgtttcagcaacaagctgcagctgccgcagcagccaccaacagcgccaatcagcagaccacccctcaggctcagcagggtcagcagcaagttttacgtggtggagcgtctcaaaggccgttgacccctaatcagaatcagcaaggacagcagactgatccccttgtggccgctgccgccgttaacagcgctttggcctttggacagggactggcagcagggatgccagggtaccctgtcctggccccggccgcctactacgaccaaacaggagcgttagttgtcaatgccggcgcgagaaatgggctcggcgctcctgtacgcctcgtggcacctgcccctgtgattatttcctcaagtgccgctcaggccgctgtggccgctgcggctgcctctgctaacggcgccgccggcggactcgcagggacaacaaacggcccatttcgtccattgggcacgcagcagccacagccacaaccacagcagcagccaaacaataatctcgcatccagctccttttatggcaacaactcacttaatagcaactcccagagcagtagcttattctcacaaggctcggctcagccagcaaacacgagtctcggttttggttctagctcttctctcggcgccactcttggcagtgccctgggaggctttggcactgccgtagctaattcaaataccggttccgggagccggcgcgattctctgactggtagttctgatctgtacaaacggacaagctcctctctgaccccaattggacactccttctataacggactttctttcagctccagtccaggcccggtggggatgccactgccgagtcagggaccaggccacagccagactcctccgccttccctttcatctcacgggtcaagcagctctctgaatctagggggactgactaacggctctggcagatacatttcagccgcacccggcgccgaggcgaagtataggtccgcgtcgagcgcttcttctttgttttcaccaagctcgaccctgttctcaagcagcaggctcaggtacgggatgagcgatgtcatgcccagcgggcgttcccggttgctggaagatttccgtaacaatagatatcccaatcttcagctgcgtgagattgctggacacattatggagtttagccaagatcagcatggtagcaggtttattcagctcaaattagagcgtgcgacaccagccgaacggcaactggtgttcaacgaaatactgcaggctgcttaccagttgatggtggatgtgtttgggaactatgtcatccagaaatttttcgaattcgggagtctcgagcagaaattggcccttgctgagagaatcaggggtcatgtattgtcgctcgccctccagatgtatggatgtcgtgtcattcagaaagcactcgagttcatacccagtgatcagcaggttattaatgaaatggtgagagaattggatggacacgtcctgaagtgtgtcaaggatcaaaacgggaatcacgtggtacaaaagtgtattgagtgcgtgcagcctcaaagcctgcaatttatcatcgacgcctttaagggccaggtgttcgccctgtcgacccatccctatggatgcagggtgatccagagaattttggaacattgtttaccagatcagacgctgcccatcctagaggagttacaccagcatacagaacagcttgtgcaggatcagtatggaaactatgtcatccagcatgtactagaacacggccgacccgaggacaaatccaagattgtcgcggaaatacgcggaaatgtgttggtgctgagccagcacaagttcgcttccaatgtggtggagaaatgcgtgacccacgcttcaaggacagaaagagccgtactgattgacgaagtgtgcaccatgaatgatggtccgcattcagccttgtataccatgatgaaggaccagtacgctaattatgtggtccagaagatgattgatgtggcagaaccaggacaacgcaagattgtgatgcataaaattcggcctcatatagccaccctgaggaagtacacttacggtaaacatatacttgcaaagttagaaaagtactatatgaagaacggcgtcgacctggggcccatatgtgggcctccgaatggaattatctag

SEQ ID NO: 202047 - DNA, 3489 bp, Artificial Sequence
  Description of Artificial Sequence: Synthetic coding sequence
atgagcgtggcctgcgtgctgaagcggaaggccgtgctgtggcaggactcatttagcccacacctgaagcaccacccacaagaacctgcgaatcccaacatgccagtggtgctcactagcggcactggaagccaggcccagccccagccggcagctaaccaggccctagcggccggcacccattcttctccagtgcccggttcaattggggttgccggtaggagtcaggatgacgccatggttgactatttcttccaaagacagcatggagagcagctgggcggggggggctctggtggcggtggctacaacaactcaaaacatcggtggccaaccggtgacaacattcacgcagagcaccaggttcgcagcatggatgagcttaaccatgactttcaagcgctggcattggaggggagagcgatgggggaacaactgctaccggggaagaaattttgggagaccgacgaatcttccaaggatggcccgaaaggcatctttctcggcgatcagtggagagactccgcttggggcacctccgatcacagcgtgagtcaacctatcatggtgcaacgtaggcctgggcagtcattccatgtcaactcagaggtcaatagtgtgctttctcctcgcagcgaaagcgggggactcggggtctctatggtggagtatgtactgtcaagctcccctggcgacagttgtctgcgtaagggcggctttggtccacgggatgccgattccgatgaaaacgataagggggaaaagaaaaataaaggaactttcgatggtgataagttaggagacttgaaagaggaaggggatgtgatggataagactaacggactcccagtccagaacgggatcgacgccgatgtaaaagacttttcacggactcccggcaattgtcagaattccgctaacgaagtcgatctgttaggcccaaaccagaacggatcggaaggtctggcccagcttactagcactaacggggccaaaccagttgaggacttctccaatatggaatctcagtccgtgcccctggatccaatggaacacgtagggatggaaccgttgcaattcgattactccggaactcaggtcccggtggacagtgcagctgcaacagtggggcttttcgactataactcacagcaacaactttttcaaagaccgaacgcactcgctgtacagcagctgaccgccgcgcaacagcaacagtatgccctagcggctgcccatcagcctcacattgccggtctcgctcctgctgcattcgtgccgaacccctacatcatttcggccgcccctccaggcaccgacccttacacagctggccttgcagctgccgcgaccctgggacccgctgttgttccccatcaatattatggcgtgacaccatggggggtctatcccgccagcctctttcagcaacaggcggcagcggctgccgcagctaccaactctgccaaccagcaaacaactcctcaggcccagcaaggtcagcagcaagtcttgaggggcggcgcttcccagagaccattgactccaaaccagaaccagcagggtcaacagactgatcctctggttgccgccgcagcagtgaatagcgcgttggcattcggccaaggacttgccgctggaatgcctgggtatcccgtgctggcacccgccgcctactatgaccagaccggtgctcttgtggtgaacgccggcgccaggaatggcctcggtgcacctgttcgcctcgttgcgcctgctccggtcatcatttcctctagcgctgcccaagctggaactcagcagccgcaacctcagcctcagcagcagcccaacaacaacctcgcaagctcttcgttctacggcaataattcactcaattctaattcccagtcatcttcgttgttctcccagggatcggcccagcctgccaacacatctttaggattcggcagctctagctccctgggggctacccttgggagtgcactagggggctttggtaccgccgtggctaactccaatactggtagcggctccaggcgtgacagtctgacaggtagttctgacttatacaaaaggaccagctcttcgctgacccctatcggacattcattctataatggactgtcattctcctcatccccagggccagtgggcatgccgcttccgtcccagggacctggacattcacagactcctcctccgtcactctcttctcatggttcatcctctagcctcaatctcggcggattaacgaatggaagcgggcgctacatctccgcggcgcctggcgccgaggctaagtacagaagcgccagctcggcgtcatctcttttctcccccagctccacactgttttcctcatcacggctgagatacggtatgtccgacgtcatgcctagcgggcggtcaagattgctcgaagacttccgcaataaccgttatcctaatctgcagctgcgggagatcgctgggcatattatggagttctcccaggaccaacacgggagcagattcattcagctgaaactcgagcgggctacccctgctgaacggcagcttgtgtttaacgagattctgcaggcagcctaccaactgatggtggacgtgttcggaaactatgtcatccagaagttctttgagttcggcagcctggagcagaaactggcgctagccgagcgaatccgagggcacgttctctctctcgcactgcagatgtacggctgccgagtgatccagaaagccctggaatttattccatccgatcaacaggtgataaacgagatggtgcgcgagttagacggacacgttttgaaatgtgtgaaagaccaaaacggtaaccatgtggtccagaagtgcattgagtgcgtgcagccacaatcgctccaattcatcattgatgcctttaaaggccaagtgttcgccctgtctacacatccctatggctgtcgggttatccagcggatcctggagcactgcctaccagaccagactcttcccatactcgaagaacttcaccagcacactgaacagctggtacaggaccaatacggcaactacgtgatccaacacgtcctggagcatgggaggcccgaagataagtctaagattgtcgctgagattcgcggcaacgtgttagtcctgtctcagcataagtttgcctccaatgtggtggaaaagtgcgttacacacgcatctaggacagagcgagccgtcctgattgatgaagtatgtacaatgaacgacggtccacatagcgctctgtacactatgatgaaagatcagtatgccaattacgtggtgcagaagatgattgacgttgccgaaccgggtcagcgaaagattgtcatgcataagatccggcctcacatcgccaccctccgaaaatacacctatggaaagcatattctggccaaactcgagaaatactacatgaaaaatggggtggatctgggccccatctgcggcccacccaacggaatcatctag

SEQ ID NO: 202048 - DNA, 291 bp, Artificial Sequence
  Description of Artificial Sequence: Synthetic coding sequence
atgagcgtggcctgcgtgctgaagcggaaggccgtgctgtggcaggatagtttctcgcctcatctcaagcatcacccgcaggagccagctaatcctaacatgcccgtggtgctgacatctggaacgggctcccaggctcagccccagccagcagccaaccaggctttggcagccggaacccattcttctcctgtgcctggaagtattggagtggcaggtaggagccaggacgacgccatggtcgactatttttttcagagacagcacggggagcagctgggcgggggatag

SEQ ID NO: 202049 - DNA, 1551 bp, Artificial Sequence
  Description of Artificial Sequence: Synthetic coding sequence
atgagcgtggcctgcgtgctgaagcggaaggccgtgctgtggcaggactcatttagtccccacctgaaacaccaccctcaggaaccagccaacccgaacatgccagtggtcctcacttcagggacagggagtcaggctcagccccagcctgccgctaaccaggctctggccgccggtacccatagttcccctgtccccggcagcatcggagtcgcaggcagaagccaggatgacgccatggtcgattattttttccaaaggcaacacggagagcagctcggcggtggcggatccggtggtggcggttacaacaactccaaacatagatggccaacaggggacaacatccatgcagagcaccaggtgcggtctatggacgaattaaaccacgatttccaggccctcgccctcgaaggcagggccatgggggagcaattacttcccggcaaaaagttctgggaaacagatgagtcaagtaaagacggaccgaaagggatcttcctgggtgatcagtggcgcgacagcgcgtggggcacatctgatcattcagtgtctcagccaattatggttcagagacgacccggccaatcatttcatgtgaattctgaagtcaacagcgtgctttcaccacgctccgaatctggaggcctcggagtaagcatggtcgagtacgtgcttagctcctccccgggcgacagctgcctgaggaagggaggcttcggccctcgcgatgctgactctgacgaaaacgacaaaggagaaaagaagaacaaaggtactttcgacggcgataagctgggggacttaaaagaggagggcgacgtcatggacaagaccaatggcttgccagttcagaatggcatcgacgccgacgtcaaggatttcagtcggaccccggggaactgtcagaactccgctaatgaggtggatctcttgggaccaaaccagaacgggagcgaggggctggctcagttgacgtcaactaatggcgccaaacctgtagaagacttttcgaacatggagtcacaaagcgtccctctggatcctatggagcacgtaggcatggaaccactgcagtttgactatagtggcacacaagtccccgtagactctgcagcagcgactgtgggtctgtttgactacaacagccagcagcagctgttccagagacctaacgctctcgcagtgcaacagctcaccgccgcacagcagcagcaatatgccttggctgccgcccatcaaccgcatataggtctcgcaccagctgccttcgtgcctaatccctatattatttcagctgctccccctggaaccgacccctatacggcgggcctggctgctgcagccaccttggggcctgccgttgtgccgcaccagtattatggtgttaccccatggggcgtctatccggccagcctctttcaacagcaggccgcggctgcagctgccgccacaaactccgcaaatcagcagacgacaccacaagcccagcagggacagcagcagactgaattctgtttctgttgccctggttggtccgctatggtgtag

SEQ ID NO: 202050 - DNA, 2964 bp, Artificial Sequence
  Description of Artificial Sequence: Synthetic coding sequence
atgaaccacgacttccaggccctggccctggagagccggggcatgggagaactactgcccacaaagaagttctgggaaccagatgattccaccaaagatggccagaaaggaatcttcctcggcgatgatgagtggcgcgaaacggcatggggcgccagtcatcacagcatgtctcaacctattatggtccagcggcgaagtgggcaaggattccatggcaattccgaggtgaacgcgattctgtcacctaggagtgagagcgggggtctcggagttagcatggtcgagtatgtcctgtccagctcacctgccgacaaattagacagtagatttagaaagggcaacttcggcactagagacgctgaaacggacggtcccgaaaagggggaccagaagggcaaggcatctccctttgaggaggaccagaaccgggatctgaaacagggggatgatgacgattcaaagataaacggtcgcggactgcccaacggtatggatgcagactgcaaggattttaatcggacaccagggtccagacaggcaagccccacggaggtagtagaacgtctgggccccaatacaaatccgtccgaaggccttgggcccttaccaaacccaaccgccaataaacctcttgttgaggaattcagtaaccctgaaactcagaatttagacgcaatggaacaggtgggccttgagagcctgcaattcgattacccagggaatcaagttcccatggacagcagtggcgccactgtggggttatttgactataacagtcagcagcaactgtttcagcgaaccaatgcactcaccgtgcagcagctgactgcagcccagcagcaacagtatgcattagctgctgcccaacagccccatattgccggtgtgttctctgcgggcctggctcccgctgccttcgtgcctaatccctacattatcagcgctgcacccccaggaacggacccttacaccgccgcagggctggccgctgctgctacgttggcagggcctgctgttgtacccccccagtactatggagtgccttggggggtgtacccagctaatcttttccaacagcaggctgctgcagccgccaacaacaccgccagccaacaagctgcatcccaggcccagccaggccagcagcaggtgctgagagcaggtgctggacagagaccgttgacgcccaatcagggccaacagggccagcaagctgaaagtctagcagccgctgccgcagccaaccctacactggcatttgggcagggcctcgctaccgggatgccaggctatcaggtgctggcgccaacggcctattacgaccaaacgggggccctcgtggtggggcctggagccaggacggggctgggcgcccccgttcgactgatggctccaactcctgtactgatctcaagcgcggccgcacaggcagctgccgctgcagctgccgggggcactgccagttcattgacagggtcaaccaacggactgtttcgtcctattggaacgcaaccaccccagcagcagcagcagcaaccctcaaccaaccttcagtctaatagcttctatggatcaagcagtctgactaactcctctcagagctcaagtctgtttagtcatggccctggacaacctggctcaacaagcttgggatttggcagcggcaattcactgggggctgcaataggctcggctttatccgggttcggcagctctggcggactcaccaatgggagcggacggtacatcagtgccgcgccaggtgctgaggcaaagtatcggagcgcctcttcaacctcctccttgttctcgagtagtagtcaactctttcctccgtctagactgaggtataataggtctgacataatgccttctgggcgctcacgcctgttggaggatttccgtaacaatcggtttcctaacctccagttgcgcgacctgatcgggcatatagttgaattctcacaagaccaacatggttctagatttattcagcaaaagctggagagagccaccccagccgagagacagatggtcttcaacgagatactgcaggctgcataccagctgatgactgacgtattcggtaattatgtgatacagaaattctttgagttcgggtctctggatcagaaattggccctagcaacacgaattcgcggccatgtgttgccgttggcactgcaaatgtatgggtgcagagtgatccagaaagccttagagtcaatctcatctgaccagcaggtaatctctgagatggtgaaggagctggatgggcatgtgctgaagtgtgtaaaggatcagaacggaaatcacgtggtccaaaaatgtattgagtgtgttcagccacagagcctacagtttataattgacgctttcaaagggcaggtgttcgtgctgtctacccacccctacgggtgcagggtcattcaaagaattttggaacattgcaccgccgagcagactctccccatcttagaagagcttcatcagcacactgagcagctcgtgcaggatcagtacggtaattacgtgatccagcacgtgctggagcatggccgtcctgaagataagagtaagatcgtgtccgagatcagggggaaagtcttggcgctgtcccagcacaagttcgcaagcaacgtggtggagaagtgcgttacacacgcttcaagagccgagagggctctgctgattgatgaagtctgttgccagaatgacgggccgcactccgctctgtacaccatgatgaaagaccaatatgcaaattacgtggtacagaagatgattgacatggccgaaccagcccagagaaagattattatgcataagataagaccccacattaccaccttgaggaagtatacctatggaaagcatatcctcgcaaagttagaaaagtattacttgaagaactcccccgatctgggcccgattggggggccgcccaacggaatgttatag

SEQ ID NO: 202051 - DNA, 3195 bp, Artificial Sequence
  Description of Artificial Sequence: Synthetic coding sequence
atgaaccacgacttccaggccctggccctggagagccggggcatgggcgaactgctgccaacgaagaaattttgggagccagacgactccacaaaagacggccagaaaggcattttcctgggtgacgatgagtggcgcgagaccgcatggggagcaagtcatcactctatgagccagccaataatggtccagaggagatccggacagggctttcacggcaactctgaagtgaatgccattctcagtccacgttctgagagcggcggtttgggagtgagcatggtggagtacgtcctgtcttcctccccggccgacaagctcgactctcgcttcaggaaaggcaatttcgggacacgagacgccgagactgatggacctgagaagggcgaccagaaaggcaaggccagtccattcgaagaagaccagaatagggacctgaagcagggggacgatgacgattccaaaattaacgggaggggtctgccaaacggcatggatgctgactgtaaagactttaatcgaacaccagggtctcggcaggcaagccctactgaggtggtggagcgcttaggacccaataccaatccatcagagggcctgggtcctctgcccaatcccaccgctaacaagccactggtcgaggagttctctaaccctgagactcagaaccttgacgcaatggagcaggtaggacttgagagtctgcagttcgactacccaggtaatcaagtgcccatggatagctctggagcaacagtcggcctgtttgactataatagtcagcagcagctctttcagagaactaatgcactgacagtccaacagctgacagcggcacagcagcagcagtatgcactggctgccgcacagcaaccccacattgcaggagtctttagcgccggactcgccccagcagcctttgtacctaacccgtatataatctctgctgcccctccaggtaccgatccgtatactgcagcaggacttgctgcagctgccaccctggccggtccagcggtggtcccaccccagtactatggagtcccctggggagtctatccggcaaacttgtttcagcagcaggctgccgccgccgccaataatacagcaagccagcaagcagctagccaggcacagcctggacagcaacaggttcttcgagctggtgccggacagcggcccctaaccccgaatcaaggccaacaggggcagcaggcagagtcactggccgccgcagccgccgctaatcccacgttggcgttcgggcagggcctcgctacgggaatgcctggctaccaggtgctcgctcccactgcctactatgaccagaccggagctctggtcgttggaccaggagcaagaaccggcctgggtgcacccgtgagactaatggcaccaacacccgtgctgatatcttcagctgccgctcaggccgcagcggcggctgcggctggggggaccgcctccagtctcaccggttctacgaacgggctgttccgtcccattggaacccagcctccccagcagcaacagcagcagccatccaccaatttgcagtccaactctttctacgggtcgagttcattaactaactctagtcagtcctcttctctgttttcccacgggcccggccagcctggctcaacctctcttggctttgggtctggcaatagtctcggcgccgcgatcggcagtgctcttagcggatttggttcaagcgtgggctcctctgccagcagctcagcaactcgccgcgaatctctttccacttctagtgacctatacaaaagatcctcctcgtcactggcgcctattggtcagccattttacaacagtctgggcttcagtagtagcccctccccaataggcatgcctctcccgtcgcagacacctgggcacagtctgacacctccgccctccctgtcgtcgcacggctctagctctagccttcatctcgggggactgactaacgggtccggtaggtatatttcagccgcccccggcgcagaggctaagtacaggagtgcatcctccacttcttccctgttctcctcatctagccagctgttcccccccagtcgtctgcgctataatagaagcgatatcatgccaagcggaagatcacggctgctggaggacttcagaaacaatagattcccaaaccttcagctgcgggacctcatagggcacatcgtagaattcagccaggatcagcacgggagccggttcatccagcagaagctagaaagggctactcccgcagaaagacaaatggtgtttaatgagatcctgcaagctgcgtatcagctgatgacagacgtgtttggcaactatgttatccagaaattcttcgagttcggctccctggatcaaaaactcgcactggcaacgcgaattcgtggccacgtccttccacttgcactgcagatgtatgggtgtagggtcatccagaaagcgctagagagcatctcttctgaccaacagtccgaaatggtcaaggaactagacggacacgtgctgaagtgtgtgaaggaccagaatggcaaccatgtcgttcaaaaatgcatcgagtgtgtgcagccacagagcctgcagttcattattgatgcatttaagggccaggtgttcgttctgtctacccatccctatggatgccgtgtgattcagaggatcctcgagcactgtaccgccgaacagaccctgccaatactggaggagctgcaccagcacaccgagcaactggtgcaggaccagtacgggaactatgtgatccagcatgttctggagcatggacgaccggaggacaaatctaagatcgtgtctgagatcagaggcaaggtcctggccctgagccaacacaaatttgcgtctaatgtcgtcgaaaaatgcgtcacccatgcgagcagggcggagagagccctcctaattgacgaagtgtgctgccagaacgacgggccacactctgccctttatactatgatgaaggatcaatacgccaactacgtcgttcagaagatgattgatatggccgagcccgctcagagaaaaataatcatgcataagattcgccctcacataaccactctgcgcaagtacacatacggaaagcacattctggccaaattggaaaagtactacttgaaaaacagcccggacttagggccaattggggggcccccaaacggcatgctgtag

SEQ ID NO: 202052 - DNA, 3201 bp, Artificial Sequence
  Description of Artificial Sequence: Synthetic coding sequence
atgaaccacgacttccaggccctggccctggagagccggggcatgggagaactccttcctactaagaagttttgggaacccgacgacagcacaaaggatggacagaaggggatcttcctcggcgacgatgagtggagggagaccgcatggggggcatcgcatcacagcatgtcacagcccattatggttcaacggcgatctggccaaggattccacggaaactccgaggtgaatgctattctgtcccccagaagcgaatccgggggtctgggtgtgagtatggtagagtacgtcctttcctcctcaccggccgataagctcgactcaaggttcaggaagggcaatttcggcactagggacgctgagacagacgggccagagaagggggatcagaaaggcaaagcctctcccttcgaggaagatcagaatagggatttgaaacagggggatgatgacgattccaagatcaatggaaggggccttcccaacggcatggacgccgactgcaaagactttaataggactcccgggtctaggcaggcctcccccaccgaggtggtggagcgcctgggacccaatacaaatccaagtgagggacttggaccattgccaaaccctactgcaaataaacctctggttgaggagttctccaaccctgagactcaaaacctcgatgccatggagcaagttggtctggaatcactgcaattcgattacccgggcaaccaggtgccgatggacagctctggggccactgtgggactcttcgactacaactcacagcaacagctatttcagaggaccaacgccctgactgtgcaacagttgaccgccgcccagcagcaacagtacgctctcgccgccgcccagcagcctcacatagctggagtcttctctgcgggactggcacccgccgccttcgtgcccaatccatatataatttcagctgcacctccaggcacggatccatatacagctgccgggctcgctgcagccgccacgctggctggcccagctgttgtgccgccacaatactatggcgtgccttggggtgtttatccggccaacttgttccagcagcaggctgccgccgcagctaataataccgctagtcaacaggccgcatcccaggcccagcctggccaacaacaggtgctgcgagctggagctggacagcgcccacttaccccgaaccagggacaacaaggtcagcaagccgagtcattggctgccgcagctgccgcaaaccccaccctggcctttgggcaaggcctcgctacgggcatgcccggctaccaggtcctagcccctaccgcctattacgaccagacaggcgccctagtggtgggtccaggcgcccgcaccggactgggggcccctgttcggctcatggcgcctacccctgtcctgatatccagcgcggccgctcaggctgccgctgccgctgcagccggcggtactgcttccagtctcacaggatccacaaacggactgttcaggccgattggtacccagccaccacagcagcagcagcagcagccctccaccaacctccagtctaactccttctacggatctagctccctgacgaattctagtcagagctcttcactgttctcccacggcccaggccagccaggcagcacctcgctgggatttggcagtgggaattctttgggggcagcgattggcagcgcgctttccggatttgggagttcagtcggcagttccgccagcagtagcgcaacgcggcgggagagcctttcaacttccagcgatctatataagcggtcttcttcctcgctggcccccatcgggcagccattttataattcccttggcttctcctccagcccctctccaatcgggatgccgctcccctctcagacaccgggccactccttgactccccctcccagtctgtcatcacatggcagtagttcatctctccatcttgggggactcaccaatggcagtgggagatatatctcagccgcccctggcgcggaggctaagtaccggtcagccagttcaacctcaagcctgttcagcagctcaagtcagctcttcccaccctccaggctccgatataaccgaagtgacatcatgcctagcggccgttccagactgctggaggactttcgcaataatcggtttcccaatcttcagctacgcgatcttattggccacattgtcgagttcagccaggaccaacacggctcgcgttttattcagcagaaattagagcgtgccacccctgccgaacggcaaatggtgtttaatgaaatactacaagcagcgtaccaactgatgactgacgtgttcggcaattacgtgattcagaagttttttgagttcggctctctcgatcagaagttggcccttgctactaggataaggggacatgtcctccccctggcattgcagatgtacggctgccgggtaatccaaaaagcactggaaagtatctcctccgaccagcaggttatttccgaaatggtcaaggagttggatggccatgtgctgaaatgcgttaaggatcaaaatggaaatcatgttgtgcagaaatgcatcgaatgtgtacaacctcaatctttgcagttcattatcgatgctttcaagggccaagttttcgtgctaagtacccacccctacggatgtagggtaattcagagaatcctcgagcactgcaccgccgaacagacgttaccaatcctggaagagctacaccagcataccgagcaactcgtccaggatcagtatggaaactatgtcatacaacacgttctggagcatggtcgaccagaagataaaagcaaaattgtttccgagatccgggggaaggtactagcactgagtcagcataaatttgcctccaacgtcgtagagaaatgtgtgacgcatgcttccagggccgagcgagcactcttaatcgacgaggtgtgctgccagaatgatggtccacattcagcactgtacaccatgatgaaagatcagtatgcaaattatgttgtccagaaaatgattgacatggcagaacccgcccagcggaagatcataatgcataaaatacgtccacatattacgactctgaggaaatacacctatggcaaacatatccttgcaaaacttgagaagtactacctgaaaaatagtccagatctcggtccaatcggcggccctcccaatggaatgctgtag

SEQ ID NO: 202053 - DNA, 3195 bp, Artificial Sequence
  Description of Artificial Sequence: Synthetic coding sequence
atgaaccacgacttccaggccctggccctggagagccggggcatgggcgaactgcttccaacaaaaaagttttgggagccagatgattcaactaaggacgggcagaaagggatctttcttggagacgacgaatggcgtgagacagcatggggcgctagccaccattctatgtctcaaccaattatggtgcagcgaaggtctggacagggatttcacggaaattcggaggtaaatgctattctgtcccccaggagcgaatccggcgggctgggcgtgagtatggttgaatatgttctgtcaagtagccccgccgacaaattagacagccggttccggaagggcaacttcggaacccgggatgctgagaccgacgggcccgagaagggtgatcagaagggcaaggcgtcacctttcgaggaggatcagaacagagacttaaagcagggcgacgatgatgactctaagattaatgggagggggctgcccaacgggatggacgcggactgcaaagatttcaatcgaacccccggcagccggcaagcgtcgcccactgaggtagtcgaacgcttgggaccaaatacaaacccttcagaggggctcggacctctgccaaaccccaccgctaataaaccgctcgtggaagaattctccaacccggagacacagaatcttgatgctatggagcaggtgggcctggagtctttacagtttgactacccgggaaaccaggtgcctatggattccagtggcgccaccgtcgggctcttcgattacaacagtcagcagcagctcttccaacgcacaaacgctcttactgttcagcagctaacggccgctcagcagcaacaatatgccttggccgcggcccagcagcctcatatcgcaggcgtgttcagcgccggtcttgcgcctgccgcatttgtgccgaacccatatatcatctcagcagccccccctggtacagacccctatactgctgcagggttggctgctgccgccaccctcgcggggccggcagtagtcccaccgcagtattacggcgtgccctggggagtataccctgcaaacttatttcaacagcaggcagccgcagccgctaacaacacagctagtcagcaagcggctagccaggcccagccgggtcagcagcaggtgttacgagcaggggctggccagcgcccactaaccccaaaccagggccagcaggggcaacaggccgagtcactggccgcagccgcagcggccaacccaacgctagcttttggccaggggctcgccaccggaatgccaggttatcaggtcctggctcctacagcgtactacgaccaaaccggcgcgctggtggtgggccctggggcccgcacaggcctgggcgctcccgtgaggctgatggcaccgacgcccgtactcatcagttcagccgctgcacaggccgccgccgccgcagccgctggtggaacagccagctcactgactggaagtactaacggactgttccgccccatagggactcaacctccccagcaacaacagcagcaacctagcactaacctccaatctaacagtttttatggctccagttctctgactaacagcagccagagttcttctttattcagtcacgggccaggacaacccggatctacctctttgggatttggttccggcaattctctaggagctgccatcggatctgccttatccggatttggatcttctgttgggtctagcgcttcctccagtgcaacgcggagagagtcactgtcaactagtagcgatttgtataaacgctcaagcagctctttagcaccaatcggccaaccattttataactccctgggcttctcttcctcaccatcgcctatcggaatgcctttaccctcccagactcctgggcattccctgaccccgcccccctcattaagtagtcacggcagctccagctccctgcacctgggtggcttgaccaacggctcagggcgatatatatcagctgcgcctggcgcagaagcaaagtatagatctgcatctagtacttcttcactgttctcaagtagttctcagctgtttccacctagccgtctcaggtacaatagaagtgacattatgccctctggtcggagcaggttgctggaggattttaggaataaccgcttccctaacctgcagctgcgggaccttattgggcacattgttgagttttcacaggatcagcatggaagtcggtttattcagcaaaagctggaaagagccactcctgccgaaaggcagatggtgtttaacgaaatcctgcaggcagcttaccaactgatgacagatgtcttcgggaattacgtgatccagaaattctttgaattcggctccctcgatcagaagctggccctggccacccgtatccgagggcatgtgctacctcttgccctgcaaatgtatggatgccgcgtaatccagaaggccctggaatccatttctagcgaccaacagtccgagatggtgaaagagttggacggtcatgtcctgaagtgcgttaaggatcagaacgggaaccatgtcgtgcagaaatgcatcgagtgcgttcaaccacaatccctccaatttatcatcgatgcctttaaggggcaggtatttgtgctgtccactcatccctacgggtgcagggtcattcagcggattctggaacactgcaccgctgaacagaccctgcccattctcgaggagcttcatcagcacaccgagcagctggtccaggaccaatatgggaattacgtgatccagcacgtactcgagcacggaagacctgaggacaagagcaaaatcgtgagcgagatacgggggaaagtactggctctttctcagcataagtttgcgagcaacgttgttgagaagtgcgttacccacgccagccgcgcagaacgggctcttctgatcgatgaggtgtgttgccagaacgatggtccacattctgcactctatactatgatgaaagaccagtacgctaactacgtcgtgcagaagatgattgacatggccgagcccgcacagcgcaaaatcataatgcacaagattaggccacacataaccactctgagaaagtatacttacggcaagcacattcttgcgaagctggagaagtactacctgaagaactcccccgacctgggtccaattggggggccccctaatggtatgctgtag

SEQ ID NO: 202054 - DNA, 105 bp, Artificial Sequence
  Description of Artificial Sequence: Synthetic coding sequence
atgaaccacgacttccaggccctggccctggagagccggggcatgggagagctcctcccaactaaaaagttctgggaaccagacgactctactaaagacgggtag

SEQ ID NO: 202055 - DNA, 882 bp, Artificial Sequence
  Description of Artificial Sequence: Synthetic coding sequence
atgaaccacgacttccaggccctggccctggagagccggggcatgggcgaactgctgccgacaaagaagttttgggagccagatgacagcaccaaggatggacaaaagggtatctttttaggagacgatgagtggagagagacggcttggggagcatcccaccactccatgagccagccgatcatggtgcagcgtcggagcggccagggcttccatggcaactcagaagtcaacgccattctctctccaaggtccgagagtggaggcctgggggtgtccatggtggagtacgtcttaagtagcagtcccgccgataagctggacagccgattccggaagggcaatttcggcacaagggacgcagaaacagatggccctgagaaaggagatcagaaagggaaagctagtccctttgaggaggatcagaatcgagatctgaagcagggggatgatgacgatagtaaaatcaatggcagaggcctacctaacggaatggacgcagattgcaaggatttcaaccgaaccccaggcagtaggcaggcaagtccaaccgaggtggtggaaagactggggccgaacactaacccaagcgaaggacttgggcccttaccaaaccctactgcaaataagccgcttgttgaggagttctccaaccccgaaacccaaaacctcgatgctatggaacaggtgggcctggaatctctccagtttgattatcccggaaaccaggttcctatggacagctctggcgcaactgtcggcttgttcgactataattcacaacagcagctgttccagcgtacaaacgctctcacggtgcagcagctcaccgccgcccagcagcagcagtatgcgctggccgccgcccagcagcctcactag

SEQ ID NO: 202056 - DNA, 3027 bp, Artificial Sequence
  Description of Artificial Sequence: Synthetic coding sequence
atgagccagcccatcatggtgcagcggcggagcggccagggcttccatgggaacagcgaagtgaacgccattttgagtccccggagcgagtcgggaggactgggcgtgagcatggtagagtacgtgcttagtagctctcctgccgacaagcttgattctaggtttcggaaagggaacttcggtacaagggatgccgagactgatggtcctgagaagggtgatcagaaaggcaaggcctctccttttgaggaggatcagaatagggacctaaagcagggcgatgacgacgacagcaaaatcaacggaagggggctgccaaacggtatggatgcagattgcaaagatttcaaccggacccccggctctcgacaagcctcacctaccgaggtagtagaacggctgggtcctaacaccaatccgtcggaggggctgggaccattgccgaaccccaccgccaacaagccactagtggaagagttctctaatcccgagactcagaatctggacgcaatggagcaggttggcctcgagtcattgcaatttgattaccccggcaaccaggtcccaatggactcaagtggggccacagtgggtctgttcgactataactctcagcaacagctgtttcagcgcactaatgcgctgactgttcagcagttaactgctgcccagcagcagcagtacgctctggccgccgcacagcagccacatattgctggagtattcagtgccgggttggcccctgccgccttcgtaccaaacccatacatcataagcgcagctcctcctggtactgacccgtacaccgcagccggcctggcggcagccgccaccctcgcgggaccggctgtggtgccaccgcagtactatggagtcccatggggtgtgtaccctgcaaacctgtttcaacagcaagcagccgccgctgcaaataataccgcctcccaacaagcagcctctcaggcccagcctggccagcagcaggtgcttcgcgctggggctggacaaagacctctgacaccaaatcagggacagcagggtcagcaggccgaatctcttgcggcggctgctgcggcaaatccgacgctcgcatttgggcaaggactcgctaccggcatgcctggataccaggttttggccccgaccgcttactacgatcagaccggggcattggtggttggtcctggcgctcgtacggggctcggagccccagttcggcttatggcacctacaccagtgctcatctccagtgccgctgcgcaggcggcggcggcggctgcggctggaggaaccgccagctcactgactggctccactaatggactgttcaggccaatcggtacccagcccccccagcaacagcagcagcaacctagcacaaatctgcagagcaactctttctacggctccagctctcttacaaacagcagtcagtcctcctccctattctcacatggccccggacagccgggctccactagcctgggattcgggtcaggaaatagtctgggtgcagccatcggctccgcactctcgggattcggcagcagtgtgggcagttccgcttctagttccgcgacaaggcgtgaatctctgagtacgtcctccgacctctacaagcgctcgagtagttctcttgctcccatcggccagcccttctacaactcactgggattctccagcagcccttcaccaatcgggatgcccctcccttcccagaccccagggcacagcctgaccccccccccctcgctctctagccacggttccagtagttccctgcatctgggagggctgaccaacgggagcggtaggtatatctctgctgccccaggcgcagaggcaaaatacagaagcgcgtcgagcacttcttcattgtttagctcgtcatcccagctcttcccccctagccgactccgatacaacaggtccgatattatgcccagtggtcgctctcgacttcttgaagactttaggaacaaccgtttccccaaccttcagctcagggacctgattgggcatattgtggagttctcacaggaccagcacggatctagatttattcagcagaaattggaacgggcaacccccgctgaaagacagatggtcttcaatgagatcctacaggctgcttatcaactgatgactgatgtgttcggcaactacgtgatccagaaattctttgaattcggtagtctggatcagaaattggcactggctactcggattaggggtcatgtgctgccgctggccttacaaatgtatggatgtcgagtgatccaaaaggccctcgagtcaatttcatcagaccagcagtctgaaatggtgaaagagctagatggtcacgtgttaaagtgtgtgaaggaccagaatgggaatcacgtcgtgcagaagtgcatcgagtgcgtccaaccacagagcttgcaatttattattgatgctttcaagggccaggtgttcgtgctctcaacacacccttacggatgcagagtcattcagagaatccttgaacattgcactgccgagcaaactctccccatcctggaggaactgcatcagcatactgagcagctggtccaggatcagtacggaaactacgtgatccagcatgtgctggagcacggccggcctgaggacaagtcaaagatcgtgtccgagatccgaggcaaagtgctcgccctgtctcagcataaatttgcctcgaacgtggtggagaagtgtgttacacacgcgagccgggccgaaagagccctactgattgacgaggtgtgctgccaaaatgatggtccccactctgccctctacacaatgatgaaagaccaatatgcgaattacgtggtccaaaagatgattgacatggcagagccagctcagcgcaagatcatcatgcacaaaatccgcccgcacatcaccacactgagaaagtacacatacggtaaacacatcctcgccaaacttgagaaatactatctgaaaaactcaccagatctgggcccgatcggaggcccgcccaacgggatgctctag

SEQ ID NO: 202057 - DNA, 870 bp, Artificial Sequence
  Description of Artificial Sequence: Synthetic coding sequence
atggagaacggctacacctacgaggactacaagaacaccgccgagtggctgctatctcacacgaagcacaggccacaggtggctattatatgtgggtctggactgggcgggcttacggataaactgacccaagcccagatattcgattatggcgaaatcccgaactttcccaggtccacagtcccaggccacgccggccgactcgtcttcggctttttgaatggaagagcatgtgtgatgatgcagggtcggttccatatgtacgaaggttacccgctgtggaaggtaacttttccggtgagagtgtttcatttgctaggagtggataccttagtagtgaccaacgcagcaggagggttgaatcctaagtttgaggttggcgatattatgttaatcagggaccacatcaatctgccagggttttcaggccagaacccactgaggggccccaacgacgagcgctttggtgataggttccccgccatgagcgatgcttacgatcggaccatgcgccagcgagcactgagcacctggaagcagatgggagaacagcgtgagcttcaggagggaacgtatgttatggtggctgggccttcatttgagaccgtcgccgagtgcagagtcttgcagaagttgggcgcagatgctgtcgggatgagtacagtcccagaagttatcgttgcccgccattgcggcctccgggtgttcggatttagcctcatcactaacaaagtgatcatggactatgaatccctggagaaagctaatcacgaagaagtactggccgctgggaaacaggcagctcagaaactcgagcaatttgtgtctattctgatggccagcattccattgcccgataaggcaagttag

SEQ ID NO: 202058 - DNA, 282 bp, Artificial Sequence
  Description of Artificial Sequence: Synthetic coding sequence
atggagaacggctacacctacgaggactacaagaacaccgccgagtggctgcttagccatacgaagcataggcctcaggtggccattatatgcggaagtggtttaggcggcttaacagataagcttacacaggcacagatctttgactatggcgaaatacctaattttcctagatcgactgttcctggacatgcaggaaggctggtatttggcttcttgaatggccgcgcttgtgtgatgatgcagggtcgcttccacatgtatgagggataccctctctag

SEQ ID NO: 202059 - DNA, 375 bp, Artificial Sequence
  Description of Artificial Sequence: Synthetic coding sequence
atgagctacatccccggccagcccgtgaccgccgtggtgcagcgggtggaaattcataaacttaggcagggagaaaacttaatcctcggattcagtatcggaggtggcatcgaccaggacccctcccagaacccattttccgaggataagaccgacaaaggcatctatgtaacgcgggtctctgaaggaggcccagccgagattgcagggctgcagattggcgacaaaataatgcaagtaaatggatgggatatgacaatggtgactcacgaccaggcacgcaagaggctcactaaacgaagcgaggaggtggtaaggttactggtcactagacagtcgttacaaaaagcggtgcagcaatccatgctgagctag

SEQ ID NO: 202060 - DNA, 1194 bp, Artificial Sequence
  Description of Artificial Sequence: Synthetic coding sequence
atgaactgcatcagcgacttcttcacctacgagaccaccaagagcgttgttgtgaaaagttggactattggaatcattaatagagttgttcaactgctgattatctcttacttcgtcggatgggtgtttttgcacgaaaaggcctaccaggtgagagatactgctattgaatcaagtgtggtaacaaaggtgaagggcagtggactatacgctaatcgagtaatggatgtatctgactatgtcactcctccgcagggtacctcagtgtttgttattataaccaagatgatagtcacagaaaatcagatgcaggggttttgccccgagtcagaagagaagtatagatgcgtgtccgattctcaatgcggccctgaacgcctgccaggtgggggcattctgacgggaagatgcgttaattactcctccgtgttgagaacgtgtgagattcaaggctggtgtccgacagaggttgataccgtagagacccctatcatgatggaagcggaaaactttacgatcttcattaaaaacagtataagattccctttatttaacttcgaaaagggcaacctgctgccaaacctgacagccagagatatgaagacttgcagatttcacccagacaaggaccctttttgccccatcctgcgagtgggcgatgtagtcaaattcgccgggcaggatttcgcgaagttggctagaacgggcggagtgcttggaataaaaatcggttgggtgtgtgaccttgacaaagcctgggaccagtgtatcccaaaatactcatttacacgcctcgacagcgtgtccgagaaatcatccgtctcccctggatataacttcaggttcgccaagtactacaagatggaaaacggttcagaataccggacattactgaaggccttcggcattcgcttcgatgtgttagtgtatggaaacgcaggaaagtttaatatcataccaactataatctcttccgttgcagcttttaccagcgtcggagtgggcacagttctttgtgacatcattctcctgaacttcctcaagggcgcagaccagtacaaagctaagaagttcgaagaggttaatgagaccaccttaaaaatagcagctcttactaaccctgtatacccctccgaccagactacagctgaaaagcagagcactgacagcggcgcttttagcatcgggcattag

SEQ ID NO: 202061 - DNA, 1191 bp, Artificial Sequence
  Description of Artificial Sequence: Synthetic coding sequence
atgaactgcatcagcgacttcttcacctacgagaccaccaagagcgtagtagtcaagtcgtggactatagggatcattaaccgagtcgtacagctgctgattatcagttattttgtgggctgggttttcttgcacgaaaaagcctaccaagtccgggataccgccattgagtcatccgtggtgaccaaggtcaaaggtagtggcctctatgccaaccgcgttatggacgtttcggactacgtgacccctcctcagggaaccagtgtgtttgtgatcattacaaagatgatcgttaccgagaaccagatgcaaggattttgtccggagtccgaggagaagtacagatgcgtaagtgacagccagtgtggcccagaacggttgcccgggggaggtatcctcacaggacggtgtgtcaactatagtagtgtcctgcgcacctgcgaaatccaagggtggtgccccacagaagtggatactgtggagactcctattatgatggaggcagaaaatttcaccatatttattaaaaactcaatcagattccccctgttcaacttcgaaaaaggaaatttgctgcccaatcttaccgcgagagacatgaaaacctgcaggttccatccagacaaggacccattctgtccaatccttcgagtcggggatgtggttaagttcgccgggcaggacttcgctaagctggctcgcacgggcggggtcctcggaataaagatcggctgggtgtgcgatcttgataaagcttgggatcagtgcataccaaagtacagtttcacgcgtttagactctgtgtcagagaagtcttctgtgagtcccggatataactttagattcgcaaaatactacaaaatggagaatggctccgagtatcggactctccttaaagcatttggcattaggtttgatgtgctgtatacaggggcggggaagtttaacatcattccaaccatcatcagtagcgtggctgctttcactagcgtaggagtgggcactgtcctctgtgatattattcttttgaatttcctaaagggggccgaccagtataaagccaagaagttcgaggaggttaacgagacgactctcaaaatcgcggccctcacaaacccagtgtacccctccgaccagactactgcagagaaacagtccaccgatagcggcgcttttagcatcggccactag

SEQ ID NO: 202062 - DNA, 1167 bp, Artificial Sequence
  Description of Artificial Sequence: Synthetic coding sequence
atggccggctgctgcgccgccctggccgccttcctgttcgagtacgacactcccaggatcgttctgattagatcacgaaaagtgggcttgatgaatagagccgttcaactcctaattttagcttacgtcataggctgggtctttgtgtgggagaagggttaccaggaaaccgactctgtggtttccagcgtcactactaaggttaaaggcgtggcagtgacgaacacatctaagcttgggtttaggatctgggatgtggcagactatgtgattccggctcaggaggaaaacagcctcttcgttatgaccaacgtgatactgacaatgaaccaaacacagggcctctgcccagagatccctgacgccacaacagtgtgtaagtccgatgctagctgtacagccggctccgccggaacacactctaatggggtgtccaccgggagatgtgtggccttcaacggatccgttaaaacatgcgaggttgccgcctggtgccctgtggaagacgacacccacgtccctcaaccagcatttctgaaagctgctgagaattttaccctcctggtcaagaataatatttggtatcctaagttcaacttcagtaagagaaacattcttcctaatataaccaccacttacctgaagagctgcatctatgacgccaagacagatccgttctgtccgatcttccgtctgggcaaaatagtggagaacgccggccactcctttcaggacatggcagtggaaggaggaatcatgggcatacaagtgaactgggattgcaacctggaccgggccgcgtcactgtgcttaccacggtactcctttcggcgattagatacccgggatgtggaacacaacgtcagtcccggatataattttaggtttgccaaatattacagagacctggctgggaatgaacagagaacactgatcaaagcgtacggaatccgattcgacattatcgtgttcgggaaggccgggaaatttgacatcatcccgacaatgattaatatcggctcagggcttgccctcctcggcatggccaccgtgctttgcgacattatagtgctgtactgtatgaaaaagcggctgtactatcgtgaaaagaaatacaagtatgtcgaggactatgaacagggcctggcctcagagctggaccaatag

SEQ ID NO: 202063 - DNA, 1215 bp, Artificial Sequence
  Description of Artificial Sequence: Synthetic coding sequence
atggccggctgctgcgccgccctggccgccttcctgttcgagtacgacactcccagaatcgtcctgattagaagtagaaaggtgggactaatgaatagagccgttcaactcctaatcctggcctacgttattggatgctaccacccccacctggctgaagtggaaatggagagtcctcggagatgggtttttgtctgggaaaagggttaccaggaaactgactctgtggtgagtagcgttaccaccaaggtcaagggcgtagccgtgacaaacacgagtaaattaggattcaggatctgggacgtggctgactacgtgatcccagcacaggaggagaactcgttgtttgtaatgacaaatgtaatattgacaatgaatcagacacagggactgtgtccagagatcccagatgccacaactgtctgcaagagcgatgcaagttgcacggccggaagtgctggtacacactccaatggggtgtcgaccgggcgttgtgtggcctttaacggctcagttaaaacatgtgaagtcgccgcatggtgtcccgtggaggacgatacccacgtcccgcagccagcctttctgaaggccgccgaaaattttaccttactcgtgaagaacaatatctggtaccccaaattcaacttcagtaaacgaaacatcctgcctaacatcaccactacatacttgaaatcctgcatttacgatgccaagacagaccctttttgcccaatatttaggctcggaaagatcgtggagaatgcagggcacagtttccaggacatggctgtcgaaggcggcattatgggaatccaggtgaactgggattgtaatctagatagggctgcttccctgtgcctgcctagatactcattcagacggctggatacacgggacgtggagcacaatgtctccccaggctacaactttcgatttgccaagtactatcgggatctggcggggaatgaacagagaactctcatcaaagcttatggtatcagattcgacattatagtgtttggcaaggcaggcaagtttgacatcatcccaaccatgattaatattggttccggactggctctgctgggaatggcaacagtcttgtgcgatataatcgtgttatattgcatgaagaaaaggttgtactaccgggagaagaaatataagtacgttgaggactatgaacagggactggccagcgaattagatcagtag

SEQ ID NO: 202064 - DNA, 441 bp, Artificial Sequence
  Description of Artificial Sequence: Synthetic coding sequence
atggccggctgctgcgccgccctggccgccttcctgttcgagtacgacacgcccaggatagtgctcattcgatctaggaaggttggccttatgaatagggccgtgcagctccttatcctggcatacgtgatcggctgggtctttgtatgggaaaagggctaccaagagactgacagcgtcgtatcgtctgtcacaacaaaggtcaagggagtcgccgttactaatacgtcaaagctgggctttcgaatttgggatgtcgctgattatgtgatacctgcacaggaggaaaatagcctgtttgtgatgaccaatgtcatcttaacgatgaaccaaacacaggggctgtgcccggaaatccctgatgcaacaaccgtttgcaagtctgacgcctcctgcactgccggttcggctgggacgcattctaacgacttgctcttctag

SEQ ID NO: 202065 - DNA, 1086 bp, Artificial Sequence
  Description of Artificial Sequence: Synthetic coding sequence
atggccggctgctgcgccgccctggccgccttcctgttcgagtacgacaccccccgcattgtattgatccgcagcagaaaagtgggtttgatgaatagggctgtgcaactgcttattttagcatacgttatcgggtgggtcttcgtctgggagaaagggtatcaggagaccgactcggttgtgtcatccgttaccactaaggtcaaaggagtggcagtgacaaatacctctaagctcgggtttcggatatgggacgttgcggactatgtgattcccgcccaagaagagaactcactatttgttatgacaaatgtgattctcactatgaaccagacacagggattgtgcccagaaattcccgacgctacaacggtctgtaaatccgatgcctcttgcactgctggttccgccggcacgcacagcaacggcgtctcgacaggacgccctgcattcctgaaagctgctgagaatttcactctgctggtgaaaaacaacatttggtacccgaaattcaatttctctaagcggaatatcctgcccaacatcacgactacttacttgaagtcgtgtatttacgatgctaagacagacccattctgtcccatctttaggctcgggaaaatcgtggaaaacgctgggcactccttccaggatatggcagtggaaggcggcatcatgggaatccaggttaactgggattgtaacctggatagagcggcaagcctctgcctgcctcggtactcatttaggcggctagatacccgagacgttgagcacaatgttagccccggctacaatttccggttcgccaaatactatcgtgaccttgccgggaatgagcaaagaaccctgattaaggcttacggaattaggtttgatatcatcgtattcggaaaggctggcaaattcgacattatcccaactatgataaatattggatccggactggccttactgggaatggctacagtgctgtgtgacatcattgtgctttattgtatgaaaaagcggctgtattatcgtgagaagaagtataaatacgtagaagactatgagcaaggacttgcctccgagttggatcagtag

SEQ ID NO: 202066 - DNA, 864 bp, Artificial Sequence
  Description of Artificial Sequence: Synthetic coding sequence
atgaccaacgtgatcctgaccatgaaccagacccagggcctgtgccctgagatcccagacgccaccacagtgtgcaagtccgacgcatcctgtaccgccggctccgctgggacacacagtaatggcgtcagcacaggaagatgtgtggccttcaatggttccgtcaaaacttgtgaggtcgcagcctggtgccctgtggaggatgacactcacgtgccacagcctgccttcttgaaagctgctgagaatttcacccttttagtgaagaataatatctggtaccccaagttcaatttcagcaagagaaacatactgcccaatattacaacaacctaccttaaatcctgtatatatgacgctaaaactgacccattctgccctatttttcggctgggcaaaatcgtagagaacgcaggacactctttccaggacatggccgtggaaggcggcatcatgggcattcaggttaattgggactgtaacctggatagggccgcatccctgtgtttaccaagatactcatttcgaaggctggacacacgggatgtcgaacataacgtaagccctgggtacaattttaggttcgccaagtactaccgagatctggccgggaacgaacagcgcaccctgatcaaggcttacggtattcgcttcgatattatcgtgttcggaaaggccggtaagtttgacatcattccgaccatgatcaatatcgggagcggactggcattgctcggcatggccaccgttctgtgtgacatcatagtcttgtactgtatgaaaaagcgcctctattatagggaaaagaaatacaaatatgtcgaagactatgaacagggcctggcatccgagctagatcagtag

SEQ ID NO: 202067 - DNA, 1278 bp, Artificial Sequence
  Description of Artificial Sequence: Synthetic coding sequence
atggacggccccgccgagcagcggcccgccctgctgaacagcgccgagaacttcacggtgctcataaaaaacaacattgacttccccggtcataattataccactaggaatattctccctggccttaacatcacatgcactttccacaagacacagaatccgcagtgccctatatttagactgggggatatcttcagagagacgggcgacaacttttccgacgtggcaattcagggcggaataatgggcatcgagatctattgggactgcaaccttgatcgatggtttcaccactgccgccccaaatatagtttcagaaggctggacgacaagaccaccaacgtcagtttgtatccggggtacaactttagatatgccaagtactacaaagagaacaatgtagagaaacgcacacttatcaaggtcttcggaattcggtttgatattctggtgtttggtacaggcggtaaatttgacattatccaactggtggtttatattggctcgacactctcatatttcggcctggctgcggtgtttatcgatttcctgattgacacctactccagcaactgttgccgctcgcacatatatccatggtgtaaatgctgtcagccatgtgtcgtcaacgaatactactatcggaagaagtgtgagagcattgtagaacccaaacccacactgaagtacgtgtctttcgtggacgagtctcacattcggatggtgaatcagcagttactgggacgctccctgcaggatgtgaaaggccaagaggtgccccgcccagcgatggatttcaccgatcttagtcgcctaccgcttgcactgcacgatactccacctatccctggccagcccgaagaaatccagctgttacgcaaggaggcgacaccgcggagccgggacagccctgtttggtgccagtgcggtagctgccttcccagccaattacccgaaagccatagatgcctcgaagagctgtgttgtcggaaaaaacctggagcatgtattacaacaagcgagctgttccgcaagcttgtgctgtcccggcacgttctgcagttccttctgttgtaccaagagccccttttggctcttgacgtagatagcactaattctaggttgcgtcactgtgcttataggtgttacgccacatggcggtttgggtctcaggacatggcagatttcgccaacctcccatcttgctgtcgatggcgcattcggaaagaatttccaaaaagcgagggacaatattccggcttcaagagcccttactag

SEQ ID NO: 202068 - DNA, 828 bp, Artificial Sequence
  Description of Artificial Sequence: Synthetic coding sequence
atgcccgcctgctgcagctgcagcgacgtgttccagtacgagaccaataaggtcactcggattcagtcgatgaactacggtacaattaagtggttctttcatgtaattatattctcttacgtgtgctttgcgctcgtctccgataaactttatcagagaaaggaaccagtgatttcctctgtgcatacaaaagttaagggtattgcagaagtcaaagaggaaatagttgaaaacggggtgaagaaattggtccatagtgtcttcgatacagccgactatacctttccgcttcagggtaatagcttttttgttatgaccaacttccttaagactgagggccaagagcagagactctgtcccgagtacccaactcggcgtacactgtgtagcagtgacagaggatgcaagaaaggatggatggacccacagtcaaagggtatccaaacagggaggtgtgtcgtgtatgagggcaaccaaaaaacttgcgaagtttctgcgtggtgccctattgaggccgtggaggaagccccgcggccggccttgctgaacagtgctgagaacttcactgtactaatcaagaataacatcgacttccccggacacaattacactacgtacgcaaagtactacaaggagaataacgtcgagaagcggactctgataaaggtcttcggcattcggtttgatatacttgtgtttggcactggcggcaaatttgacatcattcaactggtggtttacatcggctctacactgagttatttcggtctggtgcgcgactctctcttccacgcattgggcaaatggtttggagagggctccgactag

SEQ ID NO: 202069 - DNA, 1518 bp, Artificial Sequence
  Description of Artificial Sequence: Synthetic coding sequence
atgacccccggcgaccacagctggggcaacagcttcttcgtgatgacaaactttctgaaaaccgaaggccaggagcaacgcttgtgtcccgagtacccaacaagaaggaccttatgctcatcggatcggggctgtaagaaaggttggatggacccacagtccaaaggaattcagacaggacgctgcgtcgtttatgagggcaatcagaaaacctgcgaagtgtctgcttggtgccctatcgaagccgtagaggaggccccccgacctgccctcctcaattctgctgaaaatttcacggtgcttattaagaacaacattgacttccccggccataactatacaactcgtaacatactccctggacttaatatcacatgtactttccacaagacacagaatccccagtgtcccatctttcgcctcggcgacatcttccgcgaaaccggcgacaacttctcagacgtcgcaatccaagggggaataatgggaatcgagatctattgggactgtaacctggacaggtggtttcatcattgccgacctaaatattcattccgtcggctggatgataagacgacgaatgtgtctttataccctggctacaacttcaggtatgctaagtactataaggaaaacaacgttgagaaacgaacacttatcaaggtcttcggaattcggtttgatatcttggtgtttggtaccgggggaaagttcgatatcatccagctggttgtctacattggaagcaccctatcttactttggccttgctgctgttttcatcgattttctcattgatacctattcctctaactgctgccgttctcacatttacccttggtgtaagtgctgccagccgtgcgtggtgaatgaatattactatagaaaaaagtgtgagtcaatagttgagcccaaaccgaccctgaagtacgtatcatttgtcgatgagtctcatatcagaatggtaaatcagcagctgctgggtcgctctctgcaagacgtcaaagggcaggaagtaccccgtcctgccatggatttcaccgacctgagccggttgccattagctctccacgacacaccacccatacccggtcagcctgaagagatccagttattgaggaaggaagcaacccctaggtcccgtgatagtccagtctggtgtcaatgcgggtcttgcctaccatctcagctccctgaaagtcacaggtgtctggaggaactctgttgccggaagaagcccggagcgtgcatcacgacctcagagctttttcgaaaactagtgctgtcacgacatgtcctgcagtttcttctactctatcaggagccgctcttggcactcgatgtggattcaaccaattcaaggctgcgtcactgcgcttatcggtgttacgcaacctggagattcggtagccaagacatggccgattttgctaatctacctagctgttgtcgatggcgtattcggaaagagttccctaaatcagagggacagtacagtggctttaagtccccatattag

SEQ ID NO: 202070 - DNA, 387 bp, Artificial Sequence
  Description of Artificial Sequence: Synthetic coding sequence
atgcccgcctgctgcagctgcagcgacgtgttccagtacgagaccaacaaagttacccgtatacagagtatgaactatgggaccattaagtggtttttccatgtgatcattttcagttacgtgtgcttcgccctcgtttcagacaagttgtaccagaggaaagaaccggtgatttcatcagtgcacaccaaagtaaagggaattgccgaggtcaaggaagagatagtagagaatggagtgaagaaactggtacattctgtatttgatactgcggactacacatttccactccagggcaacagcttttttgtcatgaccaacttccttaagacagagggccaggagcaaaggctgtgccctgaggagtttcggccagagggcgtttag

SEQ ID NO: 202071 - DNA, 921 bp, Artificial Sequence
  Description of Artificial Sequence: Synthetic coding sequence
atgtggcagttccggtacgccaagtactacaaggagaacaacgtggagaaaagaacactgataaaagtcttcggcatcagatttgatatcttggtgtttgggactggtgggaaattcgatattatacagcttgtggtctacatcggctctacactgagctatttcggactggctgccgtgttcatcgatttcttaattgatacatactccagcaactgttgtagatcgcatatctatccatggtgcaaatgttgccagccatgcgtagtgaatgagtactattatagaaaaaaatgcgaatccatcgtggaacctaagcctacacttaagtacgtgtccttcgttgacgagagtcacatacggatggtgaaccagcagctgctggggcggagtctgcaggatgttaaaggccaagaggtcccaaggcctgccatggattttaccgacctttctcggctgccactagccctgcatgatacaccccctatccccgggcaacccgaagagatacagctgctgcgcaaggaggccacacctcgaagccgggactcacccgtgtggtgtcagtgtggctcttgtcttcccagtcagctacctgagtcccatcgctgcttggaagagctatgttgcaggaaaaaacccggcgcctgcataaccacttctgagctttttagaaagctggtgctgagccgccatgtgctgcagttcctcctgttgtaccaagagccccttttggcattagacgtcgattcaaccaacagccgcctccgtcactgcgcctaccgctgctacgccacctggcgattcgggtctcaagacatggccgatttcgccaatcttccgtcttgttgtcggtggaggattcggaaagagttccccaagagtgaaggccaatatagcggctttaagtcgccatattag

SEQ ID NO: 202072 - DNA, 387 bp, Artificial Sequence
  Description of Artificial Sequence: Synthetic coding sequence
atgcccgcctgctgcagctgcagcgacgtgttccagtacgagaccaataaggtgacacggatacagtctatgaactacggcacaatcaaatggttcttccatgtaatcatcttttcatacgtgtgttttgccttggtgagcgataaactgtaccagagaaaagagccggttatctcctcggtgcacacaaaagtcaaaggtatcgccgaagtgaaagaggagatcgttgagaacggagtgaagaaactcgttcatagcgttttcgacacggctgattacacattcccgctgcaggggaatagtttctttgtcatgaccaactttttgaagacagaaggacaggagcagcgcctgtgccccgaggagtttcgccctgagggcgtgtag

SEQ ID NO: 202073 - DNA, 1788 bp, Artificial Sequence
  Description of Artificial Sequence: Synthetic coding sequence
atgcccgcctgctgcagctgcagcgacgtgttccagtacgagaccaacaaggtaacaagaatccagagtatgaattatggaaccataaagtggttttttcacgttatcatcttctcctacgtttgttttgccctggtgtcggacaagctgtatcaaaggaaggagcccgttatcagctccgtacatacaaaggtgaagggcattgcagaagtgaaagaggaaattgtcgagaatggcgtgaagaagttggtccatagtgtttttgacacagcggactataccttccctcttcagggaaattcctttttcgttatgacaaacttcctgaagaccgaaggacaggagcagagattgtgcccagaataccctactcgtcgtacattgtgtagctctgaccgcggatgcaaaaaaggctggatggacccacagagtaagggaattcagacagggagatgcgtagtgtatgagggaaatcagaagacctgcgaggtaagcgcctggtgccccatagaagccgtagaagaagctccaagacctgctcttctcaacagcgctgaaaattttacggtgctgataaaaaacaatattgactttcctggtcacaactacactactagaaacattcttccagggctcaacattacctgcacctttcacaaaacacaaaacccacagtgtcctatttttcggcttggggacatcttccgggagacgggggacaacttcagcgacgtggccattcaagggggcatcatgggtattgagatttactgggattgtaatctagaccggtggttccatcactgcagacccaagtatagcttccgaaggctggacgacaagaccaccaacgtgtccctgtatccaggttacaatttccggtacgccaaatactacaaggaaaacaatgtggagaagcggaccttgatcaaggtattcggtatcagatttgatatcctagtgttcggcaccggcggcaaatttgatataattcagctggtggtctacataggctccacattatcatattttgggctggcagctgttttcatcgatttcctgattgatacatatagctccaattgctgcagaagccacatatatccttggtgcaaatgttgtcagccctgtgtagtgaatgaatattactatcggaaaaaatgcgaatctattgtcgaacctaagcctacactgaagtatgtgtcttttgtggatgaatcacacatccgcatggtaaaccagcagctgctaggcaggagtcttcaagatgtgaagggccaggaggttcccagacccgcaatggatttcacggacctgtctaggctaccactggctctgcatgacaccccgcctataccgggccaaccagaggagatccagctactgaggaaggaggccacaccgcgcagtcgggatagcccagtctggtgtcaatgtgggtcatgcctcccctctcagctgcccgaatctcatcgatgcctagaagaactgtgttgcaggaaaaagcccggagcctgcataacgacctctgagctgttccgaaaacttgtgctgtcccgccatgtccttcagtttctgctcctgtaccaggagcctctgctggctctggatgtggattccaccaactctaggcttagacactgcgcatatcgctgttatgctacttggcggtttgggagtcaggacatggccgacttcgccaatctcccgtcttgctgccggtggcggatcagaaaagagttcccaaagtctgagggccagtattccggattcaaaagtccatattag

SEQ ID NO: 202074 - DNA, 1122 bp, Artificial Sequence
  Description of Artificial Sequence: Synthetic coding sequence
atgaccgaggtgctgtggcccgccgtgcccaacggcaccgacgccgcattcctggctggcccaggcagctcttggggaaactccacggttgcttccactgctgctgtgtcttcgtcctttaaatgtgcgctgacaaaaacggggtttcagttttactacctgcccgctgtatatattctcgtattcataatcggctttctggggaactccgtggctatctggatgttcgtgtttcacatgaaaccttggagtggcattagcgtgtacatgtttaacctggcacttgccgacttcctgtacgtactcactctccccgcgttaatcttctattacttcaataagaccgactggattttcggcgatgctatgtgcaagcttcagcgcttcattttccatgtgaatctgtacggcagcatcttgttccttacctgcatatcagctcaccgctacagcggcgttgtgtatccactcaagtcactgggaaggctcaagaaaaaaaacgcgatttgcatttccgtcctcgtgtggctgatagtggtggtggcaatctcacctattctcttttactctggtactggtgtccgcaaaaataaaacaatcacgtgttatgacacaacgtcagacgaatacttgcggtcttattttatttattccatgtgcaccactgttgctatgttttgcgtgcctcttgttttaatcctaggatgctatggcttaattgtgcgcgccttaatatataaagacctcgacaactcaccattgcgtcgcaaaagtatctacttagtcatcattgttttgacagtgtttgcggtgagctacattcctttccacgtcatgaaaacaatgaaccttagagctcgactcgactttcaaacacccgctatgtgcgcgtttaatgatagggtatacgctacctaccaggtcacacgcgggctggcatctcttaatagctgcgtggatccaatactttatttcctcgctggcgatacattccggcgacggctgtcccgcgccacaaggaaggcaagcaggagatccgaagcaaacttacagagtaaaagtgaagacatgacccttaatatcctgcctgagtttaaacaaaacggggatacctctttgtag

SEQ ID NO: 202075 - DNA, 1125 bp, Artificial Sequence
  Description of Artificial Sequence: Synthetic coding sequence
atggccgccaacgtgagcggcgccaagagctgccccgccaacttcctggcggccgctgacgataagttgtccgggttccaaggagacttcctgtggccgattctcgtggtggagtttctagtagctgtggcaagtaacgggctggccctatatagattttcaatacgcaaacaacggccttggcatccagctgtcgtcttctctgtgcagttagccgtgagcgacctgctctgtgccttgacactcccgcccctcgccgcgtacctctatccccctaagcattggagatacggagaggctgcctgcaggctagagcgttttttgttcacctgcaaccttcttggaagcgtcatcttcataacctgtattagccttaacagatacctgggtatcgtgcacccattctttgctagatcacatctcaggccaaaacacgcctgggccgtgtcagctgccgggtgggtgctggccgctcttctggccatgcctaccctatctttctctcatctgaagcgaccccagcagggcgcaggcaactgctccgtggcacggccggaggcttgcattaaatgtctcggcaccgctgaccatggactagcagcctatcgggcatattctctggttctcgcggggttaggctgtgggctgccgttgctactcactttggccgcttacggcgccttgggccgggctgtgctcaggtctccaggcatgactgtggcggagaagctgcgcgtggcagcactcgtggcatccggcgtggcattatacgctagttcctacgtcccctatcacatcatgcgcgtgctgaatgtggatgcaagacgccgctggtccacacgatgcccatctttcgccgatatcgcccaggccacagccgccctggagttaggaccttatgttggctaccaagttatgcgtgggttaatgccgctagccttctgcgtgcaccccctcctctacatggccgccgttccgagcctcggatgctgctgccggcattgccctgggtacagggattcttggaatcccgaagatgccaaatcaaccgggcaggcccttcccctcaatgccaccgccgctccaaagccatcggagccacagtccagagaattgagccagtag

SEQ ID NO: 202076 - DNA, 1029 bp, Artificial Sequence
  Description of Artificial Sequence: Synthetic coding sequence
atgcaggccgtggacaacctgaccagcgcccccggcaacaccagcctgtgtacccgggattataaaatcactcaggtactttttcctctactgtataccgtacttttttttgtgggcctgatcacgaatggcctcgcaatgcgaatattctttcagatcagatccaagagcaatttcataatcttcttgaagaacaccgtcatcagtgatctcctgatgatcctcacttttcctttcaagatcttgtccgatgcaaaactggggaccggaccactgcgtaccttcgtgtgccaggtaacctccgttatattttacttcactatgtatatctccatctcctttctcggcctcattacaatagacaggtaccagaagacaacccgcccattcaagacttctaaccctaaaaatcttctaggtgccaagatcctgtctgttgtgatttgggccttcatgtttctgctcagcctgcctaacatgattttgaccaaccgacagccccgcgataaaaacgtgaaaaaatgctcgttcctgaagagcgagttcggcctggtctggcacgagatcgtaaattatatctgccaggtcatcttttggatcaactttctgatcgtgattgtatgttatacactcatcactaaggagctgtacagaagttatgtccgcaccagaggggtgggtaaggtgcctcgtaaaaaggtgaacgtcaaggtttttataatcatcgcggtgttcttcatttgtttcgtgcctttccacttcgccagaataccatataccctctcccagactagagacgtcttcgactgcaccgccgaaaacacgctgttttatgtgaaagaaagtacactttggctgacgtcactcaacgcttgtttggaccccttcatctatttttttctgtgcaagtcattccggaatagcttgatatccatgctcaagtgcccgaacagcgccacatccttatcacaggataataggaaaaaggagcaagacggaggcgatccaaatgaggagacaccaatgtag

SEQ ID NO: 202077 - DNA, 738 bp, Artificial Sequence
  Description of Artificial Sequence: Synthetic coding sequence
atgcaggccgtggacaacctgaccagcgcccccggcaacaccagcttgtgcaccagagactacaagattacacaagtgctattcccactcctgtatacagtactattttttgtcgggctgataacgaacggtctggccatgcgcatctttttccagattcgctcgaagtcgaactttatcatttttctcaagaacactgttatttctgacttgctgatgatattgacttttccattcaagattctatcagatgccaagctcgggaccggcccacttcgaacgttcgtctgtcaggttatattttggattaattttctgatcgttatcgtttgttatacgctgataacaaaagaactgtataggtcatatgtccgaacccggggcgtcggaaaagtcccacgcaagaaggtcaatgttaaggtgttcatcattatcgccgttttcttcatatgcttcgtcccattccacttcgcccgtatcccttatactctctcacagactcgagacgtctttgattgtacagcggaaaataccctcttctacgtgaaggagtctactttatggctgacatctctcaacgcttgcctggatccgttcatctactttttcctgtgtaaaagctttcggaactccctgatctccatgctgaagtgccctaactctgccacaagcctctcacaggacaacaggaaaaaggaacaggacgggggcgatcccaatgaggagacgcctatgtag

SEQ ID NO: 202078 - DNA, 1134 bp, Artificial Sequence
  Description of Artificial Sequence: Synthetic coding sequence
atggccgccgacctgggcccctggaacgacaccatcaacggcacctgggatggagatgagctgggatacagatgccggttcaatgaggactttaagtacgtgctccttccggtgtcatacggcgtcgtttgcgtcccagggctgtgtctgaacgccgtcgcactgtacatcttcctctgtcggttgaagacctggaatgcttcgacaacttacatgtttcacctcgcggtgtcggatgccttatacgctgccagcctgcccctgctggtttattactacgccagaggagatcactggcctttttcaactgttctgtgcaaactcgtccggttcttattttacacaaatctgtactgtagtatcctcttcctaacttgtattagcgtccataggtgtctcggggttcttcggcccttgcggagcctcagatgggggagagctcggtatgcacgccgggtagctggtgccgtctgggttctcgtactggcttgtcaagcacccgttctatactttgttaccacctcagcccggggggggagggttacctgtcatgacacgtctgcccccgagctgttctcccgctttgtggcatactctagcgtcatgcttggcctcttgtttgccgttcccttcgcggtcattctagtgtgctacgttctcatggcccgtagactgctcaagcctgcctatggaactagcggtggcctgccacgggctaagcgaaagtctgttcgcactattgctgttgtactggcggtgtttgccctatgcttccttcctttccacgttacaaggacattgtactacagcttccggtccttggacttatcttgccataccttgaatgctataaatatggcctacaaggtgacccgcccgctcgcaagcgcgaactcctgcctagatccagtactctacttcctggccggacagcgcttagtgaggttcgcccgcgacgctaaaccacccaccgggccatccccagctacccctgccaggcgacgactgggactgaggcggtctgaccgcaccgacatgcagagaattgaggacgtcctggggtcgagtgaagattcccgaagaacagaaagtaccccggctggctcagagaataccaaggatatacgtctgtag

SEQ ID NO: 202079 - DNA, 1134 bp, Artificial Sequence
  Description of Artificial Sequence: Synthetic coding sequence
atggccgccgacctgggcccctggaacgacaccatcaacggcacctgggatggagacgagctcgggtaccggtgcaggttcaacgaagatttcaaatacgttctcctgccagtgtcttacggagtagtgtgtgtacctgggctgtgtcttaacgcagtcgcgctgtatatctttctgtgccgccttaaaacctggaacgcctctacaacgtacatgttccacttggccgtttctgacgctctgtacgctgcgagtctgccacttctcgtctactactatgcaagaggcgaccactggccattctcgaccgtactctgcaagttggtgcggttcctgttctacactaatctgtactgctcgattctgtttttaacttgtatatcagtgcatcgctgcctcggcgtgctgcgacccctccgaagcctcaggtggggcagagcccgctacgcaagaagggtggccggcgctgtttgggtgttagtgctggcctgccaagctccagtactgtatttcgtgaccacctcagctaggggcgggcgtgtgacgtgtcacgacacatcagccccggagttgtttagtcggttcgtcgcctatagtagtgtgatgctggggctcctctttgccgtgcctttcgctgtcatcctggtttgttatgtgctcatggcgcggcgattactcaagcctgcttatggtacatccggcggccttccccgcgccaaacggaaaagcgtccgcaccattgccgtagttttagccgtcttcgccctctgcttcctgccatttcatgtcacgaggaccctctactatagttttcgaagcctcgacctctcctgtcatacgctgaatgccattaacatggcctacaaggtcacaaggccgctcgcctcggctaactcctgtctggatcctgtgctttactttctggcgggccagagactggtcaggtttgcacgggatgccaagccccccaccggtccttctcccgccaccccagctcgcaggaggctgggactcaggcgttccgatagaaccgacatgcagcgaatagaggacgtcctggggtcctccgaggatagtcgaagaaccgagagcaccccggcgggtagtgagaacaccaaggacatccgcttgtag

SEQ ID NO: 202080 - DNA, 1134 bp, Artificial Sequence
  Description of Artificial Sequence: Synthetic coding sequence
atggccgccgacctgggcccctggaacgacaccatcaacggcacctgggacggcgatgaactggggtacagatgtcgttttaacgaagatttcaagtatgtgctgctgcccgtttcctacggcgtagtttgcgtgcctgggctgtgcctgaatgccgtagcgctttacattttcctatgcaggcttaagacctggaacgctagcactacttacatgttccacttggccgtctcagatgcattatatgcggcatccttgccgctgcttgtttattactacgcgaggggggatcactggcccttctccaccgttctgtgcaagctcgtgaggttcctcttctacacaaacctgtattgttccattctttttctcacctgtatttccgtgcaccgctgcctgggggtgctgcggccactgcgcagtctgagatggggacgggccaggtatgccagaagggtggccggagccgtgtgggtcctcgtcctggcctgccaggcccccgtgctctattttgtgaccacatcggcccgaggcggccgggttacatgccatgacacgtctgctcctgagctgtttagtcgctttgtagcatattcatctgtcatgcttgggctgctgttcgccgtgccatttgccgtgattttagtgtgctatgtgttgatggcgcgaaggctccttaaacctgcgtatgggacctccggagggcttcctagggccaaacggaaatcggtgcgcacaatagcagtagttctggctgtattcgctttgtgcttcctgcccttccatgttacccgtactctatattactcattccgctctcttgaccttagctgtcatactctgaacgcaattaacatggcttataaggtcacccgtccattggcaagcgccaattcctgcctggaccccgttctgtattttttggccgggcagaggctagtgagattcgcccgtgatgctaagccgcctactggcccctcacctgccactcccgccaggagacggctggggcttagacgatctgacagaactgatatgcagagaatcgaagatgtattgggctctagcgaagattcccgtcgaactgagtcgacgcccgccggcagtgagaataccaaggatattaggctgtag

SEQ ID NO: 202081 - DNA, 1080 bp, Artificial Sequence
  Description of Artificial Sequence: Synthetic coding sequence
atgcaggtgcccaacagcaccggccccgacaacgccaccctgcagatgctgcggaatcctgccattgctgtcgctctgcccgtggtgtacagccttgtggccgctgtatctattccgggtaacctgttttctctctgggtgttgtgtcggcgtatgggcccccggtctccctcagttatttttatgattaacctgtcagtgactgacctgatgctcgcctctgttctccctttccagatctattaccattgtaatagacaccattgggtgttcggcgttttgctctgtaatgtggtcactgtggctttttatgcaaatatgtattctagtatacttacaatgacctgcatctctgtggaacggtttctaggtgtcctgtaccccctcagtagtaaacgctggcgaaggcgcagatatgccgtggccgcttgcgcgggaacatggcttcttctgctcaccgccctgtccccactggcgagaaccgacctgacatatcccgtgcacgcattaggaatcattacctgcttcgacgtcctcaagtggaccatgcttccttctgtggcgatgtgggcggtgtttctgttcacaattttcattctcctctttctcatcccatttgtcattaccgtggcttgttataccgctactatattgaaactgctcaggaccgaggaagcccatggtcgcgaacagcgcaggcgggcagtggggctggccgcagttgtcctactggcgtttgttacttgcttcgcacccaacaatttcgtgcttttagcccacatcgtgagccgattattttacggaaaatcatactaccatgtgtataagctaaccttgtgcctgtcgtgtcttaataattgcctggatccattcgtctactatttcgcctctagagagttccagctcagattgcgcgaatatttggggtgccgaagagtcccacgtgacactctcgacactcggagagaatcattgttttctgcaaggacgaccagtgtgagatctgaggccggagcccaccctgaggggatggaaggcgccacccgccccggactgcagcggcaggagtcggtattctag

SEQ ID NO: 202082 - DNA, 189 bp, Artificial Sequence
  Description of Artificial Sequence: Synthetic coding sequence
atgagcgagcggcagggcgccggcgccaccaacggcaaggacaagacatccggggagaatgacggccagaaaaaggtgcaggaagaatttgacatcgacatggacgcacccgaaaccgagagggccgctgtagcgatccagagccagttcagaaagttccaaaaaaagaaggcgggaagtcagtcttag

SEQ ID NO: 202083 - DNA, 1914 bp, Artificial Sequence
  Description of Artificial Sequence: Synthetic coding sequence
atggccagcaacgagcgggacgccatcagctggtaccagaagaagattggcgcttacgaccagcagatttgggagaagagcatcgagcagacacagattaagggtttaaagaataaaccaaaaaagatgggccacatcaagcccgacctgattgacgtcgacttaatccgaggcagtacattcgcaaaagctaagcctgaaattccctggacctccttgaccaggaagggacttgtgagagttgtttttttccctctcttctcgaattggtggattcaggtcacttccctgcgaatctttgtgtggcttttgttgctgtatttcatgcaggtgatcgctatcgtcctctacctcatgatgcccatagtcaacatcagtgaagtccttgggcctctgtgtctgatgctgcttatggggactgtgcactgccagatcgtctcaacccagattaccagaccatcaggaaataatgggaacagaaggcgcaggaagctccggaagaccgtgaacggggacgggagcagagaaaatggcaataatagctccgacaaagtgagaggtattgaaaccttggaatccgtgccaattattggtgggttctgggaaaccattttcgggaaccgaataaagagagtcaagctgatttccaataaaggcacggaaacggacaacgatccgagttgcgttcacccaatcatcaagcggagacagtgtagaccagaaattagaatgtggcaaacccgggagaaagccaagttttctgacggagagaagtgtcgacgggaagcgttccgacgtcttggcaacggcgtgtctgatgatctgagctccgaggaggacggggaagccagaacacaaatgatcctattacgacggtccgtcgaaggggcttcctcagataacgggtgtgaggtgaagaatcgcaaatccatactctctcgacacctgaacagccaggtgaagaagaccacaactagatggtgccatatcgttcgcgactcagactctctcgcagaatcagagtttgagtccgccgctttcagccaggggtcaaggtccggcgtcagcgggggcagtcgatcattaaatatgagcaggcgtgatagcgagagtaccaggcacgactccgagacggaagatatgttatgggatgacctgttacatggaccggaatgccgatcgtccgtcaccagtgactctgaaggcgctcatgtcaatacgctgcactccgggactaagagagatcccaaagaagacgtgttccaacaaaatcatcttttttggctacagaatagcagcccttctagcgatcgggtcagtgccatcatctgggaaggcaacgagtgcaaaaaaatggacatgagtgtcctggaaatttccgggatcatcatgagccgggtcaacgcctaccagcagggcgtcggctatcagatgctcggcaatgtggtcacgattggactcgcattctttccattcttgcaccggctgtttcgggagaagtctctcgaccagctgaagagcattagtgccgaagaaattctcaccctgttttgtggggcaccaccggtgacgcccatcatcgtgttgtcgattatcaatttcttcgaacgtctctgtctgacctggatgttcttctttatgatgtgcgtcgccgagcgtacctataagcagcggtttctgttcgccaagctgttcagtcacataacgtctgctcgcaaggctcgtaagtatgaaatcccacattttcgcctcaagaaggtcgaaaatattaagatttggttgtcccttcgtagctatcttaagagacgaggcccacagcgttccgtggacgtggtcgtgagcagcgtgttccttctgactctctctatcgcattcatttgttgcgctcaggttaaggtgtcacacctcctgtag

SEQ ID NO: 202084 - DNA, 2130 bp, Artificial Sequence
  Description of Artificial Sequence: Synthetic coding sequence
atggccagcaacgagcgggacgccatcagctggtaccagaagaagatcggggcttacgatcagcaaatttgggagaagtctattgagcagacgcagataaaagggctcaagaacaagcccaaaaagatgggccacattaagccagatctgattgatgtagacctgatcagagtcattgcaatagttctctaccttatgatgccaatcgttaatatctcagaggtgctgggtcctctttgtcttatgctcctaatgggtaccgtccattgccagattgttagtacccagatcactagaccttcaggtaacaacggcaacagacgcaggcggaaacttagaaagacagttaatggagacgggtctagggaaaatggtaataattcgtccgacaaagtcagagggatcgagacactggagtccgtgcctattattggcgggttctgggaaaccatatttggcaatcgaattaaacgcgttaaactaatctctaataagggcacggagacagataacgacccatcctgtgtccacccaatcatcaagcggcggcaatgtagacccgagattagaatgtggcaaactagggagaaggcgaagttcagtgatggtgaaaaatgcagacgtgaagccttcaggcgactgggaaatggcgtgtcagacgatctgtctagcgaggaagacggagaggcccgcacacagatgattctgttaagacggagtgtggagggcgcctccagcgacaatggctgtgaggtcaaaaatcggaaatcgattcttagccgtcacctcaatagtcaggtgaagaaaaccacaactcggtggtgccacattgttagagacagcgacagtcttgctgagtctgagtttgaaagtgcggccttttcacagggatcacggtcaggtgtgagcgggggcagcaggtctttgaatatgagccgacgggattccgagtccacacgtcacgactcagaaacggaggacatgctgtgggacgatctgctgcacggccctgaatgccgatcaagcgtcaccagtgattcagagggcgctcatgtgaacactctccactccggtaccaagagagaccccaaggaggacgtttttcagcagaatcacctcttctggttgcagaattcctcgccgtcctcagatagagtcagtgccattatttgggaaggaaatgagtgcaagaagatggacatgtcagtacttgagatcagcgggatcatcatgtcccgtgtcaacgcctatcaacaaggggtggggtatcagatgctgggtaatgtggtgactattggtctggcatttttcccattcctgcatcggctgtttagagaaaagtccctagaccaattaaaaagtatctcagccgaggaaatactcaccctcttctgtggagccccacccgtgacccccataatcgtgttgtctatcatcaactttttcgagaggttgtgtctcacgtggatgttcttctttatgatgtgcgtggccgagcgaacttacaagcagcgattcctcttcgctaaacttttcagtcacatcacatcagcccgaaaagctcgcaagtacgaaatcccccactttagattgaaaaaggtggagaatatcaagatctggcttagtctgcgttcctatttgaagaggcggggaccccagaggagcgtggatgttgtggtcagttcagttttccttcttaccttaagcatcgcgtttatttgttgcgctcaggtgctgcagggacataaaaccttcctgaatgacgcctacaattgggaatttttaatctgggagacagccttgctgctgtttctgctgcggctcgcctcactggggagtgaaacaaataaaaaatacagtaatgttagcattctgctgaccgagcagataaacttatatctgaagatggaaaagaagccaaataaaaaagagcagctaaccctcgtgaacaacgtgttaaagctgtctacaaagctccttaaggagcttgacactccttttagactgtacggcttgacaatgaacccactcatctataatatcacgagagtggtcatactctctgccgttagtggcgtgataagtgacctgctggggtttaatatccgtttgtggaagatcaaatcctag

SEQ ID NO: 202085 - DNA, 2154 bp, Artificial Sequence
  Description of Artificial Sequence: Synthetic coding sequence
atggccagcaacgagcgggacgccatcagctggtaccagaagaagattggcgcctatgatcagcagatctgggagaagagtattgagcaaacgcagataaagggcctcaagaataaaccgaagaaaatgggacacataaaacccgacctcattgacgtggacttaatcaggggttccacctttgccaaagctaaacccgagattccctggacttctctgactcgcaaaggcttggtacgcgtggtattcttcccattgttctccaactggtggattcaggtgaccagcctgcgtattttcgtctggctactgctcctgtacttcatgcaggtcattgcaatcgtgctatatctgatgatgccaatcgtcaatatcagcgaggtcctgggacccctctgcctgatgctgctgatgggcacagtccactgccaaattgtgagcactcagatcacgagacccagcggaaacaatggtaatagacggcggaggataaaacgcgtgaaactgataagcaacaaaggcaccgagacggataacgaccccagctgtgtgcaccccataatcaaacgacggcagtgccggcctgagatccgtatgtggcagaccagggagaaagccaagttttcagacggtgagaagtgtaggcgggaggcatttaggcgcctggggaacggcgtcagcgacgacctttctagtgaagaggacggagaggcaaggactcagatgattctcctgcgccggtctgttgaaggcgccagcagcgacaatgggtgcgaagtcaagaataggaaatccatactatctcgtcaccttaactctcaggtgaaaaaaaccacgacacgctggtgtcacatcgtgcgagattccgactcacttgctgagtctgagttcgagtccgcagccttttctcaaggatcacgcagcggggtgtcaggtggctccagatcccttaacatgtcacggagggattccgagagcactcgccatgacagtgaaacagaggacatgctttgggacgacctcttacatggccctgagtgtcggtcctcggtcacaagcgacagtgagggagcccacgtgaacacattgcacagcggaactaagcgagatcctaaggaggatgtctttcaacagaaccatctgttctggctacagaacagctcaccgagtagcgacagagtctccgccataatttgggaggggaatgagtgtaagaagatggatatgtcagttctcgagatctcaggcatcatcatgagtcgagtgaacgcgtaccagcagggtgtgggatatcagatgctcgggaatgttgtaactatcggcctggcctttttcccctttctccataggctcttccgggaaaaatcacttgatcagctcaagagcatctccgctgaagagatcctcactctattttgcggagctcctcctgtgacacctatcatagtgctttcaattatcaatttcttcgaacgcctgtgtcttacatggatgttttttttcatgatgtgtgtagctgagcggacatataaacagagatttttgttcgccaagttgtttagccacatcactagcgcccggaaggcacgtaaatacgagattccccatttccgtttaaaaaaagtggagaatattaagatttggttgtctttgaggtcttacctgaagaggcgcggaccccagcgcagtgtggacgtagttgtctcctccgtattcctgctgaccctgtccatcgctttcatatgctgtgcacaagtgttgcagggacacaagacgtttctcaatgacgcttacaattgggagtttctgatctgggaaactgctctgctgctatttctcctacgattggcgagcttgggatcagagaccaataagaaatacagcaatgtgtctatattgcttacagaacaaatcaacctttatctgaaaatggaaaaaaaaccaaataagaaagaacagctgactcttgtgaacaatgtcctgaagctctctacgaaactgctgaaagagttggacacacctttccggctttatgggttgaccatgaatcccctgatctacaatattaccagagtcgtgatcttgtcagccgtttctggtgtcatcagtgacctgctgggattcaacatcagaatctggaagcattcttcttag

SEQ ID NO: 202086 - DNA, 2154 bp, Artificial Sequence
  Description of Artificial Sequence: Synthetic coding sequence
atggccagcaacgagcgggacgccatcagctggtaccagaagaagatcggtgcgtatgaccagcagatttgggagaagagtattgagcagacacagatcaaaggtctaaaaaataagcctaaaaaaatggggcacatcaaacctgatctaattgatgtggacctgataaggggatcgaccttcgcaaaggctaagccagaaattccttggacatccttaactcgtaaagggcttgtgcgggtcgttttcttccccctgttttctaactggtggatccaggttacttctttacgaatctttgtgtggctgctccttctgtattttatgcaggtaatcgcaattgtcctttacttgatgatgcccattgttaacatatctgaggtcctggggcccctctgtctcatgctgttaatgggcacggttcactgccagatcgtctccacgcagattacccggcccagtgggaacaatgggaatcgcaggcgaagaatcaagagagtcaagctaatcagtaacaaaggcacagaaactgacaacgacccttcttgcgtgcatccaatcatcaagcggcgacagtgtaggcctgagataagaatgtggcagactcgagaaaaggccaagttctcggacggtgagaagtgtcgaagggaggcctttcgacgtcttgggaacggcgtcagtgacgacctgtcttcagaggaagatggtgaagcaaggacacaaatgattctgctgagaaggagcgtcgagggtgcctctagcgacaacggctgtgaggtaaaaaatcgcaaaagcatcctctctcgccaccttaactcccaggtcaagaaaaccacaactagatggtgtcacatcgtgagggacagcgacagtttagccgagtccgagtttgagtccgcggctttcagtcaggggtccaggtctggtgtgtcaggaggaagcagatcacttaatatgagtaggcgcgactcggaatctacgcgccacgattcggagaccgaggacatgttgtgggatgacttgcttcacggaccagagtgtcggtcatccgttaccagcgattctgagggggcccacgtgaataccctacatagtggcactaagagagatcccaaggaagatgtgtttcaacagaatcatctgttttggctgcaaaacagttcgccgtcaagtgatagggtgagcgctattatctgggaagggaatgaatgtaagaaaatggatatgagcgtgttagagatttccggtataatcatgtcccgggtaaatgcgtatcagcaaggcgtgggataccagatgttgggaaatgttgtgactataggccttgcatttttcccctttctgcataggctatttagggagaagagcctggatcagctcaagagtattagcgccgaagaaattcttactctcttctgtggggctcctccggtaactccgattatcgtgctctctattattaactttttcgaaagactgtgcctgacctggatgtttttcttcatgatgtgcgtggccgaaagaacctacaaacaaaggtttcttttcgccaagttatttagccacattacctcggcccgaaaagcaaggaaatatgaaattccacactttagactaaagaaagtggagaacatcaaaatctggctttcactgcgctcgtacctcaaaaggcgcggtccacagaggtcagtggacgtggtggtctcatcagtttttttgctgactctctccatcgcctttatctgttgtgcccaagtgctgcaaggacataagacctttctgaacgacgcttataactgggaatttttgatctgggagaccgctcttctcttattcctgttgagacttgccagcctgggttccgagaccaacaagaaatattccaatgttagtatcctgttgaccgagcagatcaacctctatttaaagatggagaaaaagccaaataagaaggagcagctcactctcgtcaacaacgtattgaagttgtccactaaactcttaaaggagcttgacaccccattccgcctgtacggcctgacaatgaatcccttgatatataacatcacacgggtggtcattctctccgcggtgagcggagtgatctcagacctactgggttttaacatccgcctgtggaaaatcaaaagctag

SEQ ID NO: 202087 - DNA, 2130 bp, Artificial Sequence
  Description of Artificial Sequence: Synthetic coding sequence
atggccagcaacgagcgggacgccatcagctggtaccagaagaagattggcgcttacgatcagcagatctgggagaaaagcattgaacagacccaaatcaagggtttgaagaacaagccaaaaaaaatgggtcatattaagccagatctcatagacgtcgacctgatacgcgtaatcgccatcgttctgtacctaatgatgcccatcgttaatatatctgaggtgctgggcccactctgcctgatgctgcttatgggcacggtgcactgtcaaattgtctctactcagatcactaggccaagtgggaataacggcaatcggaggaggcgcaaactaaggaaaaccgtgaacggggacggatctagggaaaacggtaataattcgtctgacaaggtgcggggcattgaaaccctcgaatctgtacccatcattgggggattttgggagaccatcttcggcaaccgtattaagcgggtgaaactgatttcgaataagggcacagagaccgacaacgacccctcgtgtgttcatccaataataaagagaaggcagtgccggccagagatccgaatgtggcagacccgggaaaaggccaagttcagcgacggagaaaagtgccgaagggaggccttcaggagactcggtaatggagtctcagacgacctgagtagcgaggaagacggggaagcccgtacacagatgattctgttgcggagatccgtggagggcgctagctcagataatggctgcgaagttaaaaatagaaaaagcatactgtctcgccacctcaacagtcaggtaaaaaagaccacaacacggtggtgccatatcgtcagagatagcgatagtttggctgaaagtgagtttgaatctgcagctttcagccaaggcagccgttccggcgtgagcggagggagccgttcactgaacatgagcaggagagattccgagagtacccggcacgatagcgaaacagaggacatgctctgggacgatcttctgcatgggccagagtgtcgttcttccgtgacatcagactcagaaggggcccacgtgaataccctgcattctggtacaaaacgtgaccctaaagaggacgtatttcagcagaatcacctcttttggctccagaatagcagtccgagctctgacagggtctcagcaataatctgggagggaaacgaatgtaagaagatggatatgtcagtgctcgagattagcggaattataatgtctagagtcaacgcataccagcagggcgtggggtaccagatgctgggcaatgtggtcacaatcgggctggcctttttccccttcctccaccgccttttccgggagaaatccctagatcaattgaagagcatttccgccgaagagattctcacgctgttttgcggggcacccccagtgactccaattattgtgctgagcattattaatttcttcgagagactctgcctgacatggatgtttttcttcatgatgtgcgtggccgaacgcacttataagcagagattcctttttgctaaactattcagccatattacctctgcgaggaaggccaggaagtatgagatcccacatttcagattaaagaaagtggagaacatcaaaatctggctttctctcagatcatatcttaagaggcgggggccccagaggagtgttgatgtggtggtctcttccgtgtttctcctgaccctttcgattgcctttatatgctgtgcccaggtgcttcaaggacataagacattcctgaacgacgcttataattgggagtttctgatctgggaaactgctcttttattgttccttctgcggctcgctagcctggggagcgagaccaacaagaagtatagcaatgtgtccatcttactaactgaacaaattaacctgtacttgaaaatggagaagaaaccgaacaagaaagagcagttgacccttgttaataatgtccttaaactgagcactaagctgctgaaggaactggacacccctttcagactgtatggactcactatgaatcctctcatttataacatcacgcgggtggtgatcctgtcggcagtaagcggtgttattagcgacctcctcggatttaatatccggctttggaaaatcaagagctag

SEQ ID NO: 202088 - DNA, 2289 bp, Artificial Sequence
  Description of Artificial Sequence: Synthetic coding sequence
atggccagcaacgagcgggacgccatcagctggtaccagaagaagatcggcgcttatgatcaacagatatgggagaagtctatagagcagacccagataaagggtcttaagaataagcccaagaaaatgggtcacattaagcctgatctgatcgatgtggatttgatacgcggctccacctttgcaaaagcgaagccagaaatcccctggacttctctcacacgcaaagggttagtgagagtggtttttttccctcttttcagcaattggtggattcaggtcaccagcttgcgcattttcgtgtggttacttttgctgtactttatgcaagtcattgccattgtcctgtaccttatgatgccaatagttaacatctctgaagtgctggggccattatgcctgatgctactgatgggaactgtccattgccaaattgtttctactcagatcactaggccctcagggaataacgggaacagaagacggcgtaaattgaggaaaacagtcaacggtgacggcagcagagaaaacggcaacaattcttctgataaggtgcgtgggatcgaaacccttgagtctgtccctattatcgggggcttttgggaaacgattttcggaaacagaatcaagagagtgaaattgataagtaataaaggcacagaaaccgataacgatccctcctgtgtgcacccaatcatcaagagacgccaatgccgcccagagatccggatgtggcagacacgcgagaaagccaagtttagcgacggcgaaaaatgtcggagggaggctttccgccggttgggcaacggggtcagtgacgatcttagttctgaagaagatggtgaggctaggactcagatgatcctgttgcgtcgctctgtggagggggcatctagcgataacggatgtgaggtgaagaatcggaaatccatcctctcacgacacctgaactctcaggtgaagaagactacgactaggtggtgccatatcgtgcgagactctgacagcttagcggaatctgagttcgagtcagccgctttctcccaaggcagccgcagcggtgtgagcggtggctctaggagtctaaacatgagtcgacgtgattctgagtctacacgtcacgacagcgagaccgaagacatgctatgggacgacctactgcatggaccggaatgccgcagcagtgtaactagtgactccgagggagctcacgtgaacaccttacattcaggaactaagcgtgatcccaaggaagacgtgttccagcagaaccacttgttctggttacaaaattccagcccatccagtgatagagttagtgctataatatgggagggaaacgaatgtaagaaaatggacatgtccgtcttggagatctctggcattattatgagccgcgtcaatgcctaccagcaaggagtgggatatcagatgctgggtaacgttgtcacaatcggtttggcgttttttcctttcctccacaggttgtttagggagaagagccttgatcagttaaaatcaatcagcgctgaagaaatcctcactctgttttgcggtgctcctccggttaccccgattattgtgctcagcattataaacttcttcgaaaggctctgtttaacctggatgttttttttcatgatgtgcgtggctgaaaggacatacaagcagaggttcctattcgccaagctcttcagccatattacgtcagccagaaaggcgagaaaatatgagattccacactttcggctgaaaaaggttgaaaacataaagatctggctgtcactgcgtagctacctgaagaggcgcggcccccagagaagtgttgatgtggtggtcagtagcgtgttcctcctgacactgagcatagcttttatctgctgtgctcaggtcttgcaaggacataagacctttctcaatgacgcttataactgggaattcctgatctgggagacagccttgctgttattcttacttaggttggcctcactgggttccgaaactaataaaaaatactcaaacgtgtctatcctgttgacagagcagatcaacctgtacttaaagatggagaagaaacccaataaaaaggaacagctgacccttgtgaataacgtcctgaaattatcaactaagctgctcaaggaactggataccccattcagattgtatggcctgacaatgaatcctctaatctacaatatcactcgcgtcgttatcttgagcgccgttagcggtgtgatttccgacctgcttgggtttaatataaggctctggaaaattaagtcttag

SEQ ID NO: 202089 - DNA, 2289 bp, Artificial Sequence
  Description of Artificial Sequence: Synthetic coding sequence
atggccagcaacgagcgggacgccatcagctggtaccagaagaagatcggggcctacgatcagcaaatttgggagaagagcatcgaacagacacagatcaagggactcaaaaataagcctaagaaaatggggcatattaagcctgaccttatcgacgtcgatctgatcagggggagcactttcgcaaaggccaagcccgagatcccatggacttctctcactcgcaaagggctggtgcgcgttgtgttctttccattgtttagcaactggtggattcaagtgacatcgctgcgaatcttcgtgtggttactgctgttgtattttatgcaggtgattgcaatagtcctttacctcatgatgcccatcgtcaacatctcagaggtactgggcccactctgccttatgctgctgatgggaacagttcactgtcagattgtctctactcaaataaccagaccgtctggcaataacggaaataggcgtcgtcggaaactgagaaagaccgtaaatggtgatggctcccgcgagaacggcaacaattcctcggataaggtgaggggaatcgagaccctggaatccgtgcctattatcggtggtttctgggaaaccatctttggaaacaggatcaagcgcgtcaagctgatttccaacaaaggtaccgagacagacaatgatccatcttgtgtccatcccatcataaaacggcggcagtgcagaccagaaatacggatgtggcaaactcgagagaaggcaaagttttctgacggagaaaagtgtcgaagagaagctttccggaggttaggtaatggcgtgtcagatgacttaagctctgaggaagatggagaagctcgaacacagatgatactgctaagacgaagcgtcgagggcgcttcttctgacaatggctgtgaggtcaaaaatagaaagtcgatcctgtcccgtcatctgaacagtcaagtgaagaagaccacgacgaggtggtgtcacattgtgagagattcagactctttggctgagagtgagtttgaaagcgctgccttttctcaaggatctaggagtggcgtgtcaggggggtcgcgttccctgaacatgagccggagggattcggagtcaacgaggcatgacagtgagacagaggacatgctttgggacgatttattacatggcccagaatgcaggtcatccgtcaccagcgattccgaaggcgcacacgtgaacacgttgcacagcggtacgaaaagagatccgaaagaagacgttttccagcagaaccaccttttttggctgcaaaattctagcccatcttcagaccgagtcagtgccatcatttgggaagggaatgaatgtaaaaagatggacatgagcgtgttggagatttctggcattattatgtccagagtgaatgcctaccagcaaggagtcgggtatcagatgttgggaaatgtggtaacaatagggctcgctttcttcccatttttgcaccggctctttagagagaaaagcttggatcagctcaagagcatttcagcagaggaaatcttgacactcttctgcggcgctcccccagtgacgcctatcatagttctatccatcataaactttttcgagcgtctttgcctcacctggatgttcttttttatgatgtgtgtggctgaacggacgtacaagcaacggttcctgttcgctaagcttttctcacatattacctctgccaggaaggccaggaagtacgaaatcccgcacttccgactgaagaaggtcgagaatatcaagatctggctcagcctacgttcctacttgaagagaagaggcccccagaggtcagtggatgtcgtggtgtcctcagtgttcctgctcaccctgtcaattgcctttatatgttgcgcacaggtcctccagggccacaaaactttcttaaatgatgcttataactgggagttcctcatttgggaaacagcgctgctgctcttcctgttgcgcctggcatccctgggaagtgaaacaaataagaagtactcgaatgtgtctatattgctgaccgaacagattaatctgtatttaaagatggagaaaaagccaaataaaaaggagcaattaactttagtgaataacgtcctcaagttatcgactaagttactaaaagaattagacacgcctttccgtctgtacggcctcaccatgaaccctctgatttataatattactagggtagtcattctctctgccgtgtccggggtgattagtgacttgctcggtttcaatataaggctctggaagataaagtcctag

SEQ ID NO: 202090 - DNA, 996 bp, Artificial Sequence
  Description of Artificial Sequence: Synthetic coding sequence
tgacagacccgggagaaggccaagttcagcgacggcgagaagtgccgccgggaagcctttagacgcctcggaaatggcgtgtctgatgatctgagttccgaggaagacggggaggctcggacccaaatgattctgttgcgacgatccgttgagggggcctcaagcgacaatgggtgcgaggtgaagaaccgtaagtctattttgagtcgccatctgaatagccaggttaaaaaaacgaccactagatggtgccacattgtgcgggactcagactcactggctgaaagtgagtttgaatctgcagccttctctcagggatctcggtccggcgtcagcggcggttcacggagtctgaacatgtctagacgagattctgaatctacaaggcatgacagcgaaaccgaagacatgctctgggacgacctcctgcacggccctgagtgtcgttcgagcgtgacttctgacagtgagggggcccacgtgaatactctgcactcaggaacgaaacgggacccaaaggaagatgtgttccaacagaaccacctgttctggctgcagaacagttctccatcctcagatagagtgtccgccattatttgggagggaaatgaatgcaaaaagatggatatgtctgtgctggaaatctcagggattattatgagcagagtcaatgcgtatcagcagggtgtgggctatcagatgctagggaacgttgtgaccataggcctcgccttcttccctttccttcacagattgttcagagagaagtccctggatcagctgaaatcaatcagcgcagaagagattcttaccctcttctgcggcgcaccacccgtcacaccaatcatcgtgcttagtattattaattttttcgaacgtctctgtctaacgtggatgttcttctttatgatgtgcgtagcggagaggacatacaagcaggtctctggcgagatccgtaagatcttctatttattcctttacatgatttttcattag

SEQ ID NO: 202091 - DNA, 318 bp, Artificial Sequence
  Description of Artificial Sequence: Synthetic coding sequence
atggccagcaacgagcgggacgccatcagctggtaccagaagaagatcggtgcatacgatcagcagatctgggagaaaagtattgagcagacccaaatcaagggcctgaagaacaaaccgaagaagatggggcatataaaacctgatctcatcgatgtcgatctcattagaggcagtacattcgcgaaggccaaaccagagataccatggactagtctcacaagaaagggcttagttcgggttgtgtttttccccttatttagtaactggtggatacaggtgacctctctgcggatctttgtgtggttgctcttatag

SEQ ID NO: 202092 - DNA, 702 bp, Artificial Sequence
  Description of Artificial Sequence: Synthetic coding sequence
atggccagcaacgagcgggacgccatcagctggtaccagaagaagatcggtgcatacgatcaacagatttgggaaaagagtatcgaacagactcagatcaaagggctcaagaataagccaaagaaaatgggacatatcaagccagacttaatagatgtagacctgatcagaggtagcacatttgctaaagctaagcctgaaatcccctggacatcactcacaagaaaaggcctggtgcgggtggtgttcttccctttattttcaaactggtggatccaggtgacctctctacgaatattcgtgtggcttctgctcctgtatttcatgcaggtgatagccatagtgctctacctcatgatgcctatcgttaacatcagtgaggtcttgggccctctgtgtctgatgctactaatgggcaccgttcactgccagatcgtatcaacccagattactagacctagcggtaataacgggaataggcggcgccgaaagctccggaaaaccgttaatggagatggctcaagagagaacggtaacaatagctccgataaggttcgcggcatcgaaacactggaatcagtgcccatcattggaggtttctgggagacaatttttggtaataggcgattactgggagtgtgggtaatgggttgtctgatgacgtgccaagtgaaaaaaatggttaaacacggccatcgttag

SEQ ID NO: 202093 - DNA, 2760 bp, Artificial Sequence
  Description of Artificial Sequence: Synthetic coding sequence
atgaagttcgcctaccggttcagcaacctgctgggcaccgtgtacagacggggcaatttgaattttacatgtgacgggaactcagtaattagcccggtgggaaacagggtaacagttttcgacttgaaaaacaataagagcgatacccttccactcgcaacccgttataacgtcaaatgtgtgggactgagtcccgacggccggctggccatcatcgtggatgaaggtggcgacgctctactcgtttccctcgtttgtcgcagcgtgctgcatcattttcatttcaaggggtcagttcactcggttagcttcagcccagacgggaggaagtttgtggtaaccaaaggcaatatcgcacagatgtaccacgccccaggaaagaagagagagtttaacgctttcgtactggacaagacttatttcggcccctacgatgaaaccacgtgtatcgactggaccgatgactcgcgctgtttcgtggtcggcagcaaagacatgtccacttgggtgttcggcgctgagcgctgggataatcttatctactacgcactcggcggccataaggacgcgatcgtggcctgttttttcgagtccaacagtcttgacctgtatagtctgtctcaggatggggtgctgtgcatgtggcaatgcgacaccccacccgaaggcctgcgtctgaagccccctgcgggatggaaggccgatctgctgcagagagaggaagaggaagaagaggaagaagatcaggaaggtgacagagaaacaacaattaggggaaaagctacgcccgccgaagaagagaagacaggcaaagtgaagtacagcaggctggctaagtacttctttaacaaggagggggactttaataatctaactgcagccgcctttcataaaaaaagccatctcttggtaactggctttgcgtccggaatcttccacctgcatgaactgcccgaatttaacctaattcacagtttgtccatttcagatcaatcaatcgcatctgtagccattaatagctctggcgactggatcgcatttggctgctccggacttgggcagcttttggtttgggagtggcaatctgaaagctacgtgctgaagcagcagggccacttcaattccatggtcgcgctggcctattctccagacgggcaatacattgtgaccggcggagatgacggcaaggtcaaggtgtggaatactttaagcggattctgctttgttactttcaccgaacattcatccggggtgaccggggtgacatttacagcaactggctacgtggtggtcacatctagtatggacggcacagtgcgggccttcgaccttcacaggtatagaaattttaggacatttacttctccccgcccaactcaattctcctgtgtggctgtggacgcttcgggagagatcgtctctgctggagctcaagattctttcgaaattttcgtttggagtatgcagaccggaaggctgctcgatgtgctctccgggcatgaaggccctatatctggactatgcttcaatccgatgaaaagcgttctcgcatctgccagctgggacaagactgtacgtctttgggacatgtttgacagctggaggaccaaagaaactctggctctcacctccgacgcactcgcggttaccttcaggcccgatggtgccgaactcgcagtcgccacactgaacagtcagataaccttctgggacccggagaacgcggtccagacaggcagcatagaagggcgccatgacctaaaaacgggacggaaagagctggacaagataaccgctaagcatgctgctaaaggaaaggccttcaccgctctgtgttattccgccgatggacactctattctagctgggggtatgtccaagttcgtatgtatatatcatgtgcgcgaacaaatcttgatgaagcggtttgagatcagttgtaacctttccctcgacgccatggaagaattcctgaacaggcgcaaaatgaccgagttcggcaaccttgctctcattgatcaagatgcaggtcaggaggacggagttgcaatcccccttccaggcgtcaggaagggggatatgagttcacgccattttaaaccggagattagagtgacttccttgcgattttctcctaccggccgttgctgggccgcaaccacaacagaagggctcctgatttactctctggatacgcgagtgctatttgacccattcgagttggacacgtcagtcaccccaggcagagtgcgggaggccctgcggcaacaggactttacgcgggcaatcctaatggctctaagactgaatgagtcaaaacttgtgcaggaagccctggaggcggtgcccaggggggaaatcgaggttgtgacgagttctctaccggagctgtacgtcgagaaagtcctagagtttttggctagcagctttgaagtgagcaggcaccttgaattctatttgctgtggacccataagttactcatgctccatggtcagaagctgaagtccagggctggcacacttcttcccgtgatccagtttttgcagaaatccatccaacgccatctggatgatctttctaagctatgcagttggaaccattacaacatgcagtatgccctggcggtgagcaagcaacggggcactaagcggtcccttgaccccctgggctcggaagaggaggcagaggcctccgaagatgactctttacacctgttaggcggaggtggcagagactctgaagaagagatgctggcctag

SEQ ID NO: 202094 - DNA, 1686 bp, Artificial Sequence
  Description of Artificial Sequence: Synthetic coding sequence
atggccttcatggagaagccccccgccggcaaggtgctgctggacgatacagttcccttgaccgccgccatagaggcttcacagagcctccagtcccacaccattgtccgccggtatagtgattttgacctgttaaacaacagtctgcaaatcgctggcctgtcactcccactgccccctaagaaactcatcggtaatatggaccgggagtttatcgccgagcgccaaaaagggctgcagaactatttaaatgtcatcaccactaaccatattctctctaattgcgaactggtaaagaaattcctggacccaaataattacagtgcgaattataccgagattgcgcttcagcaggtctctatgttctttcgatccgaaccaaagtgggaggttgtcgagccgcttaaagatatcggttggcggatcaggaagaagtacttcttaatgaagatcaagaatcagcccaaagagaggctggtcctttcttgggcagacttgggacccgataagtacttgtcagacaaggatttccaatgtctcatcaaactgcttcctagctgcctacatccttacatatatcgggtcactttcgccaccgccaatgagagctctgccctgctaatcagaatgtttaatgaaaaggggaccctcaaggatttgatttataaggccaaacctaaggacccttttttgaagaagtactgcaatccaaagaagatccaaggattggagctgcaacagattaagacctatggcaggcagattctcgaggttttgaaatttcttcatgacaaagggtttccatatgggcatttacatgccagcaatgtgatgttggacggcgacacatgtaggctcctggacctggagaattctctgcttggtctcccttcattttatcgatcatacttctctcaattcaggaaaataaatactctggagtctgttgatgtgcactgttttggtcatcttctctacgagatgacatacggccgaccaccagactcagttccagtggatagctttccccctgcacctagcatggctgtggtcgccgtgctcgagtcaactctgagctgtgaggcctgcaagaacggcatgccaaccatctctcgtctgctgcaaatgcccctcttttccgatgtgctcttgacaacatccgaaaaaccgcagttcaagattcccactaaactgaaggaggcattgaggattgctaaggagtgtatcgaaaaacgtctcatcgaagagcaaaaacagattcatcaacacaggagattgacaagggcccagtctcatcacgggtctgaagaagaacggaagaaaagaaagattctggcgagaaaaaaatctaaaagaagtgcgttggaaaactctgaggaacactctgccaaatattccaactcgaacaactccgctggcagtggagcgagctctcccctcacaagcccgtcaagtcccacacccccttccacctcagggatcagcgcgctaccccccccacccccaccacccccaccaccggccgctcccctcccccctgcctctacggaagctccagctcagctgtccagccaggccgttaacggaatgagtagaggtgccttgctgtcaagcatacagaacttccagaagggaactctcaggaaggctaagacttgtgaccacagcgccccgaagatcgggtag

SEQ ID NO: 202095 - DNA, 1737 bp, Artificial Sequence
  Description of Artificial Sequence: Synthetic coding sequence
atggccttcatggagaagccccccgccggcaaggtgctgctggacgatacggttcctctgacagcggcaattgaagcttctcagagcctacagagccacacagaatatattatccgagtccagagagggatcagtgtcgagaactcctggcaaatcgttcgcagatattccgattttgatctgcttaataattcgttgcagatcgcagggctcagcctccccttacctcccaagaaactgatcggcaacatggacagggagttcattgctgagaggcaaaagggtctccagaactaccttaatgtgatcacaactaaccacatcctgtcaaactgtgagctggttaagaaattcctcgatccaaacaactacagtgccaattacacagaaatcgccctgcagcaggtctcaatgttttttcggagtgagccaaagtgggaggtggtagagccgctcaaggacatagggtggagaatccgcaaaaagtatttcttaatgaaaataaaaaaccagcccaaagagcgcctagtcctgtcttgggccgatctgggacccgataagtacctgagcgacaaggacttccaatgtcttatcaaactgttgccatcctgcctccacccctacatctaccgcgtgaccttcgctaccgctaacgaatcatcagcgctccttattcgaatgttcaacgaaaaggggactctgaaagatctcatctataaagccaagcccaaggatcccttcctcaagaagtactgtaacccaaagaagatacagggtctagagttacagcagatcaagacatacgggcgccagattctggaggtgctcaagttcctgcatgataaaggattcccttacggccatctgcatgccagcaacgtaatgctggacggggatacctgtcgcttacttgacctagagaattccctgcttggactgccttctttctatcgtagctacttctcacagtttcgaaagattaacaccctcgaatccgtagatgttcactgcttcggccacctgctttatgagatgacttacgggcgcccccccgatagcgtcccagtggatagttttccccccgcaccgagtatggctgtggtggccgtgcttgagtccacattgagctgcgaagcctgtaagaatggcatgccgactatctctcggttgctccagatgccgctgttttccgatgtgcttctgacaacctctgagaagccccaatttaagatccctacaaagctcaaagaggcactgcgaattgctaaggagtgtatagaaaagagactaattgaggagcaaaagcaaatacaccaacatcggcggctcacccgagctcaaagccaccatgggagtgaggaggagaggaaaaagcgtaaaatccttgcccgtaagaaatcaaagcgctcagctctagagaactcagaagaacattcagctaaatatagcaatagtaataacagtgctggatctggcgcgagcagtccacttacaagcccgagctcaccaaccccccctagcacctctggaatatcagcgcttcccccacccccccccccccccccaccccccgctgctcccctaccccctgcttctactgaggcccctgcacagttatcatcccaggcagtcaatgggatgtcgcgcggtgccctgctctcaagcattcagaactttcagaagggtacattacggaaggccaagacttgtgaccactctgcaccgaaaatcgggtag

SEQ ID NO: 202096 - DNA, 1638 bp, Artificial Sequence
  Description of Artificial Sequence: Synthetic coding sequence
atggccttcatggagaagccccccgccggcaaggtgctgctggacgacaccgtgccattaaccgccgccattgaggctagccagtctttgcagtcgcataccatcgctggtctgtctctgccactccctccaaaaaagctcatcggcaatatggatcgagagttcatcgccgagaggcagaaaggactccaaaactatctgaacgttatcactactaatcacattctctctaactgcgaacttgtcaagaaattcttagatcccaacaattactccgctaactatactgagatcgctttgcagcaagtctccatgttcttcaggtcagagccaaaatgggaggtcgtggagccactcaaggatataggctggcgcattcggaagaagtatttcctaatgaaaattaagaatcagcctaaggagcgcctggttctttcatgggccgatttgggcccagataaatacctctccgacaaggatttccaatgcctgatcaagctccttccctcttgtttacatccatacatttatagagtgacattcgctaccgctaacgaatcttctgctctgctgatacggatgtttaacgaaaagggcactctgaaggacctgatttacaaagccaaacccaaagatcctttcctgaagaagtactgtaatccaaagaagatccaggggcttgaactgcaacagattaagacttacggtcgacagatcctggaggtgctgaagtttttgcacgataaaggtttcccttatgggcacctgcatgcttctaacgttatgctggacggtgatacctgccggctgcttgatctggaaaattctctattgggcttgcccagcttctatcgctcttatttttcccaattcaggaaaattaacactctggagagtgtggacgtgcattgcttcgggcacttgctgtacgaaatgacttacggccgaccacccgattccgtacctgtggattctttccctccagccccttcgatggccgtggtggccgttctggagtccacattatcatgtgaggcctgcaagaatgggatgcccaccatctccagactcctgcaaatgccactttttagcgacgtgctgctgaccacatcagagaaaccacagttcaaaatccctacaaagctaaaagaggctctcagaatcgctaaggagtgtattgagaagcgtttgattgaagaacaaaagcagatccaccagcaccggagactgacgagggcccagagccaccacggcagtgaggaggaacgcaagaagaggaaaattcttgccaggaagaaatccaagcgctctgccctggagaactccgaagagcatagtgcaaagtattccaactccaataattcagccggaagtggagccagcagcccgctgaccagccccagctccccaactcccccgtcgacctcaggcatctcagctctcccgcctccccctccacctcccccgccccccgctgcccctctaccacctgcttccaccgaagccccagcccagctctcatcccaggcggtgaacggcatgtccagaggagctctgttgtcaagcatccaaaattttcagaaagggacactcagaaaagctaagacttgcgatcactcagcacccaaaatcggctag

SEQ ID NO: 202097 - DNA, 1548 bp, Artificial Sequence
  Description of Artificial Sequence: Synthetic coding sequence
atggccttcatggagaagccccccgccggcaaggtgctgctggacgacaccgtgcctctcaccgctgccatcgaggcctcccagtcgctgcaaagtcacactgaatacatcatcagggtgcagaggggaatcagtgtggagaatagttggcagatcgtccggcgatattctgacttcgatctcctgaacaactccctgcagatcgccgggctgtccttgccattaccccctaagaaactgatcggaaacatggatagggagttcatcgcagaaagacagaagggactccagaattacctcaatgttatcacgaccaaccacatcctctctaactgtgaactagtgaagaagttcttggatcctaataattactctgccaactacaccgaaattgcactgcagcaggtgtctatgttctttcgcagcgagcccaaatgggaggtggtggagcccctgaaggatatcggctggaggattagaaagaagtacttcctcatgaagattaagaatcagcccaaggaacgactggttctttcctgggcagacctgggacctgataagtacctgagtgacaaggatttccagtgccttatcaagttactgcctagctgtctacacccttatatttacagggtaaccttcgcgacagctaacgagtcatcagctctactgatcagaatgttcaacgaaaagggcaccctcaaggacttaatctataaagccaagcccaaagatccattcctcaagaagtactgcaatccaaagaaaattcagggcctggagctgcagcagattaagacatatggccggcaaattctcgaagtcctcaaatttctgcacgataaagggttcccctacggacatctgcacgcatccaatgtcatgctcgacggggacacatgcaggttgctagaccttgaaaattccctgttaggactcccaagcttctaccggtcatatttctcccagtttcgaaagataaacaccctcgaatcagttgacgtacactgttttgggcacctattatatgagatgacttacggtcgacctcccgatagtgtgccagtggactcattcccccccgccccaagtatggccgtggttgcggtattagaaagcacattgtcctgcgaggcctgcaaaaatggcatgccaacaatcagcagactgctgcagatgcctctgttcagtgacgtgctcctgaccacttctgagaagccccaatttaagatccctacgaaactgaaggaggccctcaggattgccaaggagtgcatcgagaaacgcctgatcgaggaacagaagcagatccaccagcaccgccgcctgactcgcgctcagtcacatcacggatctgaagaggaacgaaaaaaaaggaagatcctcgctcgtaaaaaatcgaaacggagtgccctggagaacagcgaggaacacagtgcaaagtactcaaactccaataactctgccgggagtggcgccagcagcccgcttacctccccaagtagccccactccaccatctacgagcgtggagcacgcacctttctag

SEQ ID NO: 202098 - DNA, 1326 bp, Artificial Sequence
  Description of Artificial Sequence: Synthetic coding sequence
atgttcttccggagcgagcccaagtgggaggtggtggagcccctgaaagatattggatggagaatccgcaaaaagtattttctgatgaagattaaaaaccagccaaaggaacgccttgtgctgtcctgggctgatcttggacctgataaatacctctccgataaggattttcagtgtttgataaaattgctgccttcttgcctccacccatacatctacagagtcacctttgcgactgcaaatgaaagcagtgcacttctcatcagaatgtttaatgaaaagggtactttaaaggaccttatctataaggcaaaaccaaaggacccgttcctgaaaaaatactgcaatcctaaaaagattcagggtctggagttgcagcagattaagacttacggacggcagatactggaagtgttgaagtttcttcatgacaaagggttcccttacggccacctgcatgctagtaacgtgatgcttgacggcgacacctgtcgcctgcttgatcttgaaaactccctactgggcttgcctagcttctacaggtcgtatttcagccagttcaggaagatcaataccctggagtccgtcgatgtgcattgctttgggcatctgttatatgagatgacatatggacggcctccagacagcgtccccgtcgactccttccctcccgctccgtccatggccgtagtggccgtcctcgagagtacactctcttgtgaggcctgcaagaacggtatgcctactatctcacgcctcctgcagatgcctctcttctctgacgttcttctgactacgagcgagaaaccccagtttaaaataccaaccaaactcaaggaggctctccgaatagcaaaggagtgcatcgaaaagcgactcatagaggagcaaaaacagatacatcagcatcggaggcttactcgagctcagagtcaccacggctccgaggaggagcggaaaaagaggaagatcctcgcaagaaaaaagtctaagcgatcagcacttgaaaactcagaggaacactctgcaaaatattcaaattccaataactctgccggtagcggtgcatctagccccttgacttccccttccagccccacgcccccttccacaagcgggatttccgccctgccaccaccaccccccccccccccaccccctgcggccccactaccgcccgccagtacagaagctcccgcccagttatctagccaggcagtgaacggcatgtctcgcggtgcgctgctctcatcaatccagaattttcagaaaggaacattacgaaaggctaagacatgcgaccacagcgctccaaagattgggtag

SEQ ID NO: 202099 - DNA, 1005 bp, Artificial Sequence
  Description of Artificial Sequence: Synthetic coding sequence
atgttcttccggagcgagcccaagtgggaggtggtggagcccctgaaggatattgggtggagaattagaaagaaatacttcttgatgaagataaagaatcagccaaaggagagactcgtcctgtcttgggcagacctaggtccagataaatacctgtcggataaagattttcagtgcctgatcaaacttcttccaagctgcttgcacccttatatataccgcgtaaccttcgcaactgcaaatgaaagtagcgctttgctcatacggatgtttaacgaaaagggaactttaaaggatttgatctacaaagcaaagccaaaagaccctttcctgaagaaatactgtaacccaaagaagatacagggtctcgagctccagcagattaagacttacgggcgacaaatcctcgaagtgctgaagttcctgcatgataagggctttccatacggtcacctgcacgcgagcaacgtcatgcttgatggcgatacctgcaggctcttagacctggaaaactcactccttggcctgccatcattctatcgaagttacttcagtcaattcaggaaaatcaacaccctcgaatcagtcgatgtgcattgcttcgggcacctgctgtacgagatgacctacggccggccacccgactccgtgcccgttgacagtttccccccagctccctccatggcggtggtcgctgtcctggaatccactctgtcttgtgaagcttgtaaaaacggcatgcctactatttccagacttctgcagatgcctcttttcagtgatgtgctgctgaccacttccgagaagcctcagttcaaaatacctacgaaactgaaggaggcattgcggatagcgaaggaatgcatcgagaagcgtttgatcgaagagcaaaagcaaattcaccagcaccggcggcttactcgggcccaaagtcatcacgggtccgaggaagaacgcaagaaaaaagatttcagttccaaagaagttaagactatctgcagctag

SEQ ID NO: 202100 - DNA, 1110 bp, Artificial Sequence
  Description of Artificial Sequence: Synthetic coding sequence
atgaagagccccgagaagaagcggcggaagagcaacacccagggcccggcttactcgcacttgacagaattcgcccccccaccaaccccaatggtcgatcatcttgtggcctccaatccatttgaggatgacttcggagctccgaaagtgggggtggcggccccgcccttcctggggtctcccgtgccattcgggggctttagggttcagggaggaatggcaggccaagtcccacccggctactccacaggcggggggggggggccccaacctctcagaagacaaccgccacctttccctccgaatccgatgggacctgcgttcaacatgcccccccagggacctggatatccaccaccgggcaatatgaattttcctagccagcctttcaaccagccattgggccaaaatttcagtccgcctagcgggcaaatgatgcctgggcccgttggaggattcggacccatgatctccccgactatgggacagccaccaagagccgaactcggtcctccttccctgtcacagcgctttgcccaaccgggcgctccattcggaccttctccactccagcgccccggacagggtttgccatcactccctcccaatactagcccctttcccggccctgatcccggcttccccgggccaggaggggaggacggtggaaaacccctgaacccaccggctagcacagcttttccccaagagccccattcaggctccccagccgcagcagtgaacggcaatcagcccagtttccccccaaactcctccggacgcggggggggtacgccagacgctaatagtctggctccaccaggaaaggcaggaggtggatctggaccccagccaccacctggcctggtgtatccatgtggcgcgtgcaggtctgaggtgaacgacgatcaagacgcaatcctgtgtgaagcttcatgccagaagtggtttcaccgcgaatgtacaggcatgaccgaaagcgcatatgggctgttgaccactgaagcaagcgcagtttgggcctgcgatctctgcctaaagaccaaagaaatccagtcggtttatatccgcgagggtatgggtcaactcgttgcggctaacgatgggtag

SEQ ID NO: 202101 - DNA, 1221 bp, Artificial Sequence
  Description of Artificial Sequence: Synthetic coding sequence
atggccgccagcgccccccccccccccgacaagctggagggcggcggaggccctgctccacctccagcccctccgtccacggggcgcaaacaggggaaagctggcttgcagatgaagtcaccagagaagaaacgacgaaaatcaaatacccagggtcccgcctactcacacctgacagagttcgcccccccccccaccccaatggtggatcatttagtagcgagcaaccccttcgaagatgactttggagcacccaaggttggagtcgctgccccccccttcctaggcagcccagtcccattcggtgggtttcgggtgcagggggggatggcgggtcaggtgccccctggatacagtacagggggaggtgggggccctcagccgcttcgtaggcagccgcccccattccctccgaatccaatgggccctgccttcaatatgccgccccagggacccggctacccaccaccggggaatatgaatttcccttcccagccttttaatcagccgctgggccaaaatttctcccctccttctggacagatgatgcctgggccagtaggcggttttggtccgatgatatccccaactatgggacagccacctagagccgagttgggtccaccatctctctcacaacggtttgcacaacctggggcacccttcgggccatccccccttcagagaccaggtcagggacttcccagtcttcctccaaacacctcaccatttccaggaccggacccgggcttccctgggcccggaggggaagacggcggaaagcccctgaaccctcccgcatcaacagcattcccacaagagccacactcaggatcccccgctgccgccgttaacggtaatcaacctagcttcccgcccaactccagtggtaggggtggagggacacccgatgccaactccctagcaccacctggcaaggccgggggcggctccggtccccaacctccacctgggctggtgtatccttgtggagcatgcagaagtgaggtaaatgacgatcaggacgctatcctttgcgaagccagctgtcagaagtggttccatcgagaatgtactggcatgaccgaatccgcatacggcctgctcactacagaggcctctgcagtgtgggcctgtgatctgtgcctcaagaccaaggaaattcagtccgtgtacatcagggaaggaatggggcagctcgtggcggctaatgacggatag

SEQ ID NO: 202102 - DNA, 939 bp, Artificial Sequence
  Description of Artificial Sequence: Synthetic coding sequence
atggaggaggagtgccgggtgctgagcatccagagccacgtgatcagaggttatgtaggcaacagagccgctacatttcctctgcaggtgctaggatttgagatcgatgctgtgaatagtgtccagttctccaaccacactggctacgctcactggaaggggcaagtgctgaactcggacgaactgcaagaactctacgagggtttacgattgaacaatatgaacaaatacgactacgtgctcactggttacactcgcgacaagagcttcttagcaatggtggtggatatagtgcaggaacttaagcaacagaatccccggctggtgtatgtctgtgatccagtgctaggggacaagtgggatggtgagggaagcatgtacgttccggaggaccttctccccgtttacaaggaaaaagttgtgcccctggccgatatcattacgcccaaccagttcgaagcggagctgctgtctggtcggaaaatccacagtcaggaggaggctctgcgtgtgatggatatgctgcatagtatgggtcccgacacggtggttatcacctctagtgatctgccatcccctcagggctctaattaccttattgtcctcgggtcccagaggagaagaaaccccgcaggttcagtggtgatggaaagaatcaggatggatattcggaaggtggacgcggtgttcgtcggcaccggcgacctgtttgcggctatgctcttagcctggacgcataaacacccaaataatttgaaggtggcgtgcgagaagactgtatcaaccctccaccacgtgctccaacgaacaattcaatgtgcgaaagcgcaggccggggaaggtgttcgacccagtcccatgcagctggagctcagaatggttcaatctaagcgcgatatcgaagaccccgaaattgtggtccaggccactgtgctctag

SEQ ID NO: 202103 - DNA, 855 bp, Artificial Sequence
  Description of Artificial Sequence: Synthetic coding sequence
atggaggaggagtgccgggtgctgagcatccagagccacgtgatcagagggtacgtggggaatagggccgctacgttccccctacaagtcctgggatttgaaatcgatgcagtgaattctgtacagttttccaaccataccgggtacgcccactggaaggggcaggtgctgaattcagacgaactgcaggaactgtatgaaggacttcgcctgaataatatgaataaatacgattacgtgctcacagtttgtgatccagtactgggagacaagtgggacggagagggcagcatgtacgtgcccgaggacctcctgccagtatataaggagaaagttgtgcccttggccgacattataacccctaatcagttcgaggccgaactgctgagtggacgtaagatccactctcaagaggaggccctgcgggtgatggacatgctgcatagcatgggtcccgacacagtggtgatcacttcctccgacctgccgtctcctcagggctcgaattatttgatcgtcctgggcagccaacgaaggaggaaccccgcgggaagtgtagtgatggagaggatccggatggacattcggaaggttgatgctgtctttgtgggaaccggcgatttgtttgcagccatgttgctggcctggacccacaagcatcctaataatctcaaggtagcatgtgagaaaaccgtgtctacgcttcaccacgtcctacagcggacaatccagtgcgccaaagcccaagccggcgagggcgtgagaccttctcctatgcagcttgaattacgtatggtgcagagtaagagggacatcgaagaccccgagatcgttgttcaggctactgtactctag

SEQ ID NO: 202104 - DNA, 2322 bp, Artificial Sequence
  Description of Artificial Sequence: Synthetic coding sequence
atgggcaagaacctgaaggaggccgtgaagatgctggaggacagccagcgaaggacagaagaagagaacggtaagaagctgatctccggtgacattcctggccccctgcaaggaagcggccaggacatggttagtatcctccagttggttcagaacctgatgcatggagacgaagatgaggaaccccagtcaccacgcatccagaacattggcgagcaaggccacatggccttactgggccattctctgggggcctatatttctactctcgacaaagagaaattaagaaaactcaccacccgaatccttagtgatactaccctgtggctgtgcagaatcttccggtatgaaaacggctgcgcatattttcacgaggaggaacgcgagggcctagccaagatctgccggcttgctattcactctagatatgaagactttgtcgtggatgggttcaatgttctgtataacaagaagccagttatctatttatccgcagccgcgcgaccgggacttggccagtacctatgcaatcagttggggctgccatttccttgtctttgcagggttccctgcaataccgtatttgggagtcaacaccaaatggacgtggcttttctggagaaactaattaaagacgacatcgaacgcggtcggctccctctgttattggtggctaatgcgggcacggctgccgtgggccataccgacaagattgggcgcctgaaggaactctgcgaacagtacggcatatggttacacgtcgagggcgtcaatctggcaaccttggcgctcggttacgtgagctcatcagtgctcgccgctgctaagtgtgatagtatgaccatgactcctgggccatggctcgggctccccgctgttccagcagtcactctatacaagcacgacgatcctgctctcaccttagtagccgggctcacttctaacaagcccacggataagctacgggctctgcccctgtggctgagtctgcaatacctgggacttgacgggttcgttgagcgaataaagcatgcctgccagcttagtcagaggcttcaggagagcctcaaaaaagttaactatataaagatcctggtcgaggacgaactgtcttcccccgttgtagtcttcaggttcttccaggagctccccggcagtgatccagtgttcaaggcagttccggtgccaaatatgaccccatcaggggtggggagggaacgccatagttgcgacgccctaaaccggtggttgggcgagcaacttaagcaactcgtacctgcttcaggacttacagtgatggacctggaggccgaaggcacatgcctgagatttagcccactgatgacagcagcagtgctggggacaaggggcgaggacgtcgatcagctagtggcctgcatcgaatctaagctgcccgtgctgtgttgtacactccaactgcgggaggaattcaagcaggaagtcgaagccactgccggactgctgtatgtcgatgaccctaattggagcgggataggcgtagtcagatatgagcacgctaatgacgataaatcaagcctcaaaagcgatcctgaaggcgaaaacatccacgctggactactaaaaaaattgaacgagcttgaatcggatttgacattcaagattggcccagaatataagtcgatgaagtcctgcttatacgtggggatggccagcgataatgttgatgctgcagagctggttgaaactattgccgcaaccgctagggagatcgaggaaaacagccgccttttagagaatatgaccgaggttgtgagaaagggtatccaggaagctcaggtcgagctgcagaaagccagtgaagaaagattgcttgaggagggcgttctgaggcagatcccagtggttgggtctgtgctgaattggttctcccctgttcaggccctgcagaaagggcggacttttaacctgacagcaggaagcttagagtccactgagccaatctacgtctataaggcccagggagcaggtgtcaccttgcctcccacaccttctggtagcagaacgaaacagcggctgcctgggcagaagcccttcaagcggagcttgagagggagcgacgcactcagtgagactagcagcgtgtcccacatcgaggatctcgaaaaagtcgaacggctgtcgagcggtcccgaacaaattacactagaggccagcagtaccgagggtcaccctggtgccccatctccacagcacaccgaccagaccgaggcatttcaaaagggggtccctcatcctgaagatgaccactcccaagttgagggcccagaatccctgcgttag

SEQ ID NO: 202105 - DNA, 2367 bp, Artificial Sequence
  Description of Artificial Sequence: Synthetic coding sequence
atggacgccagcctggagaagatcgccgaccccaccctggccgagatgggcaagaatttgaaagaggctgtgaagatgctcgaagacagccagcggcgaaccgaggaggaaaacggaaagaagttgattagcggtgatattccggggccactgcaaggctccggccaggatatggtctcaattctgcagctggtgcagaacctgatgcatggcgacgaagacgaggaaccccagagcccccgcatccaaaatatcggcgagcagggtcacatggctctgctcggacactcactcggtgcatacatctccacactggataaagagaagctgagaaagctcactacaagaattctgtccgatactacactatggttgtgcaggatatttcggtatgagaatggctgcgcgtattttcatgaagaggagagggaaggcttggccaaaatttgccggctcgcaatccactccagatatgaagactttgtcgtcgacggttttaacgtgctgtataacaagaagcccgtgatctacctgtctgctgcagcgcgcccaggactgggccagtatctgtgcaaccaactaggcttgccttttccatgtctgtgccgagtgccctgtaataccgtgttcggcagccagcaccaaatggatgtggcattccttgagaaattaatcaaagacgacatcgaacgcgggcgccttcctttgctcctcgttgcaaatgccggaaccgccgctgttggccacactgataagattggtcggttgaaggaattgtgcgagcagtacggaatctggctccatgtggaaggggtgaatcttgccaccctggctctgggctacgtttcatcctcggttctggctgccgcaaaatgcgatagtatgacgatgacccccggaccatggctcggactgcccgctgttcctgccgtgacgctttacaagcacgatgaccccgccctgaccttggtggctggacttacctctaacaagccgactgacaagttgcgggctctgcccctctggttatcccttcagtacttggggcttgatggatttgtcgagcgtatcaagcatgcctgccagctgagtcagcgtctgcaggagagccttaagaaagttaactatatcaaaattttagtggaggacgagctttccagccccgtggtcgtttttaggttcttccaggagcttcccggctccgaccccgttttcaaggcagtgccggtccctaatatgacaccttccggcgtgggaagggaaaggcacagctgcgatgccctaaacaggtggctgggggagcagctgaagcagctggtacctgcaagtgggctaactgtgatggacctggaggccgaagggacctgtctgcgctttagcccattgatgaccgcagccgtcctgggcacccggggagaggacgtcgatcagttggtggcttgcatagaatccaaattgcccgtgctgtgctgtactctgcaactgagagaagaatttaagcaggaagtggaggctacagctggtcttctgtacgttgatgatcccaactggtcaggtatcggagtcgttcggtacgaacacgccaacgacgacaaatcctcgcttaagagcgatcctgaaggcgagaacattcacgctggattacttaagaagctgaacgagcttgaaagcgacctgacgtttaagatcggccctgaatacaagagcatgaaaagctgcctttacgtaggaatggctagtgataatgtggatgcagccgagttggttgaaacaatagcagccactgcgcgcgagatcgaggagaattcaaggctgttagaaaacatgactgaggttgttaggaagggcattcaggaggctcaggttgagcttcaaaaggctagcgaagagagactactcgaagagggcgtgctgagacagataccagtggttgggagtgtgttaaattggttctcccccgttcaggctttgcagaagggtaggacctttaaccttacagctggatcgctggaaagcaccgaaccaatctatgtgtataaggctcagggggccggcgtaacactgccacccacacctagcggaagccgtacaaaacagagactgcccgggcagaaacccttcaagcgctcacttcgtggtagtgatgctttgagcgagaccagctccgttagtcacatagaagatctagagaaggtggaacgactcagcagcggacctgaacagatcactctcgaagcctctagcaccgaaggccatcctggagccccttccccacagcacactgaccaaacagaggccttccagaaaggggttcctcaccccgaggatgaccactcacaggtcgagggccccgagtctctccgttag

SEQ ID NO: 202106 - DNA, 2094 bp, Artificial Sequence
  Description of Artificial Sequence: Synthetic coding sequence
atgggcaagaacctgaaggaggccgtgaagatgctggaggacagccagcgcaggacagaggaagagaatggcaagaaattgatctcaggcgacatcccaggcccgcttcagggtagatatgagaatggatgcgcttactttcacgaggaggaacgtgaaggtctggctaaaatctgtagactggcaatccactctcgctatgaagacttcgtagtagacggctttaatgtgctttacaacaaaaaacctgtgatttatctatccgctgcagctcggcctggccttggacaatacctgtgtaaccagctgggcttgccgttcccatgtctgtgtcgcgtgccctgcaatactgtgtttggatctcaacatcaaatggacgtcgcttttctcgagaagctcatcaaggacgacatagagcgcggacggttgcctctcttgctcgttgcaaacgccggtaccgctgctgtgggccatactgacaagatcgggcgcttgaaggagctgtgcgagcaatacgggatttggctgcacgtggagggtgtgaatctggcaaccctcgcactggggtatgtgagctcttctgtactggctgctgcgaaatgcgattctatgaccatgacaccagggccctggcttgggcttccggcagtgccagctgtgaccctctacaaacacgacgaccctgcactgaccctagttgctggacttacttcgaataagccaactgacaagcttcgagctttaccgctctggctctctttacagtatctcgggctggatggcttcgtggaacggattaaacacgcctgtcaactgagccagcgcctgcaggagtctttgaaaaaggttaattacataaagatcttagtggaggacgaactttccagcccagtagtagtgttccggttcttccaggagctcccagggtcagaccccgtgtttaaagccgtgccagtgccaaacatgacgccatctggcgttggtagggagcgtcatagctgtgacgctctgaacagatggttgggggagcaactcaagcagctcgtgcccgcctccggcctcaccgtgatggacctggaggccgaggggacatgtcttagatttagtcctttaatgacggccgctgtgttgggcacccgtggcgaggacgtggatcagctcgtggcgtgtatcgagagcaaattgcctgttctgtgttgcactttacaactgcgagaagaattcaaacaggaggtcgaggcaacagctggtctgctctatgtggatgaccccaactggagcggaatcggagtggttagatatgaacacgccaatgatgataagagtagtctgaaaagcgacccagaaggggagaatattcatgcaggtctcctgaagaaactaaacgagctggaatcggacctgacttttaaaatcggccccgaatacaagagcatgaagagctgtctctacgttggcatggccagcgacaacgtcgacgctgccgaattagttgagactattgccgctacagcgagagaaatcgaggaaaatagcagattgctggagaacatgacagaagtggtcagaaaaggaatccaagaggcccaggtcgagctgcagaaggcttcggaggaaagattgctcgaggagggcgtgctgaggcaaatccctgtggtagggtctgtattgaattggttctcccccgtgcaggcactgcagaagggaagaaccttcaatctcaccgccggtagccttgaatctacggagcctatctatgtctacaaggctcaaggggccggagtgacactcccacctactccaagcggaagtaggacaaagcagcggctcccaggacaaaaacctttcaaacggtccctgcggggtagcgacgccttaagtgaaacttcctctgtttctcacattgaggacctcgaaaaagtcgagaggctgtcttcagggccggaacaaattactctggaagcctcttccacagagggacacccaggggcccccagcccccaacataccgaccagacggaagccttccagaaaggggtgccccaccctgaggacgatcacagccaggtggagggccctgaaagtctgaggtag

SEQ ID NO: 202107 - DNA, 2283 bp, Artificial Sequence
  Description of Artificial Sequence: Synthetic coding sequence
atggacgccagcctggagaagatcgccgaccccaccctggccgagatgggaaagaacctcaaagaagccgttaaaatgttagaggattcacagcggaccgaagaagaaaatggcaagaagctgatttctggagacatcccagggccacttcaaggccggattcagaatatcggcgagcaaggacacatggccctgttggggcacagcctgggggcatacataagcacactcgacaaggagaagctgcggaaattgacaacccggatattatctgacactactctttggctgtgcaggatcttcagatacgagaacggctgcgcctacttccacgaggaggaaagggaggggctcgccaaaatctgtcgcctcgcgatacatagccgttacgaagatttcgtcgtagacggttttaatgtgctgtataataagaagcctgtgatttacctgagcgcagccgctcgccccgggctgggtcaatacctttgtaatcaactcgggcttccattcccatgtttgtgcagagtgccctgcaacacagttttcgggtctcagcaccagatggacgttgcctttctggagaagcttataaaggacgacatcgagcgtggaaggctgcccctgctgttggtggctaacgccggaactgccgctgtgggccatacagacaagattggccgcctgaaagagctgtgtgaacagtatggcatttggctgcacgtggagggggtgaacctagcaacgctcgcgctggggtatgtcagtagctctgtgcttgcggctgcaaagtgcgactcaatgacaatgacaccggggccgtggctaggactgcctgcggtaccagccgtcacattgtacaagcacgatgatcctgctctgacgctggtcgccggactgacctcaaacaaaccaaccgataaactgagagcgctcccgctttggctgtctctgcagtacttaggcctggatgggttcgttgaaaggattaaacacgcctgtcagctttcccagcggctccaggagtcgttaaaaaaagtcaactatattaaaattctcgtggaggacgaactgtcaagtcccgttgtggtctttcgattcttccaggagcttccaggttcggaccctgtattcaaagccgtccccgtacctaacatgactccttcgggggtcggcagagagcgtcactcatgcgatgcattgaatagatggctgggagagcaactcaaacaactcgttcccgcctccggacttacggtcatggatctagaggcagaagggacttgtctgcgcttctcccctctgatgacagcggcggttctgggaacacgaggggaagacgtcgatcagctcgtcgcctgcattgagagtaagctgcccgttttgtgctgcaccttgcagctgcgcgaggagtttaaacaggaggtggaggctactgccggattgttgtacgttgacgatcctaattggagcggaattggagtggtccgttacgaacacgctaacgatgacaaaagttcactaaaaagtgaccccgaaggggagaacatccacgctggcctgttgaaaaagctcaatgagcttgagagcgatctaacctttaagattggacctgagtataaatcaatgaaaagttgcttatacgtgggcatggcttctgacaacgttgacgccgcggaactcgtggaaactatagccgcaactgcaagggaaatcgaggagaacagcagactgctggagaatatgacggaggtggttcgcaaaggcatccaggaggcccaggtggaactgcagaaagccagcgaggagagactccttgaggaaggcgtcctgagacagataccggtagtagggtcagttcttaattggttcagcccagtgcaggccttacaaaaaggacggaccttcaacctgaccgccggatctctggaatcaactgagccaatttatgtgtacaaagcgcaaggggccggagtgaccctgccgcctacgccttcaggttcaagaaccaagcagagactgccagggcagaagccatttaagcggtctttaagggggagcgacgccttgtcagagacatcctctgtttcccacattgaagacctggagaaggtggagaggctgtcatctgggcccgagcagatcactctggaggcatcctccaccgagggacaccccggggctccgagcccgcagcacactgaccagaccgaggcattccagaagggcgtcccacaccccgaagacgatcactcacaggttgaggggcccgagtcattgaggtag

SEQ ID NO: 202108 - DNA, 1290 bp, Artificial Sequence
  Description of Artificial Sequence: Synthetic coding sequence
ctgagcagcaccctgcggcggatcgccgaccccaccctggccgagatgggcaagaacctaaaagaggctgttaagatgctcgaggactcgcagagaaggactgaagaagagaatggaaagaagctgattagtggagatattcccggacccttgcagggttcaggacaggatatggtcagtatattgcagctcgtccaaaatctgatgcatggagacgaagatgaggagccccagtcaccacgtatccagaatattggcgagcaagggcacatggccctgctgggacattccctcggagcctacatctcaacgcttgataaagagaaacttcgaaagttgactacccggatactgagtgatacaaccctctggttgtgccgaattttccggtacgagaatgggtgtgcctatttccacgaagaagagcgcgaaggcctggccaagatttgccggttggctatacacagccgatatgaagattttgtggttgacgggtttaatgttctgtacaataagaagcctgtgatttacttaagcgccgccgcgcggcccgggttaggccagtacctgtgtaatcaggatgtagcgtttcttgagaagttgataaaggacgatattgagcgaggacggctgccactcctgctggttgccaatgccggtacagctgccgtaggtcacaccgataaaattggacgcctgaaggaactgtgcgagcaatacgggatttggcttcatgtggagggagtaaacctagcgacactcgcactgggctacgtctcctcatccgtgctggccgccgcgaagtgtgactcgatgactatgaccccgggtccttggctgggtctgcctgctgtgccagctgttacgctgtacaagcatgacgaccctgccctaactctggtggctggtctgacttccaacaagccgaccgacaagttgcgggctttacccctgtggctgtcactgcagtacctcggactggacgggtttgtagagaggatcaaacatgcctgtcagctgagccagaggctgcaggagtctcttaaaaaggtgaattacataaaaattttggtggaggacgagctatctagcccagtggttgttttcaggttcttccaggagcttcccggatctgaccccgtgtttaaagccgtgcccgtgccaaatatgactccatccggcgttggacgggaaagacattcctgcgacgccctgaaccggtgggtgaggatggcagtgactccgcttagttttcaggtgcctgtgcaccaccacccaacgtgctggtag

SEQ ID NO: 202109 - DNA, 1497 bp, Artificial Sequence
  Description of Artificial Sequence: Synthetic coding sequence
atggacgccagcctggagaagatcgccgaccccaccctggccgagatgggaaaaaacctaaaggaagcagtgaaaatgcttgaagattctcagagacggaccgaagaagagaatgggaagaaactaatttccggagatattccaggcccactgcagggaagcggccaggacatggtcagcatactgcagctggtgcagaatctgatgcacggtgacgaggatgaagagccacaatcaccccgcattcagaatatcggggagcaggggcacatggcccttctggggcactcattaggcgcctatatctcaactctcgataaagaaaaattgcgcaagctgaccacaagaattctttccgacactaccctctggttgtgtaggatttttcggtatgaaaatgggtgtgcctatttccatgaggaggaacgcgaagggctggcaaaaatctgccgattggcaatccacagtcggtatgaggatttcgtcgtggatgggttcaatgtgttgtacaacaagaagcccgtgatttacttgtccgccgccgccaggccagggttgggccagtacctatgtaaccagctcggtctgccctttccttgcctctgtcgggttccctgtaatacggtgttcggaagccagcatcagatggatgtggcgttcttagagaagctgataaaggacgacattgagcgaggcaggctgcccctgctgttggtagccaacgctggcaccgctgccgtagggcacacggataagatcgggcgcctcaaggagctctgtgagcagtatggtatttggcttcatgtcgaaggcgtcaatctggccacacttgctctgggatatgtcagtagctctgtgctggctgctgccaagtgcgactctatgacaatgaccccgggtccatggctgggtctccccgcggttccagcggtaacactatataagcacgacgatcccgccctgactctggtggcaggcctgacaagcaataagcctaccgataagttgagggcattaccactttggttgagtctccagtacctgggactcgacggttttgttgaacggattaagcatgcatgtcaactgagtcagagattacaggagtcactcaaaaaagtgaattacatcaagatactggtggaggatgagctcagctcaccggtggtggtgtttcgcttctttcaggaacttcccgggagtgaccctgtatttaaagccgtcccagtcccaaatatgactccatctggcgtcggacgcgagcgtcactcctgcgacgccctgaatcgttggttgggagagcagctgaaacagttggttccagcatcagggttgacagtgatggatctcgaagcagaaggcacatgtctgcgcttctctcccctgatgacggctgccggctggtcccactgcggcacaactacccgctacgactgcgtccgctctcgattaacgacccgtttgcccggctctaccggggagcaggcgccgccctag

SEQ ID NO: 202110 - DNA, 615 bp, Artificial Sequence
  Description of Artificial Sequence: Synthetic coding sequence
atgaccatgacccccggcccctggctgggcctgcccgccgtgcccgcagttaccctttacaagcacgacgacccagccctgacattagtggccggcctaacctcgaataagcccacagataagctacgagcactgcccctttggctgtctctacagtatctggggctggatgggtttgtggaacggatcaaacatgcgtgccagctgtcccagcgacttcaagagtcgctgaagaaggtaaattatattaagatcctagtggaggatgagctgtcaagtccagtcgtcgtgttcaggttctttcaggagctgcccgggagcgatcctgtgtttaaagcagtacctgtgccaaatatgacacctagtggtgtgggccgggagaggcatagttgtgatgccctgaatcggtggttaggcgaacagctcaagcagctcgtgccagcatcaggtctgacggtcatggatctagaagccgagggcacttgtctgaggttcagccccctgatgactgccgccggatggtctcactgtgggacaacaacacgctatgattgtgtgcgcagtcgtctgaccacccgcctgccaggctctacgggtgaacaggccccaccatag

SEQ ID NO: 202111 - DNA, 642 bp, Artificial Sequence
  Description of Artificial Sequence: Synthetic coding sequence
atggaccccctgttccagcagacccacaagcaggtgcacgagatccaatcatgcatgggaaggctagagacagcagataaacagagtgtccatattgttgaaaacgaaattcaggcgtccatcgatcaaattttttctcgcctggaacgcctggaaatcttgtccagtaaagagccacctaataagagacagaatgcacgccttcgggtcgatcaattgaagtatgatgtgcagcacctgcaaactgcacttcgaaactttcagcaccggcgccatgcccgggagcagcaggagcgtcagcgggaggaattactgtcgagaacttttaccactaacgattccgataccacaattcctatggatgaatcactccagttcaactcaagtctgcagaaagtgcacaacggaatggacgacctgatcctcgacgggcacaacatcctcgacgggctgagaacgcagaggctgacacttaagggcacgcagaaaaagatccttgatatcgcgaacatgttaggcctctcaaatacagtgatgagactgatcgaaaagagggccttccaggacaagtacttcatgattggtacccaggggtcatgccagaccgcacacttcggtggccggagcgctggctcttcctag

SEQ ID NO: 202112 - DNA, 657 bp, Artificial Sequence
  Description of Artificial Sequence: Synthetic coding sequence
atgacctgctggctgcggggcgtgaccgccaccttcggccggcccgctgaatggccgggctacttgtcccacctctgtgggcgaagcgcagccatggatctgggacctatgcgcaaaagttacaggggagatcgcgaggctttcgaagaaacacatctgacctcccttgatccggttaaacagtttgccgcctggtttgaggaagccgtgcagtgcccagatattggcgaagcgaatgccatgtgtttagctacctgcacccgggacggcaagccgagcgctcgcatgcttctgctaaagggtttcggtaaagatggctttaggttttttactaacttcgagtctcggaaggggaaggaactggacagtaaccccttcgcctcactagtgttctattgggaacccctcaataggcagtatcttcggaagaagaatgaggagcttgaacagttataccaagaccaggaggtccctaaacccaaaagctgggggggatacgtactttaccctcaggtgatggagttttggcagggacagacaaacaggctccacgaccggatagttttcagaagagggttaccaacgggcgattctcccctcggtccaatgacccaccgcggggaggaggattggttatatgagcggttagctccctag

SEQ ID NO: 202113 - DNA, 501 bp, Artificial Sequence
  Description of Artificial Sequence: Synthetic coding sequence
atgctgctgctgaagggcttcggcaaggacggcttccggttcttcacgaacttcgagtctagaaaaggcaaagaactagacagcaatccctttgcaagtctggtcttctattgggagccactgaatcgtcaggtgcgggttgaggggccggttaaaaaattgcccgaggaggaggcagagtgttacttccactccagacctaagtctagtcaaatcggcgcagttgtctcccatcaatcaagtgtgatcccagacagagagtatcttagaaaaaagaacgaggagctagagcaactctatcaagatcaggaggtcccaaaacccaaaagctggggaggatacgtactctacccacaggtgatggagttttggcaaggacagacaaacagattgcatgacagaatagtcttcagaagaggattgccaactggtgattcgcccctgggccctatgacccaccgcggcgaagaagactggctatatgagcggctggccccatag

SEQ ID NO: 202114 - DNA, 732 bp, Artificial Sequence
  Description of Artificial Sequence: Synthetic coding sequence
atgacctgctggctgcggggcgtgaccgccaccttcggccggcccgccgagtggcccggatatctgagccatttatgcggtcgatcagcggctatggacttgggcccaatgaggaaaagttatcgcggtgaccgggaggcctttgaagagacccaccttacttctttggacccggttaagcaattcgctgcatggtttgaggaggcagtccagtgcccagatatcggcgaggctaacgccatgtgcctggcaacatgcacaagggacggcaagccttcagcacgcatgctcctgctgaaggggtttgggaaggacggttttagatttttcacaaatttcgagtcgagaaaagggaaggaattggtgcgcgtggagggaccagtcaaaaagctgccggaggaagaagcagaatgctactttcactcaagaccgaagtcaagccagatcggcgccgtggtgtctcatcagagctctgtcatacccgatagggagtatctccggaaaaaaaatgaagagctcgaacagctgtaccaggatcaggaagtgcccaagcctaagtcctggggagggtatgtgctgtacccacaggtcatggagttttggcaagggcagactaacagactgcatgaccgaattgtgttccgccggggattacccacgggcgacagtcctctcggacccatgacccacaggggggaagaagactggttatacgagaggctggcgccttag

SEQ ID NO: 202115 - DNA, 1098 bp, Artificial Sequence
  Description of Artificial Sequence: Synthetic coding sequence
atggccagcaccgagagcagcctgctgcggagcctgggcctgagccccggccctggaagttctgaggtcgaactggattgttggttcgacgaagacttcaagtttattctgctccccgtatcatacgccgtggtgtttgtcctcgggctgggtctgaacgccccaacattgtggctgtttatctttagacttagaccctgggatgcaaccgccacgtatatgttccatttggctctttctgatacattgtacgtgttatcattaccaactttaatctactattatgccgcccacaatcattggccttttggaactgagatttgcaagtttgtacggttcttgttctactggaacctgtactgtagtgtgctgttcctcacatgcatatcagtgcatcgctacctggggatttgtcaccctcttagagcactgaggtggggaaggcctcgacttgccggcttgctgtgcttggccgtctggctagttgtcgctggctgcctggtcccaaacctttttttcgtcacgacttctaataagggcacaactgtgctgtgccatgacaccactagacccgaggagttcgaccactatgtgcacttttcctctgcggtgatgggcctcttgttcggagttccatgtcttgtaaccctagtgtgttacggtctgatggcccgcaggctgtatcaacccctcccaggctcagctcagtcatcatcgagactgcggagccttcggactatcgccgtggtgttgaccgtgtttgctgtgtgtttcgtgcccttccacatcaccaggaccatatactacttggctaggctcctggaagcagactgcagagtcctcaatattgtgaatgttgtttataaggtgactcggcctttggcctccgccaactcttgcctggatcctgtactgtatctcctgactggtgacaaatatcgcaggcaacttcggcagctttgcggagggggaaagccacagcctcggaccgctgctagttccctggccctagtttctctccctgaggacagctcctgtcgttgggctgcgacacctcaggactcatcttgcagcacgccaagggcagataggctgtag

SEQ ID NO: 202116 - DNA, 987 bp, Artificial Sequence
  Description of Artificial Sequence: Synthetic coding sequence
atggagtgggacaacggcaccggccaggccctgggcctgccccccaccacgtgcgtttatcgcgaaaattttaagcagctgctgttgccccctgtctactctgctgtgttggcggcagggttgccactgaacatttgcgtcataacacagatctgtacatcacggcgggctctaaccaggacagcagtgtacacacttaacctggcactcgctgatttgctgtacgcatgttcgctgcccttgctgatatacaattacgcccagggagatcactggccctttggtgattttgcatgccgcctggtgagatttcttttttacgccaatttacatggatcaatcctgttcttgacatgtataagctttcagaggtacctaggaatctgtcacccactggcgccgtggcacaaacgcgggggccgacgtgccgcctggcttgtgtgcgtggctgtgtggttggccgtaacaacccagtgccttcctactgctatattcgcagccaccggaatccagcgcaaccggaccgtgtgctacgacctctctcctcccgccctggccacgcattatatgccgtacggtatggccctgactgttatcggatttctgctcccattcgccgcacttctcgcatgctactgtctgcttgcatgtcgattgtgtcgacaagacggacccgcagagccagtcgcgcaggaacggagaggcaaagctgcacgtatggccgtggtcgtggccgccgccttcgccatttctttcctgcctttccatattactaaaaccgcataccttgctgtccgcagcacccccggtgtaccttgcactgtattggaggcctttgcagctgcctataaagggacaagaccgtttgcatcagcaaacagcgtgttggatccgattctgttctatttcactcagaagaagtttcgacggaggcctcacgaactgttgcaaaaattgacagccaagtggcagcgccaggggcggtag

SEQ ID NO: 202117 - DNA, 987 bp, Artificial Sequence
  Description of Artificial Sequence: Synthetic coding sequence
atggagtgggacaacggcaccggccaggccctgggcctgccccccactacttgcgtttaccgagaaaatttcaagcagttgctgctacctcccgtttattcggccgtacttgccgccggacttcccttaaatatctgcgtgataacccaaatctgtacgagccgcagggcacttactcgcacggccgtgtatactctcaatttggctctggctgatttgctgtacgcctgtagtttgccgctgctgatatataattacgctcagggcgaccactggccttttggcgattttgcttgtcggttggttcgttttctattttacgcaaatctccacgggagcatcctgtttttgacttgcatatctttccagaggtacttgggtatatgccacccactggccccctggcacaagcggggcgggcgcagagctgcctggttggtttgcgtggccgtgtggttagccgtcactacacagtgtctccctacggccattttcgctgctacaggaatccaacggaatcgcactgtatgctatgacttgagcccgcccgctctggccactcactatatgccttatggcatggctcttaccgtgattggcttcctcctgcctttcgctgcactcctggcttgctattgcctgctggcatgtcggctgtgccgacaggatgggccggctgagccagtggctcaagaacgtcgcggtaaggcagcacgaatggcagttgtggtggcagcagccttcgctatcagtttcctcccctttcatatcacaaaaaccgcttatctggccgtccgttctacacctggcgtgccttgtactgttttggaggctttcgccgctgcctataagggaacccgcccctttgcaagtgccaactctgtgttggatccaatattgttctactttacccaaaagaagtttagaagacgaccacatgagctcctgcagaaactgactgcgaaatggcagagacaagggcggtag

SEQ ID NO: 202118 - DNA, 987 bp, Artificial Sequence
  Description of Artificial Sequence: Synthetic coding sequence
atggagtgggacaacggcaccggccaggccctgggcctgccccccacgacatgcgtgtatcgggagaactttaaacaactactcctgcctccggtgtacagcgccgtgctcgctgcaggactgccgctgaacatctgtgtgatcacacagatttgcactagccgcagagccctgacgaggacagctgtgtacaccctcaacctcgctctggccgacctgctgtacgcctgctcactgccgttgctcatctataattacgcacaaggagaccactggccatttggcgactttgcatgcaggctggttcgattcttgttctacgctaatctgcatggaagtatactgtttctgacctgtatttcattccaacggtatctcggcatctgtcatccactggccccctggcacaagaggggtgggaggcgcgccgcttggctcgtttgcgtggccgtatggttggcagtgaccacccagtgcttgcctacggccattttcgctgcaacaggtattcagagaaaccggactgtctgctacgacttgtctccccccgctctcgcaacgcactacatgccgtacgggatggccctcaccgtcatcggattcctgcttccttttgccgctctgcttgcctgttattgtctgctggcctgtagattatgccgtcaggatggacctgctgagcctgtcgcccaggagaggcgcggcaaagccgcaagaatggcagtggtagtggctgccgcattcgccattagttttcttccctttcacataacgaagactgcttacttagccgtccgatcgacaccaggagtaccgtgcaccgtgttggaagccttcgccgcagcatacaaggggacacgacccttcgcttctgcgaactcggtattggacccaatactgttctacttcacccagaagaagttccgcaggaggcctcatgaattattgcagaaactgacggccaaatggcagagacagggaagatag

SEQ ID NO: 202119 - DNA, 987 bp, Artificial Sequence
  Description of Artificial Sequence: Synthetic coding sequence
atggagtgggacaacggcaccggccaggccctgggcctgccccccacgacctgcgtgtatcgggagaattttaaacagttgctcctgccacctgtatatagcgctgtactcgccgctgggttgcccttgaacatatgcgtaattacacagatatgtacgtctagacgagccttgacgagaacggccgtgtatacactgaatctggccttagccgacctcctctatgcctgtagtctcccacttcttatctacaattatgctcagggcgaccactggccttttggagattttgcttgccggctggttaggttcctcttttatgctaatctccacggcagcattctcttcctcacgtgcataagtttccagcggtatctcggtatctgccaccctctggcaccctggcataagaggggcggacgtcgcgcggcgtggttggtctgtgttgctgtttggctcgccgtgaccacccagtgcttgccaaccgccatcttcgcagccaccgggatccagcgcaatcgtaccgtgtgctacgatctgtctccacccgctctggcaacccattacatgccatacggcatggctctgacagtgatcgggttcttactaccctttgcagccctgctagcctgttattgcctgctggcctgtaggctctgtaggcaggatggccctgctgagccagttgcccaggagcgacgtgggaaagccgctagaatggccgtggtggtcgctgcggccttcgccatctcatttcttcccttccacatcacgaagactgcttaccttgctgtacgctccaccccaggtgtgccttgtaccgtacttgaagcattcgccgcagcttataaggggactcgaccctttgcctccgcaaacagcgtgctcgacccgattctgttttacttcactcaaaagaagttcagacgaagaccccatgaactcctgcagaagctgactgccaaatggcaacgccagggtaggtag

SEQ ID NO: 202120 - DNA, 738 bp, Artificial Sequence
  Description of Artificial Sequence: Synthetic coding sequence
atggagtgggacaacggcaccggccaggccctgggcctgccccccacaacctgtgtgtatcgggagaacttcaagcagctgcttctcccccccgtctatagcgctgtgctcgcagcaggacttcccctaaacatttgtgttattactcaaatctgtaccagtagacgtgcactcacacgaaccgccgtgtacactctgaacctggcgctggcagacctgctctatgcatgtagtctgcctctcttgatatataattatgcccaaggggaccactggcctttcggcgattttgcttgccggctcgttaggttcctcttctacgccaacctccatggcagtatcctgtttttgacctgcatcagctttcagaggtatttagggatctgtcatcctctagccccatggcacaagagagggggtcgcagagcagcatggctggtctgtgtcgccgtgtggctggctgtcactactcagtgcctgcccacagcaatcttcgccgcaaccggtatacaacgcaataggaccgtctgctatgatctgagtccgccagctctcgccacgcattacatgccttacgggatggcactgactgtcattggctttctcctgcctttcgcggcccttctcgcatgttattgccttctggcctgccgattatgcagacaggacgggcctgccgagccagtggcccaggaacgccgcgggaaggcagccagaatggctgttgtcgtagcatag

SEQ ID NO: 202121 - DNA, 987 bp, Artificial Sequence
  Description of Artificial Sequence: Synthetic coding sequence
atggagtgggacaacggcaccggccaggccctgggcctgccccccactacatgtgtctatagagagaatttcaagcagttgttgttgccaccggtgtattctgcggtgctggctgcaggcctgcccttaaatatctgcgtgatcacccagatttgtacctcccggcgagcccttactcgaaccgcagtgtatacattgaatctggctctcgccgacctactctatgcctgctccctaccactgctcatctacaactacgctcagggcgaccactggcctttcggcgactttgcttgtagactcgttaggtttctgttttacgccaatcttcacggttctatcttgttcctgacatgcatttctttccagcggtatctggggatctgtcacccactcgccccctggcataagcgaggaggacgccgagccgcttggctggtgtgtgtggctgtctggcttgcggtgacaactcagtgccttcccacggctatctttgctgctactgggatccaacggaaccggacagtttgttacgatttgtcaccccctgcactcgccactcactatatgccctatggaatggcactgacagttattggatttctgctgccttttgccgctctgctggcatgctattgccttctggcctgtcggctttgcaggcaggacggtccggccgagccggttgcccaggagagaagaggaaaagccgccagaatggcagtagttgttgccgccgcctttgccattagttttttaccatttcacattacaaagacagcttacttggctgtgcgttccaccccgggcgtgccatgtactgtgctcgaagcgtttgcagcagcctataaaggcacccgcccatttgcctcagctaatagcgtgctggatcctattctgttttatttcacccagaagaaatttcgcaggaggcctcacgagcttttacagaagttgaccgccaagtggcaaaggcaggggcgctag

SEQ ID NO: 202122 - DNA, 987 bp, Artificial Sequence
  Description of Artificial Sequence: Synthetic coding sequence
atggagtgggacaacggcaccggccaggccctgggcctgccccccactacatgtgtatatcgggagaatttcaaacagttgcttctcccccccgtatactcagccgttttagcagccgggctccctctgaacatatgtgtgattacgcaaatatgtaccagtcgcagggctcttacgcgcaccgccgtttacaccctgaatttagcactggcagacctgctgtacgcttgcagtctgccactactgatctacaactacgcccaaggcgaccactggccctttggagacttcgcctgccgactcgtccgctttctgttctacgcaaaccttcacggctctatattgttcctgacctgcatctccttccagcgttacctcgggatctgtcatccgctcgccccatggcacaaaagaggagggaggcgggcggcctggctcgtgtgtgtcgcagtgtggctcgccgtgacaacccaatgcctgcccacagcaatattcgccgctacagggatccagcgaaatagaacagtatgctatgacctgtctccgcccgccctcgctacgcactacatgccgtacggcatggccttgacggtcatcggcttccttcttcctttcgcagctttactggcctgctattgtctcctggcctgccgcttatgtcgtcaagatggccctgccgagcccgtcgctcaagaaagacgcgggaaggctgcacgcatggcagttgtggtcgccgcagctttcgccatatcttttctcccgtttcacataacaaagacagcctacctcgccgtgagaagcactccaggtgtaccgtgtacagtattagaagccttcgcggcggcctacaaaggcaccagaccgttcgcatctgcaaatagcgtgttagatcccatcttattctacttcactcagaagaaattcagaagacgcccccatgaactgctgcagaagctgactgcaaagtggcagcggcaggggaggtag

SEQ ID NO: 202123 - DNA, 987 bp, Artificial Sequence
  Description of Artificial Sequence: Synthetic coding sequence
atggagtgggacaacggcaccggccaggccctgggcctgccccccacaacctgtgtgtaccgagagaactttaaacagctcctcctcccgcctgtatactccgcagtactcgccgccggcctgcctttaaacatctgtgtgattactcagatctgcacttctcgcagggctcttaccagaacagcagtgtacactctgaatttagcgttggctgatttgctgtacgcttgttctcttccattgctgatatataattatgcccaaggcgatcactggccttttggcgattttgcttgccgcctggtgcgcttcctgttctacgccaacctgcatggctcaatcctgtttctcacatgcatcagtttccagaggtatctcggaatctgccatccattagccccttggcacaagaggggaggcaggcgggctgcatggcttgtctgtgtggccgtgtggttggccgtgaccacccagtgcctgcccaccgcaatcttcgccgctaccgggatccaacggaacaggactgtgtgctacgatctttctccccctgccctggctacacactacatgccctacgggatggccctaactgttataggatttttgttaccatttgcagctctgctcgcctgctattgccttctcgcatgcaggctgtgcaggcaagatgggccggccgaaccggttgcccaagagcgcagaggcaaggctgcaaggatggcggtggtggtggccgctgcttttgccatttcgttcctgccatttcacatcaccaaaacagcttacctcgccgtgagaagcacgcctggcgtgccgtgtaccgtgctggaagccttcgccgctgcctacaagggcacgaggcctttcgcctctgccaactcggtgctcgacccaatcctcttctacttcacccaaaaaaaattccgccggcgaccccacgaactgttgcagaaattaaccgccaaatggcagcgccagggccgctag

SEQ ID NO: 202124 - DNA, 987 bp, Artificial Sequence
  Description of Artificial Sequence: Synthetic coding sequence
atggagtgggacaacggcaccggccaggccctgggcctgccccccactacttgcgtgtaccgtgaaaattttaagcagttgcttctaccaccagtctactctgctgtgctggctgcaggcttgccactgaacatttgtgtcatcacccaaatctgcaccagtaggcgagccctgacacggacagcagtttataccctcaaccttgccttggccgatctactctacgcgtgttccctgcctctattgatttacaattacgctcaaggcgatcactggccattcggggactttgcatgtaggctcgtgaggtttttgttctacgccaatttgcacgggtcaatactttttctcacatgcatctcatttcaacgctacctgggaatatgtcatcctctcgcaccatggcataaacgcggcggcagaagagctgcttggcttgtatgcgtcgctgtttggctagcagtcactactcagtgcctgcccactgccattttcgcagcaacaggcattcaacggaatcggacagtctgttatgatctgagccctccagctctcgccactcactatatgccgtacgggatggcacttacagtcatcgggttcttgctgcctttcgcagctctgttagcgtgctattgcctgttagcatgcagactctgccgccaagatggtccggctgaaccagtcgctcaggagcggaggggaaaagccgccagaatggcggtagttgttgcagctgcatttgccatctcattcctgccattccatatcaccaagactgcctacctggcagtgcgcagcacccctggcgttccctgcactgtcctcgaagcatttgcagccgcatataaggggacaagaccgtttgcttctgcaaatagcgtgctggaccccattcttttctacttcacacaaaagaagttccggcgaagaccacacgagcttctccaaaaattgaccgcgaaatggcaacgccaggggaggtag

SEQ ID NO: 202125 - DNA, 387 bp, Artificial Sequence
  Description of Artificial Sequence: Synthetic coding sequence
atggagtgggacaacggcaccggccaggccctgggcctgccccccaccacctgtgtatatagagagaactttaagcaacttctgctacctccggtgtacagcgcagttctcgccgccggccttcctctgaatatctgcgttatcacccagatatgtacctcccggagggctctcacacgcaccgctgtgtatacccttaatttggctcttgccgacttgctgtatgcatgctcactgcctctccttatttacaattacgcacaaggagaccactggccctttggtgactttgcctgtcgcctcgttagatttctcttctacgctaatcttcacggctccatactattcctgacatgtatctctttccaaaggtatctgggcatctag

SEQ ID NO: 202126 - DNA, 738 bp, Artificial Sequence
  Description of Artificial Sequence: Synthetic coding sequence
atggccaacaactacaagaagatcgtgctgctgaagggcctggaggtcatcaacgactaccacttccgaatcgttaagtccctcctcagtaacgatttgaagctaaaccccaagatgaaagaggagtatgacaaaatccagatcgcagatctgatggaagagaagtttcctggtgatgcaggcctcggcaagcttattgaattctttaaggagatcccaacactgggcgatctggcggaaactctgaaacgagagaagctgaaagttgccaacaagattgaatcaataccagttaaaggaataattccatctaagaaaacaaaacaaaaggaagtgtacccagccactcctgcttgtactccaagcaatcgcttaacggcaaaaggggccgaggaaaccctcggcccccagaaacggaaaaagcctagcgaggaagaaacagggacaaaacggtcaaagatgtccaaagagcaaactcgccccagctgttccgctggcgccagcacatcaacggcaatgggtagaagtcctcccccccagactagctcttctgctccacctaatacctcatccacagaggcttacctgatgaatcttactttatctttgaccgcagggtccttcctaagttgcgctgtgtggggtagagatcgagagctaagaaacctggagttatccgctacagacagtctaagtacagcccctatctattatacccccatccctttcgcccactag

SEQ ID NO: 202127 - DNA, 1452 bp, Artificial Sequence
  Description of Artificial Sequence: Synthetic coding sequence
atggccaacaactacaagaagatcgtgctgctgaagggcctggaggtcatcaacgattatcacttcaggattgtgaagtctctgctgtctaacgacctgaaactgaatcccaagatgaaggaggaatacgataagattcagatagccgacctgatggaagagaagttcccaggtgatgctgggctggggaagcttatcgagttcttcaaagaaatccctaccttgggtgatctggccgagactttgaaacgggaaaagctcaaagtaaaggggatcattccctcaaaaaagacaaaacagaaagaagtgtatccagccacacctgcctgcacaccttctaaccgtttgacagccaaaggagccgaggaaaccttggggcctcagaagcggaagaagccaagcgaagaggaaaccggaaccaagcgtagtaaaatgtccaaagaacagacgagaccgtcatgtagtgccggtgcttcaactagcacagccatggggagaagccccccacctcagacaagctcctctgcgcctccgaatacaagctccaccgaaagcttgaagccactcgccaatcgtcatgccactgccagtaaaaacatatttagagaggatccaatcattgcaatggtcctcaacgctacaaaagtgttcaagtacgaaagctctgaaaacgaacaacggcggatgtttcacgccacagtggcgacacagacacagttctttcacgttaaggtgctaaacataaacctgaagcgcaagtttatcaaaaaaaggatcataattatcagcaactatagtaagcgtaacagccttctcgaggtgaatgaggcctctagcgtcagcgaagccggtccggatcaaaccttcgaagtccccaaagacatcatccggcgcgcgaaaaaaatccctaagatcaatattctccataagcagacgagcgggtacattgtgtacggattgtttatgttacataccaaaatcgtgaatcggaagactacaatttatgaaatacaagacaaaactggatctatggctgttgtggggaagggcgagtgccacaacatcccttgtgagaagggggacaagctgcggctgttctgctttcgcctgcggaagagggaaaacatgtccaagctcatgtctgagatgcactccttcattcagattcagaaaaatacgaaccaacgtagtcatgattcccgttctatggccctgccacaggaacagagtcagcacccaaagcctagtgaagcaagcaccactctaccagaatcccatctgaagacgccccaaatgccccctaccaccccctctagttcctccttcaccaaaaaggatgaaactcaccccggagcccagagcagccctgcaaattttcgaattacctcgcccacggtcgcccctccactttcatcggacacaagtacaaataggcacccagcagttccatag

SEQ ID NO: 202128 - DNA, 1479 bp, Artificial Sequence
  Description of Artificial Sequence: Synthetic coding sequence
atggccaacaactacaagaagatcgtgctgctgaagggcctggaggtcatcaatgattaccactttcgcatagtcaagagtctgctgtcaaacgacctaaagctcaacccaaaaatgaaggaagagtatgataaaatacagatcgccgatcttatggaggaaaagtttcccggagatgctggcctggggaaactgatcgagtttttcaaagaaatccctacccttggcgacctggccgagaccctgaaaagggaaaagcttaaagtcgccaataaaatagagtctatccctgtaaaaggaataatcccctcaaagaagactaaacaaaaggaggtataccctgctacccccgcctgcacacccagcaatcggcttaccgctaagggcgcagaagaaacgctgggccctcagaaaaggaagaaaccatctgaagaggagacaggaactaagaggtccaagatgtccaaagagcagactaggccttcttgttcggccggcgcctctacgtccactgcgatgggccggagtccccccccgcagacatcctcctctgctccacctaatacgtccagcacggaatcattaaagcccctcgcaaatagacatgccacggcaagcaagaatatctttcgggaggatcccatcattgccatggtgttaaatgccactaaagtctttaagtatgaaagtagcgaaaatgagcagcggagaatgttccacgcgactgtagcgacccaaactcaattcttccatgtaaaagtgctgaatatcaatctaaaaagaaagttcatcaagaaaagaattattatcatatctaactactctaagcgaaattcactgctggaagtgaatgaggccagtagcgtgtcagaagcagggcccgaccagactttcgaagtgccaaaggatatcatacggagggccaagaagattcctaagattaatatcctccacaagcagacaagcggatacatagtgtacggcctgttcatgctgcataccaaaatcgtcaaccggaagaccacaatttacgaaatccaggacaaaactggatcaatggccgttgtggggaagggcgagtgccacaacatcccttgcgagaagggcgataagctcaggttgttctgcttccgcctgcggaaaagggaaaacatgtcaaagctcatgtctgaaatgcattcctttatacagatccagaagaacaccaaccagagatcacatgattcacggagcatggcattaccgcaagagcagtcacagcaccccaagccctcggaggcttctaccacactgcctgagagccacctaaaaacaccacagatgcctcctacaacaccctcgtcctcatccttcaccaaaaaggatgaaacacatccgggcgctcagtcttccccagctaattttcggattaccagcccaacagtcgccccacctttatcttccgacacgtcaaccaatcggcatccagccgtgccttag

SEQ ID NO: 202129 - DNA, 1359 bp, Artificial Sequence
  Description of Artificial Sequence: Synthetic coding sequence
atggccaacaactacaagaagatcgtgctgctgaagggcctggaggtcattaatgactatcatttccggatagttaaaagtctgctgagtaatgaccttaaattaaatccaaaaatgaaagaagaatatgacaagatccagatcgcggacttgatggaggagaagtttcccggagacgcagggctggggaagctcatcgagtttttcaaggagatccccacactgggcgatctagctgagactctaaagagagagaagcttaaggtgaaggggattatcccatccaagaaaacgaaacagaaagaagtttaccccgcaactcctgcttgtacgcccagtaatcggctgactgctaagggggcggaagagaccttgggacctcagaaaaggaaaaaaccttccgaagaggaaaccggaaccaaacggtctaagatgagcaaagagcagacacgtcccagctgctctgcaggagcatctactagcacagccatgggacggagtccacccccacagacaagctcctcagcccctccaaataccagtagcacagagagcctcaagcccttagctaatagacacgccacagcatcaaaaaacatttttcgtgaggatccaattattgctatggtgctgaacgccactaaggtgttcaagtatgaatcatctgagaatgaacagagacgcatgttccacgctacggttgccacccagacacagtttttccacgtcaaggtgctgaacatcaacttaaagcgtaaatttattaagaaaaggattatcataattagtaactattcgaagcgcaattcactgctggaagtcaacgaagcatcctcagtatccgaagcgggaccggatcagacttttgaagtgccaaaggatattatccggagagccaagaagatcccgaagatcaatatcctccacaagcaaacgagtggctatattgtatacgggctgtttatgctccacacaaagatcgtgaacagaaagaccacgatttacgaaatccaggacaagaccgggtccatggccgtcgttggtaaaggggagtgtcacaacatcccgtgtgaaaagggagataagcttaggctgttctgcttcaggctacgaaagcgcgagaatatgtcaaagctgatgtcagaaatgcatagttttatccagattcagaagaatactaatcagaggagccatgactctcgttccatggccctaccacaggagcagtcacaacaccctaagcctagcgaagcctcgaccacactccccgaatcccaccttaaaacaccgcaaatgccccctacaacgcctagtagcagttcgtttacaaaagtaactaaggacaaagacatcaaatag

SEQ ID NO: 202130 - DNA, 1386 bp, Artificial Sequence
  Description of Artificial Sequence: Synthetic coding sequence
atggccaacaactacaagaagatcgtgctgctgaagggcctggaggttataaatgactatcacttccggatcgtgaagagcctgttgtcgaacgatctgaagttaaaccctaaaatgaaggaggaatatgataaaattcaaatcgcagatctcatggaggaaaagtttcctggagatgccgggctgggtaaattaatagagttttttaaagagattcctacactgggcgatcttgccgaaacattgaaaagagaaaagctgaaggttgcaaacaaaatcgagtcaatccctgtgaaagggattattcctagtaagaaaacaaaacagaaggaggtataccctgctacacccgcttgcacaccaagtaacaggctcaccgccaagggggcggaggagactctcggaccacagaaacggaagaagccgtccgaggaggagacaggcaccaaacgttccaagatgtccaaagagcagacccggccttcatgctccgctggagcctctacttcaaccgccatgggccgatcccctcctcctcagacaagctctagtgccccccccaatacttcaagcacagagtctctgaaaccactcgcaaacagacacgctaccgcttctaaaaatatttttagagaggacccaattattgctatggttcttaacgcgaccaaagtgtttaagtatgagtcaagcgaaaacgaacagaggcgcatgttccatgctacagtcgccacgcagacgcagttttttcatgtcaaggttctcaatatcaatcttaaacgaaaattcatcaagaagcgcatcattattatatccaattactcaaagcgcaactctctgcttgaggtgaatgaggcatcttcggtgtctgaagcaggacctgatcaaacctttgaggtgccgaaggacattatccggagggccaagaagattcctaagataaacattcttcataagcagacctctgggtacattgtatacggcctcttcatgttgcacactaaaattgtgaacaggaagaccaccatttacgaaattcaggataaaactggatctatggctgtggtcgggaagggagagtgtcataacattccgtgcgaaaagggcgataaactgcgcctcttttgcttccgcctgaggaagagagagaatatgtccaagctcatgagcgaaatgcattccttcatacagatccagaagaacaccaatcagcgaagtcacgactcacgttctatggcccttccccaggagcagagccaacaccctaagcccagtgaagcatcaaccaccctgcccgagtctcacctgaaaactcctcagatgccccctactactcctagcagcagctcctttaccaaagtgaccaaggataaggacattaagtag

SEQ ID NO: 202131 - DNA, 453 bp, Artificial Sequence
  Description of Artificial Sequence: Synthetic coding sequence
atggccaacaactacaagaagatcgtgctgctgaagggcctggaggttatcaatgactaccacttcagaattgtaaagtcactgctttcaaatgatcttaagttgaaccccaaaatgaaggaagagtacgacaagattcagattgctgatctcatggaggaaaagttcccaggggacgcgggactgggcaaattaatcgagttcttcaaggaaatccctacccttggagatcttgctgaaaccctaaagcgggaaaagctaaaagtagccaataagatagagtccatccctgtgaagggaattattccttccaagaaaactaaacagaaagaggtgtaccctgctaccccagcttgtacaccttcaaatagactcacggccaagggcgcagaggagactctcggaccacagaagcggaagaaaccaagtgaggaggagaccggcaccaaatag

SEQ ID NO: 202132 - DNA, 399 bp, Artificial Sequence
  Description of Artificial Sequence: Synthetic coding sequence
atggccaccaccgtgaccctggagaagtgcggccacaacaagggctacaaaggcctggacaattgcagattttgcccgggctcgcaatgttgcgtagaagatggccctgaatctatagatagtatcatcgacatggacgcagtctgtaaaagggtcactactttgggactggacgtgagcgtcactatttcccaagacgccggccgttacttgtgcgactttacgtactacacatcactgtaccagtcacatggtaggtccgctttcgtccatgtccccccgctgggcaagccatacaacgcagatcagctgggccgagcgctgcgcgccattatagaggagatgttggatctcctcgaacagagtgagggaaaaattaactattgtcataaacactag

SEQ ID NO: 202133 - DNA, 630 bp, Artificial Sequence
  Description of Artificial Sequence: Synthetic coding sequence
atggagcagccccggaaggccgtggtggtgaccggcttcggcccctttggcgagcatactgtgaatgcctcttggatcgcagttcaggagctcgaaaaactaggactgggggactcagtcgatctccacgtatatgagattccagtggagtaccagacagtccagcggctgataccagctctgtgggaaaaacactccccccagctggttgtccacgtgggggtgtccggaatggcaactacggtgactcttgagaagtgtggtcataacaagggttacaaggggctcgacaactgtagattttgccccggttctcagtgttgcgtggaagatggccccgagagcattgactccataattgacatggatgctgtctgcaagagagtaacaacccttggcctggatgtttctgtgacaattagccaggacgctgggagatacctgtgcgatttcacctattataccagtttgtaccagagccacgggagatccgcattcgtgcatgtgccccctctcggtaagccttacaacgccgatcagctgggccgcgccctaagggctatcattgaggagatgctggatcttttggaacagtctgaaggtaaaattaactattgccacaaacactag

SEQ ID NO: 202134 - DNA, 609 bp, Artificial Sequence
  Description of Artificial Sequence: Synthetic coding sequence
atgaagaaggcccggaacgacgagtacgagaacctgttcaacatgatcgtggagatcccaaggtggacgaatgcgaagatggagatcgctaccaaggagcccatgaatcccattaaacaatatgttaaagatggcaaactgcggtacgtggcgaatatttttccctacaaagggtatatctggaactacgggacactcccccaaacttgggaggacccccacgagaaagataaatcaacaaattgcttcggagacaacgatcctatcgatgtctgtgagatagggtccaaaattctttcttgcggggaagtgatccacgtgaaaattctgggtatactcgctttgatcgatgagggcgagaccgactggaagctaatagcgatcaatgccaacgatccagaggctagtaagtttcacggattgagaaacatccccgtgtacactattaataggatcgtaatcctccctagcttagaccggtcacagacctcaagcctctcctatcttccggcacaccaggattcttgcgtgcctctcgatgcggcgttgcatgtggtgttgtacttctgttcactcttaggcctccaatcatatcttagttgtttttag

SEQ ID NO: 202135 - DNA, 1005 bp, Artificial Sequence
  Description of Artificial Sequence: Synthetic coding sequence
atgagcgccctgctgcggctgctgcggaccggcgcccccgccgccgcttgcttacgcctcggtaccagcgccgggacaggttcccgccgcgcaatggccctctatcacacggaggagaggggccaaccttgtagtcaaaactataggctgttcttcaagaatgtaacaggccattatatatctccctttcatgatatcccattgaaagtgaattccaaggaggaaaacgggattccaatgaaaaaggctcggaacgatgagtatgagaacctgttcaacatgatcgttgagattcccaggtggaccaatgctaaaatggagattgcaactaaagagcctatgaaccctatcaagcaatacgtcaaagatggcaaactccggtacgtggcgaatatcttcccatataagggctacatctggaactacggaactctcccacagacatgggaagatccccacgagaaggataaatccacaaattgtttcggagataatgatcctatagacgtgtgcgaaataggctccaagatactgagctgcggagaagtgatccacgtaaaaattctaggaatcctagccctaattgatgaaggggagaccgactggaaattaattgctatcaatgccaacgatcctgaggcgtctaaattccatgatattgatgatgtgaagaagttcaagcctggctatctggaagcgacactgaactggttccgactgtacaaggttccagacggaaagccagagaatcagtttgccttcaatggtgagttcaagaataaggccttcgcactcgaggtcattaagtcaacgcaccagtgttggaaggcactattgatgaagaagtgtaacggcggagcaataaattgcacaaacgtccagatcagcgattccccttttaggtgcacccaagaggaggccagaagtcttgttgagagcgtgtcctcgtctcctaacaaggagagcaacgaagaggaacaggtttggcactttctgggcaagtag

SEQ ID NO: 202136 - DNA, 918 bp, Artificial Sequence
  Description of Artificial Sequence: Synthetic coding sequence
atgagcgccctgctgcggctgctgcggaccggcgcccccgccgccgcttgcctcagactcggcacctcagctggaacagggtctcgcagagccatggctctgtatcatacggaagagagggggcaaccttgttcgcagaattacaggcttttttttaaaaacgtgaccgggcactatattagccctttccacgacatacccctcaaggtcaatagcaaggaggagaatggtatccccatgaagaaagctaggaatgatgagtacgaaaatttgtttaacatgatagtcgagattcctcgatggacaaatgccaaaatggagatcgctaccaaggagcccatgaatccaataaaacaatacgtgaaggacggcaaactgcggtatgtggccaatattttcccatacaaaggttacatttggaactacggaacgctgcctcagatcctgtcctgcggagaagtgatacatgtcaaaatcctgggtattctggcactcatagatgaaggggaaaccgactggaaactgatcgccattaatgctaacgatccagaagcaagcaaattccatgacatcgatgatgtcaaaaaatttaagcccggatatctggaggcaaccctgaattggttccgcctctataaagttcctgacggtaagcccgaaaatcagtttgcctttaacggcgaattcaaaaataaggctttcgccctggaggtgataaaatctacacaccagtgctggaaggcactgctgatgaaaaaatgcaacggaggagccatcaattgtactaacgtgcagatttcagactcaccttttcggtgtacccaggaggaggcccggtcattggtcgaaagtgtgagttcatccccaaataaagagtcaaacgaagaggaacaagtctggcacttcctgggcaaatag

SEQ ID NO: 202137 - DNA, 507 bp, Artificial Sequence
  Description of Artificial Sequence: Synthetic coding sequence
atgagcgccctgctgcggctgctgcggaccggcgcccccgccgccgcctgcctgcggctggggacatcagctgggacaggatcaaggcgcgcaatggcactgtaccacaccgaggaaagaggacagccctgtagccagaattaccggctctttttcaacatcgatgacgtgaaaaaattcaaacccgggtacctcgaagcaaccctgaactggtttcggctgtacaaggtgccagatggaaagccagagaaccagtttgccttcaacggtgagtttaagaataaggcttttgccttagaagtgatcaaaagcacacaccagtgttggaaggctctgttgatgaaaaaatgcaacggaggtgccatcaactgtaccaacgtgcaaatttccgattcacccttccgttgtacccaagaggaggcccgtagcttagtcgaatcagtgagttcttctcccaataaagagtctaacgaagaggaacaggtgtggcactttttggggaagtag

SEQ ID NO: 202138 - DNA, 1050 bp, Artificial Sequence
  Description of Artificial Sequence: Synthetic coding sequence
atgagcgccctgctgcggctgctgcggaccggcgcccccgccgccgcctgtcttagacttggtaccagcgcaggaaccggaagccggcgggccatggccctgtatcatacagaagagaggggccaaccttgttcacagaactacaggttgtttttcaagaatgttacggggcactacatcagtccattccacgatattcccctgaaagtcaatagcaaagaggatacagaggcccagggtattttcatcgacttaagcaagatctgggagaacgggattcctatgaaaaaggcaaggaacgacgaatacgaaaacttattcaatatgatagtggaaattccacggtggactaatgccaagatggagatcgccactaaagaacctatgaaccctatcaagcagtacgttaaagacggcaaactccgctacgttgcaaacattttcccgtacaaaggctacatttggaactatggaactctgcctcaaacgtgggaagatcctcacgaaaaggacaagtctactaattgctttggcgataacgatccaatagatgtctgcgaaatcggctccaagattctgagttgtggcgaggtgatacacgtgaagattctgggtatcttggctctgattgatgagggtgagactgactggaagctaattgcgattaacgccaatgacccggaggcgtccaagtttcacgatattgacgatgtgaagaagttcaagcccggttatttggaggctactctcaactggttccgcctatacaaggtgcccgatggcaaacccgagaatcaatttgcattcaatggcgagtttaaaaacaaggcattcgcactggaggtgatcaaatctactcaccagtgctggaaagctcttctcatgaaaaagtgcaatggcggcgcaattaattgcacaaatgttcaaattagcgactcgccattccgttgtacgcaagaggaggctagatcactcgtcgaatctgtgtctagtagccccaacaaagagtccaatgaggaggaacaggtatggcattttctgggtaaatag

SEQ ID NO: 202139 - DNA, 951 bp, Artificial Sequence
  Description of Artificial Sequence: Synthetic coding sequence
atgagcgccctgctgcggctgctgcggaccggcgcccccgccgccgcctgtctcaggctaggtacgtctgctggcacaggatctagacgtgcaatggccctgtaccatacggaggaaagagggcagccctgttcacagaattacaggctcttttttaagaatgtcactggacactatattagtccttttcatgatatccctttgaaagtgaactcgaaggaagaaaatggtattcccatgaaaaaggctaggaacgacgagtacgagatcgctaccaaggagcccatgaatcctatcaagcaatatgtgaaggacggtaagcttcgctacgtggcaaacatctttccgtacaaaggttatatttggaactatggcactctccctcaaacctgggaggatccccatgaaaaggacaaatcaaccaattgcttcggcgacaatgatcccatcgacgtctgcgagatcggatctaaaatcttgtcatgcggggaggttatccacgtgaagatcctgggcatcttggccctaatcgacgaaggggaaacagattggaagctcatcgccatcaatgccaatgatccagaggcatcaaagttccatgatatcgacgatgtcaagaagtttaagccaggctacctggaggccacactgaactggtttagattatataaagtcccggatggcaaacccgagaatcagtttgcttttaatggggagttcaaaaataaagcattcgcactcgaagtaatcaagtcgacacatcagtgttggaaggcactcctgatgaagaaatgcaacggaggcgccatcaattgcacaaacgtccaaatctctgacagcccatttaggtgcacacaggaagaggcaaggtcgctcgtggagagcgtctcatccagccccaacaaagaaagtaatgaggaagaacaagtctggcatttcttggggaagtag

SEQ ID NO: 202140 - DNA, 699 bp, Artificial Sequence
  Description of Artificial Sequence: Synthetic coding sequence
atgagcgccctgctgcggctgctgcggaccggcgcccccgccgccgcctgtttacgcctgggtacgtctgctggaacaggctctaggagagcgatggccctctatcacaccgaggaacggggtcagccttgctcccagaattaccggcttttttttaaaaacgtcacgggacactatatatccccctttcatgatatcccccttaaggtgaacagtaaggaaattctgtcgtgcggagaggtgatacacgttaagatacttggtattctggccctgatcgatgaaggggagactgactggaagttgattgccatcaacgccaatgaccctgaggccagtaagttccacgatatcgacgacgttaaaaagtttaagccaggttacttggaggctaccctcaactggttcagactatataaggtgccggacggaaagccagaaaaccaatttgcgttcaacggcgagtttaaaaataaggcctttgcactcgaggtgattaagtccacacaccagtgctggaaagccctcctgatgaagaagtgtaacgggggcgctatcaactgtacgaacgtgcaaatttccgactctcccttccggtgcacacaggaagaagcaagaagcctcgtagagtcagtctcttcctcacccaacaaagaaagtaacgaggaagagcaggtgtggcattttttgggaaaatag

SEQ ID NO: 202141 - DNA, 960 bp, Artificial Sequence
  Description of Artificial Sequence: Synthetic coding sequence
atgagcgtgggcttcatcggcgccggccagctggccttcgccctggctaagggatttacagccgctggcgtgttagctgcacacaaaatcatggcgtccagccccgacatggacttggcaacggtttccgccttgaggaagatgggggtcaagcttaccccccacaataaagaaactgtacagcacagcgacgtgctgttcctcgctgtcaagcctcatatcattccttttatactggacgagataggggcagatatcgaggaccggcacatcgtcgtatcatgtgccgccggcgtgaccatctcctccatcgagaagaagctgagcgcatttcgacctgctcccagggtgatcagatgcatgaccaacaccccagtggttgtgcgggagggtgccaccgtctatgccacaggcacacacgcccaagtagaggatggaaggctcatggagcagcttctgtcctctgtcggtttttgcacagaggtagaggaagatttgattgacgccgtaacagggctaagtggctctggcccagcttacgcttttacggcactggatgccctggccgatggcggagtaaagatggggctgccgaggaggcttgcagtgcggctgggggcccaggccctgcttggggcagctaaaatgcttttgcatagtgaacaacaccccggacaactcaaagacaacgtttctagtcctggtggcgccactattcacgcccttcacgttctggagagcgggggtttccgtagcctcctgataaacgctgttgaggcttcctgcatccgtaccagggagttacagagcatggcagatcaggagcaggtgagccccgcagctattaaaaagaccatcctcgacaaagtgaagctggacagccccgctgggactgccctctcaccttctggccacaccaagctgttgccacgttcattggcacccgcgggaaaggactag

SEQ ID NO: 202142 - DNA, 951 bp, Artificial Sequence
  Description of Artificial Sequence: Synthetic coding sequence
atgagcgtgggcttcatcggcgccggccagctggccttcgccctggcaaagggcttcacagctgctggggtgctcgccgcccacaaaatcatggcgtcttccccagatatggatctggccacagtgtctgccttaaggaagatgggggtgaagttgacaccgcataacaaggagactgtccagcacagcgatgtgctttttctggctgtcaaacctcacatcatccctttcatcctagatgagattggtgcggacatagaagacaggcacatcgtggtgagctgcgcagcaggcgtgaccatttcttcgatagaaaagaagcttagcgccttccgcccagccccgcgcgttataaggtgcatgaccaataccccagttgttgtacgagagggcgccacagtttatgcaactggcacccatgctcaagtggaggatgggaggctgatggaacagctgctctcttctgtggggttttgcactgaagttgaggaggatttgatcgacgccgtaacaggtttatctggcagtggtcctgcatatgcgttcacagcactggatgcacttgccgatggcggtgtgaagatgggcctgccccgcagactggcagtgaggctgggggcgcaggctctgctcggtgcagctaaaatgctcctccatagcgagcagcaccccgggcaactgaaggacaacgtgtctagccccgggggcgccacgatccacgctctgcacgtgcttgaaagcggaggctttcgtagcctgctgattaacgctgtcgaagcctcttgcatcagaacacgtgagttacagagcatggccgatcaggaacaggtctcaccagcagccattaagaagacaatcctcgataaagaccatctgcctctggaactgggatctcctgagggtctgcatcctctcttgctgcaatatcagctggctcgagctccgtcctag

SEQ ID NO: 202143 - DNA, 1041 bp, Artificial Sequence
  Description of Artificial Sequence: Synthetic coding sequence
atggtgggcggcggccggcgggtgggccgggacgagcccgtgccctccgtgggtgctctgggtcagggttccccagatagtatgtctgtgggctttataggagctggtcagcttgcctttgctctggcaaaaggctttaccgcggcaggcgtgttggctgctcataagatcatggcttcctcccccgacatggaccttgcgactgtgtctgcattacgtaaaatgggcgtcaagctgactccccacaataaagagacagtgcagcattctgatgtactgtttctcgcagtgaaaccgcacattataccgtttatcctggatgagattggtgctgacatcgaagataggcacatagtcgtgagctgtgccgcaggcgtcacaatctcctcaatcgaaaaaaagctcagtgcctttcggcctgccccacgcgtaattcggtgcatgactaataccccagttgtcgtgagagagggagccactgtttacgctaccgggactcatgctcaagtggaggacggacgtctaatggagcaactgctgagcagtgtgggattttgcaccgaggtcgaggaggacctgatcgatgcagttaccggtctgtccggttcgggccctgcctatgccttcactgccctggatgccctcgccgacggaggagtgaagatgggcctccccaggcgtttagccgttaggctgggagctcaggctctgctcggggccgctaaaatgctcttgcacagcgagcagcaccccggccagttgaaggataatgtttcgtcacccggaggagcaacaattcatgcacttcacgttcttgaaagtgggggcttcagatctcttttaattaatgctgtagaagcgagctgtattagaacacgtgagcttcagtctatggcagaccaggaacaggtttctccagcagccatcaaaaagacaatactggataaagtcaagctggatagtcccgcggggaccgccctcagtccctcaggacatacaaagctgctgcctcgaagcctggcgcccgccggcaaggactag

SEQ ID NO: 202144 - DNA, 819 bp, Artificial Sequence
  Description of Artificial Sequence: Synthetic coding sequence
atgagcgtgggcttcatcggcgccggccagctggccttcgccctggctaagggcttcactgcggcaggcgtcctggcagctcacaagatcatggcgtctagcccggatatggacctcgctactgtcagcgcccttcgtaaaatgggggtgaaactgactccacataacaaggagactgtgcagcactctgatgtcctgttcctggctgtgaagccccatatcatcccatttatactcgacgagatcggggccgatatcgaggacaggcatattgtggtttcttgcgccgccggcgttacaatttcctctatagaaaaaaaactttccgctttccgacctgcaccacgcgtgataaggtgcatgaccaacacccctgttgtggtccgagagggcgctacagtctacgcaacaggaacgcatgctcaggtggaggatggaagactgatggagcaactgctgtccagcgtgggattctgtacagaagttgaggaagatctcatcgatgccgtgacaggcctgtcagggagcgggcctgcgtacgcctttacagccttggacgccctggctgacgggggagtaaagatgggactgcctcggcgcctcgcagtccggctcggagctcaggccttgctgggcggatgtcaggatgcggccgctctgcgtaccgcccctcgccccgcacagggtcaacgtcaactgtcgtggtggggccatcatccatgcttagcgtgcgctggggaatggggcctgcccttgccggcgcaccagcggtgcggagggttgctccaccctcataccggcgcagctgtgcatggttag

SEQ ID NO: 202145 - DNA, 723 bp, Artificial Sequence
  Description of Artificial Sequence: Synthetic coding sequence
atgagcgtgggcttcatcggcgccggccagctggccttcgccctggctaagggtttcacagctgcaggggtcctggccgctcacaaaatcatggcctctagcccggatatggatctggctacagtatccgccctgaggaaaatgggggtgaaactgaccccccataataaggaaactgtgcagcacagcgacgtgctgtttctagcggtgaagccacatattattagtatagaaaagctgtctgcgttcaggcctgcccctcgagtgattcggtgtatgactaacactcctgttgtggtgagggagggggccaccgtctacgcaactggcacacacgctcaggtggaggacggacgtctgatggagcagctgctgtctagtgtgggattttgtaccgaagttgaggaagatttgattgatgctgttaccggcctttctggttccggaccagcctacggagccgcgaaaatgcttttgcactccgagcaacatccaggccagctaaaagacaacgtgagctctccgggaggggctaccatacacgcactccatgtgctcgagagtggtggttttagaagtttgctgatcaacgccgtcgaggcaagctgtattagaactcgatgggccccagccctgcccgcctccctcgtctccagtccatgtatggctgaggcgtcactgacacatatttgcagttttacccactccgccgatacctattag

SEQ ID NO: 202146 - DNA, 1590 bp, Artificial Sequence
  Description of Artificial Sequence: Synthetic coding sequence
atgctgaagttccggaccgtgcacggcggcctgcggctgctgggcattaggcgtacttctacagcccctgctgcatctcctaatgtgcgcagactggagtacaaacccatcaaaaaagtaatggtggctaataggggagagatagccattagggtattcagagcttgcactgagctcggaatccgaactgttgcgatttactcggaacaggacacaggacagatgcaccgtcagaaggcggatgaggcctacttgataggacggggacttgcaccagtccaagcctatctacatatcccagatatcattaaggtcgccaaggagaacaatgttgacgctgtacaccctggctatggcttcctttctgagagagcagattttgcccaggcctgccaggatgcaggcgtcagattcataggaccaagcccagaagttgtgagaaaaatgggcgacaaggtcgaggctcgcgccatagccatcgccgcgggggtccctgtagttcctggcactgacgcgccgattactagcttgcacgaggcgcacgagttttcaaatacgtacggcttccctatcatatttaaagctgcatatggagggggtggacgcgggatgagggtcgtccatagttacgaggagctggaagagaactacaccagagcatacagtgaggcactggcagcattcggaaatggagccctgttcgtggagaaatttattgaaaagcccaggcacatcgaggtgcagattctcggcgaccagtatggcaatattctgcacctctacgagcgggattgcagcattcagagacgccatcagaaggtggtcgagatagctccagcagcacacctagatcctcagcttcggacacgtttgacatccgatagcgtgaagctggccaagcaagtgggctacgaaaatgcagggacagttgaattccttgttgatcgccacggaaagcattacttcattgaagtgaatagcaggctgcaagtggaacacacagttaccgaagagatcaccgatgtcgatcttgtgcacgcccagatacatgtggcagaaggacggagtctgcctgacctgggactgcgacaggagaatataaggattaacggatgtgcaatccagtgcagggtcaccaccgaagatccagctcggtctttccagcctgacacaggacgcatagaggtcttccgcagcggcgagggcatgggcatacgccttgacaacgcatccgccttccagggcgccgtcatctctccccactacgactcactgctcgtgaaagtgatcgcccatgggaaagatcatccaactgccgccactaagatgagcagggccctcgctgaattcagggttcgaggggtcaaggtgcggcgtcaccaggcccagcctctcgccgctgctctgggcagaccttgtgggcaggaggctcgtcggccccaggcagcagtgaccgcaccaaccggtccaggaagcccaaccctagtcagagtgcctcctgctgctagagtgctgagctcaagattaggggggccgtctcagacaactccggaaacttctaccgaggtctccccaactattctgttgtag

SEQ ID NO: 202147 - DNA, 3537 bp, Artificial Sequence
  Description of Artificial Sequence: Synthetic coding sequence
atgctgaagttccggaccgtgcacggcggcctgcggctgctgggcataaggcgaacctccacggctcccgccgcgtcgccaaatgtgcgtagactagaatacaaacccatcaagaaggtgatggtagccaacagaggagaaatagccattcgagtgtttcgagcctgcaccgagcttgggatacggacagttgccatttactcggaacaagacaccggccaaatgcataggcagaaggcagacgaggcctacctgatagggcgggggctggctcccgtccaggcttacctccacattccagatatcataaaggtggccaaagaaaataatgtggatgctgtccacccagggtacggttttttatccgagcgcgcagattttgcgcaagcatgtcaggatgcgggagttcgcttcattgggccctcaccagaggtggtccgcaaaatgggggataaggtggaagctagagccattgcaattgccgccggagtcccagtggtgcctggcacagatgctcccattacaagtctgcatgaagctcatgaatttagtaatacttacggcttcccgataatcttcaaagccgcttacggagggggtggccggggcatgcgcgtggtgcacagctacgaagaattagaagaaaactatacccgcgcatatagtgaagccctagcagctttcggcaatggagctctctttgtagaaaagttcatagaaaaaccaagacatattgaagttcagatcctgggcgatcagtatggtaacatcctccacctctacgaaagagactgttcgatccagcggcgtcatcagaaagtggtggaaatcgcacccgccgctcatctggatccacagctgcgtactcgtctcaccagcgatagcgttaagctggcaaagcaggtcggttatgagaacgctggaactgtggagtttctcgtggaccgtcacgggaaacactacttcatcgaggttaattcccggctccaggtggaacatacagtgaccgaggagattaccgatgtggacttggtgcatgctcagattcatgtggcagagggtcgctccctgcctgacctgggcctccggcaggagaatatcaggatcaacggatgcgcaatccagtgcagggtgacaacagaagatcccgctagatcatttcagcccgacaccggacgcatagaagtgttccgctcaggggagggaatgggcatacgcctggacaacgccagtgcctttcaaggggccgtcatctctccacattacgattctctcctggtgaaggttatcgctcacgggaaggaccatccaactgcagctacaaaaatgtccagagcgcttgcggagttccgggttaggggcgtcaagaccaatatagctttcctgcagaacgtattaaataaccagcagtttcttgcagggacagttgacacgcagtttatagatgagaatcccgaactgttccaattgaggcccgcgcagaaccgagcccaaaaattgcttcattacttggggcacgttatggttaacggaccaactactccaataccagttaaggcgagtccatcacctacagatcctgttgtccccgccgtccctattggcccacctcctgccggttttcgggatatcctgttaagggaaggccctgaaggcttcgcaagggccgtccggaaccaccccggactgttgctcatggatactacattcagagacgcccaccaaagcctgctggcaacccgggtgcgcacacacgacctaaagaagatcgctccttatgttgctcacaacttctcaaagttgttctcaatggagaattggggcggggccacctttgacgtggccatgcggttcctatacgagtgcccatggaggcgtctccaggagctgcgggagttgatccctaatattcccttccagatgctgctgaggggagccaatgctgtgggatataccaactatcccgacaatgtagtgtttaagttttgcgaggttgctaaagaaaatggcatggacgtctttcgggttttcgatagtctcaattacctccctaacatgctactgggaatggaggctgctggttccgccgggggggttgtcgaggccgccatttcctacactggggatgtcgccgacccaagccgtacgaaatactcactacagtattacatgggactggccgaggagctggttcgggcagggacgcatatcctctgcatcaaagatatggccggacttctcaagccgacagcatgtactatgctagtgtcttctcttcgggaccggttcccagatctacccctgcacatacatactcacgacacttccggcgctggagtcgccgccatgttagcttgcgcccaggcaggcgccgacgtggtggatgtcgcggcagatagtatgtcaggaatgacctcccagcctagcatgggcgctttggtggcatgcactcgcggcactcctctggacaccgaagttccgatggaaagagtgttcgattacagtgagtattgggagggtgcacgcggactttacgccgcatttgactgcactgcaaccatgaagagcggcaattcagacgtgtatgaaaatgaaattcccggcgggcaatatacgaatctgcattttcaggctcacagtatgggtcttgggtcaaaattcaaagaggtgaagaaggcctacgtggaggctaatcagatgctcggagatctcatcaaggtgacaccttccagcaagatcgtcggcgacctggcacagtttatggtgcaaaatggcctgtcacgcgcagaggccgaagcccaagctgaggaactgagcttcccacggtcagtggttgagttcctccagggatatatcggagtgcctcatggaggcttccctgaaccatttcgcagcaaagtcctcaaagacctaccacgcgttgaagggcgcccaggcgcctcccttcccccactggatcttcaggctctcgaaaaagaactggtcgaccgccacggcgaggaggtgacacctgaagacgtgcttagtgctgcaatgtatccagacgtttttgcccacttcaaggattttacagcaactttcggacctttggactctctgaatacccgactattcctccagggacccaaaatcgctgaggaattcgaagttgagctagaaaggggcaaaacactgcatataaaggctctggccgtgagcgatctgaatcgcgctggacagagacaggtcttctttgaactgaacggacagctgcggagcatactggtgaaagacactcaggcaatgaaagagatgcactttcaccccaaagccttgaaagacgtgaaagggcagattggggccccaatgcccggcaaagtgattgatatcaaggtcgtggcaggggccaaggttgccaaaggacagcctctttgcgtgctcagcgctatgaagatggagaccgtcgtgacctccccgatggagggcaccgtccggaaggttcatgtcactaaagacatgaccctcgagggggacgacttgattttagaaatagagtag

SEQ ID NO: 202148 - DNA, 3537 bp, Artificial Sequence
  Description of Artificial Sequence: Synthetic coding sequence
atgctgaagttccggaccgtgcacggcggcctgcggctgctgggcattagaagaacatcgaccgccccagcagccagccccaacgtcagacggctggaatataagcccataaagaaagtgatggtggccaacaggggcgaaatcgctattcgcgtcttcagagcctgtactgagcttggtatccgcacggttgctatttacagcgagcaagacaccggacagatgcacagacagaaagccgacgaagcatatttgattggaaggggcctcgcccccgtacaggcttacttgcacatcccagacataattaaggtcgctaaagaaaataatgtcgatgctgtccaccctggatacggctttctgtctgagcgcgctgactttgcccaggcatgccaagatgccggtgtcaggtttatcggcccgtcgcctgaggtcgttaggaagatgggcgacaaggtggaggctagagcgatcgcaatcgccgcaggggttccagtggtcccgggaactgacgccccaatcacctctctgcatgaggcccacgagttctctaatacttatggctttccaattatctttaaggcagcctatggaggcggaggtcggggcatgcgcgttgtgcacagttacgaagagctggaggagaattatactcgcgcgtactccgaagccctggccgccttcgggaacggagcactgtttgtcgaaaagtttatcgaaaagccgagacacattgaagttcagatcctgggggaccaatacgggaacatactgcatttatatgagcgagattgcagcatccagcgccgtcaccaaaaagtggtagaaatcgccccggcagcacaccttgacccccaattacggacaaggctgacctccgattcggttaaactggccaagcaggtgggttacgagaacgcgggtacagttgaattcttggttgacaggcacgggaagcactactttatcgaggtgaacagcagactgcaggttgaacacaccgttaccgaggaaataacagacgttgatctggttcacgcccagatccacgttgcagagggccggtccctgcctgatctggggcttcggcaagaaaacatcagaataaatggctgcgccatacagtgtcgtgtcaccacagaggatccagcacgttctttccaacccgataccgggaggatcgaggtttttaggtccggtgaaggaatgggaattcggttagacaatgcttcagccttccagggcgcagttatctccccgcactacgacagcctccttgtcaaagtaattgcccatggaaaggaccacccaaccgccgctactaagatgtctagggccttggctgaatttcgggtgaggggagtgaagaccaatatcgccttcctgcagaatgtactcaataaccagcagtttctcgccgggaccgttgacacccagttcattgatgaaaacccagaactgttccagttgcgcccggctcagaatcgagcacagaagctgctacattacctgggccacgtcatggtaaacggccctaccactcccattccagttaaggcatccccctccccaacagaccctgtggtccccgctgtacccattggacctccaccagccggcttcagagacattctcctcagagagggacccgaaggatttgctagggcagtgcgcaaccacccgggccttctcctgatggacaccacttttcgagacgcgcaccagagcctgctcgccactagagtccgaactcacgacctgaaaaaaatagctccatatgttgctcacaatttctctaagttgttcagcatggagaactgggggggtgccaccttcgacgttgccatgcggtttttgtatgagtgtccatggagacgactccaggaactacgcgagctgattcctaacatccctttccaaatgttattgagaggggccaatgccgttggttatacaaactatcccgacaatgtggttttcaagttctgcgaggttgctaaggaaaacggcatggatgtgttcagagtctttgattctctgaactatctgcctaacatgttgttaggaatggaggctgcgggtagcgctggtggcgtcgtcgaggccgcaatctcctacaccggggacgtcgccgatcctagtcggaccaaatattcattacagtactacatgggcctcgctgaggaactggtgcgcgcaggcactcacatcttgtgtattaaggatatggcaggactgctgaaaccaactgcgtgcacaatgctcgtatccagccttcgagaccggtttccagatctccccttacacattcacacccacgacacatctggagctggggtggccgctatgctggcctgcgctcaggctggagccgatgtcgtcgacgtggccgcagattctatgagtgggatgaccagtcagccctccatgggagctctggtggcatgtacacgcggcacacccctggacaccgaggttccaatggaaagggtgtttgattatagtgagtactgggaaggagccagggggctgtacgcggccttcgattgcaccgctaccatgaagtccggcaattccgatgtatacgaaaacgaaattccaggcggacagtacactaatctgcatttccaggcccactctatggggttgggttcaaagtttaaagaagtgaagaaagcgtatgttgaggcaaaccagatgctgggtgacctgataaaggtgacacctagctctaaaatcgtgggcgacctcgcccaatttatggtgcaaaacgggctcagccgcgctgaggccgaagctcaggccgaggaactgagctttcctagatctgtggtggagtttctccagggatatattggcgtaccccatgggggctttcccgagccctttcggtctaaggtcctgaaagacctgcctcgcgtggagggacggcctggggcaagtttgccgcctttggaccttcaggccctcgaaaaagaactcgtggacagacacggagaagaggtgaccccagaagatgtgctcagcgccgcaatgtatcctgatgtctttgcccactttaaggactttacagcaacattcggccctctggacagcctgaatacacgtctgttcttacaggggcctaaaattgcagaagagtttgaagtcgaactggaaaggggtaagactctgcatataaaggcgctcgccgtttctgacttgaatagagcagggcagcgacaggtctttttcgagctgaacggacagctcagaagtattctcgttaaggatacacaggcaatgaaagagatgcacttccaccccaaggccctgaaggatgtgaagggccagatcggggctcccatgcccgggaaagtgattgacatcaaagtagtggccggggccaaggtcgccaaagggcaacccctctgcgtactctccgccatgaaaatggaaacagttgtgactagtccaatggaaggaacagtgagaaaggtgcatgtgactaaagacatgacactggaaggcgatgacctgattctggagatcgagtag

SEQ ID NO: 202149 - DNA, 3537 bp, Artificial Sequence
  Description of Artificial Sequence: Synthetic coding sequence
atgctgaagttccggaccgtgcacggcggcctgcggctgctgggcataagacggacctcaaccgctcccgccgcaagtcccaacgtcaggcggttggaatacaagcccattaaaaaggttatggtggctaatcgtggtgagatcgccatacgcgtgttcagagcctgcactgagctcggcatccggactgtggcaatctactctgagcaggatactgggcaaatgcatcgccaaaaggccgacgaagcctaccttattgggcgtggactggcacccgtgcaggcctacctgcacattcccgacatcatcaaagttgctaaagaaaataacgttgatgcagtacaccccgggtatggcttcctgagtgagcgggccgacttcgctcaggcttgccaggatgctggggtgcgatttataggaccttcaccagaggtggtaagaaagatgggcgacaaagtggaagccagggctatcgcaatcgccgccggtgtgccagtggtgcccggaaccgacgcccccataacctctctgcacgaagctcatgaattctcaaacacatatggattccctattatatttaaggcagcttatggaggtggggggagagggatgcgagttgtgcacagctatgaggagttagaggaaaattacacccgtgcctactccgaggcccttgctgcctttggtaacggagcgctgtttgtggagaagtttattgagaagcccaggcatatcgaggtccagatactcggagaccagtatggtaacatcctacacctgtacgagcgtgattgcagcatccagcgccgtcatcagaaggtggtggagattgcccccgccgctcatctcgacccccagctcaggacgagactcacatccgattctgtgaaattggctaagcaggtcggctacgagaatgccggtaccgtagagttcctcgtggaccgccacggcaagcactattttatagaagtcaattctcgcctccaagttgaacacacagtgacggaggagatcaccgacgttgacctggtgcatgcccagatacatgtcgctgagggcagaagcctgccagacttggggctgcgccaggagaacattcggataaacggatgcgcaatacagtgcagagtgaccactgaggatcctgcccgttctttccagccagacaccgggcgcattgaggtctttagaagcggagaagggatggggatccgccttgataacgcaagcgcctttcagggcgctgtgatttccccacactacgacagtctgctggtgaaagttatcgcccacggaaaggatcatcccactgcagcaaccaagatgagtcgcgctttagccgagtttcgagtccgcggtgtcaagacaaacatcgccttcctgcagaacgtgttgaataaccaacagtttttggccggcacagtggacacccagtttattgatgaaaacccagagctctttcagcttaggcctgcccagaatcgcgcacagaaactgctgcattacctgggacacgtcatggtcaacggtcctactaccccaatccccgtaaaggctagcccttcaccaactgaccccgtggtaccagcagtgccaatcggccctcctccagcaggatttcgggatatcttattgcgggagggcccagagggctttgcgcgcgccgtcagaaaccacccagggctgctgctgatggataccacattcagagacgcccaccagagcttgctggccacccgcgtgcggacacacgacctcaagaagattgcgccgtacgtagctcacaacttctccaagctgttcagcatggaaaattggggtggcgccacctttgatgtggcgatgaggttcctctatgagtgcccctggcggaggctgcaagagctgagagaactgataccgaatattccctttcagatgctcctgagaggagcgaatgccgtcggatacactaactatcctgacaatgtcgttttcaaattttgcgaagtagcaaaagaaaacgggatggacgtattccgtgtgttcgacagtctgaactatctacctaacatgcttcttggaatggaggcagccggttccgcaggcggtgtcgtcgaggctgccatctcctataccggagatgtagctgatcctagcaggacaaaatattccttgcagtactacatggggctggctgaagaattagtgcgcgccggaactcatatactctgtattaaggacatggccggactcctgaagcctacagcttgtacaatgctcgtgagcagccttcgggatcgttttcccgatctccccctccacatccacacacatgacacatctggggcaggtgtagccgccatgctcgcttgcgcccaagctggagctgatgtggtggatgtggccgcggattctatgtccggaatgacatcccagccgagtatgggcgcactcgtcgcatgtacacggggaaccccgctggacaccgaggtgccaatggaaagggtgtttgactatagtgaatactgggagggagctcgaggcctgtacgccgccttcgattgcacggctactatgaaatcaggcaatagcgacgtttatgagaacgagatacccggtggtcaatatactaacctacatttccaggcccacagcatgggcctgggctccaagtttaaggaggtcaagaaagcttacgtcgaagctaatcagatgttgggggatcttataaaggtgacaccatcttcaaaaatagtgggagatcttgcacagttcatggtccagaacgggctctcacgggccgaggcggaggcgcaggctgaagagttgagcttccccaggtccgtggtggagtttttgcagggttacatcggcgtcccccatggggggttcccggagccctttcgtagcaaagtcttaaaagatctgccgagagtggagggccgcccgggggcgagcctacctccactggaccttcaggctctagaaaaagagttggttgacaggcatggggaagaggtaacccctgaagatgttctgagtgcagctatgtacccagacgttttcgcccatttcaaagacttcactgctacatttggacctctcgacagtctcaacacgaggttgttcctccagggacccaaaatcgccgaagagtttgaggtcgagttggagcgcgggaaaacactgcatattaaagctttggccgtttcagatttgaatcgggctggccagcgacaagtgttctttgagctgaatggacagctgcgttccatattagttaaggacacccaggccatgaaagaaatgcactttcaccccaaggcccttaaagacgtcaaaggccagataggagctcctatgcccgggaaggttatcgatatcaaagtagttgcaggcgctaaggtagccaagggacagcctctgtgtgtcctaagcgccatgaaaatggagactgtcgttaccagcccgatggagggcactgtccgcaaagtacacgtcaccaaggatatgacgctagagggtgacgacctgattctggaaatcgagtag

SEQ ID NO: 202150 - DNA, 615 bp, Artificial Sequence
  Description of Artificial Sequence: Synthetic coding sequence
atgcggaagatgctggccgccgtgagccgggtgctgagcggcgcctcgcagaaacccgcatctcgggttctcgtcgcttccaggaacttcgcaaacgacgccaccttcgagatcaagaagtgtgacctccaccgtttggaggagggccctcctgtgacaaccgtcttaacaagagaagacggactgaagtattacaggatgatgcagactgtgcgcagaatggaactcaaggcagatcagctgtacaaacaaaagatcattcgcggattttgtcacctgtgcgatggccagtttctcctgcccctgactcaggaagcctgttgcgtgggcctggaagctgggatcaaccccacagaccacttgataaccgcctaccgcgcccacgggtttacgttcactagaggtctgagtgtgcgggaaatactggccgagctgacgggcaggaagggaggatgtgcgaaaggcaagggcgggtccatgcatatgtatgcaaaaaatttttacggtggcaacggaatagtgggcgcacaggtgccactgggcgccgggatcgccctggcttgcaagtacaacggtaaggacgaagtgtgcctcaccttatacggcgatggttag

SEQ ID NO: 202151 - DNA, 330 bp, Artificial Sequence
  Description of Artificial Sequence: Synthetic coding sequence
atggagctgcagacctaccggtaccacggccacagcatgagcgaccctggggtgagttaccgcacccgcgaagaaatccaggaagtccgctcgaagtcggacccgattatgcttttaaaggatcggatggtgaactccaatctcgcttctgttgaggagctgaaggagatcgacgttgaggttcggaaggaaattgaggatgctgcacagtttgcaacagcagatccggagcctcccttagaagagcttggctaccatatatactcttctgaccctccatttgaggtacgaggtgccaatcagtggatcaagttcaagtctgtctcttag

SEQ ID NO: 202152 - DNA, 543 bp, Artificial Sequence
  Description of Artificial Sequence: Synthetic coding sequence
atgcggaagatgctggccgccgtgagccgggtgctgagcggcgcctcccagaaacccgcctcgcgagtcttggtggcttcaagaaactttgctaacgatgccacctttgagattaaaaagtgcgacctgcacagactggaggaggggcccccggtgacaacagtgttgacacgagaggatggactcaaatactatcgaatgatgcagacagttcgccgaatggagctcaaggccgaccaattgtacaagcagaaaataataagaggcttctgccacctgtgtgatggccaggaggcgtgctgtgtcggactcgaagccggcatcaatccgactgaccatctgatcacagcatatagagcccatggcttcacatttacaagaggcctgagtgtgcgcgagattctggccgaacttacaggtcgaaaaggcggctgtgccaaaggcaagggcggcagcatgcacatgtacgctaaaaatttctatggtgggaatggcattgtgggggctcaggttgtgaaagatgaggattgcgtgctcctttag

SEQ ID NO: 202153 - DNA, 1287 bp, Artificial Sequence
  Description of Artificial Sequence: Synthetic coding sequence
atgcggaagatgctggccgccgtgagccgggtgctgagcggcgccagccaaaagcccagacatggacttgcaactctgccttccctagtgagcatctccagattgaagcagagtagtcacctgggactaccgaaatgctgggactacagccacagtctgaagacacggcaggcatcgagagttcttgtggccagtaggaattttgcaaatgacgctactttcgagatcaagaagtgcgacttgcatcgccttgaggaaggtcctccagtgaccacggtgctgaccagagaggatgggctgaagtattaccgaatgatgcagacagtgcgacggatggaactgaaagctgatcagctatacaagcaaaaaatcatccggggcttctgccatctatgcgacggacaagaggcatgctgcgtgggactggaagccggtattaaccccacagaccacctcatcactgcctatcgggcgcacggatttacctttacacgaggcttgtccgtgcgcgagatcttggcagagcttaccggtaggaaaggtgggtgcgcgaagggtaaaggcgggagcatgcacatgtacgccaagaatttttacggcggtaacggcatcgtgggcgctcaggtccccctgggcgcgggaatcgctctggcatgtaaatacaatgggaaagacgaggtgtgtcttacgctctacggcgacggtgctgccaatcaggggcagatctttgaagcatataatatggccgccctgtggaagctgccgtgcatatttatatgcgagaataaccgatacggaatgggtacgagtgtagagcgagccgctgcatcaactgattattacaaaaggggggacttcattcctggactccgcgttgatggaatggacatcctctgtgttagggaggccaccagattcgcggctgcttattgtaggtcgggcaagggccctatactgatggagctccagacataccggtaccacgggcattcgatgtcagatccgggggtgtcatacaggacgagggaggaaatacaggaagtgcgctccaagtctgatcctattatgctcttgaaagacaggatggtcaatagcaacctggcctccgtcgaagaactgaaagagatcgacgtcgaggtgagaaaagagattgaggatgctgcacagtttgcaaccgccgacccagagcctccgctagaggagttaggctaccacatctatagctccgacccccccttcgaggtgcgaggagccaaccaatggatcaaattcaagtccgtaagctag

SEQ ID NO: 202154 - DNA, 366 bp, Artificial Sequence
  Description of Artificial Sequence: Synthetic coding sequence
atgcggaagatgctggccgccgtgagccgggtgctgagcggcgccagtcagaagccttttgcgggatcaccacccccacggcacttaaccgtgggccgcaagctgtccagtcggtacgaagtgaccttcgaatcggctcaggcctcccgagtgttggtggccagtcgcaattttgccaacgatgctacgtttgagataaagaagtgcgacctgcatcgcctcgaggaggggcctccggtgacgacagtgctaaccagagaggacgggcttaagtactaccgcatgatgcagacagtgcgacgcatggaactgaaggccgatcagctttataagcagaaaataattcgcggcttttgtcacctgtag

SEQ ID NO: 202155 - DNA, 366 bp, Artificial Sequence
  Description of Artificial Sequence: Synthetic coding sequence
atgcggaagatgctggccgccgtgagccgggtgctgagcggcgcctcacagaaaccgtttgctggaagtccccctcccagacatctcacagtcggaaggaagctttcctcccgttacgaagtgaccttcgagtcagcacaagcctctcgcgtgctagttgcctctcgcaatttcgcaaacgatgcgacgttcgaaatcaagaagtgcgacctgcaccggctggaggaaggaccgccagtgacaacagtactcactcgagaggatggattgaagtattatcgcatgatgcagaccgtacgccgtatggaactgaaggcagatcagttgtataaacagaaaatcattagggggttctgtcacctctag

SEQ ID NO: 202156 - DNA, 1173 bp, Artificial Sequence
  Description of Artificial Sequence: Synthetic coding sequence
atgcggaagatgctggccgccgtgagccgggtgctgagcggcgccagccaaaagccagcctctcgcgtcttagtagcttcacggaatttcgccaacgatgccacgtttgagatcaagaaatgcgatttacacaggctggaagaaggcccgccagttactactgttctgaccagagaggacgggctgaagtattacagaatgatgcagacagtccgtcggatggagttaaaggccgatcagctctataagcagaaaattattcggggtttttgccatttgtgcgacggacaagaagcttgctgtgtcggccttgaggctggaatcaaccctaccgaccatctcattacagcctatcgtgcccacgggtttacattcacgcggggcctttctgtgcgggaaatcttggccgagcttacagggaggaaggggggctgcgcaaaaggaaagggcgggagcatgcacatgtatgccaaaaacttttatgggggcaacggtatcgtcggtgctcaggtgccactgggcgcaggcatcgctttggcctgtaagtacaacggtaaagatgaggtctgtctaaccctgtatggagacggagccgcaaaccagggtcagattttcgaagcctataatatggccgctctgtggaaattgccttgcattttcatatgtgaaaacaaccggtacgggatgggaacctccgtcgagcgtgcagctgccagtactgattactacaagagaggagacttcatccccggccttcgtgttgacgggatggacatactgtgtgttcgggaagcaacacgttttgcagctgcgtactgcagatccgggaagggccctatattgatggaactccagacctacagatatcacggacactctatgtcagacccaggtgtctcctacagaacccgcgaggagatccaggaggttcgatcgaagagcgacccaatcatgctgctcaaggacagaatggtgaactccaacctggcaagcgtggaggaactcaaggagatagatgtcgaagtgcgaaaagaaattgaggatgcagctcagttcgcaaccgccgatccagagcctcccttagaggaattgggctatcatatctatagcagcgaccctccttttgaggtgagaggggccaatcagtggatcaagtttaagagcgtttcatag

SEQ ID NO: 202157 - DNA, 618 bp, Artificial Sequence
  Description of Artificial Sequence: Synthetic coding sequence
atgcggaagatgctggccgccgtgagccgggtgctgagcggcgcctctcagaagccaaggcacgggctggccacactgccttctctcgtgagtattagtcggctgaagcaatcttcccatctgggcctgccaaagtgctgggattactctcacagcttgaaaacgaggcaggccagccgcgtgcttgtggcttcaagaaacttcgcgaacgacgccacatttgaaataaagaaatgtgacttgcatagactggaggaaggcccgcctgtgaccaccgttttaacccgggaagacggtctgaagtactaccgtatgatgcagaccgttagacggatggaactgaaagcagatcagctgtacaagcagaaaataattcgaggtttttgccatctctgcgatggccaggaggcctgctgcgtcggactggaggcagggatcaacccgacagatcatctcatcacagcttatcgcgcccacggatttactttcactcggggcctcagcgtgagggaaatcctggccgagttgacaggtcgcaaaggtggatgcgcgaaagggaaaggcggatcaatgcacatgtacgcaaagaacttctatggggggaacgggatagtctag

SEQ ID NO: 202158 - DNA, 1080 bp, Artificial Sequence
  Description of Artificial Sequence: Synthetic coding sequence
atgcggaagatgctggccgccgtgagccgggtgctgagcggcgcctcacaaaagccagcaagccgcgtactggtggcaagcagaaacttcgccaacgacgccactttcgaaatcaaaaagtgtgacctccatcgcctcgaggaagggccccccgtgactaccgtccttactcgcgaagatggtctgaaatattatcggatgatgcagaccgttcggcgaatggagctcaaggcagaccaattatacaaacagaagattatccgaggcttctgccacttgtgcgacgggcaggaagcctgttgtgtgggcctggaagctgggatcaatcctacagaccacctgataacagcctatagggcgcacggctttacctttacaagaggcctgagcgtgagagaaattttagctgagctgaccggtcgcaaagggggttgtgctaagggaaaggggggttccatgcatatgtatgcaaaaaatttttacggcgggaatggaattgtgggagctcaagggcagatcttcgaggcatacaacatggcagcactgtggaagttgccgtgcattttcatttgtgagaacaacaggtatggcatgggcacctctgtggagcgcgctgctgccagcactgactattacaaacgcggagactttatcccaggattgcgtgttgacggaatggatatcctgtgcgtgcgggaggcaacacggttcgcggctgcatactgcagatcaggtaaagggccgatcctgatggaattgcagacttatcgttaccatggtcatagcatgagcgaccctggggtcagctataggaccagggaagagatccaagaagtgcgatctaagagcgatccaatcatgctgttgaaggataggatggtaaatagcaacctagcctccgtcgaagaactgaaggagatcgatgttgaggtccggaaagaaatcgaagacgccgcacagttcgctactgccgaccctgagcccccgttggaggaattggggtaccacatctattcatctgaccccccattcgaggtgcgtggtgccaaccaatggatcaaatttaagtctgtctcttag

SEQ ID NO: 202159 - DNA, 129 bp, Artificial Sequence
  Description of Artificial Sequence: Synthetic coding sequence
gccaaccagtggatcaagttcaagagcgtgaagggccggcggcggcgaggatatactttcaggggactgcctgattcagtgttgaatctcgtgaaagaggaggaaaacccagttaacgagatacagtag

SEQ ID NO: 202160 - DNA, 1194 bp, Artificial Sequence
  Description of Artificial Sequence: Synthetic coding sequence
atgcggaagatgctggccgccgtgagccgggtgctgagcggcgcctcccagaagccggcttccagagtgttggtggccagtaggaatttcgccaacgatgctacatttgaaattaaaaaatgcgatttacatagactagaagaaggaccgcctgtgaccaccgtgctaaccagagaggacggcctcaagtactatcgcatgatgcagacagtgagaaggatggagctcaaggctgatcagctgtataagcagaagataattaggggattctgtcatctctgcgacggtcagttcctccttcccctgactcaggaggcttgttgcgtgggccttgaagcgggcatcaatccaacagatcatctaatcacagcttatcgagcacacggcttcacgttcacaaggggcctatctgttagagaaatattagcggagctgacaggtaggaagggaggctgtgccaagggaaaaggtggctcgatgcatatgtatgcaaaaaacttttacggcggtaacggaatcgttggagcccaggtccctctgggggctgggatagctctggcctgcaaatacaacggcaaagatgaagtgtgcctgacactgtatggcgacggcgccgctaaccagggccagatatttgaggcctacaatatggccgctctgtggaagcttccctgcatcttcatttgtgagaacaacagatacggaatgggaacctcagttgagagggcagccgcttccaccgattattacaagcgtggagacttcatcccaggccttagagtcgacggaatggacatactgtgcgtgagggaagcaactaggttcgccgccgcgtactgtcgatcaggaaaaggacctattctgatggagctccagacctataggtatcacggccatagtatgtccgaccccggcgtgtcttatcggactcgtgaggaaatccaagaagttcgttcaaagtccgaccctattatgcttcttaaggatagaatggtgaatagtaatctggcaagcgtcgaagagctcaaagagattgatgttgaggtgcgcaaagagattgaggatgcggcacagtttgccacagcggatccagaaccgccgttagaggaattgggctatcacatctacagtagtgatcctcctttcgaggtccgtggtgcaaatcagtggatcaagttcaaaagcgtcagctag

SEQ ID NO: 202161 - DNA, 1167 bp, Artificial Sequence
  Description of Artificial Sequence: Synthetic coding sequence
atgctggccgccttcatcagccgggtgctgcggcgggtggcccagaagtccgcccgccgcgtcctcgttgccagccggaattccagtaatgatgcgacattcgagatcaaaaaatgcgacctttatcttttggaggaagggcctccagtgacaaccgtcctgactcgggctgaagggcttaagtactacagaatgatgctgactgtgaggagaatggaattaaaagctgaccaattgtataaacagaagtttataagaggattctgtcacctctgcgatggccaagaagcctgctgcgtaggcctggaagctggtattaatccgtccgatcatgttataacaagctacagggctcacggcgtgtgctatactagagggttatccgtaaggagcattctggccgaactgaccggtcgacggggcggctgtgcaaagggaaaaggcggaagtatgcacatgtacaccaagaacttctacgggggaaacggaattgtcggagcccagggaccactgggcgctggaatcgcgctggcttgcaagtacaagggcaatgacgaaatctgcctgaccctctacggtgatggagctgccaatcagggccagatcgccgaagcatttaacatggccgcactgtggaagttgccatgcgtcttcatttgtgagaacaacttgtacggaatgggtacaagtacagagcgcgctgcagcaagcccagactattacaagcggggtaacttcatccccggactgaaagtcgatggaatggatgtcttatgcgttcgggaggccaccaagttcgctgccaactactgcaggtctgggaagggaccaatattaatggaactccagacataccgctatcatggccactcaatgtctgaccctggtgtctcctacaggactcgggaggagatccaggaagtaaggagtaaacgcgaccctatcattatactccaggaccgtatggtaaattcaaaactcgctaccgtggaagagcttaaggagatcggagccgaggttcgtaaggagatcgatgatgcagcgcagtttgccacgacggaccctgaaccccatcttgaggagctgggccaccatatatactcttccgattcatctttcgaagtgcgcggtgctaacccgtggatcaagtttaaatctgtatcttag

SEQ ID NO: 202162 - DNA, 1080 bp, Artificial Sequence
  Description of Artificial Sequence: Synthetic coding sequence
atggccgccgtgagcggcctggtgcggcggcccctgcgggaggtgtctgggctgctcaaacgaagatttcactggaccgcaccagctgctctgcaggtgacagtccgcgatgcaatcaaccaaggcatggatgaagagttagaaagggacgaaaaggtattcctcctgggagaggaggtggctcagtacgacggtgcttacaaggtctccagaggcttgtggaagaagtatggtgacaagagaataatcgacacgcctatctcagagatgggtttcgccggcattgccgttggggctgctatggccgggctccgacccatttgtgagtttatgacctttaacttcagcatgcaagctattgatcaggtgatcaattcagccgcgaaaacttactacatgtccgggggcctgcaacctgtgccaattgtgttccgtggccctaacggagcatctgcgggcgtggctgcacagcattctcagtgctttgcagcttggtacggacactgccctggactgaaggtggtgagcccttggaacagtgaagacgccaagggcctgattaaaagtgccatacgagacaacaaccctgtggttgtgttagagaacgagttaatgtacggcgtgccatttgaatttcccccggaagctcagagtaaggacttcctgattccaattggaaaggccaaaattgagcggcagggaactcacattaccgtggtgagccacagcaggccagtaggacactgcttggaagctgctgctgtgctgtcgaaagaaggcgtggagtgcgaggtaataaatatgagaactatccgtcctatggacatggagacaatcgaagctagcgtaatgaagacaaatcaccttgtgactgtcgaggggggctggccccagtttggcgttggggcggagatctgcgcccgaataatggaggggccagcctttaactttttggacgctccggccgtgcgcgtgactggagcagacgttcccatgccttacgcaaaaatcctcgaggacaactctatcccacaagtcaaggatataattttcgctattaagaagacgctcaacatttag

SEQ ID NO: 202163 - DNA, 1026 bp, Artificial Sequence
  Description of Artificial Sequence: Synthetic coding sequence
atggccgccgtgagcggcctggtgcggcggcccctgcgggaggtgaccgtgagggacgccatcaaccaggggatggatgaagaactggagagagatgaaaaagtgtttctgctgggggaggaagttgcacagtacgacggcgcctataaagtctcacgaggtttatggaaaaaatacggagacaagaggatcatagatactccgatatctgagatgggattcgcagggatagcagtcggcgctgccatggctggcctccgacccatatgcgagttcatgacctttaacttcagcatgcaggccatcgaccaggtgatcaacagcgccgctaaaacctattacatgtctgggggcctgcagcccgtgcccattgtttttagagggccaaacggagcctctgcaggggtggctgcccagcattctcagtgcttcgccgcctggtatgggcattgtcctggactcaaggttgtttccccatggaatagtgaagacgccaagggcctgataaagtcagccatccgagataataacccagtcgtcgtcctggaaaatgagttaatgtacggagtcccatttgagttcccccctgaggctcagagtaaggatttcctgattcccatcggaaaggccaaaattgagagacagggcacgcatattaccgtggtgtctcatagcagaccagtaggacattgtctcgaggcagctgcagtgctgtccaaagagggtgtagaatgtgaggtgattaatatgcggaccattcgacctatggacatggagaccatcgaggcttctgtcatgaagactaaccatctagtgacagttgaagggggctggcctcagtttggggtgggtgcagaaatctgtgcccgaattatggaagggcctgcatttaatttcctcgacgctcccgccgttagggtgaccggggctgatgtaccaatgccctatgcgaaaatactcgaggacaactctattccccaggtgaaggacatcatatttgctattaagaaaaccctaaatatatag

SEQ ID NO: 202164 - DNA, 1026 bp, Artificial Sequence
  Description of Artificial Sequence: Synthetic coding sequence
atggccgccgtgagcggcctggtgcggcggcccctgcgggaggtgagcggcttgctgaagcgacgttttcactggacggcccccgctgctttgcaggttaccgtccgggacgctattaatcaagggatggatgaagaactcgagcgcgacgaaaaggtgtttctgctcggggaagaagtggcacagtatgatggggcctacaaggtatcaagaggcctgtggaagaagtacggcgataaaagaattatcgacacgcctattagtgaaatggggttcgccggtattgccgtgggagctgcaatggcaggtctgagacctatctgtgaatttatgaccttcaacttctcaatgcaggcgattgaccaggtgatcaattcagccgcgaagacatattacatgtctggagtggctgcgcagcactctcagtgcttcgccgcctggtatgggcattgtccaggtctcaaggttgtgagtccatggaactctgaggacgccaaagggctgattaagagcgctataagagataataatcccgtagtcgttctcgagaatgagctgatgtatggggtgccatttgagttcccccctgaggcacagtccaaggactttctcatccccatagggaaggcaaagatcgaacgacagggcactcatatcacggtggtgtcccattccaggcctgtcggacattgtttggaagctgctgcagtcctgtctaaagaaggagtcgaatgcgaagtgataaatatgaggactatccggccaatggatatggagactattgaggcatcggtcatgaaaacaaaccacctcgttacagtggaaggcggttggcctcagtttggcgtgggagctgagatatgcgctagaataatggaaggtccagctttcaacttcctcgatgccccagctgtgagagtgactggagctgatgtaccgatgccctatgcaaagattctcgaagataacagcatcccccaagtcaaagatataatttttgccatcaaaaagacactgaatatttag

SEQ ID NO: 202165 - DNA, 1236 bp, Artificial Sequence
  Description of Artificial Sequence: Synthetic coding sequence
atgaaggccgcccggttcgtgctgcggagcgccggcagcctgaacggggctgggctggttcctcgcgaggtggaacatttcagtagatacagcccttctccactgtcaatgaagcagctcctggattttggctccgaaaacgcatgcgaacgtacatcattcgcctttctgaggcaggagctccccgtgaggttagctaacatccttaaggagatcgacatcctcccgacacagctggtgaatacgtccagcgtgcagctcgtaaaatcctggtatatccagtcactcatggaccttgttgaattccacgagaaaagtcctgacgaccagaaggcgttgtcagacttcgtcgatacgctgattaaagtccggaacagacatcataatgttgtgccaacaatggcccaggggattatcgaatacaaagacgcctgtactgtggacccagtgacaaaccaaaatttgcagtatttcctggatagattctatatgaacaggatcagtacacgcatgctgatgaaccagcacattctcatcttttctgattcccagacaggcaacccttcacacattggctccatcgaccctaactgcgacgttgtggcagttgtacaggacgccttcgaatgtagtcggatgttatgcgaccagtattatttgtcctcccccgagctcaagctgacacaggtgaatggcaagttccccgatcagcccatccacatcgtgtacgtccctagtcacctgcaccacatgctgttcgagctgttcaagaacgccatgagagctactgtggaacaccaggaaaaccagccatctttgacaccaattgaggtcatcgtagtcctggggaaagaggatttaacgatcaaaatctccgataggggcggcggggtacctctaagaatcattgatcggttattcagctatacctacagcaccgccccaaccccagtgatggataactcccgaaatgctcctctcgccggctttggttacgggcttccgatttcacggttatacgccaaatattttcagggtgatctgaacctctactctctatccggatacggcactgacgcaatcatttatttgaaggcactgtccagtgaaagtatcgagaaactacctgtttttaacaaatccgcgtttaagcactatcagatgagcagcgaagccgacgattggtgcatcccctcaagagaaccaaaaaacctggccaaagaagtagcaatgtag

SEQ ID NO: 202166 - DNA, 1128 bp, Artificial Sequence
  Description of Artificial Sequence: Synthetic coding sequence
atgaagcagctgctggacttcggcagcgagaacgcctgcgagcggacatccttcgccttcctgcgccaagagctcccagtccgcctcgctaacatcctgaaggagatcgatatcctcccaactcaactggtgaacacttcaagcgtgcaattggtgaaaagttggtatattcagagtctaatggacctggttgaattccacgagaagtctcctgacgaccagaaggccctgtccgattttgtcgacaccttaatcaaagtgcggaaccggcaccacaatgtggtgccaactatggctcaaggcatcatagagtacaaagatgcctgcactgtcgaccccgtcactaatcagaatttgcagtactttctggacagattctacatgaatcgcatctctacccgcatgcttatgaaccaacatatactcatctttagtgacagtcagaccgggaatccttctcacattggttctatcgatccaaactgcgacgtcgtagccgtggtacaggacgcgtttgaatgctcacgaatgctgtgcgatcagtattatctatccagtccagagctgaaattaactcaagtgaatgggaaatttcccgatcagccgatccacattgtgtatgtgccctctcacctacaccacatgctattcgaactgttcaagaacgccatgcgggctaccgtcgagcaccaagagaatcaaccgtccctgaccccgatcgaggtgatcgttgtgctgggcaaggaggacctcacaattaagatctcggatcggggtggcggggttcctcttcgcattatcgatcgactcttctcctacacatattctaccgcccccaccccggtgatggataactcacgcaatgctcctctagcgggattcggttatgggctgcctatttcaagactgtacgcaaaatactttcagggagatctgaacctgtacagcctgagcggttacggcacagacgctatcatttacttgaaagcccttagcagcgagagtatcgagaagctgccggtgttcaataaatcagccttcaaacactaccagatgagctctgaggctgatgactggtgcatccctagccgagaacccaagaacctggccaaagaggttgcaatgtag

SEQ ID NO: 202167 - DNA, 1614 bp, Artificial Sequence
  Description of Artificial Sequence: Synthetic coding sequence
atgcccgcccccacccagctgttcttccccctgatccggaactgcgaactctctagaatctatggcaccgcctgctactgccatcacaagcacctctgctgttccagctcctacatccctcaatcgcgcctgaggtacaccccacatcccgcttacgctactttttgtcgcccaaaggagaactggtggcagtatacacaggggagacgttacgcttcgactcctcagaaattttatttgaccccacctcaggtaaacagtatcttgaaagcaaatgagtattccttcaaggtgcccgagttcgatggcaagaatgttagcagtattctgggtttcgattccaaccagctgcctgctaacgcccctatagaggatagacggagcgcagcaacttgtctgcagacaaggggcatgctgctaggggtatttgatgggcacgctgggtgcgcgtgttcacaggccgtgagtgaacggctgttctactatatcgccgtgagcctgctgcctcacgagacactcctggagatcgagaacgccgttgaatccggccgcgccctgctcccgatcctacaatggcacaagcaccccaacgactacttctccaaagaggccagtaaactgtactttaatagcttacgtacctactggcaggagctgatcgaccttaataccggcgagtcaacagacatagacgtcaaggaggctctgatcaacgcgtttaaaagactagataacgatatcagtcttgaggctcaggtgggcgatccgaactcgtttctcaattatctagtcttaagggtggccttttcaggagccacagcctgtgttgcacacgtggatggcgtagatcttcacgtcgctaacaccggggactcacgcgccatgctgggggtgcaggaagaggacggcagctggagcgctgtgaccctgtccaatgaccataatgcacaaaacgaacgcgagctggagcgactcaagctggagcatccaaagagcgaggctaaatctgtggtgaagcaggatcggctgctcggcctgctgatgccattccgcgcattcggggacgtcaaattcaagtggagtattgatctccagaagagagtgatcgagagtggccctgaccaactaaacgacaacgaatataccaagtttatcccccccaactatcacacgcccccgtatttgacagcggagcccgaggttacttatcaccggctacgcccacaggacaaatttctcgttttagccactgacggcttatgggagaccatgcaccggcaggacgtcgtaaggattgttggcgagtacttaactggaatgcaccatcaacagcccatcgccgtgggtggctacaaggtgactctagggcaaatgcacggactgctgacagagagaaggactaagatgagcagcgtattcgaagatcagaatgctgcaacacatttgatcaggcatgccgttgggaacaatgagttcggaaccgtggaccacgagagactttccaagatgttaagccttcctgaggaactggcccggatgtaccgagacgatattacaattattgtggtccagtttaacagtcatgtggtaggtgcctaccaaaatcaggaatag

SEQ ID NO: 202168 - DNA, 1689 bp, Artificial Sequence
  Description of Artificial Sequence: Synthetic coding sequence
atgtgcgtgtgccccggcccccggcggatcggcatccccgtgcggagctccagtctcccattgttctccgacgccatgcctgcccccacacaactcttttttcccctgatccgaaattgcgaattgtctcgaatttacggaactgcctgctattgccatcataagcatctctgctgttcctccagttacattcctcaaagccggttgcggtacacacctcaccccgcatacgccactttttgtagaccaaaggagaactggtggcaatatacccagggacggcgatacgccagtactccccagaagttttacctgacccccccgcaggttaactccattctgaaagccaatgaatacagctttaaagtacccgagtttgatggcaagaacgtcagctctatactgggatttgatagtaatcagctccccgcaaacgctcctattgaagaccgacgctccgccgccacctgccttcaaacccgtggaatgctcctgggcgtcttcgacggacacgctgggtgcgcttgctcacaggccgttagcgaaagactgttttattacattgccgtctccttgttgcctcacgagacgcttctggagattgaaaatgccgtcgagagcgggcgggccctgctcccaatcttacagtggcacaaacatccaaacgactacttttccaaggaggcctccaaactctattttaattctctgagaacgtattggcaagagctgatagacctcaacacaggggagtctactgacatcgatgtgaaggaggctttaattaacgcttttaaacgcttagacaatgatataagcctcgaagcccaggtgggtgatccaaattcctttctgaattacctggtcctgcgcgtggccttctctggcgccactgcttgcgtagcacacgttgatggggtggatctacatgtggcgaatacaggggatagccgggctatgctgggggttcaggaagaagatgggagctggtctgctgtgaccctctccaacgaccacaacgctcaaaacgaacgcgagctggagcgccttaaactggagcaccctaaatctgaggctaaatcagtcgttaagcaggatcgcctcttgggcctcctcatgccgtttcgggcattcggggacgtcaagtttaaatggtcgatagacctccagaagagggtcatcgagagcggccctgaccagctcaacgacaatgagtataccaagtttatacctcctaactatcacaccccgccctatttgaccgccgaacccgaagtgacttaccatcggctgcgcccccaggacaaatttctagtccttgctactgatggtctttgggaaacaatgcacaggcaagacgttgtgagaattgtcggagagtacctgacaggtatgcatcatcaacagcccatagccgtagggggttacaaggtgaccttaggccagatgcacggcctgctgaccgagagacgaacaaaaatgagcagtgtgtttgaggaccagaacgcagctacacaccttatccgccacgcagtaggcaacaatgagttcgggaccgtcgatcatgaaaggcttagtaagatgttatcacttcccgaagagctagctcggatgtaccgggatgatataactatcatagttgtccagtttaatagtcatgtcgtgggcgcgtatcagaatcaagagtag

SEQ ID NO: 202169 - DNA, 1614 bp, Artificial Sequence
  Description of Artificial Sequence: Synthetic coding sequence
atgcccgcccccacccagctgttcttccccctgatccggaactgcgagctttctcgcatttatggcacggcttgttactgccaccataagcatctgtgctgttctagtagttatatcccccagtcaaggctgcgctataccccacacccagcatacgccacattttgcaggccaaaggaaaactggtggcagtacacccagggcagacggtacgcaagtacaccccaaaagttttatcttacacctccacaggtgaatagtattctaaaggcaaatgaatattccttcaaggtgccagaatttgacggaaaaaacgtgtcttcaatcctaggcttcgattcaaatcaactaccagctaatgcgcccatcgaagataggcggagtgccgccacctgcctgcaaaccaggggaatgcttcttggtgtgttcgacgggcatgcaggatgcgcttgttcccaggccgtttctgaaaggcttttttactacattgcggtttcactgctgccacatgagaccttgctggagatcgagaacgctgtggaatctggccgtgcattgctgcccatcctgcagtggcacaaacatcccaacgattatttcagtaaggaagcttcaaaactgtactttaattctctcagaacgtattggcaggagctgatagacctgaatactggagagtctactgacatagacgtaaaggaggctttaattaacgcctttaaaaggttagacaacgacatttcgcttgaggcccaggtgggggatccaaatagcttcctcaattatctggtccttcgagtggcattctcgggagctacggcctgcgtggctcacgtggacggcgtcgatcttcacgtggccaacacgggagactcaagggctatgttgggggtgcaagaggaagatggatcttggagtgccgtaacacttagtaacgatcacaacgctcagaatgagagggaactagaacgattaaagctggaacatcccaagtccgaagctaagagtgtggtcaagcaggaccggctgctgggcttactgatgccattccgggccttcggagatgtgaagttcaaatggagcattgatctccagaagagggtaatcgagagtggacccgaccaattaaacgacaacgaatacactaaatttattcctcctaactaccatactcccccttatctgaccgccgaaccagaggttacataccacagacttcggccccaggataagttcctggtgctggctaccgacgggctttgggagacaatgcacagacaggatgtggtgagaatcgtgggagagtatctcactggtatgcaccatcagcaacctatcgccgtggggggctataaagttaccctggggcagatgcacggccttctcactgaaaggagaactaaaatgtcttctgtgttcgaagaccagaatgccgccacacacctgatcagacatgcggtggggaataatgagttcggcactgtcgaccacgaacgcttgtctaaaatgctgtcactccccgaggaacttgcacggatgtacagggatgacatcaccatcatagtcgtgcagttcaatagtcatgtggtcggcgcttatcaaaatcaggaatag

SEQ ID NO: 202170 - DNA, 231 bp, Artificial Sequence
  Description of Artificial Sequence: Synthetic coding sequence
atgcccgcccccacccagctgttcttccccctgatccggaactgcgaactttctagaatttacggtactgcctgctactgtcaccataaacacctgtgttgctcaagttcttacattccccagagcaggctgcgatacactccccatccggcctacgccaccttctgtcggcctaaagagaattggtggcagtacacacagggacggcggtatgcctcaaccccccaatag

SEQ ID NO: 202171 - DNA, 387 bp, Artificial Sequence
  Description of Artificial Sequence: Synthetic coding sequence
atgcccgcccccacccagctgttcttccccctgatccggaactgcgagctctcacgaatatatgggaccgcgtgttattgtcaccacaaacacctgtgttgttctagttcatatattcctcagagccgtctgcggtacacccctcacccggcttatgctactttttgccgacctaaagagaattggtggcagtacacacaaggaaggcgatacgcgagcaccccacaaaagttctatctgacaccacctcaggtcaactccatcctgaaggcaaatgagtattcatttaaagttccagaattcgatggtaagaacgtatcatcgatactgggtttcgacagtaaccagcttcctgccaacgcccccattgaagatagacgttcctag

SEQ ID NO: 202172 - DNA, 699 bp, Artificial Sequence
  Description of Artificial Sequence: Synthetic coding sequence
atgcccgcccccacccagctgttcttccccctgatccggaactgcgaactctcacgtatctatgggaccgcatgctactgtcatcacaagcacctgtgttgtagtagcagctacattcctcagagtcggctgagatacacacctcacccagcctacgccacattctgtaggccaaaagaaaactggtggcagtacactcagggacggcgatatgcaagtactccccagaaattctacctgaccccccctcaagttaactctatcctgaaagccaacgaatacagctttaaagtgcccgagttcgatggcaaaaatgtctctagcatactgggcttcgatagcaaccagctgcctgctaatgcgcccatcgaagaccggcgcagtgccgccacgtgtctgcagacacgcgggatgctcttgggagttttcgacggtcacgctggttgcgcttgctcacaagctgtgagcgaacgacttttctattatatagccgtgtcactcctcccacatgaaacactgctcgaaatcgagaatgcagtggagagtggacgcgctcttcttccaatcctgcagtggcacaaacacccaaacgactactttagtaaggaggcttctaagttgtattttaacagcttgaggacgtactggcaggaattgatcgacttgaataccggcgagagtactgatattgacgtttag

SEQ ID NO: 202173 - DNA, 219 bp, Artificial Sequence
  Description of Artificial Sequence: Synthetic coding sequence
atgcccgcccccacccagctgttcttccccctgatccggaactgcgaactgtcccggatttacgggacagcatgctattgtcatcataagcatttgtgctgcagctcttcatatataccccaaagccggctgaggtacacacctcacccggcctatgccaccttctgccgcccgaaggaaaactggtggcagtacactcagggacgcaggtacgcatag

SEQ ID NO: 202174 - DNA, 1614 bp, Artificial Sequence
  Description of Artificial Sequence: Synthetic coding sequence
atgcccgcccccacccagctgttcttccccctgatccggaactgcgagctgagccgcatatacggaacagcgtgctactgtcatcacaaacacctgtgttgtagctcctcctacattccacaatcaaggctccgatacactccccaccctgcatatgcaaccttctgtcggccaaaggagaactggtggcagtacactcagggcaggagatacgccagcacacctcaaaagttctacctgacgccaccccaagtgaactccatactgaaggccaatgagtacagcttcaaagttcccgaatttgatgggaaaaatgtttcgtctattctgggttttgactccaaccagctgccagcaaatgctccaattgaagatcgccggagtgctgccacctgtcttcagacccgcgggatgttactcggcgtgtttgacggtcacgccggctgcgcctgttcccaagcagtctcagaacggcttttctactatattgctgtcagcctacttccacacgagacacttttggagattgagaacgccgtcgagtccggacgggcactcctgccaattctgcagtggcacaaacaccctaatgattacttcagcaaggaagcctcgaagctgtactttaattctctccgaacctattggcaggagctgattgacctcaacactggggagtccaccgacattgatgtgaaagaggctctcatcaacgcattcaagcgtttagacaacgacatctccttagaggcacaggttggcgatcctaactcctttctcaattatttagtgctgcgagttgcattcagcggtgcaaccgcctgcgtggcccatgtggacggggtcgatctacacgtagcaaacactggcgacagcagggcaatgttaggagtgcaagaagaggatggcagctggagcgccgtcacactttccaatgaccataatgcccaaaatgaaagagagctggaacgcctgaaactggagcatccaaagtctgaggcaaaaagcgtcgtgaagcaggataggctgctggggttactaatgcctttcagggcctttggggacgtcaagtttaagtggtcaatcgatctgcagaaacgagttattgaaagcggtccggaccagctgaacgacaatgagtacaccaagttcatacccccgaattatcatacacctccctacttgaccgcggaacctgaggtaacgtaccaccgccttcgtcctcaggataagtttctggtgctcgccaccgacggtctgtgggagaccatgcacagacaggatgtggtccggattgtgggggaatatctgactggtatgcaccatcagcagccaattgcagtgggtggatataaagtgactctgggccagatgcatgggctgttgaccgaacgcagaactaaaatgagcagtgtgtttgaggatcaaaatgccgcaactcacctcataaggcacgccgttggaaataacgagtttggcaccgtcgaccatgagaggctgagtaaaatgctgtctcttccagaagaattagcaagaatgtacagagacgacattaccattatcgtagtacagtttaattcccacgttgtcggggcataccagaaccaagagtag

SEQ ID NO: 202175 - DNA, 444 bp, Artificial Sequence
  Description of Artificial Sequence: Synthetic coding sequence
atgcccgcccccacccagctgttcttccccctgatccggaactgcgagctgtcaaggatttatggcactgcctgctattgccaccataagcatctgtgttgctctagctcctatatcccccagtccagactgaggtataccccccatcctgcatatgcaacattttgtcgccccaaagagaactggtggcaatacacgcaggggcgtaggtatgcatcgactccacagaagttctacttgaccccgccccaagtgaattctattttgaaagccaacgagtattcatttaaagttccagaatttgacggaaagaacgtgtctagcatcctgggatttgatagtaaccagctgcccgccaatgcccctatcgaggatcggagatctgccgctacatgtctacagactaggggcatgctgttgggcgtctttgatggccacgcctag

SEQ ID NO: 202176 - DNA, 1467 bp, Artificial Sequence
  Description of Artificial Sequence: Synthetic coding sequence
atggccgacaccttcctggagcacctgtgcctgctggacatcgacagtgagcccgtcgcagcgcgttccacgtctatcatcgccacaataggcccggcgtccaggagcgttgaaaggctgaaagaaatgatcaaggccggcatgaatattgctcgcctcaatttctctcatggaagtcacgaataccacgctgagtcgatagctttagacaccaagggaccagaaatcaggactggcattctccaaggtggacctgagagtgaagtcgagctggtgaaaggcagccaggtgctggttactgtagatccagcattccgtacccggggcaacgccaacacagtctgggtggattaccctaacattgttcgcgtggtacccgttggtggtaggatctatatcgacgatggcctgatatctctggtcgttcagaagattggccccgaaggactagttacgcaggtggagaatgggggggtgctcggatctagaaagggcgtaaatctgcctggcgcacaggtcgacctgccaggcctgtccgaacaggatgtgcgggacctgagatttggggtggaacatggggtggatatcgtctttgcatcatttgtacggaaggcttccgacgtggccgccgtgcgggccgcacttgggcccgagggccatggcattaaaatcatctccaaaatcgagaaccacgagggtgtaaagcgcttcgatgagatcctggaggtctctgatggcataatggtggcccgtggtgacttagggattgagattccggctgagaaggtatttctggcacaaaagatgatgatcggccggtgtaatctagcagggaaacccgtggtgtgtgccactcagatgttggagtcgatgatcaccaaacccagaccaacaagagctgaaactagtgacgtggcaaatgcagtgttggatggggccgattgcatcatgctgtctggagaaaccgccaaaggaaactttccggtcgaggccgttaagatgcaacacgccatagcccgcgaggccgaagccgcagtgtaccacagacagctgttcgaagagctgcgaagagccgctcctttgtcaagagaccccacagaggtgaccgccatcggagcagtggaggccgcttttaaatgctgcgcagccgcaattatagtgctgaccaccaccggtcgctctgctcaactgttaagccgctaccggccacgcgctgccgtcattgccgtaacgagaagcgcccaggcggcccgccaggttcacctgtgccggggcgtttttcccctgttataccgcgaaccccccgaggcaatttgggcggacgatgtggaccggcgcgtccaattcggcattgagtccggtaagctgcgggggttcctgcgcgtaggagatctggtgatagtcgtgactggctggcgaccagggagcggttacaccaatattatgagagtgctctcgatctcctag

SEQ ID NO: 202177 - DNA, 1725 bp, Artificial Sequence
  Description of Artificial Sequence: Synthetic coding sequence
atgagcatccaggagaacatcagcagcctgcagctgcggagctgggtgagcaagtcccagagggatctcgccaagagtatccttataggcgcccccgggggacccgctggctatctacggcgagcctccgttgcacagctcacacaggagctgggtaccgcatttttccagcagcagcagctgccagctgccatggcagatacatttctggaacacctgtgtctactcgatatcgacagcgagccagtggcagcgcgctctactagtattattgctaccataggacccgcgtcccgtagtgttgagcggctgaaagaaatgataaaggcagggatgaacatcgccaggctgaatttttcccacggaagtcacgagtaccatgcagagagtattgccaacgttcgagaagctgtggagagctttgctggatctccactgtcttaccggcctgtggcgatcgcgttagatacgaaaggacccgaaatcagaaccggcatcctccaaggtgggccagaaagcgaggtcgagctcgtgaaaggatcccaggtgcttgtgaccgtcgatcccgcattccgaactcggggtaacgctaacactgtgtgggtggattaccccaatattgtccgggtcgtgcctgtgggcgggaggatctacatcgacgatggcctaattagcctagttgtgcagaaaattggccctgaagggctggtaacacaggtcgagaacggcggtgtcctgggcagtcgaaagggcgtcaatcttcccggagcccaagtcgatctccccggcttgtctgaacaggacgtgagggaccttagattcggcgtggagcatggagtagatattgtttttgcaagttttgtgcgcaaggccagcgacgtggcggccgtaagagccgccctcgggcctgaagggcatggcatcaagatcatctctaaaatcgagaatcatgagggagtgaagaggttcgacgaaatactcgaagtctccgacggcatcatggtagctcgaggcgacctaggtattgagattcctgcagagaaagtctttttagcacagaagatgatgataggtcgctgcaatctggccgggaagccagttgtatgcgcgacccaaatgcttgagtcaatgatcacaaaaccacgccccacgagggcagagacctcagatgtggcaaacgctgtattggatggcgctgattgtatcatgctgagcggagagacagccaagggcaactttcctgtggaggccgtgaaaatgcagcacgctatcgcccgcgaggccgaggctgccgtctaccacagacagctgtttgaggagctgcgcagagccgccccactgagccgagacccaaccgaggtgacggcaataggtgccgtcgaggctgccttcaagtgttgtgctgcagcgatcatagtgctaactactacaggaaggtcggcgcagctactgtcaagatacagacctagagctgcagtgatcgctgtgacccgatctgctcaggccgccagacaagttcacctgtgccgcggcgtgttccctctgctctatagggaaccgcctgaggcgatttgggccgatgacgttgacagacgggtgcaattcggtattgaaagcgggaaactcagaggcttcctgcgagttggggaccttgtgatcgtggtgacaggatggcgccctggatccggctacaccaatatcatgcgggttctgtcaatctcctag

SEQ ID NO: 202178 - DNA, 1632 bp, Artificial Sequence
  Description of Artificial Sequence: Synthetic coding sequence
atggagggccccgccggctacctgcggcgggccagcgtggcccagctcacgcaggaacttggaacagctttcttccaacaacagcagcttcccgcagctatggcagacacctttcttgaacacctttgtctcctggacatcgacagcgaaccagtcgcggcccgatctaccagtatcattgccactattggaccagcttcacgcagtgtcgagagattaaaagagatgattaaggctggcatgaacatcgcacggttgaatttctctcacggcagccacgagtatcacgcggaaagtatcgccaatgtgcgagaggccgtggagtcgttcgccgggagtcccctgtcttacagaccggtcgccatcgctctcgacacaaagggacccgagatccgcaccgggatcctgcagggcgggccggagtctgaagtcgagttagtgaaaggatcacaggttctcgtgaccgttgatccagctttccggacacgtggtaatgctaatactgtctgggtcgattatccaaatattgtgcgggtcgttccagtgggtggtcgcatttatatcgatgatggcctgatctcactcgtggttcagaaaatagggcccgagggattagtgacccaggtggagaatgggggtgtgctgggtagtcgtaagggagtgaacctaccaggggcccaggttgacctgccaggcctgtcagagcaagacgtgcgggatctacggtttggggtcgaacatggcgtcgatatcgtctttgcatccttcgtgagaaaagctagtgatgtagccgccgtccgggcggctctcgggccagagggccatggaatcaaaatcattagtaagatcgaaaatcacgaaggcgtgaagagatttgatgagatactcgaagtcagcgatggcatcatggtggccaggggagatctggggatcgagattcctgcagagaaggtgtttctggcccagaagatgatgattggccgttgtaacctagcagggaaacccgtagtatgcgcgacccaaatgctcgagtccatgattactaagccacggccaaccagagccgaaacgtcggatgtggcaaatgcagtgttggacggcgccgactgcattatgttgtcaggagaaaccgctaagggcaatttccctgtggaagcggttaagatgcagcatgctatagctcgagaggctgaggctgccgtgtaccacaggcaactgtttgaagagctgaggcgggcagcccctctgagccgggaccccactgaagttacagcgattggggccgttgaggccgccttcaagtgctgcgcagccgccattattgtcctgaccacaaccggcaggagcgcccagctcctgtcacgctacaggcctagggccgctgtgattgcagtcactcgctccgcgcaggctgcaagacaggtgcacctgtgtagaggggtgttccctctcctgtatcgtgagcccccagaggctatctgggcagacgatgtggatagacgcgtgcagtttgggatagaaagcggtaaattgcgcggtttcctgagagtgggggatctcgttatagttgtgacaggatggcgtcctgggtctggatataccaacatcatgagagtgctatccatctcatag

SEQ ID NO: 202179 - DNA, 1800 bp, Artificial Sequence
  Description of Artificial Sequence: Synthetic coding sequence
atgagcatccaggagaacatcagcagcctgcagctgcggagctgggtctccaaatcccagcgagacctggcgaagtctatcttgattggcgccccaggagtaccactcacaactcaacagtgtggggctgaccctcagagagggcggcctcgagaggtgtgttcaggaatggagggcccggctggttatctgaggcgagccagcgttgctcagttgactcaagaattgggtacagctttttttcaacaacaacaactcccagctgctatggcagatacttttcttgaacatctgtgccttcttgacatcgatagcgagcccgtggctgcacggtctacgagcatcatcgctaccatcggtccagcaagtcggtctgtggagcggctgaaggagatgataaaagcagggatgaatatcgcccgcctgaacttcagccacggcagccacgagtatcacgccgaaagcattgcaaacgtgcgggaagctgtggaatcgttcgccgggtctccattatcctatagaccagttgcaatagcactggatacgaaggggcccgaaataagaaccggcattcttcaggggggccccgaaagtgaggttgaactggtgaaggggagtcaggtactagtgacggtggaccccgcttttaggaccagagggaacgctaacacagtctgggtcgactatccaaacattgttcgtgttgtgcccgttgggggccggatatatatagacgatgggctcattagtctagtcgtgcagaagatcggacccgaagggttggtcacccaggtcgagaacggcggagttctaggtagtcgcaaaggcgttaaccttccgggagcacaggtggatctccccggattgtcagagcaggacgtgcgagacctgagatttggcgtggagcacggagtcgacatagtgttcgcgtcatttgtacgcaaagcctctgacgtggcggccgtcagggctgcccttggacctgagggccatggtattaagattattagcaaaatagagaatcacgagggtgtgaaaagattcgatgagatcctcgaggtgagtgatggcattatggtcgcacgcggcgacctcggaatagagattcctgcagagaaggtgtttcttgctcaaaaaatgatgattggcagatgtaatttagcagggaagcctgtggtgtgtgccacccaaatgctggagagtatgattacaaaacccaggcccacgcgagcagaaaccagtgacgtggccaacgccgttttggacggggccgattgcatcatgctcagtggcgaaactgctaaagggaatttccccgtggaggccgtgaagatgcagcacgcaatcgctagggaggcagaggctgctgtgtaccacagacagctgttcgaggaactgaggcgggcagcccctttgagccgtgaccccactgaggtgacagcgatcggcgccgtggaggctgcatttaagtgctgtgcagctgcaattatcgtcctcactacaaccggacgatctgcacaactcctgtcccggtaccgtcctcgggcagccgtcatcgcagttactagaagcgctcaggccgccaggcaagtccacctatgccggggagtgttccccttactgtatcgtgaaccacccgaggccatttgggccgacgatgtcgaccggagagtccagtttggtatcgagtcaggtaagcttcggggatttctccgagtgggggacctcgtaatcgtcgttaccgggtggagacctgggtcgggctacacgaatattatgcgagtgttaagtatttcatag

SEQ ID NO: 202180 - DNA, 1596 bp, Artificial Sequence
  Description of Artificial Sequence: Synthetic coding sequence
atgagcaagccccacagcgaggccggcaccgccttcatccagacccagcagctccacgcggccatggctgacacatttctcgagcatatgtgtcgacttgatatcgactctcccccaatcactgcccgcaacacgggtattatttgcaccattggccccgcctctagaagtgtggaaacattgaaagagatgatcaaatcggggatgaacgttgctcgcctgaacttctcgcacggcactcatgaatatcatgctgaaactatcaagaatgttaggacggccacagaatctttcgcgtcagaccctatcctttatcgccccgtcgccgtggcactcgacaccaaggggccggagattcgcactgggctgataaaaggtagtggcacggcagaggtggagctcaaaaagggcgcgacacttaagataacgttggataacgcctatatggagaagtgcgacgagaacatactgtggctggattacaaaaacatttgtaaagtcgtggaagtgggaagcaaaatctacgtcgacgatggtctgattagtttacaggtgaaacagaagggcgccgacttcctggtgaccgaggtggagaatggcggaagtctgggaagcaagaagggcgtgaatctccctggagcagccgtggatctgcctgccgtgagtgaaaaggacatacaagatctcaagtttggagtggagcaggacgtggatatggtatttgccagctttatccgcaaagctagtgacgtgcatgaagttcgaaaggtactcggagagaaggggaaaaacatcaaaatcatctcgaaaattgagaatcacgaaggtgtgcggcggttcgatgagatcctggaggccagcgacggtattatggtggcccgcggcgatctggggatcgagatccccgcggagaaagtgttcctggctcagaagatgatgatcggaaggtgcaatcgagctgggaagcctgtcatttgcgccactcagatgctggaaagcatgattaaaaagccaagacccacgcgagccgagggctcggacgttgcaaatgctgtgcttgacggcgcagattgcatcatgctctcaggcgaaacagcaaaaggtgactaccctcttgaagccgtcagaatgcagcatctcatagcacgggaggccgaggcagcgatgttccacagaaagctgttcgaggaactcgtgcgagcctctagccacagtaccgatttaatggaagctatggccatggggtcagtggaggcttcctataaatgcctggccgccgcgctgatcgtgcttaccgaaagcgggagatctgcacaccaagtagccaggtatcggccaagagcaccaatcatcgccgttactaggaatcctcagaccgcgcggcaggcacacctgtaccggggcatctttccagtcttgtgcaaggaccctgttcaggaggcctgggccgaggatgtcgatctgcgcgttaattttgcgatgaatgttggcaaagctcgcgggttttttaaaaagggagatgtggtgatcgtgttgaccggatggcgccctgggtctggtttcacaaacactatgcgagttgtgccagtcccctag

SEQ ID NO: 202181 - DNA, 1101 bp, Artificial Sequence
  Description of Artificial Sequence: Synthetic coding sequence
atgagcaagccccacagcgaggccggcaccgccttcatccagacccagcagctccatgccgccatggccgacactttcctcgaacatatgtgcagactggacatcgatagtccacccatcaagaaaggtgtgaatctccccggagccgccgtcgacctcccggcagtgagcgaaaaggacattcaggatctgaagttcggagttgagcaagacgttgatatggtgtttgcctccttcataagaaaggcttctgatgtgcacgaagtgagaaaagttttgggagaaaaggggaaaaatattaagataatatctaagattgagaatcacgaaggagtacggagatttgacgagatcttagaagcttccgatgggatcatggtagcccggggtgatctgggaattgagatcccggcagagaaggtctttctggctcagaaaatgatgataggccgctgcaatcgggcggggaaacctgtgatatgcgcaactcaaatgcttgagagtatgatcaagaagccccgacccactcgagcggagggctccgatgtggccaacgctgtgttggacggcgctgattgcatcatgctcagtggggagaccgcaaagggcgattatccccttgaggctgtgcggatgcagcacttaatcgctcgtgaggcggaggccgctatgtttcatagaaaactgttcgaggagctggttcgggcgtctagtcactctacagacctaatggaggctatggcaatgggaagcgtggaggcctcttataaatgcctggccgcggctctgatcgtgctgaccgagtccggacggtcggcccatcaggtcgcaagatacaggccgagagcccctatcattgccgtcacccgaaacccacaaaccgcaaggcaggcccatctctaccgcggcatatttccagtcctctgcaaggacccggtccaggaagcctgggccgaggatgtggacctgcgtgttaattttgctatgaatgtgggaaaagcccggggctttttcaaaaaaggggatgtcgtgattgtactgacaggttggagacctggatctggtttcacaaataccatgcgggtggttcccgtcccttag

SEQ ID NO: 202182 - DNA, 1596 bp, Artificial Sequence
  Description of Artificial Sequence: Synthetic coding sequence
atgagcaagccccacagcgaggccggcaccgccttcatccagacccagcaactccatgcggccatggctgacacctttcttgaacatatgtgtagactcgacatcgactctccccctatcacggcgaggaacacgggaatcatttgcactattggtcccgcatctcgaagcgtggagacgctcaaagaaatgatcaagtcggggatgaacgtggcccgcttaaacttttcacacgggacacacgagtatcacgcggagaccatcaaaaatgtccggaccgccactgagagttttgccagcgatccaatcctttatagacccgtcgcggttgcactcgataccaagggcccggaaatccggaccgggctgattaagggctctggaacggccgaggttgagctgaaaaagggagctacacttaagattacactagataatgcctatatggaaaagtgcgatgaaaatatattatggctggactataagaatatctgcaaggtagtcgaggtggggagcaagatctatgtggacgacggcctaatctccctgcaggtgaaacagaagggagcggactttcttgttaccgaagtggaaaacgggggatccctcggaagcaagaaaggagtgaaccttccgggcgctgccgtcgatctccccgccgtcagcgagaaagacattcaggatctgaaattcggcgtggaacaagacgtggatatggtgttcgccagtttcattaggaaggcctccgatgttcacgaagtgcggaaagtgcttggagagaagggcaagaatattaaaattatcagtaagattgagaaccatgaaggggtcagacggtttgatgagatactcgaagcttccgacggcattatggttgccaggggcgacctcggaatagagatcccggctgaaaaggtgttccttgcccaaaagatgatgataggacgatgcaaccgcgccggaaaaccagtgatctgcgcaacccagatgctcgagtccatgattaaaaaacccaggccaacaagagctgaggggtctgacgtggcaaatgcagttctggacggggcagattgcattatgctgtccggagaaacagccaaaggcgactatcctctcgaggctgtgcgaatgcaacacctgattgcaagggaggcggaggctgccatctaccacttacagttgttcgaggaacttcggagactagcacccattacctccgatcccaccgaggccacggctgtgggggctgtcgaggcctcttttaaatgctgtagcggtgctattatcgtgctgaccaaatccggaaggtcagctcaccaggttgcccgctacagacctagagcacctattattgccgttacccgaaatcctcagaccgcccgccaggcccacctatataggggcatttttcccgtgctctgcaaggatccagtgcaggaggcctgggcggaagatgttgatctgagagtgaattttgctatgaatgtgggaaaagcccgcggattctttaaaaagggcgatgttgtgatcgtgctgaccggctggagaccgggcagcggctttacaaatacaatgagagtagtcccagttccctag

SEQ ID NO: 202183 - DNA, 1596 bp, Artificial Sequence
  Description of Artificial Sequence: Synthetic coding sequence
atgagcaagccccacagcgaggccggcaccgccttcatccagacccaacagctgcatgccgctatggcggatacatttctggagcatatgtgtagactagacatagacagtcctcccatcaccgctcggaatacgggaatcatctgtaccatcggccctgcaagccgaagcgtggagacattgaaagaaatgatcaaatctggcatgaacgtggcaaggcttaatttttcacatggcacccacgagtatcacgccgaaactataaagaatgtacgcacagctacagaaagtttcgccagcgacccgatcctttacagaccagtggccgtcgcactggacactaagggcccagagatccgcactggccttatcaagggctcagggacagcggaggtagagctgaagaaaggcgcaaccctgaaaattacattggacaatgcttacatggagaagtgtgatgaaaacatactgtggctggactataagaacatctgcaaggttgtggaggtgggaagcaagatttacgtggatgacggacttatttccttgcaggtcaaacagaaaggagccgacttcctggttactgaagttgagaatggtggctccttggggtcgaaaaagggtgtcaatcttccaggtgctgctgtggatctgcccgctgtctctgagaaagacatccaggacctcaagtttggcgttgaacaggatgttgacatggtctttgccagcttcatccggaaggccagcgacgttcacgaggtccgtaaggtccttggtgagaaaggaaaaaatatcaagattatttccaaaattgaaaaccacgagggagtgcgacgctttgatgagattctggaggcgtccgacggcatcatggtcgcacgcggtgacctaggtatcgagatacctgccgaaaaggtctttctggcacagaaaatgatgatcggcaggtgcaaccgcgccggtaagcccgtgatttgcgctactcagatgctcgagagcatgataaaaaagccgcgacctacgcgtgctgagggatcagacgttgccaacgcagtgctagatggagctgactgcattatgctttctggcgaaaccgctaagggtgattatccactggaggccgttagaatgcagcatctgatcgccagggaagccgaggccgccatgttccaccgtaagttgtttgaagagctcgtccgagcctccagccactcaactgatcttatggaagccatggctatgggaagcgtggaggcatcctataagtgtcttgctgccgcgcttatcgtgctgaccgagtccggcaggtctgcccatcaggtggctaggtataggcctcgcgccccaataatcgccgtgaccagaaacccgcagacggccaggcaggctcatctgtacaggggaattttccccgtcctgtgtaaggatcccgtgcaggaagcttgggcagaggatgtcgacctaagagttaattttgcaatgaatgttggcaaggcgcgcgggtttttcaaaaagggcgacgtcgttatcgtattgacaggatggcggcccggaagcggatttaccaacacaatgcgggttgttcccgtcccctag

SEQ ID NO: 202184 - DNA, 1377 bp, Artificial Sequence
  Description of Artificial Sequence: Synthetic coding sequence
atgagcaagccccacagcgaggccggcaccgccttcatccagacccaacaacttcacgctgctatggccgatactttcctggagcatatgtgtcgcctcgatatagattccccacccattacagcgcgtaataccgggatcatctgcaccatcgggcctgctagccgaagcgaggtggagctgaaaaaaggagctactctgaagattacgctcgataatgcgtacatggagaagtgtgatgaaaacatcttgtggctcgattataaaaacatttgtaaagtggtagaggtgggctccaaaatctatgtagacgacggactcatttcactgcaggtcaagcagaaaggcgccgacttcctggtcacggaagtggaaaatgggggctcactcggtagtaagaagggcgtgaacctgccaggtgctgcagtggacctcccagccgtgagtgaaaaggacattcaggacttgaagtttggtgtagagcaagatgtcgacatggtgtttgcgtcttttatccggaaagccagcgacgtgcacgaggtgaggaaagtcctgggggagaaaggtaaaaacatcaagattatctcaaagattgaaaatcatgagggcgttaggcggttcgatgagattttagaagcaagtgatggaattatggttgcgcgaggcgatctgggtatcgagatacctgcggagaaagtgtttctggcccagaagatgatgattggccgatgcaatagagctggaaaacctgtgatatgcgccacccaaatgctggagagtatgataaaaaaaccgagacccactcgtgccgaaggcagtgacgtagcaaatgccgttctcgatggagctgattgcattatgctgtccggcgagacagccaaaggagattacccactggaggccgtgcgcatgcagcacttaattgcacgtgaagctgaggctgccatctaccacctccagttgttcgaggagttacggcgcctggctcctatcacctccgacccaacagaggccactgcagtgggcgccgtcgaagcaagctttaaatgctgcagcggcgccatcattgtgcttaccaaaagcggcagaagtgctcaccaggtggcccggtatcggcctagagccccgattatcgccgttactcggaaccctcagaccgcccgccaggcacacctctataggggtattttccccgtgctttgcaaagaccctgtacaagaggcatgggccgaggatgtggacctgcgggtcaacttcgccatgaacgttgggaaagcaagaggattctttaagaagggggacgtagtgatcgtgttgaccggctggcgtcccggaagtgggttcaccaataccatgcgcgtggtgccggttccgtag

SEQ ID NO: 202185 - DNA, 1551 bp, Artificial Sequence
  Description of Artificial Sequence: Synthetic coding sequence
atgagccccgaggcccagccccagcggaccaagggcccccagcagccttgcagaagtcctattgttaagcctggcctcccatcatttaggcccagtagctgcacccagccttggttgactcactcctggtcgacatgtgccgcttggactctgatccatcatccttcacagcctggaacccttgcatcctccgtgccactgtaccacgcagagaccattaaaaacgtcaggacggccacagagagttttgccagtgaccccattctgtatcggccagtcgccgtggcactagacaccaaaggccctgagatcaggaccgggctcattaagggttcggggactgcggaggtagagttaaagaagggagccacgcttaagatcactctggacaatgcttatatggaaaaatgcgacgagaacatcctgtggctcgactacaagaatatttgcaaggtagtcgaggtggggtctaagatctatgttgatgacggcctgattagcttgcaggtgaaacagaagggcgcagatttccttgtcactgaagtggaaaatgggggctcgctgggaagcaagaaaggtgtcaaccttccaggggctgctgttgatttaccggcggtatctgagaaagacatccaggatctaaaattcggcgtggagcaggacgtggatatggttttcgcctcctttatccgcaaagcatccgatgtccacgaagtccgcaaggtgcttggagagaagggcaagaacatcaagattatttctaagatagagaatcacgaaggagtgcggcgcttcgatgaaatccttgaagcgagtgatggaatcatggtcgccaggggtgacctcgggattgaaattccggcagaaaaagtgtttcttgcccagaagatgatgatcgggagatgcaatcgcgccggtaaaccagtcatctgcgccacacaaatgctggaatccatgatcaagaagccacgaccaacacgtgccgagggctcggatgtcgctaatgccgtgttagatggagcagactgcattatgctgtcaggagagactgcaaaaggggattacccactggaagccgtgagaatgcagcacctgatcgctagggaagcagaagcagctatttaccacctgcaactgttcgaggagttacgccgcctggcccctatcacctctgatcctaccgaggctactgctgtcggtgcagtggaggcatcctttaagtgttgcagcggagctattatcgtgctgacaaagagtgggcggtccgctcaccaagtcgcacgataccgaccaagagcccctatcattgctgtgacccgcaatcctcaaaccgcaagacaggcccatctctacaggggtatctttcctgtactgtgtaaggatccagtccaggaagcatgggcggaggacgtggacctacgggtgaatttcgccatgaatgttggcaaagctcgtggcttttttaagaagggcgacgttgtgattgtactcactggatggagaccaggctctggttttactaacacgatgcgcgtggtgcccgtcccctag

SEQ ID NO: 202186 - DNA, 1212 bp, Artificial Sequence
  Description of Artificial Sequence: Synthetic coding sequence
atggccggcgccgccacccaggccagcctggagagcgccccccggatcatgcggttggtcgcggagtgctctcgctccagggccagggccggtgaactgtggctgcctcacggaaccgtagctacccctgtcttcatgcccgtgggaacccaagcgactatgaagggcatcaccaccgaacaactcgatgcgctgggctgtcggatatgtctggggaatacttaccatctggggctgcgccctgggcccgagctgattcagaaggctaatggcctacatggtttcatgaactggccccacaatctgcttaccgacagtggtgggtttcaaatggtcagcttagtgagtttaagtgaagtgacggaggagggggtccggtttagatccccctatgacggtaacgagaccctgctgtccccagaaaagtctgtacagatacagaacgctctcggctccgacattattatgcaactggatgacgtggtttcttcgacagtgactggacctcgcgtggaggaggcaatgtatagaagcatcaggtggctggatcgttgtattgctgcccaccagaggcccgataaacagaatttatttgctattattcaaggaggactcgacgccgacctgcgcgctacctgcctggaggagatgaccaagcgagatgttcccggttttgcaataggtgggctttcagggggagagtctaagtctcaattctggaggatggttgctctgagcacctcgcggttaccaaaagacaagcccagataccttatgggagtcggctacgccactgacttggttgtgtgtgtggccctggggtgtgatatgtttgactgcgtctttcctactagaaccgctcgtttcgggtcggccttagtgcctaccgggaatctgcagcttcgaaaaaaagtgtttgagaaagattttgggcctattgatcccgagtgcacatgccccacttgccagaagcatagccgagccttcttgcatgcgcttctacactccgacaataccgccgctctgcaccaccttacagtgcataatatcgcctatcagttgcagctgatgtctgccgtgaggaccagtattgtggagaagaggttccctgatttcgttcgcgacttcatgggagctatgtacggggacccaacgctgtgtccaacttgggccaccgacgcgctcgcatccgttggtattaccctaggctag

SEQ ID NO: 202187 - DNA, 678 bp, Artificial Sequence
  Description of Artificial Sequence: Synthetic coding sequence
atggccggcgccgccacccaggccagcctggagagcgccccccggattatgagacttgtagcagagtgttcgcggtcgcgggccagagccggagaactctggcttccccacggaacagtggcaacacctgtgttcatgcccgtcgggacacaggccacaatgaaaggaataacgacagagcagctggacgccttggggtgccgtatctgtcttggaaacacttatcacctgggacttagacctggccccgagttgatacagaaggccaatggcttgcatggctttatgaactggccccacaacctgctgacggactcagggggctttcagatggtctcactggtctcactgtctgaagtaactgaagaaggcgtacgattccgcagtccgtacgacggaaatgaaacgttgctgagccctgagaagagcgttcagattcagaacgcacttggcagcgatataattatgcaactcgacgacgtcgtgtcctccacagttacaggccctagggtggaggaagccatgtaccgcccactggggctcgtaactggcgctctcttacaggttaatcctctggcaggtccagtacactgcagccctagtgcagcaggtcaggcggaacctctgcggcactaccccggctgggccggtcgaaggtccccaggccatctgccctag

SEQ ID NO: 202188 - DNA, 2097 bp, Artificial Sequence
  Description of Artificial Sequence: Synthetic coding sequence
atggccgccgccggcgccgccgtggcccggagccccggcatcggcgccgggccagctcttagagccaggaggtctcctcccccccgcgctgcccgtcttcccaggctgctggtcctgctggcggccgcagcagtgggtcctggcgccggcggagccgccaggctgtatagggccggggaggacgctgtatgggtgctggatagcggttcagtgaggggagcgacggccaattcttcagccgcctggctggtacagttctactctagttggtgtggccattgcatcggttacgcccccacgtggagagcccttgctggtgatgtgcgagactgggcctccgctataagagttgctgcattggattgcatggaagagaaaaatcaggctgtttgccatgactacgatatccatttctacccgacttttcgttatttcaaggcctttacaaaggagttcaccaccggtgagaatttcaagggccctgatcgagagctgcgcaccgtgaggcaaactatgatcgacttcctgcagaatcacacagagggctcccgtcctccagcatgtccccgtctggatccaatccaaccgtctgacgtgctgagcctgctcgacaatagagggagccactacgtggctatcgtattcgagtcaaattcatcataccttggcagagaagtgattttggatttgataccatatgaaagcatcgtcgtgactcgtgcactggacggggacaaggctttcctggaaaaactcggcgtcagttccgtgccctcttgttacctcatttaccctaatggaagtcacgggttgatcaatgtcgtaaaaccactgcgtgcctttttctcatcttatctgaaatcactgcccgacgttcgcaagaaatctcttccattgccagagaaaccacataaggaggaaaactccgagattgttgtgtggcgtgaattcgataagagcaagctctacacagttgatctcgaaagcggactgcactacttgttgcgtgtcgaactcgccgcacataaatcacttgcaggagcggaactgaagacccttaaagattttgtcacagtgctggctaagctgttccctgggcgaccacctgttaaaaaacttcttgagatgttacaggagtggttggcctcactaccattagaccggattccctataatgctgtgttagacctggtcaataataaaatgcgcataagtggaatatttctcacaaatcatatcaagtgggtgggatgccagggctctcgctcagagctgaggggttacccctgcagtctgtggaaactttttcatacattgacagtcgaggcctcgactcatccagatgcgctagtgggcaccggtttcgaggacgaccctcaagcagtgttgcagacaatgaggcgatacgtccatactttttttggttgtaaggagtgtggcgagcattttgaggaaatggcaaaagaatctatggacagcgtgaaaacacccgaccaggccattctctggttgtggaaaaagcataacatggtgaatggacgcttggccgggcacctgagtgaggatccaaggtttccgaagcttcagtggccgactccagacctgtgtccagcatgtcatgaggagatcaagggactcgctagctgggatgagggacatgtcctaacgtttctaaaacagcactacgggcgagacaaccttctggatacatacagcgcagaccagggggatagtagtgaaggtggcaccctagcccgtggcgaggaggaggaaaaaaggctcacccctcctgaggtgtctcacggagatagggatacacagagcgttcgcccccccggtgccctagggcctaggccagccctgccagaatcattgcatcatagtctcgatggcaagctgcaatcacttgatgggcctggggcacacaaggaagtagggggtgccgcaccatttctgggcgtggattttagctcactggacatgtccctttgcgtggtactatacgtggcctcctcactgttcttgatggtgatgtacttcttcttccgcgttaggagtagacgatggaaagtcaagcatcaccatcccgccgtgtag

SEQ ID NO: 202189 - DNA, 948 bp, Artificial Sequence
  Description of Artificial Sequence: Synthetic coding sequence
atggaggagaagaaccaggccgtgtgccacgactacgacatccacttctaccctacattccgctacttcaaagcctttaccaaggagttcaccaccggcgaaaacttcaagggcccagatagagaattgcgaaccgtccgccagacaatgatcgacttcttacagaatcataccgagggatccagaccccctgcttgtccaagactcgaccccatacatgtgaagcccctgcgggccttcttcagctcctatctcaagtctctccctgacgtgcggaagaagtcattgccattgcccgaaaagccccacaaagaagagaatagcgagatcgttgtgtggcgggaatttgataagagtaagctgtacactgtcgatttggaatctggcctgcactacctgcttagggtggaactggctgcacacaagagtctggcgggggctgagcttaagaccctaaaagactttgtgactgtcctcgctaaactgttccctggtcggccacctgtcaaaaagctgctcgaaatgcttcaagaatggttggccagtcttcccctggaccgaatcccatacaatgctgtgctggacctagtgaataacaagatgcggatctcaggaatctttttaactaatcatataaagtgggttgggtgtcagggatcacggagcgaactccgcggctacccatgtagcctgtggaagttgttccatacactgacggtcgaggcttccacccacccagatgctctcgtcgggaccggtttcgaggatgacccacaagctgtgctccagacaatgcgtcgctacgtgcacaccttcttcgggtgtaaagaatgcggcgagcatttcgaggagatggctaaggagagtatggacagcgtcaaaacgcctgatcaagctatactctggctgtggaaaaagcacaacatggtgaatgggcggctggcatag

SEQ ID NO: 202190 - DNA, 735 bp, Artificial Sequence
  Description of Artificial Sequence: Synthetic coding sequence
atggccgccgccgccgccgccggcgaggcccggcgggtgctggtgtatgggggaagaggggccctcggaagtcgctgcgtgcaggcttttcgagcccggaattggtgggtagcttctgttgacgtggtggagaacgaagaagcttcagcgtccatcattgtaaaaatgacagattctttcactgaacaggccgatcaggtgacggctgaggtgggaaaattacttggcgaagagaaggtggacgcaatattgtgtgtcgccggaggttgggcaggcggcaacgccaagagcaagtctctgttcaagaattgtgatctaatgtggaagcagtcaatttggacaagcacaatttcttcccacctggccaccaagcacctaaaagaaggaggtctccttaccctggctggcgcaaaagccgcactagatggcacccctggcatgatcggatacggcatggcaaagggggctgtgcatcaactgtgtcagagcctggctgggaaaaactctggtatgccccctggcgctgctgccattgcagtattgccggtgaccttggatacccccatgaatagaaaatccatgcctgaggctgacttctctagttggactccactggaatttcttgtcgagacatttcatgattggatcacaggcaagaacaggccctcctcagggtcactgattcaggtggtgaccaccgaaggtagaaccgagttgacgccagcatacttctag

SEQ ID NO: 202191 - DNA, 681 bp, Artificial Sequence
  Description of Artificial Sequence: Synthetic coding sequence
atggccgcccccctgctgcacacccggctgcccggcgacgccgccgcaagtcccagcgccgtcaaaatgttgggcgcatcaaggaccggcatctctaacatgcgcgctttagaaaacgatttctttaactcccctccaaggaagactgtacagtttggaggaactgtaacagaagtgttgctcaagtacaagacaggcgaaactaatgacttcgaactcctgaagaatcagctcttggaccccgacattaaggacgaccagatcatcaactggctattagagttcagatcctccatcatgtatctcaccaaagactttgagcagctgatctctatcattctgaggctaccttggctgaacagaagtcaaacagtcgtggaagagtacttggcttttttaggcaacctcgtgtcggcccaaactgtgttccttcgaccttgtctgagtatgattgccagtcacttcgttccaccacgggtcatcattaaagagggagacgtcgacgtgtcagattcagacgatgaggacgacaacctgccagctaatttcgatacttcccagtccttagcgaacaattccaaaatttgtactatagacacggtggtgtcccatgctaatactggcggaaaaattagtatttgttccaaaatccgcgaaaacacaggaatgctccgatcgtag

SEQ ID NO: 202192 - DNA, 894 bp, Artificial Sequence
  Description of Artificial Sequence: Synthetic coding sequence
atggacgccgagggcctggccctgctgctgccccccgtgaccctggctgccttagtcgacagctggctaagggaggactgccccggtctgaattatgcagcccttgtgtccggtgcgggcccttcacaggcagcgttgtgggcaaagtcgcccggcgtcctggccggacagcccttcttcgatgccatcttcacacagctcaattgtcaggtgtcctggtttctgcccgagggcagcaagctcgtgcctgtagcaagagtcgccgaagtccgcggtcctgcccactgtcttctcttaggcgaaagagttgctctgaatacgttagcgcgttgcagcgggattgctagtgctgccgcggccgccgtggaggccgcccgcggggctgggtggactggccacgtcgccggcacacgcaagactaccccaggctttaggcttgtcgaaaagtatggtttgttggtgggcggggccgcatcccaccgatacgatcttggtggattggttatggttaaggacaatcacgttgttgctgccggcggcgtggagaaagcggtccgggcagctcggcaggcggcagacttcacactcaaagtggaggtagaatgtagcagcctgcaggaggcagttcaggcagctgaggccggagcagatctggttttgctggataacttcaaacccgaggaattgcaccccacagccactgtcctgaaggctcagttcccgtctgtagcagttgaggcgtcagggggcataacgctagacaatctccctcagttttgtggaccacatatagatgttatctcaatgggtatgctgactcaggcagcgccagccctggacttttctctgaaactgtttgcgaaggaagtagctcctgtgcctaagatccactag

SEQ ID NO: 202193 - DNA, 498 bp, Artificial Sequence
  Description of Artificial Sequence: Synthetic coding sequence
atggacgccgagggcctggccctgctgctgccccccgtgaccctggctgcccttgtagattcatggctacgagaagactgcccgggcctgaactacgcagcccttgtgtcaggtgctgggccctcacaggcagctctgtgggctaagtctccaggggtgctggccgggcagcctttcttcgatgccattttcacgcagctgaattgccaggtcagctggttccttcccgagggatcgaagctggtccccgtcgcacgtgtcgcagaggttcgtggtcccgcccactgtttgctgctcggtgagcgagtggccctgaacactctggctcggtgttccggcatcgctagcgctgctgccgctgcagtagaagctgcacgcggggcggggtggactggtcacgtggccggaactcgcaagactacccccgggttcaggttggtggaaaaatatggtctgctggtcggaggagccgcctctcacaggtacgatcttggatag

SEQ ID NO: 202194 - DNA, 2154 bp, Artificial Sequence
  Description of Artificial Sequence: Synthetic coding sequence
atggccgtggccgtgcggaccctgcaggagcagctggagaaggccaaagagagcctgaagaatgtggatgagaatattcgcaagttgactgggcgagatcccaacgatgtcaggccaattcaggcccggctcctggcactgagtggacccgggggtggccggggcaggggatccctgctgcttaggcgcggattctctgactctggaggtggccctccagctaagcagcgggaccttgagggagccgtgtcccggctcggtggtgaacgccgcacccggagggaatctagacaggaatctgatccagaggatgacgacgtgaagaaaccagctttgcagtcttccgtggtagctaccagcaaggaacgaaccagaagagatctgatacaggatcaaaacatggatgagaaggggaagcagagaaaccgccggatcttcggcctgttgatgggcacgttacagaaattcaagcaggaaagcaccgtggccacagagcgccagaaacgccgacaggagattgaacagaaacttgaggtgcaggctgaggaggaaagaaaacaggtagagaatgagcgccgcgagctctttgaggagaggcgagccaagcagactgaactgcgcctgctcgagcagaaggttgagctggcccagttacaggaggagtggaatgagcataacgctaagatcatcaaatacatacgcactaagacaaagccgcatcttttctacattcctggccgcatgtgccctgccacacagaagctaatagaagaatctcagcgcaagatgaacgctttatttgagggcagacgtatcgagttcgctgaacaaatcaacaagatggaggctaggcctcgtcgccaatccatgaaggagaaagagcatcaagtggtccgtaatgaggagcagaaggcagagcaggaggaaggaaaagtcgcccagcgagaagaggagctggaggagactggaaaccagcacaacgacgttgaaatcgaggaagccggggaggaagaggaaaaggaaatcgccattgtgcacagcgacgcagaaaaggagcaagaggaagaagaacagaaacaggagatggaagttaaaatggaagaggaaacagaggtcagggagtccgaaaagcagcaagactcccaaccagaggaggtcatggacgtcctggaaatggtggaaaacgtgaagcacgttattgccgaccaggaggtgatggagactaatagggtggagagtgtcgagccctcagaaaacgaggcttccaaagagctggagccggagatggagttcgaaattgagcctgataaagaatgcaagacactgtctccagggaaagaaaacgtctcggcgctggatatggaaaaggagtctgaagagaaagaggagaaggaatctgagccccagcccgagcccgtggcgcagccccagcctcaatctcagccacagttgcagctgcagagtcagagtcagccagtcctccaatctcagccgccatcgcagcctgaggacctgagcctggctgtgctgcaacccaccccacaggtgacccaagaacaaggacatttgctgccagagcgaaaggacttcccagtagaatctgtaaagctcaccgaggtgcccgttgaacccgtgttgacagtacaccccgagtccaagagcaaaaccaagacaaggtctcggtctcgaggtcgggctcgtaataagacatccaaatcaagaagccgaagcagcagcagcagctcctcctcttcctcttcaacctcctctagctccggatcaagcagctcgtctgggtcatcaagcagccgctcttcctcaagcagctcaagctcaacgagtggaagtagcagcagggatagtagcagttcaacttccagttctagtgagagtagaagcagaagcagaggtcgaggccataacagagaccgaaaacaccggagatcggtggatcggaagaggagggatacgtccgggctggagcgctcccacaaatcatccaaaggcggatcaagtcgggacaccaaggggagtaaggacaagaactcgcgatctgaccgcaagcgctcaattagtgagtcatcaaggtccgggaaacgtagctcgcgtagcgaaagagacagaaagtccgatagaaaagacaaaaggaggtag

SEQ ID NO: 202195 - DNA, 1704 bp, Artificial Sequence
  Description of Artificial Sequence: Synthetic coding sequence
atgcacggccggctgaaggtgaagaccagcgaggagcaggccgaggccaagaggctggaaagggaacagaagctgaagctgtaccagtctgccactcaagccgtgtttcagaaacgccaggcaggggaattggacgagtccgtgttggagctgacgtcacagattcttggcgcaaacccagacttcgcgaccctctggaactgtagacgcgaagtgttgcagcaattagaaacccagaaatctcccgaggaactggcggctctggtgaaggccgaattgggctttcttgaatcttgcctgcgggtgaatcctaaatcctacggtacttggcaccatcgctgttggctacttggccgactgcctgagcctaattggactcgggagttggagctgtgtgcaagattcctggaagtggatgaacggaatttccattgttgggactaccgacggttcgtcgctacacaggccgctgtcccccctgcagaggagctcgcatttacagactccttaatcaccaggaacttcagtaactactcttcctggcactatagaagttgtctgctgccacagctccatccacagccagacagtggcccacagggccggctgcctgaggacgtgctactgaaggagctggagcttgtccagaacgcattttttacagatccaaatgaccagtctgcctggttctaccatagatggttgctggggcgcgcggacccacaggatgccctgagatgccttcacgtttcacgagatgaggcttgcctgactgtgtctttttcaaggccgctgctcgtagggagccgtatggaaatccttcttttgatggtggatgacagtccgctgattgtcgagtggcgcactcccgacggcaggaataggccttcacatgtgtggctctgcgatctcccggcagcatccctcaacgatcagttacctcagcacacctttagggttatctggacggctggcgacgttcaaaaggaatgtgtgctactgaagggacggcaggaaggctggtgcagagactccactaccgatgagcaactgtttaggtgtgagttaagtgtcgaaaagtcaactgtcctgcagtccgagctcgagtcatgcaaagagctgcaggagttggagccagaaaataaatggtgcctacttacgatcattttgctgatgagagccttggatcctctgctgtacgagaaggagacccttcaatatttccagaccctaaaagctgtagatcctatgagagccacatatttggatgatttacgctctaagtttctgcttgagaattcggtgctcaagatggagtatgctgaggtgcgggtgttacacttggctcataaagacctaactgttttgtgccatcttgaacagttgctgctggttacacatcttgacctgagtcacaatcgcttgagaaccctgcctcctgctttggccgcgctccgctgcctggaggtgctgcaggcaagcgataatgctattgaaagtcttgatggggttacgaatctgcctagacttcaggaactacttttgtgtaataaccgcctgcaacagccagctgtcctccagccccttgcatcgtgcccacgcctggtattactgaaccttcagggcaacccattgtgtcaagccgtggggatcctcgaacagcttgcagagctcctaccaagcgtttcatcagttcttacctag

SEQ ID NO: 202196 - DNA, 996 bp, Artificial Sequence
  Description of Artificial Sequence: Synthetic coding sequence
atgggcaccccccagaaggacgtgatcatcaagagcgacgcccccgataccttgctactggagaagcacgctgattatattgcttcctatgggtcaaaaaaggatgactatgagtactgcatgtccgaatacctgcggatgtcgggtatctattgggggctgactgttatggacctaatgggtcagctacatcgtatgaatagagaagaaatcttggcatttattaaatcttgccagcacgagtgtggagggatctccgcgtcaattggccacgatccacatctgttgtacaccctgtccgctgtccagattcttacactgtatgattctattaatgtgatagacgtcaataaggtcgtggaatacgtgaagggcctgcagaaagaggatggatcatttgccggggacatttggggggagattgatacccgcttttccttctgtgccgtggcaaccctggcacttctcggtaaactggatgctattaatgtggaaaaagctatcgagtttgtactgagttgcatgaatttcgatggaggcttcgggtgccgacctggttccgaatcgcatgcaggtcagatctactgctgtacgggcttcctcgccatcaccagtcagttgcaccaggtgaactcagacttgctcggttggtggctgtgtgaacggcagttgccaagcggcgggctcaatgggcggcccgaaaagctccccgacgtctgctatagttggtgggtgctggcttccctcaagattatcggtcgtctgcattggattgacagggaaaagttacgcaatttcatacttgcatgccaagatgaggagactggcgggttcgctgaccgccccggggatatggtcgacccctttcatacactgttcggcatcgcagggttgagcctgctcggcgaagaacagataaagcccgtcaatcctgtgttctgcatgccggaggaggtactacaacgggtcaatgtgcagcctgaactagtgtcctag

SEQ ID NO: 202197 - DNA, 963 bp, Artificial Sequence
  Description of Artificial Sequence: Synthetic coding sequence
atgggcaccccccagaaggacgtgatcatcaagagcgacgcccccgacacattgttactggagaagcatgctgactatatcgctagctatggatcgaaaaaagacgactacgaatactgcatgtctgagtacctccggatgtcaggaatttattggggtctaacagtaatggacctgatgggccagctgcatagaatgaatagagaggagattttagctttcattaagagttgccagcatgaatgtggaggcatttcagcatctatcggccatgatccccatctgctctacacactgtctgcagttcagatcctgaccctatacgactcgattaacgtaattgatgtcaacaaggtagtcgaatatgttaagggcttgcaaaaagaggacggatccttcgccggggacatctggggggaaatagacacccgttttagtttctgcgccgtggccaccttggccctattgggcaagctcgacgccataaacgtggaaaaagcaatcgaattcgtcctatcttgcatgaatttcgatggggggttcggatgtcggcctggaagcgaatcacacgccggccagatttattgttgcacggggttcctggctataacctcacagctgcatcaggtaaatagcgatctgttgggctggtggctttgcgagaggcagctcccctccggggggctcaacggtcgccccgagaagctccctgatgtctgttatagttggtgggtgcttgcctccctgaaaatcatcggcagactccactggatagatcgtgagaagcttcgaaacttcatactggcatgccaggatgaggagacaggcggattcgccgataggccaggcgatatgcatttcatttatcagaactacccgaaaaaagagctgagttctaataaagagaccttgactgaatcgttactgccgcggttagaacgtagctctacgatcagcgcatag

SEQ ID NO: 202198 - DNA, 459 bp, Artificial Sequence
  Description of Artificial Sequence: Synthetic coding sequence
atgggcaccccccagaaggacgtgatcatcaagagcgacgcccccgacaccctcctgttggaaaagcatgctgactatattgcaagctacggaagtaaaaaggacgattatgaatactgtatgagcgagtatttaagaatgtctgggatttattggggactgacagtaatggacctcatgggccagcttcataggatgaacagggaggaaatccttgcgtttatcaaaagttgtcaacatgagtgcggtggcatttccgcttccatcggacacgacccccatcttttgtataccctgtcagccgtgcagatcctgacgctttacgactcaatcaacgtgatcgatgtgaacaaggtggtagagtacgttaaaggcctccagaaggaagacgggtcatttgccggggacatctggggcaacgtacggttctcccctttttatccaaagtaccagtactag

SEQ ID NO: 202199 - DNA, 474 bp, Artificial Sequence
  Description of Artificial Sequence: Synthetic coding sequence
atgaacttcgacggcggcttcggctgccggcccggcagcgagagccacgcgggccagatatattgctgcaccggcttcctagcgattacctctcagcttcatcaggtgaactctgatctgctgggctggtggctctgtgagcggcagctgccttctggaggcctgaatggccgccccgaaaagctccccgatgtctgctacagctggtgggtgctggcgagtttgaagattatcggccggctgcactggatcgacagggagaaactgagaaacttcatccttgcatgccaggacgaggagacaggcgggttcgcagacaggcctggggatatggtggacccctttcatactctctttggaatcgcaggcttgtccctgctgggcgaggaacagatcaaaccagtgaatcccgtattttgcatgccagaggaggttctgcagagggtcaacgtgcagccagaacttgtgtcttag

SEQ ID NO: 202200 - DNA, 1476 bp, Artificial Sequence
  Description of Artificial Sequence: Synthetic coding sequence
atgagcctgaagagcgagcggcggggcatccacgtggaccagagcgacctcctgtgcaaaaaaggatgtgggtactacggtaacccagcgtggcaaggcttctgttctaagtgttggagagaagaataccacaaagcgcgccagaagcagattcaggaagattgggagctggccgaaaggctgcagcgtgaagaggaggaggccttcgcatcctcgcagagctcccagggggcacagagtttgacattttctaagttcgaagaaaagaaaactaatgaaaaaacccgcaaggttactactgtgaagaaattctttagcgccagtagtagagtaggttccaaaaaggaaattcaggaagcaaaagccccaagtccttctatcaatcggcaaacctcaattgaaactgatcgcgtatccaaggaatttattgagtttttgaaaacctttcacaagaccggacaggaaatttataagcaaactaagctgtttctagagggcatgcactacaagcgcgacttgagcatcgaagaacagagcgagtgcgcccaggatttttatcacaatgttgccgagcgcatgcagaccaggggcaaggtacctcccgaaagggtcgagaaaatcatggaccagattgagaaatatattatgacgcgtttgtataagtacgtgttctgtcccgaaactaccgatgatgagaaaaaagacctggccatccagaaacggatcagagccctgaggtgggtcacaccacaaatgctatgcgtgcccgtgaatgaggacatccccgaggtcagcgatatggtggtcaaagcaatcacagatataatcgagatggactccaaacgggtgccacgggataagctcgcatgtattacaaagtgctccaagcacatcttcaacgcaattaagatcaccaagaatgagccggcgtctgccgacgactttctgcccacactgatctacatcgttcttaaaggtaatccgccacggttgcagtctaacatacagtacatcaccagattttgtaaccccagcaggttgatgacaggggaggatggatactactttaccaatctctgctgtgccgtggcatttattgaaaagctcgacgctcagtccttgaacttatctcaggaagattttgacagatatatgtccggtcagacttccccccggaaacaagaggctgaaagctggtctcctgatgcttgtttgggggtgaaacagatgtacaagaacctggatttactgtcccagctgaacgagaggcaggagcgcattatgaatgaggcaaagaaactggagaaagacctcatagattggaccgacggaattgcccgggaagtccaggatatcgtcgaaaagtatcccctggagatcaagccgccaaatcaacctctggcggctatcgattcagagaatgtggaaaacgataaactacctcctcccctgcagcctcaggtttatgccgggtag

SEQ ID NO: 202201 - DNA, 1518 bp, Artificial Sequence
  Description of Artificial Sequence: Synthetic coding sequence
atgatggccagcagctaccacgaggtggtgagccggaagaagatgagcctgaagtctgaacggaggggcattcacgtcgaccagtcagacctcctgtgtaagaagggctgcggctactatggcaatccagcctggcagggattttgtagtaagtgctggcgagaagagtaccacaaggcaaggcagaagcagatccaggaagactgggaattagcagagaggctgcagagggaagaggaagaggcctttgcctcttctcagagctcccagggagcccagtctttaacatttagcaaatttgaagaaaaaaaaaccaacgaaaagacaaggaaggtcacaactgtgaagaaatttttctcagccagctcgcgagtcggaagcaagaaggagattcaggaagcaaaagccccaagtccctccatcaatagacaaacttccatagaaacggatcgggtcagtaaggagtttattgagttcctgaaaacctttcacaagactggccaggaaatttataagcaaaccaagttatttctggaaggaatgcattacaagcgtgatttgtctatcgaagaacagagcgagtgtgcccaggatttctatcacaatgttgcagagaggatgcagactaggggcaaagtcccgccggagcgcgtggagaagattatggatcagatagagaaatacataatgactcgcctttataaatacgtgttctgccctgagaccaccgacgatgagaaaaaggatctcgcaattcagaaacggatcagggctctccgatgggtgaccccgcagatgctttgcgttcccgtgaatgaagatattccagaagtaagtgatatggtggtgaaagccatcaccgacatcattgagatggattccaagagagttccgcgggataagctggcttgcatcaccaaatgttctaaacacattttcaatgcaataaaaatcaccaaaaacgagccggccagtgctgatgacttcctgccgactctgatttacatcgtgctgaaaggcaatcctccgcggctccagtcaaatattcagtacataacacggttttgcaatccatccagattgatgactggcgaagacggctactacttcactaacctgtgttgtgctgtggccttcattgaaaagctggacgctcagtcattgaacctcagccaagaagattttgatcgctatatgtcaggtcaaacgtccccgcgaaaacaggaggctgaatcatggagcccggatgcatgcctcggtgtaaagcagatgtacaagaacctcgacctgctgtcccagttgaacgaacggcaggagaggattatgaacgaagccaagaaactggagaaggatctaatcgactggactgatggaattgccagggaagtccaggacattgtcgagaaataccccttagaaattaagccacctaatcaaccgcttgccgcaatcgattccgagaatgtcgagaatgataagctccccccacccctccagcctcaagtgtacgccggctag

SEQ ID NO: 202202 - DNA, 138 bp, Artificial Sequence
  Description of Artificial Sequence: Synthetic coding sequence
atgagcctgaagagcgagcggcggggcatccacgtggaccagagcgatcttctctgtaaaaagggctgcggttactatgggaaccccgcttggcagggcttttgctcaaagtgttggagagaagagtatcataaatag

SEQ ID NO: 202203 - DNA, 1476 bp, Artificial Sequence
  Description of Artificial Sequence: Synthetic coding sequence
atgagcctgaagagcgagcggcggggcatccacgtggaccagagcgacctgctgtgcaagaaaggatgcggctactacgggaatcccgcttggcaaggcttctgtagcaagtgctggcgggaggaatatcacaaagcacgccagaagcagatacaagaagattgggaactcgcggagcgcctccagagagaggaagaggaggcgttcgcctcctcgcagagcagtcagggcgcgcaaagcttgacattctccaaatttgaggagaagaaaacaaacgagaagacacgtaaggtgactacggtgaaaaaatttttctcagctagcagccgggtgggtagcaaaaaagagatacaagaagcgaaggctcccagcccttcaattaaccgccagacatctattgaaaccgatcgggtcagtaaagagttcatcgagttcctgaagaccttccataagacaggccaggagatatacaaacagactaaactgtttctggaaggaatgcactataagcgagacctgtccatcgaggagcagagtgagtgcgctcaagacttctaccacaacgtggccgagagaatgcagactcgcggcaaggtgcctcctgagagggtggaaaaaatcatggaccagatagaaaaatatattatgacacgactctacaagtacgtattttgtcccgagaccacagacgatgaaaagaaagacctcgccatacagaagcgtatcagagctcttcgttgggtgaccccacagatgttatgcgtcccagtgaatgaggacattcccgaggtgagcgatatggtagtaaaggctattactgatattattgaaatggattccaaacgcgtgccaagagataagctcgcttgtatcaccaagtgctctaaacatattttcaatgccattaaaatcacgaagaacgagcccgccagcgcagacgatttcttacctacccttatctacatcgttctaaaaggaaatccccctaggctccagagcaatattcaatacatcactaggttctgtaacccatcaaggctgatgactggagaggatgggtattatttcacaaatctctgctgtgccgttgcctttattgagaagctcgatgcacagtccctgaacctctcacaggaagatttcgatcgctatatgtcgggccaaacaagcccgagaaagcaggaagccgagtcatggagcccggacgcctgccttggcgtcaaacagatgtacaaaaatcttgatctgttgtcccaactgaatgagcgacaagagagaatcatgaatgaggcaaagaagttagaaaaggacctgattgactggactgatgggatagcacgggaagtgcaagacattgtagaaaagtaccctctggagatcaagccccccaatcaacccttagccgccatcgactccgagaacgtggagaacgataaattacctccaccactgcagccacaggtgtacgcaggttag

SEQ ID NO: 202204 - DNA, 372 bp, Artificial Sequence
  Description of Artificial Sequence: Synthetic coding sequence
atggagcccgccgagcagcccagcgagctggtgagcgccgagggccgcaatcggaaggccgtgctatgccagagatgtggcagcagggtgctccagcccgggacggccctgttcagtagacgtcagctattcttaccatcgatgcggaagaagccggcactttcagatggaagcaatcctgatggcgatctactacaggaacactggctcgttgaagacatgttcatatttgagaacgtgggcttcaccaaggatgtggggaacataaaatttctggtgtgcgctgattgcgaaatagggcctatcgggtggcactgcctggacgacaaaaactctttctacgtggccttggaaagagtgagtcacgaatag

SEQ ID NO: 202205 - DNA, 1206 bp, Artificial Sequence
  Description of Artificial Sequence: Synthetic coding sequence
atggagccccggcgggccgcccccggcgtgcccggctggggcagccgcgaggctgccggctctgcttcagcagctgagctggtgtatcacttggcaggggccctgggtaccgaactgcaggacctggctaggaggtttggtccagaagcggccgccggattagtgcctcttgtcgtgcgggctctggaacttctggagcaggccgccgtcggcccagcgcccgactctctgcaggtaagcgctcagcccgccgagcaagagctacggaggctaagggaggagaacgagaggctgcgccgcgagctcagggcaggaccacaagaggagcgagccctactgagacagctaaaggaagtcactgacaggcagagggatgaactccgcgcccataaccgggacctcagacaaagaggccaggaaactgaggccctgcaggaacagttgcaaagactgctattagtgaacgcggagctgcggcacaagttggctgcaatgcaaacccagttacgcgctgcccaggacagagagagggagaggcagcaaccaggtgaagcggccacccctcaggcaaaagaaagggctcgtgggcaggccggccggcctgggcaccagcacggccaagagcctgagtgggccaccgctggtgccggcgcaccaggcaatcctgaggaccccgccgaagccgcccagcagctgggaaggccttctgaggccggccagtgcagattttcgcgcgaggagttcgagcagatccttcaagagcgaaatgagctgaaggcgaaggtcttcctacttaaggaagagttggcatactttcagagagagctgctcaccgatcatagagtgcccggactgctgctggaagccatgaaggttgccgtgaggaaacagagaaagaagatcaaagccaaaatgctgggtacacccgaagaggccgagagttcagaagacgaggctggtccttggattctgctgagcgacgacaagggtgatcatcccccaccccccgaatccaagattcagagctttttcggactgtggtatcgggggaaagcggagtctagtgaagacgagacaagttccccggcgccaagcaaacttggcggggaggaggaagcacagccccagtcccccgctcccgacccaccatgtagcgcacttcacgagcacctgtgccttggagctagcgccgcccccgaggcctag

SEQ ID NO: 202206 - DNA, 1212 bp, Artificial Sequence
  Description of Artificial Sequence: Synthetic coding sequence
atggaggaggagcggggcagcgccctggccgccgagagcgccctggagaagaatgtggccgagctgacagtaatggatgtatacgacatcgcgagcttggtgggacacgagtttgaaagagtgattgaccagcacggctgcgaggcgatagctcggctgatgcccaaggtggtgcgcgttctggagattctcgaggtcctggtgagccgccaccacgtggccccagaactggatgaactccggttggaattggatcgccttaggcttgagcgtatggatagaatcgagaaagaaaggaaacatcagaaggagcttgagctggtggaggatgtgtggcggggtgaggcacaggatctgctcagtcaaatcgcccagctccaggaggagaacaaacagttaatgaccaatctgagtcacaaagacgtaaacttctcggaagaggagttccagaagcacgagggaatgagtgagagggaaaggcaggttatgaaaaagctaaaggaggttgtcgataaacagagggatgaaatccgcgctaaggaccgcgagctgggtctgaaaaacgaagacgtggaagccctgcagcagcaacaaacgcgcctgatgaaaatcaaccacgatcttcgccatagagtgaccgttgtagaggcccagggcaaggcgctgatcgagcagaaggtcgagttggaagcagatcttcagaccaaagagcaggaaatgggttctctgcgtgcagagctcggcaagctgcgcgaacgactccagggcgaacactcccagaacggtgaggaggagcctgaaacagagcctgtgggggaagagagcattagcgacgccgagaaagtggcaatggaccttaaggatccgaatcggcccaggtttactcttcaggagctcagggatgtgcttcacgagcgcaacgagctgaagagcaaggttttcctgctacaggaggagcttgcatactataaaagcgaggaaatggaagaggaaaatagaatcccgcagccgccgccgatagcccatccaaggaccagcccacagcctgaatctggtattaagaggctattctcgtttttttcaagggataaaaagagactggccaatacccagcgtaatgtgcacatccaggaaagctttggccagtgggcaaacacacatagggatgatggatataccgaacagggccaggaggcactgcaacacctttag

SEQ ID NO: 202207 - DNA, 636 bp, Artificial Sequence
  Description of Artificial Sequence: Synthetic coding sequence
atggaggagccccccgtgcgggaggaggaggaggaggagggcgaggaggatgaggaacgtgacgaagtgggccctgagggcgcccttggcaagtccccgttccagctgaccgctgaggacgtgtatgatatttcctatctgctggggagagagcttatggccctgggaagtgatcctcgtgtcactcagctccaattcaaagtcgttagggtgctcgagatgctggaggctctcgttaacgagggatccctggctttggaagagttgaaaatggagcgtgaccacctccgaaaagaagttgagggcctccgccgccagtccccaccagccagcggagaagttaatctcggacccaacaagatggtcgttgacctgaccgatcctaacagacctcgctttaccctgcaagagctgcgagacgtgctgcaggaaaggaataagctcaaatcacaactgctcgtggttcaggaggaactgcagtgttacaagagcgggttgatcccccctagagaggggcccggaggccgccgcgagaaggacgcagtggttacgtctgctaagaatgcagggagaaataaggaagagaagaccattatcaagaagttgttcttctttcgctctggaaagcagacatag

SEQ ID NO: 202208 - DNA, 717 bp, Artificial Sequence
  Description of Artificial Sequence: Synthetic coding sequence
atggccgaggacaagaccaagcccagcgagctggaccagggcaagtacgatgccgatgacaacgtcaaaattatctgtttaggagattcagccgttggcaagtctaagctcatggagcgctttttaatggacggattccagccacagcagctgtccacgtatgctctgaccttgtacaaacataccgcaactgtggacggccgcactattctggtggacttttgggatacagctggacaggagcggtttcaatccatgcatgccagctattaccataaggcgcacgcctgtattatggtgtttgatgtgcagcgcaaggtgacttacagaaacctctctacatggtacaccgagctacgcgagttccgcccagagatcccatgtatagtcgtcgcaaacaaaatcgatgacatcaatgtgacccagaaaagctttaactttgccaagaagttcagcctccccctgtacttcgtgtccgccgccgacggcacaaatgttgtcaaagtgtggttgacggctgaagtggctagtaagctttttaacgatgccatccggctggcggtgagttacaagcagaactcgcaagatttcatggatgagatctttcaggagctcgaaaacttttccctcgaacaggaggaagaggatgtgcctgatcaggagcagtccagcagcattgaaacaccttccgaggaggcggcttctcctcacagctag

SEQ ID NO: 202209 - DNA, 498 bp, Artificial Sequence
  Description of Artificial Sequence: Synthetic coding sequence
atggccgaggacaagaccaagcccagcgagctggaccagggcaagtacgacgccgatgacaatgttaagatcatatgcttgggggacagcgccgtcggcaagtctaaactgatggaaaggttcttgatggatggctttcagccccagcagctgtccacctatgcgctcacattatataaacataccgcaactgtcgacggaaaaacaatcctcgtcgctgacattaacgttacccagaaatccttcaattttgcgaaaaagttcagcctgcctctgtacttcgtatctgccgcagatggcactaatgtagtgaagctcttcaacgatgccattcgactggcggtcagctataagcagaactcccaggacttcatggatgaaatcttccaggaactggaaaacttttctcttgaacaggaagaggaggacgtgccagatcaagagcaaagttcatccatcgaaacaccgtcggaagaagttgcaagcccccatagttag

SEQ ID NO: 202210 - DNA, 690 bp, Artificial Sequence
  Description of Artificial Sequence: Synthetic coding sequence
atggccgaggacaagaccaagcccagcgagctggaccagggcaagtatgacgctgacgataatgtaaaaataatttgtctcggagactccgctgttggcaagagcaagttgatggagcgcttcctgatggatgggttccagccccaacagctttcaacatacgcgctgacactatacaagcatacagccacagtggatggaaagactatccttgttgacttctgggataccgcaggacaagaacgttttcaatctatgcatgcttcttattaccacaaggctcacgcttgcatcatggtcttcgacattcagcgcaaggtgacttacaggaatctttccacctggtacaccgagttgcgggaattccgtccagagattccatgcattgtggttgcaaacaagatcgatgcagacattaacgtgactcagaagtccttcaacttcgccaaaaagttttcactgccactgtattttgtgagtgccgctgacgggacaaacgtggtgaaactgtttaatgacgccattcggctggctgtctcttacaagcagaattctcaggatttcatggacgaaattttccaggaactggagaatttctctctggaacaggaggaggaagacgtgcctgaccaggagcaatcctcaagtatcgagacgccttccgaggaggtcgctagcccccatagctag

SEQ ID NO: 202211 - DNA, 687 bp, Artificial Sequence
  Description of Artificial Sequence: Synthetic coding sequence
atggccgaggacaagaccaagcccagcgagctggaccagggcaagtacgacgccgatgataacgttaaaataatctgtctgggcgacagtgctgtgggaaaatcgaagctcatggagcggtttctgatggacggtttccaacctcagcagctctcgacttacgcgctgacactatacaagcacaccgcaaccgttgatggtaaaactattctggtggacttttgggacacggcgggtcaggagagatttcaaagcatgcacgctagttattatcacaaggcccacgcctgtatcatggtttttgatatccagcgaaaggtgacctatcggaatttgagtacctggtacaccgagctccgagagtttagacctgagatcccctgtattgttgtcgctaataaaattgatgacataaatgtgactcagaaaagcttcaattttgccaagaaattcagtctgccattatattttgtgtcagcagctgatgggaccaacgtggtcaaactatttaatgacgctataagactggctgtttcctataaacagaactcacaagactttatggacgagatcttccaggaactcgaaaatttctctttagagcaggaagaggaggatgttccagaccaggagcagagtagctccatagagactccgagcgaggaggtcgcgtcaccgcacagttag

SEQ ID NO: 202212 - DNA, 687 bp, Artificial Sequence
  Description of Artificial Sequence: Synthetic coding sequence
atggccgaggacaagaccaagcccagcgagctggaccagggcaagtacgacgccgatgacaatgtgaaaattatttgtctgggggactcagcagtcgggaaatccaagcttatggagagatttctgatggacggctttcaaccccagcaactgtcaacttacgctctgactttgtataagcacacggcaacagtcgatggcaagactatcctggtggacttttgggatactgccggccaggaacgtttccagtctatgcatgcatcatattatcacaaagcgcacgcttgtataatggtgttcgatatccagagaaaagtgacttatcggaatctctcgacctggtatacggaattacgagaattcagacctgagatcccatgtatagtcgtcgccaacaagattgacgacatcaatgtgacccagaagtcattcaatttcgccaagaagtttagcctgccactgtacttcgtttcagccgcagacggaacgaatgttgtgaaactgtttaacgacgcaattcgtcttgccgtaagttacaaacagaattcgcaggatttcatggacgaaatctttcaagagctcgagaacttcagcctggaacaggaggaagaagatgtgccggaccaggagcaaagctctagcatagaaacaccaagtgaagaagttgcctctcctcatagctag

SEQ ID NO: 202213 - DNA, 717 bp, Artificial Sequence
  Description of Artificial Sequence: Synthetic coding sequence
atggccgaggacaagaccaagcccagcgagctggaccagggcaagtacgatgcagatgataatgttaaaattatatgcctgggcgactctgccgtgggcaaatccaagctgatggagcggttcctgatggatggtttccagcctcagcagctcagtacctacgcgctaaccttatacaaacacacggcaactgttgacgggaaaaccatcctcgtcgacttttgggacacagccggtcaggaacgcttccagtcgatgcacgccagttattatcataaggcccatgcgtgtatcatggtgtttgacattcagaggaaagtgacatatcggaatttaagcacatggtacacggagctgcgcgaattcaggcctgaaattccttgcatcgtggtcgctaataagattgacgatataaatgtgacgcagaaatcctttaacttcgccaagaagttttcactacctctgtacttcgtctccgcagcggacgggacaaacgttgtaaaagtgtggctgaccgctgaggtggccagtaaattgtttaacgacgccattagactggcagtgtcatacaaacaaaattcacaggactttatggacgaaatcttccaagagctcgagaattttagcctggaacaggaagaggaagatgttccggaccaggaacagtcttctagtattgaaaccccgtcggaagaggtggcaagccctcatagctag

SEQ ID NO: 202214 - DNA, 345 bp, Artificial Sequence
  Description of Artificial Sequence: Synthetic coding sequence
atggccgaggacaagaccaagcccagcgagctggaccagggcaagtatgatgcggacgataatgtgaagatcatatgcctgggagattcggccgttggcaagagtaaattgatggagaggttccttatggacgggtttcaaccacagcagctctctacctacgcacttacgttatataagcacactgccacagtggatgggaagacaatccttgtggatttttgggacaccgcggggcaggagcgctttcagtccatgcacgcttcatactaccataaggcacacgcctgcattatggtgtttgacattcagagaaaggttacatatcgaaacctcagcacgtag

SEQ ID NO: 202215 - DNA, 306 bp, Artificial Sequence
  Description of Artificial Sequence: Synthetic coding sequence
atggccgaggacaagaccaagcccagcgagctggaccagggcaagtatgatgccgacgacaacgtgaaaattatttgcctcggcgattcagcggtgggaaaatcaaaattaatggaacggttcctgatggatgggttccagcctcaacaactatctacatacgccctgacactctataaacatactgcaactgttgacggaaagaccatcctggtggacttttgggatactgccgggcaggagaggtttcagtcaatgcatgcttcatattaccacaaagctcacgcctgcatcatgcagacctag

SEQ ID NO: 202216 - DNA, 690 bp, Artificial Sequence
  Description of Artificial Sequence: Synthetic coding sequence
atggccgaggacaagaccaagcccagcgagctggaccagggcaagtacgatgccgacgacaatgtaaaaatcatatgcctgggggatagtgctgttggaaagagcaagctgatggaaagattcttgatggatggctttcaacctcagcaattgtccacttatgccctaacattgtacaagcataccgcgaccgtggatggaagaaccatactggtcgatttttgggatacagctggacaggaacgcttccaatcgatgcacgccagttattaccacaaggcccatgcatgtatcatggttttcgatgtgcagcgaaaggtaacatatcgcaatctgtctacatggtacacagaactgcgagagtttagacccgaaattccgtgcattgtggttgcaaataaaatagatgctgacatcaatgtgactcagaaatctttcaactttgccaagaaattctccttgcccttatatttcgtctctgcagctgacggaaccaacgttgtcaaattgttcaatgatgcaattcggctggccgtgtcctacaaacagaacagtcaggactttatggatgagattttccaggagctggaaaatttctctttggagcaggaagaagaggatgtccccgatcaagaacagtccagcagtattgagaccccgtcggaggaggccgcctcgccgcactcttag

SEQ ID NO: 202217 - DNA, 690 bp, Artificial Sequence
  Description of Artificial Sequence: Synthetic coding sequence
atggccgaggacaagaccaagcccagcgagctggaccagggcaagtatgatgccgacgacaacgttaagatcatctgcctcggagactcagccgtagggaagagcaagttgatggagagattcctgatggacggttttcagcctcaacagctgagcacttacgctctcaccctttacaaacataccgctactgttgacgggcgaactatcctggttgacttttgggacaccgctgggcaggaaagatttcagtctatgcacgcttcgtactatcacaaggcgcacgcatgcataatggtgttcgatgtgcagcgaaaggttacttatagaaacctgtcaacttggtatacagagcttcgagaatttagacccgaaatcccctgtattgtggtagctaataaaatcgacgcagacattaatgtgacacagaaaagctttaacttcgctaaaaagttctctctcccactgtattttgtcagtgcagccgatgggacaaatgtcgttaagctctttaacgacgccattcgtctggccgtgtcctacaagcagaatagtcaggactttatggatgaaatcttccaggaactcgaaaatttctccctggaacaggaggaggaagacgtaccagaccaggagcaaagtagtagcatcgagacaccctccgaagaagctgcctccccccactcctag

SEQ ID NO: 202218 - DNA, 687 bp, Artificial Sequence
  Description of Artificial Sequence: Synthetic coding sequence
atggccgaggacaagaccaagcccagcgagctggaccagggcaagtacgacgccgatgacaacgtgaaaattatctgtctaggggatagcgcagtcggcaagtccaaactgatggaacgcttcctcatggacgggttccagccccaacagttatccacgtatgcactgacactgtataagcacacagcaaccgtggatggaaggaccattctggtcgatttttgggataccgctggccaggagaggttccaatcaatgcacgcctcgtattatcacaaggctcacgcatgcattatggtattcgatgtccagcgcaaggtgacctatagaaatctctcaacctggtatactgagcttagagagtttcggccagagataccttgtattgtcgtagctaataagattgatgacatcaatgtcacacaaaagagcttcaactttgccaaaaagttcagcttgcctctgtattttgtgtcagcagccgatggtacgaacgtagtgaagctttttaacgacgctataaggctcgccgttagctacaagcagaactctcaggacttcatggacgaaatctttcaggaactggagaacttttccctggaacaggaagaagaagatgttcccgatcaggagcaatccagttcaatcgagaccccaagtgaggaagcagcatcaccacactcctag

SEQ ID NO: 202219 - DNA, 63 bp, Artificial Sequence
  Description of Artificial Sequence: Synthetic coding sequence
atggccgaggacaagaccaagcccagcgagctggaccagggcaagtacgacgccgacgattag

SEQ ID NO: 202220 - DNA, 687 bp, Artificial Sequence
  Description of Artificial Sequence: Synthetic coding sequence
atggccgaggacaagaccaagcccagcgagctggaccagggcaagtatgacgcggacgacaacgtcaaaattatttgcctgggtgattctgccgtggggaagtctaaactcatggaacgtttcttgatggacggattccaaccacagcagctctctacctacgcgctgaccctttataagcatacagccaccgtcgatggccgaacaatcctggtagacttctgggatacagccggtcaggaaaggtttcaaagcatgcacgcctcctactatcataaggcgcacgcatgcattatggtgttcgacgtccagcgaaaggtcacataccgtaacttgtcaacctggtacacagagttgcgtgaattcaggcctgagataccatgtatcgtggtggccaacaagatcgacgatatcaatgtgacgcagaagtcattcaactttgctaagaagttttctttacccctatatttcgtctcagctgcagatggtaccaatgtggtcaagctgttcaacgatgctataaggttagccgtgtcatacaagcaaaattcccaggatttcatggacgaaattttccaggagctggaaaatttcagtcttgagcaagaggaggaggacgtcccggatcaggagcagtcatcctccattgagacaccctctgaagaggccgcatctccacatagctag

SEQ ID NO: 202221 - DNA, 603 bp, Artificial Sequence
  Description of Artificial Sequence: Synthetic coding sequence
atggccaagaagacctacgacctgctgttcaagctgctgctgatcggggatagtggagtggggaaaacttgtgtgttgttccgcttttctgatgatgcttttaatacaacatttattagcacaatagggattgacttcaagatcaagaccgtggagttacaaggaaagaagatcaaacttcagatttgggatacggccgggcaagagaggtttcacacaatcactacgtcgtattatagaggggcaatgggtattatgttggtgtatgatattacgaatggtaaaagtttcgagaacatttccaagtggctgcgcaatattgacgagcatgccaacgaagatgttgaacggatgctcctgggaaacaagtgtgatatggacgacaagagggttgtccccaaaggtaaaggggaacagatagcccgagagcatggaatacgtttcttcgagaccagcgccaaggccaacatcaacatcgagaaagcctttttaacgttggcagaagacatccttcggaaaactcctgttaaggagccaaatagcgaaaatgtggatatttcaagcggaggcggagttacagggtggaaatccaaatgctgctag

SEQ ID NO: 202222 - DNA, 1950 bp, Artificial Sequence
  Description of Artificial Sequence: Synthetic coding sequence
atgagcctgatggtgagcgccggccggggcctgggcgccgtgtggagtccgacccatgtacaagtgaccgtcttgcaagctagagggctgagggcaaaaggacccggaggaaccagtgacgcgtatgccgtcattcaggtcgggaaggaaaagtacgcgactagtgtttccgagcggagcctcggtgcccctgtgtggagggaggaagcaacatttgagcttccgtcattgctgagctcagggcctgccgccgctgccactctccaactgactgtcctacatagggctttgctgggcctggacaaatttttaggcagggccgaagtcgaccttagagatctgcatagagatcagggaagacgtaagacccagtggtacaaactaaagtccaaaccgggcaaaaaagacaaggagcggggcgagatcgaggttgacattcagtttatgagaaacaatatgactgcgagcatgttcgacctgagcatgaaagataaaagccgcaatccttttggcaagctcaaggataagatcaaagggaagaacaaggactccgggagcgataccgcgagcgcgatcatcccaagtaccaccccttcagtggactccgacgatgagtccgtcgtaaaagataagaaaaagaaatctaagattaaaacactgctgtccaagtccaatttgcaaaagacaccactttctcagagtatgtccgtgttgcccacttcgaagccagagaaagtccttctcaggccgggagatttccagtctcagtgggacgaggacgacaatgaagatgaatcctcaagcgcttcagatgtcatgtcacacaagcgtacggcctctactgacctgaaacagctgaaccaggtgaacttcacactgcccaagaaggaagggcttagttttctgggggggctgaggtctaagaacgatgtcctttctagatcgaatgtttgcataaatgggaatcacgtgtacctggaacagcctgaagcaaaaggcgaaatcaaggactcctcaccgtctagctcaccgtcgcctaaaggcttcagaaaaaaacacctgttcagttctactgaaaacctggccgccggaagctggaaggaacctgcagaggggggggggcttagttccgataggcagctctctgaaagctccaccaaggacagcctaaagtcaatgacattgccaagctacagacccgcgcctctcgtatcaggcgatctccgagaaaacatggcaccggctaattcggaagctacgaaggaagccaaggagtctaagaaacccgagagtcgtcgtagctccttgctttccctcatgacgggtaagaaagacgtggccaaaggctctgaaggcgagaatccactgactgtccccggtcgtgaaaaagaaggaatgctaatgggagttaagccgggggaggacgccagtggacctgcagaggatctggtaagacgttccgaaaaggacacagctgccgtggtatcacggcaaggatcaagtctaaatctctttgaggacgtgcagattaccgagccagaggccgaaccagagtcaaaaagcgaaccgcgtccccctatatctagcccaagggccccacagacccgtgccgtgaagccccgccttcatccagtcaaacccatgaacgctatggcaaccaaggttgcgaattgcagcctgggcacggctacaatcatctcagaaaacttgaataatgaagttatgatgaagaaatatagcccatcggatcctgcatttgcatatgcccagcttactcatgatgagctcatacagctcgtactcaagcagaaagagaccatcagtaaaaaagaattccaggtgcgggaactcgaggactacattgataacctcctcgtgcgagtgatggaagagacacctaatatactgagaatacccacccaggtggggaagaaggccgggaaaatgtag

SEQ ID NO: 202223 - DNA, 3852 bp, Artificial Sequence
  Description of Artificial Sequence: Synthetic coding sequence
atgagcctgatggtgagcgccggccggggcctgggcgccgtgtggagcccgacccacgtgcaggtcacagtcctgcaggcgagggggctgcgagcaaagggccctggcgggacgtctgatgcctacgctgtgattcaagtaggtaaggaaaagtacgccactagcgtgtctgaacggagtcttggtgcaccggtctggagggaggaagctacatttgaacttccaagcctcctgagctccggccctgcggctgccgctactctgcagctaaccgtgctccacagggcactccttgggcttgataagttcctgggacgagcggaggttgacctgagggatcttcaccgcgatcagggaaggcgcaaaacccagtggtataaactaaagtccaagcctgggaagaaggataaggagaggggtgaaattgaagtcgatatccagtttatgcgcaacaacatgacagcgtcaatgttcgatctgtctatgaaagataagagcaggaatccctttggcaagttgaaggataagattaagggaaagaacaaggacagcggatcagacacagcgtctgccattatccccagcaccacgccctctgtcgattctgacgacgagtccgttgtcaaagacaagaaaaagaaatccaagatcaaaaccttgctgtccaaaagcaacttacagaagacgccactcagtcagtccatgagtgttctgcccaccagcaaaccggaaaaggttctgctcagacctggggactttcagagccagtgggatgaagacgataacgaagatgaatcatcgtccgcatctgacgtaatgtctcacaagcgcacagcatccactgaccttaagcaactcaaccaggtgaactttacattacctaagaaagagggtctttcattcctcgggggtctaagaagcaagaatgacgtgctgtcacgttccaacgtctgcataaatggtaatcacgtctatctggaacaaccagaggctaaaggcgagattaaggacagcagtccatcctcttccccaagtcctaaaggtttccgcaagaaacatctgtttagcagcaccgagaatctggcagctgggagctggaaggagccggccgagggagggggactctccagcgatcgacagctgtctgagtcctccacgaaggactccctgaaatccatgacactaccctcctaccgccccgctcccctcgtatctggcgatttgagggagaatatggccccggccaatagtgaggccaccaaggaggcgaaggaaagcaagaaacctgagtcacggaggtccagcttgctgtctctgatgactggtaaaaaggatgtggctaaaggatccgagggcgaaaatccacttactgtgccaggcagagaaaaagaggggatgctaatgggagtgaaacctggcgaagatgctagcggccctgccgaggacttggtaagaagatcagagaaagataccgcggccgtcgtcagccggcagggatccagtctcaacctgtttgaagatgtgcaaatcacagaaccggaagcagaacctgaatctaagagtgaacctcgaccaccgatttcttctcctagggcgccccagactagggccgtaaagcccaggttagaagtgtctcccgaggctcagcccaccgcacggctgccctctccaaccgattccccctcaagccttcccccactgccctcctcatctggccaggcttccgttcctagtgagctggggcatggagcggacacacagtcatcagagtctccttctgtgttttctagtttatcttcacctatagcagccccaatctctacgtccacaccaattgagagctggcctctcgtggaccgcggccaggctaaatcagagggaccacccctgttgcctaaagctgagttgcagacagagtctttgacgcccgtgccaaactccgggagctccgctttgggtagcctgttcaaacaaccatcattccctgccaacaaaggcacggaagacagtctgatggggcgtacccgggagaccggaacagagaagaatacaagtagtcttgaacttgaagaaagccttccggaacaacctgaaaccggccgtcaggaagaggagcttccaagattcccatgcaagaaacaggactattcaccctcctccggtgaggctcaagaagtgccattcgccctctctcttagctctgacggagcagtgtcccctgtgggcgaactcgccgcaggaggcgaccgggacctagagagtcaggcaggatctctggtggaaagcaaagcgcgggatgcggcagaggaggtggctccacccctcccaatgggggcatcagtgccgagtatcgacagtatgatgagaaagctggaagaaatgggattaaacctgcgcaaggaccaaaagaagactaaaaagcgggtatctttttctgagcagctgttcacagaagaggccgttgcgggagcagccttattggtcgagggccattcttcgtgccctcaggagctgaacccagcttggagcgtggccggcaacgcatcagacggtgagccacccgagagcccacacgctgaggattccgaacgggaatccgtcaccactccagggcccgcaacctgcggagcccccgcctcccccgcagaccatctgttgcttccctcccaagaggagagtttctcggaggtgcctatgagtgaagcaagcagcgcaaaggacaccccgctgtttcgaatggaaggggaggacgctctggttacccaataccagagcaaggcaagcgaccacgagggcctcctgagtgacccactctccgaccttcagctcgtttctgacttcaagagccctatcatggccgatctgaatctgtctctgccaagtataccagaggttgctagcgacgacgagaggattgatcaggtcgaagacgacggggaccaagtggaagatgacggggaaaccgctaaaagctcaacccttgatatcggggccctgtctctgggcctggtcgtgccttgcccggagagaggaaaaggaccttcaggcgaggcagaccgattagttctcggagaggggctgtgcgattttcgcctccaggcccctcaggcctccgtgaccgctccttctgagcagaccacggagttcgggatccataagccccatcttgggaagtcaagctccctggataagcaattgcccgggccttcgggaggtgaagaagagaagcccatggggaatggatcaccaagtcctcctcctgggacatcactggataatccagtgccttctccgagtccaagcgaaatattcccagttacgcatagttttcctagttcagcgcacagcgatacgcaccacacctctacggcagagagccagaagaaagccaccgccgaaggctctgccggtcgtgtggagaacttcgggaaaagaaaaccattactgcaggcatgggtgagtccatcagagacacaccccgtgagcgcccaacccggggcaggaactggaagcgcaaagcatcggctccaccctgtgaagcccatgaatgctatggccacaaaagtcgcaaactgctcactgggcactgctacaattatcagcgagaacctgaacaacgaagtcatgatgaagaaatactccccttcagatccagcttttgcttacgcacaattgacccacgacgagttgatccaactcgtcctaaagcagaaggagacgatatccaagaaagaattccaggtcagagaactggaggattatatcgataacttgttggtcagggtcatggaggaaactcccaacatactgcgcatccccactcaggttggaaaaaaggctgggaaaatgtag

SEQ ID NO: 202224 - DNA, 429 bp, Artificial Sequence
  Description of Artificial Sequence: Synthetic coding sequence
atgagcctgatggtgagcgccggccggggcctgggcgccgtgtggagccctacacatgtgcaggtcacagtgctgcaggctcgcggcctgagagccaagggccctgggggcacgagtgatgcttacgcggtgattcaggttgggaaggaaaagtatgcaacctctgtgtctgagcgctcgctgggtgctcccgtgtggagggaggaagccacattcgagcttccaagcctgctgagcagcggacccgcggctgcagcgactctgcagcttaccgtgctgcacagggccttgctcggtctggataaattcctagggcgggcagaggtagacttgcgggacttgcacagagacctgggaaaaagtttcttcaagacattaaagaagagagcctgggctatttttctaagactctgcttgaagaaaaattag

SEQ ID NO: 202225 - DNA, 1320 bp, Artificial Sequence
  Description of Artificial Sequence: Synthetic coding sequence
atgcggaacaacatgaccgccagcatgttcgacctgagcatgaaggataaaagcagaaatcccttcggtaagctgaaagataagatcaaaggaaagaacaaggatagcggtagcgacactgcctcggccataattccatctaccactccctccgttgatagcgacgacgaaagcgtggtgaaagacaagaagaaaaagtccaagatcaagaccctcctgagcaaatcaaatctccagaagacccccttgtcccaatctatgagcgtgcttccgacttctaaaccagagaaagtcctattacgacccggggacttccagtctcagtgggatgaggatgataacgaagatgagagctcttccgcttctgatgtgatgtcccataaaaggacagcaagcaccgatctgaagcagctgaatcaggttaacttcacattgcctaagaaagaaggcctaagttttctagggggcctcaggagcaagaacgatgtcctgtctagatccaacgtctgcataaatgggaaccatgtgtatctggaacagccagaagctaagggcgagataaaggacagctctccctcctccagcccctcccccaagggttttagaaaaaagcacctgttctcatcgacagaaaacctggccgcaggtagttggaaggaaccggctgaaggcggcggactgtcatccgaccggcagctttcggaatcatcaaccaaggacagcctaaagtcaatgactctcccttcttatcggccagccccgcttgtgagtggcgacctccgcgagaacatggcacccgccaatagtgaggccacgaaagaggccaaagagtccaaaaagcccgaatcccggcggagttcccttctgtctctgatgacaggcaaaaaagacgttgccaaggggtcagagggagaaaacccgctcaccgtccccgggagggagaaggagggaatgctaatgggcgtgaagcctggcgaggacgcgtccggcccagctgaagatttggtccgacggtccgagaaggatacagccgccgttgtatctcgccagggctcctcgttgaatctcttcgaggacgtccagataacagaacctgaggcagagcccgagagcaagagcgagcctcggcctccaatcagttctcctcgagcgccccagactcgtgctgttaaaccacgcttgcatccggtgaagcctatgaatgcaatggccacgaaggtcgctaattgctcattaggaacagcaactattatctcagaaaacttaaacaatgaggttatgatgaaggtctgtcccctgcggtcctggtgtgttcggtag

SEQ ID NO: 202226 - DNA, 1539 bp, Artificial Sequence
  Description of Artificial Sequence: Synthetic coding sequence
atgatgctgagcgagcaggcccagaagtggttccccacccacgtgcaagtcaccgtcctgcaggctaaggacctgaaacccaagggaaagtcaggcaccaacgacacctatactatcattcaattggggaaggaaaagtattctacatctgtggccgaaaagacgctggaacctgtatggaaggaagaggcctctttcgagctgccaggactcctgatacagggcagcccggaaaagtacatcctcttccttattgtcatgcatagaagcctggtgggcttggacaaatttcttggtcaagtagcaataaatcttaacgacatctttgaggataagcagcgccggaagacagagtggttccggctcgagtccaaacagggcaagcgcatcaaaaacaggggcgaaattaaggtgaatatccaatttatgcgcaacaatatgacagcaagcatgttcgacctgtccatgaaagacaagactaggtcacccttcgccaaacttaaggataagatgaagggccggaaaaacgacgggacttttagcgatacttcttcggcaattatccccagcacacacatgcctgacgccaactccgaattcagttccggcgaaatccagatgaagagcaagcccaaaaaaccatttctgctgggacctcagcgactcagctcagcccatagcatgagtgatctgtctgggtcccacatgtcctcagaaaaattgaaggctggcacaatcggacagacccatctgctgggtcatcagctcgattcttttggtacagtacccgagtctggtagtctgaagtcaccccaccgacgtactctatcattcgacacttccaaaatgaaccagccagactcaatcgttgatgagggtgagctgtgctttggacgacagaacgacccttttaccaatgtgaccgctagtctgccacagaaattcgctactctcccccgcaagaagaaccctttcgaggagagttccgaaacttgggattcgtcaatgaaccttttctcaaaaccaatcgaaattcgaaaagaaaacaaacgcgagaagagggaaaaggtgtccctgtttgagcgggtgactggtaagaaagatagccgcaggagtgataaactaaacaatggaggctctgacagcccttgtgatctgaaaagtccaaacgccttctctgaaaatagacaagattactttgactatgaatctacaaacccattcacagccaaatttcgcgcctccaacatcatgccttcttcaagtttccatatgagccccacgtccaatgaggacttacgaaagattcccgactcgaacccttttgacgctaccgcaggctatcgctcactcacatacgaggaggtgctgcaggagcttgtgaaacataaggagctcttacgccgaaaagatactcacattagggagctcgaggattatatagataacttactggtccgcgtgatggaagagactcccagcatcctgcgggtcccatatgagccatcccgcaaagctggcaagttcagcaactcatag

SEQ ID NO: 202227 - DNA, 1599 bp, Artificial Sequence
  Description of Artificial Sequence: Synthetic coding sequence
atgatgctgagcgagcaggcccagaagtggttccccacccacgtgcaggttaccgtcttgcaggccaaggatctgaaacccaagggaaaatcagggactaatgacacttataccatcatccagttggggaaggaaaagtactcaaccagcgtagccgagaaaactctggagcccgtatggaaggaggaagccagctttgaacttccaggtctgctgatacaggggagccccgagaaatacattctgttcttaatagtgatgcaccgctccctggtggggctggataagtttctagggcaggtggccattaatttaaatgatatttttgaagataaacaaaggagaaagacggagtggtttcgactggagtctaaacagggaaagcggatcaaaaacagaggggaaattaaggtaaatattcagttcatgcgaaacaacatgacggcttccatgttcgatctttctatgaaggataaaacccggagtccctttgctaagttaaaagataagatgaagggtagaaagaacgacggcacatttagtgatactagttctgcaatcatcccgtcgacacatatgcctgatgcaaactcggagttcagctctggcgagatacagatgaaatccaagcccaaaaaacccttcttgttagggccacaacgcctttcatcggctcactctatgtctgatttaagcggaagccatatgtccagtgaaaaattgaaggccggcactattggacagacgcacttgctggggcatcaactggactctttcggaaccgttccagagtccggatctcttaagtctccccatcgaaggaccctgagctttgacacttccaaaatgaatcagcccgacagcatcgtggacgagggtgagctttgtttcggcagacagaacgatccatttaccaacgtcacggccagcctgcctcagaagttcgccactctgccacgaaagaagaacccctttgaggaatcgtccgaaacctgggactccagcatgaatttattttccaagccaattgaaatcagaaaagagaataaaagagaaaaaagggaaaaggtgagcctctttgaacgagtcactggaaagaaggattcccgccggagtgacaagctaaataacggcgggtccgattctccatgtgacttgaagagccctaatgcattcagcgagaatagacaggattactttgattacgagagtactaatccattcacagccaaattccgcgcttcgaacataatgcctagttccaggaacacactcttaacaccggcagttgccgagtggaggggctcccttaggtgggccgagctgttccacatgtcccccacttcgaatgaggacttacggaaaatccccgactctaatcccttcgacgctacagctgggtacaggagcctgacctatgaagaagtgctgcaggaattggtcaagcataaagaactgttaagacgaaaggatacccatattagggaactggaggattatatcgataacctcctcgtacgcgtgatggaggagactccaagtatcttacgagttccctatgaaccctctcgcaaggccggaaaattttccaacagctag

SEQ ID NO: 202228 - DNA, 2271 bp, Artificial Sequence
  Description of Artificial Sequence: Synthetic coding sequence
atggccagcgccccccccgccagcccccccggcagcgagccccccggcccggatcctgaaccaggggggcctgatggacccggggccgctcagttagcgcctggaccggccgagcttagattgggtgcgccggtggggggccccgatccccagtccccaggattggacgaaccagctccaggagccgccgccgatggtggtgctcggtggtctgcaggccccgcacctggcctcgagggagggcccagggaccccggaccttccgctccccccccccgttctgggccccgggggcagttggcctccccagacgcaccaggccccggacctcggagcgaggcaccactgccggagctggatcctctgttcagctggacggaagaaccagaagagtgtggacctgccagttgtcccgagagcgcccccttccggcttcagggctcttcatctagccatcgggctcggggtgaagtggacgtcttctccccctttcccgcaccaaccgctggtgaactggctctggagcagggccccggttctcctccacagcccagcgacctttctcagacacacccccttccttcagagcccgttggatcccaagaagatggtcctcgattacgggctgtgtttgacgccctggacggagatggcgacggctttgttcgtatcgaggatttcattcagtttgccacagtttacggggccgaacaggtcaaagacctgaccaagtatctggatccaagcggcctgggcgtgatctcgttcgaggacttctaccaaggtatcactgccatccgcaacggggatcctgatggacagtgctatggcggcgtcgctagcgcacaggacgaggagcccctggcatgccccgacgaatttgacgattttgtgacttacgaggctaacgaggtgacagactctgcctatatgggctcagagtccacctatagcgaatgcgaaactttcacggacgaggataccagtacccttgtgcatcctgagctccagccagaaggagacgcggacagcgcaggcggtagcgctgtaccttcagaatgtcttgatgcgatggaggagcccgaccacggagctttgctcctcctgcctggtcgccctcacccccatggccaatctgtcattacagtcatcggcggcgaagaacacttcgaggattacggcgaaggcagtgaggccgagctgtctccagaaactttgtgcaatggtcagctgggttgtagcgacccagcctttttaacgccctcaccaactaaacggctgtcatctaaaaaagtcgctagatacctccatcaatctggagcgctaacgatggaggccctggaagacccttctcccgagctcatggaagggccagaagaggacatcgcagacaaggtggtcttcctcgagagaagggtgctagaattagaaaaagacaccgccgccaccggggagcaacattcccgcctcaggcaggaaaacctacaactcgtgcatcgcgctaatgccctggaggaacagttgaaagagcaggagctaagggcgtgcgaaatggtgttagaagagacgcggagacaaaaggagctgttatgtaagatggaaagagagaagtctatcgaaatagaaaacctccagacccgtcttcagcagttggacgaggaaaattcagagctgaggtcatgcaccccatgtctgaaggccaatatagaaagactggaggaggagaagcagaaattgctggacgaaatcgaatctctcactctccgactgtctgaggagcaggagaacaagaggcggatgggcgacagactctcccacgagcgccatcagtttcagagggacaaggaggccacacaggaacttatcgaagacctgagaaaacaactagaacatctgcaacttttgaaactggaagcagaacagaggcggggccggtcttctagcatggggcttcaagagtaccactctcgggcacgggaatccgagttggaacaggaagtacgcagattaaagcaggataatcgcaatttaaaagaacaaaacgaagagttgaatggacagatcataacactctccattcaaggcgcgaagagtctcttctcaacagcattctccgagtcgctggcagcggagatctcatccgtaagcagagatgagctcatggaagcgattcagaagcaggaggaaatcaattttcgattgcaggattatatcgaccgaataattgtggccattatggagaccaatccttccattctcgaagtaaagtag

SEQ ID NO: 202229 - DNA, 1383 bp, Artificial Sequence
  Description of Artificial Sequence: Synthetic coding sequence
atgagcctgctgcgggccaacgaggtgaccgacagcgcctacatgggttcagagtcaacatatagcgaatgcgaaacattcactgatgaagacacctccaccctggtgcaccccgagctgcagcccgagggcgacgcagactccgctggaggaagcgctgtgccctcagagtgcctcgacgccatggaggagcctgaccacggtgcattactgcttctgccgggaaggccacacccacatggtcagagtgtaattactgtgatcggaggagaggaacactttgaggactacggcgaaggtagcgaagcagagctgtcacctgagaccctgtgtaacggacagctcgggtgcagcgatccagcctttctaacccccagccccaccaaacggctgagttccaagaaggtggcccggtacctgcaccagagtggggcgctgaccatggaggcgctggaggatccatccccagagttgatggaggggcctgaagaggacattgcagataaagtggtgttcttagaacggagggtgctggaactggaaaaagacaccgccgccacaggagagcaacattcccggctacgccaggaaaatctccaactggtccaccgcgctaatgccctggaagaacagttgaaagagcaagaattgcgagcctgtgagatggttctcgaggaaacccggcgccaaaaagaattgctgtgcaagatggaaagagaaaagtccattgagatagagaacctgcagacgcgactgcagcagctggacgaagagaacagtgaacttagatcatgtacaccttgtcttaaggctaatatcgaaaggcttgaggaagagaaacaaaagctgctggacgagatcgaatcccttacccttaggctgagcgaggaacaggaaaataagcggcgcatgggtgatcggctgagtcacgaacgtcatcagtttcagcgggacaaggaggccactcaagaattgatcgaagatctgagaaaacagttagaacatctgcagctgctcaagctggaggctgaacagcgccgcgggcgcagctccagcatgggcctgcaggagtatcattctcgcgcccgcgagtcggaactagaacaggaggtgcgtaggcttaaacaggataacagaaatctgaaggagcaaaatgaggaactgaacggacagataatcactctgtctattcagggcgccaaaagcttattctctacagctttctcggaatcccttgcagcggagatcagcagtgtgagccgtgacgaactcatggaggctattcagaagcaagaggaaattaacttcagactgcaggactacattgacaggattatcgtggccatcatggagacaaacccctctattctcgaggtgaagtag

SEQ ID NO: 202230 - DNA, 1383 bp, Artificial Sequence
  Description of Artificial Sequence: Synthetic coding sequence
atgcccttcctgaaggccaacgaggtgaccgacagcgcctacatgggttctgagtcaacctactccgaatgcgagaccttcaccgacgaggacacctctactctagtacaccctgagttacagcccgaaggtgatgccgacagcgctgggggatcggctgtcccaagcgagtgccttgacgccatggaagaaccggaccatggggctctcctcctcctgccagggcgcccacatccacacggacaaagcgtcatcacagtgattggcggagaggagcactttgaggattacggagagggaagtgaagccgagctcagtcccgaaaccctctgcaacggacaattggggtgttctgacccggcctttcttacaccctcccctaccaaaaggctgagcagtaaaaaggtcgccaggtacctacaccagtctggcgccctgacaatggaggctctagaggacccctcgccagagcttatggaagggcctgaagaagacattgcagacaaggttgtgttcctggaacggagggtcctggaactggagaaagacaccgctgctaccggcgagcaacatagcagactccgacaagaaaatctgcagctggtgcatagagccaacgctttggaagaacagctcaaagaacaggagcttcgcgcatgtgagatggtgttggaggaaacccgccggcagaaggagctcctctgtaaaatggaacgcgaaaaatctattgagattgagaatctccagacacgcctgcaacagctagacgaggagaactccgagcttagatcctgcacgccttgcctgaaggcaaacattgagcggctggaggaggagaaacaaaagctgctggatgaaatcgagtccttgacactccggctgtcagaagaacaggagaataagcgacgcatgggagaccgtctgtcacacgaacgacatcagttccagcgggataaagaagctactcaggagttgattgaggatctgcgcaagcagctggaacacctgcaactcctgaaactggaggcagaacagcgccgtggcagaagttcctctatgggactacaggagtatcacagtcgcgccagagaatccgaactagagcaagaggtccgtaggctcaaacaggacaacaggaacctcaaagagcaaaacgaggaactgaacggacaaatcatcaccctttctatccaaggcgcaaagtctctgttctcaaccgccttctcggaatctcttgcagcagagatctcttctgttagtcgcgacgaattgatggaagcaatccagaaacaggaagagatcaacttccgcctgcaggactacattgaccgcattattgtagcaattatggagactaacccttccattctcgaggtgaaatag

SEQ ID NO: 202231 - DNA, 549 bp, Artificial Sequence
  Description of Artificial Sequence: Synthetic coding sequence
atgggcagcgagagcacctacagcgagtgcgagaccttcaccgacgaagacaccagcacattggtgcaccccgagctgcaaccagagggagatgctgacagcgccggaggcagcgccgtcccctccgagtgcttggatgctatggaggaacccgaccacggagccttgctgctgctccccggtcggccacatccccacgggcagtcagttatcacagtcatcggcggcgaggaacacttcgaggattatggcgaaggaagcgaagccgaattatcccctgaaaccctgtgtaatgggcagcttggttgctccgatcctgccttccttactccttcccccacaaagaggttgagcagcaaaaaggtggcaagatatctgcaccagagtggtgctttaacgatggaggcattggaagatccctccccagagctgatggaaggcccggaggaagatatagcagacaaagtcgttttcctggagcgccgagtgctggagctcgaaaaagacacggcggcgaccggcgagcagcacagccgactgcgacaatag

SEQ ID NO: 202232 - DNA, 2406 bp, Artificial Sequence
  Description of Artificial Sequence: Synthetic coding sequence
atggccagcgccccccccgccagcccccccggcagcgagccccccggcccagaccctgaacctggaggaccggacgggcctggggctgctcagttggcccctggtcccgctgagctgcgccttggagcgccagtcgggggccctgatccgcagtcccccggcctcgacgagcctgctccaggcgctgccgctgacgggggggcccgctggagtgcaggcccggccccaggactcgagggtggccccagagacccagggcctagtgcccctcctcccaggagcggccccagggggcaacttgctagtccggacgcaccaggccccggcccacgctctgaagcccctctccctgagttggaccctctgtttagctggacggaagagcccgaggaatgtggtcccgcatcttgccccgaatctgcccctttcagacttcagggttcttcttcctctcaccgggctaggggtgaggtcgatgtcttttccccttttccagcacccactgcaggagagttggctctggaacagggacctggtagtccgccccagccatccgatttgagccaaacgcatccactgccgagtgagcccgtcggatcccaagaagatggcccccgacttagggccgtgttcgacgccttggatggtgatggcgacggcttcgtcagaattgaggacttcatccagtttgcaaccgtgtacggcgccgaacaggtcaaagacttgaccaaatatctggacccttcaggccttggggtgatcagctttgaagatttttaccagggtattactgccatcaggaacggcgaccctgacggtcagtgttatggcggagtcgcctcagcccaggatgaggaacccctggcctgccctgacgaattcgacgacttcgtaacttatgaggccaatgaggtcaccgacagtgcctatatgggctccgagagtacctatagtgagtgtgagactttcaccgatgaggataccagcacgctggtgcacccagagctgcagcccgagggtgatgcagactcagccggcggctctgccgtgcctagcgagtgtttggatgctatggaagaacccgaccacggcgccctactcttactacctgggcgacctcatcctcatggacagtcagtcattactgtcatcggcggagaggagcactttgaggattatggggaagggtcagaggcggagttatcccccgagacactgtgcaatggtcaactgggctgctcagaccccgcttttttaacacctagcacggaccctttagccgccaaattacactccatactcacggatgaggctttcgagttttactgttcacagtgtcacaagcagattaatagattggaagatttgagtgcacgactctctgatctggaaatgaattcaccaactaaacggctgagtagcaagaaggtggcaagatacctgcatcaatcaggagcgcttacaatggaggccctggaggatcctagccccgagctgatggagggccccgaggaggatattgcggacaaggtggtgttcttagagcggagggtgctagagctggaaaaagataccgcagcgactggcgagcagcattctaggttgcgacaagagaatctgcagctggtccatcgagccaacgcactggaggagcagctgaaagagcaggaactgagggcgtgcgaaatggtgctggaggagacccgcaggcagaaggagctactctgtaaaatggagagagagaagtcaatcgaaattgaaaatctccagacgcggttacagcaactggacgaagagaattcggagttgaggtcgtgcaccccatgtctaaaggcgaatattgagcggctagaagaagagaagcaaaaactcctggacgaaatcgaatccctcaccctaagactgagcgaggaacaagaaaacaagagacgaatgggagaccggctctcccacgagcgccatcagttccagcgcgataaggaagctacacaggagctcatcgaagatctccggaagcagctggaacatctgcagctgttgaagctggaagcagagcagcggaggggtaggtcatcaagcatggggctgcaggagtaccactcgagggcacgcgaatccgagctcgaacaagaagtccgacgtctaaaacaggataaccgcaacctgaaggaacagaacgaagaacttaacgggcaaattattaccctgtccatccagggagccaagtccttgttctccaccgcctttagtgagtcacttgctgctgaaatttcctccgtctctcgggacgagctgatggaagctatacaaaaacaagaggagatcaactttcgactgcaggactacatagatagaatcattgttgccattatggagaccaacccaagcatactcgaggtgaagtag

SEQ ID NO: 202233 - DNA, 1914 bp, Artificial Sequence
  Description of Artificial Sequence: Synthetic coding sequence
atggccggcggcgccggctggagcggcgcccccgccgccctgctgagatccgtcagacgcctgagagaggtgtttgaggtgtgcggccgggatcctgacggcttcctgagggtggaacgtgtggcagctctcgggcttaggttcggacagggagaggaagtggaaaaactggtgaagtatctagacccaaacgacttagggaggatcaattttaaggatttttgccggggagtctttgctatgaaaggctgcgaggagctgctcaaggacgtactgtccgtagagtcagcgggcaccctaccttgcgcacccgaaatccccgattgcgttgaacaagggtctgaagtgacagggccaacctttgccgatggtgaactaataccccgagagcctggattctttcctgaggatgaggaagaagctatgacactcgcgcctcctgaagggccacaggaattgtatacagacagccctatggagagcacacaaagcctcgaaggctctgtgggtagccctgccgagaaggatggggggctgggcgggctctttctcccagaggataaatcgctggtgcatactccctctatgacaacatccgatctctcaacccactcaacaaccagtctgatatccaacgaagagcagtttgaggattatggggagggtgacgacgtggattgcgcaccctcgagcccatgcccggacgatgagactcgcaccaatgtctactcagacctaggtagttcagtcagcagctctgccgggcagacaccaagaaaaatgcgccacgtctataatagcgaactcctcgacgtgtattgttctcagtgttgcaaaaagattaatctgctgaatgatctcgaggctagactaaagaacctgaaggctaattcacccaatcgcaaaatatcttctaccgcgttcgggcgccagttaatgcacagctctaacttttcaagttcaaacgggagcaccgaagatcttttcagagattccattgactcatgcgacaatgatatcaccgagaaggttagctttctggaaaaaaaggtcaccgagctagaaaacgatagcctcactaacggagacctaaagtccaagctgaagcaggaaaacactcaattagttcacagggtgcacgagttggaggaaatggtaaaggaccaggaaactaccgccgagcaagcacttgaggaagaggctaggcggcaccgtgaggcttacggcaaattggaacgggagaaagcgaccgaagtcgaactgcttaacgcgagggtgcaacagctagaagaggaaaatacagaactgcgaacaaccgttactaggctgaagagtcagaccgagaagctggatgaagagagacagcgtatgtcggataggcttgaagacacatccctgcgtttaaaagacgagatggatctgtacaagcgtatgatggataaactacgacagaaccgcttggaattccagaaagagcgggaagccactcaggagctcatcgaggaccttcggaaggagctcgaacatcttcaaatgtataagctcgactgcgagcggccaggccggggccggtctgcatcgtcagggttgggtgaattcaacgcgagagccagagaggtagaactggagcacgaagtgaaacggctgaagcaagagaactataaattgcgggatcaaaacgacgatttgaacggtcagatcctcagcctaagcctgtacgaggccaagaacctgttcgccgcccaaaccaaggcacagtcccttgctgcagagatcgatacggcgagcagagatgaattgatggaagccctgaaagagcaagaggagatcaacttccggttacgccagtatatggataaaattattctagcgatcctcgaccacaacccgtcaatactcgaaatcaaacactag

SEQ ID NO: 202234 - DNA, 1914 bp, Artificial Sequence
  Description of Artificial Sequence: Synthetic coding sequence
atggccggcggcgccggctggagcggcgcccccgccgccctgctgcgaagtgtgcgtaggctccgggaagtcttcgaggtctgtggtcgcgaccctgacggtttcctaagagtagagcgggtggctgccttgggcctaagattcggacagggcgaagaggtggagaagctggttaagtacctggatcctaatgatctggggcgcattaatttcaaggatttttgtagaggggtgtttgctatgaaaggatgcgaggaactactaaaggatgtgctctccgtggaaagcgctggcactttaccttgcgcgccggaaatacccgactgcgttgagcagggttccgaggtaaccggacctacattcgctgatggggagctgatccctcgggagccaggattcttccctgaagacgaggaggaggccatgaccctcgccccaccagaggggccccaggagctgtacactgacagccctatggaatcaacacagagcctcgagggatccgtgggcagccctgccgagaaagatggtgggctaggaggactgttcctccctgaggataagagcttagtgcacacaccttcgatgactacttctgacctctccacacatagtacaaccagcctgatttccaacgaagagcagttcgaggactatggcgagggcgacgacgttgactgcgccccaagcagcccctgccccgatgatgagaccagaacaaatgtgtacagtgacctgggctcctctgtgtctagctcagctggacagaccccgaggaagatgaggcacgtatataactccgagctgctggacgtgtattgctcccagtgctgcaagaagatcaacctgcttaatgacttggaagctcggttgaaaaatctgaaggcaaacagcccaaacaggaaaatatccagcactgcatttggacgacagctcatgcactcttctaatttctccagctcaaatggctcaaccgaagacctctttcgggacagcatagacagctgcgacaatgatattacagagaaggtgtcatttctggagaaaaaggtgacagaactagagaatgattcgctaactaacggcgatctcaaatctaagctgaaacaggaaaacacccaactcgtccatcgcgtgcacgagctcgaagaaatggtgaaggaccaggagacaaccgctgaacaggcattggaggaggaagcccgccgtcacagggaagcctatggtaaactggagagggaaaaggccacagaggtagagttacttaatgccagggtccagcagctggaggaagagaatacagagctgagaacaacagttacacggctgaagagccagacagagaagctcgatgaagaacgccaacgaatgtccgatcggctggaggacacatcattgcgcctgaaagatgaaatggatttgtataagcgcatgatggacaagctgcgccagaaccgccttgagtttcagaaagagagggaggccacccaggagctgattgaggacctcaggaaggagttagagcatctgcagatgtacaagttagattgtgaaagacccggaaggggcagaagcgcatcaagtggcctgggcgagttcaatgcccgtgcccgcgaagttgagctcgaacacgaagtaaaacgcctgaagcaggaaaactataagctgcgggatcagaatgatgacctcaatgggcagattctctctctctcattgtacgaagccaagaacctgttcgccgctcagactaaggcccagagcctggccgccgaaatcgacactgcgtcacgagatgaactcatggaggctctcaaggaacaagaagaaatcaattttagactgcgtcagtacatggataaaatcattttggccatcctcgaccacaatccctccatcttagagatcaagcattag

SEQ ID NO: 202235 - DNA, 651 bp, Artificial Sequence
  Description of Artificial Sequence: Synthetic coding sequence
atgggcacccgggacgacgagtacgactacctgttcaaggtggtgctcatcggcgacagcggcgtaggaaaatccaatctgctctcccgcttcacccggaacgagtttaacctggagtctaaatcaaccattggcgtcgaattcgctacccggagtatccaggtcgatggcaagaccatcaaggcacagatttgggatacggctgggcaggaacggtacagggcaatcacgagtgcatattaccggggcgccgtgggggcgctcctcgtatacgatatcgccaagcacctgacttatgaaaatgtcgagcgctggctcaaagaattgcgtgatcacgccgattcgaacattgtcatcatgctggttggaaacaaatcagacctcagacaccttcgtgctgtcccaaccgacgaagcccgagcatttgcagagaagaatggcctgtcattcattgaaacatccgcattggacagtacaaacgtggaggcggcattccagaccatcctcacggagatctaccgcattgtgagccaaaaacagatgagtgaccgtagggagaatgatatgagtcccagtaataatgtggtgcccattcatgtccctccaacgaccgaaaacaagccaaaggtacaatgctgtcagaacatctag

SEQ ID NO: 202236 - DNA, 468 bp, Artificial Sequence
  Description of Artificial Sequence: Synthetic coding sequence
atgggcacccgggacgacgagtacgactacctgttcaaggtggtgctcattggggacagcggtgtgggcaagtccaatctgctctctcggttcactcgcaacgaattcaaccttgagagcaagtctaccattggagtagagttcgccaccagatccatccaggtagacgggaaaacaataaaggctcagatttgggatacagcgggtcaggagcggtatcgcgccatcacatccgcctattataggggcgcagtgggtgccttgcttgtgtacgacatagccaagcacctcacgtacgagaatgttgagaggtggctgaaggagctgagggatcatgctgactccaatatcgtgataatgctggtcggcaacaaaagtgacctcaggcacctgagggccgtaccaacagacgaggcccgagcgtttgcaggttacaacaaggctaacgtgcggcagacacggaagtag

SEQ ID NO: 202237 - DNA, 612 bp, Artificial Sequence
  Description of Artificial Sequence: Synthetic coding sequence
atggccaaggcctacgaccacctgttcaagctgctgctgatcggcgattcaggcgttggcaagacatgtcttatcatccgctttgctgaggataacttcaacaacacctacatatcgaccatcggcatcgacttcaaaatacggactgtggacattgaggggaagaagatcaaactccaggtgtgggacacggctgggcaagaacgattcaagaccatcaccaccgcctattatcggggcgccatgggaatcattctggtgtacgacatcacagatgaaaaatcctttgagaatatacaaaactggatgaaatccattaaggaaaatgccagtgctggggtggagaggctcttgttaggaaacaaatgtgacatggaggcaaaaaggaaagtgcagaaagagcaggccgacaaactggcacgtgagcatgggatcaggtttttcgaaacctccgctaagtcctcaatgaacgtggatgaagccttcagcagtctcgcgcgcgacattcttctgaagagtggcggtcgccgcagcggcaatggcaacaaacccccttctactgaccttaaaacctgcgataagaagaacaccaataaatgctcactgggatag

SEQ ID NO: 202238 - DNA, 648 bp, Artificial Sequence
  Description of Artificial Sequence: Synthetic coding sequence
atggccaccgccccctacaactacagctacatcttcaagtacatcataatcggcgacatgggggtgggcaagagctgcctcctacaccagtttacagaaaaaaaattcatggccgattgcccccataccatcggagtcgagttcggcactcggatcatcgaagtcagtgggcaaaagatcaagctccagatatgggacaccgccgggcaagaaaggtttagagctgtgacgagatcttactacagaggcgccgccggtgctctgatggtttatgatatcacacgtcgcagtacatataatcatctgtcatcttggctcacagacgccaggaatctgaccaatcccaacacagttatcatactaattggtaataaggccgacctagaggctcagagggatgtgacctatgaagaagctaaacagtttgctgaagagaatggcctcctgtttttggaggcctccgccaaaacaggagaaaatgtagaggatgctttcctggaggctgcaaagaagatctaccagaatatccaagatggctctctcgatctgaacgccgccgagtctggcgtgcagcacaaacccagcgctccccagggcggccgcttaactagcgaaccccagccacagcgggaaggctgcggatgctag

SEQ ID NO: 202239 - DNA, 546 bp, Artificial Sequence
  Description of Artificial Sequence: Synthetic coding sequence
atggccaccgccccctacaactacagctacatcttcaagtacatcatcataggtgacatgggcgtgggaaagtcatgcttgttgcatcagtttacagaaaagaagttcatggcagattgccctcacaccataggggtggaatttggaacaaggatcatagaagtcagcggacagaagattaagcttcagatatgggacactgcagggcaggaacgcttccgcgccgtaacccgctcgtattaccgtggcgctgctggcgccctgatggtttatgatattacacggagaagtacctataaccatctctcgtcatggctgacagatgcccgaaacttgactaaccccaacaccgtgatcatactgataggaaataaggccgatttggaggcacaacgagacgtcacctatgaggaagccaaacaattcgccgaggagaacggtctgctgttcctggaggcaagtgcaaagaccggcgagaatgtggaggacgcatttttggaggcagcgaagaagatttatcaaaacattcaagacggatcactgtag

SEQ ID NO: 202240 - DNA, 711 bp, Artificial Sequence
  Description of Artificial Sequence: Synthetic coding sequence
atgggccagaaggccagccagcagctggccctgaaggacagcaaggaagtgccagtggtgtgtgaggtggtgagcgaggctatcgtgcacgccgcccagaagctgaaagaatacctgggtttcgaatatcctccttccaagttgtgtccagctgccaataccctaaatgaaattttcctgattcacttcatcaccttttgtcaagaaaagggcgtggacgagtggcttaccaccacgaagatgactaagcaccaggcttttctcttcggcgccgactggatatggaccttctggggctctaataaacagatcaagttacagctagccgtccagacacttcaaatgagcagcccccctcctgtggagagtaaaccatgcgatctctcgaatcccgaatctagggtcgaagaaagcagctggaaaaaaagtcggtttgacaagcttgaagagttctgcaacctcataggcgaggactgcttgggcctgtttatcattttcggaatgcccggtaaaccaaaagacatccggggcgttgtcctcgattctgttaagtcccagatggttaggagccacctcccgggcggaaaggcggtcgcacagttcgtcctcgagaccgaagactgtgttttcatcaaagagttactgagaaattgcttaagcaagaaggatgggctgcgggaagtcggtaaggtatatatcagtatcctttag

SEQ ID NO: 202241 - DNA, 639 bp, Artificial Sequence
  Description of Artificial Sequence: Synthetic coding sequence
atggcccaggcccaccggaccccccagccccgggccgcccccagccagccgcgagtttttaaacttgtccttctgggaagcggctcagtgggaaaaagcagcctagccctgaggtatgttaagaatgacttcaaatccatactgcccactgtagggtgcgcgttttttactaaagtggtggacgtgggagccacgtctttgaagctggagatttgggacacagcgggacaggagaaataccatagtgtctgtcacctgtattttcgtggcgccaacgccgctttattagtctatgacattactcggaaggattcctttctcaaggctcaacaatggctgaaagatcttgaggaagagcttcatcccggcgaggtccttgtgatgctcgtcggcaacaagacagatctttcccaggaaagggaagtaactttccaggaagggaaagagtttgccgattctcagaaacttcttttcatggaaacatccgccaaactgaatcaccaggtttctgaagtatttaacactgtagctcaggagcttttgcaacgttcggatgaggaagggcaagctctcagaggtgatgcagcagtagcactgaacaaaggacccgcacggcaagctaaatgctgcgctcattag

SEQ ID NO: 202242 - DNA, 258 bp, Artificial Sequence
  Description of Artificial Sequence: Synthetic coding sequence
atgctggtgggcaacaagaccgacctgagccaggagcgggaggtgacgtttcaagagggtaaggagtttgccgattcacagaagctgctgttcatggaaacgtccgccaagctgaatcaccaggtctcagaggttttcaataccgttgcacaggaactgctgcagcgcagcgatgaggaaggccaagctctgcggggagatgcagccgtagccctgaataagggccctgctcgccaggccaaatgctgcgcccactag

SEQ ID NO: 202243 - DNA, 621 bp, Artificial Sequence
  Description of Artificial Sequence: Synthetic coding sequence
atggacgaggacgtgctgaccaccctgaagatcctgatcatcggcgagagcggagtgggaaaaagttccctcctcctccggttcaccgacgatacgttcgaccccgaacttgctgctactatcggcgtggatttcaaagtgaagacaatttccgttgacgggaacaaggcaaaattggccatctgggataccgccggccaggaaagattccgcacactgactccgtcatattaccgaggagcacagggggtgatcctcgtttacgatgttaccagacgcgataccttcgttaaattagacaattggctgaatgagctcgagacatattgtacaaggaacgatatcgtgaatatgctggtcggtaataaaatcgataaggaaaaccgcgaggtcgatcggaacgaggggctgaaattcgctagaaaacatagcatgctgttcattgaagcctcagccaaaacctgtgatggtgtgcagtgcgccttcgaagaacttgtagagaagatcatccaaaccccaggattgtgggaatcggagaatcaaaataaaggcgtaaagctgtcacatcgggaggaaggacagggcggcggagcttgtggtggctattgcagcgtcttgtag

SEQ ID NO: 202244 - DNA, 486 bp, Artificial Sequence
  Description of Artificial Sequence: Synthetic coding sequence
atggacgaggacgtgctgaccaccctgaagatcctgatcatcggcgaaagcggggtggggaaatcttctttactccttcgatttacggacgacactttcgacccagaactggccgcaactatagtgtacgacgttacccggagagacaccttcgtgaagctcgacaattggttaaatgagcttgagacgtactgtacccggaacgacatcgtgaacatgctggtcggcaataaaattgataaagagaacagggaggtggatcgaaatgaaggccttaaattcgcaagaaaacattccatgctgtttatcgaggctagcgccaagacatgcgacggcgtccagtgtgcattcgaggagttagtggaaaaaattattcaaacaccaggactctgggagagtgagaaccagaataaaggagtgaagctttcacacagggaagaaggccaaggagggggcgcctgcggggggtactgttctgtgctctag

SEQ ID NO: 202245 - DNA, 876 bp, Artificial Sequence
  Description of Artificial Sequence: Synthetic coding sequence
tgacggctgcccggcagccggcccctgcccggccccagcagcctgggccgaagcccatcatgcagcgctgaaaaaacccccttcaggggtccccccctgggaaggcagtcagccgtaaaggagctggacctcgtcaccgccggaaagttccggttttcagtccgtagcgaatgctttagtcgcggaccgccccttaaaatcaaatgtaattgctatttcagtttttgccacatactctggcgccaaaagatatcggtagtgctttcattttttacgttttctctgggtaagattatcctaaccgtggaactgagtatttcgttattactgcggtttactgacgacacctttgatcccgagctcgctgctaccataggtgtggatttcaaggtaaagacaatctctgtcgacggaaataaagctaaattggccatctgggttacccttcaccagcagactgccaactttttcctcaaaagccaaatcggcaattcccctatcttgaagtgggcgatgtggcagtacgacaccgcaggacaggaaagatttcgaactctgactccaagttactatagaggcgcccagggcgttatcctggtttacgacgtaacccgccgagacacattcgtcaagctggacaactggctcaatgagttggagacttattgcaccagaaatgacatcgtgaacatgctggtgggcaacaagatcgataaagagaaccgcgaggtggaccgaaacgaaggactcaagttcgctcggaagcattcaatgttatttatagaggcttcagccaaaacatgcgacggtgtgcagtgcgccttcgaggaacttgttgaaaagatcattcaaactccaggcctttgggaatcttag

SEQ ID NO: 202246 - DNA, 429 bp, Artificial Sequence
  Description of Artificial Sequence: Synthetic coding sequence
atggacgaggacgtgctgaccaccctgaagatcctgatcatcggcgagagtggagtaggcaagagctcgctgctcctgagatttacagatgatacctttgacccagagcttgccgccaccatcggggtagactttaaggtcaagactatatctgtggacgggaataaagccaaactagctatctgggagaatagggaagttgaccgaaatgaaggattaaaatttgcccggaaacattccatgctgtttattgaggcctccgccaagacttgtgatggagtgcaatgtgcattcgaagagcttgttgagaaaatcatccagactccaggtctctgggaatccgagaatcagaataaaggcgtgaagctctcccacagagaggagggccagggcgggggcgcatgtggtggatactgtagcgtgctttag

SEQ ID NO: 202247 - DNA, 555 bp, Artificial Sequence
  Description of Artificial Sequence: Synthetic coding sequence
atggacgaggacgtgctgaccaccctgaagatcctgatcatcggcgagtccggagtgggcaagtccagtctcttgctccgcttcaccgacgacacttttgatcctgagctggcagctactgacacggcggggcaggaacgctttcggactctgacacctagttactatagaggggcacagggggtcattctcgtgtatgatgtcacaaggagggacacgtttgtgaagctggataattggctgaacgaactggagacgtattgcacaaggaacgacattgtcaacatgctagtcggaaacaaaatagataaagagaacagggaggttgatcggaacgagggccttaagtttgcaaggaaacactctatgctgttcatcgaagcatcagccaaaacctgcgacggagtccagtgcgccttcgaagagctggtggagaaaatcatccaaacccccgggctgtgggagagcgaaaaccagaacaaaggagtaaagctatcccaccgagaggagggccagggagggggtgcctgcggaggatattgcagcgtgctgtag

SEQ ID NO: 202248 - DNA, 390 bp, Artificial Sequence
  Description of Artificial Sequence: Synthetic coding sequence
atgagcagcatgaaccccgagtacgactacctgttcaagctgctgctaataggcgacagtggcgttggcaaatcctgtctccttctacgcttcgctgacgacacatataccgagtcttatatttccactataggtgtggattttaagatcaggacaattgaactggacggtaaaacaatcaaactgcaaatcgaatttgctgactctttggggatccctttcttagagacctctgctaagaatgctaccaacgtggagcagtccttcatgaccatggcggccgaaattaaaaaaagaatggggcccggggctacagccggcggggccgagaagtcgaatgtcaagattcagagtacccccgttaaacagtctggaggtgggtgttgttag

SEQ ID NO: 202249 - DNA, 390 bp, Artificial Sequence
  Description of Artificial Sequence: Synthetic coding sequence
atgagctgcctgcaccccaccagcgactacctgttcaagctgctgttgatcggtgactcgggggtggggaagtcgtgtttacttttgagatttgccgatgacacatacactgagagttacatttctactattggagttgattttaaaatacgtacaatagagctcgacggcaagaccataaagctccagatcgagtttgccgactccctggggataccctttctagaaaccagcgccaagaacgctaccaatgtggaacagagctttatgaccatggccgcggaaatcaagaagcgtatggggcccggggctactgccggaggcgctgagaagtcaaatgtgaagattcagtcaacacccgtaaaacagtccgggggagggtgctgttag

SEQ ID NO: 202250 - DNA, 522 bp, Artificial Sequence
  Description of Artificial Sequence: Synthetic coding sequence
atgagcagcatgaaccccgagtacgactacctgttcaagctgctgttaatcggagacagtggggtgggtaaatcctgcttgttgcttaggttcgcagacgatacgtacacagaaagctacatttcaaccattggggtagattttaagatcaggactatagagctcgatggaaagaccattaagttgcaaatcgagtcctttaacaacgtgaaacagtggctgcaggagattgacagatacgctagtgaaaacgtgaataagcttctcgtggggaataagtgcgacctaaccacaaaaaaggtggtggactatactactgcaaaggaattcgcagactctttgggaatccccttcctcgaaacatcagcaaagaatgccacaaacgttgaacaaagctttatgaccatggctgctgaaataaaaaagcgtatgggccccggagccacggcaggcggcgctgagaaaagcaacgtcaaaattcagtctacgcccgtgaaacagtccggaggaggctgctgctag

SEQ ID NO: 202251 - DNA, 522 bp, Artificial Sequence
  Description of Artificial Sequence: Synthetic coding sequence
atgagcagcatgaaccccgagtacgactacctgttcaagctgctgctgattggagactctggcgttgggaagagttgcctcctcctgaggttcgcctgggacaccgcaggccaggagcggtttcgaactattacttctagttactaccggggggcacatggcatcatcgtagtgtatgacgtgaccgaccaggagagctttaacaatgtgaaacaatggctacaggaaatcgacagatacgcttcagagaatgtcaacaagctactcgtgggcaataagtgcgatctcacgacaaaaaaggtggttgactacaccacggctaaagagtttgcggattccctgggtatcccgttcttggaaaccagtgcaaagaacgccacaaacgtggagcagtcttttatgactatggccgcagagattaaaaagaggatggggcccggagcgaccgcgggaggtgcggagaaatccaatgtgaagatccagtcaaccccggtgaaacaaagcgggggcggttgttgctag

SEQ ID NO: 202252 - DNA, 618 bp, Artificial Sequence
  Description of Artificial Sequence: Synthetic coding sequence
atgagcagcatgaaccccgagtacgactacctgttcaagctgctgctcattggagactctggcgtgggcaagagttgcctgttgctccgattcgcagatgatacttatactgagtcttacatcagtaccatcggagttgactttaagatccgcactattgagctggatggtaaaactattaagttacagatctgggacactgctggccaggaacggtttcgcaccatcacgtctagctattaccgcggagcccatggaatcatagtcgtctacgatgttaccgaccaggaaagcttcaacaacgtcaaacagtggctgcaagagatcgatagatatgcgtcagagaatgtcaataagttactggttggaaataaatgtgatttgaccactaagaaggtggtggattacacaaccgccaaggagttcgcagattccctggggatcccattccttgagacgagcgccaagaatgccacgaacgtggagcaatccttcatgaccatggcagcagaaatcaaaaaaaggatgggccctggcgccaccgcaggcggggcagagaagtcgaatgtaaagatacagtcaacccccgtcaagcagagtgggggtggatgttgttag

SEQ ID NO: 202253 - DNA, 426 bp, Artificial Sequence
  Description of Artificial Sequence: Synthetic coding sequence
atgagcagcatgaaccccgagtacgactacctgttcaagctgctgcttatcggcgattccggcgttgggaaatcatgtctcctcctgcgctttgccgaatcttttaataacgtaaaacaatggttgcaggagattgaccgctacgcgtcggaaaacgttaataagttgttggtaggtaacaaatgcgacctcacaacaaaaaaagtggttgactacacaacagctaaagaatttgcagattcactgggcattccctttctggagacatccgcgaaaaatgccaccaacgttgagcagagctttatgaccatggctgccgagatcaagaagcggatgggacctggagcgaccgccgggggggccgagaagtcaaatgtgaaaattcagagtacccctgtcaagcagtccggaggcggctgctgttag

SEQ ID NO: 202254 - DNA, 606 bp, Artificial Sequence
  Description of Artificial Sequence: Synthetic coding sequence
atgaaccccgagtacgactacctgttcaagctgctgctgatcggcgatagcggcgttggaaagtcatgccttctcttacgcttcgccgatgacacgtatactgagtcatatattagtaccataggcgtggactttaagatcagaaccatcgagctggatggcaaaactatcaaacttcagatttgggacacagccgggcaggagcgattcagaactataacaagctcctattaccgcggggcgcacggaatcatcgtggtatacgacgtgactgatcaagagtcctatgcaaacgtgaagcagtggctccaagaaatcgataggtacgctagcgagaatgtcaataagcttctagtggggaataagtcagatcttactactaaaaaggtcgttgataatacaacagcaaaagaatttgctgatagcctcgggatcccgttcttggaaaccagtgccaagaacgccaccaacgtcgaacaagctttcatgacaatggccgccgagatcaagaaacgcatgggccctggggctgccagcggcggcgaaagacccaacctcaaaatcgattccacccctgttaagccagctgggggcggttgctgttag

SEQ ID NO: 202255 - DNA, 489 bp, Artificial Sequence
  Description of Artificial Sequence: Synthetic coding sequence
atgaaccccgagtacgactacctgttcaagctgctgctgatcggcgacagtggagtgggtaagagctgcctgctcctccgcttcgcagacgatacttacacagagagctatattagcaccatcggtgtcgatttcaagatccgcacaatcgagctggacgggaagacaatcaagctccagatatgggacactgcaggccaagagaggttccgaactatcaccagctcctactacaggggcgcccacggcattatagtggtgtacgatgtcacagatcaggagtcttatgcaaacgtgaagcaggggtgccggcggcttactgcgatgcctgcacgcacatccatcagctcttggtgggccacaagggccaccagccccccccgcagatggtggaccactccacagccgaggagtctccaaacactttgggcatctccatcctggaggcgagcccctcgaatgcctcctatgtcgagtcggcgaagctag

SEQ ID NO: 202256 - DNA, 360 bp, Artificial Sequence
  Description of Artificial Sequence: Synthetic coding sequence
atgaaccccgagtacgactacctgttcaagctgctgctgatcggcgactcaggtgttggcaagtcgtgcctgctgctaagatttgcggatgatacttacaccgagagctacatttcaacaattggagtggatttcaagatcagaactatcgaactggacgggaagaccattaagctgcagatctgggatactgcgggccaggagaggttccggactataacctcatcttactaccggggggcccacggaattattgtggtgtacgacgtgacagaccaggaaagttacgctaatgtaaagcagtggctccaagagatcgacaggtacgctagtgaaaatgttaacaaattgttagtgtag

SEQ ID NO: 202257 - DNA, 678 bp, Artificial Sequence
  Description of Artificial Sequence: Synthetic coding sequence
atggccgccgccggcggcggcggcggcggcgccgccgccgccggccgtgcctattcctttaaggtggtcctgctgggcgagggatgcgttggaaaaacgagtctcgtacttcggtattgtgaaaacaagttcaatgacaagcatatcaccaccctacaagctagttttctgactaaaaaactgaatatcggagggaagcgtgtgaatctggctatttgggataccgcgggccaagagaggtttcacgctctggggcccatctactatcgggactctaatggggcaatcctggtttatgacataaccgacgaggattctttccagaaagtgaagaattgggtcaaggaactccggaaaatgctcggaaatgagatctgtctctgcattgtcggcaataaaatagacttagagaaagaacgacatgtctctatccaggaagctgagagctatgcagagtccgtcggggcaaaacactatcatacaagcgccaagcagaacaaggggatcgaggagctgtttctggacctttgcaagcgaatgattgaaacggcccaggtagatgagagggcaaaaggtaatggatcaagccagcccggtacagctaggcggggtgtgcaaatcatcgacgacgagccccaagctcagaccagtgggggaggttgctgtagtagcggctag

SEQ ID NO: 202258 - DNA, 585 bp, Artificial Sequence
  Description of Artificial Sequence: Synthetic coding sequence
atggccctgcgggagctgaaggtgtgcctgctgggcgacaccggcgtcgggaagtccagcatcgtatggcgcttcgtcgaggattcattcgaccctaatatcaatcctacaatcggggctagctttatgacaaagaccgtgcagtatcagaatgagctgcataagtttcttatctgggatactgcagggcaagaacgcttcagggccttggcaccaatgtattaccgcggttccgccgccgcaattattgtgtacgatatcaccaaagaagaaaccttttctaccctgaaaaattgggttaaagagctgaggcagcacggcccgccaaatatagtagtggctatagctgggaacaaatgtgatctcatcgacgtgagagaggtgatggagcgggatgcaaaggactatgcggactccattcacgcgatatttgtggagacatctgcgaagaacgccatcaacatcaacgaactcttcatcgagatatccaggcggattcctagcacggacgcaaatctcccctccggcgggaagggcttcaagctcaggagacagccttctgagcccaaaagatcttgttgctag

SEQ ID NO: 202259 - DNA, 714 bp, Artificial Sequence
  Description of Artificial Sequence: Synthetic coding sequence
atgctggaggaggacatggaggtggccatcaagatggtggtggtgggcaacggagccgtcggcaaaagcagtatgatccagagatattgtaaaggcatcttcacaaaagactataaaaaaacaattggagttgatttcctggaaaggcaaatacaggtgaacgatgaagacgttagactgatgctttgggataccgccggacaggaagaatttgatgcaataacgaaggcgtactaccgcggagctcaagcatgcgtcctggtgttctccaccaccgaccgggagagttttgaagcagtaagcagctggagggaaaaagtggttgctgaagtcggtgacattccaacagtactcgtccagaacaagatagatctgttagacgattcctgtattaaaaacgaagaagccgaggctcttgctaaaaggctgaaactgcgtttctataggacctcagtgaaagaggacctgaacgtcaacgaggtgttcaagtatctggcggaaaaatatctgcaaaagcttaagcagcaaatagcagaagaccctgagctgacccacagcagctccaataaaataggtgtcttcaatacaagtggtgggtcacactccgggcagaattccgggacgctaaacggaggagatgtgataaatctacgccctaataagcagaggacaaaaaagaaccggaacccatttagttcatgttccatcccttag

SEQ ID NO: 202260 - DNA, 714 bp, Artificial Sequence
  Description of Artificial Sequence: Synthetic coding sequence
atgctggaggaggacatggaggtggccatcaagatggtggtggtgggcaatggcgccgtggggaaatcgagtatgatccaacgctattgtaaaggcatctttacaaaggactataaaaaaacaattggggtggatttcctggaaagacagatccaggtgaacgatgaggacgtgaggctaatgctctgggatacagccgggcaagaagagttcgatgcgatcacaaaagcatactatcggggggcccaagcatgtgtcttagtgttctccacaacagacagagagtcatttgaggctgtgtctagctggcgggagaaggttgtagctgaggttggagacatccctacagttttagtccagaataagattgatctgctcgatgacagctgcatcaaaaatgaagaagcagaggctttagcgaaacggctaaagcttcgcttctacagaacatcagtaaaagaggatctcaatgttaatgaagtgtttaaatatctagctgagaagtacctccagaaactaaagcagcagatcgcagaagatcctgagttaactcactcctcaagcaataagatcggggtattcaataccagcggcggctctcatagtggccaaaacagtgggaccctgaatggtggtgacgttattaacttgcggcctaacaagcagcgaactaaaaagaataggaacccattcagctcctgcagcatcccatag

SEQ ID NO: 202261 - DNA, 612 bp, Artificial Sequence
  Description of Artificial Sequence: Synthetic coding sequence
atgagcggccagcgggtggacgtgaaggtggtgatgctgggcaaggagtatgtggggaaaacctccctggtggaacgatatgttcacgaccggttcctggtgggcccctaccagaacacaatcggggctgccttcgtggccaaggtaatgtccgtgggggacaggacagttaccctcggcatctgggatactgctggctctgagaggtacgaggccatgagtcggatttattatcgcggagcgaaagccgcaatagtctgttatgacctgacagattcctctagttttgaaagggcgaagttttgggttaaagagttaaggagcttggaggaggggtgccagatttacctctgcggcaccaagtccgacctcctggaggaagaccgaagacgccgccgcgtcgatttccacgacgtgcaggactacgccgacaacattaaagcacagctgttcgaaacttcgagcaaaacagggcagtccgtcgatgaactgtttcagaaggtcgccgaagactacgtatctgtcgccgcttttcaagtgatgaccgaagataagggcgtggacctcgggcagaagccaaatccgtacttttatagctgctgccaccactag

SEQ ID NO: 202262 - DNA, 612 bp, Artificial Sequence
  Description of Artificial Sequence: Synthetic coding sequence
atgagcggccagcgggtggacgtgaaggtggtgatgctgggcaaggagtacgtgggcaagacgtccctggtcgaaagatatgtgcatgatcgattcctagtgggcccctatcagaatacgattggagccgctttcgtcgctaaggtgatgtcagtcggcgaccgcacagtgaccctgggcatctgggatacagctggcagtgagaggtacgaagctatgtcacgaatttactatcgcggtgcgaaggccgcaattgtttgttacgatctgaccgattcctccagcttcgagcgcgccaaattttgggtgaaggaattgaggtccctggaggagggttgtcagatttatctgtgcgggacaaagtccgatctattggaggaggaccggcggcgcagacgcgtcgactttcacgacgtccaggattacgctgacaacatcaaagcacagctttttgaaacctccagtaaaaccgggcaatctgttgatgaattattccaaaaggttgccgaggattacgtgagcgtggcggccttccaggtcatgaccgaggataaaggcgtcgatctgggacagaagccaaacccatatttttattcttgttgccaccattag

SEQ ID NO: 202263 - DNA, 201 bp, Artificial Sequence
  Description of Artificial Sequence: Synthetic coding sequence
atgagcggccagcgggtggacgtgaaggtggtgatgctgggcaaggagtacgtcgggaagactagtctggtggagcgctatgtccacgaccgtttccttgtaggtccatatcagaatactatcggcgctgcatttgtcgcgaaggtgatgtccgtgggcgaccgaacagtgactctgggcatttgggacacagccggctag

SEQ ID NO: 202264 - DNA, 642 bp, Artificial Sequence
  Description of Artificial Sequence: Synthetic coding sequence
atgggcaacggcaccgaggaggactacaacttcgtgttcaaggtggtattaatcggagagagtggcgtgggtaagacgaatctgctcagcagatttacacgcaacgagtttagtcacgattcacggacaacaatcggcgtggaattttccacgcgtaccgtaatgctcggaaccgcagctgtgaaggcccaaatctgggatacagcgggcctggaacgctaccgagcaataacatccgcatactacaggggagccgtcggtgctctcttagtgtttgatctcacgaaacaccagacttacgctgtcgtggagcgttggctgaaagaactttatgaccacgctgaagccactattgtggtcatgctggtcggtaacaagagcgatctctcgcaagctcgggaagtgccaaccgaggaggcccgcatgttcgcagaaaataatggcctcttgtttctggagacatctgctttagacagcactaacgtagagctcgccttcgagactgtcttgaaggagatttttgccaaggtgtcgaagcagaggcagaacagtatcaggaccaatgcaatcaccctgggctcagcccaggcaggtcaggagcctggaccgggagagaaacgcgcctgttgtatttcactctag

SEQ ID NO: 202265 - DNA, 1110 bp, Artificial Sequence
  Description of Artificial Sequence: Synthetic coding sequence
atggagggcagcctggagcgggaggcccccgccggcgccctggccgccgtgctcaaacacagctccacactgcctccagaaagtacccaagttcggggctatgattttaatagaggggtcaactacagggctctactcgaagcatttggcacaacaggatttcaagccacaaacttcggaagagctgttcagcaggtgaacgcgatgatagagaaaaagctggagccgctgtctcaggacgaagatcaacacgctgacctgacgcagtcaagaagacccttaacctcttgtaccatattccttggatatacgagcaaccttatttccagcggcattagggaaaccatcaggtacctagttcagcacaatatggtggatgtgctggtaaccaccgcagggggagtggaagaggatcttatcaaatgcttggcacccacttatctgggcgagttctcacttagaggcaaagagctgcgggagaatgggatcaaccgaatcggcaatctgctggttcctaacgaaaattattgcaaatttgaagattggcttatgcctatccttgatcagatggttatggagcagaacacagagggggtcaaatggacacctagtaaaatgatcgcacgcctgggaaaggagattaacaacccggaaagcgtatactattgggcacaaaagaaccatatccccgtgttcagtccagcactcacagatggatctctgggggatatgatttttttccatagctacaaaaaccccggcctggtgctggatattgtggaagacttgaggctgataaacactcaggctatcttcgcgaagtgtaccggaatgataatcttaggtggaggagtggtaaaacaccacatcgccaacgctaatctgatgcgaaacggggccgattatgcggtttacattaataccgcacaggaattcgatggaagcgactccggcgcccgacccgacgaggccgtgagctggggcaagattagggtggatgcccagcctgtcaaggtatacgcggatgcctccctggtatttccactgctggtagccgaaaccttcgcccagaagatggacgccttcatgcacgaaaaaaacgaagattag

SEQ ID NO: 202266 - DNA, 573 bp, Artificial Sequence
  Description of Artificial Sequence: Synthetic coding sequence
atgctggtgggcgacagcggcgtgggcaagacctgcctgctggtgagatttaaggatggcgccttccttgccggaacatttatttcgacagttggcattgactttaggaataaagtgcttgatgttgatggcgtcaaagttaagctccagatgtgggatacggcagggcaggaacgctttaggtcagtgacccacgcgtattacagggacgcacacgccctgctgttactgtacgatgtgacgaataaagccagcttcgataacatccaggcctggctcacagaaatccatgagtacgctcagcatgacgtggcccttatgctcttaggcaacaaagtggatagtgcccacgaacgtgtcgtcaaacgagaggacggggaaaagttagccaaagagtatggactgccttttatggagacctccgcaaaaacagggcttaatgtggacctggctttcacagccattgccaaggaacttaaacagcgatcgatgaaggcgcctagcgaaccaaggtttcgattacatgattatgtgaaacgagaaggccgaggtgcgagttgctgccggccttag

SEQ ID NO: 202267 - DNA, 666 bp, Artificial Sequence
  Description of Artificial Sequence: Synthetic coding sequence
atgagcgacggcgactacgactacctgatcaagttcctggccctgggggactctggggttggcaagacgtccgtgctgtaccaatataccgacgggaaatttaatagcaagtttattacgacagtgggcatcgattttcgggagaagcgagtggtgtacagagcgagtgggccagacggcgccacagggcgtggacaaaggatccacctgcagctgtgggatacagccggacaagaacggttccgttcgctgaccaccgcgttttttcgcgatgccatggggttcctgctactgttcgacttaacaaacgaacagagcttcttgaacgttagaaactggatctcgcaactccagatgcacgcttattgtgagaatcctgacattgtgttgtgcggaaacaagtcggatctggaagatcaacgcgtggttaaggaggaggaggccatcgctctcgcggagaaatacgggatcccatactttgagaccagtgccgccaatgggactaacatctcccaggccattgagatgcttctggaccttatcatgaaacgcatggagcggtgtgtagacaagagctggatacccgaaggcgtggtccgatcgaacggacatgcttccacggatcagctgtctgaagagaaagagaagggcgcgtgtggatgctag

SEQ ID NO: 202268 - DNA, 642 bp, Artificial Sequence
  Description of Artificial Sequence: Synthetic coding sequence
atgagcgacggcgactacgactacctgatcaagttcctggccctgggggacagcggagttggaaagactagtgtcctgtatcaatacaccgatggaaaattcaatagcaagtttattactacggttggaatcgacttccgtgaaaagcgagtggtgtacagagccagtggcccggatggagctaccggtcggggccagagaattcacttgcagttatgggacacggcgggccaggaaagattccgctccctgactaccgcattttttagggacgctatgggtttcttgctgctattcgacctgacgaatgagcaaagcttcctgaatgtgcgaaattggatctcccagctgcagatgcacgcctactgtgagaatccggatatagttctgtgcggtaacaaatccgacctggaggatcagcgagtagtgaaggaaaaatacgggatcccctatttcgaaacatcagcagccaatgggacaaacatctcccaggcaatcgagatgcttttggacctgatcatgaagcggatggaacgctgcgttgacaagagctggattccggagggagtggtccggagcaacgggcatgcctcgacagaccaactcagtgaggaaaaagaaaaaggggcctgcggatgttag

SEQ ID NO: 202269 - DNA, 666 bp, Artificial Sequence
  Description of Artificial Sequence: Synthetic coding sequence
atgagcgacggcgactacgactacctgatcaagttcctggccctgggggactcgggcgtaggcaaaacttccgtgctgtatcaatataccgacggcaagttcaacagtaaattcatcaccactgttggcatcgattttagagagaaaagggtggtgtacagagcaagcggtccggacggggcaacaggccgcggtcagcgcatccatctgcagctttgggataccgcaggacaggaacgatttcgctcgttgaccactgcgtttttcagagatgccatgggcttcctgctgctgtttgatctgaccaacgagcagagcttcctcaacgtcagaaactggatctcacagctccagatgcatgcctactgtgagaacccggatatagtcctgtgcggtaataagtcggatctggaggaccagcgagtggtgaaagaagaagaagcaattgccctggcagagaagtatgggatcccctactttgagaccagcgccgccaatggcacaaatatcagccaagctatcgagatgcttttagacctcatcatgaaacgaatggagcgctgcgttgataagtcatggattcctgagggcgtcgtcagatcgaatgggcatgcatcaaccgaccaactgagcgaggaaaaggaaaagggcgcttgcggctgctag

SEQ ID NO: 202270 - DNA, 663 bp, Artificial Sequence
  Description of Artificial Sequence: Synthetic coding sequence
atgagcgacagcgaggaggagagccaggaccggcagctgaagatcgttgttctgggcgacggtgcctcaggcaaaacgtccttaacaacatgcttcgcacaggaaacgttcggcaagcagtacaaacaaacaatcgggctggatttctttttacgccggattacattaccagggaacctgaacgtgacactccagatctgggacatcggtggccagaccatcgggggcaaaatgctggacaaatacatatatggagcgcagggggtccttttggtgtatgacatcaccaactaccagtctttcgaaaatcttgaggactggtacacagtggttaagaaagtgtccgaagaaagtgagactcagccactcgtagccctggtaggtaacaaaatagatctggagcacatgaggacaattaaacctgagaaacatttgagattctgtcaagagaatggattttccagccacttcgtatctgccaaaacaggagatagtgtttttctttgttttcagaaggtggctgccgaaatcctcggaataaagctcaacaaggcagagatcgaacagtcccagcgaatcgtacgagccgagatcgtgaaatatcccgaggaggagaaccaacataccacctcaacccagtccaggatatgtagcgtccagtag

SEQ ID NO: 202271 - DNA, 666 bp, Artificial Sequence
  Description of Artificial Sequence: Synthetic coding sequence
atgagcgacagcgaggaggagagccaggaccggcagctgaagatcgtcgtattaggcgacggagctagcgggaagacttccctcactacttgttttgcccaggagacgttcggaaaacagtataaacagactatcggtctggattttttcttaagacgcatcaccctgcccggtaacctgaacgtgactcttcagatatgggatatcggtggccagactatcgggggcaagatgttggataagtatatttatggggcgcaaggtgttctgctggtctacgatattacaaattaccagagcttcgaaaacctagaagattggtacaccgtggtaaaaaaagtatccgaggagagcgagacccaacctttagtggctcttgtcggtaacaaaatagacctggaacacatgcggaccatcaaacccgagaaacacctacggttttgccaggagaacggtttttcctcccactttgtaagtgccaagaccggcgacagtgtgttcttatgctttcaaaaagtggccgctgaaattctgggcatcaagctgaataaggcggagattgaacagagtcaacgcgtcgtgaaagcagatatcgtcaattataaccaggagccgatgagtaggactgtgaatcctcccagatcttcaatgtgcgctgtccaatag

SEQ ID NO: 202272 - DNA, 615 bp, Artificial Sequence
  Description of Artificial Sequence: Synthetic coding sequence
atgagcgacagcgaggaggagagccaggaccggcagctgaagatcgtcgtgctcggcgacggagcttccggcaagacgtccctaacaacctgtttcgcgcaagaaacctttgggaagcagtacaaacagaccatcgggctagacttctttctgaggcgaatcactctgcctggtaatctcaacgtgactttgcagatttgggacatcggaggccagactatcggaggaaaaatgctggataaatatatctacggcgcccagggcgtcttgctggtgtacgatattacaaattaccagagctttgagaaccttgaagactggtatacagtcgtaaaaaaggtcagcgaggaatccgagacacaacccctagttgccctggtgggtaataagatcgatcttgaacacatgaggaccattaaacccgaaaaacacctacggttttgccaggagaatggtttctccagtcactttgtgtccgcgaagacaggagattctgtgtttctgtgctttcagaaggtggcagctgagatcctgggaattaagctgaacaaggccgagattgaacagagtcaggggcattttatcatcttcatctccagtacgaaccgagagtag

SEQ ID NO: 202273 - DNA, 288 bp, Artificial Sequence
  Description of Artificial Sequence: Synthetic coding sequence
atgagcgacagcgaggaggagagccaggaccggcagctgaagatcgtggtgctcggtgatggcgcctccggcaagacgagtctaacaacgtgtttcgctcaagaaacatttggcaagcagtataagcaaaccatcggtctggacttcttcctgaggcgtatcacgctgcctgggaacctcaatgtcacgctgcagatctgggatataggcggtcaaactattggcggaaagatgctcgacaaatacatctacggtgcacagctgatatggagcatttgtgagcagtag

SEQ ID NO: 202274 - DNA, 639 bp, Artificial Sequence
  Description of Artificial Sequence: Synthetic coding sequence
atggcctacgcctacctgttcaagtacatcatcatcggcgacaccggtgtgggaaaaagttgcctactcctacagtttacagacaaacgctttcagcctgtgcacgatctgaccatcggcgtggagttcggtgctagaatgataaccatcgacggcaagcagattaagcttcagatttgggatactgccgggcaggagtccttcagatccataacacggtcgtactatcgcggggctgcaggcgcccttctggtctacgacatcactcgacgtgacacctttaaccatctcacaacctggttagaagatgccagacagcacagcaattctaacatggttatcatgttaatagggaataaatctgatcttgagagccgaagagaagttaaaaaggaagaaggtgaagcgttcgcccgcgagcacggcctgatcttcatggaaacatcagccaagaccgcatccaatgtggaggaagcttttataaacactgccaaagaaatctacgagaaaattcaggagggtgtgttcgatatcaataatgaagctaatggtattaaaattgggccacagcatgccgctaccaatgccacgcacgcagggaaccaaggagggcagcaggcaggtggtgggtgctgttag

SEQ ID NO: 202275 - DNA, 567 bp, Artificial Sequence
  Description of Artificial Sequence: Synthetic coding sequence
atggcctacgcctacctgttcaagtacatcatcatcggcgacaccggcgtcgagtttggagctcggatgatcacaatcgatgggaagcagataaaactgcagatttgggacactgcaggccaagagtcctttcgatcgatcacaaggtcctattataggggtgccgccggcgcccttctggtttatgacataacccgtcgggatacgtttaatcacctgacaacttggctcgaagacgcgagacagcattccaactccaacatggtcatcatgctgatcggtaataagtcggatctggaatctcgaagagaggttaagaaggaagagggcgaggcctttgcccgagagcacggtctcattttcatggaaacaagcgctaagaccgcgtccaacgtcgaggaggctttcatcaataccgcaaaagagatttatgagaagatccaggagggtgtcttcgatatcaacaacgaggctaacgggattaaaattggaccacagcatgccgctaccaatgcaacccatgctggaaaccaggggggccaacaagccggtgggggatgttgctag

SEQ ID NO: 202276 - DNA, 501 bp, Artificial Sequence
  Description of Artificial Sequence: Synthetic coding sequence
atgatcaccatcgacggcaagcagatcaagctgcagatctgggacaccgctgggcaggagtcattccgttctataacacggagctactatcggggcgctgccggagcactgctcgtgtacgatatcacacggcgcgatacctttaatcatcttactacctggctcgaggacgcaagacagcactccaactccaacatggtgataatgctgatcggaaacaagtcagatttggaatccaggagagaagttaaaaaggaggaaggtgaagctttcgcacgcgagcatggacttatctttatggaaacttcagccaaaactgcttcaaacgttgaagaggcttttattaataccgccaaagaaatatacgagaaaattcaggaaggcgtgttcgacattaataatgaagcgaacgggattaagattggtccacagcacgcggccacaaacgctacacatgctggcaaccagggtgggcaacaggcgggcggtgggtgctgctag

SEQ ID NO: 202277 - DNA, 630 bp, Artificial Sequence
  Description of Artificial Sequence: Synthetic coding sequence
atgacctacgcctacctgttcaagtacatcatcatcggcgacaccggcgtaggaaagagttgtctcctcctacagtttacagataagcggttccagccagtacatgatctcaccatcggggttgaatttggagcacggatggtcaacattgatggaaagcagattaagttgcagatctgggatactgccggccaggagagtttccggagtatcactagaagctattacaggggagcagccggtgctctgctcgtttatgacattacgcggcgcgagacgttcaaccacctgacttcgtggcttgaggatgccagacagcacagtagctcgaatatggtcatcatgctcataggaaacaagtcagacctggagagccgaagagatgtgaaaagggaagaaggcgaggccttcgcgcgggagcatggactgatcttcatggagacttccgctaagaccgcctgcaacgtagaggaggctttcatcaacaccgccaaggagatttatagaaagattcagcagggcctgtttgacgtccacaacgaagcgaacggcattaagatagggcctcagcagtccatcagcacaagcgtggggcccagcgcctctcagtccgctggcctgcaggtctag

SEQ ID NO: 202278 - DNA, 651 bp, Artificial Sequence
  Description of Artificial Sequence: Synthetic coding sequence
atgacctacgcctacctgttcaagtacatcatcatcggcgacaccggggtgggtaaatcttgtctgctgctacagtttaccgataaacgctttcagcccgtgcatgacctgacaataggcgtcgagttcggagcacgcatggtgaatatcgatggaaagcagatcaaactgcaaatttgggatacagccggccaggaaagtttcaggtccattacccggagctactatcgcggcgctgccggcgcactacttgtgtacgacattaccagaagggagacctttaatcatctgacatcctggctcgaggacgcacgccagcacagcagctcaaacatggtgatcatgctcatcggaaacaagagtgacctcgagtcccggagagatgtaaaacgagaggaaggggaagcttttgcccgcgagcacggcctgattttcatggagaccagcgctaaaacagcatgtaatgtggaggaggccttcatcaataccgcgaaggagatatatcggaagatccaacagggactctttgatgttcataacgaggccaatggaatcaaaattggcccccagcaaagtatttccacatccgttggcccttcggcatcccaacgcaatagtcgcgatatcggcagtaattctggctgttgctag

SEQ ID NO: 202279 - DNA, 189 bp, Artificial Sequence
  Description of Artificial Sequence: Synthetic coding sequence
atgacctacgcctacctgttcaagtacatcatcatcggcgacaccggcgtgggcaagtcatgtctcttactgcagtttaccgacaaacgttttcaacccgtccacgacctaaccatcggggtggagtttggcgccaggatggtcaatatagatggcaagcagattaaactgcagatttgggatacatag

SEQ ID NO: 202280 - DNA, 2946 bp, Artificial Sequence
  Description of Artificial Sequence: Synthetic coding sequence
atggccgccgacagcgagcccgagagcgaggtgttcgagatcaccgatttcacaacagcctccgagtgggagaggttcatatctaaagtggaggaagtactcaacgattggaagctgatcgggaattccttagggaaacccctcgaaaagggcatttttacctctggaacttgggaggagaagtcagacgaaatatcgtttgccgactttaagttctccgtcacacaccactacttggtccaagaaagcactgataaggagggcaaggacgaactgcttgaagatgtagtgccccaaagcatgcaagacttactgggaatgaacaatgacttccccccccgggcccactgccttgtccggtggtatggcctgcgagagttcgtcgtgattgcacctgctgctcattctgacgccgtgctgtcggaatctaagtgcaatttgctcctgagctccgtatctatagctctgggaaataccggctgtcaggtgcctctgttcgtccagatacaccataagtggcggaggatgtacgttggcgaatgtcagggacctggggtgcgtactgatttcgaaatggtgcacctgcgaaaggttcctaaccagtatacccacttgtctggcctgctggatatattcaagtccaagattgggtgcccattaaccccactgccacctgtgagcatcgcaatccgcttcacatatgtgttacaggattggcagcagtacttctggcctcagcagccgccagacatcgacgcacttgtgggcggagaggttggaggcctggaattcgggaagctcccattcggggcctgtgaggatcctattagcgaactgcacttagcaactacctggccgcacctgactgagggaattattgtggacaacgacgtgtactcagaccttgacccaatccaggcacctcactggagtgtcagagtgcgcaaagctgaaaaccctcagtgtcttctgggagactttgtcaccgaattctttaaaatttgccgtcgtaaagagagcacagatgagattctgggtcgtagcgcctttgaggaggaagggaaggagaccgcggacatcacgcatgccttgtctaagctgaccgagccagccagcgtcccaatccacaaactctcagtctccaacatggtacacacagccaaaaagaagatccggaagcatcgcggggtcgaggaaagtcccctgaataatgatgtgctgaatactattcttctgtttctgttcccagatgcggtgagcgagaagccccttgacggtaccaccagtactgacaataacaacccaccatcagagagtgaggattacaatctgtataaccagttcaagtccgccccaagcgatagtctaacatacaagctagctctgtgcctgtgcatgatcaacttctatcacggcggcctcaagggcgtcgcccacttatggcaggaattcgttctggaaatgcggttccggtgggaaaataattttttgattccgggtctggcaagcggtccgcctgatctcaggtgctgtctcttgcaccagaagctgcagatgctcaattgttgtatcgagcggaaaaaggctagggatgagggaaagaagacctcagcctctgatgtgacgaatatctaccctggggatgccggaaaggctggggaccagctcgtcccagataatctcaaagagactgacaaagaaaagggggaggtaggaaaaagctgggattcgtggtcagactctgaggaggagttctttgagtgtctctccgatactgaggagctaaagggaaatggacaagagtcgggaaaaaagggggggccaaaggagatggcgaatctgcgcccagagggtcggttgtatcagcacggaaagttgacactgctgcacaatggcgagcccctttacattccagttactcaggaaccggcaccaatgacggaggacctgttggaagaacaatccgaggtgctggcaaagctggggacctccgccgagggggctcatttgagggcccggatgcagtctgcttgcctattatccgacatggagagttttaaagccgccaatccgggttgctcgctggaggactttgtacgttggtatagcccacgtgattatatcgaagaggaagttatcgacgagaaaggcaacgtcgtgctcaaaggggagctgtcggccaggatgaaaatcccctcaaacatgtgggtcgaagcctgggagacggccaaacccattcccgcccgcaggcagcgcagactctttgacgacacgcgagaggccgagaaggtccttcactatctggcaattcaaaaacccgccgacttggcccggcacctcctgccctgcgtgatacacgccgcagtgctcaaagtgaaagaagaggaaagcctggagaacatctcatcagttaaaaagatcatcaaacagatcatttcccatagcagtaaagtcctacactttccaaaccctgaagataaaaaattagaagaaatcattcaccagatcaccaatgttgaagctctgatcgcgcgggcacgcagtctaaaggctaaattcggaaccgagaagtgtgagcaggaagaggagaaggaagaccttgaacggttcgtcagttgcctgctggaacagcccgaggttctcgtgacgggtgctggtcgggggcatgcaggtagaatcatccataaattattcgtgaacgctcagagggcggcagctatgacgcctccggaggaggagctaaagcgaatggggtcccctgaggaacgtaggcagaactctgtctctgacttcccaccgcctgccggacgcgagtttatcctgaggactactgtgcccaggcccgccccctactccaaagcactgcctcagcggatgtactcggtcctgaccaaagaagacttcagactcgccggagcattttcatcagatacttcattcttttag

SEQ ID NO: 202281 - DNA, 2808 bp, Artificial Sequence
  Description of Artificial Sequence: Synthetic coding sequence
atgttcagcctgatcagcggcatcttcaccagcggcacctgggaggagaagtctgacgagatcagcttcgcagactttaagtttagcgttacacaccattatctggtccaggaatctaccgacaaagagggcaaggacgagcttctggaggatgtcgtaccacagtccatgcaggatttgctgggaatgaataacgattttccccccagggcgcactgcctggtaagatggtacggactgagagaattcgtcgtgatcgccccagcagcccatagcgatgccgtgttgtccgaatcaaaatgcaacctgctgctctcatccgtaagcatcgccctgggaaacactggctgtcaagtccctttgtttgtccagattcatcacaaatggcgcaggatgtatgttggtgagtgccagggtcccggcgttagaaccgacttcgagatggtgcatctccgaaaagttccaaatcagtatacccatctgtcaggcctcctggacatatttaagtctaagatcggatgccctctcacccctctgccaccagtcagcatcgctatacggttcacctatgtcctccaggactggcagcagtacttttggcctcaacagccacctgatatcgatgcccttgtcgggggcgaggtcggtgggttagaatttggcaaactgcctttcggtgcttgtgaggaccccatctccgagcttcatttggccactacatggccccaccttaccgagggaatcatcgtcgacaacgacgtgtacagcgacctggacccgattcaagcgccgcattggtcagtcagagtccgtaaggcagaaaacccacaatgtcttttgggggacttcgttacggaatttttcaagatctgccggaggaaagaatccaccgacgaaattttaggccggtcagctttcgaggaggaaggtaaagagacagccgatattacccacgccctgtcaaagctgaccgagcctgcctctgttccaattcacaagctttccgtctccaacatggtgcatactgcaaagaaaaaaatccggaaacacagaggagtggaagagagtcccctgaacaacgatgtcttgaatactatcctcctatttctgtttcctgatgctgtaagcgagaagccattggacggaaccacctccacagataacaacaatcccccatcagagtcggaggactacaatctgtataaccagtttaagagcgcgcctagcgacagcctgacatataagctggccctttgcctttgtatgatcaacttttaccatgggggcttaaaaggcgtggcccatctgtggcaggagttcgtgttggagatgagatttagatgggagaacaattttttgatacctgggctggcctcgggccctccagacctccgttgttgtttgcttcaccagaagctgcagatgcttaattgttgtatcgagcggaagaaagcccgggacgagggcaaaaagacgtccgcctccgacgttaccaatatttatcccggcgacgctggcaaagccggggaccagctcgtgcctgataatctaaaagagaccgataaagagaagggcgaggtcgggaagtcttgggatagttggtcagactccgaagaggagttcttcgagtgcttatctgatacagaggagctgaaagggaatggacaagagtctggtaagaaagggggacccaaagaaatggccaaccttaggcccgaaggacgcctgtaccaacacgggaaacttacactcttgcacaacggtgagcctctctatatcccagtgactcaggagcccgctccgatgaccgaggatttgctcgaagagcagtccgaagtgctggcaaagctcggtacctcagctgagggtgctcacctcagggccagaatgcagtcggcgtgcctgctgtcagatatggagagtttcaaggccgcgaaccccggctgttctttggaggattttgtcaggtggtatagcccccgtgactacatcgaggaagaagtgattgatgagaaaggcaatgtggtgctgaagggcgaactgtccgctcgcatgaaaattccgtctaatatgtgggtggaggcatgggagacggctaagcccatccccgcaagaaggcagcgacgcctctttgacgacactcgggaggccgaaaaagtcctgcactacctggctatccagaaaccagctgatcttgcgagacacctgctgccatgcgtcattcatgccgccgttcttaaggtcaaagaggaagagagtctagaaaacatctcatcggtcaagaagatcattaagcaaatcattagccactcgtccaaagtgctgcatttcccgaaccccgaagacaagaagctagaggaaataattcaccagatcactaacgtcgaggcgctcattgcccgcgcccgctctctaaaagcaaagttcggaacagaaaagtgcgagcaggaagaagaaaaagaagatttagagagatttgtcagctgcttgctcgagcaacctgaagtcctcgtgactggagccggcagagggcatgccgggcgaataatccataagctattcgtaaatgcccagcgagcagccgctatgacacccccggaggaggaattaaagcgcatgggatcacctgaggaaagacggcagaatagcgtgtctgacttcccccctcccgccggtagagagttcatcctgaggacaactgtacctagacccgccccttatagcaaagccctgcctcagagaatgtactccgtgctcactaaggaagatttccgcctggctgtgaagattatcgatggggatgtctag

SEQ ID NO: 202282 - DNA, 2967 bp, Artificial Sequence
  Description of Artificial Sequence: Synthetic coding sequence
atggccgccgacagcgagcccgagagcgaggtgttcgagatcaccgactttactaccgcctctgaatgggagagatttatctcaaaagttgaggaggtgctaaacgattggaaattgataggaaacagcttgggcaaacctctggaaaaggggatattcactagtggtacgtgggaggagaagtccgatgagattagttttgccgacttcaagttcagcgtaacccaccattatctagttcaagaaagtaccgataaggagggaaaggacgaactgctcgaggatgttgtcccccagtccatgcaggacctcctgggcatgaataatgacttccccccccgggcgcactgcctcgtaaggtggtatggccttcgggaatttgtcgtgatagcaccagctgctcatagcgacgccgtcctatccgaaagtaagtgcaatctccttttgtcctcagtttccattgcactgggaaataccggatgtcaagtgccactttttgtgcaaatccatcacaaatggcgacgtatgtatgtgggagagtgtcaagggccaggggtaagaactgatttcgaaatggtgcatttacgaaaagtgcctaaccaatacacacatttgtccggtctcttggatattttcaaaagcaagatcggttgccccctgacccccctcccccctgtgagtattgccattaggtttacttatgttctccaggactggcagcagtatttttggcctcagcagcctcccgacatcgatgctctcgtaggaggcgaggtaggaggactagaattcggaaagttaccttttggcgcctgtgaagatcctatctcggaacttcatcttgcaaccacatggccacatttgaccgagggcatcatcgtggataatgatgtctatagcgaccttgaccccatccaggccccccactggagtgttcgtgtgcggaaggccgaaaaccctcagtgcctgctgggtgacttcgtgacagagttttttaaaatctgccggaggaaggaaagtacagatgagatcctcggtaggtcagccttcgaagaggagggaaaagagactgcggacatcactcacgcgcttagcaaactcaccgagccggcctcggtccccatacataagctgtctgtgtctaatatggtccataccgcaaagaaaaaaattagaaagcatagaggggttgaagagtctcctctgaataatgacgtgctgaacacgatcttgcttttcctcttccctgatgccgtcagtgagaaaccgctggatggaaccacgagtaccgacaacaataaccccccctcagaatctgaagactacaacctgtacaaccagtttaagtctgctccaagtgattctctgacctacaaactggccctgtgcctgtgtatgatcaacttctaccatggcggattgaaaggtgtggcccacctatggcaggaattcgtcttggaaatgaggttccggtgggagaacaacttccttattcccgggctggcttccggccctcctgacttacgttgttgtttactccatcaaaaactgcaaatgctcaactgctgtatcgagaggaaaaaggcaagggacgagggcaagaaaacctccgcaagcgatgtaacgaacatttaccccggtgacgccggcaaggcaggggatcaactggtgccagacaacctaaaggaaactgataaagagaagggagaagtgggaaaatcatgggactcctggtctgactctgaggaggagtttttcgagtgcctgtctgataccgaggaattgaaagggaatggtcaggaatccggaaagaaggggggaccaaaggaaatggctaatctccgacctgaggggcgactgtatcaacacggcaagctcaccctactccacaatggtgagccactgtacatccctgtaacccaggagcctgccccaatgacagaagaccttctggaagaacagtccgaggtgctcgccaagttgggaacttctgctgagggggcccacctcagggcacggatgcaaagcgcgtgcctgctgtccgatatggagtcttttaaggccgccaacccaggatgcagcctggaagattttgtgcggtggtattcaccacgggactatatagaagaggaggtgatcgacgagaaaggaaatgttgttctgaaaggggagctgagcgcgcgaatgaaaatacccagtaacatgtgggtagaggcgtgggagacggccaaaccgataccagcgcggcgacagcggaggttgtttgacgatacccgggaggccgaaaaggtgctgcactatctagctattcaaaaacctgctgatctcgcacgtcacctgttgccctgtgtcattcacgcagccgtcctcaaagttaaagaggaggagagcttagaaaatattagctctgtcaaaaagatcataaaacagatcattagccactcatccaaggtcctgcattttccaaaccccgaggacaagaagcttgaggaaatcatccaccagataaccaacgtcgaggccttaatagctagggcacgcagcctgaaagctaagtttggaacggagaaatgcgaacaggaagaggaaaaagaagatttggagcggttcgtgagctgcctcttggaacagcctgaggtgctggtgaccggcgccggcagaggacatgccggtcgcatcatacacaagctattcgtcaacgctcagaggctaaccgagagctccgacgaagccgcggcgatgactcctccagaagaagaactaaagcgcatgggtagccctgaggaacgccgacagaactccgtgagcgactttccacctcccgccggtagggagttcatcctccggaccaccgtccccagacctgcgccttattcaaaagcactccctcagaggatgtatagcgtacttaccaaagaggacttcaggctggcaggagcattctcctctgacacgtcattcttttag

SEQ ID NO: 202283 - DNA, 4182 bp, Artificial Sequence
  Description of Artificial Sequence: Synthetic coding sequence
atggcctgcagcatcgtgcagttctgctacttccaggacctgcaggctgcacgcgatttcttgttccctcacctgagggaggaaatcctatctggtgccctgaggcgagaccctagtaagtctaccgactgggaggacgatggctggggtgcctgggaggagaacgaaccgcaagaaccagaagaagaaggaaatacctgtaagacccagaagacctcctggctgcaggactgtgtcctgagcttatccccaaccaatgatctgatggtgatcgccagagagcagaaggcagtgtttcttgtgcctaaatggaaatatagtgacaagggtaaggaagaaatgcagtttgccgtcgggtggtctgggtcactgaacgtggaggagggggaatgcgtaacaagcgcactgtgcatcccactagccagccaaaagcgcagctccaccggccggcctgattggacctgcatcgtggttggcttcactagcggttacgtgcgcttctataccgaaaatggggtcctgctgctggctcagctcctcaacgaggaccctgtactgcagctcaaatgtcgaacatacgagattccgcgccatccaggggttactgaacagaatgaggaactgtccatcctctaccccgccgctatcgtgaccattgatggcttttctctctttcaatcactaagggcctgtagaaatcaagtagccaaagccgctgccagcggtaatgagaatattcagcctccaccactcgcttataagaagtgggggctccaggacattgatacgattattgaccacgcaagcgttggtattatgaccctctcccctttcgaccaaatgaagactgccagcaatatcggtggttttaatgctgccatcaagaatagcccgccagccatgtcccagtacattacggttggctccaatccctttacaggttttttctatgctctggaagggtctacccagcccctgctgagccatgtagctctcgcagtcgcatctaaactgacctcggctctgttcaacgccgcttctgggtggttggggtggaagagcaagcatgaggaggaggccgtgcagaaacaaaagcccaaagtggagcctgcaacacctctcgccgtacgttttggactccccgacagtcggcggcatggggagtctatctgcctgtctccttgcaatacccttgctgcagtcaccgacgactttggacgggtaattctgctggacgtggctagaggaatagcaatcaggatgtggaagggttatcgagatgctcagattggatggatccagacggtggaagacctgcacgaaagagtgccagagaaggctgacttttcgccgttcgggaattctcagggaccctcacgggtggcccagttcctggtgatctatgcgccccggaggggcattctggaagtgtggagcacacagcagggccccagagtcggcgcgtttaacgtcgggaagcattgccgcctcctatatcccggttacaaaatcatgggattgaacaatgtgacctcccagagttggcagccccagacttatcagatctgtttggtggaccccgtgagtggcagcgtcaagacagtgaacgtgccgtttcatctggccctgtcagataaaaaaagcgagcgggcaaaagacatgcatctggtgaaaaagctggccgcgctgttaaagactaagtctcccaacttggatctggtggagacagaaattaaagagctaattctggacataaagtaccctgcgaccaagaagcaggccctggagtctatcctcgcctctgagcgccttccttttagctgtctgagaaatattactcaaaccctgatggatactcttaagagccaagaattggaatccgtggatgaaggcttattacagttttgtgctaacaagttaaagctgctgcagctatacgagagcgtctctcaacttaattctctggatttccatcttgatactcccttctccgataatgatctcgctctgctgttgcgactggatgagaaggagctgctgaaactacaggcactgctagaaaagtataagcaggaaaatacccgcactaatgtgcggttttccgatgacaaggacggcgtgttacctgtcaagaccttcttggagtacctggagtacgaaaaagacgtcctaaatatcaagaagataagcgaggaagagtatgttgctcttggatcttttttcttctggaagtgtctacatggggaaagctcgaccgaagacatgtgccacaccctggagtccgcaggactatccccacagcttctgctcagcctcttgttgtcggtatggttgagtaaagaaaaagatattctggataaaccgcagagcatctgctgcctgcacaccatgctatctctgctgtccaagatgaaagtagctatcgacgagacatgggacagtcagtctgtgtcaccctggtggcagcaaatgcgcaccgcctgtatacagagcgagaacaatggcgccgccctcctttctgcacacgtgggccactccgtggcggcccagatctcaaataacatgaccgagaagaagttttcgcaaacagtcctcggcgcagattcagaagctctgaccgatagttgggaagcgctctctttggataccgaatattggaagttacttttgaagcaacttgaggattgcctcattcttcaaactttgttgcacagtaaaggaaacacacagacatccaaagtgtcatcactccaagccgaaccactgccccgtctaagcgtgaagaagctgctggagggtgggaaaggaggcatagccgatagcgtggctaaatggatatttaaacaggatttttcccccgaggttctgaaactggcgaacgaagagcgggacgctgagaatccagatgagcccaaggaaggcgtcaacaggtcttttctggaggtcagcgaaatggagatggatctgggagcaattcccgatctcctgcaccttgcatatgagcagtttccctgttccttggagctggacgtcttacacgcgcactgttgctgggaatatgtggttcaatggaataaagatcctgaagaagctcggttttttgtacgtagcatcgaacatctcaagcagattttcaacgcacacgtgcagaatgggattgcactgatgatgtggaacaccttcctggtgaagaggttctcggccgcaacgtacctgatggataaggtgggcaagagcccgaaggataggctgtgtaggcgagacgtcgggatgtcagatactgcaatgaccagcttcctcggatcttgcttagacctgttacagatcctgatggaggctgatgtttcacgagacgagatccaggttcccgttctggatacagaagacgcctggttgtccgtagaggggcctattagtattgtggaacttgctctcgagcagaagcacatacattatccgctcgtggagcaccattccattctgtgttccattttgtatgcagtcatgcgcttctcacttaaaacagtgaagcccctgtccctcttcgatagcaagggcaagaacgcctttttcaaagacctgacttctatccagctgttgccttcaggggagatggaccctaactttatttccgttcgccaacagttcctgttgaaggttgtgagcgcagctgtccaggcacagcacagtgctactaaggtcaaagatccgactgaggaggcgaccccgaccccctttggcaaggaccaggattggcctgccctggcggttgacctggcacaccacctgcaagtctcggaggacgtcgtgcgacggcattatgtgggcgaactgtacaattacggagtggatcatctgggagaagaggctattttgcaggtgcatgataaagaggttctggcgagtcaattgctcgtcttgacggggcaaaggctcgcacatgccttgctgcatacacagacaaaggaagggatggagctcctcgctcgtttaccccctacactctgcacctggctgaaagcaatggatcctcaggacctgcaaaataccgaggtgccaattgcaacgaccgccaagctggtgaacaaggtcattgaattgctgccggagaagcacggccagtacgggctcgcactgcatttgatcgaggctgtcgaggccataagcctgccaagcctttag

SEQ ID NO: 202284 - DNA, 612 bp, Artificial Sequence
  Description of Artificial Sequence: Synthetic coding sequence
atgagcatggaggactacgacttcctgttcaagatcgtgctgatcgggaacgcaggcgtaggaaaaacgtgtcttgtccggaggtttacgcagggcctgttccccccgggccagggagcaactattggggtcgatttcatgatcaaaactgtggaaatcaatggggagaaagttaaactccagatctgggatactgccggacaagagcgctttagatccattacgcaaagctattaccgttccgcaaatgctctcattctgacttatgatatcacatgcgaggagagttttaggtgtctccctgagtggttgagagagatcgaacagtatgcatctaacaaagtgatcactgtgctggttggcaacaagattgatctggctgaacgccgtgaggtctcacagcagagggctgaggaattcagtgaggcgcaggacatgtactacttagaaaccagtgccaaggaaagtgacaatgtggaaaagctcttcctggatttggcctgcagactcatctccgaggcgaggcagaacaccctggttaataatgtgagctctccactacccggagagggaaagtcaatttcctacctgacatgttgtaattttaattag

SEQ ID NO: 202285 - DNA, 345 bp, Artificial Sequence
  Description of Artificial Sequence: Synthetic coding sequence
atgagcatggaggactacgacttcctgttcaagatcgtgctgatcggcaatgcaggggtcgggaaaacttgtctcgtccggcgttttactcagggactttttcccccaggtcagggagccacaatcggtgttgacttcatgattaaaacggtggagattaatggagagaaggtaaagctacagatatgggacactgcggggcaagagcggttcaggtccattactcagtcctactacagatccgcaaatgctctgatattaacctatgacattacttgcgaggaatcattccgctgtctgcctgagtggctgcgcgaaatcgagcaatacgcctctaacaagtag

SEQ ID NO: 202286 - DNA, 612 bp, Artificial Sequence
  Description of Artificial Sequence: Synthetic coding sequence
atgagcatggaggactacgacttcctgttcaagatcgtgctgatcggaaatgcaggcgtggggaagacatgtctcgtacgtcggttcacacagggcttgtttccgcccggccagggtgcaacaattggagtggattttatgataaaaaccgtggaaataaacggagaaaaggtgaagctgcagatctgggacaccgccgggcaggagaggttccgctctatcacccaaagctactacagaagtgccaacgcactcattttgacatatgacatcacctgcgaggagagttttcgatgtcttccagaatggttgagggagatcgagcagtacgcatccaacaaggtcatcacagtcctcgtgggaaataagattgacctggccgaaaggcgagaggtttctcagcagcgcgctgaagaatttagcgaagcgcaagatatgtattatctggaaacgtctgccaaggagagcgacaatgtagagaagctgttcctggatttggcttgccgcttaatctctgaggcgcgccagaacactctggtaaataacgtgagtagtcccctgccgggagaaggaaagtcgatatcttatctcacctgctgcaacttcaattag

SEQ ID NO: 202287 - DNA, 168 bp, Artificial Sequence
  Description of Artificial Sequence: Synthetic coding sequence
atgagcatggaggactacgacttcctgttcaagatcgtgctgatcggaaatgccggtgttgggaagacatgcctggtccgcaggttcactcaaggactgtttccgcctggacagggcgcaaccattggtgttgacttcatgatcaagacagtggaaatcaacgggtag

SEQ ID NO: 202288 - DNA, 507 bp, Artificial Sequence
  Description of Artificial Sequence: Synthetic coding sequence
atgagcatggaggactacgacttcctgttcaagatcgtgctgatcggaaacgcgggcgtaggaaagacatgcctcgttcgccggttcactcagggactgtttccccccggccagggagccactatcggggtcgacttcatgattaagactgtggaaattaatggcgagaaggttaagctgcagatctgggacaccgcaggccaggagcgcttccggtccatcacgcaaagctattataggtcagctaatgcactcatcctgacttacgatataacttgcgaagaaagtttcaggtgcctgccagaatggctgcgtgagatcgaacaatacgcaagcaataaagtcataaccgtgctcgtcgggaacaagatcgaccttgccgaacgccgcgaagtcagtcagcagcgcgcagaggagttctcagaggcacaagatatgtactacctggagactagtgccaaggaatccgacaacgtggaaaaactcttcttagacctggcatgctag

SEQ ID NO: 202289 - DNA, 183 bp, Artificial Sequence
  Description of Artificial Sequence: Synthetic coding sequence
atgagcatggaggactacgacttcctgttcaagatcgtgctgatcgggaatgccggggtaggaaagacttgcctcgtgcggagatttacccaagggcttttcccaccgggacaaggagccacaataggagtggatttcatgattaagactgtagaaattaatggcgaaaaggtaaaactgtag

SEQ ID NO: 202290 - DNA, 612 bp, Artificial Sequence
  Description of Artificial Sequence: Synthetic coding sequence
atgagcatggaggactacgacttcctgttcaagatcgtgctgatcggaaacgctggcgtcggcaaaacatgccttgtgagacgcttcactcagggactctttcctcccgggcagggcgcgacaattggcgtcgattttatgatcaaaaccgtggagataaatggagagaaagttaaattgcagatttgggataccgctggccaggagcgcttcagatctattacacagtcctattaccggagtgcaaatgccctgattctgacctatgacatcacatgcgaagagtcgttcaggtgcctgccagagtggctccgggagatcgagcaatacgcaagcaataaagtgatcacagtacttgtcggcaataagatcgaccttgccgagcgcagagaggtaagccaacagcgcgccgaggagttctccgaggctcaggacatgtattacctggagacatccgcgaaagagtccgataatgttgaaaaactctttctagacctcgcttgcagactcatatctgaagctcgccagaacacactggtgaacaacgtttcttcacctctgcctggggagggaaagtccatctcttatctcacttgttgcaatttcaattag

SEQ ID NO: 202291 - DNA, 303 bp, Artificial Sequence
  Description of Artificial Sequence: Synthetic coding sequence
atgagcatggaggactacgacttcctgttcaagatcgtgctgatcggaaatgcgggcgtgggaaagacgtgtctcgttcgccgctttactcaggggctctttccgccggggcagggtgccacgattggtgtggacttcatgattaagacggtcgagatcaacggcgagaaggtgaaactccagatctgggacacagcgggacaggagagattccgatcaattactcagtcatactacagaagtgctaatgccctcattctgacatacgacatcacatgtgaggaaagttttagatgcctgtag

SEQ ID NO: 202292 - DNA, 495 bp, Artificial Sequence
  Description of Artificial Sequence: Synthetic coding sequence
atgagcatggaggactacgacttcctgttcaagatcgtgctgatcggcaatgcaggtgtgggcaagacctgtctggtccgacgttttacacagggactgtttcctccaggccagggagctaccataggggtggatttcatgatcaagaccgtcgaaatcaatggggaaaaggtgaagcttcagatttgggacacagccgggcaggaacgatttcgcagtatcacccagagctattaccggtctgccaacgcactgattctgacctacgacatcacatgcgaggagtccttccggtgtctgcccgagtggctccgggaaattgagcagtacgcaagtaacaaggttatcactgtcttggctacccggctgacctggttaaagggcgaaaggtttccttctagtgagctgaagaacagccagaagttgcggacttgcatcatctggagacctcagccccggaacctcatcatgtggaggaactctagcctcacgtag

SEQ ID NO: 202293 - DNA, 420 bp, Artificial Sequence
  Description of Artificial Sequence: Synthetic coding sequence
atgagcatggaggactacgacttcctgttcaagatcgtgctgatcggcaacgcaggagtgggtaaaacctgcctggtacgccgcttcactcagggtctgttcccacccggccagggggccaccattggggtggacttcatgattaaaactgtggaaatcaatggagagaaagtgaagttacagatttgggatacggctgggcaagagaggtttagatccataacacagagttactaccgttctgccaatgccctgatccttacttacgatatcacctgcgaagagtccttccgatgcctgcccgaatggctcagggagatagaacagtatgcttcgaacaaggtgattaccgtcctggtgggtaacaagatcgacctagccgaacgccgcgaagtgtcgcagcagcgggccgaggagtag

SEQ ID NO: 202294 - DNA, 588 bp, Artificial Sequence
  Description of Artificial Sequence: Synthetic coding sequence
atgatggccatccgggagctgaaggtgtgcctgctgggcgacaccggagttggaaagagctctattgtctgcaggtttgtccaggaccacttcgatcataatatcagtccgaccattggcgcatcatttatgactaagaccgttccttgcggtaatgaactccataagttcttaatctgggacacggcggggcaggagcggttccatagccttgccccaatgtattataggggaagcgctgccgctgttatcgtgtatgatataacaaagcaggacagtttttatactctgaagaagtgggtaaaggaacttaaagaacatggtcccgaaaacatagtaatggctatcgcagggaataagtgtgatctctcagatatccgggaggtgccattaaaggatgctaaggaatatgccgaatccataggggcaatagtcgttgagacctctgccaaaaatgcgatcaatatagaggagctgtttcagggaatctcgcggcaaattccgcccctcgatcctcacgaaaacgggaataatggtacgatcaaggtcgagaagccaaccatgcaagcctcacggaggtgttgctag

SEQ ID NO: 202295 - DNA, 561 bp, Artificial Sequence
  Description of Artificial Sequence: Synthetic coding sequence
tgcctgctgaacgacaccggcgtgggcaagagcagcatcgtgtgcagatttgtacaggatcatttcgatcataatattagtcctacaatcggagccagtttcatgactaagacagtcccatgcggaaacgagctccataagttcttgatctgggacaccgcaggtcaagagaggttccactccctggcacctatgtattatcggggatccgcggcggccgttattgtgtacgatatcaccaagcaggattccttctatactctgaagaagtgggtgaaagaactgaaagagcacggtcccgagaacatagtgatggccatcgcagggaataaatgtgatctctctgacatccgcgaggttcccctgaaagacgcgaaagagtacgctgagagcatcggagccatcgtggtggaaaccagtgccaaaaacgctatcaatattgaggagttgttccaaggtatttcccgccagatcccccccttggaccctcacgagaacggtaacaatggaaccattaaagttgaaaagccaaccatgcaggcctcgagaaggtgttgttag

SEQ ID NO: 202296 - DNA, 678 bp, Artificial Sequence
  Description of Artificial Sequence: Synthetic coding sequence
atggccggcggcggcgccggcgaccccggcctgggcgccgccgccgctcccgccccagaaacacgagagcatttgttcaaggtactggtaatcggcgaattgggcgtggggaagaccagcattataaaaaggtacgtccatcagctgttcagccagcattaccgggctactataggcgtggattttgctctgaaggtcctaaattgggacagcaggacactggtgagactccagctgtgggatattgcgggccaggagcggtttggcaatatgactagagtgtactacaaggaagcagtgggcgcttttgtggttttcgacatctcacgcagtagcacattcgaagcagtgttaaaatggaagagcgacctggactctaaagtacacctgcccaacggatcaccaatcccggccgttctgctggctaacaagtgtgatcaaaataaggattcctcacagagcccttcccaggtggaccagttttgtaaggagcatggctttgccgggtggtttgagacatcagcgaaggataacataaacatagaggaagctgcccggtttctggtggagaaaattctagtgaatcaccaatctttccccaatgaggaaaacgacgtcgataagatcaagttagaccaggaaactctcagagccgagaacaaatctcagtgctgttag

SEQ ID NO: 202297 - DNA, 714 bp, Artificial Sequence
  Description of Artificial Sequence: Synthetic coding sequence
atggcccagcccatcctgggccacggcagcctgcagcccgccagcgcagccggactcgcctccttggaactggattcttctctggaccagtatgtccagatcagaatctttaagattatcgttatcggggacagtaatgtaggcaaaacgtgtctgacctttcgattttgtggtggaactttccccgacaagaccgaggccacaattggagtagacttcagggagaagactgtagagattgagggagagaagatcaaggtgcaggtttgggacacggctggacaagaacgcttccgtaagtcgatggtggaacactattataggaacgtgcacgccgtggtttttgtttacgacgtgacaaagatgacgtcctttacaaatctgaagatgtggatccaggaatgcaacgggcatgcagtgcctccgctggtcccaaaggtactggtggggaacaagtgcgacttgcgcgaacaaatccaggtcccttctaatctggctctcaagtttgctgacgcgcataacatgctgctcttcgagacctctgcaaaggatcccaaggagagccagaatgtggaatctatcttcatgtgtctggcttgcaggctaaaagcccagaaatctttgctgtacagagatgcagagaggcagcaagggaaagtccagaaattggagttcccgcaggaggccaactcaaagacctcttgtccctgctag

SEQ ID NO: 202298 - DNA, 714 bp, Artificial Sequence
  Description of Artificial Sequence: Synthetic coding sequence
atgaacatcctggcccccgtgcggcgggaccgggtgctggccgagctcccccagtgcttgcgcaaggaagctgctctgcacggtcataaggactttcatccaagagttacctgcgcatgccaggaacacagaactggcacggtaggcttctgcaaggacaccttcgacaagaattacaaagctacaattggggttgattttgagatggagcggttcgaggtgctaggtatcccgttctccttgcagctctgggatactgcaggacaggagagattcaaatgcattgctagcacttattacaggggcgctcaggctataatcattgtgtttaatcttaatgacgtagcatctctggagcacaccaagcagtggctcgcagacgcactcaaagaaaacgaccctagctctgtgttattgtttctggtcgggtcaaaaaaagacttgtccactcccgcccagtacgccttgatggagaaggacgctctgcaagtggctcaagaaatgaaagccgagtattgggcagtgtcatcattaaccggcgagaatgtacgggagtttttcttccgagtggcggcactgacatttgaagcaaacgtgttggcggaactggagaagagtggcgctcggcgcatcggggatgtggtgcgcattaattcagatgacagtaatctatatctgactgcctcaaaaaagaagccaacatgttgtccttag

SEQ ID NO: 202299 - DNA, 780 bp, Artificial Sequence
  Description of Artificial Sequence: Synthetic coding sequence
atgaacatcctggcccccgtgcggcgggaccgggtgctggccgagttgccccaatgcttgcgtaaagaagcagcgcttcacggacataaggacttccacccaagggtgacttgcgcctgccaggagcacaggactggcaccgttggattcaagatcagtaaggtgatagtggttggcgacttatcagtaggcaagacttgcctcatcaaccgcttctgcaaagacacattcgataagaactacaaagcgacaatcggcgtcgactttgagatggaacgcttcgaggtactcgggatccccttttctcttcagctgtgggataccgcaggacaggagagattcaagtgcatcgcctctacatattaccggggagcacaggcaatcatcatcgtcttcaacctaaacgatgttgcatccctagaacacactaaacagtggctggctgatgctctcaaagagaatgacccctcctcagtcctgctcttcctcgtgggaagcaaaaaggacctgagtactcccgcccagtatgccctcatggagaaggatgctttgcaggttgcacaggagatgaaagcagaatactgggctgtctcttccctgaccggggaaaacgtgagggaattttttttcagagtagcagctctgacgtttgaggcgaatgtgctagccgagcttgagaaatctggcgctcgtcgaatcggagacgttgtccggatcaactcagacgactctaacctttatctgactgcgtctaagaaaaagccaacgtgctgtccttag

SEQ ID NO: 202300 - DNA, 636 bp, Artificial Sequence
  Description of Artificial Sequence: Synthetic coding sequence
atgaacatcctggcccccgtgcggcgggaccgggtgctggccgagctgccacagtgtctgcgtaaagaagccgcactccatggccacaaggactttcatccccgcgtcacttgtgcctgccaggaacatcggactggaactgtgggttttaagatttcgaaagtgattgtggtcggggacctctctgtaggtaagacttgcctgattaataggttttgcaaagacacgtttgataagaactataaggctaccattggcgttgacttcgagatggagcgctttgaagttctcgggataccatttagccttcagttatgggacacagctggacaagaacgctttaagtgtatagcctcaacttattatcgtggtgcccaggccattatcatcgtcttcaatcttaacgatgtcgcaagcctagagcataccaaacagtggctggccgacgccttgaaagaaaatgacccctcgagcgtgctcttgttcttggttggcagtaaaaaagatctgagcacccctgcccaatacgccttgatggaaaaagatgccctgcaagtagcccaggaaatgaaagctgagtactgggccgtcagtagccttactggggagaatgtgcgcgagttttttttccgttag

SEQ ID NO: 202301 - DNA, 756 bp, Artificial Sequence
  Description of Artificial Sequence: Synthetic coding sequence
atgaacatcctggcccccgtgcggcgggaccgggtgctggccgagttgccccaatgcctccggaaagaggccgccttgcatggtcacaaggactttcaccctagggtgacttgcgcttgtcaggaacaccgaactgggacagtcggattcaagatctctaaagttatcgtggtgggcgatctgtctgtgggcaaaacatgcctgatcaaccggttttgcaaggataccttcgacaaaaattataaagccaccatcggagtggacttcgaaatggaacggttcgaggtcctgggtatccccttttccttacagttgtgggataccgcaggccaagagcgttttaagtgcatcgcaagcacctattataggggcgcccaggccattatcatcgtgtttaaccttaacgacgtagcctccctagaacatactaaacagtggttggccgacgcccttaaggaaaacgacccctcatcagtgttattattcttaacccctgcccagtatgccctgatggagaaggatgccctgcaggtcgcacaggagatgaaagcagagtactgggccgtgagctcgctgaccggagaaaacgtccgggagttctttttcagggtggcagctctgacgtttgaggccaatgtacttgctgagctggaaaaatctggtgcccgtcggatcggcgacgtcgttcggataaactcggacgattcgaacctgtacttgaccgcttcaaagaagaagcctacgtgctgcccctag

SEQ ID NO: 202302 - DNA, 780 bp, Artificial Sequence
  Description of Artificial Sequence: Synthetic coding sequence
atgaacatcctggcccccgtgcggcgggaccgggtgctggccgagcttcctcagtgtttacgcaaggaagcggccctgcacggccataaagactttcaccctagagtgacatgcgcatgtcaggagcaccgcaccggcaccgtcggtttcaaaatcagcaaggtgatcgttgtgggagatctgtcagttggtaagacctgtcttattaatagattctgcaaggacacctttgacaagaattataaggcgactatcggcgtggatttcgaaatggagagattcgaagttctcggaatccccttttctctccagctgtgggatacggctggacaggagaggtttaagtgcatcgcgtccacatactaccggggcgcacaagccatcatcattgtgttcaatctgaatgacgtagcctcactggaacataccaaacagtggctcgccgacgcgttaaaagagaacgacccttcttctgtgttattattccttgtaggctccaaaaaagacttgtccaccccggcccagtatgccctgatggagaaggatgctctccaggtagcccaggagatgaaagctgagtattgggccgtgagtagtctgaccggcgaaaatgttagggaattcttcttcagagtagcggcactgaccttcgaggcaaatgtgctggccgaacttgagaagtccggagcacggcggatcggggatgtggtacgaattaattcagatgactctaacctgtacctaacagcatctaaaaagaaacctacctgctgcccgtag

SEQ ID NO: 202303 - DNA, 636 bp, Artificial Sequence
  Description of Artificial Sequence: Synthetic coding sequence
atgaacatcctggcccccgtgcggcgggaccgggtgctggccgagctgccacagtgccttcgcaaggaggctgctctccacggtcataaagacttccaccctagagtaacctgcgcatgtcaggagcaccgaaccgggacagtggggtttaagatttcaaaagtgatcgtggtaggggacttgagcgtgggaaagacttgtttgattaatcgcttctgcaaggatacatttgataagaattacaaggcaaccataggtgtggattttgaaatggagaggtttgaggttctgggcatcccttttagcctgcagctgtgggataccgctggccaggagcgctttaaatgtatcgcatctacttattacaggggggcccaggccattatcatcgtgtttaacctgaacgacgtggcaagtctcgagcacacaaagcagtggctagccgacgctctgaaggagaatgacccaagtagcgtgctgttatttcttgtaggatcaaagaaagatctgagtaccccggcacagtatgcgctgatggaaaaggacgccctccaggtcgctcaggaaatgaaggcagaatattgggccgtgagcagtctgacaggagaaaacgtgagggagtttttctttagatag

SEQ ID NO: 202304 - DNA, 696 bp, Artificial Sequence
  Description of Artificial Sequence: Synthetic coding sequence
tgaagcctgcggttccccatcaccaacagcgccggcgccccctgcaaagcagcaggaagaatgaacattttggcacctgtgcgcagggatcgcgtgctcgcagagttaccccaatgcctgcgaaaggaagccgccctgcacgggcacaaagacttccatccacgcgtgacttgcgcatgccaggaacacaggacagggacggtggggcgtttcaaaatcagcaaggttatcgtggttggagacctgagcgtggggaaaacttgtcttatcaacaggttctgcaaagacaccttcgacaaaaactacaaagcaactattggtgtggacttcgaaatggaaagattcgaagtgctgggtataccatttagtcttcagttgtgggatactgcagggcaggaacgttttaagtgtatcgcttctacttactacaggggcgcccaagctattatcatcgtgtttaacctgaacgacgtggcctcactggaacatacgaagcagtggctagccgacgcactgaaggaaaacgacccatcatccgttcttctgttcttggtcgggtctaagaaagatctgtcaacaccagctcagtatgcgctcatggagaaggacgctctccaagtcgctcaagaaatgaagaccgtccagcgtctgccctcaccaagagccctgtgtcatccacattcgtctcgcgcctag

SEQ ID NO: 202305 - DNA, 951 bp, Artificial Sequence
  Description of Artificial Sequence: Synthetic coding sequence
atgagccacctgcccggcctggagctgcggcgggaggccccccccctcctcggccccctgctctccccctttcctcttcccgcagggtcctggcaccgtcagatgctgcgcagctcactgcgctttcccatcaccaattcagcaggtgccccttgtaaggcagcaggacggatgaacatacttgccccagtgcggagggatagggttttagctgagttgcctcaatgtcttcggaaggaagccgctttacatggccacaaagactttcaccccagggttacctgtgcttgccaggagcataggacaggcacggtgggctttaaaatatccaaggtcattgtcgtgggagacctctcagttggtaagacctgcctgatcaaccgcttttgtaaagacacattcgataagaattataaggcaaccattggggtggatttcgagatggaacgcttcgaagtcctggggatccccttttcccttcagctgtgggatacggctggacaggagcgctttaagtgcatcgccagcacctattataggggggctcaagcaatcatcatagtgttcaatcttaacgacgttgcctccttggaacatacaaagcagtggttggcggatgccttgaaggagaacgatcccagctcagtgctgctgttcctggtgggcagcaaaaaagacctcagtacgcctgctcagtatgccctgatggagaaggatgccttgcaggtggcccaggagatgaaagccgaatactgggccgtatccagtctaactggcgagaacgtccgagagttctttttcagagtcgcggcgctgacattcgaagctaacgtcctggccgagctagaaaaatctggggctaggcgtattggcgacgtcgttcggatcaacagtgatgacagtaacctgtatctgaccgcctcaaaaaagaaacccacatgctgtccctag

SEQ ID NO: 202306 - DNA, 825 bp, Artificial Sequence
  Description of Artificial Sequence: Synthetic coding sequence
atgctgcggagcagcctgcggttccccatcaccaacagcgccggcgcgccatgtaaggccgccggccgtatgaacatactcgcacctgtgcgacgcgatagggtgctggccgaattgccacagtgcctcaggaaggaggccgcccttcatgggcataaggacttccaccccagagttacttgcgcgtgccaggaacatcgtactggcacggtcggatttaagatctccaaagtgatcgtggtgggggatctaagtgttggcaaaacctgcctcatcaacagattctgtaaggatacttttgacaagaattataaggccaccataggggtcgattttgaaatggagcgtttcgaggtcctggggatacccttcagcctccagctgtgggatacggctggccaggagcgctttaaatgtatcgcttctacttattatcgtggcgcccaggccataatcatcgtatttaatctaaacgatgtggcgtcactggaacacaccaaacagtggttggcagacgctttaaaggagaatgaccccagcagtgtgctgctcttcttgacacctgcccaatacgccttgatggaaaaggatgctcttcaagtagctcaggagatgaaggctgaatactgggccgtgtcttcattgaccggtgaaaatgtacgggagtttttcttcagagtagctgccctcacatttgaagccaacgtcctggccgagcttgagaaaagtggagcccggaggatcggcgacgtggttaggatcaattctgacgactccaacctgtacctgacagcaagcaaaaagaaacctacgtgctgtccctag

SEQ ID NO: 202307 - DNA, 807 bp, Artificial Sequence
  Description of Artificial Sequence: Synthetic coding sequence
atgagccacctgcccggcctggagctgcggcgggaggccccccccctcctgggtcccctcctgagtcccttccccctgccagccggctcttggcaccggcaaatgctgagatccagtctgcgattcccgattacaaattcagccggtgctccctgcaaggcggccggccgcatgaatatcctggcacccgtgcgccgggaccgcgtacttgccgagctaccccagtgtctgcggaaggaagcagcactccacggccacaaggactttcatccccgcgtgacatgcgcctgccaagaacatcgaacaggaactgtggggcgctttaaaatcagtaaagttatcgtagtgggcgatctgagtgtcggaaagacatgtctaatcaatcgcttctgcaaagacaccttcgacaagaattataaggcaactataggggtcgattttgaaatggaaagatttgaagttctcgggattccatttagcctgcagctttgggatactgctggacaggagaggttcaagtgtatcgcctctacgtactacagaggtgcccaggccattattatagtgtttaaccttaacgatgtggccagtctcgagcacacaaagcagtggttggcagatgccctaaaagaaaacgacccctccagcgtcctgctgtttttggtggggtccaaaaaagatttgtccacgcccgcacagtacgctttgatggaaaaggatgcattacaggtcgcccaggagatgaaaaccgtccagaggttaccctctcccagggccctctgtcatccccacagctcccgcgcctag

SEQ ID NO: 202308 - DNA, 1002 bp, Artificial Sequence
  Description of Artificial Sequence: Synthetic coding sequence
atggtgatcgccggcgccagctggatgctgggccgggccgccgccagccctacccaaacaccaccaactacgagcactattagggtcgctaggaggagcagagttgccctcgtggctatggttattgccgctgcagggtcagggggaccaggcagagccgagccacagctgtcccagcctagtctggattgcggacgaatgcggagtagtctcaccccactcgggcctccggtgtcaagagaccgtgtgatcgccagctttccaaagtggtatacaccagaagcctgcttgcaactgcgcgaacatttccatggacaagtctccgctgcctgtcagaggcggaatacgggcactgtcggcttaaagttgtcaaaagtggtcgtcgttggggatctgtacgtgggcaagacttccctcatccataggttctgcaagaacgtcttcgaccgtgactacaaagccaccatcggagtcgacttcgaaattgaacggtttgaaattgccgggatcccctactctctgcagatttgggataccgccgggcaggaaaagttcaagtgcatagctagcgcctactaccggggagcacaggttattatcactgcctttgatctgactgatgtgcagacactggagcacacccgccagtggttggaagatgccctaagggagaatgaagcaggctcctgcttcatttttcttgtgggaacaaagaaggacctgctttccggagctgcttgtgagcaggcagaagccgatgctgtccaccttgcacgagagatgcaggctgaatattggtctgtgagcgctaagacgggtgagaatgtgaaggcgtttttcagtagggtggccgccctcgccttcgagcagtccgtcttgcaggacctggaacgacagtcttctgcgcgactgcaggtcggaaatggtgacttgatacaaatggaaggtagcccccctgaaacccaggaatctaagagacccagttctctgggctgctgctag

SEQ ID NO: 202309 - DNA, 936 bp, Artificial Sequence
  Description of Artificial Sequence: Synthetic coding sequence
atggtgatcgccggcgccagctggatgctgggccgggccgccgccagtcccacgcagacccctcccacaactagcacgatccgggtggcccgacggtcccgtgtggccctggtcgccatggtgatcgcagccgccggctctgggggcccggggcgggccgagccgcagctttcccagccctcattggattgtggccggatgcggagtagcctgaccccacttgggcctcccgtgagccgggatcgggtcattgccagtttcccaaagtggtatacccccgaggcatgcctgcagctgcgcgagcactttcacggtcaagtgagcgcagcctgccagaggaggaatactggcaccgtgggattctgcaagaacgtgtttgatcgggattataaggccaccattggagtagattttgaaatcgagaggttcgagattgccggaatcccttacagcctacagatttgggacacagccgggcaagagaaattcaagtgcattgcctctgcctactatcgcggcgctcaggtgatcataaccgcatttgacttaacagatgtgcaaacattggagcatactcggcagtggttggaagacgcgttgcgggagaatgaggctggctcttgttttattttcctggtaggtacaaagaaggatttgttgtccggggctgcatgcgaacaggctgaagctgacgccgtgcacctggccagggaaatgcaagcagaatattggagcgtgtcagctaagacaggggaaaacgtcaaggccttttttagcagggtggccgccctggcattcgagcagtctgtcctccaagacctggaacgacagtctagcgctagactccaagttggcaatggcgatctgattcaaatggaaggtagcccgccggagacgcaggagtctaagagaccctccagcctgggatgttgttag

SEQ ID NO: 202310 - DNA, 498 bp, Artificial Sequence
  Description of Artificial Sequence: Synthetic coding sequence
atggtgatcgccgccgccggcagcggcggccccggccgggccgagccgcagctctcccagccgtccctcgattgcggacgcatgaggtcctcactcaccccgctcggccctcctgtgagccgtgacagagtcatcgcctccttccctaagtggtacacccccgaggcttgcttgcagcttagagagcatttccatggtcaggtgtctgctgcatgccagcggaggaatactgggactgttggactgaagctgtccaaagtggtagtcgtaggagatctttacgttggtaagacctccttgagtgcacaatatgcccatcctcagggctttctcacagctatgaaccagccacactctccacgccccctaagtccgggctatgcccattccagccacccttctagagcggtcgctagtaggaggtggagagctccctgcagacaaccgagcgatcagtactgtagcccccgagcatggcacacagcggccgccctgtag

SEQ ID NO: 202311 - DNA, 549 bp, Artificial Sequence
  Description of Artificial Sequence: Synthetic coding sequence
atggacctgcagcggcccgacagctaccagggcggcgccggccccgacttcaacgatcatgtgctgcacaaaactattctggtaggagattctggcgtcggaaagacctccctgctcgtgcagttcgatcagggaaaattcatccccgggtctttcagcgctaccgttggtatcggattcactaacaaagtagtgactgttgatggagtcagagtgaagctccaaatatgggacactgccgggcaggagcggttccggtccgtcacacatgcttattatcgggacgcacaggccctgctcctcctgtatgacatcactaacaaaagcagcttcgacaacatcagggcctggctaactgagattcatgaatacgcccagcgtgatgtagtcattatgctgctggggaataaggctgatatgtcctccgaacgggtcatacgcagtgaggatggggagactctggcacgcgagtatggggtcccatttctggagacttctgccaagacggggatgaatgttgagctcgccttccttgccattgcgaaatag

SEQ ID NO: 202312 - DNA, 570 bp, Artificial Sequence
  Description of Artificial Sequence: Synthetic coding sequence
atgaccggcacccccggcgccgtggccacccgggacggcgaggccccggaacggtcccctccctgctcacccagttatgatctcacgggcaaggtgatgctgctcggggataccggggttggcaagacctgcttcctaattcagtttaaagacggggctttcctgtcaggtactttcatcgctacagttggcatagattttagaaacaaagtcgtaacagttgatggcgtgagggtcaagctgcagatctgggataccgctgggcaggaaagattcagaagcgtgacacacgcttactacagggacgcacaagcattgctgctcctgtacgacatcactaacaaaagctccttcgacaacatccgggcctggctcaccgagattcacgaatacgctcaacgcgacgttgttattatgctgctgggaaataaagctgatatgtcaagtgagagagttattaggagcgaagacggcgaaactctggccagggagtatggggtgccgtttctggagacttctgcaaaaacagggatgaatgtggaactagctttcctggcgattgctaagtag

SEQ ID NO: 202313 - DNA, 561 bp, Artificial Sequence
  Description of Artificial Sequence: Synthetic coding sequence
atgaccggcacccccggcgccgtggccacccgggacggcgaggccccggaacgatcgccaccatgttccccatcatacgatctgaccggcaagaacaaggtagtcaccgtcgatggggtgagagtcaagcttcagatttgggacacagccggacaggagcgcttcagatctgtgactcatgcatattaccgcgacgcacaagctctccttctgctgtacgatatcactaacaaatcttcattcgataatattcgcgcctggctcactgaaattcacgaatacgcacaaagggacgtggtcatcatgctgttaggcaacaaggccgacatgagttcagaacgcgtcatccgctctgaagatggtgagactttggccagggagtacggcgtgccctttctggagacaagcgcaaagactggtatgaacgtagaactggccttcttggcaattgcgaaggagctgaagtatagagccggtcatcaggccgacgagccctcgtttcagatacgtgactatgtggagtcccagaagaagcgatcctcctgctgttccttcatgtag

SEQ ID NO: 202314 - DNA, 672 bp, Artificial Sequence
  Description of Artificial Sequence: Synthetic coding sequence
atgaccggcacccccggcgccgtggccacccgggacggcgaggcccccgaaagatctccaccatgtagtccctcatatgacttaaccgggaaggttatgttactcggcgacaccggcgtcggcaagacatgcttcctgatccaattcaaagacggagccttcctgtcaggcacgttcatcgccactgtggggattgatttccgaaataaggtggtgacagtggacggagtgcgcgtaaaacttcagatttgggatactgctgggcaggagaggtttcggagtgtgacacacgcctattatagggacgctcaagctctgctccttctttacgatattacaaacaagtcatctttcgacaatatccgggcctggctgacggagattcatgaatatgcgcaaagagacgtggttataatgctgctcggaaataaagccgatatgagcagcgagcgagtcattcgaagcgaagatggggaaactctggctcgcgaatatggggtgccctttctcgaaaccagcgccaagaccggtatgaacgtggaattggcatttctggcaattgcaaaggaactaaaataccgtgccgggcaccaggcggatgagcctagcttccagatccgagattacgtggagtctcagaagaaaagaagtagctgttgtagcttcatgtag

SEQ ID NO: 202315 - DNA, 687 bp, Artificial Sequence
  Description of Artificial Sequence: Synthetic coding sequence
atgtggctgatgagcgaggcccacggcgccgagcccgtgctgctgagggaggcagcaagaccgtttacccagaccctgcggctttgcgtgcccagcggtaatagtaaggtcatgctgttgggagatactggagtgggcaagacgtgcttccttatacagtttaaagacggggccttcctttccggcactttcatagctactgtcggaatcgactttcgtaacaaagttgtgactgttgacggagtgagggtcaagctgcagatatgggacaccgctggacaggagagatttagatcagtaacccatgcatactacagagatgcccaggcactgctgttactgtatgacatcacaaacaaatcctccttcgacaacatccgggcctggctgacggagatacatgagtacgcgcaacgggacgtagtcatcatgctgctagggaataaggcggacatgtcctctgagagagtgatccggtcggaggacggcgaaacactggccagggaatacggggtgcctttcctcgaaaccagcgcaaagaccggaatgaatgtggagttggccttccttgcaatcgccaaggagcttaagtatagagctggacatcaagccgacgagccctctttccagattcgtgattacgtggaatcacaaaagaaacggagcagttgctgctcatttatgtag

SEQ ID NO: 202316 - DNA, 576 bp, Artificial Sequence
  Description of Artificial Sequence: Synthetic coding sequence
atgtggctgatgagcgaggcccacggcgccgagcccgtgctgctgcgggaggcagcccgaccattcactcagaccctgagactatgcgttcctagtggtaactctaagaacaaggtggtcacggtggacggggtgcgagtaaaattgcagatctgggatactgctgggcaagaacggttccgcagcgtcactcacgcttattaccgagacgcacaggccctgttactcttgtacgatatcacaaacaagtcgtctttcgacaatattcgagcttggctgaccgagatccacgagtacgcccagcgtgatgtggtgattatgcttctgggcaacaaggccgacatgagctccgagcgcgtgattaggagcgaagacggtgaaacactggcgcgagagtacggtgtgccattcctcgagacctccgcgaaaaccgggatgaatgtggagctcgccttcctcgccatcgccaaggagttaaagtaccgcgccgggcatcaagctgacgaaccctcattccagatccgggattatgtagaatctcagaaaaaaagaagctcttgttgctcctttatgtag

SEQ ID NO: 202317 - DNA, 510 bp, Artificial Sequence
  Description of Artificial Sequence: Synthetic coding sequence
atggacctgcagcggcccgacagctaccagggcggcgccggccccgattttaacgatcacgtgctgcacaagaccatcttagtgggcgatagcggtgtgggaaaaaccagccttttagttcagttcgatcaaggaaagttcataccaggctccttctccgctacagtggggataggcttcactaataaagtagttacagtggatggcgtgcgagtcaagcttcaaatttgggatacggccggtcaggagagatttagaagtgtcacacatgcttattaccgagacgctcaagccctgcttctgctgtacgacatcaccaacaagagctctttcgacaacatccgagcctggctgactgaaatacacgagtacgcccagagggacgtggtcataatgctacttggaaataaggtgtctggtagcggagccggaagcgctcaaccgtgcacgtcttccgctcttgcagggcccataactactcaggagcagttaagcagacatcctagctag

SEQ ID NO: 202318 - DNA, 651 bp, Artificial Sequence
  Description of Artificial Sequence: Synthetic coding sequence
atggacctgcagcggcccgacagctaccagggcggcgccggccccgacttcaacgaccacgtcctccacaaaaccatcctcgtgggggactccggtgtggggaaaacatctctgttggtccagtttgatcaaggcaagtttattccaggaagtttttccgccactgttgggattggtttcactaacaaggtcgtgactgttgacggagtgagagtgaagcttcagatctgggacactgccggtcaggagaggttcagaagtgtcacccatgcttattaccgcgacgcccaagctctcctactactctatgacattactaataaatcttccttcgataatatcagggcctggctgactgagatccacgagtacgcccagcgcgacgtcgttattatgctgctggggaacaaggcagacatgagtagtgaacgtgttattaggagcgaggacggagaaacacttgcccgagagtacggcgttccatttctggagacatccgcgaaaaccggaatgaacgtcgaactggccttcctggcaatcgctaaggagctgaaatatagggctggccaccaagcagacgaaccatcttttcagatccgcgattacgtggagtcccaaaaaaagcggtctagctgctgtagctttatgtag

SEQ ID NO: 202319 - DNA, 651 bp, Artificial Sequence
  Description of Artificial Sequence: Synthetic coding sequence
atggacctgcagcggcccgacagctaccagggcggcgccggccccgacttcaacgatcacgttttgcacaaaaccatcttggtgggcgacagtggagttggaaagacatccttactggtgcagttcgaccaaggcaagttcatccccggctctttttctgctacagtcggaatcggctttacaaacaaagtagtcacggtcgacggagttagagtgaaactgcagatatgggacactgccggccaggagagatttcgatcagtgacccacgcctactaccgggatgcgcaagctctgttgttgctgtacgacatcaccaataagtcaagcttcgataatatccgcgcatggctcacggaaattcacgagtatgcacagcgtgacgtagtgatcatgctgttaggcaacaaggccgacatgtcttccgaaagggtcatacggtccgaggacggcgaaacccttgctcgggagtacggcgttccttttttagaaacttccgctaaaaccggaatgaatgtggaattggcatttctggcgatcgctaaggagcttaagtacagagccggccatcaggcagatgagccaagcttccaaattagagactacgtggagtcccagaaaaaacgctctagctgttgttcatttatgtag

SEQ ID NO: 202320 - DNA, 672 bp, Artificial Sequence
  Description of Artificial Sequence: Synthetic coding sequence
atgaccggcacccccggcgccgtggccacccgggacggcgaggcccctgagcggtccccgccatgcagcccttcctatgatctgaccggaaaggtgatgttgttgggggacactggagtgggtaagacttgctttctgattcagttcaaagacggcgcttttctgagtggaacattcattgctaccgtcggcatcgactttcgaaataaagttgtaacagttgacggagttcgggtgaagctacaaatttgggacaccgcagggcaggagaggtttagatcagtgacacacgcctactacagagacgcgcaggctctgctgctcctctatgacatcaccaataagagctcatttgacaatattagagcctggcttaccgaaattcacgaatacgctcagcgcgatgtggtcatcatgctcttgggtaacaaagctgatatgtcttcagaaagagtcattagatcagaggatggtgagaccctggctagagaatacggggtgcctttccttgagacttcggccaaaacaggtatgaacgttgagttggctttcctagctatagcaaaagagttaaaatatcgtgctgggcatcaggcagacgaaccatctttccagatccgggattacgtagagagccagaagaagcgaagctcttgctgttcgtttatgtag

SEQ ID NO: 202321 - DNA, 591 bp, Artificial Sequence
  Description of Artificial Sequence: Synthetic coding sequence
atgtgctgcaaggtgatgctgctgggcgacaccggcgtgggcaagacatgctttctgatccagtttaaagatggcgcctttctaagtggcacctttatcgctaccgtgggcatcgattttcgtaataaagtggtcaccgtggacggcgtccgcgtgaagctgcagatttgggacacggccggtcaagaacgatttcggtccgtcactcacgcctactatcgcgacgctcaagcattgctgctgttgtacgatattacaaacaagagctctttcgacaacatacgagcctggttgaccgaaattcatgaatatgctcagcgggatgtcgtgattatgctgctggggaacaaggccgatatgagcagcgaacgcgtgattcggagtgaggacggggaaacgctcgcccgggagtacggcgtaccatttctcgagacgtctgcaaagacgggtatgaacgtcgaactggcattcctcgctatagccaaagaactaaaatatagagctggacatcaggctgatgaacccagctttcaaatcagagattacgtcgagagccagaagaagcggtcgagctgttgtagttttatgtag

SEQ ID NO: 202322 - DNA, 636 bp, Artificial Sequence
  Description of Artificial Sequence: Synthetic coding sequence
atgcaggccccccacaaggagcacctgtacaagctgctggtgatcggcgatctcggtgtgggaaaaacaagcataatcaaacgctatgtccaccaaaattttagttcacactatagagcaactattggtgtggacttcgccctgaaagtgctgcattgggaccccgagactgtagtcagactccagctgtgggacattgctgggcaggaacggtttggcaacatgactcgcgtctattaccgggaggctatgggggctttcatcgtgtttgatgttactaggcccgcaactttcgaagccgttgccaaatggaaaaacgacttagactcaaagctctccctgccaaacgggaaaccggtcagcgtggtgctacttgctaataaatgtgatcagggcaaggatgtactgatgaacaacggacttaagatggaccagttttgtaaggagcacgggtttgtggggtggtttgagaccagtgcaaaggaaaacattaacatcgacgaggcaagtcgatgcctcgtgaaacacattttggccaacgagtgtgacttgatggagagcatagaaccggatgtcgttaagccgcacctcaccagtaccaaggtcgcatcttgctctggatgcgccaaatcatag

SEQ ID NO: 202323 - DNA, 642 bp, Artificial Sequence
  Description of Artificial Sequence: Synthetic coding sequence
atggaggccatctggctgtaccagttccggctgatcgtgatcggcgacagcaccgtgggaaagagttgcttgattagaagattcacagaaggtaggtttgctcaagtaagcgacccaacagtgggggtcgattttttctctcgtttagtggagatagagccaggcaagcggattaagcttcagatctgggacaccgccggacaggagaggtttaggtcaataacccgcgcatattatagaaacagcgtcggaggcctgcttctcttcgacattacaaatcgtcggagtttccaaaatgtgcacgagtggttagaggaaaccaaggtgcacgtacagccttaccagattgtcttcgttctggttggccacaagtgcgatctcgacacccagcggcaggttaccaggcacgaagccgagaaacttgccgctgcctacggcatgaaatacattgagacctctgcccgggatgcaatcaatgtggagaaggccttcaccgaccttactcgagatatttatgagcttgtaaagcgaggtgagattaccatacaggagggatgggagggagtcaaatctgggtttgtacccaatgtggtgcactcaagtgaggaggtggtgaagtccgagcgccggtgcctttgctag

SEQ ID NO: 202324 - DNA, 2187 bp, Artificial Sequence
  Description of Artificial Sequence: Synthetic coding sequence
atggccggccccgagggcttccagtaccgggccctgtaccccttcagaagggagagacctgaggacctggagctgttgcccggagacgtcttagtagtatctcgtgctgcactgcaggctctgggggtggctgaaggcggggagcggtgtcctcagagcgttgggtggatgcctggcctgaacgaacggactcgccagcgcggggactttcctgggacttacgtggagttcctgggcccagtggcactggcaagacccgggccgcgacctaggggcccaaggcccctgcctgcccggccccgggacggagcccctgagccaggtctaacactccccgatctaccagaacagttcagccctcccgacgtggccccaccgctgctcgtaaaactcgtggaggccatcgaacggacaggcctagattctgaatctcactaccggcctgaattaccagcccctagaacggactggtctttatctgatgtggatcagtgggacacagccgctctggccgatggcatcaaatcattcttactggcactaccggcccctctggtgactcccgaagcctctgccgaggcgaggcgagcactccgtgaagcagcaggccccgtgggtcctgctcttgagcccccaactttgcccctgcacagggccctcacattgcgattcctcttacagcatctggggcgcgtcgcatccagggctcctgccctcggacctgcggtgcgggccttaggggcaacattcggtccactcctgctgcgagctcctcctcctcccagttctccgcctcccgggggggcaccagatggttcggaaccctctcctgacttcccagcactcctggtagagaagttactccaggaacacctagaggagcaggaggtggctccgcctgccctgccccctaagcccccaaaagccaagcctgcttccaccgtactggcaaacggtggatctcccccttcgctccaggatgcagagtggtactggggcgatattagcagagaagaggtgaatgaaaaactgcgcgataccccagatggaacatttctggtgcgcgatgcctcttcgaaaatccaaggggaatacacgctgacccttcgaaaggggggcaacaacaagctgataaaggtgttccaccgcgatggccattatggattttctgaaccattgactttctgttccgtggtagacttaattaaccactacagacatgaatccctggcacaatacaatgccaagctggacacgaggttgctttacccagtgtcaaaatatcagcaggaccagatcgtgaaagaggattcagtcgaggcggtaggtgcacagctcaaagtgtatcaccagcaataccaggataaaagccgggagtacgaccaattgtatgaagaatatactagaacaagccaggaactgcaaatgaaacgaaccgcaattgaagcatttaacgaaacaatcaagatcttcgaggagcagggccaaacccaggaaaagtgttccaaagaatatttggagcgattcagaagggaggggaatgaaaaagagatgcagcgaattctgctgaactctgagaggttgaaatccagaatcgccgagatccacgagtcccggactaagctggagcaacagctacgggctcaggcatccgacaacagagagattgacaagcgcatgaactcactcaagcctgatctcatgcagctgagaaaaatcagggaccagtacctagtgtggctcactcagaaaggagcgcgacagaaaaagataaacgagtggctggggattaagaatgagacagaagaccagtatgccttgatggaagatgaggacgacctgccccatcacgaagagcggacttggtacgtcggcaaaattaaccggacccaagcagaggagatgctctctggaaagcgcgatgggacattcctcatccgggaatcctcccagcggggatgttacgcctgtagcgtcgtggttgatggagataccaaacactgcgtgatctacagaaccgccacgggctttggatttgccgaaccctacaacctctacggcagcctgaaagaattagtcctgcactatcagcacgccagcttagtccagcacaatgacgctctgactgtgaccctggctcatcccgtgcgtgctcccgggcccggcccgcccccagctgctcgttag

SEQ ID NO: 202325 - DNA, 660 bp, Artificial Sequence
  Description of Artificial Sequence: Synthetic coding sequence
atggccagcgtgaccgacggcaagaccggcgtgaaggacgccagcgaccagaactttgactatatgttcaagctgcttatcatcggcaattcttctgtcgggaagacatcatttttgttccggtacgcagacgatacttttacgccagcattcgtcagtaccgttggtattgacttcaaagtgaaaacagtttaccgccatgaaaagagagtgaagctacagatctgggacacagccgggcaggagaggtaccgcacaataaccactgcttattacaggggtgccatgggattcatccttatgtatgatatcacaaatgaggaatccttcaacgccgtgcaggattgggcaacccagatcaaaacttattcctgggataatgcccaagtcatcctagtgggcaataagtgtgacatggaggaggagagggtcgttcctaccgaaaaaggccagctcctggcagaacaactgggatttgattttttcgaggcttctgcgaaagagaacattagcgtccgccaggccttcgaaagacttgtggacgccatttgtgataagatgagtgacagccttgataccgacccttctatgcttggttcctctaaaaacacgagactgtcagacactcctcctctcctccaacagaactgctcatgctag

SEQ ID NO: 202326 - DNA, 660 bp, Artificial Sequence
  Description of Artificial Sequence: Synthetic coding sequence
atggccagcgtgaccgacggcaagaccggcgtgaaggacgccagcgatcagaacttcgactacatgttcaagctcctgattatcggtaattcatcggtcggaaagaccagcttcctgttcagatacgccgatgacactttcacgcccgcctttgtctcaaccgttgggatcgattttaaggttaaaactgtgtacaggcacgagaaacgggtcaagcttcagatatgggataccgccggacaggaacgttaccggacgatcacaaccgcttactaccgaggtgcaatgggctttattttgatgtacgatattacgaatgaggaatcgtttaacgcagtccaggattgggctacccaaatcaaaacctattcatgggataatgctcaggtgatcctggtgggtaacaagtgcgatatggaggaagagcgcgtcgtaccgacagagaagggccagctgttagcagagcaactcgggtttgatttttttgaagcttctgctaaggagaacataagtgtgagacaagctttcgagaggcttgtggacgctatctgcgacaagatgtcggacagcctggacactgacccatcaatgctgggatccagcaaaaacacacggttgagtgatacacctccccttttgcagcagaattgctcttgctag

SEQ ID NO: 202327 - DNA, 684 bp, Artificial Sequence
  Description of Artificial Sequence: Synthetic coding sequence
atgcggcacgaggcccccatgcagatggccagcgcccaggacgcccggtacggccaaaaggacagctctgatcagaatttcgattatatgttcaagctcctcataattggtaacagctctgtcggcaaaaccagcttcctatttcgctatgccgatgacagcttcaccagtgccttcgtgtctaccgttggaatcgattttaaagtaaagacagtgtttaagaacgaaaagaggattaaactgcagatctgggacacagctggacaggagcggtaccgcaccataactacagcctattatcgcggcgccatgggcttcattttgatgtacgacattactaatgaagagtcttttaacgccgtgcaagattggagcacacagataaaaacatactcctgggataacgcacaagttattctggtggggaataaatgtgatatggaagacgagcgcgtaattagcaccgagcgtggacaacatctgggcgagcagttaggattcgagtttttcgaaacctctgctaaagacaacatcaatgtcaagcagacctttgagcgtctcgtagacattatttgcgacaaaatgtccgagagtctagagaccgatcctgccatcaccgctgcaaagcaaaacacaaggctcaaagagacaccccctcctccgcagcctaattgtgcttgctag

SEQ ID NO: 202328 - DNA, 783 bp, Artificial Sequence
  Description of Artificial Sequence: Synthetic coding sequence
atggccggcagccccctgctgtggggcccccgggccggcggcgtgggattactggtactcctgctgttgggactgtttcgacccccgccagccctgtgtgccaggccagtaaaagagccccgaggacttagcgccgcatcccctcctctggccgaaacaggggcccctcgaagattccgccggtccgtgcctcgcggcgaagccgccggcgccgttcaggagctggcacgcgccttagctcatttactggaagctgagcgtcaggaacgggctcgagcagaagcgcaagaagccgaagaccagcaagctcgggttctggcccagctcctgcgcgtctggggcgctcctagaaacagtgaccctgcgctcgggttagacgatgatccagatgctcccgccgctcagctcgctcgcgcccttctgcgcgccaggctggatccagctgcacttgccgcgcagctcgtaccggccccagtgcctgcagccgctctacggccaagacctccagtgtatgacgatggtcccgccgggcctgacgctgaggaagctggcgacgaaactccggacgtcgacccagagctactgcgttatctgctgggccgcatcttggccggttctgcggatagcgagggagttgccgctcccagacgactgcggagggcagccgaccacgatgtaggatctgaactgcctccagaaggcgttctcggcgctttactaagggttaagcggctggagacaccagccccacaagtgcctgcccgacgactgctgccaccttag

SEQ ID NO: 202329 - DNA, 657 bp, Artificial Sequence
  Description of Artificial Sequence: Synthetic coding sequence
atgagccagaccgccatgagcgagacctacgacttcctgttcaagtttttggtaatcggcaatgctggtacgggaaagtcctgtctgctgcatcagttcatcgagaaaaagttcaaagacgactctaaccacacgattggcgtggaattcgggtccaaaattataaatgtggggggaaagtacgtgaagctccagatttgggatactgcgggtcaggagagattcaggtctgtgacgcggtcctattaccggggggccgctggtgccttactggtctacgacattacctccagggagacatataacgccctgactaattggttgactgatgccagaatgttagcctcacagaacattgtgattattctgtgtgggaataagaaagatctggacgcagatcgggaagttacctttctcgaggcatctcgttttgctcaggaaaacgaactgatgttcctcgagacttctgccctgaccggcgaaaatgtggaggaggctttcgtccaatgcgccagaaagatattgaataagatcgagagcggcgagctcgatcctgagcggatgggatccggcatacagtacggcgatgcagctttacgccagctgagatcccccaggagggcccaggctcctaatgcgcaggaatgcggatgctag

SEQ ID NO: 202330 - DNA, 648 bp, Artificial Sequence
  Description of Artificial Sequence: Synthetic coding sequence
atggccagccggggcgccacccggcccaacggccccaacaccggcaataaaatttgtcagttcaaactcgtcctacttggggaatcggccgtggggaagtcatctctcgtcctaagattcgtcaaaggccagtttcacgaattccaggagtcaaccatcggcgccgctttcctgacccagaccgtatgcttggatgacacaaccgttaagtttgagatttgggacaccgcgggtcaggagagatatcattcactggcccccatgtattaccgcggagcacaggccgctattgtggtgtatgacatcaccaatgaggaaagcttcgcccgagccaagaattgggtgaaagagctccaacgccaggctagccccaacattgtgattgccctttcgggtaacaaggccgatctggccaacaagcgagcagtggacttccaggaagctcagagctatgctgatgacaactcattgctttttatggagacaagcgccaaaacatctatgaatgttaatgagatttttatggccattgcaaaaaaacttcctaaaaatgagccgcagaacccaggcgctaacagtgcaaggggacgcggggtggaccttacagaacctactcagccgacacgtaatcagtgctgttccaactag

SEQ ID NO: 202331 - DNA, 606 bp, Artificial Sequence
  Description of Artificial Sequence: Synthetic coding sequence
atggccagccggggcgccacccggcccaacggccccaacaccggcaacaagatctgccaattcaaactggttctcctcggtgaatctgctgtcggcaaatcatccctcgtgctgcggtttgtaaagggtcagttccacgaatttcaggaatctaccataggagtcaagtttgagatctgggacaccgctgggcaggagcggtatcacagcttagctcccatgtactatagaggggcccaggcagcaatcgtggtgtatgacatcaccaatgaagagagtttcgcccgggcgaaaaattgggttaaggagttacaacggcaggcctccccaaatatagtcattgccctctccggtaacaaagccgacctcgccaataagcgggctgtggattttcaggaggcccagagctacgctgacgacaactccttgctgtttatggagacatctgccaaaactagtatgaacgttaacgaaatcttcatggcgattgctaagaagctcccgaaaaacgaaccacagaatcctggtgccaacagtgccaggggtaggggtgtggatctgactgaacctacacagccgacacggaaccagtgctgttccaattag

SEQ ID NO: 202332 - DNA, 48 bp, Artificial Sequence
  Description of Artificial Sequence: Synthetic coding sequence
atggccagccggggcgccacccggcccaacggccccaacaccggctag

SEQ ID NO: 202333 - DNA, 648 bp, Artificial Sequence
  Description of Artificial Sequence: Synthetic coding sequence
atgaccagccggagcaccgcccggcccaacggccagccccaggcctccaagatctgtcagttcaaactggttctgctgggcgagtcagcagtgggtaaaagcagcctggtgctgcgctttgtaaagggtcagttccatgaataccaggagagtacgattggagcagccttcctgacacaaagcgtgtgcctggatgataccacagtcaagtttgagatatgggacacagccggtcaggaacgctaccacagcctggctcccatgtactatcggggcgcccaggccgcaatcgtcgtctacgacattaccaatcaggaaacatttgcccgggccaagacctgggtgaaggagctccaaagacaggccagcccgagtatcgtgatcgcattagcaggcaataaagccgacttagccaataaaagaatggtggagtacgaagaggcacaggcctacgctgatgataacagtctgcttttcatggaaacgtcggccaagacagccatgaatgtgaacgacttatttctggccatcgctaagaagctgccaaagagtgagcctcagaacctcgggggagcagccggtcggtcccgaggagtagacctgcacgaacaatcgcaacagaacaaaagccagtgttgctctaattag

SEQ ID NO: 202334 - DNA, 525 bp, Artificial Sequence
  Description of Artificial Sequence: Synthetic coding sequence
atgaccagccggagcaccgcccggcccaacggccagccccaggccagtaaaatttgccagtttaagctggtgctgctcggggagtctgccgtgggtaaaagcagcctggtgcttagatttgtgaaaggccagtttcatgagtatcaggaatctaccataggagccgccttcctcacccagagcgtttgtctagacgacactacggtgaaattcgaaatctgggataccgcgggtcaggagagataccattccctggccccaatgtactacagaggagcccaagcggcaatcgtagtgtatgatataaccaaccaggaggcacaagcatatgccgacgataattcactgctatttatggaaacttccgccaagaccgccatgaatgtgaatgatctgtttctggcaatcgccaaaaaactgcccaagagcgaaccccagaatctgggaggtgcagcaggccgcagtaggggtgtcgaccttcacgagcagtcacagcaaaacaaatcccagtgctgttcgaactag

SEQ ID NO: 202335 - DNA, 348 bp, Artificial Sequence
  Description of Artificial Sequence: Synthetic coding sequence
atgaccagccggagcaccgcccggcccaacggccagccccaggcctctaaaatttgtcagtttaagctggttttgctgggagaaagcgctgtggggaagagttccctggtgctgcggttcgtgaagggtcagtttcacgaatatcaggaatccaccattggtgccgccttcctcacgcagagtgtgtgcctcgatgataccacggtgaaattcgagatttgggataccgcagggcaggagaggtaccacagtttggctccgatgtattaccggggtgcccaagctgccatcgtggtctatgatattactaaccaggagacctttgccagggccaagacatgggtgtag

SEQ ID NO: 202336 - DNA, 303 bp, Artificial Sequence
  Description of Artificial Sequence: Synthetic coding sequence
atgaccagccggagcaccgcccggcccaacggccagccccaggccagcaaaatctgccagtttaagctcgttctgttaggtgaatccgcggttgggaagtcctctttagtgctgcgcttcgtgaaaggacagttccatgagtatcaagagtcaacaatcggcgctgcgttcctcacgcaatccgtgtgtttagatgacactacagttaagtttgagatctgggataccgcaggacaggagcggtaccattcacttgcacctatgtactaccgcggggcccaggcagctattgtcgtctactag

SEQ ID NO: 202337 - DNA, 648 bp, Artificial Sequence
  Description of Artificial Sequence: Synthetic coding sequence
atgaccagccggagcaccgcccggcccaacggccagccccaggccagcaaaatctgtcagttcaaactggtgctgctgggagaatctgcagtggggaaaagctccctcgtcctgaggttcgtgaaaggccagttccatgagtatcaggaatcaaccataggagccgcattccttacccagtcggtttgcctggacgatactacagttaagttcgaaatctgggacactgcaggtcaggagaggtaccattctctggcacctatgtattacaggggggcacaggccgcaattgttgtgtatgacatcacaaaccaggaaacctttgcacgcgcaaagacatgggtgaaagaactacaacgccaggcttctcctagcatagtgatcgcactggctggaaataaggctgaccttgctaataaacgaatggtggagtatgaggaagcgcaggcatatgccgacgataacagtctccttttcatggaaacatcagccaagaccgccatgaacgtaaacgacctcttcctggccattgccaagaaacttccaaaatcggagcctcaaaatcttggaggcgccgctgggcggtctcggggcgtggatctgcacgaacagtcacagcagaataaaagccagtgctgctccaactag

SEQ ID NO: 202338 - DNA, 651 bp, Artificial Sequence
  Description of Artificial Sequence: Synthetic coding sequence
atggccggccggggcggcgccgcccggcccaacggccccgccgccggcaataagatctgtcagtttaagttggtcctgctgggcgaatcggcagtggggaaatcctctcttgttttaagattcgtgaaggggcaattccatgagtatcaggagagcactattggtgccgcattcttgacccagaccgtttgcctagatgatactaccgtgaaattcgaaatttgggataccgctggtcaggagcgataccattctctggctcctatgtactatcggggagctcaggctgccattgtggtctatgacattactaatacagataccttcgcccgcgcaaaaaactgggtgaaggaactacaaaggcaggccagtcctaacattgtgatagctctggccggcaataaggctgatctggcatcaaaacgggctgtggaatttcaggaggcccaggcatatgctgacgataatagcctgctgttcatggagacgagcgctaaaacggcgatgaacgtcaacgaaatatttatggccatcgcaaaaaagttgccaaagaacgagccccagaacgctactggtgctcccggcagaaacagaggcgtcgatctccaggagaataatcctgctagtaggtctcagtgctgctccaactag

SEQ ID NO: 202339 - DNA, 651 bp, Artificial Sequence
  Description of Artificial Sequence: Synthetic coding sequence
atggccggccggggcggcgccgcccggcccaacggccccgccgccggcaacaaaatctgccagttcaagttggtgctgctcggtgagtctgctgtgggcaaatcgtcgctggtattgcgctttgtgaaagggcagtttcatgaatatcaggagagtactattggggccgcctttctaacgcagacagtgtgcctggacgatacgacagtgaagtttgagatctgggatacagccgggcaggaaaggtatcatagcctggcacccatgtactaccgcggcgctcaggcagccatcgtggtttacgatattacaaataccgataccttcgcccgtgccaaaaattgggttaaggaactgcagcgacaggccagcccgaatattgtcatcgcccttgctggcaataaggcagacttggccagcaaacgggccgtagagtttcaagaagcacaggcttacgctgacgacaattcactacttttcatggaaacatcagcaaaaactgccatgaacgtcaatgagatctttatggcaattgcaaagaaactgccaaaaaatgagccccagaatgccactggggcccccgggcgtaataggggagtggatctgcaagagaataaccctgcatcgagatcacagtgttgttctaactag

SEQ ID NO: 202340 - DNA, 750 bp, Artificial Sequence
  Description of Artificial Sequence: Synthetic coding sequence
atggagctgagctggcggagccccagccccctgagcgccagcctgcacagcactagccctcatccacacgccctgtggactactaccgcaggtcgggcaatggcgggccgaggaggggcggccagacctaatggaccagctgccgggaacaagatttgtcaattcaagctcgtgctcctgggtgagagtgcagtcggcaagtctagtctggtcctgcggttcgttaagggccaatttcatgagtaccaggagtcaaccatcggtgccgcattccttacccagacagtctgcttagacgacacaaccgttaagtttgagatttgggacacagcaggacaggagcgataccacagccttgcacctatgtactacagaggagctcaggcagcaattgtagtgtacgatatcactaatactgacactttcgccagggcaaagaactgggtcaaggagctgcaaagacaggcttcccccaacatcgtgattgccctcgccggcaacaaagctgatttggcatcaaaacgggcggtagaatttcaggaagcacaggcatacgctgatgacaattcactactcttcatggagacatcagccaaaacagcaatgaatgtgaatgaaatctttatggctatcgctaaaaagttaccaaaaaacgagccacagaatgccaccggcgcacccggccggaaccggggggtggacctccaggaaaacaaccccgcctcccggtcccagtgttgcagcaactag

SEQ ID NO: 202341 - DNA, 225 bp, Artificial Sequence
  Description of Artificial Sequence: Synthetic coding sequence
atggccggccggggcggcgccgcccggcccaacggccccgccgccggcaacaaaatctgtcagttcaaacttgtgctgctcggcgagtccgctgtcggaaaaagctcattggttcttaggttcgtcaaaggccaattccacgagtatcaagaatcaaccatcggcgctgcattcctgacccagacagtctgtctggatgacacgaccgttaagtttgaaatctag

SEQ ID NO: 202342 - DNA, 279 bp, Artificial Sequence
  Description of Artificial Sequence: Synthetic coding sequence
atggccggccggggcggcgccgcccggcccaacggccccgccgccggaaacaagatctgccagttcaaactcgtgctcttaggggaaagcgccgttggtaaaagctccctggttttgaggtttgttaaaggacagtttcatgaataccaagagagtactatcggcgccgcctttcttacacaaacagtgtgtctggacgacaccacagtcaagttcgagatttgggatactgctggccaagagagatatcattcccttgctcctatgtattatcgctag

SEQ ID NO: 202343 - DNA, 375 bp, Artificial Sequence
  Description of Artificial Sequence: Synthetic coding sequence
atggccggccggggcggcgccgcccggcccaacggccccgccgccggaaataaaatttgtcaatttaagttggtcctgctaggagagtctgccgtgggaaaaagctccctcgtcctacgctttgtgaaaggtcagtttcatgagtaccaggagagcacgattggcgcagcctttctaactcagaccgtgtgcctggatgacactacagtcaagttcgagatctgggacactgctggacaagagagataccatagtctcgctccaatgtactaccggggcgcacaagccgcgattgtggtgtatgacattacaaacactgacacatttgctcgagccaagaattgggtgaaagaactgcagaggcaggcgagctag

SEQ ID NO: 202344 - DNA, 627 bp, Artificial Sequence
  Description of Artificial Sequence: Synthetic coding sequence
atgagcaccggcggcgacttcggcaaccccctgcggaagttcaagctcgtgtttcttggcgagcagagcgtgggaaagacctctctgattactcgctttatgtacgatagtttcgataatacctaccaagctaccattggcatcgactttctatccaagaccatgtacctggaggaccggaccatcaggctgcaactgtgggataccgccggccaggagagatttcggagcctgatcccaagttacatccgcgattccgccgccgccgttgtcgtctatgacataacgaacgtgaattcctttcagcagacaactaagtggatcgatgatgtgcgcacagagcgggggtccgacgttattatcatgctcgtaggaaacaagacggatctggcagataagcgccaagtgagtatcgaggaaggtgagaggaaggccaaggagctcaacgtcatgtttatcgagacaagtgccaaggccggatataacgttaagcagctgttcaggcgggtagctgctgcactcccagggatggaatctacccaggaccgtagccgggaggacatgattgacatcaagttggagaagccccaggagcagcccgtatctgaaggtgggtgtagctgctag

SEQ ID NO: 202345 - DNA, 627 bp, Artificial Sequence
  Description of Artificial Sequence: Synthetic coding sequence
atgagcaccggcggcgacttcggcaaccccctgcggaagttcaagctggtcttcctgggcgaacagagtgtcgggaaaacttcgctaatcactcgattcatgtacgactccttcgataacacataccaggcgaccattggtatcgattttttgagcaaaacaatgtatcttgaagatcgaacagtgcgactccagctgtgggatacagcagggcaggaacggtttcgtagtctgattccatcttacatccgcgattccaccgtagctgtcgttgtgtatgacattactaacgtgaattcgtttcagcaaaccacaaagtggatcgacgacgtgaggactgagcggggtagcgacgtcatcataatgctggtgggcaataaaaccgatcttgccgacaagagacaggtgtctattgaggagggcgaacggaaagcaaaggagttgaatgtgatgtttattgagacctcagcaaaagccggttataacgtcaagcagctgtttcgaagagtagctgcagcactgccgggaatggagtccacccaggaccggtcccgggaagacatgatagacattaagcttgagaagcctcaggagcaacctgtcagtgagggcggatgttcttgttag

SEQ ID NO: 202346 - DNA, 627 bp, Artificial Sequence
  Description of Artificial Sequence: Synthetic coding sequence
atgagcaccggcggcgacttcggcaaccccctgcggaagttcaagcttgtgttcctgggggagcagagtgtgggaaagacatcactgatcaccagatttatgtacgactcgttcgataatacataccaggctactatcggaattgacttcctgtctaaaactatgtacctcgaggatcggaccatccgactgcagctctgggatactgccggccaggagcgtttcaggagtctgatccctagctacatccgggactccgcggccgcagtggtagtttacgacataaccaacgtgaatagctttcaacagactactaagtggattgacgatgtgagaacagagcgcgggagcgacgtcatcattatgcttgtgggcaataagactgaccttgcggacaaacgccaggtgtctatcgaagagggagagcgcaaggccaaagagctgaacgtgatgtttatagaaacatccgccaaagcgggctataatgtgaagcagctcttcagacgggtggctgccgctctgccaggaatggaaagtacccaggaccgcagccgggaagatatgattgacattaaactcgaaaagccccaggaacagccagtctccgagggaggttgcagttgttag

SEQ ID NO: 202347 - DNA, 525 bp, Artificial Sequence
  Description of Artificial Sequence: Synthetic coding sequence
tgacccctgcggaagttcaagctggtgttcctgggcgagcagagcgtcggcaagacttcattgataacaagattcatgtacgattccttcgacaatacgtatcaggctactattggaattgatttccttagcaagaccatgtaccttgaggaccgaaccgtacgactccagctttgggacacggcaggccaggagcggtttcgaagtcttatccctagctatatcagggactccaccgtcgcagtagtggtgtacgacataactaatgtcaactcttttcagcagaccacgaagtggattgacgatgtgcgaaccgaaagggggtctgatgtgatcattatgttggtcggaaataagactgatttggccgataagaggcaagtatctatcgaggagggagagagaaaggccaaagaactgaatgtgatgttcattgagacttccgcaaaagccggatacaacgtgaagcaaaggataggttcatgccatgtggcccaggccagcttggagctgctcgattcatag

SEQ ID NO: 202348 - DNA, 225 bp, Artificial Sequence
  Description of Artificial Sequence: Synthetic coding sequence
atgagcaccggcggcgacttcggcaaccccctgcggaagttcaagctggtctttctgggcgagcagagtgtcggtaagacatcgctcataaccagatttatgtacgatagcttcgacaatacatatcaagccacaatagggatcgactttctcagtaaaaccatgtatttggaagaccggacagtgaggctgcagttatgggacaccgctggacaggaaaggtag

SEQ ID NO: 202349 - DNA, 528 bp, Artificial Sequence
  Description of Artificial Sequence: Synthetic coding sequence
atgtacgacagcttcgacaacacctaccaggccaccatcggcatcgacttcttgagcaaaaccatgtatttggaagaccgcacgattcgcctgcagctttgggacacagctggtcaggaacggtttcgctcactcatcccatcctatatccgagattcagccgcggccgtcgtcgtgtacgatatcaccaacgttaattctttccagcagactaccaagtggatagacgacgttcgtaccgagagaggctctgacgtcatcatcatgctcgttgggaataagaccgatttagcagataagcgacaggtgtctattgaagaaggcgagcgcaaggcaaaggaactcaacgtgatgttcatcgaaacttccgctaaagcaggctacaatgtgaaacagttatttcgtagggtggctgccgctctgccaggtatggagagcacacaggacaggtcccgcgaagatatgattgacattaagctggaaaagccccaggaacaacccgtgtccgagggtggctgctcgtgctag

SEQ ID NO: 202350 - DNA, 429 bp, Artificial Sequence
  Description of Artificial Sequence: Synthetic coding sequence
atgagcaccggcggcgacttcggcaaccccctgcggaagttcaagttggtctttctgggtgagcagagcgtgggtaagaccagtcttattaccagattcatgtatgattcattcgacaacacctatcaggctaccatcggcatagattttttgtctaaaacaatgtacttagaagatagaacgatccggctgcagctgtgggacactgctggtcaggaaaggtttcgatccctgattcctagttatatacgggacagcgctgcagctgtcgttgtatatgacattactaacgtgaactccttccagcagaccaccaagtggatagacgacgtgaggaccgaacggggaagcgatgtgatcatcatgctggtgggaaataaaaccgaccttgctgacaaaagacaagtgagtatagaagaaggtgagtag

SEQ ID NO: 202351 - DNA, 315 bp, Artificial Sequence
  Description of Artificial Sequence: Synthetic coding sequence
atgagcaccggcggcgacttcggcaaccccctgcggaagttcaagctggtttttcttggtgagcagagcgttgggaaaacttctttaatcactagattcatgtatgacagcttcgacaacacgtaccaggccaccatagggatagactttttgagcaaaaccatgtacctggaggatagaactctgtttcggagggtggccgctgccctccccggcatggaaagcacacaggatcgctctcgcgaggatatgattgacatcaagttggagaagccccaggagcagccggtgtccgagggaggttgcagctgttag

SEQ ID NO: 202352 - DNA, 606 bp, Artificial Sequence
  Description of Artificial Sequence: Synthetic coding sequence
tgagtgttcccccggggcctggccctgcggagcgccgacgtggtggaagtgggcaagacttcactcatcactcggtttatgtacgatagttttgacaacacctaccaggccacaattggaatcgactttctgtctaagacaatgtatctggaggatcgcactattagactgcaactgtgggacacggccgggcaggagcgatttcgcagcttaattccaagctatattagggacagcgccgccgccgtagtagtgtacgacataaccaacgtcaatagtttccagcagacgacgaaatggatagacgatgtgagaacagaacgtggatcagatgtaatcattatgctggttggcaataagacggacctggctgataaaagacaagtgtccatagaagaaggggaacgcaaggccaaagagctgaatgttatgtttatcgagacttccgccaaggcaggctataatgtgaaacagttgttcagaagagtggctgcagctttgcccggtatggaaagcacccaggaccggtcccgcgaagacatgattgacatcaagttggagaaaccacaggagcaacctgtctcggagggcgggtgttcatgttag

SEQ ID NO: 202353 - DNA, 144 bp, Artificial Sequence
  Description of Artificial Sequence: Synthetic coding sequence
atgagcaccggcggcgacttcggcaaccccctgcggaagttcaagctagtgttccttggagagcagagtgtcgggaaaacaagccttatcacaagatttatgtatgactccttcgataacacctaccaggcaacaattggctag

SEQ ID NO: 202354 - DNA, 765 bp, Artificial Sequence
  Description of Artificial Sequence: Synthetic coding sequence
atgagcgccggcggcgacttcggcaaccccctgcggaagttcaagctggtgttccttggagaacagtcagtggcaaaaacttctctgattacaaggttccgatacgattcatttgacaatacatatcaggcaataatcggaattgactttctatctaagacgatgtacttagaggacggaactatcggtttgcgcctctgggacacggccggccaggagcggctccgttcactgatccccagatacatccgggatagcgctgccgccgtcgtggtgtatgatattacgaatgtgaattcctttcaacagacgaccaagtggatcgatgacgtcaggacagagagaggctctgatgtcattatcactctagtagggaatagaacggacctggccgataaacggcaggtatctgtcgaggaaggcgaacggaaagctaaaggtttgaatgtgaccttcatagaaacccgggcaaaggccggatataatgtgaaacagctgtttagacgcgtggccgcggcccttcccggtatggagagtacccaggatgggagtagagaggacatgtctgatatcaagttggaaaaaccacaggaacaaacggtgagcgaagggggctgtagttgctactctcctatgtcgtcctctaccctaccacagaagcctccttactcctttattgattgctcagtgaacattgggctcaacctgttcccttccctcataacattctgcaactcatccctcctgccagtcagctggcgctag

SEQ ID NO: 202355 - DNA, 612 bp, Artificial Sequence
  Description of Artificial Sequence: Synthetic coding sequence
atgggcagccgggaccacctgttcaaggtgctggtggtgggcgacgctgccgttggcaaaacgtctctcgtgcagagatacagccaggactcgttctcaaaacattacaaaagcactgtgggcgtggactttgcactcaaagtactgcaatggtccgattatgagatcgtcaggttacaactttgggacatagccggccaggaaagatttacgagtatgacacggctctattaccgggacgccagcgcttgtgtcataatgtttgatgtgacaaacgccactaccttcagcaattcccaacggtggaaacaggacctggatagcaagctcactctgccaaacggcgagcctgtgccatgtttgcttctggccaataaatgtgacctgtctccttgggccgtatcaagagaccaaattgacagatttagcaaagaaaatggctttacagggtggactgaaaccagcgtgaaagaaaataagaacatcaacgaggccatgcgggtcctgattgaaaagatgatgagaaattctaccgaagatatcatgagcctctccacccagggagattatataaacctacagacaaaatcatcctcttggagctgctgttag

SEQ ID NO: 202356 - DNA, 612 bp, Artificial Sequence
  Description of Artificial Sequence: Synthetic coding sequence
atgggcagccgggaccacctgttcaaggtgctggtggtgggcgacgctgcagtgggcaaaaccagcttggtccagcgatactcccaggactccttctccaagcactacaagtccactgtcggtgtggacttcgctctcaaagtactccagtggtccgattacgaaatcgtaaggctccagctatgggatatcgccgggcaggaacgcttcacctccatgactcgtctttactaccgagacgccagcgcctgtgtgatcatgtttgacgttaccaacgccacaacatttagcaactcccagcggtggaagcaggacctggatagcaagctgactttacccaacggagaaccagtgccgtgtctgctgttggccaacaagtgcgatctttccccatgggccgtgtccagagaccagatcgaccgattttctaaggagaacggattcaccggttggacggagacctccgtgaaagagaataaaaatataaacgaggcaatgcgtgttttgatcgagaagatgatgagaaattccaccgaagatattatgtccctgtcgactcaaggcgactatataaaccttcagacaaagtcctcatcatggtcctgttgttag

SEQ ID NO: 202357 - DNA, 612 bp, Artificial Sequence
  Description of Artificial Sequence: Synthetic coding sequence
atgggcagccgggaccacctgttcaaggtgctggtggtgggcgacgccgccgttggcaagacctccctggtgcagagatatagccaggacagcttctcaaagcactataagagcacagtgggcgtggatttcgcactcaaggtgctgcagtggtccgattacgagatcgtgcgcctgcagctctgggatattgccggacaagaaagattcacatcaatgaccaggctgtactatcgcgatgccagcgcttgtgtaattatgtttgacgtgacaaacgccacaactttctctaactcacagcgctggaaacaggacctcgactcgaaattaactttgccgaacggtgagcctgtcccatgcctgctgctagccaacaagtgcgacttatcaccgtgggcagtgtctagagatcagattgaccggttcagtaaggagaacggttttactggttggaccgaaacatccgtcaaagagaacaagaatataaatgaggccatgagagtattgatcgagaaaatgatgagaaactccaccgaggatatcatgtccctgtccacacaaggggactatatcaacttgcaaacaaagagtagctcctggagttgctgctag

SEQ ID NO: 202358 - DNA, 396 bp, Artificial Sequence
  Description of Artificial Sequence: Synthetic coding sequence
atgacccggctgtactaccgggacgccagcgcctgcgtgatcatgttcgatgtgacaaatgctacgactttcagcaactcccagcgatggaagcaggatctggactccaagctgactctccctaacggggagcccgtcccatgtttacttttagcaaacaaatgcgatctaagtccctgggccgtgagccgtgaccagattgatcggttcagcaaggaaaacgggtttacgggttggaccgagactagcgtcaaggaaaacaaaaacataaacgaagccatgcgagttctgattgagaagatgatgagaaactctacagaagacattatgtcattgtctacacagggcgactacatcaacctgcagacaaagtcgtccagttggagttgctgctag

SEQ ID NO: 202359 - DNA, 540 bp, Artificial Sequence
  Description of Artificial Sequence: Synthetic coding sequence
atgggcagccgggaccacctgttcaaggtgctggtggtgggcgacgccgccgtgggaaagactagcctggtccagcgctatagccaggattccttctccaaacattacaagtccactgtgggaggacaggaacggttcacctccatgactaggctgtactaccgagacgcttccgcttgtgttatcatgtttgatgttaccaatgcaaccactttcagtaattcacagagatggaaacaagacctggacagtaaacttactctaccaaatggggaacccgtcccttgcctcttgctcgccaacaagtgtgatctgtcaccctgggctgtcagcagagatcagatagatcgcttcagtaaagaaaacgggttcactggatggacagagaccagtgtgaaagaaaataaaaatatcaatgaagccatgcgcgtgctgattgagaagatgatgagaaattctactgaagatatcatgtctttgagtacgcagggtgactatataaacctacaaacaaagagcagtagttggtcttgctgctag

SEQ ID NO: 202360 - DNA, 624 bp, Artificial Sequence
  Description of Artificial Sequence: Synthetic coding sequence
atggccaagacctacgactacctgttcaagctgctgctgatcggcgacagcggtgtgggcaagacatgtgttctgttcaggtttagtgaggatgcctttaattctaccttcatttccacaatagggatcgacttcaaaatccgcaccatcgagctcgatgggaaacgtatcaagctgcaaatttgggacaccgctggccaggagaggtttagaaccatcaccaccgcatactaccggggagctatgggcattatgttggtttacgatatcacaaacgagaagagttttgataatattagaaattggatcagaaacattgaagaacatgccagtgccgacgtggagaagatgattctggggaataaatgcgatgtgaatgataagcgtcaggtcagcaaggagagaggcgagaagttggccctggactacggaatcaagttcatggaaacctccgcaaaagctaacatcaacgttgagaacgcattctttaccctcgccagagacataaaagctaaaatggataagaaactggagggtaattcacctcagggaagcaatcagggggtgaaaataactcccgatcagcaaaaacggtcaagtttttttcggtgtgtcttgttgtag

SEQ ID NO: 202361 - DNA, 606 bp, Artificial Sequence
  Description of Artificial Sequence: Synthetic coding sequence
atgagcggcaagagcctgctgctgaaggtgatcctgctgggcgacggcggcgtggggaaatcctccctgatgaatagatatgtaacaaataagtttgattcgcaggcattccacacaataggggtggaattcctcaacagagacttggaggtggatggcagattcgttacactgcagatttgggacaccgcgggacaggagcggttcaaaagtcttcgaacaccgttctaccggggcgccgactgctgcctgttgaccttctctgttgacgaccggcaaagtttcgagaatttaggtaactggcagaaagagtttatctattacgctgacgttaaagaccctgagcactttccatttgttgtacttggcaacaaggttgataaagaagaccgccaggtgaccaccgaggaggcccagacctggtgtatggagaatggtgactacccctacctcgaaaccagcgccaaagacgatacgaacgtaaccgtggcgttcgaagaggctgtgcggcaggtcctcgctgtggaggaacaactggagcactgtatgcttgggcacacgatcgaccttaactcaggttcaaaggccggcagctcttgttgctag

SEQ ID NO: 202362 - DNA, 2589 bp, Artificial Sequence
  Description of Artificial Sequence: Synthetic coding sequence
atggcccagcccggccccgccagccagcccgacgtgagcctgcagcagcgtgtcgcagaactggagaagattaatgcggagttcctgagagctcagcaacagttggagcaggaatttaaccagaaaagggctaagtttaaagaactttatctcgctaaggaggaagacctcaaacggcagaacgctgttctccaggccgcccaggatgatctcggccacttgagaactcagctctgggaagcccaggccgagatggaaaatatcaaagccatcgccactgtctctgaaaatactaagcaggaggcaatagacgaagtcaaacggcagtggagggaggaggtcgcctcgctccaagccgtgatgaaggagacagtcagagattacgagcaccagtttcatctaaggttagaacaagagcggacacagtgggcacagtacagagaatctgctgaaagagaaatcgcagacctacgacggcgactatccgagggccaggaggaggagaacctggaaaacgaaatgaaaaaggcacaggaggatgctgaaaagctacgaagcgtcgtaatgccaatggagaaggagattgctgctctcaaggataaactgacggaagcggaggataaaatcaaggagctggaggcaagtaaggtgaaagagctgaatcactaccttgaggccgagaagtcttgccgcaccgaccttgaaatgtatgttgcggtgctgaacacccaaaagtctgttctacaggaagatgccgagaaacttcggaaggaactccacgaggtctgtcacttgctcgagcaggaaagacaacagcacaaccagcttaagcacacctggcagaaggccaacgatcagttcctagagagtcaaaggcttttgatgcgagacatgcagcggatggagatcgtgctgacgagcgagcaactcaggcaagtggaggaactaaagaagaaagatcaggaggacgacgaacagcagcgactgaataaacggaaggaccataaaaaggccgatgttgaggaagagatcaaaatcccggtggtatgcgcactgacccaggaagaatcctctgcacaactgtcaaatgaagaagagcacttggacagcacccggggctcagtgcacagcctcgatgcaggcctccttttgccatccggagatcctttttctaaaagtgataacgatatgttcaaagacggactgcggagggcacagagcactgacagcctggggaccagcgggtccctgcagagtaaggctttaggatacaactacaaagcaaaatcggctggaaatctcgatgagtcagacttcggcccactggtcggagcagattcagtctcagagaacttcgacacggcgtcgctggggtccttgcagatgccctccggtttcatgctcaccaaagatcaggaaagagctatcaaggctatgacaccagagcaggaggagactgcaagtctactatcctcagtgacccagggaatggaatcagcgtatgtctcacctagtgggtataggctggttagcgaaaccgagtggaatctgctccagaaggaggtgcacaatgcggggaacaagctgggccgcagatgcgatatgtgttctaactatgagaagcaactccagggcatccaaatccaagaggcagaaacccgcgaccaggtgaaaaaactgcagctcatgctgcgccaagccaacgaccaactggagaagacgatgaaggataagcaggagctcgaggacttcatcaaacagagcagtgaggattcctcacaccagatttctgctttagtgctgcgggcccaggcctctgagatcctgttggaggagttacagcaaggactgtcgcaagccaaacgcgacgtccaggagcaaatggcggttcttatgcagagcagagagcaggtctcagaggagctggttcggctccagaaggacaatgactcacttcaggggaagcattccttacacgtgtccctccagcaggcagaggacttcattctgcccgataccaccgaggcccttcgggaactggtgcttaagtaccgagaggacattataaacgtgagaaccgctgctgatcacgtggaggagaagctgaaagccgaaattctcttcctgaaagaacagattcaagccgagcaatgtctcaaggaaaacttagaggagactctacagcttgaaatcgaaaattgcaaggaagagattgcatctatctcgagcctcaaagccgagttagagaggattaaagtggagaagggccaactcgagagtaccctgcgggaaaagagccagcagttagaatctctgcaggaaattaaaatctccctggaggagcagcttaagaaggaaactgccgcaaaggcaacagtggaacagctgatgttcgaggaaaaaaacaaggcgcaaaggctacagacagagttagacgtttctgagcaagtccagagagacttcgtgaagctttctcagacgctgcaggttcaattggaacgaatacggcaggctgatagcctggagcgcatcagggccattctgaatgacacaaaactgactgacattaaccaactcccggaaacctag

SEQ ID NO: 202363 - DNA, 2490 bp, Artificial Sequence
  Description of Artificial Sequence: Synthetic coding sequence
atggcccagcccggccccgccagccagcccgacgtgagcctgcagcaacgagtcgctgaactggaaaagatcaacgccgagttcctccgcgctcaacaacagctcgaacaggagttcaaccagaagcgggccaaattcaaagagctgtatctggccaaagaagaggatctgaagcgccagaacgctgtgcttcaggccgcccaagacgatctagggcatctcaggacacagctgtgggaggcccaggcagagatggagaatatcaaagccatcgcaacggtgagcgaaaatactaagcaagaggccattgatgaagtgaagagacagtggagagaggaggtcgcttcgttgcaggcagtgatgaaggagaccgtgcgcgattatgagcaccaatttcaccttagactcgaacaggagcgaacacagtgggctcagtatagagaatcggctgagcgagaaatagcggatcttaggagacggttgagcgaaggacaggaggaggagaatctagagaatgagatgaaaaaggcccaggaggacgccgaaaaactcaggtctgtcgtaatgcccatggagaaggagatcgctgccctcaaggacaaactgacggaagccgaggacaaaattaaagagttggaggcatctaaggtcaaggaactcaaccactatctagaagccgaaaaaagctgtcgcacagacctagaaatgtatgttgctgtgctgaatacacagaagtctgtgctgcaggaggacgctgagaagttgaggaaggagctgcacgaggtgtgccatctgttagagcaggagcgccaacagcacaatcagctaaaacatacctggcagaaggcaaatgatcagttcttggagagtcagagactgttaatgagggatatgcagcgaatggaaatcgtgctgaccagcgagcaactgaggcaagtggaggaattgaaaaaaaaggatcaggaagatgatgaacagcaaagattgaataagaggaaggaccataagaaggcagatgtggaggaagaaatcaagatccctgtggtatgtgccctgacccaggaagagtcgtcagcacagctgagcaacgaagaagaacacctggactctactcgaggaagcgtacactccctggacgctggactacttttgcccagcggcgacccattttccaaaagcgataatgacatgttcaaggacggcctgagacgtgcacagtcaacggactcacttggcactagtggctccctacaatccaaggccctgggctacaactacaaggcgaaaagcgcgggaaacctggacgagtccgattttggtccactggtaggcgcagactccgtttccgagaactttgacactgccagccttggcagcctgcaaatgccctccggatttatgctgaccaaggaccaggagagagctatcaaggccatgaccccggagcaggaagagactgcctccctgctgtcttctgtgacccaggggatggagtcagcctacgtgtctccttctgggtacaggctggtgtcagagacagagtggaacctcctccagaaggaagttcacaacgctggaaataagctgggccgccgctgcgatatgtgttccaattatgagaaacaactgcaggggatacagattcaggaggccgagactcgcgatcaggtcaaaaaactgcagctcatgttgaggcaggcgaacgaccagctggagaaaaccatgaaggataaacaggagctagaagattttataaaacagagtagtgaagactcaagccatcaaatttcagcgctagttctacgcgctcaggcttctgagattctgctggaggagctgcaacagggactgagccaggccaaacgcgatgttcaagagcaaatggccgttctgatgcagtccagagagcaagtgagcgaggaactcgtgcggcttcagaaagacaatgactctctacagggaaaacactcacttcatgtgagtctgcagcaggccgaagactttatcttgcctgacacaaccgaagccttgcgcgagcttgtgttgaagtatcgggaggacattattaacgtgcgaacagccgctgatcacgtggaagaaaagctgaaggcggagatactatttttgaaggaacagattcaggcagaacaatgtctgaaggaaaatctggaagaaacacttcagttggaaatcgaaaactgtaaggaggagattgcatccatttcctctctcaaggcagagctcgagcgtattaaggtggaaaaaggacaagcaactgtagagcagctgatgtttgaagagaaaaataaggcacagaggcttcagacagaactggacgtgtctgaacaggtgcagagggacttcgtcaaactttctcagaccctccaggtccagctggaaagaattagacaggctgactccctcgaacgcataagggcaattttaaatgacactaaactgaccgatatcaaccagctaccagaaacatag

SEQ ID NO: 202364 - DNA, 2490 bp, Artificial Sequence
  Description of Artificial Sequence: Synthetic coding sequence
atggcccagcccggccccgccagccagcccgacgtgagcctgcagcagagagtagcagaacttgagaaaatcaacgccgaatttctgcgggcacagcagcagctcgagcaggagtttaaccaaaaaagagctaaatttaaggagctttatcttgccaaggaagaggatctgaaacgccagaacgcagtgttgcaggctgctcaggatgatctgggacatctacgcactcagctgtgggaggcccaagccgagatggagaatatcaaagctatcgctactgtgtcagaaaacacaaaacaggaggccattgacgaagtgaaaagacagtggcgagaggaggtcgccagcctacaggctgtgatgaaagaaacagtcagggactacgagcatcagttccaccttcggctggaacaggaacggactcaatgggctcagtaccgagaatccgcagaaagggaaatcgctgaccttcgacggaggctgagtgaagggcaagaagaagaaaacctggaaaatgagatgaagaaagcccaggaagatgcggaaaaacttagaagcgtggtaatgccaatggagaaagagatcgctgccctgaaagacaaactgaccgaagctgaggacaaaatcaaggagttggaggccagtaaggtaaaggaactcaatcactaccttgaggccgagaagagctgcagaaccgacttggagatgtacgtggctgtgctgaacacgcagaaatctgtgctgcaggaggacgctgagaagttgagaaaagagcttcatgaagtgtgccacttattggagcaagagcggcaacagcataatcaactgaaacacacttggcagaaagcgaacgaccagttcctggaatctcagaggcttcttatgagggatatgcagaggatggagatcgtcctgacttcggagcagctgcgccaagtggaagaactgaaaaagaaagaccaagaggacgatgaacaacaacgactgaacaagaggaaagatcacaaaaaagccgatgttgaggaagagattaaaataccggttgtgtgcgcgctcacgcaggaggaatcatcggctcagctctccaatgaggaggaacacttagactcaactcggggatcagtccactcccttgatgccggcctcctccttcccagcggcgaccctttcagcaagagcgacaacgacatgtttaaggacggcctaaggcgagcccagtctaccgacagcctcggcacttccggtagcctccagtcaaaggctctgggctacaactacaaagccaaatctgccggaaatcttgatgaatctgacttcggacccctagtgggtgccgactctgtctcggagaattttgacactgcttctcttggatccctgcagatgcccagcgggtttatgctgactaaagaccaggagagagctatcaaggccatgaccccggagcaagaggagacagccagcctcctgtccagcgtcacccagggaatggaaagcgcatatgtttctcccagtggctaccgcctggtcagtgagaccgagtggaatttacttcagaaagaagtgcacaatgcaggcaacaagctgggtagacgatgtgatatgtgctccaattatgaaaagcagctccaagggattcagatccaggaggccgaaactcgggatcaggtcaaaaagctgcaactgatgttgcgccaggcgaacgatcagctagagaaaacaatgaaagataagcaagagcttgaagattttataaaacagtcgtctgaagatagctcacatcaaatcagcgccctagtcttaagggctcaggcaagcgagatcctgctggaagagcttcagcaaggactatcccaggctaaacgagatgtgcaagagcaaatggctgtcctgatgcagagcagagagcaggtgtccgaggaactggttagactccagaaggataatgattctctccaggggaagcactccctgcacgtctcccttcagcaggctgaggatttcattctacccgacaccacagaagcccttcgtgaattagtcctgaaatatcgcgaggatatcatcaatgttcgcacggcagctgatcatgtggaagagaaactgaaggcagaaattctcttcctgaaggaacagattcaggctgaacagtgcctgaaagagaatctggaggagacgctgcagctcgaaatcgagaactgtaaggaagagatcgcctcaatctcctctcttaaggcggagctggaaagaattaaggtggaaaagggacaggcaactgtggagcagctgatgtttgaggaaaaaaataaggcgcagagattgcagacagagctcgacgtatcagagcaagtacagcgagacttcgtgaagctgtctcaaaccctgcaggtccagctcgagaggatacgccaggccgattcactggagagaatccgagcaatcttgaatgatactaaactgacagatatcaaccaattgccagagacttag

SEQ ID NO: 202365 - DNA, 2460 bp, Artificial Sequence
  Description of Artificial Sequence: Synthetic coding sequence
atggcccagcccggccccgccagccagcccgacgaggacctgaagcggcagaacgccgttctgcaagctgcacaggacgacttgggtcacttgagaacacaactttgggaggctcaggccgagatggagaatattaaagcaattgccacagtcagtgaaaacacaaaacaggaggcaatcgacgaggtgaaacgccagtggagggaggaagtcgcctcgctgcaggctgtcatgaaggagaccgttcgagactatgagcaccagttccatttgcggctggaacaagagagaacacagtgggcccagtatcgcgaaagcgctgagagggaaatcgccgaccttagaagaagactgagtgagggacaagaagaggagaatctagagaacgagatgaaaaaggcgcaagaggacgccgagaagctgcgctccgtggtgatgcctatggagaaggaaattgctgccctgaaagataaactgacagaagcagaagacaagattaaagagctcgaggcaagcaaggtcaaagagctaaatcactatctggaggccgagaagagctgtcggacagacctagaaatgtacgtggccgttttgaacacacagaaaagtgtcttgcaggaagatgccgagaaactcagaaaggagcttcatgaggtgtgtcatttacttgagcaggagcggcaacagcacaatcaattgaaacatacctggcaaaaagccaacgatcagtttctggaatctcagcggctcctcatgcgggatatgcagagaatggagattgttctgacatcagaacaactcagacaggtggaagaactgaaaaagaaagaccaggaggacgacgagcagcaaagattgaacaagcggaaagaccacaagaaggcagacgtggaggaggagataaagattcctgttgtctgcgctctgacccaggaggagtcctcagcgcaactgagtaacgaggaggaacaccttgatagcacacgggggtcggttcacagcctggacgctgggctcctgctcccatctggagatcccttctctaaatccgataacgacatgttcaaagacggcctcaggagggcacaatccactgactccttggggacatccgggtccttacagtctaaggccctggggtataattataaggcaaaatccgctgggaatctcgatgaaagcgacttcggacccctggttggcgctgactccgtgtcagagaattttgataccgctagcttaggaagtcttcagatgccttccggcttcatgctcacgaaggaccaggagagagccatcaaggccatgactcccgaacaagaagaaacggcttctttgctatctagtgtgacacaggggatggagtccgcctacgtcagcccctcaggttatcggttggttagtgagaccgagtggaacctgcttcagaaggaggttcacaatgccgggaataagctgggacgccgctgtgacatgtgttctaattacgaaaagcagctgcaggggatccagatccaggaagctgagacccgcgaccaggttaaaaagctgcagctgatgctcaggcaggccaatgaccagctggaaaagacgatgaaggataagcaggaactggaggactttattaaacagagtagtgaggactcaagccatcaaatttcagccctcgtactccgagctcaggcatctgagatactgctagaagagcttcaacaaggtttaagccaggcgaagcgcgacgtccaggagcaaatggccgtgttgatgcagtctcgggagcaggttagcgaggagcttgtccgtcttcagaaggacaacgattcattacaggggaagcactcattacatgttagtctgcagcaggccgaggactttatcctacctgacacaacagaggcccttagagaactggtcctaaagtacagagaagatattataaatgtccggaccgccgcagatcatgttgaggagaagttgaaagctgagatcctcttcctcaaagaacagatacaggccgagcagtgcctgaaggagaacctggaagaaactctgcaactggaaattgaaaattgcaaggaggaaatagcttctatcagtagcttgaaggctgagctagagcgcatcaaagtggagaaaggacaactggaatcaacactgagagaaaagagccagcagctggagagtctacaggaaatcaagatttcactggaggagcagctgaaaaaggagaccgctgctaaggccactgttgaacagctgatgttcgaggagaaaaacaaagcccaacgcttgcagacggaacttgatgtgtccgagcaagttcagcgagacttcgtgaagcttagtcagactttgcaggtgcagctggaacgcatccgccaggccgactctctggagcgtattagagctatattaaatgatactaaattaaccgacatcaaccaattgccggagacatag

SEQ ID NO: 202366 - DNA, 2151 bp, Artificial Sequence
  Description of Artificial Sequence: Synthetic coding sequence
atggcccagcccggccccgccagccagcccgacgtgagcctgcagcagagagtagctgagttggaaaagatcaacgctgaattcctccgggctcaacagcagctcgagcaggagtttaatcaaaagagggcaaagttcaaggaactatatctcgctaaagaagaggatctgaagagacaaaatgcagttctgcaggccgcccaggacgatttaggccacttacgcacccagctgtgggaggcccaagccgaaatggaaaatattaaggctatcgccaccgtttctgaaaacaccaagcaagaagctattgacgaggtcaaaaggcagtggagggaagaagtggctagtttgcaggccgtgatgaaggagaccgtcagagattacgagcaccagttccacctgcgcctggagcaggagcgcactcagtgggctcagtaccgggagagcgcagagagggagattgctgatctgcggcggaggctcagtgaaggtcaggaagaggaaaatctcgaaaacgagatgaagaaggcgcaggaggacgcggaaaaactgagatctgtggtgatgcccatggaaaaggagattgctgctcttaaagacaagcttacagaggcggaggacaagatcaaggaactggaggcttcgaaggttaaagagctgaaccactaccttgaagcagaaaagagctgcagaactgacctggaaatgtacgtggccgtattgaatactcagaaatctgttctccaggaagacgccgagaagctgcgcaaggagctccaccaggaacgccaacaacacaaccagcttaagcacacctggcagaaagcgaatgaccagtttctcgaaagtcaacgcctcctgatgagggacatgcagcgcatggaaatcgtgctgactagtgaacaactccgtcaggtagaggaacttaaaaagaaagatcaggaagatgatgaacaacagaggcttaataagcggaaggatcataaaaaagcggacgtggaagaggaaattaaaattccggtggtgtgtgccttaacacaagaggagtcaagtgcacaattatccaacgaagaagagcacttggattccactagaggttcagtgcatagcttggatgccgggcttctcctaccttctggtgatccgtttagcaagagtgacaatgacatgttcaaggatggactcaggagagctcagagtacagatagcctcgggacaagcggcagcctgcaatcaaaagccctcgggtataattataaggctaagtcagccggtaatctggatgaatccgattttggtcccctggtaggcgccgatagcgtgtcagagaatttcgataccgcaagcctgggttcgctccagatgccctcaggtttcatgcttaccaaagaccaggagagggcaattaaggccatgacaccggagcaggaagaaaccgcaagcctgcttagcagcgtgacccagggaatggagagcgcctatgtcagcccttctggttaccgactagtgagcgagactgagtggaatctcctgcagaaagaagtgcacaatgccggtaacaaattgggaaggcgttgtgacatgtgtagcaactacgaaaaacagttacagggcatccagattcaggaggcggaaactcgcgaccaggtgaagaaattgcagctcatgctccgccaggccaacgaccagcttgagaagactatgaaggacaagcaggaacttgaagactttatcaagcagagctcggaggacagcagccaccaaattagtgctctggtcttgcgcgcacaggcctccgaaatcctgttggaagagcttcagcaggggctgagtcaggccaagcgtgacgtgcaggagcagatggccgttcttatgcagtcccgggagcaggtgagtgaggaattagttcgacttcagaaggataacgactccttgcagggaaagcacagtctgcacgtctctctccagcaggccgaagacttcattctgccagataccacggaagctcttcgagagctcgtgctgaagtaccgtgaggatatcattaacgtcaggaccgccgcagaccatgttgaagagaagttaaaggctgagattttgttcctcaaagaacagatccaagctgagcaatgtctgaagaaaaagaaatag

SEQ ID NO: 202367 - DNA, 2589 bp, Artificial Sequence
  Description of Artificial Sequence: Synthetic coding sequence
atggcccagcccggccccgccagccagcccgacgtgagcctgcagcaaagggtggcggagcttgagaagatcaacgcagagtttctaagagctcagcagcagctcgagcaagagttcaatcagaagagggccaagttcaaggaactttacctcgcgaaagaggaggatctgaaaagacaaaacgctgttttgcaggccgcccaggatgacctgggacatttaagaacccaactttgggaggctcaggctgagatggagaacattaaagctattgctactgtgtccgagaacacaaagcaggaggctatcgatgaggtgaagaggcagtggagggaggaagtcgctagcttgcaggccgttatgaaggagaccgtgcgcgactatgaacatcagttccatctcagactggagcaggagagaacacagtgggcccagtatcgggaatccgcagaacgtgagattgctgacctacgccgtagactgagcgaaggccaggaagaggagaatcttgagaacgagatgaagaaggctcaggaagatgccgagaagctcagaagtgtggtaatgcccatggagaaggagatcgctgcactgaaggacaaactgaccgaagccgaagacaaaatcaaggagctggaagcctccaaagtgaaggagcttaatcactacctggaggctgagaagagctgcagaactgaccttgagatgtacgtggctgtcctgaatacacagaagagcgtcttgcaggaggacgcggaaaaattacgcaaggaacttcacgaagtttgtcacctgctggagcaggagcgccagcaacacaatcagttgaaacacacctggcagaaagccaatgatcagtttctggagtctcagcgactgttgatgcgggatatgcagagaatggaaatagtcctgacttctgagcagttacggcaggtggaggagctgaagaagaaggatcaggaagacgatgagcagcagcgccttaacaagcgcaaggaccataagaaggctgatgtggaggaggaaatcaaaattccagttgtgtgtgccctcacacaggaagaatcatcagctcagctctctaatgaggaagaacatttagactctacacgggggtcggtccactcgctggacgcagggttgctccttcctagtggcgaccctttcagcaagtccgacaatgacatgtttaaggatggactacgccgagctcagagtaccgacagcttagggactagtggctctctgcagtctaaggcactgggctacaattacaaagccaaatctgccgggaacttggacgagagcgacttcggacccttggtcggagcggactctgtcagtgagaattttgacacagccagccttggcagcttgcagatgccaagtgggtttatgttaacaaaggatcaggaacgtgcaatcaaggctatgactcctgagcaggaggagacagcatctcttctgtcatcagtgactcagggcatggaaagcgcctacgtctcaccatccggttaccggttggtctcagagacggagtggaacctgttacaaaaggaggtgcacaacgcgggaaataagctgggaagacgctgcgacatgtgtagcaattatgaaaagcagctccagggaatccagattcaggaagccgaaactcgcgaccaggtcaaaaagttacagctgatgctgaggcaggcaaacgaccagctagaaaaaactatgaaggataagcaggaactcgaagactttattaaacaatcttccgaggattcaagccaccaaattagcgccttagtcctgcgcgctcaggccagtgaaatactgctagaggaactacagcagggattgtctcaggctaaacgcgatgttcaagaacagatggcagtgctcatgcagtcccgtgagcaggtcagtgaagaactggtaagactgcagaaagataatgactctttgcaggggaaacacagcttacatgtcagcttgcagcaagccgaggacttcatcctgcccgatacaaccgaggctttgcgcgagctcgtcctaaaataccgtgaagacattattaacgtgaggactgcagcagatcatgtagaagaaaaactgaaggctgagattttattcctgaaagagcaaatccaggccgagcagtgtctgaaagaaaatcttgaagaaacattgcagcttgagatcgagaattgcaaggaggagatcgcctcaatctcttcattgaaggctgaacttgagcgtatcaaggtcgagaagggacagctggagagcacgttgagggaaaagtcacaacagctggagagcctccaggaaatcaagataagtttggaggagcaattgaagaaagagactgcagcaaaagccacagttgagcagctgatgtttgaagagaagaacaaagcgcagagactgcagacagagctggacgtgagcgagcaggtgcaaagagatttcgtcaagctttctcagaccttgcaggttcaactcgagcgcatcagacaagctgattccctcgagagaatacgggctatactgaacgacaccaaacttaccgatatcaaccagttgccagagacatag

SEQ ID NO: 202368 - DNA, 1602 bp, Artificial Sequence
  Description of Artificial Sequence: Synthetic coding sequence
atggccgccgccgcccccgtggccgccgacgacgacgagcggcggcgtaggcctggggcagctttagaagactctcgctctcaagaaggcgccaatggggaggctgagtccggagagctttcaaggttgcgagcagaactggccggcgccctggctgagatggaaaccatgaaggcagtggcggaggtctccgagtctaccaaggcagaagccgtcgctgcagtgcagcggcagtgccaggaggaggttgcgtcccttcaggccatcctgaaggacagcatcagctcatacgaagcacagataactgctctgaaacaggagaggcaacagcagcagcaggactgcgaggagaaagaaagggagctcggccgtcttaagcagctgttatccagagcctatcctctcgattccctggagaaacagatggaaaaagctcatgaggattcggagaaactgagagagattgtgctgccgatggagaaagaaatcgaagagctaaaggcaaaactattacgagccgaagaactgatccaggaaatccaacgccgcccgaggcatgcccctagcttgcacggctccactgagctgctgcctcttagtagagacccatctccccctctggagccccttgaagagctcagcggcgatggcggcccggctgccgaggcgttcgcccataattgtgatgattccgcttcaatctcctctttctcgctgggcggcggcgtggggtcatcatcttccctgccccaaagcagacagggactttcccccgagcaagaagagactgcctccctcgtttccaccggcaccctcgtccccgagggaatctacctgccaccacctgggtaccagttggtcccagacacacaatgggaacagttacagaccgagatgcaggttctcctggcacaggtccagaactctgagcaacttctgcggacacttcaggggacagtgagccaggcccaggagcgggtgcaactgcagatggctgagctggtcaccacacacaagtgcctgcaccacgaagtcaagaggttaaacgaggagaaccaagggctcagggctgagcagctcccgtcaagtgctccgcagggttcccaacaggaacagggagaagaagaaagtctgccctccagtgttcctgagctccaacaattgttgtgctgtacccgccaggaggctagagctcgcctgcaggcacaggaacacggcgccgaacggttaaggatcgagatcgtgacactgcgtgaggccctggaggaagagaccgtggcccgcgccagccttgaaggccagcttcgggttcaacgagaggagaccgcttctttgtgttccctgaggacagagatggagagagttcagcaagagcaatctaaggcccagctcccagatctgctcagcgagcagagagctaaggtcctgaggctgcaggcagagctcgaaacctcagagcaagttcagagagactttgtgaggctgtcacaggcacttcaagtgagactggaaaggatccgacaagctgaaaccctggagcaggtaagatctatcatggacgaggcccccctgactgatgtgagagacatcaaagatacgtag

SEQ ID NO: 202369 - DNA, 1710 bp, Artificial Sequence
  Description of Artificial Sequence: Synthetic coding sequence
atggccgccgccgcccccgtggccgccgacgacgacgagcggcggcggaggcctggggcagcacttgaagattctagaagccaggagggagcaaatggcgaggctgagtccggggagctctctcgcttgcgagcagagctggctggggcactagctgagatggagacaatgaaggcggtggccgaggtgtccgagagcaccaaagctgaggccgtggccgccgtacagaggcaatgtcaggaggaagtggcaagcctccaggctatcttaaaggactctatttccagctacgaagcacagatcactgccttgaagcaggaaagacagcaacagcagcaagactgtgaagagaaagaacgcgagcttggacgcctgaagcaactgttatctcgcgcgtatcccttggatagtctggaaaagcagatggagaaggcccatgaggactcagaaaaactgcgggagattgtgctccccatggaaaaagaaatcgaagagctgaaagccaagctgctcagggcggaggagctcatacaggaaattcaacgcagaccaaggcatgctccaagcctgcacgggtccactgagctgctgcctctgagccgcgatccttctcctccgttggagccactcgaagaactttctggggacggaggacccgcagctgaggccttcgcccataactgcgacgacagtgcatccatcagctcctttagcctggggggcggtgtagggtcctcttctagcctgcctcaatcacgccagggtctgagccccgaacaggaagaaacagcttcattagtgtccaccggcaccctggtccccgagggcatttatcttcctccccctggctaccagttagtgcccgacactcagtgggagcagctgcagacagaaggaaggcaactgcagaaggacctggaaagcgtatctcgcgaacgggatgagctacaggagggattacgcagatcaaacgaagactgcgccaagcagatgcaagtgttgcttgcccaggtgcagaattcagaacagctgctcagaaccctacaggggacggtgtctcaggcacaggagcgtgttcaactgcaaatggcagagttggtgacgacccacaagtgtcttcaccacgaggttaagcggttgaacgaagaaaatcaaggccttagagcagagcagctaccctcatccgccccgcaggggagccagcaggaacagggcgaggaggaaagcctaccatccagcgtaccagagttgcagcagctgttgtgctgcacaagacaggaagctcgggccaggctgcaagcccaagaacacggagctgagaggctgcgaatcgagatcgttacattacgcgaagcattagaggaggagaccgtcgcaagagcctcacttgagggccagctccgggtccaacgagaagagaccgaggtgctggaagcctcattgtgctctctccggacagaaatggagcgagttcagcaggaacaaagcaaggcccagctaccggacctattgtcagagcagcgcgccaaggtgcttcgcctgcaagccgaactagagacttcagaacaggtgcagagagatttcgtgcggctatcccaggccctgcaagtgaggctggaacggatccgacaggcggaaactctggagcaggtacgtagcatcatggacgaagcaccactgactgacgtccgtgatattaaggatacctag

SEQ ID NO: 202370 - DNA, 1497 bp, Artificial Sequence
  Description of Artificial Sequence: Synthetic coding sequence
atggccgccgccgcccccgtggccgccgacgacgacgagcggcggcgcagacctggggctgattcgatttctagttacgaagcccagatcacagcccttaaacaggagagacagcaacaacagcaggactgcgaagagaaggaacgtgaactcgggcggctgaagcagctgctgtcacgggcatatccgttggattcccttgaaaagcagatggagaaggctcatgaggattcagaaaaactgagagagattgtgttacctatggagaaagagattgaagaactgaaagctaagctgctccgcgccgaggaactgattcaggagatccagagaagacctagacacgcaccaagcctacatgggtcaaccgagctcctccccctgtctagagacccgagcccaccgttggagcccctggaagagttgagcggagacgggggacctgctgccgaagcatttgcacacaactgtgatgactctgcctccatttcctccttctcacttggtggtggggtgggaagctcctctagcctacctcagtcgaggcagggcttatcaccagaacaggaggaaactgcctctctcgtcagcaccgggactctggtcccagaggggatatatctaccaccgcctggataccagttggttcccgatacacagtgggagcaattacagacagaagggaggcaattgcagaaggatctggagtcagtgtcccgcgaaagggacgagcttcaggagggtctccggagatctaatgaggattgcgctaaacaaatgcaggttttgctggcccaggtgcagaacagtgaacagctgttacgtacacttcagggcactgtcagccaggcacaggagcgcgtgcagctccagatggccgaactagtcaccacccacaaatgtttgcaccacgaagtgaagagactaaacgaggagaatcaaggcctccgggcggagcaactgccctcatccgcacctcaggggtctcagcaggagcagggtgaggaagaatcattaccgtcatctgttccagagcttcagcaactgctctgttgcacaaggcaggaggctcgggcgcgcttacaggcacaagaacatggcgctgagagactacggatcgaaattgtgacactcagagaggcccttgaggaggagaccgtggccagggctagcttggagggccagctcagggttcagcgcgaggagacggaggttttagaagcttccttgtgcagcctcagaacggaaatggagagggtccaacaagaacagtcgaaggcacagttgcctgatctgctcagcgagcagcgcgcaaaggtcctccggctgcaggcagagttggagacaagtgaacaggtacagcgcgatttcgtgagactttctcaggctctccaagtgcgcctagaaagaatacggcaggctgagaccctggagcaggtcaggtcgatcatggacgaagctcctctgaccgatgtgcgtgatattaaggacacctag

SEQ ID NO: 202371 - DNA, 2085 bp, Artificial Sequence
  Description of Artificial Sequence: Synthetic coding sequence
atgaccgacaccgtgttcagcaacagcagcaaccggtggatgtaccctagcgataggccactacaaagcaatgacaaagaacagctacaggctgggtggtcagtgcatcccggtggtcaacctgatcggcaacgaaagcaggaagaactgacagatgaggagaaggaaatcatcaacagagtgatcgcacgggctgagaagatggaagaaatggaacaggagcgcatcggccggttggtggatcgacttgagaatatgcggaaaaatgtcgccggcgacggtgtaaaccgctgtattctctgtggtgaacagttgggaatgttagggagtgcatgcgtggtatgcgaagattgcaagaaaaacgtctgcaccaagtgtggcgttgaaaccaataacaggcttcacagcgtctggctgtgtaagatttgtatcgagcagcgagaggtatggaagaggagcggcgcatggttctttaagggcttccctaaacaagtgcttccccaacctatgccaattaagaagactaagcctcagcagccagtctcagaaccagcggccccggagcaacccgcccccgagcctaaacaccctgcccgtgcacctgcacggggcgacagtgaggatagacgagggcccggtcagaaaacaggacccgacccagcttcagcgcccggacgcggaaattatggtccacccgtcagaagagccagtgaggctcggatgtcaagctctagtcgcgacagtgagtcctgggaccactcaggcggagccggcgattccagcagatctcccgctggactgcgaagagccaacagcgtccaggcctcccgaccagctcctgggagtgtccagagtcccgccccaccccagccaggtcagccagggactcccgggggctcacgccctggaccaggccccgcaggaagatttcccgaccaaaaacctgaggttgcgccctccgacccgggtacaacagctcctcctagggaagagcgaacaggcggagtgggcggctaccctgcagtgggcgcaagagaagacaggatgtcacacccatccggaccatactctcaagcctcggcggctgctccgcagccggcggctgccaggcagccccctccacccgaggaggaggaggaggaggccaacagctacgatagcgatgaggccaccacactgggcgctttagagttttcactcctctatgatcaggacaatagtagccttcagtgtacgattatcaaagctaagggccttaagcccatggactccaatggcctcgccgatccatacgtcaagcttcaccttctgccgggcgccagtaagtccaacaaactcaggactaaaacattacgcaatactcgaaacccaatatggaacgagactctagtctatcacggcatcacagacgaggacatgcagcgcaagaccctgcgcatctctgtctgcgacgaagacaagttcggccataacgaatttatcggcgaaactaggttctccctgaaaaagctaaagcccaaccagcggaagaacttcaatatctgtctggagcgggtgatccctatgaaacgggccggtacaactgggtctgcccggggtatggctttatacgaggaagaacaggtggagcgagtgggtgatatagaagagcggggcaagatcctggtctcacttatgtattccacccagcagggagggctgatagtcggcattattaggtgcgtgcatctcgccgccatggacgctaacggctacagcgacccattcgtgaaactgtggctgaagcctgacatggggaagaaggctaagcataagacacagatcaagaagaagactcttaacccggaattcaacgaagagttcttctatgacataaaacattccgacctggcgaaaaaatcacttgacatcagtgtatgggattacgatattggtaaaagcaacgattacatcggcgggtgtcaattggggattagcgccaagggtgagcgactgaagcattggtatgagtgtctcaagaataaggataagaagatcgaaagatggcatcaacttcagaacgagaatcatgtaagttcagattag

SEQ ID NO: 202372 - DNA, 2085 bp, Artificial Sequence
  Description of Artificial Sequence: Synthetic coding sequence
atgaccgacaccgtgttcagcaacagcagcaaccggtggatgtaccctagcgatcggccactgcagagcaacgacaaggagcaactgcaagctggctggtccgtacacccgggcggccagcctgatcgtcaaaggaaacaggaggagctgaccgacgaggagaaggaaataattaaccgggttatcgccagggccgaaaagatggaagagatggaacaagaacggatagggcgcctggtcgatcggctggaaaacatgcgcaagaacgtggccggagatggcgtgaataggtgtatcttgtgcggagaacagttagggatgctggggagtgcttgtgtcgtgtgcgaggattgtaagaagaatgtatgcacaaagtgcggtgtggagacaaataatcggttgcactcggtctggctgtgtaaaatctgcattgagcagagggaggtgtggaaaagatctggcgcttggttcttcaaaggttttcccaagcaggtgctgcctcagcccatgccgattaagaagacaaaaccacaacaaccagttagtgagcccgccgcgcctgagcaacctgcacctgagcccaagcatcccgcccgagctccagccagaggggattcagaggaccgacgcgggcccgggcaaaagacaggtccagaccctgcgagtgcccccggcagaggcaattacggacccccagtgcgccgggcaagcgaggctcgcatgtcctcaagctcaagggacagcgagtcatgggaccactcggggggtgctggtgatagttcccgctcccctgccgggctcaggcgagccaacagcgtgcaggcatccagacccgcccccggttcagtccagtctcccgcccccccccagcctgggcagccagggacgcccggaggctccaggcccggcccaggacccgccgggcgttttccagaccagaagccagaagttgcaccatcggatcctggtaccactgccccaccgcgggaagagcgaacgggtggcgtcggcggctaccccgctgtcggggctcgcgaagatcggatgagccatccaagtggcccatatagccaagcttcagctgccgccccacagcctgccgcagcccgccagccacctccaccagaagaggaagaagaggaggccaatagttatgactccgacgaggctactacacttggcgcactcgaattctccctgttgtatgaccaagacaacagtagcctgcagtgtacgatcattaaagccaaggggctcaaacctatggactctaatgggctggctgacccctacgtgaaactgcaccttcttccaggcgcatccaaatcgaacaagcttagaaccaaaaccttgaggaacacccggaaccctatctggaatgagaccttggtatatcacggaattaccgacgaggatatgcaaagaaagacattgagaataagtgtatgcgatgaggataaatttggtcacaacgaattcatcggcgaaacccggttctccctgaagaaactcaaaccaaatcagcgcaaaaactttaacatctgtttggagcgagtaatccctatgaagcgagctggcactaccggcagcgcaagaggcatggctctgtacgaggaggagcaagtggagagagtcggtgacatcgaggaacggggcaagattctggtttcactgatgtactctacgcagcagggtggcttaatcgtgggaattattagatgtgtccatctagccgccatggatgcgaatggctatagtgatcccttcgtgaaactgtggctgaagccagacatggggaaaaaggccaagcacaaaacacaaattaagaaaaagaccctaaacccagaattcaacgaagagttcttctacgacattaagcattcggatctggcgaagaaatcgttggatatcagcgtgtgggactatgatataggcaagagtaatgattacatcggcggttgccagttgggtatcagcgccaagggcgagaggttaaagcactggtacgagtgtctcaagaataaagacaagaaaatcgaaaggtggcaccaactgcagaacgaaaatcatgtcagttcagactag

SEQ ID NO: 202373 - DNA, 2085 bp, Artificial Sequence
  Description of Artificial Sequence: Synthetic coding sequence
atgaccgacaccgtgttcagcaacagcagcaaccggtggatgtacccctccgaccggcccctgcagagtaatgataaggagcagttacaggccgggtggagcgtgcaccctggggggcagccagaccggcagcggaaacaagaagaactgacagacgaggaaaaggaaattatcaaccgcgtgattgcgcgtgcagagaagatggaggagatggagcaggagagaatcggtaggctggtcgacagactagagaatatgcggaaaaacgtggcgggagatggggtgaatcgctgcatcctgtgcggcgagcagctcggcatgttgggaagcgcctgtgtggtttgtgaggactgcaagaagaatgtgtgcactaagtgcggcgttgagacgaacaacagactccatagtgtatggctgtgcaaaatctgtattgagcagcgcgaagtatggaagaggagcggcgcctggttcttcaaaggatttccaaagcaagtactccctcaacctatgccaattaagaagacaaagcctcaacaaccagtgtcagagccagccgcccctgagcagcctgctccagaacctaagcatcctgctagggcaccagctaggggagacagtgaagataggcgcggacctggtcagaaaaccggccccgatcctgcctcggcacccggccggggcaactatgggcctcctgtacgccgtgcctcagaagctaggatgtcctcgtcatcccgtgatagtgagtcttgggaccattcaggcggagcgggcgattccagtaggtctccagccgggctgcgcagggctaattccgttcaggcgagcaggccagcgcctggctcagtccagtcccctgcaccccctcagcctggccagcctggcaccccaggaggttcgaggccgggccctgggccagctggacgttttcctgatcagaaacctgaggtggctccatccgaccccggcaccacagcacctccccgggaagaaagaactgggggcgtgggggggtacccggccgtgggcgcccgtgaggaccgcatgagccacccctcaggcccctactcccaggccagtgctgctgccccccagcctgccgccgctcgccagccacccccccccgaagaagaggaggaggaggctaacagttatgacagcgacgaggctaccaccttgggtgccttggagttttcacttctctatgatcaggacaattcgagcttacaatgcactatcatcaaggctaaaggactcaaacccatggacagcaacggactggcagacccatatgtcaagctccacttgctgcccggggcgagcaagtccaataagctgcggaccaagactctgcgcaatactcggaatcctatttggaatgagacattggtctaccacggcattacagatgaggatatgcagcgcaagactctccggatctcagtgtgtgatgaggacaaattcggtcacaacgaattcatcggagagactagatttagcctgaagaaactcaagcctaaccaaagaaaaaatttcaatatctgcctcgaacgggtgattcctatgaagagggccggaacaactggatccgctagaggtatggccctttatgaggaagaacaggtagagagagttggggacatagaggaaagggggaagatcctggtttctttaatgtactctacccagcaaggaggcctaatcgtgggaatcatacgatgcgtccacctggcagctatggacgctaacgggtacagcgaccccttcgttaagctgtggctgaagcccgacatggggaagaaagccaaacacaagacacagataaagaagaaaaccttaaaccctgagttcaatgaggagtttttttacgacataaaacattctgatctggctaagaaaagcttggatatcagtgtttgggattatgacatcggaaaatcgaatgactacattggcggatgtcaactgggtattagcgctaagggtgaaagactgaagcactggtatgagtgccttaagaacaaagataaaaaaattgagcgatggcatcagcttcagaatgagaaccacgtttcctccgattag

SEQ ID NO: 202374 - DNA, 1938 bp, Artificial Sequence
  Description of Artificial Sequence: Synthetic coding sequence
atgaccgacaccgtgttcagcaacagcagcaaccggtggatgtacccaagcgaccgccctctgcaaagcaagctaaaggaccggcggttggtggaccgattggaaaatatgcggaagaacgtcgcaggtgatggagtgaatcgttgtatcctctgcggcgagcagctaggaatgctggggagcgcttgcgtggtctgtgaggattgtaagaagaacgtgtgtacaaagtgcggagtggagaccaacaacagactgcactcggtttggctctgtaagatttgcattgaacagcgggaagtctggaagaggagcggagcgtggttcttcaaaggctttcctaagcaagtactacctcagcctatgcctataaaaaagacaaaaccccagcagcccgtctctgagcctgctgcccctgagcagcctgctccagaaccgaaacatccagcccgagctccagcccgcggcgactcagaggaccgccgcggacctggtcagaagactggccccgatcctgctagtgccccaggtcgcgggaactacggcccacctgtccgacgcgcaagcgaggcccgtatgagttccagcagtagggattccgagtcatgggatcatagcggcggagctggggatagctccagaagtccagcgggactcagacgagcaaatagtgttcaagcctcacgcccagcacctggctcagtgcagtccccggcaccccctcagcctggccagcccggcactcccgggggatcccgccccggtccaggccctgctggccgcttcccagatcagaaaccagaggtggccccctctgacccaggtacaaccgctccccctagagaagagcgaactggaggcgtcggggggtaccctgccgtgggcgcacgggaggacaggatgagtcacccatccggaccctattcacaggcttcggccgccgcgccgcagcctgccgctgcaagacagccgccacctcccgaggaggaggaggaagaagctaattcctacgattctgacgaggccactactctaggcgcgctggagttctctttactttacgaccaagacaactccagcttacagtgtactattataaaggccaaaggtctaaagcctatggatagtaatggccttgcagacccttatgtgaagctccatctgctgcccggagcaagcaaaagtaataaactccgcacaaagactcttaggaacacccgcaatcctatttggaatgagacactggtgtaccacggaattaccgacgaagacatgcagaggaaaaccctgcggatcagtgtctgcgacgaagacaagttcggccacaacgagttcatcggagagacgaggttctcgctcaagaaactcaaaccgaaccagagaaaaaattttaatatatgtctggagagggtcatccctatgaaacgcgccggaactactggatccgccagggggatggcactctatgaggaggaacaggtggaacgtgtgggcgatatcgaggagaggggcaaaatccttgttagcctcatgtatagcactcagcaagggggattaatcgtgggaattatcagatgcgtgcacctcgcggcaatggacgccaacggatactctgacccctttgtaaagctttggttgaagccggacatgggtaagaaagcaaaacacaagactcaaatcaaaaaaaagacattgaatccagaatttaatgaggagtttttctatgatattaaacattccgacctagccaagaagagtctggacattagtgtctgggattacgacatcgggaagagcaacgactatataggggggtgccaactggggatctcagctaagggtgagagacttaagcattggtacgagtgcttgaagaacaaagacaagaaaattgagcggtggcaccaactgcagaacgagaatcacgtgagcagtgactag

SEQ ID NO: 202375 - DNA, 2085 bp, Artificial Sequence
  Description of Artificial Sequence: Synthetic coding sequence
atgaccgacaccgtgttcagcaacagcagcaaccggtggatgtacccctcagaccggccactccagtctaacgataaagagcaactccaggccggttggagtgtgcaccccggcggacagccggatcggcagcgaaagcaagaagagcttacagacgaggaaaaagaaattatcaacagagtgatcgctcgggccgagaagatggaagagatggagcaagagaggatcggcagactcgtcgaccgtctggagaacatgaggaagaacgtggcaggtgatggtgtgaatcgctgcatcctctgcggagaacagttgggtatgctgggcagtgcctgcgtagtgtgtgaagactgcaagaaaaatgtctgtaccaaatgtggagtggaaacaaataataggctccattcagtgtggctctgcaaaatctgtattgaacagcgggaagtatggaaaagaagtggcgcctggttttttaaaggctttcccaagcaggttctacctcagcctatgcccattaaaaagaccaagccccaacagcctgtttccgaacccgctgcgccagaacaacccgcccccgaacctaaacatcctgctcgggccccagcccgaggtgactccgaagaccggagagggccaggtcagaaaactggaccagacccagcctctgcccccggtagggggaattatggtccccccgtaaggagggcatcagaagctcgcatgtccagttcatctagagattctgagtcttgggaccattcgggaggtgccggtgatagctcaaggagccctgcgggcctgagacgtgcaaactccgttcaagcctctaggccagctccaggatcggtgcagtccccagcacccccgcaacctggccaaccagggacgccgggtggatctaggcccgggcctggacctgccgggagatttcccgatcagaagccggaagtggcgccttcagatcccgggactaccgccccgccgcgggaggagaggactggcggcgtgggggggtaccctgcggtgggggcccgggaagataggatgtctcacccatcgggaccgtacagccaggcaagcgccgccgccccccaaccggcagctgctcgacagcccccaccacctgaagaagaggaggaggaggcaaattcgtacgatagtgatgaggctactaccctgggcgctttggagttctctctgttgtacgaccaagacaattcgagtctccagtgcacaattatcaaagcaaaagggttgaagcctatggactctaatggactggcagacccctatgtgaaattacatttgttgcccggcgcctctaaatctaataaactccggacaaaaactttgcgcaacacccgcaaccctatctggaacgaaaccctcgtgtatcatggcattaccgacgaagacatgcagaggaagacacttagaatctcagtttgtgacgaggataaatttggacacaacgaattcatcggtgagacgcgcttctccctgaaaaagttaaaacccaaccaaaggaaaaacttcaatatctgcttagaacgcgtgatcccaatgaagagggcaggcacaaccgggtccgccagaggtatggccctttatgaagaagagcaagtggagcgcgtcggtgacattgaggagaggggtaagatccttgtttctcttatgtactcaacacagcagggtgggctgatcgttgggataattagatgcgtgcacttggcagccatggatgccaatggttactctgacccctttgtcaaactatggctgaagccagatatgggtaagaaggccaagcacaagacacagattaaaaaaaaaacattgaatccagaattcaacgaggaattcttctatgatataaagcactccgatctggcaaaaaaatcgctcgacatatcggtctgggattatgatattggcaagtccaacgattacattggcggctgccaattgggcatatccgcaaaaggtgagaggctgaagcattggtatgagtgtttgaagaacaaagacaaaaagattgagcggtggcatcaactacaaaacgagaaccacgtgtccagcgactag

SEQ ID NO: 202376 - DNA, 39 bp, Artificial Sequence
  Description of Artificial Sequence: Synthetic coding sequence
atgaccgacaccgtgttcagcaacagcagcaaccggtag

SEQ ID NO: 202377 - DNA, 252 bp, Artificial Sequence
  Description of Artificial Sequence: Synthetic coding sequence
atgaccgacaccgtgttcagcaacagcagcaaccggtggatgtacccctcagacaggcctctgcagtctaatgacaaagagcaactgcaggctggctggtccgtccaccctgggggccagcctgataggcagcgtaaacaggaggagctgacggacgaggagaaagaaatcattaaccgcgtaatcgcaagggctgaaaagatggaagagatggagcaagagagaattggaagactcgtggaccgcttgtag

SEQ ID NO: 202378 - DNA, 285 bp, Artificial Sequence
  Description of Artificial Sequence: Synthetic coding sequence
atgaccgacaccgtgttcagcaacagcagcaaccggtggatgtacccttcagaccggcccctgcagtcaaatgacaaggagcagctccaagccggttggagtgtccatcccggagggcaacctgaccgccagcgcaagcaagaagagctgaccgacgaagaaaaggagatcatcaacagagtgattgctcgggcggaaaagatggaagaaatggagcaggaacgtataggcaggcttgttgatcgcctggagaacatgcgaaagaatgtcgccggggacggttag

SEQ ID NO: 202379 - DNA, 492 bp, Artificial Sequence
  Description of Artificial Sequence: Synthetic coding sequence
atgaccgacaccgtgttcagcaacagcagcaaccggtggatgtaccccagcgataggcctctccagagtaacgataaagagcagctccaagctggatggtcagtgcatccaggcggtcaaccagacaggcagcggaaacaggaggagttgactgacgaagaaaaagagatcatcaacagagtgattgcgcgggccgagaagatggaagagatggaacaggagagaatcggacgtctggttgatcggctggagaacatgcgaaagaacgttgctggtgacggagtgaatcgctgcatactctgtggcgagcaattaggcatgcttgggtctgcttgcgtcgtgtgtgaggattgcaagaaaaatgtgtgcactaaatgcggtgtggaaacgaacaatcgccttcatagtgtctggctgtgtaagatctgtattgaacagcgcgaggtgtggaagaggtcgggcgcctggttcttcaagggcttccctaagtag

SEQ ID NO: 202380 - DNA, 384 bp, Artificial Sequence
  Description of Artificial Sequence: Synthetic coding sequence
atgaccgacaccgtgttcagcaacagcagcaaccggtggatgtacccttccgaccggcctctacaatcaaacgacaaagaacaactgcaggctggatggtcagttcacccaggaggccagcccgaccgacagcgaaaacaggaagagctgactgacgaagagaaggagatcatcaatcgtgtgattgcacgcgctgaaaaaatggaagagatggagcaggagcgcataggccgactagtggatcgactggagaacatgaggaagaacgttgctggcgatggagtgaaccgatgcatcctgtgcggcgaacagctgggtatgctgggcagcgcctgtgtcgtatgtgaagactgcaaaaaaaacgtctgcacgaaatgtgggtag

SEQ ID NO: 202381 - DNA, 315 bp, Artificial Sequence
  Description of Artificial Sequence: Synthetic coding sequence
atgaccgacaccgtgttcagcaacagcagcaaccggtggatgtacccatccgaccggccactgcagagtaatgacaaagagcagctacaggccggctggtcagttcacccaggcggacagcctgaccgacagcggaagcaagaggaactcacagacgaggagaaggaaatcattaatcgcgtgatcgccagggctgagaaaatggaggagatggaacaagagagaatcgggcggctcgtcgatagactagaaaatatgaggaagaacgtggccggagacggcgtcaacagatgcattctgtgcggggagcaatag

SEQ ID NO: 202382 - DNA, 120 bp, Artificial Sequence
  Description of Artificial Sequence: Synthetic coding sequence
atgaccgacaccgtgttcagcaacagcagcaaccggtggatgtacccatcagatcgccccctgcagtcaaatgataaggaacagttacaggccgggtggagtgtgcaccctggcgggtag

SEQ ID NO: 202383 - DNA, 348 bp, Artificial Sequence
  Description of Artificial Sequence: Synthetic coding sequence
atgaccgacaccgtgttcagcaacagcagcaaccggtggatgtacccctcagatcggccactgcaatctaatgataaggaacagctacaggccggctggtccgtgcatccaggcggccaacctgatcgccagcgcaaacaggaggagctcaccgatgaagaaaaagaaatcataaatcgagtgatcgccagggctgagaagatggaggaaatggagcaagagcgaatcgggcgcctggtggatcggctcgaaaatatgcggaagaacgtcgcgggagatggggttaaccgctgcattctgtgtggggagcaattgggtatgctcggatctgcctgcgtggtctgttag

SEQ ID NO: 202384 - DNA, 2073 bp, Artificial Sequence
  Description of Artificial Sequence: Synthetic coding sequence
atgaccgacaccgtgttcagcaacagcagcaaccggtggatgtacccgtccgacagaccactccagtcgaaactgcaggcgggttggagtgttcatccaggcgggcagccagaccggcagcgtaaacaggaggaactcactgacgaggagaaggagattattaacagggtgattgcccgcgcagagaagatggaagaaatggagcaggaacgaattggacggttagtggatcggctggaaaatatgcgaaaaaatgttgccggagacggggtaaatcgttgtatactgtgcggcgagcaactgggtatgctcgggagcgcttgcgtggtatgtgaggactgtaagaaaaatgtgtgtacaaagtgtggcgtcgagacaaataacaggctccattctgtttggctctgtaagatttgcatcgagcagagagaggtgtggaagaggagtggagcatggttctttaagggattcccaaagcaagtgctgccacagcccatgcccatcaaaaaaacgaaaccccagcagcctgtgtcagaacctgctgccccagagcagccagctccggagccaaaacacccagcaagagcccctgccaggggggattctgaggaccgtcggggacctggacagaagacgggtcctgatccagcaagcgctcccggaagggggaattacggcccccctgtgcgtagggcttcagaggctcggatgagcagctcatcacgcgatagcgagtcttgggatcactctggcggggctggtgatagtagtcgctctcctgcggggttgcgaagagcgaactccgtacaggccagcagaccggctccaggctcagtgcagagccccgcaccacctcaaccagggcagccaggaacccccggaggcagccgccccggacccggaccagccggacgattccccgatcaaaagcctgaggtcgccccgtctgatcctgggactaccgcaccccctagggaggagagaacaggaggagtcggggggtaccccgcggttggcgcaagagaagaccgcatgagccacccttctgggccctactcgcaggcctcagccgctgccccccagcctgctgctgcacgccaaccgcctccgcccgaggaggaggaagaagaggcgaactcatatgactcagatgaggcaaccaccctgggagcactggaattttccctactctacgatcaagataattcttcactgcagtgcaccattatcaaagccaagggattgaaacccatggactccaacggtctggccgacccctatgtcaaacttcatctgctccccggtgcgagcaaatcaaataaattgcgcaccaaaacgctccggaataccagaaatccaatatggaacgaaaccctcgtctaccacggtataactgacgaagacatgcaacgtaaaactctgagaatctcagtgtgtgatgaagataagtttggccacaatgagttcattggggaaacacgcttttcccttaaaaaactcaagccgaatcagagaaagaatttcaatatttgcctagagcgcgtaattccgatgaagcgagctggcacaactggtagcgcccggggcatggccctttacgaggaggagcaggtggaaagggtgggcgatatcgaggagaggggcaaaatcttagtctcactgatgtattcaacacagcagggaggtctcatcgttggtattattaggtgcgttcatctagcggcaatggacgctaacggatatagtgatccctttgtcaaactctggttaaaacccgatatgggaaagaaggcaaaacataagacccagatcaaaaagaaaacgctgaatccggagtttaatgaagagtttttttacgacatcaagcacagcgatctggccaaaaaatcactggacatatccgtatgggactacgacatagggaaaagtaatgactatattggcggctgtcagttaggtatatccgctaaaggtgagcgcctgaaacattggtatgagtgtttgaaaaataaagacaagaagatcgagagatggcaccaactgcaaaacgagaatcacgtgagctcagactag

SEQ ID NO: 202385 - DNA, 378 bp, Artificial Sequence
  Description of Artificial Sequence: Synthetic coding sequence
atgaccgacaccgtgttcagcaacagcagcaaccggtggatgtacccctcggatagacccctacagagcaacgataaggaacagctgcaggcggggtggagtgtgcaccccggtggacagcctgatcgacagagaaaacaggaagagctcacagacgaagagaaggaaattataaatcgtgtaatcgcgagggcagaaaagatggaggagatggagcaagaacggattggcagactcgtagaccgcttggagaacatgcgcaagaatgtcgccggagacggcgttaatagatgtattctctgtggagagcagcttggaatgcttggatccgcatgtgtcgtctgtgaagattgtaagaagaatgtctgtactaagtag

SEQ ID NO: 202386 - DNA, 546 bp, Artificial Sequence
  Description of Artificial Sequence: Synthetic coding sequence
atgaccgacaccgtgttcagcaacagcagcaaccggtggatgtacccctctgatcggcctctgcagagtaacgataaggagcaacttcaggcgggctggtccgtgcatcccggcgggcagcccgatcgacagcgcaaacaggaagaactgaccgatgaggaaaaggagataattaaccgtgttattgctcgcgctgagaagatggaagagatggaacaggaacgtatcgggaggctggttgacaggctggagaacatgcgcaagaacgtcgcaggtgacggggtgaatcggtgcatcctttgtggggagcaattgggaatgttgggcagcgcatgtgttgtgtgtgaagactgcaagaagaacgtctgtactaaatgtggtgtggaaactaacaatcggctccactctgtgtggctgtgcaaaatctgtattgagcagcgggaggtttggaaaagatctggcgcatggttctttaaagggttccccaagcaggttctgccacagcctatgcccatcaagaaaaccaagcctcaacagcccgtttag

SEQ ID NO: 202387 - DNA, 285 bp, Artificial Sequence
  Description of Artificial Sequence: Synthetic coding sequence
atgaccgacaccgtgttcagcaacagcagcaaccggtggatgtacccgtccgacagaccgcttcagtcaaatgacaaagagcagttgcaggccgggtggtccgtgcatccagggggccagccggatagacagagaaagcaggaagagctgacagacgaggaaaaggagataattaacagggtcatcgcaagagcagagaaaatggaggaaatggaacaggaaaggattgggcgactggtagaccgacttgaaaatatgaggaaaaacgtggccggtgacgggtag

SEQ ID NO: 202388 - DNA, 363 bp, Artificial Sequence
  Description of Artificial Sequence: Synthetic coding sequence
atgaccgacaccgtgttcagcaacagcagcaaccggtggatgtacccatcagatagacccttgcagtctaatgacaaggagcagctacaggccgggtggtctgtgcaccctggggggcagcccgataggcaaagaaagcaggaagaactcacagatgaggaaaaagagattattaaccgggtcattgcgagagctgagaagatggaggagatggagcaggaacggattggcaggttagtggaccgactggaaaacatgagaaagaacgtggcaggagatggggtgaatcgttgtatcctgtgcggagaacaactcgggatgctgggttccgcgtgcgtggtctgcgaggattgtaagaaatag

SEQ ID NO: 202389 - DNA, 405 bp, Artificial Sequence
  Description of Artificial Sequence: Synthetic coding sequence
atgaccgacaccgtgttcagcaacagcagcaaccggtggatgtaccctagtgacagaccccttcagagcaacgacaaggaacagctacaggccggttggagtgtgcatccaggagggcaacctgaccgtcagcgaaagcaggaggagctcactgatgaggagaaagagatcataaacagagtgatagctagagcagaaaagatggaggaaatggagcaggaacgaatcggacggctggtggatcggctcgagaatatgcgaaagaacgttgcaggagacggcgtgaatcgatgtattctctgcggcgagcagttaggcatgcttggaagcgcctgtgtcgtgtgcgaggactgtaagaaaaatgtttgcacaaagtgtggcgtggaaacgaataatcgactgtag

SEQ ID NO: 202390 - DNA, 948 bp, Artificial Sequence
  Description of Artificial Sequence: Synthetic coding sequence
atggccgacaccatcttcggcagcggcaacgaccagtgggtgtgccccaatgataggcagctagccctccgggccaaactgcagactggatggtcagtgcacacctaccagactgaaaaacagagacgaaagcagcacctttcccctgcggaagtggaagccattcttcaggtgattcagagggcagaacgcctggacgtcctcgaacagcagcggatcggcaggttggtggagcggctggagaccatgcggcgcaacgttatgggcaatggactctcgcagtgtttattgtgtggtgaagttcttggcttcctgggaagcagctcagtcttctgcaaggactgtaggaagaaggtctgcaccaaatgtggaatcgaggcttcccctggccagaaacgacccctatggctgtgcaaaatctgcagtgagcaacgcgaggtatggaagagaagcggcgcctggttttacaagggcctccctaagtacatcttgccactcaaaaccccaggacgtgccgatgatcctcacttccgtccgctcccaacagagccggcggagagggaacctaggagctccgaaacttctcggatatatacatgggcaaggggaagggtcgtctcatcggatagcgattctgactccgacctttccagctcctcattggaagacagattaccgtcgaccggggtgcgcgacagaaaaggcgataagccctggaaggagagcggcggatcggtcgaggcccctagaatgggatttactcatccacccggccacctgtccggatgccagtcttccctggccagcggagagacaggcacaggctcggccgaccccccaggggggccccggccaggtttgaccaggcgagccccggtaaaggacacccccggtcgagccccagctgccgacgccgcgcccgctgggcctagctcttgtctaggctag

SEQ ID NO: 202391 - DNA, 861 bp, Artificial Sequence
  Description of Artificial Sequence: Synthetic coding sequence
atggccgacaccatcttcggcagcggcaacgaccagtgggtgtgccctaacgatcgacagttggccctcagggcgaaattgcagactgggtggagcgtgcatacctatcagactgagaagcagaggagaaagcagcatttgtctcctgcagaagtagaggcaatattgcaggtaatacagagagcagaaagactcgatgtgctagaacagcagaggatcggcagactggtcgaacgattggagacaatgcgaaggaatgtgatgggcaatggcctgtcacaatgtcttctgtgtggagaggtcttgggcttccttggctcatcaagcgttttctgcaaagattgtcgcaaagtatggaagcgtagcggggcctggttctataaaggtctccccaagtatattctgcctctgaagactcccgggagggcagatgacccccatttccgacctctgcctactgagcctgccgaacgggagcctaggagcagtgagacatccagaatctatacatgggcaagaggtagggtcgtgtccagtgacagtgactcggacagtgatttgtcgagtagctcactggaggatcggctgccaagcaccggtgtgcgggacaggaaaggggacaaaccttggaaagaaagtggcgggtctgttgaagcgcctagaatggggtttacacatccaccaggacacctttccggttgccagagctccctggcctcgggagagaccggaaccggttccgctgaccctccagggggaccaagacctggcctgacgcggcgtgcaccagtcaaagacaccccaggtagagcgccagcagccgatgcagctccagcaggaccttcttcttgccttggatag

SEQ ID NO: 202392 - DNA, 861 bp, Artificial Sequence
  Description of Artificial Sequence: Synthetic coding sequence
atggccgacaccatcttcggcagcggcaacgaccagtgggtgtgccccaatgaccggcagttggccctaagagcgaagctccagaccggctggagcgtgcacacataccagaccgaaaaacagcgccgcaagcagcacctatctccagccgaggtggaggcaatcctgcaggtaattcagcgggcagaaagactagatgtcctggagcagcagcgcattggcaggcttgtcgagaggctcgaaaccatgaggaggaacgtgatgggaaacggcctgagccagtgcctgctctgtggggaggtcctcgggtttctgggcagttcgagcgtcttctgcaaagactgtcggaaagtgtggaaacgaagcggcgcttggttttacaagggcctccccaaatatatactccctctgaagactcccggccgggccgacgaccctcacttccgccccctgcccactgagcccgccgagcgagagcccaggagtagtgaaacttcccgaatctacacttgggccagagggcgggtggtctcgtcagatagcgattcggatagcgacctgtctagttcttctttggaggaccgccttccctctaccggggtacgggatcgcaaaggggacaaaccatggaaggagtccggcggcagcgtggaggctccacggatgggcttcacacaccctcctggacatctctcgggttgccagagttcactcgcgagcggggagacggggacggggtcagccgacccacccggcggcccccgccctggactgaccagaagggctccagtgaaagatactcctggcagagccccggctgctgacgccgcgcctgcagggccctcatcttgtctcggttag

SEQ ID NO: 202393 - DNA, 2331 bp, Artificial Sequence
  Description of Artificial Sequence: Synthetic coding sequence
atgaaccccgaggagcagatcgtgacctggctgatcagcctgggcgttctcgagagccccaagaagactatttgcgatcccgaagagtttctcaagtcctctctgaaaaatggtgtcgtcctgtgcaaactgataaatcgcctgatgcctggctccgttgagaagttctgcttagaccctcagacggaggccgactgtatcaacaacataaacgattttctcaaaggttgcgccacactgcaagtagagattttcgatccagacgacctgtatagcggtgttaacttcagtaaggtgctaagtacattactcgcggtgaacaaggccaccgaggatcagctgtccgagaggccctgcggacgctcgtcttccctgagcgctgctaacactagccagaccaacccccagggagctgtgtcttccaccgtctccgggcttcagaggcagagcaagaccgttgaaatgaccgagaacggctctcaccagctcatcgtcaaagcaaggttcaacttcaagcaaactaacgaggacgagcttagcgtgtgtaagggagacatcatctatgtaacccgagtggaggaagggggctggtgggagggtacgttaaatgggaggacgggttggttcccaagcaattacgtgagagagataaagtccagcgagcgtcccctgtctcccaaggcagtcaaagggtttgagacagctccactcacaaagaactactatacagtggtgctccagaacattctggacactgaaaaggagtatgcaaaggaattacaatcattactagtgacgtacttgcggccattgcagtccaataacaatctgtcaaccgtggaagtgacctctctcctggggaatttcgaggaagtttgcacctttcagcaaacactgtgccaggcattggaagagtgctcgaaatttcccgaaaatcagcacaaagtgggcggatgtcttctgtcgctcatgcctcacttcaagtctatgtatctcgcatactgtgccaatcatccctctgctgtgaacgttctgactcagcacagcgatgagctggagcagtttatggaaaaccaaggcgcctcctcccctggcatcctgattctgaccaccaatctctcaaagccctttatgagactggagaaatacgttaccttgctccaggagttggaacgccatatggaagatacacaccccgaccatcaggatatactgaaagctatagtggcatttaagacgctaatgggtcaatgccaggacctgcggaagaggaagcagttggagctgcagattttaagcgagccaatccaagcgtgggagggtgaagatatcaaaaaccttggcaacgtgatcttcatgagtcaagtcatggtccaatacggtgcatgtgaggaaaaagaggagcggtacctgatgttatttagcaatgtgttgatcatgctgtccgccagtccaaggatgagcgggttcatttaccagggcaaaattccaatcgccggcactgttgtgacacgcttggacgaaatcgagggtaacgattgtacattcgagattaccggcaacaccgtggagcgcatcgtcgtccactgcaacaacaaccaggatttccaggagtggttagagcaactcaaccggctgatcagaggcccggctagctgctcttcgttaagtaagacaagtagcagtagctgttccgcccacagctctttctctagcaccggacaacctcggggcccactggaaccacctcaaatcatcaagccatggtccctgagctgtctgaggcctgctcccccactgaggccgtcagcagctttgggctataaggaacgcatgtcctacatcctaaaagagtcaagcaagtcccccaaaacaatgaagaaattcctccacaagagaaaaacggaacgtaagccctctgaggaagaatacgtgattaggaaaagcaccgccgccttggaggaggacgcccagatactgaaagtaatagaggcttactgtacctccgccaattttcagcagggccatgggagttcaacaaggaaagatagcatcccacaagtgcttctgccagaggaggagaagctgataattgaggagacccggtccaatggccagacgatcatggaggaaaagtccctggtagatacagtttatgctttgaaagacgaggtgagagagctgaagcaggaaaacaagagaatgaagcaatgcctggaggaagaactgaaaagtaggcgggatctggagaaactcgtacgccgcctgctaaagcaaacagatgagtgtatcaggggggagagctcctctaagacttccatcctcccctag

SEQ ID NO: 202394 - DNA, 1869 bp, Artificial Sequence
  Description of Artificial Sequence: Synthetic coding sequence
atgaccgagaacggcagccaccagctgatcgtgaaggcccggttcaattttaagcagaccaacgaagacgagctttctgtttgcaagggcgacatcatctacgtaaccagggtggaagagggaggatggtgggagggaactctcaacggcagaactggttggttcccctccaactacgtaagggagattaagagttctgaacgaccactctcccctaaagcagtgaaagggttcgagacggctcctctcactaagaactactatacagttgtcctgcagaatatacttgacactgagaaggaatacgcaaaggaacttcagtctcttctggtcacatacctgcggcccttgcagtctaataacaacctctcaacggtggaggttacctctcttcttggcaattttgaggaggtgtgcacattccagcagacactgtgtcaggcacttgaagaatgttccaaattccctgaaaatcagcacaaggtaggaggctgcttgctttcactgatgccgcatttcaaatccatgtacttagcatactgcgctaaccatccgagtgcagtaaacgtcctcacccaacattctgatgagctggagcagtttatggagaatcagggtgctagcagccccggaatcttgattctcaccacaaatctttctaagcccttcatgcgccttgagaagtacgtgactctgctgcaggagttggaaaggcatatggaggatacccatccagatcaccaggacatcctcaaggctattgtggccttcaagaccctgatgggacaatgtcaggatttacgcaagagaaaacagcttgaactgcagatcttatcagagccaatccaggcctgggaaggtgaggacattaaaaacctgggtaatgtgatcttcatgagccaagtgatggtccagtacggcgcctgcgaggaaaaggaggaaaggtacctgatgctattctcaaatgtgctcatcatgcttagtgctagccccagaatgagtggatttatataccaggggaaaattcctatcgccggaaccgtcgttacacgtctggatgagattgaagggaatgactgtacatttgagatcactgggaacacagttgaacggatcgtcgtacactgcaacaataaccaggattttcaagagtggctggaacagctcaataggcttatccgggggccagccagctgttcatctttgagtaaaacaagttcttcatcctgctctgcacacagctcctttagcagtacgggccagccacgggggccactggagccccctcaaataattaagccgtggagtttgagttgtctgcgtccggcccccccactacgcccatccgctgcgcttggatataaggaaagaatgagctatattctgaaagaatccagcaagtcccccaagactatgaagaagttcctccacaaacgtaaaacagaacggaagcctagtgaagaagaatatgttattcgaaagtcgaccgctgccctcgaggaggacgctcagattctgaaggtgatagaagcctattgcaccagtgccaatttccagcaaggccacgggagctctactaggaaggattcgataccacaagtgctcttgccagaggaggagaagctgattattgaggagacaagaagtaatgggcagaccattatggaggagaagtctttggtggacacggtctacgccctgaaggatgaagttcgggagctgaaacaagaaaataaacgaatgaaacaatgcctggaagaagagctcaagagtcgcagggatttggaaaaactggttcgaagattacttaagcagaccgacgagtgcatacggggcgagtcgtcctcgaagacatccatcttaccttag

SEQ ID NO: 202395 - DNA, 1869 bp, Artificial Sequence
  Description of Artificial Sequence: Synthetic coding sequence
atgaccgagaacggcagccaccagctgatcgtgaaggcccggttcaatttcaaacaaacaaatgaagatgaactgagcgtatgcaaaggggacattatttatgtgacaagggtcgaggaaggtgggtggtgggaagggaccctaaatgggagaacagggtggtttcccagcaactatgtgagagaaatcaaaagctccgagagaccgctgagtccaaaggccgtaaaaggttttgaaactgcaccactgacaaagaactattacaccgttgttttgcagaatatcttagatactgagaaggaatacgccaaggagttacagtctctccttgtgacctatctgaggcccctacaatccaataataacctgtcaacagttgaagtcacctccttattgggtaatttcgaggaggtgtgcacctttcaacagaccctgtgtcaggctcttgaggaatgctcaaagttccctgaaaaccagcacaaggttggaggctgtctgctctccctgatgcctcacttcaagagcatgtacttggcttattgcgcaaaccacccaagcgccgtgaatgtgctcacccagcattctgacgagctcgaacaatttatggaaaaccagggggcgagctcacccggaattctaatactgactacaaatctgtccaagccgttcatgagactggagaagtatgtgacactgctacaggaacttgaaagacacatggaggatacccaccctgaccatcaggatatcttaaaggctattgttgcctttaaaaccctgatgggacaatgccaggacctccgtaagcgcaaacagcttgagctgcaaatcctgagcgaacccattcaagcatgggaaggcgaagacataaagaacttaggcaatgtcattttcatgagtcaggttatggttcaatatggggcttgtgaagagaaggaggagcgctacttgatgctcttctccaacgtcctgatcatgctctctgcctcaccccgcatgagtgggtttatttaccaggggaagatcccgatagccggaaccgtcgtgacccggttggatgaaattgagggtaacgactgtacctttgagatcactggcaatacagtggaacgcatcgtagtgcactgtaataacaaccaagatttccaggagtggttggaacagcttaaccgactgattcgtggccctgctagttgtagctccctgtcaaaaacgagctcttcctcctgctcggctcattccagcttctcatcaaccggacagcccaggggacctctcgaaccgccacagatcattaagccctggagtctcagctgcttaaggccggccccacccctccgaccttccgccgctttaggctacaaggagcgcatgagctacatcctcaaagaaagcagcaagagcccaaagactatgaagaaatttcttcataagaggaagacagagagaaaaccctctgaagaggagtatgtcatcagaaaatctacggcagctttggaagaggacgcccaaattctaaaggtcatagaggcctactgcacatctgctaatttccaacagggacacggatcctccacacgcaaggattctattccacaggtgctgctgcccgaggaggaaaaattgattatcgaggaaaccagatcaaacggacaaaccattatggaagagaagagcctggtcgataccgtgtatgcccttaaagatgaagtgcgggagcttaaacaggaaaataagcgcatgaaacagtgcctggaagaagaactgaagtcacgaagggatctggaaaaactcgtaaggagactcctaaagcaaactgacgaatgtatccgtggtgagtcatcctcaaagacctctatcttaccctag

SEQ ID NO: 202396 - DNA, 1950 bp, Artificial Sequence
  Description of Artificial Sequence: Synthetic coding sequence
atgaccgagaacggcagccaccagctgatcgtgaaggcccggttcaacttcaaacagaccaatgaagacgagttgagcgtctgtaaaggcgatattatttatgtgacacgggttgaggaaggaggctggtgggaagggaccctgaatggcagaacggggtggttcccgagtaattatgtgcgggagataaagtccagcgacggagtgtcgttgctccttcctgggctggaatgcaatggggcaatctcagctcaccataacttgtgtctccctgggagcaagcgcccgctctctccgaaggccgtaaaaggattcgaaacagccccactcacaaagaattattataccgtggttctgcagaatatcttagacaccgaaaaggaatatgcaaaggaactgcagtctctccttgtgacgtacctgcgccccctgcagtccaataataatctatccactgtagaagttacgtcactgttaggtaatttcgaagaggtgtgcacttttcaacaaactctgtgtcaggcactggaggaatgctcaaaattcccagagaaccagcacaaagtgggcggttgcttgctttccctgatgcctcattttaagagcatgtatctcgcctattgcgctaaccatccgtcagccgtcaacgtcttgactcagcacagcgacgaattagagcaattcatggagaatcaaggggcatccagtccaggcatactgatcctcacaactaacctttcaaaaccttttatgcgcctagaaaaatacgtgacgctacttcaggaattggaaagacacatggaagacacccacccagatcaccaggatatcctgaaagccatagtggcattcaaaacgttgatggggcagtgtcaggatttacgcaagcgaaagcagttagagctgcagatcctttcagagcctattcaggcctgggaaggcgaggacatcaaaaatcttgggaatgtgatatttatgtcgcaagtaatggttcagtacggcgcgtgcgaagagaaggaagaacgctacctgatgctcttctctaatgtccttattatgctgtccgcatctcctagaatgtctggatttatctatcagggcaagatcccgattgctggtactgtagtgacacgacttgacgaaatcgaaggtaatgactgtacctttgagataactggcaacacggtggagcgcatcgtagtgcattgcaacaataatcaggacttccaggagtggctggagcaattaaacagactgatcagaggccctgcgtcatgctcctcactgagcaaaactagctctagcagctgtagcgctcacagttcgttcagcagcacaggacagccacgcggtcctctggaacccccacagatcatcaaaccttggtcgttatcttgtctgaggcccgcacccccattgagaccgagcgcagccctaggatataaggaacggatgtcatatatcctgaaggagagttctaaaagcccgaaaactatgaaaaaatttttacacaaacggaaaactgaacgtaagccctccgaagaagagtatgtgataaggaaaagtacagctgcacttgaggaagatgcccaaatcctgaaggtgatcgaggcctactgtacgtccgctaactttcaacaggggcacggtagctccacgcggaaagattctattccgcaggtgctactgcccgaggaagagaaattgattatcgaggaaacccgctctaatgggcaaacaattatggaggagaaatcactagttgataccgtgtacgcccttaaagacgaggttcgtgagctcaaacaagaaaataaacgcatgaagcaatgcctggaggaagagctgaaaagcaggagagacctggaaaaactggttcggagactgctcaaacaaaccgatgagtgtatacggggtgagagttctagcaagacctccatccttccctag

SEQ ID NO: 202397 - DNA, 1869 bp, Artificial Sequence
  Description of Artificial Sequence: Synthetic coding sequence
atgaccgagaacggcagccaccagctgatcgtgaaggcccggttcaacttcaaacagactaacgaggatgagctatcagtgtgtaaaggagatatcatttatgtcacccgagtggaagaagggggttggtgggaagggaccttgaacggaagaactgggtggttcccctctaactatgttcgcgagatcaagtcttccgagcgtccactctcccctaaggccgtgaaaggctttgagactgcccctcttacaaagaactactatactgtggtgctgcagaatattctggacacggagaaagaatacgccaaggagctccaatccctacttgtgacttacctcagacctcttcagtcaaacaataacctgtctaccgtggaggtgacgtccctactgggaaacttcgaggaagtttgtacctttcagcagacgttgtgccaggccctggaggagtgcagtaagtttcccgagaatcagcacaaggtcggggggtgtttgctgagtctgatgccccactttaaaagcatgtacctggcatattgtgccaatcatcctagcgcggtaaatgtcctaacccagcattccgatgaactcgagcagttcatggaaaatcagggtgcctcttctccggggattctcatccttactaccaaccttagcaagccgtttatgaggttggaaaagtatgtgaccctgttgcaggaactagaacgacatatggaggatacccacccagatcatcaagatattctcaaggctatcgttgccttcaaaaccctgatgggtcagtgccaggacttaaggaagaggaaacagctggaattgcaaatccttagcgagccaattcaggcatgggagggtgaggacatcaaaaacctgggaaacgtaatctttatgtctcaggtaatggtccagtacggagcctgtgaagaaaaggaggagcgatatttaatgctcttctctaacgttctcatcatgctttccgcgagtccccgcatgagtggatttatttaccagggaaagatccccattgccggcaccgtggtgacacgcctggatgagatcgagggtaacgactgcacatttgaaataacaggaaacaccgtggaaagaatagttgtgcattgcaacaataaccaggattttcaggagtggctcgagcaactcaaccgattaatacgcggtccggcctcttgtagctccctttccaaaacctctagctcaagctgctcagcccattcttccttctcttctacaggacagccacgaggccccctggagccaccccagatcatcaaaccatggagcctcagctgtctccgacctgcccctcctctacgccccagcgctgctctaggttataaagaagcttttacctttgtatttgaggagagctctaagtcgccaaagaccatgaaaaagttcctgcataagcggaaaactgaaaggaagccctctgaagaagagtacgtgattcgtaagtctactgctgcgctagaggaagatgctcagatcttgaaggtcatcgaggcctactgtacatctgcaaacttccaacagggccacggcagcagcacaagaaaggattctattcctcaagtgcttttgcccgaggaagagaaattaatcatcgaggagaccaggagtaacggacagacaatcatggaagagaagagcctcgtcgacacagtatatgccttaaaggatgaagtgagggagctgaaacaagaaaataagcgtatgaaacaatgcctggaagaagagctaaaaagccggcgtgatctggagaaactggttcgcaggcttctcaagcagactgacgaatgtataaggggagagtcctccagcaaaacctccattctcccatag

SEQ ID NO: 202398 - DNA, 1896 bp, Artificial Sequence
  Description of Artificial Sequence: Synthetic coding sequence
atgttctacgcccacttcgtgctgagcaagcggggccccctggccaaaatttggctcgcagctcactgggataagaagctgacgaaggcacatgtgtttgagtgtaacctcgaatcctcagttgaatccattattagtccaaaggtaaagatggccctacggacaagcggacatctgctgctgggcgtcgtgcggatctaccatcgcaaggcaaaatacttgctggctgactgtaatgaggccttcataaagattaagatggctttccgtccaggagttgtggatctcccggaggaaaaccgagaggcagcgtacaatgccattacactgccagaggagttccacgatttcgaccagcctctcccagacctggacgacattgacgtggcgcaacagttctcactgaaccaatcccgcgtagaagaaatcactatgagagaagaagtcgggaatataagtattcttcaggagaacgacttcggagattttggcatggatgatcgcgagatcatgagagaaggatcagccttcgaagacgatgacatgctcgtgagcacgacaacctcaaacctgctgttggaatcagagcagtccacctctaatctgaacgagaaaatcaaccacctggagtacgaagaccaatataaagacgataacttcggagaaggcaatgatggaggaatcctggatgataagctcatctctaataacgacgggggaatcttcgacgatccccccgctttaagcgaagccggcgttatgctacccgagcagcccgcacacgacgatatggacgaggatgataacgtcagcatgggtggcccggattcgccagattcagtggatccagttgagcccatgcccacgatgacggatcaaacaacgttagtgcctaacgaagaagaggcattcgccttggaaccaatcgatatcaccgtgaaagaaacgaaggcgaaacggaaaagaaagctgattgtagacagcgtgaaagaactagatagcaaaacaatccgcgcacaattatcagattactctgacattgtcactaccctggacctggcgccaccaaccaagaagctaatgatgtggaaagagactggcggtgtggagaagctcttctcgctccccgcacagcctctgtggaacaacagactcctgaagttatttacaaggtgcctgacgcccctggtgcctgaagacttacgcaaaagaagaaagggcggtgaggccgacaacctggacgagtttctcaaggaattcgaaaatccggaagtgccgcgcgaggatcagcagcagcagcaccagcagcgcgatgttatagacgaaccaattatcgaggaaccaagccgcctgcaggagagcgtgatggaggcaagcaggacgaatatcgacgagagcgctatgccaccaccaccgccacagggcgtcaagaggaaagccgggcaaattgaccctgaaccagtgatgccacctcagcaggttgaacaaatggagatccctcccgtggaactcccaccggaggagcctcctaatatatgccagctgatccccgaactggaactcttgcccgagaaggagaaagagaaggagaaagagaaggaggacgacgaagaggaggaagacgaagatgcatcaggcggcgaccaggaccaggaagaacggaggtggaacaagcggacacaacagatgttgcacgggctccagcgagctcttgccaagaccggggctgaatccattagcctgttagagctctgtaggaatacaaatcgtaaacaggcagcagccaaattttacagtttccttgtgttgaagaagcagcaggctatcgagctcactcaggaagaaccctattccgacatcattgccactccaggtccccgattccacattatttag

SEQ ID NO: 202399 - DNA, 501 bp, Artificial Sequence
  Description of Artificial Sequence: Synthetic coding sequence
atggcccccaagaaggccaagaagcgggccggcggcgccaacagcaacgtgttctccatgttcgagcagactcagatacaagagtttaaagaggcctttactattatggaccagaatagggacggctttattgacaagaacgacctgcgggacacctttgctgccttagggagagtgaatgttaaaaatgaggagattgacgagatgattaaggaggcgcctggtcccataaactttacagtgtttctcacaatgtttggcgagaaactgaaaggggccgaccctgaggagacgattctcaacgcatttaaggtgtttgaccctgaaggcaagggcgtgttgaaagcagactacgtaagggaaatgctgacaacccaggctgaaagattctcaaaagaagaagtggaccagatgttcgccgcctttcctcctgatgtcacaggaaacctggattataaaaatctcgtccacattattactcacggagaagaaaaagactag

SEQ ID NO: 202400 - DNA, 909 bp, Artificial Sequence
  Description of Artificial Sequence: Synthetic coding sequence
atggtgcggcccgtgcggcacaagaagcccgtgaactacagccagttcgaccacagcgactccgatgatgactttgtgagcgccaccgtacctctgaacaaaaagagccgcactgcccccaaagaactgaaacaggacaaacccaagccgaacttgaacaacctcagaaaggaagagattccggtacaggaaaagacacctaagaagcggctcccggagggcacgttctctattcccgcttcagctgtgccgtgcacaaaaatggcacttgacgataaactgtatcaaagagatctcgaggtggctctggcgctcagcgttaaagagctcccgaccgtgacaactaatgtccagaatagccaagacaaatccattgaaaagcatggttcttctaaaatcgagaccatgaacaaaagcccccacatctcaaactgcagcgtagcctctgattatctcgatctcgacaaaatcacagtcgaagatgatgtcgggggggtgcagggaaagaggaaagcggcatccaaagccgctgcccagcagcgcaagatcttgctggaaggctctgacggtgatagcgctaatgatactgagcccgactttgcaccgggcgaagactccgaagatgactccgatttttgcgagagtgaggataatgacgaagacttcagcatgcgtaaaagcaaggttaaagagataaaaaaaaaagaggtgaaggtcaagagtcctgtggaaaagaaagagaaaaagagcaaatcaaaatgcaacgcgctggccgccagcggcggcagtcggtcctctagttctcccttggtggtagtgtcggtcaaaagtccaaaccagtctcttcgcctgggtctgagcaggctagcacgtgtgaagccactccatcctaatgccacatcaacttag

SEQ ID NO: 202401 - DNA, 1008 bp, Artificial Sequence
  Description of Artificial Sequence: Synthetic coding sequence
atggtgcggcccgtgcggcacaagaagcccgtgaactacagccagtttgatcactccgacagcgacgatgatttcgtatcagctacggtgccgctgaataagaaatcccgcacagcccccaaagagctgaaacaggacaaaccaaagcccaatctcaacaaccttaggaaggaggagatacctgtccaggaaaagacccccaagaaaagaatggcactggatgataagctctaccaacgtgatctggaggtcgcattggcactttctgttaaggagttgcctaccgtgacaaccaatgtacagaactcccaggataaaagtatagagaaacacggatcgtccaaaatcgagactatgaataaatctcctcatatatctaactgtagtgtggccagcgactatctggacttagacaaaattactgttgaggacgatgtgggcggagtgcagggcaaacgcaaagctgcaagcaaggcggccgcccaacagcggaaaattctcctcgaaggctcagacggtgattcagccaatgacaccgagcccgactttgctcccggagaggacagcgaggatgactctgatttctgcgagtccgaggacaatgacgaagacttctctatgcggaaaagcaaagtgaaagagattaagaagaaagaggtgaaggtgaagtcgccggtggagaagaaagagaagaagtcaaaatccaaatgtaacgcactggtgacctcagtagattctgctccggcagccgtgaagtcggagtcccagagtctccccaaaaaggtgtccctgtctagtgataccacgcggaagcctctggagattcggtccccatcagctgaaagtaagaagccaaagtgggtgccacccgctgcatcggggggctccagaagtagctcatcgcccctggtcgttgtgtctgtgaaatcccccaatcagagtctgaggttggggcttagtagactggcccgcgtaaagccgcttcatcctaatgcaacctctacctag

SEQ ID NO: 202402 - DNA, 702 bp, Artificial Sequence
  Description of Artificial Sequence: Synthetic coding sequence
atgaacaagagcccccacatcagcaactgcagcgtggccagcgactacttagacctggacaagatcaccgtggaagatgatgtcggtggcgttcaagggaagagaaaggcggcttctaaggccgccgcacagcagcgaaagatcctcttagagggaagcgacggcgactctgccaacgacaccgagcccgattttgcacccggggaggactcagaggatgacagcgatttctgcgagagtgaagataatgatgaggacttcagcatgcgcaaaagcaaggtaaaagaaattaagaaaaaggaagtcaaggtgaaaagccccgtcgaaaaaaaggagaagaagagcaaaagcaaatgtaacgctctggtcactagcgtcgatagcgcaccagcagccgtgaagagcgaatcccagagtctccctaagaaggtgtccctctcctcagacactacgcgcaaacctttagagattcgcagccctagtgccgaatccaaaaaacctaaatgggtccccccaggaatggcctatttgtcctccagaacgggtgcatggaagattataaccgcagccagcggcggctcaagatctagttcatctcctctagttgtcgtgtccgtgaagtctcccaatcagagcctgcgtctaggcctttccaggctggcccgagttaagccgttacacccgaacgctacttctacttag

SEQ ID NO: 202403 - DNA, 408 bp, Artificial Sequence
  Description of Artificial Sequence: Synthetic coding sequence
atgcggggcaagaccttccggttcgagatgcagcgggacctggtgtctttccctttgtcacccgcagtgagggttaaattagtgtctgcagggttccagaccgctgaggagctcttggaagtgaaaccaagcgagttgagtaaggaagtcggtatttccaaggctgaggcacttgagacccttcagatcatacggagagaatgcttgaccaataagcccaggtacgccggaactagcgagtctcacaagaagtgtactgctctggagctgctcgaacaagagcatactcagggcttcattattacattttgcagcgctctcgatgatatactcggcggtggcgtgcccctcatgaaaaccacggaaatatgtggcgccccaggtgtgggcaaaacccagttatggtag

SEQ ID NO: 202404 - DNA, 855 bp, Artificial Sequence
  Description of Artificial Sequence: Synthetic coding sequence
atggccgagctggtgcccttcgccgtgcccatcgagagcgacaagactctcttggtctgggagttgtcaagcgggccgaccgccgaagctctccaccattccctgttcactgctttctcccaatttggactgctttacagtgtccgagtgttccctaatgctgcagttgcccatccgggcttctatgcagttataaagttctactccgcccgcgcggcgcatagggctcagaaggcctgtgataggaagcaactattccagaagagtccagtcaaagttagactgggtacccggcataaagccgtccagcaccaggccctggccctcaactcgagtaaatgccaggaactcgccaattattacttcggttttaacggatgctcgaagagaattatcaaactccaggaactatcagacttggaagaacgtgaaaacgaagacagtatggtgcctctgccaaagcaatccctcaagttcttctgcgccctggaagtggttctccccagttgcgattgtcgcagcccaggaattggactggtagaggaacccatggataaggtggaagagggccccctctccttcctcatgaagcggaaaacggcacaaaagctggcaattcaaaaggccctctccgacgccttccagaagcttctcatcgtggtgctggagtcaggcaagattgcagtggaatacaggcccagtgaagatatcgtaggggtccggtgcgaggaagagctgcacggattaatacaagtgccctgttctccctggaagcagtatggacaggaggaagaaggatatctttctgatttctccctcgaggaggaggagtttagactgccggaactcgactag

SEQ ID NO: 202405 - DNA, 351 bp, Artificial Sequence
  Description of Artificial Sequence: Synthetic coding sequence
atgcacctgctggtgccccccccccagcacagcctgttcaccgccttcagccagttcgggttactgtactccgtgagagtgtttccaaatgccgcagtggcccatccaggcttttatgccgtcataaagttttattcagcgcgtgcagcccacagagctcagaaggcttgcgatagaaaacagctgtttcagaaatcccctgtcaaagtgcggctgggaacacgacacaaggccgttcaacatcaggccttggcacttaattcatctaagtgccaggagctggccaattactattttggatttaatggctgcagcaagagaataatcaaggaccactatcacagcctctag

SEQ ID NO: 202406 - DNA, 711 bp, Artificial Sequence
  Description of Artificial Sequence: Synthetic coding sequence
atggccgagctggtgcccttcgccgtgcccatcgagagcgacaagactctcctggtgtgggaactctctagcggaccaaccgctgaggcactgcatcactctctgttcacagcgttttcacaattcggcctgctatattccgtgcgggtatttcctaacgccgcagtggcgcacccaggcttctatgccgtgatcaaattttacagtgcacgggccgcccatcgggcacagaaggcttgtgatcggaagcagctgttccagaagtctcctgtgaaagtgcgtctgggaactcgtcacaaagccgtgcaacaccaagccctggcactgaactcatccaagtgtcaggaattggcgaactactattttgggtttaacgggtgtagtaagcgtatcattaaacttcaagagttgagtgatctggaagaacgagaaaacgaggactctatggtgccccttccaaaacagagtttgaagtttttctgtgcattggaagtggtgctgccttcttgtgactgcagatcccctggaattggcttagtagaggaaccaatggacaaagtcgaagaagggcccttgagtttcctgatgaaaaggaaaaccgcacagaaactggccatccagaaggcgctgagtgacgcctttcaaaagttgctgatagtagttctaggaaagaccgtgctgattattcttgaggttctgcagttccagtag

SEQ ID NO: 202407 - DNA, 786 bp, Artificial Sequence
  Description of Artificial Sequence: Synthetic coding sequence
atgcacctgctggtgccccccccccagcacagcctgttcaccgccttctcccagttcggactgctgtatagtgtacgagtgtttcccaacgctgcggtggcacaccccggtttctacgccgtcataaaattctactctgcccgggctgctcacagggcacagaaagcatgtgaccgcaaacagctgttccagaagagtccagtgaaggtccgactgggaacgcgtcacaaagccgtgcagcaccaggcactcgcactgaactcttccaagtgccaggaactcgctaattattattttggctttaatgggtgcagcaagaggatcatcaaactgcaggagctcagcgaccttgaggaacgagagaatgaggactctatggtgcccctgcctaagcagagtcttaaattcttttgcgcactggaggtggtgctgcccagttgcgattgcagatcacctggaataggattggttgaagagcctatggataaagtggaagaaggccctctctccttcctgatgaagcggaagaccgcccaaaagctggcaatccagaaggctctgtcagatgcctttcagaagctccttatcgtcgtgttagaatctggcaagatcgctgtggaataccgtccttccgaagatatcgtgggggtgcggtgcgaagaggaattgcacgggttaattcaggtcccttgtagcccatggaagcagtacggccaggaggaggagggttacctgtccgacttcagcctggaggaagaggaattccggctgcccgaactcgattag

SEQ ID NO: 202408 - DNA, 393 bp, Artificial Sequence
  Description of Artificial Sequence: Synthetic coding sequence
ttcggcttcaacggctgcagcaagcggatcatcaagctgcaggagctgagcgatcttgaggagcgtgaaaacgaagacagtatggtgcctctcccgaagcagtccctcaagttcttttgcgcactggaagtggtcctaccttcctgcgattgtaggtctcccgggatcggcttggttgaggagcctatggacaaagtcgaagaggagtcaggcaaaatcgccgtggagtatcggcccagcgaagatattgtgggcgtaagatgcgaagaagaattacatggcctgatccaggtcccttgttccccctggaagcagtacggacaggaagaagaaggctatctgagtgacttttctttggaggaggaggaattccgcctgcccgagctggactag

SEQ ID NO: 202409 - DNA, 501 bp, Artificial Sequence
  Description of Artificial Sequence: Synthetic coding sequence
atggccgagctggtgcccttcgccgtgcccatcgagagcgacaagaccctcctggtgtgggagctttccagcggccccactgccgaggcactgcatcattcactgttcacagcgttctcccagtttggcctactgtactccgtgcgggtttttcctaacgcggccgtcgcccatcccggattctatgcggttatcaagttctatagcgcacgagcagcgcaccgggctcagaaggcctgcgatcgaaagcagttgttccagaagtcgcctgttaaagttaggctgggcacccgccacaaggcggtgcagcatcaggcactggccttaaattctagtaagtgccaagaattggccaattattacttcgggtttaacgggtgctccaagagaattattaaagtgccatgcagtccgtggaagcagtacggtcaggaggaggaagggtatctttctgatttcagcttggaggaggaagaattccgactgccagagctggattag

SEQ ID NO: 202410 - DNA, 642 bp, Artificial Sequence
  Description of Artificial Sequence: Synthetic coding sequence
atgcacctgctggtgccccccccccagcacagcctgttcaccgcctttagccagttcggcttactgtacagtgtgagggtcttccctaacgccgccgtggcccaccccggattctacgctgttattaaattctattcagcacgtgccgctcacagggctcaaaaagcttgtgaccggaaacaactgtttcaaaaaagccccgtaaaagttagactcggtacacgacataaggccgttcagcatcaggcactggccctgaatagctctaagtgtcaggagcttgccaactattactttggcttcaatggatgttctaagcgaataattaagttgcaggaattgtcggacctggaagaaagagagaatgaagattccatggtgcctctgcctaaacagagcctgaaatttttctgcgccttagaagtggtactgccatcttgcgactgcaggagccccggcatcggcttggtagaagagcctatggacaaagtagaggagggcccactctctttcctgatgaaaagaaaaactgcccaaaaattagcaatccaaaaggccctgtccgacgccttccagaaacttctaatcgtggtcctggggaaaacagtgctgattattctggaggtactgcaattccagtag

SEQ ID NO: 202411 - DNA, 756 bp, Artificial Sequence
  Description of Artificial Sequence: Synthetic coding sequence
atggccgagctggtgcccttcgccgtgcccatcgagagcgacaagacccttctggtttgggagctcagttcaggccctacagcagaggccctgcatcactctttatttaccgcattctcccagttcgggctgctgtacagtgtgagagtattccccaacgctgccgtggcccatcctggcttctacgctgtgattaaattctactccgccagagccgcacacagggcccagaaagcctgcgatcggaagcagttatttcaaaaaagccccgtgaaggtacgactgggcaccaggcataaagctgtgcagcatcaggctctcgcccttaactcctcaaagtgtcaagagctggctaactactactttgggtttaatggctgctctaaaaggatcataaagcttcaggagctgagcgaccttgaggaaagggaaaacgaggatagtatggtgcccctgccgaagcaatctctgaagtttttctgtgccctggaagtggttctaccttcttgcgactgcagaagccctggtatcggtcttgtcgaagagcccatggataaggtggaggaagaatccgggaagatcgccgtggagtaccgaccaagcgaggacatagtgggtgtccgatgcgaagaagagctgcatggcctcatccaagtgccgtgttctccctggaagcagtacggacaggaggaggaaggatatttgagtgacttttctctggaagaagaagagttccggctgccagaactggactag

SEQ ID NO: 202412 - DNA, 420 bp, Artificial Sequence
  Description of Artificial Sequence: Synthetic coding sequence
atggccgagctggtgcccttcgccgtgcccatcgagagcgacaagacactgctggtctgggagctgtccagcggaccgaccgcagaagctctccatcatagtttatttacagcattttctcaatttggacttctgtatagcgtgagagtttttcctaacgctgcagtagcccatcctgggttttatgccgttattaagttctacagcgcccgcgctgcgcatcgcgcccaaaaagcttgcgacagaaagcagctgtttcagaagagtcccgtgaaagttcggctgggcacaaggcataaggccgtccaacaccaggccctggcattgaacagcagtaaatgccaggagctagcaaattattattttgggtttaacggctgttcgaaaagaatcattaaagatcactatcacagcctctag

SEQ ID NO: 202413 - DNA, 432 bp, Artificial Sequence
  Description of Artificial Sequence: Synthetic coding sequence
atgcacctgctggtgccccccccccagcacagcctgttcaccgcctttagtcagtttggcctcctgtactctgtgagagtgttccccaatgcagccgtggctcatcccgggttctatgcggtgatcaagttttactccgcgagggcggctcatcgggcgcaaaaagcatgcgaccggaagcagctgttccagaagagcccagtaaaagtgcgtctgggcacacgtcacaaggcagtgcaacatcaagccctcgctctgaactcctcaaagtgccaggagcttgcgaattattacttcgggttcaatggatgcagtaaaaggattattaaggtgccctgttctccctggaagcaatacggacaggaggaagaaggctatctttctgatttcagtcttgaggaagaggagtttcgccttccggaactcgactag

SEQ ID NO: 202414 - DNA, 2733 bp, Artificial Sequence
  Description of Artificial Sequence: Synthetic coding sequence
atgcggcggagcgccgcccccagccagctgcagggcaacagcttcaaaaagcctaagtttatccctccgggccgaagcaaccctggcttgaatgaagagatcaccaaacttaatcctgacattaaactgttcgaaggcgtggcaataaacaatacctttctgccctcccagaatgacctgaggatttgctctctgaacctgcccagtgaagaaagtactcgtgagattaataatcgtgataactgcagcggaaaatactgtttcgaagccccgacccttgccacactggaccccccccacacagtgcattctgcgccaaaggaggtagcagtcagcaaggagcaggaggaaaagtccgattccctcgtaaaatatttctcagtggtctggtgcaaaccttcgaaaaagaagcataaaaaatgggagggagatgctgttctgattgtaaagggaaagtcattcattctgaagaatttggagggcaaagacattggaaggggaattggctacaaattcaaggaactcgaaaaaatcgaggaaggccagacactaatgatctgtggcaaggagatcgaggtaatgggtgtgatttcacccgatgatttctcatctgggcggtgttttcagctgggagggggcagcaccgccatcagtcattcaagccaggtagctcgcaaatgtttctcaaaccctttcaagtcggtttgcaaaccttctagcaaagaaaaccgccaaaatgacttccagaattgcaagccccggcacgatccttatactccaaactcgctcgtgatgccccggcctgacaaaaaccaccagtgggtttttaataagaactgcttccctctggtcgacgtggtgatcgatccctatctcgtttatcatttaaggccccaccaaaaggagggaataatcttcctttatgaatgcgtgatgggaatgcggatgaatgggagatgcggggccatcttagctgatgagatgggattaggcaagacgctgcagtgcatctctttgatatggacactgcaatgccaaggaccatatggcggcaagcctgtcattaaaaagaccttgattgtgacgcctggctccctagtcaacaattggaagaaggaattccaaaagtggcttggctcggagagaataaagatatttacggttgatcaggatcacaaagtggaggagttcatcaaatctatcttttattctgtgcttatcatctcctatgagatgctgttgcggtcactcgatcagatcaagaacataaagtttgatcttctgatatgtgacgaaggtcaccggcttaaaaacagcgctataaaaactacgacagcgttaatctccctgagttgtgagaagcgtattattctgaccgggaccccaattcagaacgacctgcaggaattttttgccttaattgactttgtgaatcccggcatactggggtcgctgtcttcgtaccgtaagatctacgaggagcctattatcctcagccgtgagccgtccgctagtgaagaagaaaaggagctcggcgaacgaagggctgccgaactcacttgtctgaccgggctgttcatactaagacgcacacaggaaatcattaataaatacctgccccctaagattgagaacgtagtcttttgcaggccaggcgcactacagatcgagctgtacagaaagctgctcaattcacaggtggttagattttgcctccaggggttgctggagaattctcctcacctgatttgcataggagcccttaaaaaattatgtaatcatccatgcctcctgtttaacagtatcaaagagaaggagtgttcttcaacttgcgataaaaacgaggagaagagtctgtataagggtcttttgtcagtgttcccggcggactacaaccctctgctgttcaccgaaaaagaatccggtaagctccaagtactgtctaagctgttggcggttatacatgaactgcgccctacagaaaaggtggtcctcgtctcaaactacactcagactctgaatatcctgcaggaggtttgtaagcgccacggctatgcctacacaaggctcgatggacaaactcctatcagccagcgccagcagattgtggatggttttaactcacagcatagttccttttttatcttcctgttgagctctaaggctggcggagtaggcctgaatcttatcgggggaagccacttaattctgtacgatatcgattggaatcccgctaccgacatccaggccatgagtcgggtttggcgcgacggacagaagtacccagtgcatatttatcgattgctaacaactggcaccattgaggagaagatttatcagagacagattagcaaacaaggactgtgcggtgcggtcgttgatctgaccaaaacttccgaacacatccagttctcagtggaggagctgaagaatttgtttactttacacgagtcgtcggattgcgtcacccacgatctcttggattgtgaatgtacgggagaagaagtgcataccggggacagcttggaaaagtttattgtgtctagagactgccagctcggaccccatcaccagaagtcaaacagtcttaagccgttgagcatgtcccagctgaagcaatggaaacacttctccggtgatcacctgaaccttaccgatccgtttctagagcgcatcacagagaacgtctctttcatattccagaacatcactacacaggcgaccgggacgtag

SEQ ID NO: 202415 - DNA, 900 bp, Artificial Sequence
  Description of Artificial Sequence: Synthetic coding sequence
atggtgggcaaggcccggagcagcaacttcaccctgagcgagaagctggatctgctcaaattggtcaaaccatacgtgaagatcctcgaggagcacacaaataagcacagcgtgatcgtcgaaaaaaatcgctgctgggacattatcgctgtgaattacaatgctataggggtggatcggccccccagaacagctcaagggctacggacgctatacaagaggctcaaagagtacgccaagcaagaactgctgcagcagaaagagacccagtctgatttcaaaagtaacatcagtgaaccaactaagaaggtgatggagatgattccacagataagctctttctgcctggtgagggacaggaaccacatccagagcgctaatctggatgaggaggcacaggcgggtaccagctcgctccaagtaatgctggaccatcatcccgtcgcgatcaccgtagaggtgaagcaggaagaagacataaagcctcccccccctctggttctcaacagccagcagtccgacaccctggaacagcgtgaggaacacgagctcgtacatgtcatggaaagatcccttagcccatcacttagctcagttgacatgagaatgactagcagcccgagtagcattccgaggagagatgacttctttcgtcatgagtctggagagcacttccggagcctgctgggctatgatcctcagattctgcagatgctcaaagaagaacaccagataatcctggagaaccagaagaatttcggtctatatgtgcaggaaaagcgcgacggactgaagcggagacagcaattagaagaggaactgctgagggcaaaaattgaagtggagaagttgaaggctataagacttaggcacgatctgccggaatacaattcattgtag

SEQ ID NO: 202416 - DNA, 378 bp, Artificial Sequence
  Description of Artificial Sequence: Synthetic coding sequence
atgcggcggagcgccgcccccagccagctgcagggcaacagcttcaagaaaccgaaatttatacctccagggcgctcaaatcccggactcaacgaagagatcaccaagctgaatcccgacattaagctctttgagggggtggccatcaataatacattcttgccttcccagaacgatttgcggatctgctccttaaatctgccctctgaggaaagcacgcgggaaatcaataaccgtgataattgcagtggaaaatattgcttcgaagccccaacactcgccactctggaccccccacatacagtgcactctgcccccaaggaggtggctgtgtctaaggaacaagaggagaagtcagacagcttagtcaagtattag

SEQ ID NO: 202417 - DNA, 354 bp, Artificial Sequence
  Description of Artificial Sequence: Synthetic coding sequence
atgcggcggagcgccgcccccagccagctgcagggcaacagcttcaagaaaccaaagttcataccccctggcaggtcaaatcccggtcttaatgaagagataacaaagttgaatcctgatattaagctctttgaaggagtcgccattaataacacttttctcccatcacagaatgatctgagaatctgtagccttaacctgccatccgaagagagcacacgggagattaataacagagacaactgctcggggaagtactgtttcgaggctccaacgttggctactttggatccacctcacacagtacagacctggatgcgccgtcacaggctggtccctgtccactatcgctag

SEQ ID NO: 202418 - DNA, 477 bp, Artificial Sequence
  Description of Artificial Sequence: Synthetic coding sequence
atgctggaccaccaccccgtggccatcaccgtggaggtgaagcaggaagaggatatcaagccaccaccccccttggtgcttaacagccagcagagtgacacactggaacaacgagaggagcatgaactggtgcacgtgatggaacggagtctaagcccaagtttgtcaagcgtggatatgcggatgacatcatcccctagttccattccccgccgcgacgatttcttccgacatgagtccggggagcacttccgcagcctgcttggctacgatccccagatcctgcagatgttgaaggaagaacaccagattattttagaaaaccaaaagaacttcggcttatatgtgcaggagaaacgagacggactcaagcgtcgacaacagctggaagaggaactgttaagagccaaaattgaggtggagaaattaaaagctattcgcctcaggcatgatctcccagaatataactccctatag

SEQ ID NO: 202419 - DNA, 1749 bp, Artificial Sequence
  Description of Artificial Sequence: Synthetic coding sequence
atgggcctgggcaagaccctgcagtgcatcagcctgatctggaccctgcagtgtcagggaccctacggggggaaaccagtcatcaagaagacccttatcgtgacacccggttcgttagtcaacaattggaagaaggagtttcaaaagtggctggggtcggaacgaataaagatcttcacagtagatcaggatcacaaagtggaggaattcattaaatcaatcttctatagtgttctgattatttcatacgaaatgctgcttcgcagcctggatcagatcaagaatataaagttcgatttgttgatctgcgatgaaggccatcgattgaagaatagcgccatcaaaaccacaacagcacttatctcactatcatgcgagaagcggatcatccttaccggaacccctatccagaacgacctgcaggaattcttcgccctcatcgactttgtaaatcctggcatcctcggcagtctgtcttcctataggaagatttacgaagagcctattatattgagcagagagccatcagcttctgaagaagaaaaagagcttggggagagggagcaactgaatctgctggcctccctggatagcctcctgcggcggacccaagagattatcaacaagtatctgcctccaaagattgaaaacgtcgtgttttgtaggcccggcgcactgcagattgaattgtataggaaactcttaaatagtcaagtggtgagattctgtctgcaaggattgctcgagaactctccccacctgatctgtatcggtgcacttaaaaaattgtgtaatcacccttgtcttctattcaatagcataaaagagaaggagtgcagtagtacttgcgacaaaaatgaagagaagagcctgtataaaggccttctgtctgtctttccagcagattacaatccactgttgttcaccgaaaaagagagcggaaaactacaggtgctgtctaagctcctcgccgttattcacgagctgaggcccaccgagaaagtggttcttgtatccaattatacacagacgctgaacatcctgcaggaggtgtgcaagaggcatggctacgcttacacaaggctggacgggcagacccccatcagtcagagacagcagatcgtcgatggattcaacagccagcactcctctttttttatcttcctgctgagctcaaaagctgggggtgtgggactgaaccttattggcggatcgcatttaatcctgtatgacatcgattggaatcctgctacagacattcaagccatgtccagggtttggcgcgatggacagaagtatcctgtgcatatttataggctgctgaccacaggcacgatcgaggagaaaatataccagagacaaatttccaaacagggcctgtgtggagccgtggtggatctcacaaaaacaagtgaacacatccagttcagcgtcgaagagctgaagaatctgttcacacttcacgagtcgagcgattgcgtcacgcacgaccttctggattgcgagtgtactggcgaggaggtgcataccggggattctctcgaaaagtttattgttagccgggattgtcagctgggcccccatcatcaaaaatctaacagccttaagcctctaagcatgtcgcagctgaaacagtggaagcatttctctggggatcatttgaacctgaccgacccctttctggaaaggattacggaaaacgtgtccttcatcttccaaaacatcacaactcaggccacaggcacatag

SEQ ID NO: 202420 - DNA, 1290 bp, Artificial Sequence
  Description of Artificial Sequence: Synthetic coding sequence
atggccgccatgctgaagtgcgtgatgagcggcagccaggtgaaggtttttggaaaagctgtgcaggctctgagtcgcatctccgatgagttctggctcgaccccagcaagaagggtcttgcattgaggtgcgtcaactccagccgatccgcctatggatgcgtgttattctcacccgtcttctttcagcactatcagtggtctgctctcgtgaagatgtctgagaatgaacttgatacaaccctccacttgaagtgcaagcttggcatgaagtctatcctgccgatctttcgatgcttgaattccctcgagaggaacattgagaagtgtagaatctttacaagatcagacaaatgcaaggtggtgatccagtttttctataggcacgggatcaagaggacacataatatctgtttccaggagagtcagcccctgcaggtaatctttgacaaaaacgtttgtacgaacactttgatgatccagccgcgactcttggcagatgccatcgtcttgttcacatcctcccaagaggaggttactttggccgttactcccctgaatttttgcctgaaatccagtaatgaagagtctatggacttgtccaatgccgttcattccgagatgttcgtgggaagcgacgagttcgattttttccagattggaatggacaccgagatcactttttgcttcaaggaactgaaaggcatactgacgttctctgaagccactcacgctccaatcagcatttattttgactttccaggaaagcccttggcactttctatcgatgatatgttggtcgaggcaaactttatccttgccaccttggcagacgagcagtcacgtgcgtcctcgccacaatccctctgcctgtcacagaagcgcaagcgatcagacctgattgagaaaaaagctggtaagaatgttactggtcaagcccttgaatgtatttccaagaaggctgcaccgcggaggctgtacccaaaggagaccctgaccaacatttccgccctagagaactgtggaagtcccgctatgaaaagagtggacggcgatgtctccgaagtctcagaaagctccgtctccaacacggaagaggtgccgggtagcctgtgccttcggaagttcagctgtatgtttttcggagctgtgtcgagcgaccagcaggagcacttcaatcacccattcgactctctggcaagggctagcgactctgaggaggatatgaataacgtctgttgcaggaaggaatttaacggaagtgacgcaaagtatttctgcataatctag

SEQ ID NO: 202421 - DNA, 1038 bp, Artificial Sequence
  Description of Artificial Sequence: Synthetic coding sequence
atgagcgagaacgagctggacaccaccctgcacctgaagtgcaagctaggtatgaaatcaatcttgccgatctttcgatgccttaattcacttgaaaggaacattgaaaagtgcagaatattcacaagatccgataagtgcaaagtggtcatccaattcttttacaggcacggcattaagaggacacacaatatctgttttcaggagagtcagccactgcaggtcatcttcgacaagaatgtttgcactaatacgctgatgatccagccaaggctcctcgccgacgccatcgtactttttacatcttcccaggaggaagtaactcttgccgtcactccgctgaatttttgccttaagagttcaaatgaagaaagcatggatttaagcaatgccgtgcacagcgagatgtttgtcggcagcgacgagtttgacttcttccagataggcatggatacagaaatcacgttttgcttcaaggagctgaagggaatactaacgttcagcgaagcgacgcacgccccaatcagcatctactttgattttcccgggaagcctctagctctctccattgacgacatgcttgtcgaggctaactttatcctggcaaccttagcggacgagcagagccgcgctagcagtccacagtccttgtgcctgagccagaaacgcaagaggtctgatctaatcgagaagaaggccggcaagaatgtcaccgggcaggccctggaatgtataagtaaaaaggccgccccacggaggctttacccaaaagagacattgaccaatatatctgccctggaaaattgcggcagtcctgcaatgaaacgcgtggatggtgatgtctctgaggtttctgagtcttcagtcagcaacacagaggaagttcccggatcgttgtgtctccgtaagttctcttgtatgttctttggggcagtgagcagcgaccagcaagaacactttaaccacccttttgattctctcgcaagagccagcgacagcgaagaagatatgaataacggatccttttccatcttttag

SEQ ID NO: 202422 - DNA, 1038 bp, Artificial Sequence
  Description of Artificial Sequence: Synthetic coding sequence
atgagcgagaacgagctggacaccaccctgcacctgaagtgcaagctggggatgaagagcatcctgccgattttcaggtgtttaaactccctggaaaggaacatcgagaagtgccgtatatttacaaggtctgataagtgcaaggtcgtgatccagtttttctacaggcatggaataaagcgaactcataatatttgtttccaagaatcccagcctctgcaggtgatattcgataaaaacgtatgcacaaatactctgatgattcagccgagactgctggctgatgctatcgttctctttacctcgtcccaggaagaggttacattggctgtgactccactgaatttttgcttgaaatccagtaacgaagaaagcatggacctgtcaaacgccgttcactcagagatgttcgtcggttctgatgagttcgacttcttccagatcggcatggacactgagatcactttctgctttaaggagctgaagggaattctgaccttttccgaagcaactcacgcacccattagcatctattttgatttccccggtaagccgctcgccctctccatagatgacatgcttgtcgaagcgaatttcatcctggccacactggcagatgagcagtcccgcgcttcctcaccacaatccttatgcctctcacagaagcgcaagcgatccgacttgatcgagaaaaaagccgggaaaaatgtgaccggccaggccctggaatgcatatctaagaaagccgctccaagaaggctttatcctaaggagactttgaccaatatctctgcactcgaaaattgcggaagtcccgccatgaaacgagtagatggcgacgtcagcgaagtgagcgagtcctcagtgtccaatactgaagaggttcccggctccctttgcctgagaaaatttagttgtatgttttttggggccgtgagtagcgaccagcaggagcacttcaatcatccttttgatagccttgcacgggcttctgactccgaagaggacatgaataatggctcattcagcatattttag

SEQ ID NO: 202423 - DNA, 1449 bp, Artificial Sequence
  Description of Artificial Sequence: Synthetic coding sequence
atgggctgcgtgcagtgcaaggacaaggaggccaccaagctgaccgaggagcgtgacggttctttaaatcaatccagcggctataggtacgggaccgaccccactccccagcactatcccagctttggcgtcacatctatcccgaattacaacaattttcacgcagccgggggccagggcctgacagtgttcgggggggttaactcgagttcccacaccggaaccctaagaactcgagggggcactggcgtgacccttttcgtcgccttatatgactacgaggcacggaccgaggatgatttaagctttcataaaggtgagaaatttcaaatcctgaactcgtcggaaggggattggtgggaggccaggagcctcacaaccggtgaaacggggtatatccccagcaattacgttgcccctgtcgactccatccaggctgaagagtggtactttggcaagctcgggcgcaaggacgccgaaaggcagttgttgtcttttggtaacccacgcggaacattcctgattagagagtcagaaacgacaaaaggagcatacagcctgtccatccgtgattgggatgacatgaaaggtgaccatgtgaagcattacaagatcagaaagctggacaacggcggctattatattacaaccagggcccagtttgaaacgctgcagcaactggtgcaacattactccggcacatggaatggaaacacaaaagtggctatcaaaaccttgaaacccggcacgatgagccctgagtcctttcttgaagaagctcaaatcatgaaaaaacttaaacacgacaaactggtccagctgtatgctgtcgtttcggaagaacctatctatatcgtgacggaatatatgaacaagggatccctgctcgatttcttgaaggatggagaagggcgcgccctcaagctgccaaatctcgtggacatggctgcacaggttgccgccggaatggcgtacatcgagcgtatgaactacatacaccgcgatctgcggagtgcaaatatactagttgggaatggactaatttgtaaaattgccgatttcggactggcccggctgatagaagacaacgaatacacagccagacaaggagccaaatttccgatcaaatggacagcacctgaggcggcactctacggcagattcactattaaatctgatgtgtggagcttcgggattttgttgactgaactggttaccaaaggacgggtgccctaccccggaatgaataatcgcgaggtcttagagcaggtggagagaggatatcggatgccttgtcctcaggactgtcctatctcccttcatgaactgatgattcactgctggaaaaaagatccagaggagagacccaccttcgagtacctgcagtcattcctggaggattactttactgccacggaaccccaataccaaccaggggaaaacctgtag

SEQ ID NO: 202424 - DNA, 1410 bp, Artificial Sequence
  Description of Artificial Sequence: Synthetic coding sequence
atggaggacagcaccagccccaagcaggagaaggagaaccaggaggagttgggggagacacggcgcccttgggaggggaaaactgccgcttccccacagtattctgagcccgaaagtagtgagcccttggaagctaaacagggaccagagactgggagacaatccagaagttcccgaccctggagcccccagagcagagccaaaacccccctcggcgggcccgcaggaccggagacctcttcccccgcaccagtgagtccaagggagcctagttcatctcccagccccctggcccccgcgcgccaggacctcgcagcacccccccaaagcgacagaactacctctgtcattccggaagccggcactccctaccctgatccactggaacagtcctcagacaaaagggagtccacaccccaccatacctctcagagcgaggggaacacgtttcagcagtctcaacagcctaaacctcacctgtgtgggcggcgggatgtaagctacaacaatgccaagcagaaggagcttcgctttgacgtatttcaagaggaggactcaaacagtgactatgacctccagcagccagctccaggtggatccgaggtggccccatctatgctggaaatcaccatccagaacgctaaagcttacctgctcaaaacctcctcaaactctggcttcaatctgtatgatcacctgtccaatatgctgactaagatactgaacgagcgacccgagaacgcggtggacatcttcgagaatattagtcaggacgtaaaaatggctcatttttcaaaaaaatttgatgccctacagaacgaaaacgagctcctaccaacttacgagatagcggagaagcagaaagcattgtttctgcaggggcatctcgaaggagttgaccaggagcttgaagatgaaattggtaggtgcaattggttcaattcgatccagaagaacgaggaggaagaggaagaggaggacgaggagaaggatgattctgactatatcgaacaggaggtcggcttacccctgctgactccaatctccgaggatctggaaattcagaatatcccaccatggacaacaaggctgtctagcaacctcattccccagtacgctatcgctgtgctacagtcgaacctgtggcccggtgcttacgcctttagtaatggtaagaagttcgagaatttctacatcggatggggtcacaagtacagccccgacaattacaccccacccgtgccgccgccagtctaccaagagtatccaagcggaccagagattacggaaatggatgatccatcagtggaggaggaacaagccttccgtgccgcccaggaggccgttctcttagcagctgagaatgaagagtccgaagaggatgaggatgaggaagacgattacgattag

SEQ ID NO: 202425 - DNA, 1803 bp, Artificial Sequence
  Description of Artificial Sequence: Synthetic coding sequence
atggaggacagcaccagccccaagcaggagaaggagaaccaggaggagctgggcgagacccgccgcccctgggagggtaaaacggccgcctcaccccagtatagcgaacccgagagcagtgagccgcttgaggcaaagcaagggcccgaaacaggtcgccagtcccgaagttccaggccatggagcccccagtcccgagccaagactccactgggtggacccgcggggcccgagacaagttctcccgctcctgtttctcctagggagccttcttcatcgccttcacctcttgctcctgccagacaagacttggctgctcctccccagagtgaccgaacaacgtcagtaataccagaggcgggtacgccatatccagatcctttagagcagagttctgacaaaagagagagtaccccacatcacacaagccagtccgaaggaaatacctttcagcaatcacagcaacccaagccacacctttgcggcaggcgtgatgtgagctataacaacgctaaacaaaaggaactccggttcgatgtgtttcaggaggaagatagcaactccgactacgacctgcaacagccggccccaggtggaagcgaggtggctccatcaatgctggaaatcacaatccaaaatgccaaagcttacctgctcaagacaagtagcaacagtggattcaacctgtacgatcatctgtccaacatgctgacaaaaatccttaatgaacgccccgagaatgctgtggacattttcgagaatatctcgcaggacgtcaaaatggctcatttctctaagaagttcgacgcccttcagaatgagaacgaattactcccgacttatgaaatcgcagagaagcagaaggcactctttcttcagggccatttagagggggtcgaccaagaactcgaagacgaaatcgcggagaacgcactccctaacgtgatggaatcagctttctacttcgagcaagcgggcgtcggcctgggtactgacgagacctatcggatctttctggcactgaaacaactcacagatacccacccaatacagcgttgccgattctggggcaaaatcttgggtctggaaatgaactatatagttgcagaagtggaatttagagagggggaagatgaggaggaagttgaggaagaagatgtggccgaagaacgagataacggcgaatccgaagcccacgaggacgaggaagacgagttaccaaaatccttttacaaggcaccccaggccatcccaaaggaggagtcacgaactggggccaataaatacgtgtatttcgtgtgtaacgaacccggacggccctgggtgaagctgccacctgtgatccctgcccagatcgtgattgcaagaaagataaaaaagttctttaccggcaggctcgacgcacccatcattagttatcctcccttccccgggaacgagtccaattacctgcgggcccaaatcgctcggatttctgcaggcactcacgtatccccattgggtttctaccagtttggggaggaagaaggagaagaagaggaagaggccgaagggggtcgcaactcctttgaggagaaccctgacttcgaagggatccaggtgattgacctggttgagagcctgtccaactgggtccaccacgtacagcacatcctatctcagcggttccgtatatacccacctgggcagcacggctatcctcagatctcattccataacatgctgttgcagagttttaatcctacatttggcctcgagcatatgcctagtccaatggctaagagccttaagattagcacttag

SEQ ID NO: 202426 - DNA, 1536 bp, Artificial Sequence
  Description of Artificial Sequence: Synthetic coding sequence
atgctggagatcaccatccagaacgccaaggcctacctgctgaagaccagctccaactccggattcaacctgtacgatcacttgtccaacatgttgacgaagatactcaacgagcggcctgaaaacgccgtggatatatttgagaacatttcccaggacgtgaaaatggctcactttagcaagaaatttgacgctttgcagaatgagaatgagctcctcccaacatacgaaatcgctgaaaaacaaaaggccttgtttctccagggtcatctcgaaggagtggaccaggagctggaggacgagattgccgagaatgcacttcccaatgtaatggagtcagctttttacttcgagcaggctggggtcgggctggggaccgatgagacctatcgcatattcctcgcgctgaaacaactcaccgacactcacccaatccagaggtgcaggttctggggtaaaatattaggacttgagatgaattacattgtcgcggaggtagaattccgcgagggagaggatgaagaagaggtcgaagaggaggatgtcgctgaagaacgcgacaacggggagtcagaggctcatgaagacgaggaagatgagcttccaaaatcgttctataaggctccccaggctataccgaaggaagagtcaaggactggcgcaaataaatatgtgtacttcgtttgcaacgaacccggtcggccatgggtgaagctcccgccagtgatcccggctcagatcgttatagctcggaagattaagaaatttttcacaggacggttggacgcccctattattagctatccacccttcccaggaaacgaaagcaattacctgagggcgcaaattgccaggatcagcgctggcactcatgtgtcgcccttaggcttctaccagttcggagaagaggagggcgaggaagaagaagaggccgaaggtgggaggaacagctttgaggagaaccctgatttcgagggaattcaggtgatagacctggtagagtcactaagcaattgggtacaccacgtacagcatatcctgagccagggccgctgcaactggttcaattctatccagaaaaacgaggaggaggaagaagaggaggatgaggaaaaagacgatagtgactatatcgagcaggaagtaggcctgcctctgctcacgcccatttcagaagacctggaaattcaaaatatccctccttggaccactaggctgagttcaaacctcatacctcagtacgcgattgccgttcttcagagcaacctatggcccggggcctatgccttctctaacgggaaaaagtttgagaatttctatattggctggggccacaaatacagtcctgataactacacaccacctgtacctcctcccgtgtaccaggagtacccatccggacccgaaatcacagagatggacgacccttctgttgaagaggagcaggcctttagagccgctcaggaggctgttttattagccgccgaaaatgaagagtctgaggaggatgaggatgaggaggatgattacgattag

SEQ ID NO: 202427 - DNA, 531 bp, Artificial Sequence
  Description of Artificial Sequence: Synthetic coding sequence
atgctggtgaagcgggactaccggtacgaccgggtgctgttctgggggcgtatcctcgggttagtggccgattactatatagcacaaggactgtctgaggaccagttggcacctagaaaaacattatactctttgaattgcacagagtggtccctacttcctcctgccacagaagagatggtcgcacagagctccgtcgttaagggcagatttatgggtgatccaagctacgagtatgaacacactgagctgcagaaggtgaatgagggcgagaaagtgtttgaagaagagatcgttgttcagattaaggaggagacaaggctagtatccgttatcgaccaaattgataaggctgtcgcgatcatccctagaggagctctgtttaaaactccttttggtcctacgcatgtcaaccggacattcgagggctactataactggtacaaaacccccgctccacacccgacctgtgatgggaatcaaggggtccgggctcggggaagaagcccatccctcggcagattcctatag

SEQ ID NO: 202428 - DNA, 831 bp, Artificial Sequence
  Description of Artificial Sequence: Synthetic coding sequence
atggacgccgacagcctgctgctgagcctggagctggccagcggcagcgggcagggtttgagccctgacagaagagcatcccttctgacaagcctcatgctggtgaagagagactacagatacgaccgggtgttgttctggggccgcattttgggcctggtggccgactattacattgcccaggggctgagcgaggaccagctggcaccccgcaaaacgctctacagcctgaattgcacagagtggtcgctcctgcctccagcaacggaagaaatggtggctcaatcatccgtcgtgaaaggaaggtttatgggcgatccatcctacgagtatgaacatactgaattacagaaggtcaacgagggggagaaggtgttcgaagaagaaatagttgttcaaattaaagaggaaactaggttggtctctgtgattgaccagatcgacaaggctgtagctataattcctaggggagctttgtttaaaacaccatttggcccaactcacgtgaacaggacctttgaaggactcagcctgagcgaggctaagaaactaagcagctactttcatttccgtgagcccgtggagctcaaaaataagactctcctagaaaaagcagacctggatccttctcttgactttatggattctctggaacatgacatacctaaggggagctggagcatccagatggagcggggcaatgctctggtggtgcttagaagtttactttggcccggactaaccttctatcacgcccctcggacaaaaaactacgggtatgtgtacgtgggtaccggcgaaaaaaacatggatttgccctttatgctgtag

SEQ ID NO: 202429 - DNA, 921 bp, Artificial Sequence
  Description of Artificial Sequence: Synthetic coding sequence
atggacgccgacagcctgctgctgagcctggagctggccagcggctcggggcaggggctgtccccggacagaagggcctccctactaaccagtctgatgctggtcaaacgtgactatcgctacgaccgcgtcttgttctgggggcgcattctgggcctcgttgccgactactacattgctcagggattatccgaggaccagttggccccacgcaaaacactgtatagcctgaactgtactgaatggtcactgctaccccccgctacggaggaaatggtggcccaatccagcgtggttaagggacgctttatgggggatccctcttatgagtatgaacatacggaactgcagaaggtgaacgagggggagaaggtctttgaggaggagatcgtaatcgataaggcggttgccattattcccaggggcgccctgtttaagacaccatttggccccacccacgtcaacagaaccttcgaggggctgtcactgtccgaagccaaaaagctctcatcctacttccacttccgagagcccgttgaactaaaaaataagacactgctggagaaagctgatctcgacccatcactcgacttcatggactcgctggagcatgatatacctaagggctccgaagctgttgtacaaggcgatttcacttggctgctaagtcgctgcgggtttggatggccttgcagttgggactcatgctcagtatcaatgagggtgctcgaacatccggatggggaaggacaatgccctggcggggccgcccagccggccctggccggccctcatctgctaccctgcagcccacaccaggagttatggctgcggctgcgtggacactggcgagaggaacacgggctggcactccatgccattgagtgggaaccggcttggatgttcctgaatcgtgtctag

SEQ ID NO: 202430 - DNA, 402 bp, Artificial Sequence
  Description of Artificial Sequence: Synthetic coding sequence
tgactgaactgcaccgagtggagcctgctgccccccgccaccgaggagatggtagcccagtccagcgtggttaagggacgcttcatgggggacccctcctatgaatacgagcatacggaactccagaaagttaatgagggagaaaaggtgttcgaagaggagatagtagtccagatcaaagaggaaacccggttggtgagcgtgattgaccagattgataaagctgtggctatcatcccccggggtgccctctttaaaacaccatttggtcccacgcatgtcaacaggaccttcgaaggatattacaattggtacaagacacctgcccctcacccaacttgcgacgggaaccagggggtaagagcacgcggcaggtccccttcattggggcggttcctatag

SEQ ID NO: 202431 - DNA, 1086 bp, Artificial Sequence
  Description of Artificial Sequence: Synthetic coding sequence
atgtgggtgctgacccccgccgccttcgccggcaagctgctgagcgtgttccgccagccattgtcgtctttatggaggtcacttgtccccctattttgttggcttagggcaactttttggctgctggcaacgaagcgaagaaaacagcagctggttctgcgcggacctgatgagacaaaggaggaggaggaagacccccccctacccacaaccccaacatctgtgaactatcatttcacgcggcagtgtaactataagtgtggcttttgttttcacacagccaagactagcttcgtgctgccactcgaagaagctaagagaggtttgctgctcctgaaagaagctggtatggaaaagatcaacttcagtggcggcgaacctttcctacaggacaggggcgagtatctgggaaaactagtgcgattctgtaaagtggagctccgattgcctagcgtctctatcgtcagcaatgggtcactcatccgcgagcgatggttccagaactacggtgaataccttgacatactggcgattagctgcgattctttcgatgaggaggttaacgtgctcattggacgaggtcaaggaaagaagaatcacgtggaaaacctgcagaaactgcgccgttggtgtagagattaccgcgtggccttcaaaatcaatagcgtgatcaatcgcttcaacgtagaagaggatatgacggagcaaataaaagcactgaatcctgtccgctggaaggtttttcagtgcttgctgattgagggagagaactgcggagaggacgcactgcgagaggctgaaagattcgtaatcggagacgaagagttcgagagattcctggagagacacaaggaagtgtcttgcttagtgcctgagtccaatcagaaaatgaaggacagttacctaattctcgacgagtacatgcgctttctgaactgtagaaagggtcgaaaagatccatcaaagagcatactagacgtcggggtagaagaggctatcaagttctcaggattcgacgagaagatgttcctgaaacgtggaggcaagtacatttggtctaaggccgacctgaaactggactggtag

SEQ ID NO: 202432 - DNA, 765 bp, Artificial Sequence
  Description of Artificial Sequence: Synthetic coding sequence
atgctgcacagcagccactaccccggcatggagaagatcaacttctctggtggagaaccctttctgcaagacaggggggaatatctgggtaagctggtacggttctgcaaagttgagttaagactccccagtgttagcatcgtatcaaacgggtccctgatcagagaaaggtggttccagaactacggggaatatctggatatcttggccatttcgtgtgacagctttgacgaagaggtcaatgttcttattggccgcggacagggcaagaaaaatcacgtggaaaatctgcagaagcttcgcagatggtgtagagactatcgagtggcctttaaaattaactcagtgatcaatagattcaacgtagaagaggatatgacagagcagattaaggccctgaatcccgtcagatggaaagttttccaatgtttgctgatagaaggagaaaactgcggcgaagacgccctgagagaggcagagagattcgtgattggggatgaggagtttgaacgatttttagagagacacaaggaagttagctgtctggtgcctgaatcaaatcagaaaatgaaggattcctatctgattctggacgagtacatgcgcttcctaaactgtagaaagggacgcaaggacccatctaaatcaatccttgatgtgggagtggaggaggccatcaaattctccgggttcgacgagaagatgttcctgaagcgggggggcaagtatatttggagcaaggctgacctaaagctggattggtag

SEQ ID NO: 202433 - DNA, 1674 bp, Artificial Sequence
  Description of Artificial Sequence: Synthetic coding sequence
atgtacaagcggaacggcctgatggccagcgtgctggtgaccagcgctaccccgcagggtagtagttctagtgattcattggaaggacagagttgcgattatgcgtctaaatcctatgacgcagtggtgtttgacgtcttaaaagtcacccccgaggagtttgcatcgcagatcaccctcatggatattcccgtgtttaaagctattcaacctgaggaactggcatcatgtggttggtctaagaaggagaagcactctctggctccgaacgtagtagcctttacacggcgatttaatcaggtgagcttctgggtggttcgggaaatcctcacagcccagacattgaagatacgggccgaaatcctcagccactttgttaagattgctaaaaagctcctagaactgaataacctgcattctctcatgtctgttgtgtctgcgctgcagagtgcccccatcttccgcttgactaagacatgggctctgctgaataggaaagataaaacaacgtttgaaaagcttgactacctgatgtcaaaggaagacaattacaaacgcacccgggaatatattagatccctcaaaatggtcccctccattccttacctgggaatatacttgctcgatctcatctacattgattcagcctaccccgctagtggcagcattatggaaaatgaacagcgtagtaatcagatgaacaacatcctccgaattattgcagatctgcaggttagttgctcctacgaccatctaactaccctcccccacgtgcaaaagtacctcaaatcagtgcggtacatcgaagaactgcagaagttcgtcgaagacgacaattacaaactttctctgcgcatcgagcccggttcctcctcccctcgtctggttagctccaaggaggatctggccggcccatctgctgggtctggttcagctcgattcagtaggcgacctacgtgccctgacaccagcgtggcgggaagcttgccaactcctccagtccctagacatcgcaagtctcactccctcggtaacaacatgatgtgtcaactctccgtggtggaaagtaagtcagcaactttcccctcagagaaagccaggcatctcctcgatgactccgtgctcgagagccgctccccgcggcgagggctcgctctcacttcttcctccgctgttaccaatggactctctcttggatcgagcgagagtagcgagttcagcgaagagatgagctctgggctggaatccccaacagggccctgtatttgctctctgggtaattctgccgcagtccctactatggagggaccacttcggaggaagaccctgctcaaagagggccgaaagcccgccctgtcgtcgtggactcggtactgggtgatactctccggaagcaccctgctgtattacggagctaaaagtttgcgggggactgaccgaaaacattataaatcaacacccggaaaaaaggtttctatcgtgggctggatggttcagctgcccgacgatcctgaacatccggacatattccagctcaataatcccgacaagggcaacgtctataagtttcagacagggtcaagatttcatgcaatcctctggcacaaacaccttgacgatgcctgcaagtccaataggcctcaggtacctgctaatttaatgtcattcgaatag

SEQ ID NO: 202434 - DNA, 522 bp, Artificial Sequence
  Description of Artificial Sequence: Synthetic coding sequence
atgtacaagcggaacggcctgatggccagcgtgctggtgaccagcgccacccctcagggcagctcctcaagcgactccttggaggggcagtcgtgcgactatgcatcaaaatcatatgacgcggtggtctttgatgtcctgaaggtgactcccgaagagttcgccagccaaattaccctgatggatattcctgtgttcaaagccatacagccagaagagctggctagctgcggatggtcaaagaaagaaaagcatagtctcgctccaaacgtggtagcattcacaagacgttttaaccagaaactgcttgagttgaataacctgcactctctgatgtctgtggtgtcagccctgcagagcgctcctatttttaggctgaccaagacctgggccctcctgaaccgtaaggataagactacgttcgagaagttggactacctgatgagcaaggaggacaattacaagagaaccagggagtatatccgctcccttaaaatggtaccaagcattccctacctgtag

SEQ ID NO: 202435 - DNA, 1590 bp, Artificial Sequence
  Description of Artificial Sequence: Synthetic coding sequence
atgtacaagcggaacggcctgatggccagcgtgctggtgaccagcgccacgccgcagggctcaagcagctcagattctcttgaagggcagagctgcgattacgcctcaaagtcctatgacgccgtggtgtttgatgtgctaaaggtgacaccagaagaattcgcatctcagattactctcatggatattccggtgttcaaagcaatacagccagaggaactcgcgagctgcggctggtcaaaaaaggaaaagcattctcttgcccctaacgtggtagcctttactaggcgcttcaatcaagtctctttttgggtggtccgcgagattcttaccgctcaaacactgaaaattagggcagagatcctttcccacttcgttaagatcgctaagaaactccttgaacttaacaatttacactccttgatgtccgttgtgtctgctttgcagtcagcacccatttttcggctgaccaagacctgggcattgctgaatcgaaaggacaaaacgaccttcgaaaaattggactacttgatgagtaaggaagataattataagcggacccgtgagtatataagatccctaaagatggtaccctcaatcccgtacctgggaatctatctcctggatctcatctatattgacagtgcataccctgctagcgggagtataatggaaaacgagcagagaagcaatcagatgaataatatcctccgcattatcgctgacctgcaggtcagctgttcctacgaccacctgacgacattacctcatgttcagaagtaccttaagtcagtccgttatatcgaggaactccagaagtttgttgaggacgacaattacaagctgtctctcaggatcgaacccgggtccagctccccaaggctggtctcttcgaaggaggacctcgctggcccatcagccggcagcggttcagccagattttcacgacggcccacatgcccagacacatcggtcgccggatcgttgccgactccgcctgtaccaaggcaccggaagagtcattcgttaggcaacaaccgaggccgcctctacgcaacgttggggccgaattggcgcgttcctgtccgaaacagccctaggacacgatcatgtgtgtactcccctaccgggccctgcatttgttctttgggcaatagtgccgctgtgccaactatggagggcccactgcgccgtaagactcttctcaaggagggccgaaagcccgcactgtcaagttggacgcgctactgggtgatcctgagtggttcaaccctgctgtactacggtgctaagtcattgcgcgggactgaccggaaacacgtcagcatagtgggatggatggtgcagttgcctgacgacccggagcaccctgatatcttccaacttaacaatcccgataagggcaacgtgtacaagttccaaactggatcaagattccacgctatactgtggcacaagcacctggacgatgcatgtaagagcaatcgtccgcaggaggctggcgctgcccccgggccaactggtactgatagtcatgaggtggatcatctggagggcggagctgggaaagaggccgggccatgcgcctag

SEQ ID NO: 202436 - DNA, 918 bp, Artificial Sequence
  Description of Artificial Sequence: Synthetic coding sequence
atgtacaagcggaacggcctgatggccagcgtgctggtgaccagcgccactccccagggatcatcgagtagcgactctttggaaggacaatcatgcgactatgctagcaaatcttacgatgcagtcgtgttcgatgtcctcaaggtgaccccggaggagtttgcttcccagatcaccctcatggacatcccagtgtttaaggccatccagccggaggaactggccagttgcggttggtccaagaaagagaagcattctctggcaccaaatgtagtagccttcacaagaagattcaaccaggtttccttttgggttgtgcgggagatcctgacggcgcaaacgttgaagattcgggctgagatcctctcacatttcgttaaaatagccaaaaaactgttagaactgaacaacctccactccctaatgagcgtggtgagcgctctccagagtgcgccaatttttagattaacaaagacgtgggctctgctaaatcggaaggacaagacaacattcgagaagcttgattacctgatgagtaaggaagacaattataagcgtactcgggagtatattagatccctgaagatggtgccgagcatcccctacttgggcatataccttttggaccttatatatattgattcggcgtaccctgctagtggctcgatcatggagaatgagcagcgaagtaaccagatgaataatatcctccgtattatcgcagacctgcaggtgtcgtgctcttatgaccatttgaccactctaccacacgttcagaagtacctgaaatctgtgcgttatatcgaggaactacagaagttcgtagaagacgacaattacaagctcagcctacgcatcgagccaggctcaagcagtcctcggttggtgtcttcaaaggaggatttggccgcaatgtag

SEQ ID NO: 202437 - DNA, 642 bp, Artificial Sequence
  Description of Artificial Sequence: Synthetic coding sequence
atgtacaagcggaacggcctgatggccagcgtgctggtgaccagcgccaccccccaggggtcatcaagttcagactccctggagggacagagttgcgactatgcaagcaagtcatatgatgcggtcgtgttcgacgttctaaaagtgaccccggaagagttcgcgtcacagatcacattaatggacatccctgtgttcaaagccattcagcccgaagagctagcttcctgtggatggtccaaaaaggagaagcattcactcgctcccaacgtcgtggcattcacgcgaagatttaatcaggtgtccttctgggttgtcagggagattctcaccgctcaaactctgaaaattcgagccgagattctatcacacttcgtcaaaatcgccaagaagctcctagagcttaataatttgcactcattgatgagtgtggtgtcagcgctgcagtctgccccaattttccgcctcaccaagacatgggcgctgctcaatcgtaaagataagacgacgtttgaaaagctcgactacctcatgagcaaggaggacaattataaaagaactcgggaatacatacgctccctcaagatggttccctccatcccttaccttggtcggagcctcaactggctgatctttttctag

SEQ ID NO: 202438 - DNA, 327 bp, Artificial Sequence
  Description of Artificial Sequence: Synthetic coding sequence
atgtacaagcggaacggcctgatggccagcgtgctggtgaccagcgctacaccccaaggaagttcttcaagcgactcgcttgaaggccagagttgcgattatgcctcaaagagctacgatgcggtagttttcgacgtcctgaaggtcaccccagaagagtttgcctcccagatcacccttatggatatccccgtcttcaaggccatccagccagagaagggctggcccgcaaggatggaggactctcttcaaaagtctaccgtgtcatccaggcctcatgacactctgcagttccgcaaaaccctccccgtaggcccagggacctag

SEQ ID NO: 202439 - DNA, 1155 bp, Artificial Sequence
  Description of Artificial Sequence: Synthetic coding sequence
atgtacaagcggaacggcctgatggccagcgtgctggtgaccagcgctaccccccaggggtctagttccagcgattcgttggagggccaatcgtgcgactacgcatctaagagctacgatgccgtagtttttgacgtgcttaaggtcacacctgaggaatttgcctcccaaatcaccctgatggacattcctgtttttaaggcaatacaacccgaggaactggcatcctgcggctggtcaaagaaggagaagcattctctcgcccccaacgtggtggccttcactcggaggttcaaccaggtgtctttctgggtcgtacgcgaaattctcacagcccagaccttgaagatacgagcagagatcttatcccactttgttaagatcgcgaaaaagctattagaactcaacaatctccattccctgatgagcgtggtatctgccctgcagagcgcgcctatattcaggctcacaaagacatgggcgctgcttaacagaaaggacaagactacattcgagaagttggattacctcatgagcaaggaagacaactataaacgcacccgtgaatacatcagaagtttgaaaatggtcccttctattccctatctcgggatttacctgctggatttgatttacattgattctgcgtacccagcttctggcagcatcatggaaaacgagcaacgctccaaccagatgaacaacattctgcgcatcatagcggacttgcaggtttcatgctcatatgatcatctgaccaccctgccccatgtgcagaagtaccttaagtcggtgagatatattgaggagttacagaagtttgtagaggatgataactataaactgtccttgagaatcgagccgggcagctcaagtccaagactggtgtccagcaaggaggacttagccgttagccacctgagtagcctgtctcaccaagggcaagccgaggaagcgcggctgaaaccaacaagtgggcagcaccccgcatggatgtggccttcttcaagcagggtgcctgcagctccgccagcatctgccgccccccgaagtccgtggccccgcaacctgcggaatgaccagggccagcccggagcagtggccttgacttgcaatcctagtaccctcggttcaagaagccgtaggatcacttag

SEQ ID NO: 202440 - DNA, 1614 bp, Artificial Sequence
  Description of Artificial Sequence: Synthetic coding sequence
atgtacaagcggaacggcctgatggccagcgtgctggtgaccagcgccactccacagggatcctcctccagtgattcattggaaggtcagtcgtgtgactacgccagcaaatcctatgatgccgtcgtgttcgatgtccttaaggtgactcccgaagaatttgcaagccagattaccctcatggacattcccgtttttaaggccattcagccagaggaactggccagctgtggttggtccaaaaaggagaaacattccctcgcacccaacgtggtagctttcacaagaagattcaaccaagtgagcttttgggtagttagggaaatcttgacagcgcagactcttaagatcagggccgagattctctctcacttcgtgaaaatcgctaagaagctgctggagctcaataatttgcattcgctgatgtctgtcgtaagcgccctgcagagtgccccaatcttcagactgacgaagacctgggccctcctgaataggaaagacaaaacgacctttgagaagcttgattatctcatgtcaaaggaggacaactacaaaaggacccgcgagtacatacggagtctcaaaatggtcccctccatcccttatctgggcatctatcttctagatcttatctacatcgattctgcatatcccgcttctggttccatcatggaaaacgagcagagaagcaatcagatgaacaatatcctgagaattatcgccgatctgcaggtgtcatgcagctatgatcatttaacaacacttccccatgtccagaaatacttgaagtcggtccgctatatagaagaattacagaaattcgttgaggatgataattataagctgtccctgcgtatcgaacctggaagttccagcccgagattggtttcctccaaagaggatctggccggcccctcagccggttccggttctgcaaggttctctcgacgtccgacatgtcccgatacgtccgtggcgggttcactgcccacaccgcctgttcctcgacatcggaaatcacactcccttggcaataatcgggggaggttgtatgccactctggggccaaattggcgcgtacctgtacgcaacagtccgcgcacccgaagttgcgtgtactcacccaccggcccctgcatctgtagcctgggcaactctgcagcggtgcctaccatggaaggtccgctccgacgcaagacactactgaaggagggtcgaaaacccgcattgagctcttggacccgctattgggtaattctgtctggcagcacacttctgtactacggggcgaaatctctccgcggaaccgatcggaaacattacaagtccacccctggcaagaaagtaagtattgtgggctggatggtccagcttcctgacgacccggagcaccctgacatcttccagctgaacaaccccgataaagggaacgtgtacaagtttcagaccggatctcgcttccacgctatactgtggcacaagcatctggatgacgcctgtaagagtaaccgcccccaagaggccggtgccgcacctggtcccacagggactgactcgcatgaagtggatcacctagagggcggggcaggaaaggaagccgggccttgcgcatag

SEQ ID NO: 202441 - DNA, 462 bp, Artificial Sequence
  Description of Artificial Sequence: Synthetic coding sequence
tgaaacagcccccggacccggagctgcgtgtacagccccaccggcccttgcatttgttccctcgggaatagcgcggccgtgcccacaatggaggggccattgcgacggaagacactgctcaaggaggggcgcaaaccagcgttatcctcatggacgagatactgggtgatcctcagtgggagtaccctactttactacggcgccaagtcgctcagggggacggatcgaaaacactataagtcaacccccggaaagaaagtgtccattgttggctggatggtgcagctcccagatgaccctgaacaccccgatattttccagcttaacaaccccgacaagggcaatgtttataagtttcaaactggctctcggtttcatgctatactgtggcacaaacatctggatgacgcttgtaagtccaaccggccgcaagtgcccgctaatctcatgtcatttgagtag

SEQ ID NO: 202442 - DNA, 6252 bp, Artificial Sequence
  Description of Artificial Sequence: Synthetic coding sequence
atgttcagcaagaagccccacggcgacgtgaagaagagcacccagaaggtcctggacacaaagaaggacgccctgacacgtttaaagcacctccggatagtgattgagaacgcagagagcatcgatcttaagcaattttttgatcaacacttttcacatatttactatgtttttttcgagaacttcgttacaattgaggctagcctgaaacagaaaggccataaatcacaaagagaagaactcgacgccatcctgtttattttcgaaaaaattctccagctattgcccgaaaggatccaccagagatggcaattccattctatagggctgatccttaaaaagctattgcatacaggaaattccctcaagattcgccgcgagggggtgcggctgtttctgctgtggctacaagctttgcagaataattgttctaaggaacagttatggatgttttcatgtctgatacccggcttctcagcacctcagagtgagcatgggcctcgtaccctggacaatctcatcaaccctcccctgaacctccaagagacacaggtgaccatcgaggagatcacaccattggtgccaccccaaagcggtgacaagggacaggaagatctgacaagttatttcctcgaggcgttgcttaagtacattgtgattcaagttaaatcactggaatggaagaataaagagaatcaggagcgcggcttctcctttctgttcagtcattttaagaagtactatctgccttacatctttcccaatatatgcaaggaaaacagtctgtaccaccccatcctcgacatccctcaaatgcgccccaagccacactacgttgtcattaagaaggatgccgagactaacgaagccatctattgtacgaaagaacctttcatcaaagccagagtcattgttattcgctggctggttagcttctggttggaaccaaagcctcatacggggcctcacatccccggaatggaaggagaggtcctgcccaagaatatccagcgtgccgctgcctcgctggtgagccgcgaagagagcaagaatgacaatgccgataagaccgataggaccactgagcctgaacagagtcattctaacaccagcacgctcactgagcgagaaccgtcctcatcctccctgtgttccattgacgaggagcacttgactgacattgagatcgtgcgaagggttttttctagcaaacgcagcaacgtgaacttcgtcaccgagatctttaggcaagccttcctacttcctatctgcgaagctgccgccatgagaaaggtagtcaaggtgtatcaggagtggattcaacaggaagagaagcccctcttcatgcaggaacccgaggagatcgtcatcacgtccagcgatctgccctgtatcgagaatgtgaccgaccacgacataagcatggaggaaggggagaaacgggaagaagagaatggcacgaatacagcagaccatgtaaggaacagctcctgggcaaaaaacggcagctatcagggcgccctccataacgcatccgaagaggccaccgaacaaaacattagagccggaacacaggccgtgttgcaggtgttcattattaattcaagcaacatttttcttctcgagcctgccaatgaaattaagaacctcctggacgagcacacagatatgtgcaaacgaatcctcaatatctatagatacatggtcgtgcaagtgtccatggacaagaagacctgggaacagatgcttttagtcttactacgggtgactgaaagcgtgctgaagatgccaagccaagcgttcctccaatttcagggaaaaaaaaacatgacactcgccgggcgtctggctggaccactgttccagaccctcattgtcgcttggattaaggcaaatctgaatgtgtacatttctcgtgaactctgggacgacctgcttagcgtgctttctagtctgacttactgggaggagcttgccaccgaatggagtctcacaatggaaactctcaccaaggtgcttgcacgcaatttatacagtttggatcttagcgaccttcccctagacaaactgtccgaacagaaacagaagaaacacaagggcaaaggcgtgggtcacgaatttcaaaaagtgagcgtggataaatcattttccaggggttggagtagagaccagccaggacaagcccccatgagacagaggtctgcgaccaccaccggttctccgggtactgagaaagcgaggtcaatcgtccggcagaaaacggtcgccatgagatcaaggtctattggggagtgcgcactccccagtgcttacatccgaagcgccaaaagcgccccagtgctgatacatactagcaaacctttcctccccgatatcgtgctgacccctcttagcgacgagctcagcgacattgatgatgcccaaatcctcccacggtccacccgtgtgagacatttctcccaatccgaggaaactgggaacgaagtgtttggagccctgaatgaagaacaacccctcccccgatccagctctacatcagacatactcgagccttttacagttgagagggctaaggtcaataaggaggatatgagccagaagctgcccccattaaacagcgatatcggcggcagcagcgcaaacgtgcccgacttgatggatgaattcatcgcggagaggttgcgctccggaaatgcctcgacaatgacaaggcgcggctctagtcctggcagtctagaaatccctaaagatttgccagatatccttaataaacaaaaccagatgagacccattgacgatccaggagtgcccagtgagtggacaagcccggcttcagcgggctcctctgacctgatatcatccgatagccattccgacagtttttccgcctttcagtacgacggtcgtaaattcgacaactttgggttcggaaccgatacaggggtaacctccagtgcggatgtggattcaggctccggtcaccaccaaagcgcggaggaacaggaagtagcatctttaacaacgctgcacatcgactcagagacctcttctctcaaccaacaagcttttagcgccgaggtcgccacaataacaggaagcgaatcagcatctccagtgcacagcccattaggcagccggtctcaaacacctagcccttccacactaaacatcgaccatatggaacagaaggacctgcagctggatgaaaaattacaccactcagtgctccagacacccgacgacctcgaaatttccgagtttccatccgaatgctgctcagtgatggcaggaggtaccttgaccggctggcatgctgatgtggctacagtgatgtggaggcggatgctaggcattttgggggatgtgaacagcataatggaccccgaaattcatgctcaggtgtttgattacctgtgtgagctatggcagaacctggcaaagatacgtgacaacttagggatctccactgataatctgacaagtccctccccaccggtgttaattccacccctgaggatcctgaccccttggctgttcaaggcaaccatgctgactgataagtataagcagggcaaactacacgcctataagctgatctgcaataccatgaagaggcggcaagacgtaagcccaaatagagactttctgactcacttctataacatcatgcattgtggcctattgcatatcgaccaggacatcgttaatactataattaagcactgttcacctcagttcttttcgctggggctgccgggggcaaccatgctgatcatggatttcatcgtagcagcgggccgcgttgcctcttcagccttcctgaatgctccacgggtggaagctcaggtcctcttaggctctctggtttgtttccccaatctctactgcgaactgccatccctccaccctaatattccggatgtcgccgtgtcccagtttacagacgtgaaggagcttatcattaagaccgtactatcctcagccagggacgagcctagcgggccagccagatgcgtggccttgtgctctttggggatttggatctgtgaggagctagtgcacgagagccaccacccacagatcaaggaggctctgaatgtaatttgcgtgtccctgaagtttactaataaaacagtggcccatgtcgcatgcaatatgttacacatgctcgtgcactatgtgccacgcctccaaatataccagcctgattcccctctgaagattattcagattctcatcgcaactataacccatttgctccccagcactgaggctagttcttacgagatggacaaaaggctcgtggtatctttactgctgtgcctgcttgattggattatggcactgccacttaagacattactgcagccgttccacgctacgggagctgagagcgataaaaccgagaaaagcgttctgaactgcatctataaagtcctgcatgggtgtgtctacggggcacagtgcttctccaatcccagatactttcccatgtccctcagtgacctggctagtgtggattatgaccccttcatgcacttggaatccttgaaggagccagagcctcttcacagcccagacagtgagcgcagttccaagctgcagcccgtgaccgaggtcaaaacacagatgcaacacggcctgatttccatcgccgcccggacagtcattacccatcttgtgaaccacctcggtcattaccctatgtctggcggacctgctatgctgacgagtcaggtgtgtgaaaatcacgataaccactactcagagagcacagagctgagtcctgaactcttcgaaagtccaaatattcagttcttcgtactcaataacactacactagtgagctgcatacagattcgctcagaagaaaatatgcccggcggtggactgagcgcagggctagccagcgccaactccaacgtgcgaataattgttcgcgacctgtcagggaagtattcatgggacagcgcgattctttatggcccccctccagtcagtggactgtcagaaccaacgagtttcatgctcagtctcagccaccaggaaaagcccgaggagccgccaacaagcaatgagtgcctggaggatatcacggtgaaggatgggcttagtcttcaattcaagaggttccgcgaaaccgtgccaacctgggatacaatccgggacgaggaggacgtgttagacgaactccttcagtacctcggagtgacatctcctgagtgtctccagaggaccggaatatctttgaacatacccgccccacagcctgtttgtatatctgagaagcaggaaaatgacgttatcaacgccatcttgaaacagcacactgaggagaaggaattcgtagagaaacacttcaatgacctgaacatgaaggctgtagagcaggatgagcctatcccacagaaaccacagtcagccttctattactgtcgcttgctcttaagtattctgggcatgaacagttgggacaagcggcggtccttccatctgctcaagaagaacgaaaaactcctgcgcgagcttagaaacctggatagtcgccagtgcagagaaacacataagattgcagtgttttatgtggctgaaggccaggaggacaagcactcaatcctaacaaacacaggtggatcccaggcttacgaagactttgtcgctggcctgggctgggaggtcaacttgaccaatcattgcggttttatgggcggtctgcaaaagaacaagtccactgggctgactaccccttattttgccacctcgaccgtcgaggtaatcttccatgtgtccacccgcatgccgtccgacagtgacgatagtttaacaaaaaaactcaggcacttgggcaatgatgaggtccacattgtgtggagtgaacataccagagattaccgccgcggtatcattccaacagaattcggagatgtgctaatcgtcatttaccccatgaaaaaccacatgttctccatccaaatcatgaagaagcccgaggtgccgttttttggacccttatttgacggcgctatcgtcaatgggaaggttctgccaataatggtgagggccactgcgataaacgctagcagggcactgaagtccctgattcccctgtaccagaacttctacgaagagcgggcccgttacctccagaccatagtgcagcaccacctcgagcctacaacattcgaagactttgctgcccaggtgttctcacctgctccttaccaccaccttccttctgacgcggaccactag

SEQ ID NO: 202443 - DNA, 6252 bp, Artificial Sequence
  Description of Artificial Sequence: Synthetic coding sequence
atgttcagcaagaagccccacggcgacgtgaagaagagcacccagaaagtcctggataccaagaaggatgcactcacacgcctgaaacacctgcgcattgtcatcgagaatgcggaatccatcgatctgaagcagttttttgaccagcatttttcgcatatctattacgtattctttgagaacttcgttactatcgaagcctccctgaagcagaagggacataagagccaaagggaggagctagacgccatactctttatttttgagaagattcttcagctcctgcccgagagaatacaccagcggtggcagttccactcaatcgggctgatcctcaagaagctcctgcataccggaaacagcttgaagataaggcgcgagggcgtacggttgtttcttctgtggctgcaggcattacaaaacaattgttcaaaagagcagctgtggatgttctcctgcctgatccccggcttctcagcaccacagagcgaacacggaccacgcaccctggataatctaatcaaccctccactcaatctgcaagagacacaggtgactatagaggagatcactcctctggttccaccacaaagtggcgataaaggtcaggaggatctcacaagctactttctcgaggccctgcttaagtacatagttattcaggtgaaatcccttgagtggaagaataaagaaaaccaggagagggggttctcttttctatttagccactttaagaagtactacctcccctacatctttcccaatatttgcaaggagaattctctgtaccatcccatcctggacatcccccagatgcggcctaaaccccactacgtcgtcattaagaaagatgcggaaacaaacgaggcgatttattgcactaaggaacccttcatcaaggcacgcgtcatcgttattcgctggctggtgtctttttggctcgagcccaagccccacaccggaccccatatccctggaatggagggagaagttctaccgaagaatatacagcgagctgccgcttcacttgtctccagggaagaaagtaagaacgataatgctgacaagaccgatcggaccaccgaacctgaacaatcacactcgaacaccagcactcttacagagagggaaccctctagctcttccctctgcagtattgatgaggagcacctaactgatattgagatcgttaggcgggtgttctcctccaaaagatcaaacgtaaactttgtcacagaaatcttccgacaggccttcctgctgcctatctgcgaagcagcagccatgcgtaaagtggtgaaagtgtatcaggaatggatccaacaagaagaaaaaccgctgtttatgcaggagcccgaggagattgtaatcacgtcttctgatttgccctgtattgagaacgtcacggaccacgatatttcaatggaggaaggggaaaagcgagaagaggagaacggtaccaacactgctgatcatgtgcgaaactcttcctgggccaaaaatggcagctatcaaggggcgttacacaacgcttctgaggaagccacggaacagaatattagggccgggactcaagccgttctgcaggttttcattattaactcctccaacatcttcctgctggagccagcaaatgagatcaaaaacctgctcgacgaacataccgatatgtgtaagagaattttgaatatatataggtacatggtggttcaagtatcaatggacaagaagacttgggagcagatgctgctggtcctgctcagagtgacagagtcggtcctgaaaatgccatcccaggcttttctccaattccagggcaaaaagaatatgactctggccgggaggttagctggcccacttttccagaccctgatcgtggcctggatcaaagccaacctgaacgtctatatctctcgggaactctgggacgaccttctaagcgtcctgagctccctaacatactgggaggaactggcaacggaatggagtctgacaatggagaccctgaccaaggtcttagctaggaatctgtattctctcgatctgtccgacctaccccttgacaaactgtccgaacaaaaacagaagaagcacaagggcaagggtgtgggccacgagttccaaaaggtaagcgtggataagtcattcagcagaggatggtcacgcgaccagcccgggcaggcgccaatgcgccaaagatccgctactacaactgggtctcctgggaccgagaaggcccggtctatagtgcgccagaagaccgtggacatcgacgatgcccaaatccttcctcgatccacacgtgtgcgacacttctcccagtctgaagagacagggaacgaggtatttggcgcacttaatgaggagcagcctttaccaaggagcagttccacttctgacatcctggaaccctttaccgtggagcgggccaaggttaacaaggaagatatgtcccagaaactccctccgctgaactctgatattggtgggagctctgccaatgtcccagacctgatggacgagttcattgcggagcgtttacgatcaggtaacgcctccacaatgactcgcagagggtcatctcctggcagcctcgagatcccgaaggacctgccggatattctcaataagcaaaaccagatgcggccaatcgacgacccaggcgtgccatctgagtggacgtcacccgcgagcgccggaagcagtgatctgatctcatcagacagccactctgacagcttcagcgcgtttcagtacgatgggcgaaagttcgacaacttcgggtttggcaccgacacaggcgttacctccagtgcagatgtcgactccggcagcggacatcatcagtcagctgaggaacaggaggtggcttcattgactactctgcatatcgactccgaaacatcctctctaaatcagcaggccttctccgcggaagtagcgacaattacggggtccgagtcggcatctcccgttcattccccactgggcagcaggtctcaaacgcctagccccagcaccttgaacattgaccacatggagcagaaagacctgcagcttgacgagaagttacaccactctgtccttcagacccccgacgatctggagattagtgaattcccctcggaatgctgcagcgttatggccggtggcaccttgacggggtggcacgctgacgtggccaccgtaatgtggcgcagaatgctgggtatattaggagacgtgaattccataatggatccagagatccacgcccaggtgttcgattatctctgcgagttgtggcagaatctggccaagattcgcgataacctgggtatatccacagacaaccttacatcgccatccccacctgtgctgattcctcctctgaggatcctgaccccctggctcttcaaggcgacaatgttgaccgataagtataagcagggaaaattgcacgcatacaagctcatttgcaacactatgaaaagaagacaggacgttagtcctaaccgggatttcctgacgcatttttacaacatcatgcattgtggtttactgcacattgatcaggacatcgtcaacacgataatcaagcactgtagtccccagttctttagtcttggcctgccaggtgcgactatgctgattatggactttattgtggccgcgggtagggttgctagctcagccttcctcaacgcccccagagtagaagcacaagtcctcttgggaagcctagtttgcttcccaaacttatattgcgagctgccctcgctccaccccaatattcctgatgtggctgtgtctcagttcaccgacgtcaaagaactcatcatcaaaaccgtgctgtcgagcgccagagacgagccttcaggccccgctaggtgcgtggcgttgtgttctttggggatttggatctgtgaggagttggtgcacgaaagccatcatcctcagattaaagaggcactgaacgttatctgcgtgtctcttaagtttacgaataaaactgtggctcacgtggcttgcaacatgttgcacatgttagtccactatgtaccacggcttcagatctaccagcccgatagtcccttgaagattattcaaatccttatagctaccattacacacctcctcccttccaccgaggcgagttcttatgaaatggacaagcgcctggttgtaagtctactgctgtgtctgttggattggatcatggcactgcctctgaaaacactgttgcagccatttcacgctacgggggcagagtccgataagactgagaaaagcgttctgaactgcatctataaggtgctgcacggttgtgtctatggggcacaatgcttttcaaacccaagatacttccctatgtctctatccgatttagcctcagtcgattacgatcctttcatgcatctggaatctttaaaggagccagagcccttgcattctcccgatagcgaaaggtcctctaagctgcagcctgtcaccgaagtcaagactcagatgcagcatggactgatcagcattgcggctaggactgtcatcacgcatctcgtcaaccaccttggacactaccctatgtctggcggccccgctatgttaacgtcgcaggtctgtgagaaccacgataatcactacagcgaatctactgagctctcacccgaactttttgaatcgcccaacattcagtttttcgttcttaataatacgacgttggtgagttgcatccagatcagatccgaggaaaatatgcccggcggcgggctctctgccggcttggcatccgccaactccaacgtgcgcattatagtgagggacttgagcgggaagtacagctgggacagtgccatcctctacggacctcctcccgtgagcgggctgtcagagcccacatcattcatgctcagcctgtcacatcaggagaagccagaggaacccccaacgtccaacgagtgtctggaagatatcactgttaaggacggactgagcttacaatttaagagattccgggaaactgtgcctacttgggataccatccgggatgaggaggatgtactggatgaattattgcaatatctcggcgtaacttcccccgagtgcttgcagaggacaggcatctctcttaacatccccgcgccccagccagtctgcatttctgaaaagcaggagaatgacgtgataaatgccattctgaagcaacacactgaagagaaggagtttgtggagaagcatttcaacgatttgaacatgaaagctgtcgagcaggatgagcccattcctcagaagccacagagcgctttttactactgcaggcttctgctctctattctcggcatgaactcttgggacaaaaggaggtcattccatctgctgaaaaaaaacgaaaaacttctcagagagcttagaaatcttgattcccgccaatgccgagaaacgcataaaatcgcggtgttctatgtcgctgaaggacaggaagacaaacacagcattctgactaatacaggagggtcccaagcctacgaagacttcgtagcaggtctgggctgggaggttaacctcaccaatcactgcgggtttatgggcgggctgcaaaagaataagtctacagggctgacaactccctacttcgccacaagtacagtggaggtgatttttcacgtgtccaccagaatgcccagcgatagcgatgattcactgactaagaagctgagacatctcggcaacgatgaagtgcatattgtctggtctgagcacactcgggactacaggaggggaatcatccctaccgagttcggcgacgtcttgatcgtcatttacccaatgaaaaaccacatgttctctatccagattatgaagaaaccagaggttccattctttgggcccctgttcgacggcgccatcgttaatggaaaagtcctgccaatcatggtcagggctactgctatcaatgctagtcgagctctcaaaagtcttattccactgtaccagaatttttacgaagagagggctcggtacctccagacaatcgtgcagcaccacctcgaaccaaccacctttgaagacttcgcagcacaagtgtttagccctgcaccgtaccatcatctgccctctgacgccggctcgtacccggaaattctgcctagcgagactcccaccgccacccaggtagacggagcggacctggcgtcccctatgagccctcggacttctaaatcccgaatgagcatgaagctgcggcgcagctctggctctgcaaacaagagttag

SEQ ID NO: 202444 - DNA, 6222 bp, Artificial Sequence
  Description of Artificial Sequence: Synthetic coding sequence
atgttcagcaagaagccccacggcgacgtgaagaagagcacccagaaggtgctagataccaaaaaggatgctcttacccggctaaagcacttgcgtatagtgatcgaaaatgcggagagcatcgacctgaagcagtttttcgaccagcacttttcacacatttattatgttttcttcgaaaatttcgtgactatcgaagcctcactgaagcaaaaggggcataaatcacagagagaagaactggacgcgattctcttcatatttgaaaagatccttcagctgcttcccgagcggatccaccaacgctggcagtttcactcaatcggactcatactaaaaaaactgctccacactgggaattctctgaagatccgacgcgagggtgtgcgactgtttctgctttggctgcaggccctccagaataactgttcaaaagagcaactctggatgttcagctgtctaattcctggtttcagtgcaccgcaatccgaacatggcccacgcaccctcgacaatctgataaatcccccgctgaatctccaggaaactcaggtcactatagaggagatcaccccccttgttccacctcagtctggggacaaggggcaggaggacttaacctcttactttcttgaggcgttgctcaaatatatcgtgatccaagttaaaagccttgaatggaaaaataaagagaatcaagagcggggtttctcatttttatttagccactttaagaagtattacttgccatacatcttccctaatatatgcaaggaaaactccctataccatccgattctggacatccctcagatgcggcccaaaccgcattatgtagtaataaagaaggacgccgagaccaacgaggccatctattgtaccaaggagccatttattaaggctagagtgatagtcattagatggctagtgagcttctggctggaaccaaagcctcacactgggccccatatccccggtatggagggcgaagtgctgcctaagaatatacaaagagctgctgccagcctggtgtcacgcgaggaaagtaagaatgataatgccgacaaaacagatcgaaccaccgagcccgagcagtcacattctaatacttctactttgacggagagggagccttccagttcaagcctatgcagcatcgatgaagaacatttgaccgacattgagatagtgcgacgtgttttttcctctaagcggagcaatgtgaatttcgtcaccgagatttttcgccaagcatttttgcttccgatctgtgaggctgctgccatgcgtaaggttgtaaaagtctaccaagagtggatccaacaggaagagaagccgctgttcatgcaagaacccgaagaaatcgtgataacatcctcggacctaccatgcatagagaacgtgactgatcacgacattagcatggaggaaggagaaaagcgtgaagaggaaaacggcaccaatacggccgaccatgtgagaaactctagttgggcaaagaatggaagctaccaaggcgcgttacataacgcgtccgaagaagccaccgagcagaacataagagcaggcacacaggccgtgctgcaggtgttcattattaattcttcgaacatattcctgctcgaacccgctaatgagataaagaatttgctcgacgagcatacagatatgtgcaaacgcattctgaacatataccgatacatggtggtacaagtaagcatggataaaaagacttgggaacagatgcttcttgtcctgttacgagttacagagagtgtgcttaaaatgccttctcaggcctttctgcagttccagggcaagaagaacatgactctcgccgggcggctcgctggtccgctctttcagacactgattgtcgcctggatcaaagccaatctcaacgtgtacatcagtcgcgagctgtgggatgacctgctctcagtgctgagttctctcacatactgggaagagcttgctactgagtggtctctgacaatggagaccctcactaaagttttggctcggaatctctatagcctcgatctcagcgatttacccttggacaaactgtccgagcagaaacagaaaaagcataaaggtaaaggggtggggcatgagttccaaaaggtgtctgttgacaagtctttttctcggggctggtctagagatcagcccggacaggcaccaatgcggcagcgctcagctaccaccacaggaagccctgggactgaaaaggcacgatcaatcgtcaggcagaagacggtcgacattgacgacgcccagatactgccacgaagtactcgcgtgcggcatttttcccagtctgaggagactggtaacgaggtgttcggagcactcaacgaagagcagccgttgcctagaagttcttcaaccagtgatatactggagcccttcactgtagagcgggccaaagtgaataaagaggatatgagtcaaaagctccctccactaaactcagatattggtggttcatctgcaaacgtgcccgatctcatggacgagttcattgctgaacgtctgagaagcggaaacgccagcactatgacaagacgcgggtcaagccccggcagcttagaaattcctaaagatttgcctgatatcttaaataagcagaatcaaatgagaccaatcgatgaccctggggttccaagtgagtggacaagtcctgcatccgccggttcgtccgatttaatttcaagcgactctcacagcgactcattcagtgcttttcagtacgacggtcgcaaatttgacaacttcgggtttgggacggatactggcgttaccagcagcgcggacgtggattcgggctccggccaccatcagtcagcagaggagcaagaagtggcctcactaacgaccctccatatcgatagcgagacctccagtctcaaccaacaggcatttagtgcagaagttgcgaccattacaggaagtgaatccgctagtcccgtccatagtccactcgggagcagaagtcagactcctagccccagtacactgaacatagatcacatggagcagaaagatctgcagttagatgaaaaactgcaccactcagtcctgcagacgcctgacgatctagagatcagtgagttcccctccgaatgttgctccgtgatggccggaggaacattaacaggctggcatgcagacgtggccacggtgatgtggaggcgcatgctgggcattctgggagatgtaaactctatcatggacccggagatccacgcccaagttttcgattacctttgtgagctgtggcagaaccttgccaagatcagagacaacctcgggatctccaccgacaacttgacctccccctcacccccagtgctgattcctccgcttcgaatccttactccttggctgttcaaagcaactatgttaaccgacaagtacaaacagggcaaactgcacgcttacaaacttatctgtaatactatgaagcggcgacaggacgtttcgcctaacagggactttctgactcacttctataacatcatgcattgtggactcctgcacatcgatcaggatatcgtgaatacaattattaaacattgttccccccagtttttttctctaggtctccccggagcgaccatgctgatcatggatttcatcgtagcggctgggagggtcgcctcctctgcctttttgaacgctcctcgggtcgaagcccaggttctgttaggaagtttggtttgttttcctaatctgtactgtgaactccctagcctgcatcccaacatccctgatgttgcggtttcccagttcacagatgtcaaagagcttatcattaaaaccgtgctgagcagcgccagggatgaaccttctggcccagccaggtgtgtcgccctgtgttcacttggtatttggatttgtgaagaacttgtccatgaaagccatcaccctcaaattaaagaggcactaaacgtgatatgcgtctcacttaagtttaccaacaaaacagtggcccacgtggcctgcaatatgcttcacatgctggtacattatgtcccccggctccaaatctatcagccagactcacctctcaagatcatacaaatattaattgccaccattacgcacttactaccaagcacagaggctagtagctacgaaatggacaaaagactcgtggtcagcttacttctgtgcctattagactggatcatggcattgcctctgaagacgcttttacagccctttcacgccactggagcagagtcggataagaccgaaaagtctgtgctgaactgtatttacaaggtgctccatgggtgcgtgtacggggcccagtgtttttctaacccccgatatttccccatgtctttaagcgacttggcaagcgtggactacgatccgtttatgcacttagaatccctgaaggaaccagagcctctgcactcgcccgacagtgaaagatcgtccaagttgcagcccgtgaccgaagtgaagactcagatgcagcacggattaataagcattgcagctaggactgttattacacaccttgtgaatcacctgggacactaccctatgagtggtggccctgccatgctgacttcgcaggtctgtgagaaccacgacaaccactacagtgaaagtactgaactatctcccgagttgtttgagtcacccaatattcaattcttcgtgctgaataacactaccctagtgtcatgcatccagattcgtagtgaggaaaacatgcctggcggagggcttagtgcaggcctggccagtgccaatagcaatgttcgaataattgtccgagatctgtccgggaagtacagctgggactccgcgattttatacggccctcctccggtctcaggattgtctgagcctacctcatttatgctgagtttgagccaccaggagaaaccagaagagcctcctacgtcgaacgagtgcctggaggacatcacagtcaaagacggcctatccctccagttcaaaaggtttcgtgaaacagttccgacctgggacactatcagggacgaggaggacgtcctcgacgagctcttgcagtacctcggagttacatcgcccgagtgcctgcagagaacaggcatctccttaaatatcccagccccccaacccgtttgtatttctgagaagcaggaaaatgatgttatcaacgctatcctgaaacagcatacggaggagaaagagttcgtggagaaacattttaatgacttaaatatgaaggctgttgaacaggatgaacctataccacagaaacctcaatccgcgttctattattgtcgattgctcctgagtattctggggatgaacagctgggacaagaggcgcagcttccacttgcttaaaaaaaatgagaagctgctgcgtgaactccgaaatcttgactccaggcagtgccgagaaacacacaagatcgccgtgttttatgttgccgaaggacaggaggacaagcatagcattctgactaacaccgggggatctcaggcatatgaagactttgttgctggccttggttgggaggtcaacctgactaatcattgtgggttcatggggggactgcagaagaataagagtacgggattgaccacgccatattttgccactagcacagtagaagttatctttcacgtcagtactagaatgccttcagattcagacgactcactgacaaaaaaactgcgtcacctcgggaacgatgaagtccatatcgtctggtctgaacatacacgggactatcgacggggaataatcccaactgagttcggggatgtgctgatagtcatctatcccatgaagaaccacatgttctctatccagataatgaagaagccagaggtgccgttctttggccccctcttcgacggcgcgatcgttaatggaaaggtgctgcctattatggtaagagcaactgcgataaatgcttctagagccctgaaatcgctgattcctctgtaccagaatttttatgaagagcgcgcccggtacctgcagaccatagtgcagcaccaccttgagccaactactttcgaagactttgccgctcaggtcttttcccctgccccctaccaccatctaccatccgatgccgaagagagaaacgccgttatagtcctctttctgcccaagccccctttggagaatatcggccacttaaaggcccccacacagaggttttatcctgtgaaactacctcaacagagaaggtag

SEQ ID NO: 202445 - DNA, 6150 bp, Artificial Sequence
  Description of Artificial Sequence: Synthetic coding sequence
atgttcagcaagaagccccacggcgacgtgaagaagagcacccagaaggttctggatactaaaaaagatgccctgacgcgcctcaaacatctgcggatcgtgatcgagaatgccgaatccatcgatctgaagcagtttttcgatcagcacttcagccacatatactacgtgttttttgagaatttcgtgactatcgaggcttcactaaagcagaagggccacaagagtcaacgcgaagagcttgatgccatactgttcattttcgagaaaatcttacaattgttgccagagcgtatccatcaaaggtggcagtttcactctattggtcttattctgaagaaactcctccataccggcaatagcctgaaaatccgtagagagggggtgagactgtttctgctctggttgcaagccctgcagaacaattgttctaaagagcagttgtggatgtttagctgtttaatccccggattcagtgcaccccagtctgagcacggccctcgtactctcgacaacctcattaatccaccattaaacttgcaggaaacgcaagtcacaattgaagagatcactccattggttccaccacagtcaggggataaaggacaggaggatctcacgagctactttttagaagcacttctaaagtatatcgtgatccaagtcaagtcactggaatggaaaaacaaagagaatcaggagcgagggttctcttttttgttttcgcattttaaaaaatattatcttccgtatatttttcctaatatctgcaaagagaattctttgtaccatcctatattggacatccctcaaatgcggcctaagccacactacgtggttattaagaaagacgccgagacaaacgaggctatctattgtactaaggagccatttattaaggcacgggtcatagtcatccgctggctggtgtctttctggctggagcctaagccgcataccggtccccatatacccgggatggaaggagaagtactgcccaaaaatatacagcgggccgcagccagtcttgtatcccgggaggagtcaaagaacgataatgccgacaaaacggataggacgacagagcccgaacagtctcacagcaacaccagcaccctgacggagcgggaaccatcctcatcgagcttatgcagtattgacgaagagcacttgacagacatagagatcgtgcgacgggtattctccagtaaaagaagtaacgttaacttcgtgacggagatcttccggcaggctttccttcttcctatttgtgaagctgccgccatgcggaaggtagttaaagtataccaggaatggattcaacaagaggagaaaccgctattcatgcaggagcctgaggagatcgtgatcacaagttctgatttgccatgtatagagaacgtcacagaccatgatattagcatggaggagggcgaaaaacgcgaggaggagaatggtacaaacaccgcagatcatgtgaggaacagctcttgggccaagaacgggagctaccaaggtgccctgcataacgcatcagaggaagcaactgagcagaacatccgtgccggtacacaggcagtgctccaggtttttatcatcaactcttctaacatcttcctgctcgaacccgcaaacgagattaagaatctcctagatgagcataccgatatgtgcaagagaatactgaacatctacaggtacatggtggtacaagtttcaatggacaagaaaacttgggagcagatgctgttagtactgttgagggtcacagagtctgtgctgaaaatgccctctcaggcctttctgcagtttcaggggaagaaaaatatgacccttgccgggcgcctcgccggtccgctcttccaaaccctaattgtggcctggatcaaggcaaatctcaacgtttacatcagtagagaactatgggacgacttgctctccgtcctgtctagcttgacgtattgggaagaattggcaactgagtggtcgctgaccatggaaaccctgaccaaggtactggcccgcaacctttacagcctcgacctttctgaccttccactggacaaacttagtgagcagaaacagaaaaagcataaaggaaaaggtgtcggtcacgaattccagaaggtcagtgtggacaagtctttctcccgcgggtggtcaagggatcagccgggccaggcgcctatgcgtcagaggagtgccacaaccacagggtctccagggaccgagaaggcgcggagtatagtgagacagaagacagtggatatcgatgacgctcagatattgcctcgatccacacgcgtacgccacttttcccagtcggaagaaactggcaatgaggtgtttggcgctctgaatgaagagcagcccttacccagatcatccagcacctccgatattttagagccttttactgtcgagcgggccaaggaggccgagcagaacgcaacacgaggaagtacagaggggtccgtacaaagctgtaacgggcttttttggaaagagagctgttcagacataggggggtcctcggcaaacgtgcctgacctgatggacgaattcatcgccgagcgtttgagaagcggcaatgcaagtacgatgaccaggcgcgggtctagcccgggctccctggaaattccaaaagacctgccagatatcctgaataagcagaatcagatgcggcctatagacgacccaggggtgccatccgaatggaccagccccgctagtgctggctcaagcgatctgattagttctgattcccacagcgactccttctctgctttccagtacgatgggcggaagtttgataattttgggttcggtactgacacaggggttacttctagtgcggacgtcgactctggatccggacatcaccaaagtgccgaagaacaggaggttgcttcgctgactaccctccacattgacagtgagacctcatctctgaaccagcaggcattctccgcagaagttgccactattaccggcagcgaatccgcctctcctgtgcattctcccttaggatctagaagtcagaccccctcaccctccaccctcaacatagaccatatggaacagaaagacctacagctggatgagaagctccatcacagcgttttacagactccagacgacctcgagatcagcgagttcccctccgagtgctgctcagtgatggctggaggcacactgactggctggcacgcagatgtagccactgtgatgtggaggcggatgctgggtatcctcggcgacgtaaactcaattatggatccggagattcacgcccaggtgttcgactacctgtgcgagctgtggcagaatcttgccaagatccgggacaacttgggcatttccacagacaaccttactagccccagcccaccagtgcttattccaccactccggattttgacaccctggttattcaaggccacgatgctgaccgacaaatataaacagggtaaacttcacgcatacaaactcatttgcaacacgatgaaacgcaggcaggacgtgtcacccaacagagatttcttgacgcatttttataacatcatgcattgcggcttgctgcacattgatcaggatatcgtcaacacaattattaaacattgttccccccagtttttcagtctcggcctgcctggcgcaactatgctgataatggacttcatagtggctgctggccgtgtggcctcaagcgcctttctgaatgcccctcgcgtggaagcccaagtactactcgggtccctggtgtgcttcccaaacctgtattgtgagctcccttccctccaccctaacattcccgatgtggcagtgtcccagtttactgacgtaaaagaactcatcatcaaaaccgtcctgagctccgcccgagacgagccttccggacccgctaggtgcgttgccctatgctctctaggaatatggatttgtgaggaactggtgcacgagagccaccaccctcagatcaaggaggccctgaatgtgatttgtgtcagccttaaatttactaacaagaccgtcgcccatgtggcatgtaacatgctgcacatgctggtacattacgttccacggcttcagatctatcagcctgatagcccactgaagatcatccaaatcctgatcgctacaattacccacttgttaccatctactgaagccagcagctatgagatggataagcgactggttgtgagcttgctcctatgtctgctcgattggatcatggcgctgcccttgaaaactctcctccagcctttccacgcaacaggcgccgaatcagataaaaccgaaaagagcgtgcttaattgcatctataaagtgcttcatggatgtgtgtatggtgctcagtgcttctccaacccccggtatttccctatgtctctgagtgacctggcttccgtagattatgatccttttatgcatctggagagcctgaaggagcccgagcccctccatagtcctgactcagaaagatctagtaagctacagcctgtgacagaagttaaaacccagatgcagcacgggctcatctcgattgctgcccgcaccgtgatcacccatctggtgaaccatctggggcactaccccatgtccggcggtcctgccatgttgaccagccaggtgtgtgagaaccatgacaatcactattctgaaagcacagaactcagccccgagctattcgagtctccaaatatacaatttttcgtgctgaacaataccacacttgtgtcatgtatacagattcggagcgaggaaaacatgcccggcggaggtctatcagccggcctagcgtccgccaattcaaacgttcggatcattgtgagagatctgtccgggaaatactcctgggacagcgccattctatatggccccccccctgtgagcggtctctctgaaccaacatcttttatgctgtccctgagtcaccaggagaaacctgaggagcctccaacgtccaatgaatgtttggaagatataaccgtgaaggatgggctgtcccttcagttcaaacggttccgcgagactgtcccaacgtgggatactattagagacgaggaggacgttctcgatgagctgctccagtatctgggtgtgacatctccggagtgtcttcagagaacgggcattagcttgaacattcctgcaccacagccagtctgcatcagtgaaaagcaggagaatgatgtaattaatgctatcttaaaacagcacacagaggagaaggaatttgttgagaaacactttaatgacctcaacatgaaggccgtcgagcaagacgagcctatcccccagaagccccagtctgccttctactattgccgactgctgctttctatcctcggcatgaacagctgggataagcgtagaagttttcacctcctcaagaagaacgagaaactgctgcgggaactgcgcaacctggatagcagacagtgtagggaaacccataaaattgccgtgttttacgtggccgaagggcaggaggacaaacacagcatcttgaccaatacaggggggtcacaggcttacgaggactttgtagcaggcttaggatgggaggtgaacctcacaaaccattgcggcttcatggggggtctgcagaaaaacaagagcacaggtcttactaccccatattttgcaacaagtaccgtggaggtgatctttcacgtctccactcggatgccatccgacagtgatgactctctgactaagaaactccggcaccttggaaacgatgaggtgcatattgtgtggtccgagcacacaagagattataggcgcggcatcatcccaaccgagttcggggatgtattgattgtgatctaccccatgaagaaccacatgttcagcatccagataatgaagaagcccgaggtccccttttttggcccccttttcgatggcgctatagtgaatggaaaggttctacctatcatggtgagagcaaccgccatcaacgcttccagggctctgaagtctctgatccccctgtatcagaacttctatgaggagagggcgcggtatctgcagactatcgtgcagcaccacttagagccaaccacgttcgaggattttgctgcgcaagttttctctcctgccccgtatcaccatctcccctcagatgccgatcattag

SEQ ID NO: 202446 - DNA, 6111 bp, Artificial Sequence
  Description of Artificial Sequence: Synthetic coding sequence
atgttcagcaagaagccccacggcgacgtgaagaagagcacccagaaagtcctagacacgaaaaaggacgccctaacccgacttaagcacctgaggatcgtaatcgagaatgccgagtccatcgacctaaaacagttttttgaccagcatttctcacacatatactatgtgttcttcgagaatttcgtgactatcgaggcctcgctgaagcaaaagggacacaagagtcagcgggaggagctcgatgcgatattgttcatctttgagaagatcctgcaattgttgcctgagcggattcaccaacgatggcagtttcacagtataggccttattttaaaaaaactgctgcacaccggcaattctctgaaaatacgaagagaaggggtgcgactctttctcctgtggcttcaagcccttcagaacaattgctccaaggaacaattgtggatgttttcttgcctcatccctggctttagcgctccacagagtgagcatggaccccgaacattagacaatctgatcaatccaccactgaaccttcaggaaacccaggtaacaatcgaggagattacaccgctggtccccccccagtctggtgataagggtcaggaggaccttacaagctatttcctcgaggcccttttaaagtacattgtgattcaggtgaagagccttgagtggaagaacaaagagaaccaagagcggggcttcagcttcctgttcagccattttaaaaagtattacttgccttacattttccctaacatttgcaaagaaaatagcctgtaccatccgattctagacattcctcagatgcggccaaagccccactacgtcgttataaagaaggacgcggaaacaaacgaggcaatttattgcactaaggaaccattcatcaaggcccgcgttatcgtgattagatggctcgtgagcttttggctggagcctaagccacatactgggcctcacattcccggcatggagggagaggttcttccaaagaacatccagcgcgccgcagccagcctggtgtcccgagaagagagcaagaatgataacgctgataagactgatcggacaacagagcctgagcaatcacactccaacacatccacgttaacagagagggagccatccagttcctcactctgtagtatagacgaagagcacctgactgacattgagatagtcaggagagttttctctagcaagcgcagcaacgttaacttcgttacagagatatttaggcaagcctttctgttgcctatctgcgaggcagcagccatgagaaaggtggtcaaagtttaccaggagtggattcagcaggaggagaagccactctttatgcaggagccagaagaaatcgtcatcacaagttcagatctgccttgcatcgaaaacgtgacagaccatgatattagcatggaggagggggaaaagcgggaagaagaaaacggcacgaataccgctgaccatgtcaggaattccagctgggccaaaaacggatcctaccaaggagccctgcacaacgcctcagaagaggcgactgagcagaatatcagagctgggactcaggccgtcctccaggtgttcatcatcaatagcagcaacatcttcctgctagagcccgccaacgagattaagaatctcttggacgagcatacggatatgtgcaagagaattctcaatatttatcgttacatggtggttcaagtgagcatggataagaagacatgggagcaaatgttgctcgtcctcctgcgggtcaccgagtccgtgctgaaaatgccttcacaggccttcctgcagttccaggggaagaagaacatgacgctcgctggcagactggctgggcctctgtttcaaaccttaattgtggcttggattaaggccaatctgaacgtgtacatttcacgggagctgtgggacgacctgctcagtgtgttgagttccttaacatactgggaggagctggccaccgagtggtcattgactatggagacgttaaccaaggtgctggccaggaatctgtatagtctggacttgtcggatcttccactggacaaattgtcagaacagaagcagaagaaacataaaggaaaaggcgtcgggcacgagtttcaaaaagtgtccgtagacaagtccttttcgcgcggatggagtcgggatcaacctggccaagcccctatgagacaaagatctgccacaactacaggatcacccggcacggaaaaggcacgctctattgtgcgccaaaaaactgtggatattgatgacgctcagatcctgccccgctccacaagggtaaggcacttctctcagtcagaagagaccggaaacgaagtcttcggcgcgctgaatgaagagcagcctctcccaaggtcaagttctacctcagatatcctcgagcccttcaccgtcgaacgcgcgaaagtgaacaaagaagacatgagtcagaagcttccaccactcaactcagacatcggaggatcaagcgcgaacgtccctgatctcatggatgagtttatcgccgagcggctgcgatccggaaacgcaagcaccatgacacgcagaggcagttcaccaggaagcctggaaattcccaaagacctgcctgatattctgaataagcagaatcagatgaggcctatcgacgacccgggcgtcccctccgagtggacttctcctgcaagcgccgggagcagcgacctgatctcatcggattcgcactccgacagtttctccgctttccagtacgatggacggaaattcgacaatttcggctttgggactgacaccggagtaacgagtagtgccgacgtcgactctggatccggacaccaccaatccgccgaggaacaggaggtggcaagtttgaccaccctccatatagattcagagactagcagcttgaatcaacaggccttcagtgcggaagtggccaccatcacaggatccgaaagtgcatcgccagtgcactccccactgggctcacggtcccagaccccaagtccaagcaccctgaatatagaccatatggagcagaaggacttacagctggacgaaaaactgcaccacagcgtcctgcagacgcccgacgacctggagattagcgaatttccatccgagtgctgttcggtaatggccggcggaaccttaactgggtggcacgctgacgtggccaccgtcatgtggcggagaatgctcggcatactcggagacgtaaattcaatcatggatccagagattcacgctcaggtgtttgactatttgtgcgagttatggcagaacctggccaaaatacgggacaacctcggcatctctactgacaatctcacatccccctcccctccagtccttattcctcctttgagaatcctaaccccctggctgtttaaggcaaccatgcttacagataaatacaagcaaggcaaacttcatgcctacaagctaatttgcaacacgatgaagcgccgccaggatgtctctcctaacagagacttcctcacacacttctataacattatgcattgcggcctgctacacatcgatcaggacattgtgaatactataataaagcattgcagtcctcagtttttctccctgggactgccgggggcgactatgctgataatggatttcattgtggctgccgggcgagtagcttcgtccgccttcctgaatgctccgcgcgtcgaagcgcaggtgctgctgggctccctggtctgctttcccaatctttactgtgagcttccgtcactccaccccaacatcccagacgttgctgtttcccaattcactgacgtgaaagaactgattatcaaaacagttctgtcctccgcacgcgacgaaccttccggacctgcccgctgtgtggccctttgcagtctgggaatttggatctgtgaggaacttgtccacgagtcgcaccatccacaaatcaaggaggccctgaatgttatctgtgtcagcctgaagtttacaaataagactgtagcacacgtggcctgcaacatgctgcatatgctggtccactatgtacctaggctgcagatctaccagcctgactctcctttaaagataatacagattcttatcgcaacaattacacacttgttacccagcaccgaggcgagctcctacgaaatggataaacgtctcgtcgtgagcctgctgctgtgcctattagattggattatggctctgcccctaaaaactctcctacagcccttccacgcgaccggagccgagagcgataagactgagaagtctgtgctgaactgtatctacaaggtcctgcacggatgtgtgtacggggctcagtgcttcagcaatccccgctattttccaatgtcactgagcgaccttgccagcgtggactacgatccttttatgcatctggagtcactcaaggaacccgaaccattacattcccctgatagtgaaaggtcatccaagctgcaaccggtcactgaagtaaagactcaaatgcagcacggactgatctccatcgcagcccggaccgtcatcactcatctcgtcaatcacctgggccattaccccatgagtggtggcccagccatgttaacatcccaggtctgcgaaaatcatgataatcactactcagagagcacagaactgtcaccagagttgttcgaatcaccaaatatccagtttttcgtgctcaacaacacaacactggtttcatgcattcagatcaggtcagaggagaatatgccgggtggcgggctcagcgcaggcctggctagcgccaactcgaatgtgagaattatcgtacgggatctgtctggcaagtactcatgggattctgccatcttgtatgggccccctccagtcagcggactcagtgagcctactagtttcatgctgtctctgtctcatcaggaaaagccggaagagcccccaacttccaacgaatgtctggaggacattactgttaaagatggactgtcattacagtttaagcgttttagagaaaccgtccccacgtgggatactatccgggatgaagaagacgttctcgacgaactattacagtatctcggagtgaccagccctgaatgcctccagcggaccggtatctctctgaacattccagcacctcaacctgtctgtattagcgagaagcaagagaatgatgtgatcaatgccatcctcaagcaacacacagaggagaaggagtttgtcgaaaaacacttcaacgatctgaacatgaaagccgtggaacaggacgaacccattccccagaaacctcagtctgcattctactattgcagattgttgctgagtattctgggaatgaacagttgggacaaacgacggagcttccacctcctcaaaaaaaatgaaaaactgcttcgcgaactcaggaacctggatagccgccagtgcagggaaactcacaaaatagccgttttctacgtagccgagggccaagaggataaacatagcattctcactaacaccggcggaagccaagcctacgaagacttcgtggctggtctcggttgggaggtgaacctgaccaaccactgcggcttcatggggggacttcaaaagaacaagtcaaccggactgaccaccccttatttcgcgacttcaactgtcgaagtgatcttccatgtaagtacaaggatgccctctgatagtgacgattcccttaccaaaaaattgaggcatctgggtaatgacgaggtgcatattgtgtggtccgagcatacaagagactacagaagaggcataattccgactgaatttggcgacgtgctgatcgtgatttatcctatgaagaatcatatgttcagtatccagattatgaaaaaacccgaggtcccttttttcgggccccttttcgatggggcaatagttaacgggaaggtgctccccatcatggtccgagccaccgccattaacgcttcccgggccctgaagtctctcatacctctgtatcaaaatttttatgaggagcgcgctcgttacctgcaaacgatcgtgcagcaccatctggaacccaccacttttgaggacttcgccgcccaggttttctcaccagctccataccaccatctaccctctgatgccgatcactag

SEQ ID NO: 202447 - DNA, 6252 bp, Artificial Sequence
  Description of Artificial Sequence: Synthetic coding sequence
atgttcagcaagaagccccacggcgacgtgaagaagagcacccagaaagtgctggacacaaaaaaagatgcgttgactcgtttgaagcacctgcgaattgtgattgagaacgccgagtctatagacctgaagcaattcttcgaccagcatttctctcatatctattacgtctttttcgagaactttgtcaccatagaggctagtctcaaacagaaaggacacaagtctcagagggaggagcttgatgctattctgtttatttttgaaaaaatactgcaactactgcccgaaaggatccaccagagatggcaatttcacagtataggactcatcttgaaaaagctcttgcataccggtaactcattgaagattcggcgagaaggggttcgactcttcctgctgtggctacaagcattacaaaacaactgtagcaaggagcagttatggatgttcagttgcttgatacctggctttagtgctccgcagtccgagcatggaccacgcaccctggataacctaatcaaccccccattaaacctacaggaaacccaggtgaccatagaggaaataacacctttagtccccccccaatcaggcgataagggacaagaagacctgacttcctacttcctcgaggctctgcttaaatatattgtgattcaggttaagagcctggagtggaagaacaaggaaaatcaagaacgcggtttctcatttctcttctcccatttcaagaagtattatctcccttatatattcccaaacatctgtaaggagaactcactttatcaccctattttggatattccgcagatgcgcccaaagccacactacgtcgtcatcaaaaaggacgcagaaaccaacgaagctatttactgcaccaaagagccattcatcaaggcgcgagtgatcgtgattcgatggctggtgtccttctggctggaacccaagcctcatactggaccacacatccccggcatggagggtgaggttcttcccaaaaatattcagcgagcggccgcatccctggtgagtcgcgaagaatccaagaatgataatgccgataagactgaccggaccaccgaacccgaacagagtcactccaacaccagtactctgaccgaacgcgaaccatcgtcatcttccctctgttccatagacgaagagcacctcacggacattgagattgtgcgccgggtgttctcctcgaagcggagcaacgtgaacttcgtgactgaaattttcagacaggcattcttgctgcctatttgcgaagccgcagccatgcgtaaagttgtgaaggtctatcaggaatggatccagcaggaggagaagcctctctttatgcaggagcctgaggagattgtgattacgtcctccgatctgccttgtatcgaaaacgtaactgatcatgatatttcaatggaggagggagagaaacgggaggaagagaatggcactaacaccgccgatcatgtgcgaaactcgagttgggccaagaacggctcatatcagggcgccttacataacgcgtccgaggaggcaacagaacagaacattagagctggcacacaggctgtcctccaggtgttcatcattaacagctcaaacatttttttgctggagccggccaatgagattaagaacctcctggacgaacacaccgatatgtgcaaaagaatcctgaacatttatcgctacatggtggtacaggtgagcatggacaaaaaaacctgggagcagatgctgttagttttgctccgcgttaccgagtccgtgctaaagatgccttcccaggcattcctgcagttccaggggaagaaaaatatgaccttagccggcaggctcgccggtcccctgtttcaaacactaattgtggcttggataaaagccaacctgaatgtctacatcagccgcgagctgtgggatgacctgttgagcgtactgagttctctgacctattgggaggaactggccactgaatggtccctcaccatggagaccctgactaaggtgctagcccgtaacttatactcactcgacctgtccgacctccccctcgacaagctaagcgagcagaagcagaaaaaacataaaggtaaaggggtggggcatgagttccagaaggtgtccgtggacaagtctttcagtcgagggtggtctcgggatcaacccggccaggcccctatgcggcagcgcagtgcgaccacgactggatctccagggaccgagaaggcgaggtccatagtgaggcaaaaaacggtggccatgcgcagtaggagtatcggggaatgtgcgctgcctagcgcatatatcaggtccgccaaatcagcccctgtccttattcacacttcaaaaccttttctgccggacatcgtgttaacccccctctctgacgagttgtcagacatagatgatgcccagattctgcccagaagtactagggtgcggcacttttcccaatccgaggaaaccggcaacgaagtcttcggagccttaaacgaggagcaacccctcccgcgtagctcaagtacgtcggatatacttgaacccttcactgtggagcgggctaaggtgaataaagaagacatgtctcagaaactgccacctctgaactctgatattgggggcagttccgctaatgtgcccgacctcatggacgaattcattgccgagcggctacgttccgggaacgcctctacaatgacgagacggggcagcagcccagggtcactcgagatccccaaagacctacccgacatcctaaataagcaaaaccaaatgaggcccattgatgatcccggtgtgccctctgagtggaccagccccgcatccgcaggttcctcagacttgatttcgagtgacagtcattctgactcttttagtgccttccagtacgacggacgtaaattcgataactttggcttcggtacggataccggggtgacttcgtccgctgacgtggacagcggctcgggacaccaccagtcggctgaggaacaggaagtggcctccctgactaccttgcacatagactcggaaaccagcagtttgaatcagcaagccttctccgctgaggtcgccactataactgggtctgagagcgcttcacccgtccatagtccgcttggcagccggtctcaaacccccagcccctcaacactgaatatcgatcatatggagcagaaggatctccaacttgacgaaaaactgcaccacagtgtactccagactcctgacgacctggaaatatcagaattcccttcagagtgctgctctgtgatggcaggggggactctcaccggatggcatgccgatgtggctaccgtgatgtggaggaggatgcttggcatactcggggatgttaatagcattatggatcccgagattcacgcccaggtgtttgattacctgtgcgagttgtggcagaacctggccaagatcagggataacctggggattagcactgataatttgacatcaccttccccaccagtgttaattcccccattgagaatcctgacgccttggctctttaaagccacaatgctgacagataagtataagcagggaaagttgcacgcctacaaactgatttgcaacacaatgaaaaggagacaggatgtgtctccaaatcgggatttcctgacacatttttataatatcatgcactgcggtctactgcacatagatcaagacattgttaacactatcatcaaacattgttccccgcagttttttagtctgggactcccgggggccacaatgcttattatggatttcattgttgccgctgggagggtggcctcttccgctttcctgaatgcacctcgcgtggaggcccaggtgctcctcggttcactagtgtgttttcccaacctctactgtgaactcccctctctccaccctaatattccggacgtcgccgtgtctcaattcaccgacgttaaagagctgattatcaagactgtgttgtcctcagcacgggacgagccgtccgggccggcccgctgcgttgccctatgttcactcggtatctggatctgcgaggagttggttcatgaatcccatcatcctcaaatcaaagaagctctcaacgtgatttgcgtttccctgaaattcacaaataagacagttgcacacgtggcttgcaacatgctccatatgctggttcattacgttccaaggttgcagatctaccagcccgactctccactcaagatcatacagatccttatagctactatcacgcatctgctgccttcaactgaggcctcttcctacgagatggataaacggcttgtggtttctctgctgctatgcttgctggattggatcatggcattgccactcaaaactctcctgcaacccttccacgcgaccggcgcagagagtgacaagacagagaagagtgtcctgaactgtatctacaaggtgctccacggctgcgtatatggcgcgcaatgctttagtaaccccaggtactttcccatgtcgctgagcgatctggcctcggtggactacgatcctttcatgcatctggagtccttaaaggagcccgagcctcttcactctccagacagcgaacggagctccaaacttcagcctgttacggaggtcaagactcagatgcagcacggcttgattagcattgccgccaggactgttatcacccatttagtgaaccatctgggccactaccctatgagcgggggccctgcaatgttaacatcccaggtatgtgagaatcacgataaccattattctgagtctaccgagctcagtcccgaactgttcgagagtccaaacattcagttcttcgtgctgaacaatacaaccctcgtcagttgcatacaaatacggagcgaggagaatatgcccgggggcggcttatctgctggcttagctagcgcaaactctaacgtacggattattgtccgtgacctcagtggaaagtattcatgggatagcgctatcttgtatggacccccacctgtcagtggcctgtcagagcccaccagctttatgctctctctgtctcaccaggagaagcccgaagagccacctacgtctaatgagtgcctggaggatattacagttaaagatgggctctcgttgcaatttaagcggttcagggaaactgtacctacgtgggacacaatcagggatgaggaggatgtgctggacgagctgctacaatatctgggcgtcacttcgcctgagtgtctgcagcgcaccggaattagccttaacatcccagccccacaacccgtgtgtatttcagaaaaacaggaaaacgatgtaattaacgcaatcctgaaacagcatacagaggagaaggagttcgtcgagaaacacttcaatgacttaaacatgaaggctgtcgaacaggacgaacctattccgcaaaagccccagagtgctttttactactgtcggctgctcctcagtatcctcggaatgaattcttgggacaagaggaggtctttccatcttctcaagaaaaacgaaaagctgctgcgcgagctacggaatctggattcccgccagtgcagagagacccacaaaatagccgtgttttacgttgctgaaggccaggaggataagcactcaattctgacgaacacgggcggttctcaagcctatgaagactttgtggcaggcttgggttgggaggtcaacttaacaaaccactgtggctttatgggcgggctccagaagaacaagtcaactggattgacaactccatatttcgcaactagcacagttgaagtaattttccatgtttcgacacgcatgccaagcgactccgatgatagcttgactaaaaagctgcggcaccttggaaacgatgaggtacacatagtttggtcagaacatacacgtgactaccggcggggtatcattcccactgagttcggagatgtgctgatcgttatatacccaatgaagaatcacatgttttctattcagatcatgaagaagccagaggttccattctttggaccactgttcgacggcgcaatagtgaacggcaaagtacttccaattatggtcagagctaccgctatcaatgcaagtcgagccttaaagtcccttatccctctttaccagaatttctatgaagaacgcgctcggtatctgcagactattgtccagcatcacttggagcctacaacatttgaggattttgcagcccaggtcttcagtcccgccccctaccaccacctgccgtcagatgctgaccattag

SEQ ID NO: 202448 - DNA, 2169 bp, Artificial Sequence
  Description of Artificial Sequence: Synthetic coding sequence
cagatcctgatcgccaccatcacccacctgctgcccagcaccgaggcatcgtcctacgagatggacaaacggctggtggtctctctattactatgcttgctcgactggatcatggctctgcctctgaagaccttgctccagccgttccatgcaacaggggcagaatcagacaagacagaaaagagcgttttaaattgtatttataaggttctacacggctgcgtgtatggagctcagtgcttttcgaatcctcgctactttccgatgagcttgagtgatctggcaagcgtggactatgatcccttcatgcaccttgagtccttgaaggaaccagagcctctacactcacctgacagcgagagatcctctaagcttcaaccggtgacagaggtgaagacccaaatgcagcacggactcatatccatcgccgcccggaccgtaatcacccatttggtaaaccacttaggacactaccccatgtctggtgggcccgctatgttgacctctcaggtctgtgagaaccacgataaccactactctgagagtacagagctgagccctgaactctttgaaagtcccaatatccaattctttgtcttgaataacacaaccctggtctcctgtattcaaatccggtcagaggagaacatgcccggcggcggcctttctgccgggttggcctcagccaacagcaacgtacgtatcatcgtccgagacctctctggtaaatactcctgggactcagccatcctgtatggcccgccacccgtttccgggctctcagagcctacctcttttatgcttagcctgtcacaccaggagaagccggaagaaccgccaacaagtaatgaatgtctggaagacatcacggtaaaggacggactgtccctccaatttaaaagatttagagaaacagttcccacctgggacactatccgcgacgaggaagacgtgcttgacgagctgctccagtatctgggtgtgacgtctccggagtgtttgcaaagaacaggaatctccttaaacatccctgcaccccagcccgtgtgcatatccgagaagcaagaaaatgacgtgatcaacgctatccttaagcagcatactgaggaaaaggaatttgtcgaaaagcattttaacgatctgaatatgaaagcagtggaacaggatgagccaataccccaaaagccacaaagcgccttctactattgcaggttgctcttgagcattttaggcatgaacagctgggataaacggagaagctttcacttactcaagaagaatgaaaagctactgcgggaactgcgaaatctggatagccgccaatgccgtgaaacgcacaaaattgcggttttctatgtagcagagggccaggaagataaacactcaattctgaccaataccggtggttctcaggcatatgaagactttgtggcagggctgggttgggaagttaatctcaccaatcattgtggtttcatgggcggattacagaagaacaaatctacaggcctgaccacaccctacttcgcaacgtcgacagtggaggtgatctttcatgtgagcactagaatgccatctgatagcgacgattctctgaccaagaaactgaggcaccttggcaacgacgaggtccacatcgtgtggtcagaacacacccgggactaccgccgcggcatcattccaacggagttcggagacgttttaatagtgatttatcccatgaagaatcacatgtttagcatccaaatcatgaaaaagccagaggtgccctttttcgggccactcttcgatggcgctattgtcaacggcaaggttctgccaattatggtgcgtgcaaccgctatcaatgctagccgggctctcaagagtctgattcccctctaccagaacttttacgaggagagagcaaggtacctgcagaccattgtccaacaccaccttgagcctaccacattcgaggattttgcggctcaggtcttttcccctgccccatatcatcatctgccctccgacgctgttggatcctaccccgagattcttccttcagagacccccaccgccacacaggtggatggagcagatctggcatctccaatgtccccccgcacttctaagtctcggatgtccatgaaactgcgacgttcgagcggcagcgcgaacaagtcctag

SEQ ID NO: 202449 - DNA, 2709 bp, Artificial Sequence
  Description of Artificial Sequence: Synthetic coding sequence
atggtgcagcggatgtgggccgaggccgccggccccgccggcggcgcagaaccgctcttcccaggttcccgaaggagtagatccgtttgggatgcggtgcgccttgaagtcggtgtgccggattcttgtcctgtggtcctgcactcatttacacagctggatcccgatctgccaagacccgaatcgtctactcaagaaattggagaagaattgataaacggggtgatctactccataagcctacgaaaggtgcaactccatcatggcggcaacaaaggtcagcgatggctcggatacgagaatgagagtgccctgaacctgtatgagacctgcaaggtccggaccgtgaaggcgggaacacttgaaaaactggtcgagcacctagttcccgcatttcaaggctccgacctgagttacgtgactatctttctgtgtacctatagagctttcaccaccactcagcaggtgctcgaccttctctttaaacgatatggatgcattctcccttactcagatgaagacggaggtcctcaggaccagcttaaaaacgcaattagtagcatcctgggcacctggctagatcaatacagtgaggacttctgccagccacccgactttccatgtctaaagcaactggttgcctacgtccagctaaatatgccaggaagtgatttggagagaagggcacacctcctgctggcccagctggaacactccgaaccaattgaggccgagccagaggcactcagtcccgtaccagccctcaagcctactccggagctggagctggcactgacacccgctagagctccttccccagtccctgcgcccgctcctgagcccgaaccggcacctacccccgcaccaggctctgaattggaggtcgcgccggccccagcgccagagctgcagcaagcaccagagccggcagtgggtttagagagcgcaccggcccctgctctcgaactagagcccgcccccgagcaggatcccgccccttcccaaactttagaactagagccagccccagccccagtcccctctttgcagccctcctggccatctcccgtggtagcggagaacgggctgtccgaggagaagcctcatctgctcgtgttccccccagacttggtagccgagcagttcaccctgatggacgcagaactttttaaaaaggttgtgccctaccattgccttggatccatatggtcccaacgtgacaaaaaaggcaaggagcacctagccccaactattcgagcaacggtgacacagtttaacagtgttgccaattgtgtaattacgacctgcctaggcaacagatctaccaaggcacccgaccgcgcgcgagtggtggaacattggattgaggtggctcgggaatgtcggatcttgaagaatttctcctccctctacgccatcttgtctgctctgcagtctaatagcatccatcgccttaaaaaaacatgggaagacgtctcacgggactcttttaggattttccagaaattaagtgaaattttttccgacgaaaataattactccctgtccagggagctgctcattaaagaaggcacctccaagttcgccacgttagaaatgaacccaaaaagggcacagaagagaccaaaagagacaggtatcatccagggaactgtgccttatctggggacatttctgactgatctggttatgctggacaccgctatgaaagactatctttacggaagacttatcaatttcgaaaaaaggagaaaggaatttgaagtcatcgcccaaatcaaactgctccagtccgcttgtaataactacagcatcgcacccgacgagcaatttggagcttggtttagggccgtggaaagactgtccgagactgaatcctataacttatcttgcgaactagagcctccaagtgagagtgccagcaacacactccgtactaagaagaacactgccattgtgaagcgctggtccgataggcaggcacctagcactgaactctctaccagcggctcctcgcacagcaaaagttgcgaccagcttaggtgcggaccatatctgagctccggcgacatagccgacgcgctttccgtgcatagcgctggcagttctagttccgacgtggaggagatcaacatcagcttcgtgcctgagtcccccgatggccaggagaagaagttctgggagtctgcttctcagtctagtcccgagacatccggtatcagcagcgcatcttcttctaccagttccagtagcgcaagcactactccagttgctgcaaccagaacccacaagagatctgtgagcgggctatgcaattcttccagcgccctgccgctttataaccaacaggttggcgattgttgcataattcgcgtctctcttgatgtagataatggcaatatgtacaaatccattctggtcaccagccaagataaagcaccagccgttatcagaaaggcaatggataagcacaacctcgaggaggaggaacctgaggactatgagctcctccagatcctcagcgacgacagaaagctgaagattcccgagaatgctaacgtcttctatgcgatgaactctacagccaattacgactttgtgctcaaaaagcgtaccttcacaaagggtgttaaggtgaaacatggcgcttccagcacattacctaggatgaaacagaagggcctgaagatcgcgaagggtatcttctag

SEQ ID NO: 202450 - DNA, 2745 bp, Artificial Sequence
  Description of Artificial Sequence: Synthetic coding sequence
atggtgcagcggatgtgggccgaggccgccggccccgccggcggcgcagaacctctgtttcctggaagtcgacggtcacgatctgtgtgggatgccgtccgcctggaggtgggcgtgcctgattcctgcccagtggtgttacactccttcacacagctggaccctgatctgccgaggcctgaaagcagcactcaggagattggagaagaactaataaacggcgtgatatacagtatctcactgcgaaaggtgcagctccaccacggcggaaataaaggtcagcgctggctcgggtatgagaacgagagtgccctgaacctttacgagacgtgtaaggtgcggactgtcaaagcaggtacactcgagaagttggtggaacatcttgtcccggccttccagggttccgatctgagctacgttacgatatttttgtgtacgtatagagcctttacgacgacgcagcaggtcctagacttgctgttcaaacggtatggaaggtgcgatgcacttaccgcctcctccagatatggctgtattctgccctatagcgacgaagacggcgggcctcaagatcagttaaaaaacgcgatatcaagcatactggggacctggcttgaccaatattccgaggatttttgtcagccccccgatttcccttgccttaaacaactagtcgcttacgttcagttgaacatgccagggtctgacctggaaaggcgcgcgcatctcctgttggcacaactggagcatagcgaaccaattgaagccgaacctgaggccctgtctcccgtgcccgccctaaaacctacccctgaactcgagttagctcttacacctgctagagcgccaagtcctgtcccagcccccgcccccgaacccgaacctgcgcccactcctgcgcctggtagcgaactggaagtcgccccagcaccagcccccgagctccagcaggcacctgaaccggccgttggcttagagtccgccccagcccccgcgctggagttagaacccgcgcccgagcaggacccggcacccagccagactttggagctggagcccgctccggcgcccgtccctagtctgcaaccttcctggccctctcctgtggtcgccgagaatgggttgtccgaagaaaagccacatctgttagtgttcccccccgatctcgttgccgagcaattcaccctaatggacgcggagctgtttaagaaggtagtcccgtaccactgtctgggctcaatctggtcccagagggataagaagggtaaagagcatctagcccctacgatcagagccacagttacccaattcaattctgtcgccaactgcgtcattactacttgcttagggaaccgcagtaccaaagctccagatcgggctcgcgtagttgaacattggatcgaagtcgccagagaatgccggatcctcaaaaattttagttccctatatgccatcctgtccgctctccagtccaacagcatccataggttgaagaagacatgggaggatgtctcccgtgattcattcagaatttttcagaaactttctgagattttcagcgacgagaacaattactcactctctcgggagctgctgattaaggaagggaccagtaaatttgctacgctggagatgaatcccaaacgcgcacagaagagaccgaaagaaacagggattatacagggcaccgttccttatctggggactttcctgaccgatctggtcatgctggacaccgccatgaaggattatctctatggacgcctgatcaatttcgaaaaacggcgtaaggagtttgaagtcattgcacaaattaagctgctgcaatctgcctgcaacaattactccatagcgccggatgagcaattcggtgcctggttccgcgctgtcgaacggctttcagaaaccgaatcttacaacctcagctgtgagttggagcccccgtccgagagtgcatcgaatactctccgtacaaaaaagaatactgccattgtgaagcgatggtccgaccgccaggcaccctccacagaacttagcaccagcgggtccagtcatagcaaaagctgtgaccaactgcgctgcggaccctaccttagcagcggcgatatcgccgatgccctatctgtccattccgccggatcctcgtcaagcgacgtggaggagatcaacatctcattcgtgccggaaagccctgacggccaggaaaaaaagttttgggaatcggcctctcaatctagccccgaaactagcggtatctctagcgcatcctcttcaacttcctcttcctctgcttcaactacacccgtcgccgccacacgaacccacaaacgatccgtgtcaggattatgtaactcttctagtgcattacccttatacaatcagcaggtgggcgactgttgtatcatccgtgtcagcctggacgtggataacgggaatatgtataagagcattctcgtgacgtctcaggataaggcgcctgcagtcatacgcaaggctatggacaagcataatctcgaagaagaggagcctgaagattatgagctcctgcagatcctgtcagatgacaggaaactgaaaatccctgagaacgctaatgtgttctacgcgatgaatagcacagccaattatgattttgtgttgaagaaacgtaccttcactaaaggagtcaaagtgaaacacggagcctctagtaccctgccccggatgaagcagaaaggactcaagatcgcaaagggcattttctag

SEQ ID NO: 202451 - DNA, 1341 bp, Artificial Sequence
  Description of Artificial Sequence: Synthetic coding sequence
atgcccggcagcgacctggagcggcgggcccacctgctgctggcccagttagagcactccgagccgatcgaagccgaacccgaagcactgagtcctgtccctgccctgaagcctactcctgagcttgagttggcgctcaccccagctagagccccaagcccagttcccgcccctgccccagagcccgaaccagcacccactccggcacctggttctgaactagaagttgcacccgcccccgctcctgagctgcaacaagcccccgaaccagcggtcggtcttgaatcagcacctgcaccggccctggaattagaacctgctcctgagcaagaccccgccccttcccaaaccctcgagctggagcctgctcccgctcccgtgccaagtttgcaaccctcttggcccagtcctgttgttgccgaaaacggactgagcgaggagaagccgcatctgctagtgtttcctcccgacttagtggccgagcagttcacacttatggacgcagaatgtcggatcttaaaaaatttctccagcctgtacgctatcttgagcgcactccagtccaacagtattcacaggctgaagaagacctgggaagatgtctcacgcgactcttttaggatttttcagaagctgtccgagatcttttctgacgaaaacaattattctctgagccgggagctgctgatcaaggagggcacatcaaagtttgcgaccctggagatgaacccaaagcgtgcccagaagaggcccaaggaaaccggcattatccagggaaccgtaccttatctgggcacctttctgacagatctagtgatgctggacacagccatgaaggactacctgtacgggaggctaattaattttgagaagcggcggaaggaattcgaggtgattgcccaaataaagctgctgcaatctgcttgtaacaactacagcatcgctcccgatgaacagtttggagcatggtttcgggccgtcgaacgcttgtccgagactgagtcgtataatctgagttgcgaattagaacctccctctgaatccgcgagtaacacattgaggacgaagaagaatacagccatcgttaaacgctggagcgacaggcaagctccctctacagagctgagcacctcaggttccagccacagcaaatcatgcgaccaactgcggtgcggtccatacctctcatcaggggacattgcggatgccttaagcgtccactcagctggctcctcttcctccgatgtggaagagatcaacatctcctttgtcccagagtccccagacggacaggagaaaaagttctgggaaagcgcttcacagtcgtcccctgagacatag

SEQ ID NO: 202452 - DNA, 2658 bp, Artificial Sequence
  Description of Artificial Sequence: Synthetic coding sequence
atgtgcctgtggggccacagcaccgcccccgcccacaccctgagcagcccccctctcctcttctgtagtttaccctgtgccctgcatctgcagcccggtactggccacccacctggacaggttcctcggaagtcatccacgcaggaaatcggcgaagagctaattaacggcgtcatttactccatttccctacgtaaggtgcagctccatcatggcggcaacaagggccagcggtggctgggctacgagaacgaatctgcactgaacctctacgaaacatgcaaagtgaggaccgttaaggcaggcacgctggagaagctggtggagcatttggttcccgcttttcagggaagcgatttgagctacgttacaatttttctgtgtacctacagggctttcaccaccactcagcaggtgctagatctgctgttcaagagatatggctgcatactgccatatagcgacgaagatggaggccctcaagatcagttaaagaacgccattagcagtattctgggcacctggctcgaccagtactccgaggacttttgtcagccccctgattttccttgcctgaagcagctggtagcctacgttcagttaaatatgcctggctccgatcttgagagaagagcccatctcctgctggctcagctggaacacagcgagcctatagaggcagagcctgaggctctatccccagtcccggccttgaagccaacccccgaactcgagctagctttgacccccgccagggcaccgagtcccgtgccggcccctgcacctgagccggaaccggcgcccacaccagcacccggtagtgagttggaagttgcccctgcacccgcacctgagctccagcaagcaccagaacctgcagtaggcctggaaagcgcccctgctcccgcactggagctggaacccgcaccggaacaagatccggccccctctcagacactagagctggaacccgccccagctcctgtaccatctctccagccctcatggcccagtccagtcgtcgccgaaaacggcctctccgaggagaagccccacctgctcgtgttcccgccagatctggttgccgagcagttcaccctcatggacgctgagcttttcaaaaaggtggtaccataccactgcctggggagtatttggagccagcgcgataagaaagggaaggagcacttggccccaacaataagggctactgttacccagtttaacagcgtggctaactgtgtcattacaacctgtcttggcaaccgatcaaccaaggcgcccgacagagcacgtgttgtagagcactggattgaggttgctcgtgaatgcagaattcttaaaaatttctctagtctgtacgcaatcctctccgccctgcagtccaatagtatacacagacttaagaagacatgggaggacgtgagccgggatagctttagaatattccaaaaactcagcgagatattctcagacgagaacaactacagtctgtcccgcgagttgctgatcaaggaggggacttcaaaatttgctaccctggaaatgaatcctaaaagggctcagaagcgacccaaggaaacggggatcatacaggggacagtgccttaccttgggacgttcctcaccgatttggtgatgttggatactgcaatgaaagactatctgtatggccgattaatcaatttcgaaaagcgccgcaaagagtttgaagtgatcgcgcagattaagctgttacagtctgcctgcaacaactattccatagctcccgatgaacagttcggggcgtggttccgtgccgtggaaaggctgtccgagacggagagctataatctctcatgcgaactggaacctccttccgagagtgcttcaaacactctgaggaccaagaagaatactgctattgttaagagatggtccgatcgccaggcacccagtacagagctgtccacctctggaagcagccactccaagagttgtgatcagctgaggtgcggtccttacttgtcttcgggtgacatcgctgacgccctgagcgtacattctgcgggcagtagcagctcagacgtagaggaaataaacatcagctttgtccctgagagtccagatggtcaggagaaaaagttctgggaatcagcttcccaatcttcccctgagactagcggcatttcgtccgctagtagctccactagctcaagttccgcgtctacaaccccagtggctgcaactcgaacccataagcgatcagtgtcggggctctgtaattcttctagcgcactgccattatacaaccaacaggtcggggactgctgtatcattcgcgtgagtctcgacgtggataacggtaatatgtataaaagcattttggtcacatcacaggataaggccccggccgtgattcggaaagccatggacaagcacaacctggaggaggaggaacccgaggactacgaattgttacagattctgtccgacgaccggaagctgaagatcccagagaatgctaatgtattttacgctatgaactcaaccgcaaactatgatttcgtgttaaaaaagaggaccttcaccaagggtgtcaaggtgaagcacggtgccagcagcacgttaccccgcatgaaacagaagggcctgaagatcgctaaaggtattttctag

SEQ ID NO: 202453 - DNA, 2742 bp, Artificial Sequence
  Description of Artificial Sequence: Synthetic coding sequence
atggcccgggaggccggccaggtgtgcgcccggcccgccgtgccccggggacgcaaagggtctgttttcttcgcttgtgtgtccgtagtgactgcccggcggagggccgtggctcgccgcgctgccctgcagagcccaaccccctggctggccccgcttccggcccctgccacgacggagtcttctacccaggaaattggagaggaactgattaatggagtcatttactccatttcactgcgtaaggttcagcttcatcatggcgggaataaaggccagcggtggctggggtacgaaaacgaaagcgccctaaacttatacgagacctgtaaagttaggacagttaaagctgggactttggagaaattagttgagcacttagtccccgcctttcaggggagtgacctgtcctacgtgacgattttcctgtgtacctatcgtgcgttcaccacaacacagcaggtgctggatctcctatttaaacgctacgggcgatgtgatgcactgaccgcctctagccgttatgggtgtattctgccatattcggatgaggacgggggtcctcaggaccagttaaagaacgctatcagcagcattcttggtacatggctggatcagtattccgaagatttctgccagccgcctgacttcccctgtctcaagcagcttgttgcttatgtacagcttaacatgcccgggtctgatctggagcggcgagcacacttactgcttgcacagttggaacatagcgagccaatcgaagctgagccagaagctctctccccagtgcccgctctgaaacctacccctgaactggagttagctctgacccccgctagggcaccttctcccgtgccagcacccgcccctgaacccgaacccgccccgacaccagctcccgggtccgagctggaggtggcaccagcgccagcgcccgagctacaacaagctccggagcctgctgtgggactcgaatctgcccccgcacccgccctggagctcgaaccagcgcctgaacaagacccagccccgagtcagaccctcgagctggagcccgcgcccgccccagtcccgagcctgcaaccaagttggccttcaccagtggtggcagagaatgggttaagcgaagaaaagccccacctgctcgtctttccccctgacctggttgcagagcagttcaccctcatggacgcggaactttttaaaaaggtggtcccctatcactgtctgggttcaatctggtctcagagagataaaaagggcaaagaacacctcgccccaacaatccgagcgaccgtgactcaatttaacagcgtcgctaattgtgtgattacaacatgtctcggaaacagaagcacaaaagcgcctgaccgtgctcgggtcgtcgagcattggatcgaggttgctcgcgagtgtcgaatcctgaaaaatttttcctctctgtatgcgatcctgagtgctctccagagcaactcgatccataggctcaagaagacgtgggaagacgtgtcacgagatagctttcgcatcttccaaaagctgagcgagatctttagcgacgaaaataactatagcctttctcgagaactcttaataaaagaggggaccagtaaattcgcgacactggagatgaacccaaagcgagcacaaaagcggccaaaggaaaccggtataattcaaggcacggtgccgtacctggggacatttttgaccgaccttgttatgctggacaccgcaatgaaggactacctctatgggaggctgatcaacttcgaaaagcgcaggaaggagtttgaagtaatagcccagattaaactgctccagagcgcttgcaacaactattcgatcgccccagatgaacaatttggggcttggtttagggcagtagagagactgtccgagacggagtcatacaatctgtcttgcgaacttgaacccccttcagaatccgcgagcaataccctgagaaccaaaaaaaatactgctatcgttaagaggtggtcagataggcaggccccgtccaccgagctctcaacatcagggtcttcgcattcaaagtcatgcgaccagttaaggtgtgggccctacttaagcagtggggacatcgccgatgcattgagcgtgcacagcgcaggttcaagctcttcagacgttgaggaaattaatattagctttgtccccgagtctcccgatggtcaggaaaaaaagttttgggaatctgcgtcccaatcaagtcccgagactagtggtatatcatccgcttcatccagcacgagcagctctagcgcctctaccacgcctgtggcagcaactcgaacacacaaacggagcgtgtccggcctgtgcaattccagttccgcactgccactttacaatcaacaagtgggcgattgctgtatcatacgggtctccttggatgtggacaatggaaatatgtacaaatctatcctcgtaacctcccaggataaagctcccgccgtgatcagaaaggcaatggacaagcacaaccttgaggaggaagagcccgaagactatgagctcttacagatcctgtctgacgatcgtaaactgaagatccctgaaaatgcaaatgtgttttatgccatgaatagcactgccaattacgatttcgtgctgaagaaaaggacatttactaagggtgttaaggtgaagcacggagctagctcaacactcccgcggatgaagcagaagggcctgaagattgctaaaggaatattctag

SEQ ID NO: 202454 - DNA, 2580 bp, Artificial Sequence
  Description of Artificial Sequence: Synthetic coding sequence
atgatggtggactgccagagcagcacccaggagatcggcgaggagctcattaacggagtgatctactccatctccctgcgcaaggtgcagcttcaccacgggggtaataaggggcagcggtggctgggttacgaaaatgagtccgcgctcaatctctatgagacttgtaaagtgagaaccgtcaaggctggtaccctggaaaagctggtggaacacctcgtgccagctttccaaggctccgacctgtcttacgtcaccatcttcctgtgcacctatcgggcatttacaactactcaacaggtcctcgacctgctgtttaagcggtatgggaggtgtgacgccctcaccgcctcaagcaggtatgggtgtatcctcccatatagcgatgaggacggaggaccccaagaccagctcaaaaacgccatttcctctatcctggggacctggcttgatcaatactcagaggatttttgtcagccccctgactttccctgcctcaagcagctcgtcgcttatgttcaattaaatatgcctgggtctgacctcgaaaggcgagcgcacttactcttggcgcagctggagcactctgaacccatagaagccgagcccgaggctctgtcgcctgtgcctgcattgaaaccaacccccgagctggagttggctctcactcccgccagagcaccgtcccccgtccccgctcccgccccagaacctgagcctgccccaacgccagcacctggcagcgagctcgaagtagcacccgccccggcaccggaactccagcaggcaccggagccagccgttggtctcgagagtgcaccagcccccgccctggagttggaacctgcccctgagcaggatcccgcaccatcccagacacttgagctggaacctgcccccgctccggttcctagcttgcagccatcatggccatcccccgttgtcgccgaaaacggactcagcgaagaaaaacctcacctgctcgtgtttcccccggacttagtcgctgagcagttcacattgatggatgccgaactgttcaagaaagtggtcccttaccactgtctcgggtccatctggtctcaaagagataagaaaggaaaggagcacctcgctccaaccatacgagccactgtgactcagtttaatagcgttgccaattgtgttattacgacatgcctgggtaaccggtcgaccaaggccccagatagggcaagagtcgttgagcactggattgaggtcgcacgggagtgccggattctcaagaactttagctctctgtacgccattctgtcagccctacagtcaaatagtattcaccgactcaaaaagacatgggaagatgtgtcaagagactcctttcggatattccaaaagttgtccgagattttcagcgatgagaataattattccctgtctagagaactgctgattaaggaggggactagcaagttcgccaccctagaaatgaaccccaagagggcccagaaacgccctaaagaaaccggaatcatccagggaacagttccctacctgggcacattcttaacagatctggttatgttagacacggccatgaaagactatttatacggacgactgataaactttgagaaaaggcgaaaagaattcgaagtcattgcccagatcaagctgttgcaaagtgcttgcaataactactcgatcgccccagatgagcagttcggcgcttggtttcgggctgtggagaggttatccgagaccgaaagttataatctgagttgcgaactcgagccaccttcggagtctgctagtaacacgcttcgcactaagaagaacactgccattgtaaagcgctggtcagataggcaggcacccagcactgagctgtcgacctccggatcctcccatagcaaaagctgtgaccagttacggtgtggaccgtatctatcaagcggggatattgcggatgcactctctgtccactctgccggttcatcgtcctctgatgtggaggagatcaacatttcatttgttccagaatccccagatggacaagaaaagaagttctgggagtcagcttcccagtcctcacctgagaccagtggcatcagtagcgctagctcttcgacgtcctcatcatcagcgagcaccacgccagtggctgccacacgcactcacaagcgatccgtgtcagggctctgtaactcatcctctgctctccctctgtataaccagcaggtaggggactgctgcataatccgagtgagtctcgacgtcgacaatgggaatatgtacaaatctatcctggttacctctcaggacaaggccccagccgtcattaggaaagccatggataaacacaatctggaggaggaagagcccgaggactacgaattgttacagattttgtccgacgacaggaagctaaagattcctgaaaacgcgaacgtgttttatgccatgaacagtacagccaactacgatttcgtgctgaaaaaacgcacatttactaagggagttaaagttaagcacggggcctccagcactctgccaagaatgaagcaaaagggtctgaaaattgctaaggggattttctag

SEQ ID NO: 202455 - DNA, 930 bp, Artificial Sequence
  Description of Artificial Sequence: Synthetic coding sequence
gtggtggccgagaacggcctgagcgaggagaagccccacctgctggtgtttcccccagatctcgtcgctgagcagtttacactcatggatgccgaatgtagaatcctcaagaatttttcgagtctgtacgccatattgagcgccctgcagagtaacagcatccacaggctcaagaagacctgggaggacgtatctcgtgactcctttaggatctttcagaagctgtctgaaatattttccgacgagaataattacagcctttcgagggagcttttgatcaaggagggcacatcgaaattcgctacactcgaaatgaatccaaaaagagcacagaagagaccgaaagagactggaatcatccagggaacggtaccctacttagggacctttttgactgacctggtcatgctggacacggcaatgaaagactacctttacggtcggctgatcaacttcgaaaagagacggaaagagttcgaggtcatagcacagattaagctgctccaaagcgcctgtaataattatagcattgcccctgatgagcagttcggtgcctggtttcgggccgtggaacgcctgtccgagaccgaatcctacaaccttagctgtgaactggagcctccatccgaaagtgccagtaatacactcagaacaaaaaagaacaccgctatagtgaaaaggtggtcagacaggcaagcccccagtacggagctgtctacctcagggtcctcacactcgaaaagttgtgatcagctgaggtgcggaccctatctgtcctccggagacatcgctgatgcattgagcgtacattccgcggggagctcttcaagcgacgttgaagagattaacatcagctttgttccagagtccccagatgggcaagagaagaagttctgggaatccgcctcacagagtagccccgagacttag

SEQ ID NO: 202456 - DNA, 2958 bp, Artificial Sequence
  Description of Artificial Sequence: Synthetic coding sequence
atgcaccggcggcggctggccctgggcctgggcttctgcctgctggctggaacatccctgtctgtgttgtgggtctatcttgaaaactggctccctgtgagctatgtcccttattatctgccatgcccagagattctgccaatgatgatggcattgtcgtgcctgtgtcaccagcagcatgaagcagccctgcaagagggggaggccacccctgcacgggggatggtgacagtgcccagcgcacaggcagccggtgctcaagcacatactgctgccgatacccacacgctggtaggcgcacaccgcctgaggggtaacttacagcctagggcatcagccgcacacctgcctgcaaccgaacccgatcattggggacatggggtatgtcgaggcgagagcagtacacaggaaattggtgaggagctaattaacggcgtcatatattcaatcagtctcaggaaggtacagctgcatcacggcggcaacaaggggcagcgatggctgggatatgaaaatgaaagcgccttaaacctctacgagacctgtaaggtaagaactgtgaaagcaggcacactggagaagctggtagagcacttggttcctgctttccagggaagcgacttaagttatgtcactatctttctgtgcacttacagggccttcacgactactcagcaggttctagatcttctgttcaagcgctacggacggtgtgacgctctgaccgccagcagtcggtatggctgcatcctgccctacagcgatgaagatggtggacctcaggaccagctgaaaaatgcaatctcatcaatcctgggcacctggttagatcaatacagcgaggatttttgtcagcccccggactttccatgtttgaaacagttagttgcttacgtgcagctgaatatgcctggtagtgaccttgaaaggagggcacatctactgttggcccaactcgaacacagcgagccaatagaagccgaacccgaagccctgtcgcccgtgccggctcttaaacctacgcctgagctcgagttagcattgacgcctgcaagggccccaagcccagtgcccgcccccgctcccgaacccgagcctgcacctacaccagcccccgggtccgaacttgaagtcgccccagccccagcccccgaactgcagcaggccccagagccagcagtggggttggagtccgctcctgcaccagctctcgagcttgagcctgccccagaacaggacccagccccttcccaaacacttgagctggagcccgcacccgcccccgtcccgtcccttcagccttcttggcctagcccagttgtcgccgaaaacggtttgtccgaagaaaagccgcatttgttagtgtttcctccggacttggtggctgagcagttcaccttgatggacgccgagcttttcaaaaaggtggtgccatatcattgcctaggaagcatttggtcacagagagacaagaaaggcaaagaacacctagctcctacaatccgcgctaccgtaacccagtttaacagtgtggcaaactgtgtcatcaccacctgtctcggtaatcgcagcacaaaagccccagatcgcgctcgggtcgtagaacattggatcgaagtggcgcgagagtgccggatactaaaaaacttttccagcctctacgcaattctgtcggctctacaaagtaacagtattcataggctgaaaaagacgtgggaagacgtgagtagagatagcttccgaatcttccagaagctttctgagatttttagcgacgaaaataactatagcctcagccgggagcttctgataaaagaaggcacaagcaagtttgccaccctcgagatgaaccctaaacgcgcccagaagaggcccaaagagaccggcattatccagggaaccgtgccttatctcggcacgttcctaaccgacctggttatgctcgacaccgccatgaaagattacctgtatggaagactgatcaatttcgagaagagaagaaaagagttcgaagtgattgcacagataaaactgttacagtccgcatgcaacaactattctatcgcaccagacgaacagtttggcgcgtggtttcgggccgtcgagcggctatccgaaacagaatcctacaatctctcatgcgagttagagccaccatccgaatcggcttctaataccctgcgtaccaaaaagaatacagcaattgtcaagcgatggagcgatcgtcaggccccctccactgagctgtctacatccggttcatctcattccaaatcatgtgaccagctgagatgtgggccctacttgtcttctggagacattgcagacgcactcagcgtgcactctgccgggagctcatcaagtgacgtcgaggagatcaacatttcgttcgttcccgaaagccctgatgggcaagagaagaaattctgggagtcggcatcacagagctcaccagagacatctggcatctcttctgctagttccagcacatctagcagttccgcctctacaaccccggtggcagctacaaggacacacaagaggtctgtgagtggtctgtgtaattcctcatccgctcttcctctttataaccaacaggttggtgattgctgcatcatacgggtctccctcgatgtggacaacggcaatatgtacaagtccatccttgtaaccagccaggataaagctcccgctgtgatcaggaaggcaatggataagcataatcttgaagaagaggaaccggaagattacgaattgttacagatcctctctgatgaccgaaagctcaaaatcccagagaacgctaatgtcttctacgctatgaacagcaccgctaactatgacttcgtgcttaaaaaaagaacttttactaagggagtcaaggtcaaacacggagcctccagtacactgcctagaatgaagcagaagggcttgaagatcgccaaaggtattttttag

SEQ ID NO: 202457 - DNA, 2412 bp, Artificial Sequence
  Description of Artificial Sequence: Synthetic coding sequence
atggaggtgaagcccgtgggcgagcccacccaggaggtgagcaagtttaagctttccacaaaagtagagagcacgggccactggctcgtggaggatcacgtccggatttgggaggtcttgaaaactgaggagtcaagcattcaggattggggggaggaggtcgaggaaggggcagtgtatcatgtgactctgaagcgtgtgcagattcagcaggccgcgaataagggcgctcgatggctcggtgtggagggagaccagctgccccccggccacactgtcagccagtacgagacttgcaagataaggactattaaggctggtacattagaaaaattagtggagaacctgctgaccgcttttggagataatgatttcacttatatatcaatattcctgtctacctatcgcggcttcgcatcaactaaggaagtgctagaactgcttctagatcgttacggcaatctcacttccccgaactgcgaggaggatggaagccagagctccagcgagtcgaaaatggtgattcgcaatgcgattgcatccattcttagggcatggttggatcagtgtgcagaggactttcgcgaacctccccatttcccttgcctacaaaaactgctagactatttgactcgcatgatgccaggcagcgaccccgaacggcgggcccagaatttattggaacagtttcagaaacaagaggtggagaccgacaatggtttacccaacaccatctcattctccttagaagaggaggaggaattggaaggcggcgagagcgctgagttcacttgtttttcagaagatctcgtcgctgagcaactgacttatatggatgcgcagctgttcaagaaagttgtccctcaccactgcctgggatgcatctggagccgacgcgataagaaagagaacaagcacttggctcctaccatccgggcaacaatatctcaatttaatacactaactaagtgtgttgtgtccacaatcctcgggggcaaagagctgaagacacagcagcgggctaagatcatcgaaaagtggattaacattgcgcatgagtgtcgccttctgaagaatttctcctccctgcgcgccatcgtgagtgccctgcagtccaactccatctatcgtctcaaaaagacatgggcagctgtccctagggaccggatgcttatgtttgaggagctctctgacattttcagtgaccacaacaaccatctcaccagcagagaattgctgatgaaagaagggacttcgaagtttgctaacctcgacagctccgtgaaggagaaccagaagcgcacccagagacgcttgcagctccagaaggacatgggcgtcatgcagggcaccgtcccctacctggggacctttctgacagatctgaccatgctggacactgcacttcaggactacatagagggaggtctgattaatttcgagaagcggagacgcgaatttgaggttatagcccaaatcaaattgttgcagtccgcttgcaactcttactgcatgactcccgatcagaaatttatacagtggtttcagcgacagcaactgctgaccgaagaggaaagttatgctctgagctgcgaaatcgaggccgcagcagacgctagcactacgagtcccaagcctcggaaatccatggtgaagcgcctgtctctgctattcctagggtccgacatgattaccagtcctactccaacgaaagaacagcccaagtctaccgcgtctgggtcatctggcgaaagcatggacagcgtttccgtgtcatcctgcgagtccaaccactccgaagctgaagaggggtctattactccaatggacacacccgacgagccccaaaaaaagcttagcgaatcgtcaagtagctgtagttctatccattcaatggacacaaactcctctggtatgtcctccctcattaaccctctgtcatctccaccaagttgtaacaacaacccgaaaattcacaagaggtccgtgtctgtaacctcaattacaagcaccgtcctccccccggtgtacaaccagcagaacgaagacacatgtatcattcggataagcgtcgaagataacaacgggaacatgtataaatcaatcatgttaactagtcaggacaagactcctgctgtgatccagagagcaatgttgaaacacaacttggattcagatccagcggaagagtatgagctcgtgcaggtgattagcgaagataaggagctggtaatccctgattcagcaaacgtgttctacgccatgaactcacaagtgaatttcgacttcatcctcagaaaaaaaaattccatggaagaacaggtaaagctgagatcccgcacaagtttaacactgcccagaactgccaagcgcggctgctggtctaatcgacactcaaagatcacattatag

SEQ ID NO: 202458 - DNA, 2307 bp, Artificial Sequence
  Description of Artificial Sequence: Synthetic coding sequence
atgaagctgctgtggcaggccaagatgagcagcatccaggactggggagaagaggtcgaagagggggcggtgtatcatgtgacactaaaaagagtgcagatccagcaggccgccaataaaggagcaagatggctcggggtcgagggcgaccagctcccacccggccacaccgtaagccagtatgagacatgcaaaatccgcaccattaaggcaggaaccctggagaaactagtggagaatctgctgaccgctttcggcgacaatgattttacttacattagcatattcttatccacgtaccgcggattcgcatccacaaaagaggtcctcgaattgcttctggataggtacggcaacctgacgtcacctaactgtgaggaagatgggtctcagtcaagctccgaaagcaagatggtaattaggaacgcgatcgcatctatactcagagcctggcttgatcagtgcgccgaggatttccgtgaaccgccccatttcccgtgcttgcaaaaacttctggattatctgacacgtatgatgcccggatccgaccctgagcggcgtgcccagaacttgttggaacagttccaaaagcaggaagtggagaccgataatggtctccctaacactattagcttctctttggaggaggaggaggagctcgaggggggggaatctgccgagttcacctgtttttctgaagatcttgtagcggagcagctgacatatatggatgcgcaacttttcaaaaaagttgtgcctcatcattgcttgggctgtatctggagccggagggacaaaaaggaaaacaagcacctcgcacccaccatcagagcgacaatcagccagttcaatactctgaccaaatgcgtagtaagcaccatccttggcggtaaagagctgaaaacacagcagcgggctaagatcattgagaaatggattaatatcgcgcacgagtgccgactccttaaaaacttcagcagtctgagggctattgtgtccgctcttcaaagcaactccatatatcggttgaagaaaacgtgggctgccgtaccacgcgaccggatgctcatgttcgaagagctgagtgatatattcagtgaccataacaaccacctgacatctcgggagttgctgatgaaagagggtactagtaaatttgccaacctggattcttcagtgaaagagaaccagaagagaacgcaacggcgcttgcagctgcagaaagacatgggagtgatgcaggggaccgtgccatacctgggcacctttctgaccgatcttaccatgcttgatacagctctgcaagactacattgaagggggcctcataaattttgagaagcgtcgacgcgagttcgaagtgatcgcacagattaagttgctgcagagcgcctgtaacagttactgcatgacacccgatcagaagtttatccagtggttccagcgacaacaactgcttaccgaagaagagagctatgcactgagctgtgaaatagaggcggctgctgacgctagcacaactagtcctaaaccaaggaagagtatggtgaaaaggctcagccttctgttcctcggcagtgatatgattacctcccctacccctactaaggagcaaccaaaatccactgccagtggatcctcgggtgagtctatggattccgtctccgtgtctagttgcgagagcaaccactcagaagctgaggagggctcaatcacacctatggatacacctgacgagccgcagaagaagcttagtgaatcatcgtcttcatgttcctctatccattccatggacaccaacagcagcggcatgagttcactcatcaacccgttgagctcccctccctcctgtaacaataacccgaaaatccacaagcgatccgtgtctgttacaagcataacatctacggtgctgcctcctgtttacaaccagcaaaatgaagatacatgtatcatccggataagtgttgaagataacaacgggaatatgtataaatctattatgcttacatcacaggacaaaacacccgcagttattcagcgtgccatgcttaaacataacctggactcagaccccgccgaagagtacgaattggttcaggtgatctccgaagacaaagagctggtgatacctgacagcgccaacgtgttctacgcgatgaattcccaagtgaacttcgacttcatccttaggaaaaaaaacagcatggaggagcaagttaagctgagatcgaggaccagcctgaccctgcccagaacggcgaagagaggttgttggagtaacaggcattctaaaattaccctttag

SEQ ID NO: 202459 - DNA, 2412 bp, Artificial Sequence
  Description of Artificial Sequence: Synthetic coding sequence
atggaggtgaagcccgtgggcgagcccacccaggaggtgagcaagtttaaactatccacaaaagtagagtctactggacactggctggtggaggatcacgtacggatttgggaggtattgaaaaccgaagaatcctcaatccaggactggggtgaggaagtggaagagggagcagtatatcatgtcacattgaaaagagtccagattcaacaagccgccaacaaaggcgctcgatggctaggtgtcgagggggatcagctccctcccgggcacacagtctcacagtatgagacctgcaaaataagaacgattaaagcggggaccctggaaaagctggtggaaaatctgctcacagcatttggggacaacgactttacatatattagcatctttttgtccacatatcggggcttcgctagtaccaaggaagtcctggaattactcttggatagatatgggaatctgactagccctaactgcgaggaagacggaagccagagctcctcggagagtaagatggtgatacgaaatgcgatcgcgtcaatattgcgggcatggttggatcagtgcgccgaggacttccgggagccccctcattttccttgcctgcagaaactgctggactatctgacaagaatgatgcccggtagcgatccagaaagaagagctcaaaacctccttgagcagtttcagaaacaggaagtggagacagataacgggctgcctaataccatttccttctcactcgaagaagaagaggagttggaaggtggggagtccgccgaattcacatgtttttcggaagatcttgttgcagagcaactgacatatatggatgcacagctgttcaagaaagttgtgccgcaccactgcttgggctgcatttggagcaggcgagacaaaaaagagaacaagcacctcgctccaacaattagagcaactatctcccaatttaataccctgactaagtgtgttgtgagcactatcttaggcggcaaagaactgaagacccagcaaagagccaaaataatagagaagtggatcaatatagcacatgaatgtcgattgcttaaaaacttttcgagtttgcgcgcaatcgtgagtgcactgcagagtaatagcatctacaggctaaaaaagacatgggccgctgtcccacgtgatcgaatgctaatgtttgaagagctcagtgatatctttagtgaccataataatcacttgacaagcagagaacttctgatgaaagagggcacctctaagttcgcgaacttggattcttctgtcaaagagaaccagaagcgcactcagcgacgcctccagttgcagaaggacatgggggtcatgcagggaaccgtgccctatctgggtactttcctcaccgacttgaccatgctggacactgcgctgcaggactatatcgagggggggttaatcaacttcgaaaaacgaaggagagagttcgaagtgatcgctcaaattaaactgctgcagtcggcttgtaattcctactgcatgactcctgatcagaagtttatacaatggttccagcgacaacagttgctaacagaggaagaatcctatgcgctcagctgcgagatagaagccgctgccgatgcttctactaccagtcccaaaccacgtaaaagtatggtgaaacgtctgtccctgttattcctgggttccgacatgatcacatcccctaccccaacaaaggagcaaccgaagagcaccgcttccggatcgtcaggggagagcatggatagcgtctcagtgtcttcttgcgagtcaaaccactcagaggccgaggaaggttccatcactcccatggatacgcctgacgagcctcagaaaaaactctcggaatcctcctcgagttgctcgagcatccattctatggacaccaattcatccggcatgtcctccctgatcaatcctctctccagccccccgtcctgcaataacaatcccaaaatccataaaaggtccgtgtctgtcacgagcatcacttcgactgtgctaccgccagtgtataatcagcagaatgaggacacttgcatcataaggatttccgtggaagataataatggtaatatgtataagtccatcatgctgaccagccaggacaaaactccggctgtgattcaaagagcaatgctcaaacataatttagattccgatcccgctgaagaatacgagctggtacaggtgattagtgaggacaaagaactggtgattcccgactcggcaaatgtgttctacgctatgaacagtcaggttaactttgacttcatcttgaggaaaaaaaatagcatggaagagcaagtgaagctacgctctaggaccagccttacgttgccacggaccgctaagagggggtgttggtcgaaccgacattctaaaattaccttgtag

SEQ ID NO: 202460 - DNA, 2301 bp, Artificial Sequence
  Description of Artificial Sequence: Synthetic coding sequence
atggaggtgaagcccgtgggcgagcccacccaggaggtgagcaagtttaagctctcaacgaaggtggagtcaacaggccactggctggtcgaagaccatgtgcgaatctgggaggtattgaagaccgaggaggtggaaggtgatcagctaccaccagggcacactgtttcgcagtacgaaacttgcaaaattcgcaccattaaagccggcactctggagaagctggtggagaacctgctcaccgcctttggcgacaatgacttcacttacatctctatattcttgtccacttacaggggtttcgcatcaactaaagaggtgctggaattacttctcgatagatatggtaacttaacctccccgaattgtgaggaagatggatcacagtcttccagcgagagcaagatggtaatccgtaatgctattgcttccatcctccgggcgtggctagatcagtgtgccgaagacttccgagagcctccacatttcccctgcctgcagaagctcctggattatttaacaaggatgatgcctggctcggacccagaacgacgagcccagaacctcctcgagcagttccagaaacaggaagtggagactgataatggactgcccaatactataagtttcagccttgaggaggaagaagagttggaagggggtgaaagtgcggagttcacatgcttctcggaagacctggtagccgagcagctgacttacatggacgcccagctgtttaagaaggtggttcctcaccactgcctcggttgcatctggtcaaggcgggacaagaaagagaacaagcatctggcaccgacaatcagggccactatcagtcagtttaatactctcacaaagtgcgtagtgtctacaattctcggtggtaaagaactgaagacccaacagagagccaaaattattgaaaaatggattaatattgcccacgagtgccggcttcttaagaacttttcatcattaagggccatagtgtcagccttgcagtctaattctatctataggctcaagaaaacctgggccgccgtgccccgggatagaatgctcatgtttgaggagctgagtgatatattctctgatcataataaccacctcacatctagggaactgcttatgaaggagggtacttcaaaattcgccaacttggacagcagcgtgaaggagaaccagaaaagaacccagcgccgactccagctccagaaggacatgggcgtgatgcagggcactgtgccctatctaggcacgttcctcaccgatctgacaatgctggacactgcactccaggactacattgaggggggattaattaactttgagaagcgccggagggaatttgaagttattgctcagataaagttgctacaatctgcctgtaatagctactgtatgacgccagatcagaaatttattcagtggtttcagagacaacaactgctaactgaggaagagtcatatgccctgagctgcgaaatcgaggcagctgctgacgcctcgacgacatcccccaagccaaggaagtccatggtgaagagactctccctgttgtttttaggcagcgatatgatcacctcacctactcccacaaaagagcagccaaagtctacagcttctggatcttccggggaatctatggacagcgtgagcgtgagttcgtgcgagtccaatcactcagaggcagaagaaggctcgatcacacctatggacacgccagatgagcctcagaagaagctgtcagagagttcttcctcttgctcttctattcacagcatggacaccaacagctcaggaatgagctcacttatcaacccattgtctagccccccttcctgcaacaataaccctaaaattcacaagaggtccgttagcgtgacctctattacttcaactgtgctgcccccggtgtataaccagcagaatgaggatacctgtattattagaatatcagtggaagataataatggaaatatgtacaagagcattatgcttacatcccaagacaagacgccagctgttatccagcgcgctatgcttaagcacaacctcgactctgaccctgccgaggagtacgagctcgtgcaggtcattagcgaggacaaggagctggtaattcctgattccgctaatgtgttctacgcgatgaattcccaggtgaatttcgatttcatcctcaggaaaaagaacagtatggaagagcaggtaaaactgcgctccagaaccagcttgacactcccaagaacggccaagcgtgggtgctggagcaacagacattcaaaaatcactctttag

SEQ ID NO: 202461 - DNA, 2220 bp, Artificial Sequence
  Description of Artificial Sequence: Synthetic coding sequence
atgaagctgctgtggcaggccaagatgagcagcatccaggactggggagaagaggtggaggaaggtgctgtgtaccacgttacactgaagcgtgtgcagatccaacaggccgcaaataagggggctaggtggctgggggtcgagggtgatcagctcccacctggacatacagtgtcacagtacgagacatgcaagattaggactataaaggctggcaccctggaaaaacttgttgaaaatcttctgactgcattcggggacaacgattttacgtacatcagcatcttcctgtcaacatatcggggattcgctagcactaaggaggtcctcgagctgttgctggataggtacggcaacttgacttctcccaactgtgaggaggatggaagtcagagctcatccgagagcaagatggtgatcaggaacgcgatagccagcatacttagggcatggctggatcagtgcgccgaggacttcagggagccacctcacttcccttgtctccaaaaacttttggactatttaactagaatgatgcccggtagcgacccagagaggcgcgcccagaaccttctggagcaatttcagaagcaggaggtcgagacggataatgggttaccaaacactatctctttctccctcgaagaagaggaagaactcgaaggaggtgagtcggccgagtttacttgcttttctgaggatctcgtggcggagcagctcacttatatggatgcccagctcttcaagaaggtggtcccccaccactgccttggttgcatctggagtcggcgagacaaaaaagagaacaaacacttagcccccactatcagggccacgatcagccaatttaacactttaactaagtgtgtggtttcgacaatcctcggagggaaagaactgaagactcaacaaagagccaaaattatcgaaaagtggataaacatcgcgcacgagtgtcgccttctcaaaaactttagcagcctaagagctatcgtgtccgccttacaaagtaactcaatctaccggctcaaaaagacctgggctgctgtcccacgggatcgaatgctgatgtttgaggaactctccgatatcttttcagatcataacaaccacctgacttccagggaactgctgatgaaggagggcacatctaagttcgccaacttggatagctccgtcaaggaaaaccaaaagaggacacagaggcgcctgcagctccagaaggatatgggaggattgatcaacttcgaaaagaggcgtcgtgaattcgaagttatcgcgcaaatcaaacttctgcagagcgcttgcaacagctactgcatgacccccgaccagaaatttatccagtggtttcaacgccaacagctgttaactgaagaggagagctacgctctgtcctgtgaaatcgaggccgctgctgatgcctctaccacatcccctaagccacgcaaatccatggtaaagcgtctatcactgctgtttttgggctccgacatgatcacctcccccacccccaccaaggagcagcccaaaagcactgcgagcggatcctcgggagagtctatggacagcgtgagcgtttcaagctgcgagagcaaccattctgaggctgaggagggatctataacccctatggatacccccgatgagccccagaaaaaactgtccgaaagcagtagctcttgtagttctatacacagcatggatactaatagctctggtatgtcaagcctcataaatcctttgtctagtcctccctcatgtaacaacaaccccaagatacacaagcgcagtgtctccgtgacgtctatcacctccacagtgcttccacctgtgtacaaccagcagaacgaagacacgtgcataattcgaataagcgtggaggataataatgggaacatgtacaagtccattatgctgacaagccaagacaaaacaccagccgtgatccagcgggcaatgttaaagcacaatctagactccgaccctgccgaagaatacgagcttgtgcaagtcatctcggaggacaaggagctagtgattcccgattccgctaatgtgttttatgctatgaacagccaggttaacttcgattttatcctgcggaagaagaattccatggaagagcaggttaaactgaggtccagaacctctctgacccttccacggactgccaagagaggctgctggtccaatagacactcaaaaatcacactctag

SEQ ID NO: 202462 - DNA, 1173 bp, Artificial Sequence
  Description of Artificial Sequence: Synthetic coding sequence
atgggcagcttcaaggaccggggcgacggcctgcccaacaccatcagtttttccctggaggaggaggaagaactggagggaggagagtctgctgagttcacatgtttttctgaagacttggtcgcagagcaactcacatatatggacgcccagctattcaagaaggtggtgccccaccactgcttgggatgtatttggtcacgaagagacaagaaagagaataaacatctggcacccactatccgtgccacgatcagccaattcaacacgctgactaaatgcgtagtgtctactattttgggtggaaaggagctgaaaactcagcagcgtgctaagattatcgagaaatggattaatatcgcccacgagtgccgcttgttgaagaacttcagctccctgagggccatcgtttctgcactgcagagtaacagcatctacagactgaaaaagacgtgggcagcggtgccccgtgatcgcatgctgatgttcgaagagctgtcagacattttctcggatcataacaatcatctgacctcccgcgaactcctgatgaaagaaggcacttcaaagtttgctaatctcgacagctcagtcaaggagaatcagaagcgcacacaacgcagactgcagctccagaaggacatgggtgtaatgcaggggacagtgccctatctcggcaccttcctgacagacctaactatgttggatacagcactccaggactacatcgaaggcggtctgatcaattttgagaaaagaagacgagaattcgaagttattgcccagataaagttgttacagagcgcatgtaactcctactgcatgacacccgaccagaagttcatccagtggtttcagaggcagcagctcctgaccgaggaggaatcttacgccctctcctgcgaaattgaggctgccgctgacgcgagcactacgtcccccaagccacgcaagtccatggtcaagcgcctgtccctactgttcctgggatcggatatgatcacaagccccacccctacaaaagagcagcccaaaagcactgccagcggctcctctggcgaatccatggattccgtcagcgtgtcatcttgtgagagcaaccacagtgaggctgaagaggggtcaataacacccatggacacccctgatgagcctcaaaagaaggcgttgtag

SEQ ID NO: 202463 - DNA, 1422 bp, Artificial Sequence
  Description of Artificial Sequence: Synthetic coding sequence
atgcggaagctgctgaccaacctgcccgccgccgccgtgctgagcgcacaagtatacagcgccgttcttcaggggctctgggaggagaatgtgtgcggaacacctggacgcacccgcgtctgtacagctctactatacggacaggtttgcccatttcaggatagcacggatggccttcggaccatcactagcatcctctttaattggccccctgaaaatacttcagtctactaccaaccaccccaaaggagctcattccggattaagttggcatttcgcaacctgtcctggcctgggttaggcctggaagaccaccaagaaatagtgcttggccagttagtgcttcccgagcccaacgaggctaagcccgatgatcccgctccacgccccggccagcacgctctgaccatgcccgccctagaaccagcgccccccctgctggccgacctgggacctgcactcgaacctgaatctcccgccgctctgggaccacccggctacctgcactccgctccaggacccgcccctgctcctggggagggtcctccgccaggcactgtcctggagcctcagtccgctcctgaatcgtcatgtccatgtagaggtagcgtgaagaatcagcccagtgaagaactcccagatatgactaccttccctccaagactgctggccgagcaactcacattgatggacgctgagctcttcaaaaaggtagtcctccatgaatgcttggggtgtatttggggacaaggccatcttaaaggcaacgagcatatggcccccaccgttcgcgccacgattgcccacttcaaccggctgactaactgtataaccacatcatgtctgggagaccactctatgcgagcacgcgatcgtgccagggtcgtagagcactggatcaaagtggcacgcgagtgcttgtcattaaataacttcagctccgtgcacgttattgtgagtgcactctgttctaaccccatcggccagctgcacaaaacttgggcaggcgtatcctcaaaaagtatgaaggaactgaaagagctgtgcaaaaaggacacagccgtcaaacgagatttactcatcaaagcgggcagcttcaaagttgccactcaggaaaggaatccccagcgagttcagatgagattgagacgtcagaagaaaggtgtcgtgccctttctgggtgattttctgacagaactccagaggctcgactccgctattcctgatgaccttgacggaaataccaataaaagatcaaaagaagtgcgagtgctgcaggagatgcagctgctccaagtcgccgccatgaattacagactgaggcccctggagaagttcgtcacgtatttcacccgcatggagcagctgtcagacaaagaaagctacaagctcagttgtcagcttgagcccgagaacccgtag

SEQ ID NO: 202464 - DNA, 1743 bp, Artificial Sequence
  Description of Artificial Sequence: Synthetic coding sequence
atgcggaagctgctgaccaacctgcccgccgccgccgtgctgagcgcccaggtgtactcggcagttctgcagggcttgtgggaagagaatgtatgtggtactcccggacgcactcgagtctgcacagcactgctgtacggacaggtatgtccgttccaggatagcactgacggcctcaggacgattacgagcatcctcttcaattggcccccagagaatacctctgtgtattaccaaccaccccagcgaagtagcttcaggatcaagcttgcctttagaaatctgagctggcctggactggggttagaagaccatcaggagattgtgctggggcaactggtcctgccggaaccgaacgaagcaaaacccgacgaccccgccccaagaccgggccaacatgcgcttactatgcccgccttggagcccgcaccacctcttctcgctgacctcggacctgcgctggaacctgagtcacctgccgcccttggccctcccgggtatctccattctgcgccagggccggccccagcgcccggcgaaggacctccacctggcaccgtcctcgagccccaatcggcccctgagagttcgtgcccttgcagaggttcagttaagaaccagccatcggaggaactccctgatatgacaactttccccccccgcctgcttgcggagcagctgacgctgatggatgcagaacttttcaaaaaggtagtgctacacgagtgtttaggatgcatttggggccagggccatcttaaggggaacgaacatatggcgcctaccgtgcgagcgactattgcacactttaatcgtctgaccaattgcattaccacctcatgccttggagaccattccatgcgagctcgagatcgggccagggtggtcgaacactggattaaagtagcgagggagtgcctctctttaaataattttagctcagtacatgtcatagttagcgcactatgctccaatccaattgggcagctgcacaagacatgggccggggtttcttccaagagtatgaaagaattgaaagagctctgtaagaaagacaccgcagtgaaaagggatctcctcataaaggcaggtagctttaaggttgccacccaggaacggaatccccaacgcgttcagatgagactgcgaaggcagaagaagggcgtagtcccattcttgggggatttcctgacagaattgcagcggctagattcagccattccggatgatctggacggaaatactaataagcggtcgaaagaggttagggtcctgcaggagatgcagctgcttcaggtggctgctatgaactatagattacggcctctggaaaagttcgttacttattttacacggatggagcaactgtccgacaaagagcgttggggattcacaatgatgtcccgcatcgtctccaactcttggccccaggccattcatcctccgcaacctcctaaagtcctgactctgcagctgcaggctgtgctgcctgccggcgcccggaagcccgtgggttggcagcatcccgcagtagccggcaatcctcctggctgttggcccgaacatagactgtgtaccatccctcaccccgaccggagacaccagggaactaccagccggcgactcgctgcccaactccatctcgccctagatccccaccaccagctgttgctgctggcccgcatccgcccttgggatttttgcgagagtgggggacgccccttctatgtgtactttctgtag

SEQ ID NO: 202465 - DNA, 1968 bp, Artificial Sequence
  Description of Artificial Sequence: Synthetic coding sequence
atgaccgagtgcttcctgccccccaccagcagccccagcgagcaccggcgtgtggagcacggttccggcctgacccggactccgagcagcgaggagatttctcccacgaaattccctggtctataccgtactggcgagcccagccccccccatgatatcttacacgagccgccagacgtcgtgtctgacgacgagaaggatcatggtaaaaagaaaggaaaattcaagaaaaaggaaaagcgaaccgaaggatatgcagccttccaggaagactcctcaggagatgaagcggagtctcctagcaaaatgaaacggagtaaggggatacatgtgtttaagaaacctagcttttccaagaagaaagaaaaggacttcaagataaaggagaaacccaaagaagagaagcataaagaagaaaaacataaagaggagaaacacaaggaaaagaagtcgaaggacctgaccgcagccgatgtggtgaagcagtggaaggaaaaaaagaagaagaagaagccaattcaagagcccgaagtgccacaaatcgatgtgcctaatctgaagcctatcttcggtattccgctggccgacgctgtggaacgcactatgatgtatgatggcataagacttcccgcagtatttcgcgaatgcatcgactacgtggagaagtacggcatgaagtgcgaggggatctatcgcgtcagcggaattaagagcaaagtggacgagctgaaggcagcgtacgaccgggaggaaagcactaacctcgaggactacgagccaaacaccgtagcatctctgctaaaacagtatctccgggatctgcccgagaacctgctcaccaaagagctgatgccacggttcgaggaggcctgcggcaggaccacggaaacagagaaggtgcaagaattccaacgactgctcaaggagttgcctgaatgcaactatctgctcatctcgtggctaattgtgcacatggatcatgtcattgcgaaagagctggaaactaagatgaacatccagaacatctccattgttctgagcccgacagttcaaatcagtaatagggtgctgtacgtcttctttacccatgtgcaggagttgtttggaaatgtggtgctcaaacaggtcatgaagcccctgaggtggagcaacatggccacaatgccaaccctccccgaaactcaggccggaataaaagaggaaatccgtagacaggaattcttgctgaactgtctccacagagacctgcagggtggtatcaaagacctgagcaaggaggaacgcctgtgggaggtgcaaaggattttaactgcccttaagaggaaacttcgcgaagccaagcgacaggaatgtgagacaaaaattgcacaggagatcgcatcgctcagtaaagaggatgtgtctaaggaagaaatgaatgagaatgaggaggtaattaatatcctgctggcacaggagaatgagattctgactgaacaggaggagctgttagccatggagcagttcttgcggcgacagattgcatccgagaaggaagaaatcgagaggttaagggctgagatcgctgagatccagtctcgccagcagcacggacggagcgaaactgaggaatattcatcggagtcagaatctgagagtgaggacgaggaggaattgcagattattcttgaagatctgcagaggcaaaacgaagaattagaaatcaagaataaccacctcaatcaggcaattcatgaggaaagagaggccatcatcgagctccgtgtacagctaagattactgcagatgcagagagccaaagctgagcagcaggcccaggaggacgaggagccggaatggagaggaggtgccgtccagccgcctcgggacggagtcctggaacctaaagcggctaaggagcagcccaaagctgggaaggagcctgccaagccttcaccaagcagggaccgcaaggaaaccagtatctag

SEQ ID NO: 202466 - DNA, 1968 bp, Artificial Sequence
  Description of Artificial Sequence: Synthetic coding sequence
atgaccgagtgcttcctgccccccaccagcagccccagcgagcaccggcgagtggaacatggatctgggcttactaggacacccagttccgaagagatttcgcctacgaaatttccaggactctatcgtactggcgagccctcgcctccgcatgacattttacacgagccacctgatgtcgtaagtgatgatgagaaggatcacggcaaaaaaaagggcaagtttaaaaagaaagagaagaggacagaagggtacgctgcctttcaagaagacagctcaggtgatgaggccgaaagtccctctaagatgaaaagaagtaaaggcatccacgtattcaaaaaaccgtccttctcaaagaagaaagaaaaggactttaaaataaaggaaaagcccaaggaggagaaacacaaagaagaaaaacacaaggaggaaaagcataaggagaagaagtcaaaggaccttaccgctgcagacgtggttaagcagtggaaagagaagaaaaagaagaagaaacccattcaggagcccgaggttccccagatcgatgtgcctaacctcaaacctatctttggcatccctctagccgatgctgtggaacgtacaatgatgtacgacggcattagattaccagctgtcttccgcgagtgcatcgactatgtggaaaagtatgggatgaagtgcgagggcatctatcgcgtgagcggcatcaaatccaaagtggatgagcttaaggcagcatatgacagagaggagagtactaacctcgaggattacgagccaaacacagtggcctctctgctcaagcagtatcttcgagatctgccagagaacttgctgactaaggagctgatgccccggtttgaggaagcgtgcggacggaccactgagacagaaaaggtgcaggaatttcaaaggctgctcaaggaactcccagagtgtaattacctcctgatctcttggttgattgtgcatatggatcatgtgattgcaaaggagttagagaccaaaatgaacatacagaacatcagtattgtgttgagccccacagttcaaatcagcaaccgggtgctgtacgtgttttttacacacgtacaggaactgttcggaaacgttgtgctcaaacaggtaatgaaaccgcttcgctggagtaacatggcaaccatgcctacccttcccgaaacccaggccggaatcaaagaggagatcaggagacaggagtttctgctgaattgtctccaccgggacttgcagggtggcatcaaggatctctccaaggaggagagactgtgggaggtccaacgaatactgacagccctcaagcgcaagctgagggaagccaaacgccaggagtgcgagactaagatagcgcaggaaatcgctagtcttagtaaggaggacgtttccaaggaggaaatgaacgagaatgaagaggtgattaacatactattagcacaagagaatgagatactaaccgagcaagaagaattgctagctatggagcagttcctgaggcggcagatagcttctgagaaagaggagatagaacgcctcagagcagagatcgccgagattcagtctagacagcagcatggtcgatcagaaacagaggaatactcatctgaatcagaatcggagtcggaggatgaggaggaattgcagataatcctcgaagacctccaacgccaaaacgaagagctggagatcaagaataaccacctgaaccaggccattcacgaggagcgcgaagccatcatcgagctgagagtacaactgcggttgctgcagatgcagcgcgcgaaagctgaacagcaggctcaagaagacgaggaacccgaatggcggggcggcgccgtgcagccacctcgcgatggtgtgctggaaccaaaggccgctaaagaacagcccaaggccggaaaggagccagccaagccctctccctccagagaccggaaggaaacctctatatag

SEQ ID NO: 202467 - DNA, 1044 bp, Artificial Sequence
  Description of Artificial Sequence: Synthetic coding sequence
atgaccgagtgcttcctgccccccaccagcagccccagcgagcaccggagggttgaacatggcagcggcctcactcgtacgccatccagcgaagagatctcacctaccaagttcccaggtctttatcggacaggcgaaccctctccacctcacgacattcttcacgagccacctgacgtcgtgtcagacgatgaaaaagatcatggcaaaaagaaagggaaatttaaaaagaaggagaaacggactgagggttacgccgcatttcaggaagacagctctggagatgaggctgagagtccatcgaaaatgaaacggagtaagggcatacacgtcttcaagaagcctagcttttccaagaagaaggagaaggatttcaagatcaaggaaaagccaaaagaagaaaagcacaaagaggagaagcataaggaggaaaagcacaaggaaaaaaaatccaaggatctcactgcagccgatgtggtgaagcagtggaaagagaagaagaaaaagaagaagccaatacaggagcccgaagtaccacagatcgatgtgccaaacttgaagccaatctttggaatccccctggctgacgcagttgaacgcactatgatgtacgacggaatccgtttgccagccgtattccgggaatgtattgattacgtcgagaaatacgggatgaagtgcgaaggcatctatagagtgtcagggataaagagcaaagtcgacgaactgaaggctgcttatgatcgcgaagaaagtaccaacctggaggactacgagccaaatacggtggcttcacttctcaagcaatatctccgcgacttgcccgaaaacttgcttactaaggagctgatgccgagattcgaggaagcttgtggaaggacaaccgagaccgaaaaagtgcaatcttccggcgaggaggcagcaaggtcatgtcagttcctgaccgctggcacgagcaagggtttgttgaccggactggtgaagggctcgcacctgggcctggtgcaccctcagaggatgttattcaagcccgagattttctag

SEQ ID NO: 202468 - DNA, 1980 bp, Artificial Sequence
  Description of Artificial Sequence: Synthetic coding sequence
atggaggccgccgccgccgccgccgccgccgccgccgccgccgccgcagcaggtggagggtgcggctccgggcctccaccactcctcctctccgaaggggagcagcagtgttattcagaactgtttgcacgatgtgctggggcagccggggggggaccggggtccggtcctccggaagcagcaagggtcgcacctggaacagcaacagctgctgctgggccagtggcagacctttttcgagcgtctcagcttcctgcagagactcttcaccagattacagagctgtgcggggctaagagagtcgggtactttggaccaacacagttttacatagcattgaagctgatcgctgcagcgcagtctggtctgccagtgagaatcgaatccatcaaatgcgaattacccctgcccaggttcatgatgtccaaaaacgatggagaaatacggtttgggaatccagctgagttacatggaaccaaggttcagataccatacctcacaacggaaaagaacagcttcaaacggatggacgacgaggacaagcaggagacacagtccccaaccatgtcccctctcgccagtcctccttcctccccccctcattatcagcgcgtgccccttagccatggatactcaaagctgagatcttcagccgagcagatgcatcccgccccatatgaagcgaggcagccactggttcaaccggaggggtccagtagcgggggaccaggcactaaaccactgaggcaccaggccagcctgatccgctccttcagtgtggaacgggagctccaggataattcttcctatcccgacgaaccgtggagaattaccgaggaacaacgcgaatactatgtgaatcagttccggagcctgcaaccagatcccagctctttcatcagcggcagtgtggccaagaacttcttcaccaagtccaagttgtccataccagagctgagctacatctgggaactttcggatgccgattgcgatggtgccctgactctccccgagttctgcgcagcctttcatctgatcgtggccaggaaaaacgggtatccattgccagaggggctcccaccaaccctgcagccagagtacctccaggctgccttccctaaacccaaatgggactgccagctatttgactcgtactccgagagcttaccagctaatcaacagccacgagatttgaaccgcatggaaaaaacgagcgttaaggatatggccgacctacccgtgccaaaccaggacgtgacctctgacgacaagcaggcactgaaaagcactataaatgaggctctgccaaaggacgtttctgaggatccagcaactccgaaagatagcaattccctgaaagcgagaccgcgcagtcggtcatacagttcaacttccatagaggaggcaatgaagagaggggaggacccacccacaccccctcctcgcccgcagaaaactcactctcgcgcttcgagcttggacctgaacaaggtgttccagccatccgtccccgcaactaagagcgggttgttacctcccccccctgctctcccacccagaccatgccctagccagagtgaacaagtctccgaggcagaactcctgccacaactctctagggcaccttctcaagcggcagagtctagtcccgcaaaaaaggatgtgctgtactcgcagccaccaagtaagccaatacgcagaaaattccggcccgagaaccaggccacagagaatcaggagccaagcacagctgctagcggcccagctagcgctgccaccatgaaaccccatcctacggtgcagaagcagtcctctaagcaaaagaaggccatacagacagcaatcagaaaaaataaggaggccaatgcagtgttggcgagacttaactctgagctccagcagcagttgaaggaagttcatcaggagcgtattgccctcgagaatcagctcgagcagctgagacccgtaaccgttctgtag

SEQ ID NO: 202469 - DNA, 1983 bp, Artificial Sequence
  Description of Artificial Sequence: Synthetic coding sequence
atggaggccgccgccgccgccgccgccgccgccgccgccgccgccgccgctgggggggggtgtggaagcgggccccctccgctcctcctctcggaaggagagcaacaatgctactccgaactcttcgcgcgatgtgcgggcgcggccggaggcgggcctggctccgggccgcctgaggcagcgagagtggcccccggtactgccacagccgcggcaggtccggtcgcagatctgttccgggcctcccagttgccagctgagacgctccaccagatcactgagctgtgcggcgcgaaacgcgtggggtatttcggccctactcagttctatatagctctgaaattgattgccgcagctcagagcggcctccctgtgcgaatcgagagcataaagtgtgaactccctctcccacggttcatgatgtccaagaatgatggcgaaatcagattcggaaaccccgcagagctgcacggaaccaaagtccagattccgtacctaacaaccgagaaaaattcttttaagagaatggacgatgaagataaacagcaggagacccaaagcccaaccatgagcccattagccagcccaccttctagccccccacattaccagcgagtgcctcttagtcacggctactctaagctcaggtcaagcgcagagcagatgcacccggcaccttacgaagctcgacagccacttgtccagccggagggcagcagttctggaggccccggaaccaaaccgcttaggcaccaggccagccttattaggtcattttctgtggagagggagctccaagataattctagttatcccgacgagccctggcgtattacggaagagcagagggaatactacgttaaccaattccgatcactccagccagacccaagtagtttcatatctggaagtgtagccaagaactttttcaccaagagcaagctttccattccggaactctcctacatttgggaacttagcgacgcggactgtgacggtgctttaactctgcctgaattctgtgcagcctttcatctgattgtggcaagaaaaaacggctacccccttccagaaggactgcccccaacgttgcaaccagagtatctgcaggcggcttttcccaagcccaagtgggactgccagttgtttgatagttattcagagtccctgccagccaaccagcagcccagggatctaaatcggatggagaagactagcgtgaaggatatggctgacctgcccgtccccaatcaggatgtaacttctgacgacaaacaggccctgaagtcaaccatcaacgaagccctgcccaaagacgtttctgaagaccctgccacacccaaggactccaacagtctcaaagctcggccacggagccggtcgtattcatccacgtctattgaggaggccatgaaaaggggggaagatcctcctacccctccaccgagacctcaaaaaacccattcacgcgcaagtagcttggacctcaacaaagtgtttcagccgagcgtcccagcaactaagagcggattgcttccacctccgccagcacttcctccgcgcccatgcccttcacagtctgaacaggtgtccgaggcagaattgctgccccagctttccagggcccccagccaggcagccgagagcagtcctgccaagaaagatgttctgtatagccagcctccgtctaaacctattaggaggaagtttcgccctgagaatcaagcaacagagaaccaagaaccttccacagctgcatctggccccgcatctgccgctaccatgaaacctcatcccacagtgcagaaacagagtagcaagcagaaaaaggcgattcaaaccgctattcgaaaaaacaaggaggctaacgccgtgctggcaaggttaaatagtgagctgcagcagcagctcaaagaggtccatcaggagagaatcgcccttgagaaccaactggagcagctccgaccagtcacggtgttgtag

SEQ ID NO: 202470 - DNA, 1824 bp, Artificial Sequence
  Description of Artificial Sequence: Synthetic coding sequence
atggaggccgccgccgccgccgccgccgccgccgccgccgccgccgctgctggtggcggctgcggctcagggcctccccctctgctcctgtccgagggagagcagcaatgttactctgaactttttgctaggtgcgctggcgcagccggaggagggcccggctccggaccacccgaggccgccagggtggctccaggaaccgccacagctgcagctggacccgtggctgatttatttagagcctcccaacttcctgctgaaactctccatcagattactgagctgtgcggcgcgaagcgcgtcggttactttggacctacccagttttacatcgcactgaaattgattgcagccgctcaatccgggttgccagtgcgcatcgaaagcataaagtgcgagttgccattaccccgttttatgatgagcaaaaatgatggggagattcgattcggaaaccccgccgaactgcatggaactaaagtccagatcccatacttgactaccgaaaagaattcctttaaaagaatggatgacgaggataagcaacaagaaacccagtccccgactatgagccccctcgcatccccaccttcaagtcctcctcattatcagcgtgtgccactttctcacggctactccaagttacgtagctccgctgagcaaatgcacccagcaccatacgaggcccgccagccactcgtgcagccagaaggatcttcatccgggggtcccggaaccaaaccgctgaggcaccaagcttcactgattcgttccttctcggtcgagagagaacttcaggataacagctcttaccccgatgagccctggaggatcaccgaagagcagcgagaatactacgtgaaccagtttaggtcactgcaacccgacccatctagctttataagcggatcagtagcgaagaacttctttacaaagtccaagttatccatcccagagcttagctacatctgggagctgtcagacgctgactgcgacggtgcgctgacactgcccgagttctgtgctgcattccatctgattgtggccaggaaaaatggctatccgctccccgagggactcccacccaccttgcagcctgaatacctgcaggcggcttttcccaagccgaagtgggactgtcagctctttgactcctatagcgagtcattgcctgccaatcagcaaccccgagatctcaataggatggagaagacgtccgttaaagacatggccgatcttcctgtgccaaatcaggacgtgacttcagacgacaaacaggctctgaaaagtaccatcaacgaagccttgcctaaggatgtttcagaggatcccgccactccgaaagacagtaacagcctaaaggctagaccccgttcccgttcctactccagcaccagtatagaggaagcaatgaagaggggagaagaccctcctacaccgcccccccggccacagaagacacattctagagcctcaagcctagatctgaacaaggtcttccagccctccgtcccagccaccaagtccggactgctcccacccccacccgcgctcccccccagaccttgtcctagccagagtgagcaggtaagtgaagcggaacttttaccccagctttctcgagccccatctcaggctgccgagtcttccccggccaagaaggacgtgctctattcccagccaccttcgaagcctatcagaaggaagttccgccccgtctgcggcatccaacctttaatcagtatcgaactgagggccttcagaacctctagacacctttttaatgtgtctctggtgcactggcaggccctttccatagcatag

SEQ ID NO: 202471 - DNA, 1380 bp, Artificial Sequence
  Description of Artificial Sequence: Synthetic coding sequence
atgatgagcaagaacgacggcgagatccggttcggcaaccccgccgagctccacggcacaaaggtccagatcccttaccttaccacagaaaagaatagtttcaagcgcatggatgacgaggacaagcaggagacccagagtcccaccatgagcccactcgcctcgcccccttctagccccccacattatcagcgtgtccctctgagtcacggttactctaaactcagatccagcgctgagcagatgcacccggccccatatgaggcccgtcaacccctggtgcagcccgagggaagctcctcgggcggacccggtactaagcctctgaggcaccaagcttctcttatacggtcctttagcgtcgagcgtgaactgcaggataactcctcctaccctgacgaaccctggagaataaccgaggaacaacgggagtattacgttaatcagtttagatccctgcagcccgaccccagcagtttcatctccgggtccgtggcaaagaacttttttacgaaaagtaagctgtctatacctgagttatcgtatatctgggaattatctgacgctgattgtgatggagctttgaccctgcccgaattttgcgctgcattccacttgattgtcgcccggaagaatggataccccttaccggagggcttgccccccacattgcagcccgaatatctgcaggcagcctttccaaaacccaaatgggactgccagttattcgacagttattctgaaagcctacctgccaaccaacagccacgcgatctgaacagaatggaaaagaccagtgtaaaagatatggccgacttacccgtgcccaatcaagacgtgaccagcgacgataaacaagcactaaagtcaaccatcaacgaagccttgcccaaagacgtgtcagaagatcctgccaccaagagcggcttgcttccaccgccaccagcccttcctccgcgaccttgtccaagccagtcagaacaagtgagtgaggctgagctgctgccacagctgtcccgcgctccctcacaggccgccgagtcctcacctgctaaaaaagacgtactatacagccagcctccaagtaagccgatacggcgaaagttccggccagaaaaccaggctaccgaaaatcaggaacccagtactgccgcatcaggtcctgcaagcgccgccactatgaaacctcatcccaccgtgcagaagcagtcttcaaagcagaagaaagccattcaaaccgccattagaaaaaataaggaagccaacgctgtcctggccaggttaaattcggagcttcaacagcagctgaaagaggtgcaccaagagcgaatagcactcgaaaatcagttggagcagctgcgacctgtgaccgtcctttag

SEQ ID NO: 202472 - DNA, 1863 bp, Artificial Sequence
  Description of Artificial Sequence: Synthetic coding sequence
atggccgccgccaccgccgaccccggcgccggcaacccccagcccggcgactcctctggtgggggggcaggcggcggactgccatcgccaggagagcaggagctgtcccgcaggttgcagcgcctgtacccagccgttaatcagcaagagactccgttacccaggagttggtccccaaaggacaaatacaactacataggattgtctcaggggaacttgcgagtccattacaagggccatggtaagaaccacaaggatgcggcttctgtccgagcgacccatcctataccagcagcctgtggcatttactactttgaggtgaagattgtttctaagggaagagacgggtacatgggaatagggctgagtgcccagggcgtgaacatgaacaggctgccagggtgggataagcatagctacggttaccacggcgacgatggccactcattttgttctagcggaacaggccagccctatgggcctacgttcacaacaggggacgtgattggatgctgtgtgaatctaatcaacggtacctgcttctacacgaagaatggccactcgctgggcattgcctttaccgaccttccagccaatctgtacccaacagttggcctccagaccccaggcgagattgttgatgccaatttcggacagcagccctttctgttcgacatagaggattacatgcgcgaatggcgtgctaaggtgcaggggacagtacactgtttcccaatcagcgcaagactgggcgaatggcaggccgtgctgcagaacatggtttccagctatctggtgcatcacggctactgcgcaactgccacagcatttgccagaatgacggagacacctattcaggaagagcaggccagtattaagaacagacagaaaatccagaagctcgtcctcgagggacgggtgggcgaagctatcgaaacaacacagaggttctatcccgggttgctcgagcacaaccctaacctgcttttcatgttgaagtgccgccagtttgttgagatggtcaacgggaccgacagcgaagtgcgttcactcagtagccggagccctaagagccaggattcttatcccggctccccctccctttccccaaggcatggaccatcgtcctctcacatgcacaacacaggcgctgactcaccaagttgcagtaacggcgtcgcatcaactaagtccaagcagaaccactccaagtacccagccccctcatcatcatcatcatcatcctcctcctctagctcgtcaagcccaagctctgtcaactactctgagtctaactcgaccgactccactaaatctcagcatcattcttctactagcaatcaagagacatcagatagcgaaatggaaatggaagccgagcactatccaaacggagtgttgggtagtatgtcgacccggatagtgaatggcgcctacaaacacgaagatctccagaccgatgagtctagcatggatgaccggcacccacgccgccagctatgcgggggtaaccaggctgctacggagaggatcatcctgttcggaagagaattacaggctttgagcgagcaactaggcagggaatatggaaaaaatctggctcacaccgaaatgctccaggacgcctttagtctgttagcatattctgacccttggtcttgccccgtgggccagcaactggacccaattcaacgggagcctgtttgcgcggctctgaacagcgcaatcttggagtcacagaacttacctaagcagccacccctgatgctggcactcggccaggcctcagagtgccttcgccttatggctagagcaggactgggcagctgctcttttgcaagagtggacgactaccttcattag

SEQ ID NO: 202473 - DNA, 1602 bp, Artificial Sequence
  Description of Artificial Sequence: Synthetic coding sequence
atgggcatcggcctgagcgcccagggcgtgaacatgaaccggctgcctggctgggacaaacactcgtacggttatcatggcgatgacggacatagtttctgttcctctggaactggacagccttacggccctacctttaccaccggagacgttatcggatgctgtgtgaacctgataaacggaacttgtttttatactaaaaatgggcacagcctcggaatcgcattcaccgacctgcccgcaaatctctatcccacagtcggactacaaacgcctggagagatagttgacgcaaattttggacagcagccatttttgtttgatatcgaggactacatgagggaatggagagcaaaagttcaagggacagtgcactgctttccaattagtgcccgtctgggcgagtggcaggcagtcctgcagaacatggtctctagttacctggtccatcatggatattgcgcaaccgccacggctttcgccaggatgacggagacccccatccaggaggaacaggcctctataaagaacaggcagaagatccagaaactggtccttgaaggtagggtgggggaggcaattgaaaccacacagcgattctaccccggattgctggagcacaatccgaacctactgttcatgcttaaatgtcgccagttcgtggagatggtaaacggcactgactccgaagtgcgcagcctgagttctagaagccctaaaagtcaggattcataccctggcagcccaagcttgtcccctaggcacgggccttcttcctcacatatgcacaacactggggcagacagtccctcctgctcaaatggagtggcttccactaagagcaaacagaaccattccaagtatccagccccctcttccagctcttccagctcctcctcttcctcaagctcttcgccatctagcgttaattatagcgagagcaacagtaccgattccactaaaagtcaacatcacagcagtacttctaaccaggaaacctccaacccctggttgcagctggagcggagacctaatcaggccgcacccacgacacctcctggaccaacacctacctcaacaccaccacattctgactccgagatggagatggaagccgagcattatcccaatggagttttgggatctatgagcacaagaatcgtgaacggtgcttataaacacgaagacctccagacagacgagtcatcgatggatgaccggcatcctcgacgacagttgtgcggcggtaaccaagctgcaaccgaacgtatcatattattcggacgtgagctgcaggcactctcagaacagctagggagggaatatggcaaaaatctggcccatacagagatgctccaggatgcattttcgctactagcctactcagacccatggtcatgccccgtcggacagcagctggatccaattcagcgtgagcccgtgtgtgcagctctcaatagcgctatattagaaagccagaatctacccaagcagccacccctgatgcttgcccttggccaagcttcagagtgtctacggttgatggccagagccgggctgggcagctgttcctttgcccgcgtggatgactacctgcattag

SEQ ID NO: 202474 - DNA, 540 bp, Artificial Sequence
  Description of Artificial Sequence: Synthetic coding sequence
atgggctgggacaagcacagctacggctaccacggcgacgacggccactccttttgttcctccgggaccggacagccctacggcccgaccttcacgaccggcgatgtgattggctgttgtgtcaacctcatcaacggaacctgtttttatacaaagaatgggcattcgctcggcatagccttcactgatctccccgccaacctctacccaactgttgggctccagaccccaggggaaatcgtggacgccaactttggccagcaaccatttctgttcgatatagaggattatatgagggagtggcgcgctaaggtccagggcacagtccactgtttcccgatatctgcacgtctgggcgaatggcaagcagttcttcagaacatggtaagctcctacctggttcaccatgggtattgcgccaccgctacagctttcgctcggatgaccgaaacccccattcaggaagagcaggcgagtatcaaaaatcgtcagagcaaggtgtactcgacctttccatttccttttttgacttgtccttag

SEQ ID NO: 202475 - DNA, 1785 bp, Artificial Sequence
  Description of Artificial Sequence: Synthetic coding sequence
atggccgccgccaccgccgaccccggcgccggcaacccccagcccggagattcttcgggggggggtgccggaggagggttgccctcacctggggagcaggaattaagtagacggttacagcggctatacccagccgttaatcagcaagaaacacccctccctcgcagttggagtccgaaagacaagtataactacatcggactttcacaaggcaacctgcgtgtccattataaaggccatggaaagaaccataaggatgccgcgtccgtgcgagccacccaccccattccagcagcctgcgggatttattactttgaggtgaaaattgtgagcaagggaagagacggctacatggggatcggcttgtcggcacagggcgtgaacatgaatagactcccggggattgcttttacggatctcccagcgaacctgtatccgactgtcggactgcagacaccgggcgaaatcgtggacgcaaacttcggacagcagcccttcctattcgatatagaagactatatgagagagtggcgcgccaaggtacagggcaccgtgcactgttttcctatatcagcacgcctgggagagtggcaggccgtactgcagaacatggtctcttcatacttggtgcaccacggttactgtgccacagccacagccttcgcccgcatgaccgagacacccatacaggaggagcaggcctctatcaaaaataggcagaaaatccagaagttagttttggaaggaagggtaggcgaggccatcgagaccacccagcgcttttaccctgggttgttggaacacaacccaaacctgctgtttatgctgaagtgtcgtcaatttgtggaaatggtcaatggaacggatagcgaggtccgcagtttgtcatcaagatcccctaagtcccaggactcgtatcctgggtcacccagccttagtccccgacatggcccgtccagctctcacatgcataataccggggccgacagccccagctgcagcaacggcgtggcttccaccaagtcaaagcaaaatcacagcaaatatcccgcgccaagctcttcatcatcctcttcgtcctccagttcatcttcctcaccatcgtccgttaactattcagagtcaaattctaccgacagcacaaagtctcaacatcactctagcaccagcaatcaggagaccagcaacccttggttgcaactcgagcgacggcccaatcaggctgctccaacgacacctcccgggcccacacccacttcaacccccccacacagtgactctgaaatggaaatggaagctgagcactaccccaatggcgtgcttggctctatgagcacccgtatcgttaatggagcttacaagcatgaagacctccagaccgatgagtcctctatggacgaccggcacccaaggagacagttgtgcggaggtaatcaggctgcaaccgagcgaataattttattcggccgggaattacaggcactttcagagcaactgggacgggaatatggtaagaatttggcacacactgagatgttgcaagatgccttcagtctgttggcctattctgacccttggtcctgccccgtgggacagcaactggaccccatacagagagagcccgtgtgcgcggcgttgaactcagctatcctggagtcccagaatctgccaaaacagccaccgttgatgctggcattaggacaggcaagcgagtgcttgcgtttaatggctagggcgggtttgggcagctgttcatttgcaagagtcgacgactacctgcactag

SEQ ID NO: 202476 - DNA, 1176 bp, Artificial Sequence
  Description of Artificial Sequence: Synthetic coding sequence
atgcgggagtggcgggccaaggtgcagggcaccgtgcactgcttccctattagcgccaggctgggtgaatggcaggctgttctgcagaacatggtctcgtcttatttggtgcaccatggatactgtgccacagcgacggccttcgccagaatgaccgagacacccatccaggaggagcaggcttccattaagaaccgccagaagatccagaaactggtcctagaaggtagggtgggcgaggctattgagactacacagcgcttctatcccggcctgttggaacataacccaaacctcttgttcatgttaaaatgccgacagtttgtcgagatggtcaatggcactgatagtgaagtgaggagtttatcatcacgctcgccgaagtctcaggacagttatcctggatctccctccttgtcacctaggcacggtccctcatctagccacatgcataacaccggagccgattctccgtcgtgctctaatggcgtggcttccactaaatcgaagcagaatcacagtaagtatcccgctccctcatctagcagttcctccagcagctcctcatcctcatcaagtcccagctcagtgaattattctgagtccaatagcaccgatagcactaagagccagcaccactcatctactagtaaccaggaaacctcagattccgagatggagatggaggccgaacactatccgaacggcgtcctggggagcatgtccaccaggatcgtaaatggcgcatacaaacacgaagacttgcagacagacgagtcttctatggacgatcggcacccaagacggcagttatgcggaggcaatcaagcggctacggagcgaatcatcttattcgggagggagttacaggccttgagcgaacaactcggccgtgagtatggcaagaatcttgctcacactgaaatgctccaagacgcattttccctgctcgcctacagcgatccatggtcctgtccagtgggacagcagctggaccctatccaacgcgaacccgtatgcgcagccctaaactcagccatcctggagtctcagaacctccccaaacagccacccttgatgctcgcactggggcaggcatcagaatgtctgagactgatggctcgagctggattggggtcctgctcatttgctcgtgtggatgattacctgcactag

SEQ ID NO: 202477 - DNA, 3267 bp, Artificial Sequence
  Description of Artificial Sequence: Synthetic coding sequence
atggccctgcacttccagagcctggccgagctggaggtgctgtgcacccatttatacattggcaccgaccttactcagagaattgaggccgaaaaggctttgctggagcttatcgattcaccagaatgtctatctaagtgtcagcttctactggaacagggcaccacgtcttatgcacagttgctggccgccacttgtctgagcaagctcgttagcagagtgagtccacttcccgtggaacagcgcatggatatccgcaactacattctcaactatgttgctagccagccaaagctggctccttttgtgattcaagcactgattcaggttattgctaagattaccaagctgggttggttcgaggttcagaaagaccagttcgttttccgggagattattgccgacgtcaagaagttccttcaggggaccgtcgagcactgcatcatcggcgtgatcatcctctctgagcttacacaggagatgaacctggtggactactctaggcctagcgcgaaacatcgcaagattgccaccagtttcagggatactagcctgaaggatgtgttggtcctggcatgttctctcctgaaggaagtgttcgccaagcctctgaacctccaggaccagtgccagcaaaacctggtgatgcaggtcctgaaattagtgctgaattgcctgaacttcgatttcatcgggtcttctgctgacgagtccgccgatgatctctgtaccgtgcagatccccactacgtggcgcaccatattcctggaacccgagacccttgacttgttcttcaatctataccactcgttgccgcccctcctttcccagttagctctgagctgtctggtgcaattcgcttccacacggcggtcactcttcaactctccggaaagagcgaaatatctaggcaacctgattaaaggagtaaagcgcatcttagagaatcctcagggcctcagcgacccaggaaactaccacgagttttgtcggtttttggctcggcttaagaccaactaccagctgggcgagctcgtaatggtgaaagagtatccggaggtgatcaggctaattgctaacttcactatcacctccctgcagcactgggaattcgccccaaattccgtccactatttgctgactctatggcagagaatggtggcctcagtccccttcgttaaatcaaccgagcctcacctgctggatacctacgcaccggagatcaccaaggctttcataacttccagactggatagtgttgctatcgtggtgagagaccacctggacgaccccctggacgacactgcgacagtatttcagcaactggaacaactgtgcacagtcagccggtgtgagtacgaaaagacttgcgcactgctggttcaactttttgatcaaaatgcgcagaattaccagaagctgcttcacccttattctggcgtgaccgtggacatcaccattcaggaagggaggctggcatggctggtgtaccttgtcggcactgtggttgggggaagactgacctacacctctactgacgaacacgacgcgatggacggcgaattgtcttgccgggtgtttcagctaatcagtttaatggatacaggtctcccaaggtgttgtaacgagaagatagaacttgccatcctctggtttctggatcagttcagaaaaacctacgtgggggatcaattgcaacggacctcaaaggtgtacgctcggatgtccgaagtgctcgggatcacagacgataaccacgtactggaaaccttcatgacaaagatcgtgaccaacttaaaatactgggggcggtacgaacccgtgatcagccgcacccttcaatttctcaacgacctcagtgtcggatacatccttctgaagaagctggtgaagatagacgcagtgaagttcatgctgaaaaatcacacgtctgagcatttcccatttctcgggattagcgacaatcatagcctgagtgattttcgctgccggactactttttacactgctttgactcgccttttgatggtcgacctgggggaggacgaggacgaattcgaaaactttatgctgccccttacagtcgcttttgagaccgtcctccaaatctttaataacaactttaagcaggaggatgtgaaacgcatgcttattggccttgccagggatttaagagggatcgcatttgccctgaacaccaagacatcttacaccatgctgttcgattggatgtatccaacttacttgcctctgcttcagaacgccgtggagcgatggtatggcgaacctacttgcaccacacccattctgaagctgatggcagaattgatgcagaaccgttcacagcgcctcaactttgacgtgtcaagccctaacggcatcctcctgttccgcgaggctagcaagatggtgtgcacatacggcaatcagatcctctctttgggctctctgtccaaggaccagatttatccgatgaaactgaaaggtatctccatttgctattctgcactgaaatcagcattgtgtgggaactacgtgagcttcggagtattcaaattatatggcgacaatcattttgacaatgtgctgcaggcatttgttaaaatgctgctgagcgtgtctcattcagatctgctccaataccggaaactgagccagagctactatcctctgctggaatgtctcactcaagaccacatgagctttataattaacctggagccgccggtcctgatgtatgtgctgaccagtatctccgagggccttactacactggacacagtggtgtcatcgagctgttgcacatccctcgactatatagtaacatacttgtttaagcatattgcaaaagaagggaagaaacctctgcggtgccgcgaggctactcaggcgggtcagcggctactgcacttcatgcaacagaatccggacgtattacagcagatgatgtctgtcttgatgaataccatcgtatttgaagattgtcgcaaccagtggagcgtctcacggccgctgttaggtctgatcttattgaatgaaaagtacttcagcgagctaagggcctctttgatcaattcccagccattgcccaagcaggaagtgctcgctcagtgcttccgaaaccttatggagggagttgagcagaacctttctgtcaagaatagagaccggttcacccagaatctgtcggtttttcgccgcgatgtagcagaagctcttagaagcgatggcaacacagaaccctgttctctcgacatgatgtcatag

SEQ ID NO: 202478 - DNA, 1557 bp, Artificial Sequence
  Description of Artificial Sequence: Synthetic coding sequence
gtgtacgcccggatgagcgaggtgctgggcatcaccgacgacaaccacgtgcttgagacttttatgaccaagattgtgaccaacttaaagtattggggaagatatgagccagtgattagcaggactctgcagtttctcaacgatctgtccgtaggctatattttgcttaaaaagctagtgaagatagacgcggtgaagttcatgctgaaaaaccacactagcgagcactttccatttctggggatatctgataaccactccctgtcagattttcgatgcagaacgaccttttacaccgctctgactaggttgttgatggtggacttgggagaggacgaagacgaattcgagaacttcatgttaccgttaacggtcgctttcgagacagtgttgcagattttcaacaataatttcaaacaggaagacgtgaaacggatgttaatcgggctggcccgtgacctgagaggcattgcattcgctctcaatactaaaactagctacaccatgctctttgattggatgtatcctacatacctgccgctactgcagaatgcggttgagcgctggtatggagaacccacatgcactactcccattctgaagctcatggccgaactgatgcagaacagatcccagagactgaacttcgatgttagctccccaaatggcatactgctgtttagggaagcctctaaaatggtatgcacttacggcaatcaaatcctgagcctcggttctctaagcaaggatcaaatttatccaatgaaattgaaagggatttccatctgctacagtgccctgaagtccgccctctgcggaaattacgtttcttttggcgtcttcaaattgtacggcgacaatcatttcgataatgtactccaggcatttgttaagatgctactgagcgtgtcacatagtgacttgctgcagtatcgtaagctgtcccagagctactatccgctcctagagtgtttgacccaggaccatatgagttttatcattaatcttgaacctcccgtgcttatgtacgtgttgacgtccatttccgaagggttaacaaccttagataccgttgtgagtagttcttgctgcacgtctttagattatattgtcacttacctcttcaaacacatcgccaaagaaggcaaaaaaccgcttcggtgccgcgaggcgacccaggccgggcagaggctgttgcacttcatgcaacagaacccagacgtgctgcagcagatgatgagcgtgctgatgaatacaattgtcttcgaggattgccggaaccaatggtctgtgtcacgccccctactggggctcatcctcctcaatgagaagtatttcagtgagcttagagctagtctcatcaactctcagcccctgccaaagcaggaggtgcttgcacaatgtttccggaatctgatggagggagtagagcagaacttatccgtgaagaatagggataggttcacccaaaatttgtccgtgtttagacgagacgtagccgaggcccttcggagcgacggcaacacagagccatgtagtttggatatgatgagctag

SEQ ID NO: 202479 - DNA, 1419 bp, Artificial Sequence
  Description of Artificial Sequence: Synthetic coding sequence
atggacatccggaactacatcctgaactacgtggccagccagcccaaattggcccctttcgtgattcaagctctgatccaggttatcgcgaaaattacaaagctgggatggtttgaggttcagaaggatcagtttgtgttccgagagattatagctgatgtgaagaaatttcttcaggtcgactacagtagaccaagcgcaaagcataggaaaatcgctacatcattccgggacacctctctcaaggacgtcctcgtacttgcatgcagcctgctgaaggaagtgtttgctaagccactcaacctgcaggaccagtgccagcagaatttagttatgcaagtgctgaagctagtgctgaactgcttgaacttcgattttatcggatcctccgcagacgagtcagccgacgatttatgcacagtgcaaattcccactacatggagaaccatattccttgagcccgagacactcgatctattttttaatctgtatcattctctccctcccctgctgtctcagctcgcactcagttgcctggtgcagttcgcgagcacccgtaggagcctctttaacagtccagaaagagcaaagtatttgggcaacctcattaagggagttaagagaatcctggagaaccctcagggattgagtgatcctgggaattaccacgagttctgcagattcttggcacgcctgaaaaccaattaccagctcggcgaacttgtcatggttaaggaataccctgaagtgatcagattaatcgctaactttaccatcacttctctacagcactgggagtttgcccctaacagcgtgcactacttattgacgctatggcaaaggatggtggcctctgtgccgttcgtgaagagtacggaaccccatttgcttgacacttatgcacccgagattactaaagcttttataacaagcagactagactcggttgcgatcgtcgttcgcgaccacctcgacgacccactggatgacaccgccaccgtcttccagcagttagagcagctctgtacagtaagccgatgtgagtatgaaaaaacatgtgccctccttgttcagcttttcgatcaaaatgcccagaactaccagaaactccttcacccatacagcggagtgactgtggatataacaatccaggagggcaggcttgcttggctggtatatctagtaggcacagtcgttggaggcagactcacctacacaagcactgatgagcatgatgctatggatggagagttatcatgccgggtgttccagctcatctccctgatggatacaggactgcctagatgttgcaacgagaagattgaactggccattctgtggttcctcgaccagttcagaaaaacctacgtgggcgaccaacttcagagaacgtccaaaaagacttttatctatctgtag

SEQ ID NO: 202480 - DNA, 9675 bp, Artificial Sequence
  Description of Artificial Sequence: Synthetic coding sequence
atgcggcggagcaaggccgacgtggagcggtacatcgccagcgtgcagggcagtactccttcacctcgccaaaagtccatgaaggggttctattttgcaaagctatattacgaagccaaagaatatgacctggccaagaagtacatctgtacttatataaatgtacaagaaagggatccaaaagcacaccggtttcttggccttctctatgagctcgaggagaacactgacaaagccgttgagtgctataggcgtagtgtggagctgaatcctacgcagaaagatttggttctaaagatcgccgaactcctgtgtaagaatgatgtgactgatggaagggcgaagtattggctggagcgagctgctaagttatttcccggctcacctgctatctacaaactgaaagaacagctgttagactgtgagggcgaggatggatggaataagctgtttgatctcatacagtccgaactgtacgtaagacccgacgacgtccacgtgaacattaggcttgtcgaagtgtatcgatctaccaaacgcctgaaggacgccgtggctcactgtcatgaggccgaacggaatatcgccttaaggtcctccctggagtggaattcttgcgtagtgcagacgcttaaagagtacctcgagtccctgcaatgtctggagagtgataaatcggactggagggcaactaacaccgatttgctcctggcctacgctaatcttatgctgctgacactgtccacgagagatgtgcaggagagcagggaattattacagtcttttgattcagcattgcagtcagtcaagagcctggggggtaacgatgagcttagtgccacatttctggagatgaaaggtcatttctacatgcacgctggatcattgctgctcaagatgggccagcactcgtccaatgttcagtggagagctcttagcgagctcgcggccttatgttatctcattgcctttcaggtacctagacccaaaataaaactgattaagggtgaagcaggacagaatctgctggagatgatggcatgcgaccggttgagtcagtcaggccacatgctgctgaatctgtcaaggggtaaacaggactttctgaaggagatagtagagacctttgctaataagtccggccagtcggcattgtatgacgctcttttctcatcacagtccccgaaagacacatcgttcctcggctctgatgatattggtaacattgacgtaagggaaccagagttggaagaccttactcggtacgatgttggagcaatcagggcccacaacggttcattgcagcatctgacctggctcgggctgcaatggaatagcttgcccgccttgcccggtatcagaaaatggctcaagcagttgttccaccatctgccccatgagacaagccgcctcgaaacaaacgcacccgaatccatatgcatattagatttggaagtgtttctgctcggcgtcgtgtacacatctcacttgcagcttaaggagaagtgtaactcccatcactcatcctaccagccactctgcctgcccctgcctgtttgcaaacagctgtgtacggagaggcaaaaatcatggtgggatgctgtgtgcaccctgattcatagaaaggctgttcctggaaatgtggctaaactgcgtctgttggtgcagcacgaaattaacactctgagagcacaggagaagcatggattgcagcctgctctgttggtccactgggccgagtgtctccagaagacaggttctggacttaacagtttctacgaccaacgcgaatatataggccgatccgttcactattggaaaaaagtgcttcctctgctcaaaatcataaagaagaagaactcaatccccgaacctattgatcctctcttcaagcactttcactccgttgatatacaggcatccgaaatagtcgagtatgaggaagatgcccatatcacattcgcgatcctcgacgctgtgaatggcaacatagaagatgcagtgaccgccttcgagagtataaagtctgttgtctcctactggaatttagctctgatcttccaccgcaaggcggaggatattgagaacgacgccttgtcgcctgaggagcaggaagaatgcaaaaattacctgagaaagacacgcgattatttgatcaaaatcatcgatgacagcgactcgaatttgtcagtggtgaagaaactgccagtgcccctcgagagtgtgaaggagatgctgaacagcgtgatgcaggagctggaagactattctgaaggtggaccgctgtataagaatggatctctgagaaacgctgatagcgagattaaacatagcaccccttcccctactagatactcactgtctccttcaaagagttacaagtatagcccgaagactcctccgagatgggccgaggatcagaatagtctgcttaaaatgatttgtcagcaggtagaggcaatcaaaaaagagatgcaggaactgaagctcaactcttctaatagcgcctccccacatcggtggcctaccgagaactatgggcctgacagcgtgccagatggataccagggctcccaaacctttcatggcgctcctctcacagttgcaacaaccgggccttccgtgtattattcccagtcccccgcgtacaactcacaatatctactgcggcctgcagcaaatgtgacgccaacaaaggggccagtctatgggatgaatcgccttccccctcagcagcatatttacgcatatccacagcaaatgcatacgccccctgttcaatccagcagcgcctgcatgttctcccaggaaatgtacgggcctcccgctctgcgctttgagagccctgccacaggaattctgtccccccgaggagatgattacttcaactacaacgtacaacaaacttccaccaatccaccgctgccagagcctggctactttaccaaaccaccaattgcggcacacgcctccagatccgccgaaagtaaaacaattgagtttggcaaaacaaacttcgtgcagcctatgccaggtgaaggacttcgtccatcgctgcctacccaagctcatactacacagcctactccgttcaaatttaacagtaattttaagagcaacgatggcgactttacgttcagctcaccccaagtggtaacacagcctccaccggccgcatacagcaactccgagagcttgctgggtctgttgacttccgataaacctttgcaaggtgatgggtacagcggggcgaaaccaatccccggcggtcagaccattggacctaggaatacctttaacttcggatccaagaatgtgagcggtatttccttcacggaaaacatggggtctagccagcagaagaatagtgggtttcggagatcagacgatatgtttacatttcatggacccggcaagtctgtcttcggaacgcccacgttagagacagctaataagaaccacgagaccgacggcggttctgcccatggagacgacgacgatgatggcccccacttcgagcctgtagtgccacttcctgacaaaatcgaggtcaaaacaggcgaagaggatgaggaggagtttttttgtaaccgggcaaaactcttcaggttcgatgtggaaagtaaagagtggaaggagcgtgggatcggcaatgtgaaaatcctgcggcataaaaccagcggtaaaataaggctgctgatgaggcgcgagcaggtgctgaagatttgtgccaaccactatatctcccctgacatgaagcttacacccaacgctggcagtgatcgcagctttgtgtggcacgccctggattatgcagatgaactgccaaaaccagagcagctggccatcaggtttaagactcccgaggaagcagccctttttaagtgtaagttcgaggaggcacaatccatattaaaagcaccaggcacgaacgtggccatggccagcaatcaagccgttcggattgtcaaagagcccacgagccacgacaacaaggacatatgtaaatctgacgccggtaatctcaatttcgagttccaggttgcaaagaaggaaggaagttggtggcactgtaatagctgtagtctgaaaaacgcctccacagccaagaaatgcgtctcctgtcagaaccttaaccccagtaacaaagaactggtgggcccaccactggcggaaaccgtgtttactcctaagacatctcccgaaaatgtccaggacaggtttgccctggtcacacccaagaaggaaggtcactgggattgttcaatttgtcttgtaagaaacgagccaaccgtgagtcgatgtattgcctgccagaacaccaaatcagccaataagtccggttcaagtttcgtgcaccaggcctcctttaagtttggacaaggggacctcccaaagcctattaactccgactttcgttcagtgttcagcaccaaagagggtcagtgggactgcagcgcctgcctggttcagaacgagggatcaagtaccaaatgcgcggcctgtcaaaacccacggaaacagtcgctgccagcaacaagcattcccacccccgctagtttcaaattcggcacctccgaaacgagtaaaactctgaagtctgggttcgaggacatgtttgctaagaaggaggggcagtgggactgtagctcctgcctcgttaggaacgaagctaatgccactcggtgcgtcgcttgccagaatccagataagccgtccccgagcacctccgtgcctgcaccagcgagtttcaaattcgggacctccgaaacttccaaggctcctaaatcgggattcgaaggtatgtttacaaagaaagaaggccaatgggattgctccgtttgtttggtgagaaatgaggcctctgctaccaaatgcattgcctgccaaaacccggggaagcaaaaccaaactaccagcgccgtaagtacgcccgcctcaagcgaaactagcaaagcacccaagtctggttttgagggaatgttcacgaagaaggaagggcaatgggactgctccgtttgcttggtccgaaacgaggcctcagcaacaaagtgcatagcctgccagaacccaggaaagcagaatcagaccaccagcgccgtgtccactccggcttcatcagagacctctaaagctcccaaatcaggttttgagggcatgtttactaaaaaggagggccagtgggactgttccgtctgtctcgtgcgcaatgaagcatccgctacaaagtgtattgcttgtcagtgtccgtctaaacaaaaccaaacaactgcaatctctactccagcctcctcagagatctctaaggctccaaagtccgggtttgaggggatgttcatacgtaaaggccagtgggactgctctgtctgctgcgtacaaaatgaaagctctagcctgaaatgcgtcgcctgcgacgcttctaaacccacacataaaccgatcgcagaggccccctccgcctttaccctaggtagtgagatgaagctccatgactcatcaggatcccaggtagggacgggcttcaagagtaatttttctgagaaggctagcaagttcggcaataccgagcaaggctttaaatttggccacgttgatcaagaaaatagcccaagttttatgtttcaaggatcctctaataccgagttcaaaagtacaaaagaaggatttagcatccctgtgagcgcagatggcttcaagtttggtatcagcgagcccgggaaccaggaaaagaagtccgagaagcccttggaaaacgggactggatttcaggcccaggacataagtggtcagaaaaacggtcgcggcgtaatcttcggccagacatctagtacctttactttcgccgacctcgcgaagtctacaagcggcgagggcttccaatttgggaaaaaagatcctaacttcaagggtttctcaggagccggagagaagcttttcagttcgcaatatggtaaaatggccaacaaagcaaatacctctggagacttcgaaaaggatgatgacgcctataagaccgaagactccgacgacatccattttgaaccggtcgtgcaaatgcccgaaaaagtcgaactggtcaccggagaagaagatgagaaagtgctgtattcgcagcgcgttaaactgtttcgattcgacgccgaggtgtcccagtggaaagagcgcggcctgggaaatcttaaaatattaaagaacgaggtgaatggcaagcttagaatgctgatgcggagagagcaggtgctcaaagtctgcgcaaaccactggattaccaccacgatgaacctgaaaccgctgagcggctctgatcgggcttggatgtggttggcctctgatttctctgatggagatgccaagcttgagcaacttgcagcgaaatttaaaacaccagaacttgcagaggagtttaagcaaaagttcgaagagtgtcagcgacttctgctggacatccctctgcaaactccccataagctcgtcgacactggtcgggcagccaagctcatccagagggccgaagaaatgaagtccggtctcaaggatttcaagaccttcctgacgaacgaccagacgaaggttactgaggaagaaaataaagggtctggcaccggcgcagccggcgctagcgacactaccattaagccaaatccagagaacacaggcccaaccctcgagtgggacaactacgacctgcgggaggacgccctggacgattcggtcagttcaagcagtgttcacgcttcaccgctggcctcttccccagttcgtaagaatcttttccgcttcggtgagtcgactactggtttcaacttttcctttaagtcagccctctcgccctctaagagtcctgcgaagctgaaccagagcggcacaagtgtgggcacagacgaggagtcagacgtgacccaggaagaggaaagagacgggcagtactttgagcctgttgttccgttaccggatctggtcgaagtaagttctggagaggagaacgaacaggttgtcttctcacaccgggcaaagctttataggtacgataaagatgtggggcaatggaaagaaaggggtattggagacatcaaaatcttacagaattacgataacaaacaggtgaggatagtcatgaggcgggatcaggtccttaaactctgtgcaaaccaccggattactcctgacatgactctgcaaaatatgaagggcaccgagagagtgtggctctggacagcttgtgatttcgctgacggagagaggaaagtggagcacctggcggttaggtttaaactgcaggacgtcgccgacagctttaaaaaaatttttgatgaggcaaagactgctcaggaaaaagatagtttaattacaccccatgtgagccgctctagcacaccccgggagagtccatgtggcaaaatcgccgtggccgttcttgaggagacaacaagagagcgtacagacgtgatccagggcgacgacgtagcagacgccaccagcgaggttgaagtgtctagtacttcagaaaccacgcctaaggccgtggtctccccgccaaaatttgtgtttggttctgagtccgtgaagtctatcttctcaagtgaaaagtccaagcccttcgccttcggcaactcttcagctactggctcactcttcggatttagttttaacgctcctttaaagagtaacaatagcgaaacctccagcgtcgctcagtcaggctccgaatcgaaagtcgagcccaaaaagtgcgaacttagtaaaaatagcgacatcgagcagagcagtgattctaaggtgaaaaacctcttcgctagtttcccgacggaggaaagctctatcaactacacctttaagacccctgagaaggcaaaagagaaaaagaaacccgaggactctccaagcgatgatgacgtgctcatcgtgtacgagttaacccccacggcagagcagaaagccctagccacaaaattgaagctgcctccgacctttttctgctataaaaaccgccctgactatgtttctgaggaggaggaggacgacgaagatttcgagacagctgtcaaaaaacttaatggcaaattgtatcttgacggtagtgaaaaatgtcgcccgttagaagagaatacagctgacaacgagaaagaatgcattattgtttgggagaaaaagcccacggtggaggaaaaggcaaaagccgatacactgaagctgccacccacgttcttctgcggggtgtgcagtgacacagacgaggataacgggaacggggaggatttccagagcgagcttcaaaaggtgcaagaagcccaaaaaagccagaccgaagaaatcacctccacgaccgatagtgtgtacactggcgggactgaagtgatggtgccatccttctgcaagtcagaagaaccagattctatcaccaagtcaataagtagtcctagtgtgtcttccgagaccatggacaagcctgtagatctgagtaccagaaaggagatagacaccgatagcacctcacagggcgaatccaagattgtcagctttggttttggatccagcactggcctgagttttgcggacctggctagctccaactctggtgactttgcatttggctctaaagacaagaactttcagtgggccaatacaggcgctgccgtatttgggacccagtctgtagggacccaaagtgcagggaaagtgggagaggatgaggacggatccgatgaggaagtggtccacaacgaagatatacacttcgaaccgatcgtgtcccttccagaagtagaggtcaaaagcggcgaggaagacgaggagatcctctttaaggaaagagccaaattgtacagatgggaccgtgatgtctcgcaatggaaggaacgcggggtgggagatatcaaaatcttatggcataccatgaagaactattaccggatcctgatgcgccgcgatcaggtgttcaaggtgtgcgccaatcacgtgattaccaaaaccatggaactcaaaccactgaacgtctccaataatgccctggtgtggacagcctcagactacgccgacggcgaggccaaagtggagcagcttgcggtccgatttaaaaccaaggaagtggctgattgctttaagaagaccttcgaagagtgtcaacagaatttgatgaagctgcagaaaggtcacgtcagcctcgctgctgaactgtccaaagagacaaatcctgtggtctttttcgacgtgtgtgcagacggggaacccttggggcgcattacaatggaactgttttctaatatcgttccccggacagcagagaattttcgggccctgtgcacaggggaaaagggtttcgggttcaagaatagcatatttcatagagtcatcccagacttcgtgtgtcaggggggcgatatcacgaaacatgacggtacaggcggccagtcgatttacggtgataagttcgaggatgaaaactttgacgtcaagcataccggcccaggcctactgtcaatggccaatcaagggcagaacactaacaactcccagttcgtaatcaccctgaaaaaggcagagcaccttgactttaaacatgtagtttttggctttgtgaaagatggaatggatacagtgaagaagatagaaagttttggttcacccaaaggctccgtttgccgtcggattacgatcacggaatgtggacaaatttag

SEQ ID NO: 202481 - DNA, 1500 bp, Artificial Sequence
  Description of Artificial Sequence: Synthetic coding sequence
atggccgacctggccaacgaggagaagcccgccatcgccccccccgtcttcgtgttccagaaagataagggacagaaaaggagcgcgggcggttcatccccggaaggtggggaagactctgatcgcgaagacgggaactactgtccccccgttaagcgagagagaaccagcagccttacgcagtttccaccctcacagtctgaggagaggtcttccggattccggctgaagccacctaccctcattcacggacaagccccctccgctggattaccatctcagaaaccaaaagagcagcagaggtccgtcctaaggcccgccgttctgcaggctcctcagcctaaagcactttcacagactgtgccgagctccggcacaaatggagtgtcactgccagcggactgcaccggcgcggtccctgctgccagccctgatactgccgcttggcgctctccttctgaagccgccgacgaggtgtgtgctctggaggagaaggaacctcagaagaacgagagctccaacgcttctgaggaggaagcttgcgaaaagaaggaccccgccactcaacaggccttcgtgtttgggcaaaaccttagagaccgagtcaaactgataaatgagtcagtggatgaagcagacatggaaaacgctggccatccatctgctgacactcccacggccaccaattatttcctccagtacatcagttcaagcctcgaaaattctacaaactccgcagacgcctcctccaacaagttcgtgtttggacaaaatatgagcgaaagggtcctgagtccaccgaagctgaatgaagtgtcttctgacgcaaaccgtgagaatgccgctgccgagagcgggagtgaaagtagcagccaggaagccacacccgagaaagaatcattggccgagagtgcggctgcctatactaaggccacggctcgtaagtgcctgctggaaaaggtggaagtgatcacaggggaggaagccgaatccaacgtgctccagatgcagtgcaagctgtttgtgttcgacaaaactagccagtcttgggtggaacggggcagaggcttgttgcggctcaacgatatggcctcaactgacgatgggacattacaatcccgcctggtgatgaggacacagggaagcctcaggctgattctcaacaccaaactctgggcacagatgcagattgacaaagcaagcgagaagtccatacggatcaccgccatggacacagaggatcaaggggtcaaagtcttcctgatcagcgccagttcgaaggatacagggcaactgtacgctgctctgcaccataggatcctagccttgagaagtagagtagaacaggagcaggaagccaagatgcctgctcctgagcccggcgccgctccatccaacgaggaggatgattctgatgacgacgacgtgctcgctcccagcggcgctacggcagcaggagctggagacgagggtgatgggcagactacaggatcaacttag

SEQ ID NO: 202482 - DNA, 1194 bp, Artificial Sequence
  Description of Artificial Sequence: Synthetic coding sequence
gccgacgtgaccaaggccgagaagcccgccatcgccccccccgtgttcgtttttcagaaggataagggtcagaagcggtcagccggcggatcctctcctgaggggggggaggactcagatcgagaggatgggaactactgtccaccagtcaagcgtgagcggacctcctccctgacacagtttcccccttcccagtccgaggaaaggtcctcgggttttcgccttaaacccccaaccttaatccatggccaggctccttcggctggtttaccctcccagaaaccaaaggagcagcagcggagcgtgctgcgccctgccgtgctccaggctccacaacccaaagctctgtcacaaacggtgccttcttctggcaccaacggggtgagtttgccagccgactgtacaggcgcagtgccagcggccagcccagacacagctgcctggcgttctccttccgaggctgccgatgaggtctgtgcgctagaggaaaaggagccacagaagaacgagtcttctaacgcaagtgaggaagaagcttgcgagaaaaaagacccggccactcagcaggcttttgtgtttgggcaaaatctgagagatcgcgtcaagttaatcaatgaatcagtggacgaagcagatatggagaatgcagggcacccttccgctgatactcccaccgcaactaattattttctgcagtacataagcagcagtctagaaaattccaccaatagcgctgatgcttcttctaataagtttgttttcggccagaatatgagcgagagggtgcttagtcccccgaagttgaacgaggtgagctcagatgccaaccgtgaaaatgctgccgcagaaagcggctcagaatcctcgtcacaggaggccactccagagaaagagtccctggccgaatcggccgccgcctacacaaaggccactgcccgtaaatgtctgttggagaaggtcgaagtgattaccggcgaggaagccgagtccaacgtccttcaaatgcaatgtaagctgttcgtgtttgataaaactagccaaagctggtggctgctgaggcatccacacccctctcaccctgccgttggtccttgtctttgcggcgaacagccggccctttgtccgtgcccaggcttgcccaattaccgacccggtaccccggctcaattgggcggtctcctggtgcgggtctag

SEQ ID NO: 202483 - DNA, 1704 bp, Artificial Sequence
  Description of Artificial Sequence: Synthetic coding sequence
atggccgacctggccaacgaggagaagcccgccatcgccccccccgtcttcgtgtttcagaaagataaggggcagaaatcccccgccgagcagaaaaacctgtccgattcgggagaagagcctcggggtgaagccgaggcacctcaccatggaaccggtcatccagagtctgctggggagcatgcactggaacctcctgctccagccggcgccagtgcatctactcccccaccacctgctcctgaggctcaattgccaccttttcctagggaactagctggtcgctctgccggcggcagcagtcctgaagggggagaagattctgacagagaagacggtaactactgtcctcccgtgaagagagagaggacctccagcttaacccaattccctccttcacagtcagaagagcgctcgagcgggtttcggcttaaacctccgacgcttatacatgggcaggccccttctgccggcctgccatcacagaaaccaaaggagcaacagaggtccgtactcaggcccgcagtgctccaggccccacagccaaaggctctgtcgcagaccgttcctagcagcggcactaacggtgtaagtttgccagcagattgtaccggagccgtaccagcggcctcaccagataccgccgcatggcgcagtcccagcgaggcagccgacgaggtctgcgcacttgaagagaaggagcctcagaagaacgaaagcagcaacgcttctgaggaggaggcttgcgaaaagaaggatcctgctacccaacaggcatttgtctttggccaaaatttgcgcgaccgggtgaaactgatcaatgagagcgtcgacgaggcggacatggagaacgcaggacacccatccgctgacaccccgaccgccaccaattatttcctgcagtatatttcaagctctctggagaactccactaactccgccgacgccagcagcaataaatttgtgtttggacaaaatatgagtgagcgcgtgctgtctccgcccaaattgaacgaagttagttctgacgccaacagggaaaacgcagccgctgaatcaggctccgagagttcatcccaggaggctaccccagaaaaggaaagtctcgcggagtccgctgctgcttatacaaaagctacagcgcgcaaatgtctcctagaaaaggtggaagtgatcactggagaggaggccgagtcaaatgtgttgcagatgcaatgtaagttgtttgtcttcgacaagacatcccaatcatgggtcgaacgcggtaggggcttattgcggctgaacgacatggcctctactgatgatggcacactccagagtaggctggtcatgcgcacccaagggagcttgaggctgatcctgaatactaagttgtgggctcaaatgcagatagacaaggcttccgaaaagtcaattagaattacggcaatggataccgaggatcagggagtgaaagtatttctaataagcgcatcttctaaagacacaggtcagctgtatgccgcgttgcaccaccgaatcctcgccctgcggagcagagtggagcaagagcaagaagccaaaatgcccgctccagagcccggcgcagctccctccaatgaagaagatgatagtgacgacgatgacgtgcttgcaccctccggagctaccgcagcaggagcaggtgacgaaggcgatggccagacgacgggatcaacctag

SEQ ID NO: 202484 - DNA, 1689 bp, Artificial Sequence
  Description of Artificial Sequence: Synthetic coding sequence
atggccgacctggccaacgaggagaagcccgccatcgccccccccgtcttcgtgttccagaaggataaagggcagaagagcccggccgaacagaagaacctgagtgatagcggcgaggaacctagaggagaagccgaggccccccaccatggaaccgggcaccctgaatcagccggcgaacacgccctggaaccacccgcgccagctggggcaagcgcttctactcctcccccgcccgctcccgaggcacagctcccaccttttcctagggagctggcagggaggtccgcaggcgggtcttctcccgagggcggagaagattcagacagggaggatggaaattattgccctccagtcaagagggaaaggacgtcctcactgactcagtttcctcccagccagagcgaggaaaggtccagtggctttagactgaagccacccaccctgatacacgggcaagctccttctgctggcctaccttctcaaaagccaaaggaacagcagagatccgtgcttaggccagcagtgcttcaggccccacagccgaaggcactatcccagaccgtcccatcctccgggacgaatggagtgtcactgccagctgactgtaccggtgctgttcctgcggcatcacctgacacggcagcgtggagatctcctagtgaggcagccgatgaggaaaaggagccacagaaaaatgaatcctccaacgcttctgaggaagaagcctgcgaaaaaaaggaccccgccacgcaacaggcatttgtctttggacaaaatcttagagaccgtgtgaagctgataaacgagtccgtcgatgaggcagacatggaaaacgccggccatccctcagccgacactcctaccgcgaccaactattttctgcagtacatatctagcagtctggaaaacagcactaattccgctgacgcctcctccaataagtttgtctttggccagaatatgagcgagcgagtcctttcccctccaaaactgaacgaagtttccagcgatgctaaccgtgaaaacgccgccgctgaatcgggctctgagtcgagctctcaagaagccacccctgagaaagaatcactggctgaaagtgccgccgcatatacaaaggctacagctcggaagtgcctgttggagaaagtggaggtcattacaggtgaggaggcggagagcaacgtactccaaatgcaatgtaagctgtttgtgttcgataagacgagtcagtcgtgggtggaacgcggacgcgggctgttgaggctcaatgacatggctagcaccgatgacggaaccctgcagagtaggctggtgatgagaactcagggttccctgcgactgatcttaaataccaaactgtgggcccaaatgcagatcgataaagcttccgagaaatctatccgcatcaccgcgatggatacggaggaccagggcgtaaaagtgttccttataagcgcaagctccaaagatactggtcagctttacgcagccctgcaccaccgcattcttgctctacgcagtcgtgtcgagcaggagcaagaggccaaaatgccagcgcccgaaccgggcgctgccccatctaatgaagaggatgatagtgatgacgatgacgtgttggcacctagtggagctacagccgcaggagctggagatgaaggggatgggcaaacaactggctccacgtag

SEQ ID NO: 202485 - DNA, 1320 bp, Artificial Sequence
  Description of Artificial Sequence: Synthetic coding sequence
atggccgacctggccaacgaggaggagcggagcagcggcttccggttgaaaccgcccacgttgatacacggccaggctcccagcgcaggactccctagtcagaaacctaaggagcagcagagaagcgtacttaggccagcagtgcttcaggcaccccagccaaaggctcttagtcaaactgtgccttcctcaggtaccaatggcgtgagtctgcccgctgactgcaccggtgcggtccctgccgcgagcccagacaccgcagcatggagatcaccaagcgaggcggccgatgaagtttgcgccctggaggagaaggaaccacaaaaaaacgagtctagcaacgccagcgaagaagaggcctgcgagaaaaaggaccctgcaacccaacaagctttcgtgtttggtcaaaacctgcgtgacagggtaaagctcataaatgaatcagttgatgaggccgacatggaaaatgccgggcacccttcagcagacacccctacggctaccaactactttctgcaatacattagcagctctcttgaaaactctaccaactccgctgacgcttcctcaaacaagttcgtgtttggccaaaacatgagcgagagggttttaagcccacccaaactgaacgaggtgtccagcgatgcgaatcgagaaaatgcggctgctgaatccggctccgagtcttctagtcaggaggctactcctgagaaggagagtctagcggagtcagccgcagcctatacaaaagccaccgccagaaagtgtctgttggaaaaggtggaagtgatcacaggagaggaggccgagtctaacgtcctgcagatgcagtgcaaacttttcgtcttcgacaagacaagtcagagctgggttgaacgggggcggggtctgctgagactaaacgacatggcctccacggacgatggcactttgcagtctaggttagtgatgcggactcaggggagtctccggttgattctgaataccaagctgtgggcgcagatgcaaatcgacaaagcttctgaaaaaagcatacgcattactgctatggacactgaagaccagggggtgaaagtcttcttgatcagcgcaagcagcaaggacacaggacaactctacgcggctcttcatcatcgcattcttgccctgagatcccgcgtcgagcaggagcaggaggcaaagatgcccgcccccgagccgggcgctgctccgtcaaatgaagaggatgactctgacgatgatgacgtcttggccccatcgggggccaccgccgccggcgccggtgatgaaggtgacgggcagaccacaggtagcacctag

SEQ ID NO: 202486 - DNA, 2190 bp, Artificial Sequence
  Description of Artificial Sequence: Synthetic coding sequence
atgagcggccagcccccccccccccccccccagcagcagcagcagcagcagcagctgagcccgccccccccagcagctctggcaccagtgtccggagtagtgctgccagcaccacccgcggtcagtgcgggcagcagcccggcagggtcacccgggggaggcgccgggggggagggcttaggggctgctgccgccgccctattgttgcatccccctccacccccccccccggctactgcagcacctcccccccctcctcctccccccccacctcccgcctcagcagcggctcccgcgagtgggccacctgctccacccgggctggcagctggccccggcccagcggggggcgctccgacccccgctttggtggccggtagttctgccgctgcccctttcccccatggagatagtgcgctgaatgagcaagaaaaggaattgcaacgaagactgaagcggttataccctgctgtggacgagcaggaaacacctttgcctcggagctggagcccgaaagacaagtttagctatattggcctttcccagaataatctacgcgtccattataaaggacatggtaagacccctaaggatgccgcatctgtgagagcaactcaccctatccccgccgcgtgcggaatctactactttgaagttaaaattgtgtcaaagggtcgggacggctacatggggattggcttgtcagcccaaggcgtaaacatgaaccgcttgccaggctgggataaacacagctatggatatcacggagatgatggccattcgttttgttcttcaggcactgggcagccctacggcccaaccttcactactggagatgtgataggttgttgtgtgaacctgattaataacacctgcttttacacaaagaacgggcatagcctaggaatagcatttaccgacctcccccctaatctgtaccccactgtaggactccagaccccaggagaagtcgtcgatgccaatttcggccagcatccattcgtgttcgacatagaggactacatgcgggagtggaggactaaaatccaggcccagatagatcgttttcccatcggggacagagagggagagtggcagacgatgattcaaaagatggtgtcatcgtatttggtgcatcacggatactgtgccactgccgaggctttcgctcggtccacagaccagacggtgctcgaagaactggccagtatcaagaacaggcagcggatacagaaactcgtactcgctgggaggatgggagaggccattgagacgacccaacagctttacccctccctattagagcgcaacccaaacctcctgtttacactgaaggtgcggcagtttatcgaaatggtgaacgggacagacagcgaggttcgatgtttgggcggcagatctcctaagtcccaagatagctaccctgtgtcacccaggcccttttcctcaccgtcaatgtccccctcccacggaatgaacatccacaacttagcctctggtaaaggctccacggctcacttctccggcttcgaatcctgcagtaacggcgtgatctctaataaagcccatcagtcctattgtcactcaaataagcaccagagcagcaatctgaatgtgcctgaactgaatagcataaacatgtcgaggagccagcaggtgaataacttcacatcaaatgacgtggacatggagaccgatcattattccaacggggtgggcgagacaagttcaaatggctttctgaatggctcctcaaagcacgaccacgagatggaggactgcgatacggaaatggaggttgattcgagtcaactgagacgtcagctctgcggaggctcgcaggctgcaatagaacggatgattcactttggcagagagctccaggccatgtccgagcaactgcgccgggattgtgggaagaacaccgcaaataagaagatgcttaaggatgccttttcgctgcttgcgtacagcgacccatggaattcccccgtcggcaaccagctggaccccattcagcgggagcctgtctgcagtgccctgaattctgccatcctggagacgcataacctccctaaacagccacccctggccctcgccatggggcaggccacccagtgtctgggcttaatggcccgttcaggaattgggagttgtgccttcgccacggtggaggactatctccattag

SEQ ID NO: 202487 - DNA, 1176 bp, Artificial Sequence
  Description of Artificial Sequence: Synthetic coding sequence
atgagcggccagcccccccccccccccccccagcagcagcagcagcagcagcaattgagccccccgccgccggcagctctggctccagtatctggagtggtgctgcccgcccccccagctgtgtcggcgggcagtagccctgcagggtctcctggtgggggagctggaggggaggggctgggtgctgcagctgcggccttgttactacacccccctccacctcccccgccagctacggcggctcccccacctccacccccaccgccccctcccccggcatctgctgctgccccagcatcgggcccccctgccccaccagggctcgccgccggtccagggcccgccggcggtgctcccacgcctgcactggtcgctggatcgagcgccgctgccccattccctcacggcgatagcgctttgaacgagcaggaaaaggaactccagaggaggctaaaaaggctataccctgcggtcgacgagcaggaaaccccactgcccaggtcatggtcccctaaagataaattcagttacatcggtctgagccagaacaatctacgtgtgcactacaagggacacggaaagacacctaaagacgcagcaagcgtccgagccacccacccaatccctgcggcctgcggaatctactacttcgaagtcaagatcgtaagcaaaggccgggacggctatatgggcatcgggctctcggcacagggtgtcaacatgaaccgactgcctggatgggataagcactcctacggatatcacggcgatgatgggcattccttctgtagctccggaaccgggcaaccttacggacccactttcaccaccggcgacgtcatcggatgctgcgtgaacctgatcaacaatacttgcttctacactaaaaatggtcactctctgggaatcgcctttacagacctgcctccgcttgattacccggtgtctcctcgacctttttcttctccctcaatgtcgccctctcatggcatgaacatacacaacctcgcgtcaggtaaagggtctacagcccatttctccggttttgagtcctgttctaatggagtaatcagcaacaaagcgcaccaaagctattgtcatagcaacaagcaccaatcatccaacgagtgcacacgcaccaagcaatacaaatacgtgaagattaccgcatcttag

SEQ ID NO: 202488 - DNA, 1503 bp, Artificial Sequence
  Description of Artificial Sequence: Synthetic coding sequence
atgggcatcggcctgagcgcccagggcgtgaacatgaaccggctgccagggtgggacaagcattcctacggttatcatggcgatgatggccatagtttctgcagttccggcaccggacaaccatacggccctacattcactactggggacgtcataggctgctgtgtcaatctgatcaataacacgtgtttttatacaaaaaacggacattcgcttggaatcgcattcacggacctgcctcctaacttatatccgacagtggggctccagactcccggcgaggtcgtagatgccaattttggacagcatcccttcgtgtttgacattgaggattatatgcgggaatggcgtacaaagatccaagcccagatagaccgtttccctattggtgacagggaaggggagtggcagactatgattcaaaagatggtgtctagttacctcgttcaccatggatactgcgccactgctgaggcctttgcaagatccacggatcagactgtcctcgaggagctggcctcaatcaaaaatcgccagcggatacagaagctggtgctggctggaaggatgggcgaagccatcgagacgactcagcagctgtacccttcactacttgagcgaaatcctaacctgctgttcacactgaaagtgcggcagttcattgaaatggtcaatggcactgattccgaagtacggtgtcttggtggcaggtcaccgaagagccaggattcttatccggttagtcctcgccctttctcttcccctagtatgtcccctagtcacgggatgaacattcataacttggcgagcggaaaggggagtacagcacatttttctggctttgaaagttgtagtaatggcgtcatttctaacaaggctcaccagtcctactgtcattccaataagcaccagtcctctaatctcaatgtgcccgagcttaatagtatcaacatgtccagaagtcagcaggtaaacaatttcactagcaatgacgtcgacatggaaaccgaccattacagcaacggtgttggcgagaccagctctaacgggtttcttaatgggtcttctaagcatgaccatgaaatggaggattgtgacacagagatggaagtcgatagctcacaacttaggcgtcagctctgcggagggagccaggctgccattgaacgcatgatccatttcgggagagagctccaagcaatgagtgaacagctgaggcgcgattgtggcaaaaatacggccaacaaaaaaatgttgaaggacgcattctcactgcttgcctatagcgacccatggaactcgccagtgggcaaccaattggaccccatccagcgagagcctgtgtgttccgcactcaatagcgccattctagaaacccacaacttgcccaagcagccgccattggccttggcaatggggcaagccacccagtgtctcggactaatggcccggagcggcatcggttcttgtgccttcgcaacagtggaagactacctgcattag

SEQ ID NO: 202489 - DNA, 387 bp, Artificial Sequence
  Description of Artificial Sequence: Synthetic coding sequence
atgttcgacgtgaccagccgggtgacctacaagaacgtgcccaactggcaccgggatctggtccgggtgtgtgaaaatattcccattgtcttatgcggcaacaaggttgatattaaagacaggaaagtgaaagctaagtctattgtcttccacagaaaaaaaaatctgcagtattacgatatttccgcaaagtccaactataatttcgagaaacctttcctgtggctagcgaggaagttaatcggcgacccaaaccttgagttcgtggcgatgcctgctcttgctcccccagaggtagtaatggacccagccctcgcggctcagtacgagcacgacttagaggttgcccaaacaaccgcgctgccagacgaggacgatgatctatag

SEQ ID NO: 202490 - DNA, 702 bp, Artificial Sequence
  Description of Artificial Sequence: Synthetic coding sequence
atggccgcccagggcgagccccaggtgcagttcaagctggtgctggtgggagatgggggcactggcaagaccaccttcgttaagcggcacctgactggcgaatttgagaagaagtatgtcgcaaccctgggcgtggaagtgcaccccctcgtttttcacactaatcggggccccatcaagtttaacgtgtgggataccgccggccaggaaaaatttgggggcctcagagacggatactacatccaggaaatgggcattcatcatgtggcccacgcaggattggagctgatgtctagtgcccagtgtgccatcattatgtttgacgtgacctcccgcgttacctacaaaaacgttcctaattggcaccgggacttagtgcgtgtctgtgagaatatccccatcgtgctgtgcggcaacaaggtcgatatcaaggatagaaaggtgaaagccaaaagcatagttttccataggaagaaaaacttgcagtattacgacatttctgcaaagtccaactacaacttcgagaagccttttctgtggcttgctcggaaactgattggggatccgaaccttgaatttgtggcaatgcctgccctagccccacctgaggtggtgatggaccccgccctggcggcccagtacgagcatgatctggaggtcgcacaaactaccgcccttcccgatgaggacgacgacctctag

SEQ ID NO: 202491 - DNA, 651 bp, Artificial Sequence
  Description of Artificial Sequence: Synthetic coding sequence
atggccgcccagggcgagccccaggtgcagttcaagctggtgctggtgggtgatggcggaaccggaaaaaccacttttgttaaaaggcacctcacaggggagttcgagaagaaatatgtggccacacttggggtggaagtgcatcctctggtattccatactaaccggggccccatcaaattcaacgtgtgggacacggccggccaggagaaattcggggggttacgagacggatactatattcaggcccagtgcgcaattattatgttcgatgttacctcccgcgtgacctacaaaaacgtgccgaattggcacagggaccttgtgcgggtgtgtgagaacattccaattgtcctgtgtgggaataaggtggatatcaaggatagaaaggttaaagccaaatcaatagttttccaccgcaagaaaaaccttcagtactacgacattagtgcaaagagcaattacaacttcgagaagccatttctctggctcgcgcgtaaattgatcggcgatcccaacctggaattcgtcgccatgcctgctctggctccacctgaggtagtgatggatcctgccctcgctgctcagtacgaacacgacctcgaagtcgcccagacaacagcccttccagatgaggacgacgacttgtag

SEQ ID NO: 202492 - DNA, 705 bp, Artificial Sequence
  Description of Artificial Sequence: Synthetic coding sequence
cggcggcggcggctgcggctgcggcggctgaactgcgccagcgccattttccccgcctcggtgggaagagctagacgccgattttggaaactggttcttgtgggtgatgggggaaccggaaagacaacctttgtgaagcgccacttgaccggggagtttgagaaaaaatacgtagccaccctcggagtagaggtgcaccccttggtgttccacacgaatcgggggccgatcaaatttaatgtctgggacactgccggacaggaaaagttcgggggactgcgggacggttactatatccaggcccagtgcgccattataatgttcgacgtcaccagccgcgtcacttacaaaaatgtgcccaattggcatcgagatctggtaagggtgtgcgagaacattcccatagtgctctgcggcaacaaagtcgacatcaaagaccgcaaagtgaaagcaaagagcatcgtcttccacaggaaaaaaaatttgcagtactatgacatcagtgctaaaagtaattacaatttcgaaaagccgttcttgtggctcgctcgcaagttgataggagaccccaacctggaatttgtggccatgcccgcacttgccccccctgaagttgtaatggaccctgctctggccgctcagtacgagcacgacctcgaggtggcacagactactgcgctcccagatgaagatgacgacctgtag

SEQ ID NO: 202493 - DNA, 387 bp, Artificial Sequence
  Description of Artificial Sequence: Synthetic coding sequence
atgttcgacgtgaccagccgggtgacctacaagaacgtgcccaactggcaccgtgatcttgtcagggtttgcgaaaacattcctatagttctttgcggcaacaaagtcgacatcaaggatcggaaagtcaaggcaaaaagcattgtttttcacagaaaaaagaacctccagtactatgatatcagtgccaaaagcaattacaatttcgagaagcccttcctatggctcgccagaaaacttatcggcgaccccaatctcgagtttgtggcgatgccagctctcgctccgcccgaggtggttatggatccagctttggcggctcagtacgagcatgacctcgaggttgcccagacaactgccctgcccgacgaggatgatgacctttag

SEQ ID NO: 202494 - DNA, 651 bp, Artificial Sequence
  Description of Artificial Sequence: Synthetic coding sequence
atggccgcccagggcgagccccaggtgcagttcaagctggtgctggtgggcgatggtgggacgggcaagaccaccttcgtgaagaggcacctcacaggcgagttcgaaaagaagtatgtcgccactctaggagtcgaggtacaccccctggttttccacaccaacagaggccccatcaagttcaatgtctgggataccgctggacaggagaagtttggcggtctgcgggacgggtactatattcaggcacagtgcgccatcatcatgtttgacgtcacctctagggtgacatataagaacgtgcccaattggcatcgcgatttagttcgggtatgtgagaatattccaattgttttgtgtgggaataaagtagatatcaaggataggaaggttaaggccaaatcaatcgttttccaccgcaagaagaacctgcagtactacgatattagcgcaaagtcaaattataactttgagaagcctttcctgtggctggctcggaagctgattggagatcccaacctggagttcgtggccatgccggcactagcaccacctgaggtggtgatggaccctgcactggcagcgcagtatgagcacgacctggaggtggcacagaccacagcattgccggatgaagatgacgacctgtag

SEQ ID NO: 202495 - DNA, 5271 bp, Artificial Sequence
  Description of Artificial Sequence: Synthetic coding sequence
atgcggcggagcaaggcctacggcgagcggtacctggccagcgtgcagggttccgcaccttctcccgggaaaaaattaaggggcttctactttgccaaactatattatgaggctaaggaatatgatctggctaagaagtacgtgtgtacgtacctctccgttcaggagcgggatccgcgggcccaccgctttctgggccttctttatgagctggaagagaatacggaaaaagccgttgagtgttaccgcagaagcctcgagttgaaccctccacaaaaagatttggtcctcaagattgccgagctgttatgtaagaatgacgttaccgatgggagggccaaatactgggtggagcgcgcggccaaactattccccggatctcctgcaatttacaaactgaaggaacacctgctcgactgtgagggcgaagatgggtggaacaaattgtttgattggatccagtccgagctgtacgttaggccagacgatgttcatatgaatattcgcctggtcgaactctaccgttcgaacaaaagattaaaagacgctgtggcaaggtgtcatgaggccgagcgaaatatcgcattgcgatcgagtctggagtggaactcgtgtgtggtgcagactcttaaagaatatcttgaatcactgcaatgtttggaatctgacaaatcagactggcgcgccactaataccgacctcctcctagcgtatgcaaaccttatgctgttaaccctgagtaccagagatgtccaggaaagcagggagctgcttgagagcttcgactccgctctccagtctgccaagagttcccttggaggtaatgatgagctgtccgccacctttctggaaatgaagggccacttttacatgcacgcagggagcttgcttctgaaaatgggacagcacggcaacaatgtacagtggcaggctttaagtgaattagccgcattgtgttacgtgattgccttccaggttccacgacctaaaatcaaactgatcaagggcgaggcaggccagaatttattagaaatgatggcgtgcgatcgcctctcgcagtccgggcatatgttactcaacctgagtcggggaaagcaagactttctgaaagaggtggtcgaaacctttgccaataagagtggacaatccgtactctataacgctctgtttagtagccagtcttccaaggacacctcctttctcgggtctgacgacatcggcaatatagacgtgcaggagccagaactggaggatttggctcgctatgatgtgggtgccatccaggcacacaacggatctctacagcatctcacctggttaggtctccagtggaactctctccccgccctgcccggaattagaaaatggcttaagcaactctttcatcatcttccccaggagacatcaaggctggagaccaacgctccagagtctatctgtatccttgatctagaggtgttcctgttgggagtggtttatactagccacctgcagttgaaggagaaatgcaatagccatcattcttcataccagcctttgtgtctccctctgcctgtatgtaaacgattatgcactgagaggcagaaaagctggtgggacgccgtgtgcacgctgatccatagaaaggctgtgccagggaactcagccgagctccgattagtggtgcagcatgagataaacaccttgcgcgctcaagaaaaacatgggctgcaacccgccctactggtgcactgggccaagtgcctgcagaaaatgggtcgcgggttgaatagttcatatgaccaacaggaatatatcggccgctccgttcattactggaaaaaggtgctgcccctgctcaagataatcaagaagaattccattcccgagcccatcgatcccctcttcaaacactttcactcagtcgatatccaagcttccgagatcgttgagtatgaggaggacgctcatatcactttcgccatactggatgctgttcatggcaacattgaggacgcggtgacagccttcgaatcaataaaatcagtggtcagttattggaacctggccttaattttccatcgaaaggccgaagacattgagaacgacgcggtgttcccagaggaacaggaggaatgcaaaaactatttgagaaaaacaagagactatctcatcaagatcatagatgattccgacagcaacctgtcggtagtaaagaaactccctgttccacttgaaagcgtgaaggagatgttgaagagcgtgatgcaggagctggaagactacagcgagggcggacccctgtacaaaaatgggagcctgaggaacgccgacagtgagatcaaacacagcacaccttcacccactaagtactcactgtcacctagtaagagctacaaatattctccaaagacccctcccagatgggccgaggaccagaattctctgcggaagatgatctgccaggaagtgaaggctatcactaagttaaactcttcaaagtcggcctccaggcatcggtggcccactgagaactacggccccgattccgtccctgatggttaccagggcagccaaacttttcacggcgctcccttaacggtagccaccactggcccatcagtctactatagtcagtctccagcctacaattctcagtaccttctgaggccagccgccaatgttactccgaccaaaggaagctctaatactgagttcaagagcaccaaggagggcttttcaatcgccgtctcagcggacggattcaagttcggaattagcgaacctggcaaccaggagaaaaaatcggagaagcccttggagaacgacacaggattccaggcccaagacattagcggtcagaagaacggtcgcggggttatcttcgggcagacctcctctactttcacgttcgcagacgttgctaagagtactagcggagaggggtttcaattcggaaagaaggatcccaactttaagggatttagtggcgccggcgagaagcttttttcttctcagtgcgggaaaatggccaacaaggcgaacacttcaggcgatttcgaaaaggatgacgacgcctgtaaaacggaagacagtgacgacattcacttcgaacccgtggtgcagatgccggaaaaagtggagctcgtgacaggcgaagagggcgaaaaggtgttgtacagccagggtgtcaaactgtttcggttcgatgcagagatctcccagtggaaggagcgcggccttggcaacttgaagatcctgaagaacgaagtcaatggaaagccccggatgctgatgagaagggaccaggtgctgaaggtctgtgcaaaccattggatcacgaccactatgaacctcaagcctctgtccgggtccgatcgggcctggatgtggcttgcgagcgacttcagcgacggtgacgcaaaactggagcgtcttgccgcacagtttaaaacgcctgaacttgcggaggagttcaagcagaagtttgaagagtgccaacggctattgctagatattcctctgcaaaccccacataaacttgttgacactggacgcgcagctaagctgatacaaagagccgaagaaatgaagagcggtctcaaagatttcaaaacttttctcactaacgatcaaacgaaagttacagaagaggaaaacaaaggctccggaaccggggcagccggggcgagcgataccaccattaagcccaatccagaaaataccgggcctaccctggaatgggataattacgatctgagggaagatgcactggatgataacgttagttcatcaagtgtccatgacagccccttagcctccagccctgtgcggaaaaacatattccggttcgatgaatctactaccggcttcaatttttccttcaaatctgctttgtcgctctctaaaagccccgctaaactcaaccagtccggtacgtccgttggcacagacgaggagagtgatgtgacccaggaagaggagagagacggacaatattttgagcccgtggtcccacttcctgatctggtggaagtctcttccggggaagagaatgaacaggtggtttttagccacagagccgagctgtatcggtacgacaaggatgttggccagtggaaggaacgaggcatcggtgacattaaaatcctgcagaactatgataacaagcaagtgagaattgttatgaggcgcgatcaggtgctgaagctgtgcgccaatcacagaatcactccagacatgagtttacaaaacatgaaggggactgagcgagtatgggtatggactgcatgcgatttcgccgacggagaacgaaaagtggaacacctggccgtgaggttcaaacttcaagacgtcgcagattcctttaagaaaattttcgacgaggcgaaaaccgctcaggagaaggattccttaattaccccacacgtgtctagatcttccactccgcgtgagtctccctgcggaaaaatagctgtggcagtcttagaggagaccacacgcgagaggaccgatgtgattcagggggacgacgtcgcagacgcagcctccgaggtggaagtctctagcacttccgagactaccaccaaggcagtggttagcccccccaagtttgtcttcggctccgaatcagtcaagcgtatcttcagcagcgaaaagagcaacccgttcgcctttggtaattcctctgccacaggatccttgttcggcttttcattcaacgccccactgaaatcgaatgactctgaaacctccagtgtagcccagagcggatcagaatccaaggtggaaccgaaaaagtgcgaactgtcaaagaattctgatatcgagcagagttctgacagcaaggttaagaatctcagcgccagctttccaatggaggaaagtagcattaattacacctttaagactcccgagaaggagcctcctttgtggcacgctgaatttactaaggaggaactggtacagaaactttcttccaccaccaagagtgctgatcaactgaatggtctactgagagagactgaagccacttccgctgtactgatggaacagattaaacttttgaagagcgagatcaggaggctcgagaggaatcaggaggaatccgctgctaacgtcgagcatctgaaaaacgtgttgctccagttcatattcctgaaacctggctcagagcgtgagagtctgttgcccgtcatcaacacaatgctgcagctatcccccgaagagaaagggaagctcgcagccgtggcacagggactgcaggagacttccattcctaaaaagaaatag

SEQ ID NO: 202496 - DNA, 5247 bp, Artificial Sequence
  Description of Artificial Sequence: Synthetic coding sequence
atgaacgtgatgggcttcaacaccgaccggctggcctggacccggaacaagcttagagggttttatttcgctaagctgtattacgaagccaaggagtacgacctcgccaaaaaatatgtctgcacgtacctgtctgtccaggagagagatccaagagcacaccggttcctgggcctcctgtacgaactggaagaaaatacagagaaggccgtggagtgttaccgtagatcactagagctaaaccctccccagaaggacttggtcctgaagattgccgaacttctatgcaagaacgatgtaaccgacggaagagctaagtactgggtagaacgagctgccaaactgttccctgggtctcctgccatctataaactcaaagagcacttactcgattgcgagggtgaggacggctggaacaagctcttcgattggatccagtccgagctgtatgtgaggccggacgatgtgcatatgaatattagactggtggagctgtacagaagtaataagcgcctcaaggacgccgttgcaaggtgccacgaagcggagcgcaacattgccttgaggagttcccttgagtggaactcttgcgtagtacagactctcaaagaatacctggaatccctgcagtgccttgagagcgataagagcgattggcgcgcgacaaacacggacctgctgttagcatatgccaacctgatgctcctgacactgtcgactcgagatgttcaggaatctcgcgagctgctggaaagctttgactctgcgctacaatcagccaagagctccttaggcggcaatgacgagctaagtgccacattcctcgagatgaagggccacttttatatgcatgctgggtcccttctgttgaagatgggacagcatggcaataacgtccagtggcaagccctgtcggaattggcagccctgtgctacgtcatcgcattccaggtgcctcggccaaaaattaagctgatcaagggcgaggccggccaaaatttgctggaaatgatggcatgtgaccggcttagtcagtcaggccatatgcttctgaatctcagtcggggaaagcaggatttcctgaaagaggtagtcgagactttcgcaaacaaaagcggacagtcggtcctgtataacgcactgttctcatcacaatcctctaaggacacctctttccttggatccgacgacatcggcaacatagatgttcaggaacctgagttagaggatctggccagatacgacgtgggcgcaattcaggcacacaatgggtcgctacagcatctcacatggctgggcctgcaatggaatagcttgccagcattacctggcattcgaaaatggcttaaacagctgttccaccacttgcctcaggaaacatcgagactcgagacgaacgcacctgagtccatatgcatcttggacctggaagtgtttctgctgggagtggtttacactagtcaccttcaactaaaggaaaaatgcaactctcatcattcctcataccagcctctgtgtctgccactgcccgtctgtaagcgcctatgtacagagaggcagaaatcatggtgggacgcagtctgcactttgatccataggaaggccgtccccggcaattcagccgaattgagactcgtcgtacaacacgagatcaacactcttcgcgcccaggaaaagcacggactgcagcctgcattactggttcactgggcaaaatgtctgcagaagatgggcagaggacttaattcgtcgtacgatcagcaggagtatattgggaggtccgtgcactactggaaaaaggtgctcccactcctcaaaatcatcaaaaagaactcaatccctgagcccatcgaccccctctttaagcattttcattctgttgatattcaagcttcggaaattgtggagtacgaggaagacgcacacatcactttcgcgatcctggacgctgttcacggtaacattgaggatgctgtcacagcattcgaatccatcaaaagcgttgtttcatattggaatttggctctaatcttccacaggaaagctgaagacatcgaaaatgacgccgtgttcccggaagaacaggaagaatgtaagaattatctcagaaagacccgcgactatctgattaagattatcgacgatagtgactccaacctatcggtggtgaagaagttaccagttcccctcgaatctgtcaaggagatgctcaaatccgtgatgcaagaattggaagattacagcgagggcggaccattgtataagaacgggtccctcagaaacgcagattccgagattaaacacagcactcctagtccaacaaagtattctctgtcacccagtaaatcctacaagtattccccgaagacacctcctcgttgggctgaggaccaaaatagtttaagaaagatgatctgtcaggaagttaaggctattacaaagctgaactcaagcaaaagcgccagtcgccatcggtggccaacagagaattatggacctgatagcgtgccggacggttatcaaggcagtcagacctttcatggagcgccccttaccgtggcgaccactggcccaagcgtgtattacagccaaagtccggcatacaactctcagtatctgttacgcccagctgccaacgttacacccaccaaggggagcagtaacaccgagtttaaaagcaccaaggaagggtttagcatcgccgtttcagccgacggatttaagttcggtatctcagagcccggaaaccaggaaaagaagtctgagaaacctcttgagaacgacactgggttccaggcacaagatatcagcgggcagaagaatggccggggcgtcatattcggccagactagctccacgttcacctttgctgacgtggccaaaagcacctccggcgaaggctttcagtttggaaaaaaggatccaaattttaaaggttttagcggagcgggtgagaagcttttctctagccaatgcggcaagatggccaataaagccaacacatctggagatttcgaaaaggatgacgacgcttgcaaaacagaggattccgatgatattcacttcgagccggtggtgcagatgcccgaaaaggtggagctggtaactggggaggaaggggagaaagtgttgtatagccaaggcgttaaactgttccggtttgatgcagagattagccagtggaaggagcgcggactggggaacctcaaaattttgaaaaatgaggtgaacggcaagccgaggatgctgatgcggcgcgatcaggttctcaaggtctgtgccaatcactggataactacaaccatgaatctcaaacctctcagtggatctgatcgagcttggatgtggctggcttccgatttttcggacggggatgccaagttagaaagactggcggcccagtttaaaaccccagaattggctgaagaatttaagcaaaaattcgaggaatgtcagcgactgctcctggacatccccctccagacaccacacaaattagtcgataccggccgcgcagcaaaactgatccagagggccgaggaaatgaagtccggcttgaaggactttaagacgtttttgaccaacgaccagacaaaggtcacagaagaagagaacaaaggttccggaacaggggccgcaggcgcatccgacaccaccattaagccgaaccctgaaaataccggtccaactcttgagtgggataactacgatctaagagaagacgcgcttgatgacaacgtatcatcaagcagcgtgcacgacagccccctggctagtagtcctgtgcggaagaatatctttcgatttgatgaaagtacgaccggattcaacttttctttcaagagcgcgctgagtctctctaaatcccccgcaaagctgaaccaatcgggtacctccgtgggtacggacgaggaatccgacgtgacgcaggaggaggagcgcgatggtcagtacttcgaaccggttgtcccactcccagaccttgtggaagtcagctcaggcgaagaaaacgagcaagtggtgtttagccacagagcagagctttaccgctatgacaaagacgtgggacagtggaaagagagaggaataggcgatattaagatccttcagaactatgataataagcaggtccggattgtaatgagaagggatcaggttttaaaactgtgcgccaaccacagaatcacgccagatatgagcctccagaacatgaagggcacagagagggtctgggtgtggaccgcctgcgacttcgctgatggcgagaggaaggttgagcacttggctgttagatttaaactgcaggatgtggcagactcgttcaagaaaatctttgatgaggcaaagaccgcccaggagaaggattcgctcataacccctcatgtcagtaggagttccaccccaagagagtctccgtgtggtaaaatcgccgtcgccgtactcgaagagacaacgagagagcgaaccgacgttattcagggcgacgatgttgcggacgccgcatctgaagtggaagtgagctcaacttctgagacaactaccaaagccgtcgtctctccgccaaagtttgtcttcggcagtgaatccgtcaaacgcattttttcatccgagaaatctaacccattcgcattcgggaattctagtgccaccggctcactctttggattcagctttaacgccccccttaagtcaaacgattccgaaacttcatcggtcgctcaatctggaagtgagtctaaggtcgaacccaaaaagtgtgagctctccaaaaattccgatattgaacaaagcagcgatagcaaggttaaaaatctttccgccagcttccctatggaagagagtagcataaactatacgttcaagacccccgaaaaggaaccacccctctggcacgcggagttcacgaaggaggagctggtacagaaactttcctctactacaaaatccgccgaccagctgaatggtctgctgcgcgagaccgaggccaccagcgctgttctgatggagcagataaagctactgaaaagcgagataagaaggctggagagaaatcaggaggagtcagccgcaaatgtggagcacttgaaaaatgtgcttctgcagttcatcttcctcaagcctggcagcgagcgtgagtctcttctgccagtcattaatacaatgctgcagctgagccccgaagagaaaggcaaattggccgccgttgcacagggcttacaagagacctcaatcccaaagaagaaatag

SEQ ID NO: 202497 - DNA, 1935 bp, Artificial Sequence
  Description of Artificial Sequence: Synthetic coding sequence
atgctgatgcggcgggaccaggtgctgaaggtgtgcgccaaccactggatcactaccaccatgaatctgaagcctctaagtggtagtgacagggcttggatgtggctggcctccgacttctccgacggggacgccaagctcgaacggctggccgcgcagtttaaaactccagagttagccgaggagtttaaacagaaattcgaggagtgccagagactgttgctcgatattcctctgcagactccccacaaattggtggacacaggaagagctgctaagttgatccagagagccgaagagatgaagtctggcttgaaggacttcaaaacattcctaaccaatgatcagaccaaagtcacggaggaggagaacaagggcagtgggaccggcgctgcaggcgccagcgacacaaccataaagccaaaccctgagaatacaggccccactttggagtgggataactacgacctccgtgaggacgctttggacgacaacgtgtctagtagcagtgtgcacgattcccctctcgcgtcgtccccggtcagaaaaaacatctttaggtttgatgaaagcaccacaggcttcaacttttcctttaagtctgcattatccctgtctaagtctccagccaagcttaatcaatccggtacttctgtcgggaccgatgaagaaagcgatgtgacccaagaggaggaaagggatggccagtactttgaacctgttgtcccgctcccggacttggtcgaagtctcttcaggcgaagagaatgagcaagtggtgttcagtcatcgagccgaactgtatagatacgacaaggacgtgggacagtggaaggagcgtgggattggggatattaaaatcctgcagaactacgacaacaaacaggtaaggatcgttatgagaagagatcaggtgctaaagctctgcgccaatcatagaatcacgcccgacatgtctcttcaaaacatgaagggaaccgaacgggtctgggtctggactgcctgcgattttgccgacggagagcggaaggtggagcatctggctgtcagattcaagctccaggatgtggcggacagctttaagaaaattttcgatgaggccaaaaccgcccaggagaaagactccctgattacaccccatgtgagccggtcatctacccctcgcgagagtccatgtggaaagatcgccgtggcggtgctggaagagacaacccgcgaacgcaccgacgtcattcagggagatgatgtcgcggatgccgcctcagaggtagaggttagttccacaagcgaaactactacgaaggcagtagtgtcacctcccaaatttgtatttggttctgagtcagtgaagcgcattttttccagtgagaagtcaaatccttttgcctttgggaacagcagtgccacaggctcactcttcggattttctttcaacgctcccctgaaaagcaatgactctgagacttcatccgtagcgcagtccggctcagaatcaaaagtcgagcccaaaaagtgcgaattgtcaaaaaatagcgacattgaacagagttccgattccaaggtgaaaaacttgagtgcatcctttcctatggaggagagttctatcaactatacattcaagactccagagaaagagccaccgctctggcacgcggagttcacaaaggaagagctggtgcagaagctgagcagcacaacaaagtctgcagatcaattaaacggacttcttcgcgagaccgaggccacctctgccgtcctgatggaacagattaaactcttaaagtcagaaattagacggctcgaaaggaaccaggaggagagtgcagccaacgttgagcacctgaagaatgtgctgctgcagtttattttccttaagcccgggagcgagagggaacccagctcttgctacaagtatgacgtggccgctcagccctag

SEQ ID NO: 202498 - DNA, 5247 bp, Artificial Sequence
  Description of Artificial Sequence: Synthetic coding sequence
atgaacgtgatgggcttcaacaccgaccggctggcctggacccggaataaactgaggggattttactttgccaaactctattatgaagctaaggagtacgatctggcgaagaagtacgtgtgcacctacctgtctgtacaggaacgggatccccgggcccaccgattcttgggactcctgtacgaactggaggaaaatacagagaaagccgtagaatgctaccggcgttccttggagcttaatccaccccagaaagacttagttttgaagatagcagaactattgtgtaaaaatgatgtgacagacggcagagctaaatattgggttgaacgggcagcaaaactctttccaggaagcccggcaatttacaaattaaaggagcatctcctcgattgcgaaggggaggatggctggaataaattattcgattggattcaatcagaactttacgtacgtccagatgatgtgcacatgaatatcaggctcgtggaactgtataggagcaacaaacgcctgaaagacgccgtcgctcgctgccatgaggctgagagaaatattgcccttaggtcaagtctggaatggaacagctgcgtggttcagacattaaaggagtatctcgaaagcctgcagtgtcttgaaagcgataagtccgactggcgggcaacaaacactgatcttcttcttgcatacgctaatctgatgctgctaacactcagcacaagagatgtgcaggagagcagggaactgttagaatcatttgacagcgcgttacaatctgctaaatcttcccttggcggaaacgatgaactgtctgcaactttcctggagatgaagggccacttctacatgcacgctgggtctcttctcctgaaaatgggccagcacggcaacaatgtgcaatggcaagcactgagcgagcttgccgcattgtgctacgtgatcgcgtttcaagtgccaaggcctaaaatcaaacttatcaagggcgaggcagggcagaacctgctcgagatgatggcgtgtgatcgtctgtcacagtcggggcacatgttactgaaccttagcagagggaagcaggatttcctgaaagaagtcgtggaaactttcgcaaacaagagtggccagagcgtgctctacaatgccctcttcagctcacagtcaagtaaagacaccagctttctgggcagcgacgacattggcaatatcgacgtccaggagcctgagctggaagatctggcccggtacgatgtgggggcaatccaggcccacaatgggtcacttcagcatctgacctggttaggcctccaatggaattcccttccagcacttcccgggattcggaaatggctgaaacagctcttccatcatctccctcaggaaacttctcggcttgagactaatgctcccgagagcatatgtatactcgatttggaagtgttcctcctgggtgtcgtgtatacatctcatctccagctgaaggagaaatgcaattctcaccatagctcttaccagcccctgtgtcttcccctgcccgtctgcaagaggctctgtactgagaggcaaaaatcatggtgggacgctgtgtgtactctaatccataggaaggccgtccctggtaattccgcggagctgcgcctggttgttcagcatgaaatcaacacacttcgagcccaggagaaacacggattacagcccgcccttcttgttcattgggccaagtgccttcagaaaatgggccgagggctgaatagctcctacgatcagcaagagtacatcggcaggtctgttcattattggaaaaaggtgctccccctgctgaagataatcaagaaaaactctattcctgaacctattgatcctctgttcaagcactttcacagtgtcgacatccaggccagcgaaatcgtcgaatatgaagaggacgcccacattacattcgcaattctggatgccgtccacggaaatatcgaggacgccgtaacggccttcgagtctattaaaagcgttgtgtcatactggaatcttgctctgattttccaccgaaaggcagaagacatcgaaaatgatgccgtattccctgaggagcaggaggagtgcaaaaattatttaaggaaaacacgtgattacctcattaagatcatagacgactcagatagcaacctctccgtggttaagaaactgccagtgcccctggagagtgtgaaagaaatgctgaaatcggtgatgcaggagcttgaagactattctgagggcggcccgctgtataagaacggttccttgcgcaacgcagatagtgagattaaacattcgactcccagcccaaccaaatatagcttgagcccaagcaaaagttacaaatattctccgaaaacgccacctcggtgggcagaagaccaaaattcacttcgtaaaatgatatgtcaagaggttaaggcgataaccaagctaaatagtagcaagagtgccagccggcatcggtggcctacagagaattatggcccagacagcgtcccagacggatatcagggaagccagacttttcatggcgcccccctcacggtggctacaacaggacctagtgtttactactcacagtcacctgcttacaattctcagtacctgttaagacctgccgccaatgttactcccacaaagggatcgagtaataccgaattcaaatctaccaaagagggattcagtattgctgttagcgcggatggctttaaatttggtatatcagagcctggtaatcaggagaaaaagtccgaaaaaccgctggagaatgatacaggatttcaggctcaggatatttccgggcagaagaatggaagaggtgtgatttttgggcagacctctagcacctttaccttcgctgatgtcgccaagtccacatctggcgaggggtttcagtttggtaaaaaagatcccaactttaaggggttctccggtgccggcgaaaagttgttctcctctcagtgtggaaaaatggccaataaggccaacacaagcggcgacttcgaaaaggatgacgatgcttgtaagacagaggattcagatgatatacattttgaaccagttgtgcagatgcctgagaaggtggagctggtcacaggggaggaaggtgaaaaggttctttacagccaaggagtgaagttattcaggtttgacgccgaaatctctcagtggaaggaaagagggctggggaatcttaagatcttaaaaaatgaggtgaatgggaagcctcggatgctaatgagacgggatcaggttctgaaggtgtgtgccaaccactggatcacaacaactatgaatctgaaacccctgtccggtagcgaccgagcctggatgtggctggcctccgacttctccgacggcgatgccaaactagagcgattagcagctcagtttaagacccccgagctggctgaggagtttaagcagaagttcgaagagtgtcagaggttactcctcgatattccattacagacccctcacaagctggtggataccggcagggcagcaaagctcattcagcgtgctgaagaaatgaaatcggggttaaaagactttaagacatttcttactaacgaccaaactaaggtcacagaggaggagaataaaggctcaggtacaggggccgcaggagcctctgacacaacgatcaagcccaacccagagaacacaggccctactctggagtgggacaattatgacctccgggaggacgctctggatgacaatgtgtcaagttccagtgtccacgactctcctctggccagctcccccgtgcgaaagaatattttcaggttcgacgagtctactacgggttttaatttctcattcaaaagcgctttaagcctgtccaagagtccggccaaactgaatcagagcggcaccagcgtcgggaccgatgaagagtccgatgtgacccaggaggaggagcgcgacggccagtacttcgaaccggttgtacccctcccagatcttgtggaggtgagcagtggagaagagaatgagcaagtggtgttttcacaccgcgccgagctttataggtacgataaggacgtgggccagtggaaggagcgcggcataggagacataaagattttgcaaaattacgacaacaagcaggtgcgcatcgtcatgcggcgagaccaggtgctcaagctctgtgccaaccacagaatcactccagatatgagccttcagaacatgaagggtaccgagcgggtgtgggtgtggaccgcctgtgacttcgcagacggcgaacgcaaagtggagcacctggctgtaagattcaaactccaagatgtagccgactcctttaagaagatatttgatgaggccaaaactgcccaggagaaggacagcctgatcacacctcacgttagccggtcatccacaccgcgcgaatcaccatgcggcaaaatcgcagtcgcagtcctggaagaaaccacacgcgagcggacagatgtgattcagggggatgatgtagccgacgccgcgagtgaggtggaggtgagctctactagcgaaaccaccactaaggccgtggtatcccccccgaagtttgtattcgggagcgagtcagtgaaacgtattttcagtagtgagaaaagtaacccttttgccttcggaaacagctccgcgaccggaagcttatttggatttagctttaacgccccactgaagtccaacgattcagaaacaagctctgtcgcccagtccgggagcgaaagcaaagtcgagcccaaaaaatgcgagctgtctaaaaacagcgacattgagcaaagcagtgactctaaagtgaaaaatctctcagcttctttccccatggaagagtccagtattaattatactttcaaaacccccgagaaggagccccccttgtggcacgcggagttcacaaaggaggaactggtgcagaagctctcatcaacaactaagtccgcagaccagcttaatggattacttcgagaaacagaggctacttctgccgtattaatggagcaaattaaacttttgaagtcagaaattcggcggctcgaacggaatcaggaggaaagtgcagccaacgtggagcacctcaagaatgtacttctgcagtttatattcctgaagcccggctcagagagagaatcgctgttaccagtcatcaacaccatgctccagctgagcccggaggaaaaggggaagctcgccgctgtcgcacaaggcctgcaggagaccagcattcctaaaaaaaaatag

SEQ ID NO: 202499 - DNA, 3042 bp, Artificial Sequence
  Description of Artificial Sequence: Synthetic coding sequence
atgctgaagagcgtgatgcaggagctggaggactacagcgagggcggccccctctataagaatggatcattgagaaacgctgacagcgagatcaagcacagcactccctctcccacaaagtattcgctgagtccctcaaagagctataaatattcacctaaaacaccaccgcggtgggccgaggatcagaattccttgcgcaaaatgatttgtcaggaggtgaaagctattacaaagctgaactcgagcaagtccgcatcaagacaccgctggcctactgagaactacgggccagactccgtacctgatggataccagggttctcagacttttcatggggctcctcttacagtggctaccacggggcccagcgtgtactattctcagagccctgcatataattctcaatatctgctgaggcctgcggctaatgttacacccaccaaaggatcctccaacacagagtttaagtctactaaggagggtttctctattgccgtgtccgccgacggcttcaaattcggtattagtgaacctggcaatcaagagaagaaatcagagaaacctctcgaaaacgacaccggcttccaggcgcaggacatttccggacagaagaatggccggggcgtcatcttcggccagacctccagcacttttacatttgctgatgttgctaagtcaactagcggcgagggcttccaattcgggaagaaagacccaaatttcaagggctttagtggggccggcgaaaaactgttttcatcccagtgcggcaagatggctaacaaagcaaacacaagtggggattttgagaaggacgacgatgcttgcaagacagaagactctgacgacatccattttgaacccgtggtgcaaatgccagaaaaggttgaattggtgaccggtgaggaaggagagaaggtcctctacagccagggtgtgaagttattccggttcgatgccgaaatttctcagtggaaggagagaggactggggaatctgaagatcctgaaaaacgaagtcaacggaaaacccaggatgttaatgcggagggatcaggtgcttaaggtttgcgccaaccactggattacaacgaccatgaacctgaagcctcttagcggtagcgatagggcttggatgtggttagcctcagatttctcggatggcgacgctaagctcgaaagactcgcggctcagttcaagaccccagagctcgcggaggaattcaaacagaaatttgaagaatgccaacgactgctgcttgacataccactgcagactccccacaagctggtcgacactgggagggctgccaagctgatccaaagggcggaggagatgaagagcggcttgaaagattttaaaacattcctgacgaatgatcaaaccaaggtgacggaagaggagaataagggctcgggcaccggagccgccggcgcctccgatacaaccatcaagcctaatcccgaaaacaccgggccaacgctggaatgggataattatgacctacgtgaagacgctttagacgataacgtttcctccagcagcgttcacgactccccccttgccagctctcccgtgaggaaaaatatctttagattcgatgaaagcacaacaggtttcaattttagttttaagtccgcactgtctcttagtaagagtccagcaaaactgaaccaatcaggcacgagtgtcggtaccgacgaggagtccgacgttacacaggaggaggaaagagacggccaatatttcgaacctgtagtgcccctgccagatctggtggaggtgtcatcaggcgaagaaaatgaacaggtggtcttttctcacatggcagaactgtatcgctacgataaggacgtggggcagtggaaggaacgcgggatcggggacataaagatcctgcaaaattacgacaataagcaagttcgcatcgtaatgcggagggatcaggtgctcaagctttgcgctaaccaccggatcacccccgacatgtctctccagaatatgaaaggcaccgaaagggtgtgggtctggacagcctgcgacttcgccgatggcgagcggaaagtcgagcaccttgctgtcaggttcaagctccaggacgtggccgatagctttaaaaagatcttcgacgaggctaagactgcccaggagaaagacagcctgatcacgccgcacgtgagtaggagttccacaccccgggaatccccgtgcggcaaaattgcggttgccgtgttagaagagaccaccagagagcgcacagatgtaatccagggagatgatgtggccgacgccgcctcagaggtggaggtgtcctctacctccgaaactacaacaaaagctgtggtcagtccccccaaatttgtctttgggtctgagtcggttaaaagaatattctcctctgagaagtccaatccattcgcctttggaaattcctctgcgaccggaagcttgtttgggttctcttttaatgcccctctcaaatcaaatgacagcgagacgagttcagttgcacaaagcgggagcgagagcaaagtggaacccaagaaatgtgagctctcaaaaaacagcgacatcgaacaaagctccgatagcaaagtaaaaaaccttagtgcatcatttccaatggaggagtctagcattaattatactttcaaaacccccgaaaaggagccccccctatggcacgccgaattcaccaaggaggagctcgtgcaaaaactgtcttctaccactaaaagcgccgatcagttgaacggactgctgcgagagaccgaggccactagcgccgtcctgatggagcagatcaagttgttgaagtccgagatcagaagattggagagaaaccaggaagagtccgctgccaatgttgaacatcttaagaatgttctgctgcagtttatcttcctcaaacccggctctgaacgtgagagcctactgcccgtgataaacaccatgctccaactctctccagaggagaagggaaagctggccgctgtcgcacaaggcctccaggagactagtatccctaagaaaaagtag

SEQ ID NO: 202500 - DNA, 5271 bp, Artificial Sequence
  Description of Artificial Sequence: Synthetic coding sequence
atgcggcggagcaaggcctacggcgagcggtacctggccagcgtgcaggggagcgccccaagtcccgggaaaaagctcaggggcttttatttcgccaaactctactatgaagccaaagagtacgatttggccaagaagtacgtgtgtacctacctgagtgtacaggaacgtgaccctagggcacacagatttctcggcctcctgtatgaactcgaagaaaataccgaaaaagcagtggagtgctatcggcgatcattagaactcaatcctccgcagaaggacctcgtgcttaaaatagctgagctcctttgtaaaaacgacgtaaccgacggacgagccaagtactgggtggagagagccgccaaactgttccccgggagtcctgccatatacaaacttaaggagcatttattggattgcgagggtgaggacggctggaacaagttgttcgattggatccaatctgagctgtatgtgcgaccagacgacgtgcacatgaatattagattggtggagttgtatcgttccaataagcggcttaaagatgccgtggccagatgccacgaggccgagcggaacatcgctctgcggtcgagtctcgagtggaacagctgcgtggtacagacactaaaagagtacctggaaagcctgcagtgcctggagagcgacaagtccgattggcgagccacaaatactgacctgttgctggcttatgctaacctcatgttgctgacacttagtacccgcgatgtccaggaaagccgggagcttctggagtcttttgattccgccctccagtctgccaagagctctctaggcggtaatgacgagctgtctgccacctttctggagatgaaggggcacttttacatgcacgcagggtccctcctactcaagatgggccagcatggcaacaatgtgcagtggcaggcactctcagagttggcagcgttatgctatgtgattgcgtttcaagtacctcgcccaaaaataaaacttatcaagggtgaggctggccagaacctgctggagatgatggcctgtgatagactgagtcagtcgggacacatgctgttaaacctttcacgagggaagcaggattttttgaaggaagttgtggagaccttcgccaacaagagcggacagtccgtcctttataacgccttgttcagctcccaatctagcaaggacacgagcttcctggggagcgacgacatcggcaatattgacgtccaggaaccagagctcgaggatctcgctcggtacgacgttggagctatacaggcccacaacgggtctctgcagcatctgacctggctgggcctccagtggaactccttacccgccctcccggggattagaaagtggctgaagcagctatttcaccatctcccccaggagacctctcgcttggaaaccaacgcccctgaaagcatctgcatcctggatctggaagtgtttttactgggagtggtgtacaccagccacctgcaactaaaggagaagtgtaacagccatcacagctcctaccagcctttgtgtctccctctgcctgtgtgtaagcgtctctgcactgagcgtcaaaagagctggtgggatgcagtctgcaccctgattcaccgaaaggcagtgcccggaaactctgccgaactcaggctcgtggtccagcacgagatcaataccctgagggcacaagaaaagcatggacttcagccagccttactggttcattgggccaagtgtctgcagaagatgggcagggggctcaactccagttacgatcagcaggaatacattggaagatctgtacactattggaagaaggtgctgcccctcctgaaaatcatcaaaaagaactccatccccgagcccatcgacccacttttcaagcactttcactctgtggatattcaggccagcgagatcgtcgagtatgaggaagatgctcacataacctttgcgatactggacgctgtgcacggtaacatcgaggacgccgtgacagccttcgaatctatcaaaagtgtcgtttcctactggaatcttgcattaatatttcatcgcaaggccgaggacatagaaaacgatgccgtgtttccagaagagcaggaagaatgcaagaattatctgagaaagaccagggactacctgatcaaaataatcgacgactctgactctaacctcagtgtcgtcaaaaagctgcccgtgcctctggaatctgtgaaggagatgctgaaatcagttatgcaagagctggaggattattctgagggagggcccctctacaaaaatggctctctgagaaacgctgatagcgaaattaagcattccacgcccagtcctactaaatacagtctgagtccctctaagtcttacaagtacagccccaaaactcccccccgatgggccgaggaccagaattccctcagaaagatgatctgtcaagaggtgaaagccattactaagctcaacagttccaagtcagcatcgagacaccggtggccaaccgagaactatgggccggatagcgtaccagatggataccaaggaagtcagacctttcatggcgccccactaactgtggcgacaactgggccttctgtgtattatagccagagtcccgcttacaattcccaatatcttctgcgcccggccgccaacgtcacccccacgaaaggctctagcaacaccgaatttaaatccactaaggaggggttttctatcgccgtgagcgccgacggctttaagttcggaatttccgagcccgggaatcaggagaagaaaagcgagaaacctctcgaaaacgataccggatttcaggctcaggatattagcggacagaaaaacggccgcggggtaattttcgggcagactagctccacttttactttcgctgatgtggccaagagcacaagcggagaagggttccagttcggtaagaaagatcccaactttaagggattctcaggggctggggaaaagctgttttcaagtcagtgtggaaaaatggcaaacaaagcaaacaccagtggcgacttcgagaaggacgacgacgcctgtaagaccgaggacagtgacgacattcattttgaacccgtggtgcagatgcctgagaaggtggagttagtgactggcgaggagggagagaaggtcctgtactcgcagggtgtgaaattgtttcggttcgacgctgagatctcccagtggaaggaacggggtctcggcaacctgaagatcctgaagaacgaagttaatggaaagcctcgcatgctcatgcgccgggaccaggtgttaaaggtgtgcgcaaaccactggatcaccaccaccatgaacttgaagcccctgagtggctcagatcgcgcatggatgtggttggcctccgacttcagtgatggcgatgccaagctggaacggctcgcggctcaatttaagacaccagaattagccgaggagttcaagcagaagttcgaggagtgccagcgcctgctgctggatatccctctgcaaactcctcataaactggtcgatactggacgggcagctaagcttatacaaagagcagaagagatgaaatcaggactcaaagacttcaagacctttctgaccaacgatcagaccaaagttactgaggaggagaataaagggagcggcactggggctgcgggtgcctccgacactacaataaaaccaaatccagagaataccggccccaccctagaatgggacaactacgacctccgggaagatgccctggacgacaacgtttcatcatcctccgttcacgactcccctctggcgagctccccagtgcgtaagaacatttttcgcttcgatgagagcaccaccgggtttaacttttcgtttaagagcgccctttccctctccaaatctcccgcaaagctgaaccagagtggtaccagcgttggcacagatgaagagagtgatgttactcaggaggaagagcgagatgggcagtacttcgaacccgtggtgccgctgcccgatctcgtggaggtaagttctggcgaagagaatgagcaggtggtattctcccacatggctgagctgtataggtacgacaaagacgtggggcaatggaaggaacgagggattggagatatcaaaattctgcaaaactatgacaacaagcaggtgcgcatcgtcatgagacgtgaccaagtgctgaagctgtgtgctaatcataggatcactcccgatatgtcactgcagaacatgaaaggcacagagcgcgtgtgggtttggacagcatgcgacttcgctgatggcgaacgcaaggtggagcacctcgccgtcaggtttaaactgcaagacgtggccgactcttttaagaaaatctttgatgaagccaaaaccgctcaagaaaaggactccctcataactcctcacgtatctaggtcgagcactcccagggagagcccttgcggtaagatagcggtagcggtgttggaggagacaaccagagaacgcaccgatgttatccagggagatgacgtggctgacgctgcctccgaggtcgaagtaagctcaactagcgaaactactactaaagctgtggtgagcccccccaagttcgtattcggctcggaaagcgtgaaaaggatttttagctctgaaaaaagcaaccccttcgcctttggaaatagttccgccacgggctccctgttcggattctctttcaacgcacctctgaagagtaatgattctgagaccagctccgtggcccaatcagggagtgagtctaaggtggaaccgaagaaatgtgaactcagtaaaaacagtgacattgaacaaagtagtgattccaaagtgaagaatctttccgcaagttttcctatggaggaaagttcaataaattacacatttaaaaccccggagaaagaacctcccctgtggcacgcagagtttacaaaggaggaactggtccagaagctatcctccaccacaaagagtgcggatcagcttaacggcttacttcgcgaaaccgaggctacctctgccgtgttaatggagcaaattaagctgctgaagtcagagattaggcggctggagcgcaaccaagaggaaagcgccgccaatgttgaacacctcaaaaacgtgctgcttcagttcatttttctgaagcctggatctgaacgagagagtctgttgccagtgataaatacaatgctgcagctctctccagaggagaagggcaaattagctgccgtggctcaaggactgcaagaaaccagtatcccaaaaaaaaaatag

SEQ ID NO: 202501 - DNA, 5247 bp, Artificial Sequence
  Description of Artificial Sequence: Synthetic coding sequence
atgaacgtgatgggcttcaacaccgaccggctggcctggacccggaataaactgagaggcttttactttgccaaactgtactacgaggcaaaggaatatgacctagcaaagaagtacgtttgtacttacctcagcgtgcaggagagggaccctagagcccaccgttttcttggactcctgtacgaactagaggagaatacagagaaggccgttgaatgctataggcgcagtctggaacttaatcctccgcaaaaggatctggtgctgaagatcgccgagctgctttgtaagaatgatgttactgatgggagggcaaagtactgggtcgagcgtgctgctaagctcttccctggaagcccagcgatttacaaactgaaggaacatctcctagactgtgagggagaagacgggtggaacaagcttttcgattggattcagagtgagttgtacgtccgcccagacgacgtgcacatgaatatccgacttgtggagctctacagatctaacaagcgccttaaagatgctgtggctcgctgccacgaggctgagcgcaacatagctcttcggtcctcccttgaatggaacagttgtgttgttcagaccctgaaggaataccttgagagtctgcaatgtttggagtccgataagagtgattggcgagccaccaatacagacctcctcttggcgtacgcaaacctgatgctgcttacgcttagtactagagacgtgcaggaatcaagggagctactcgaatctttcgactccgctctccagtcggccaaaagctctttaggggggaatgatgagctgtcagcgacgtttcttgaaatgaagggccacttctacatgcatgccggctcattgctgcttaagatggggcagcacggtaataacgtacagtggcaagcactgtctgaactggccgcactgtgttacgtaatagctttccaggttccgaggcctaagatcaagcttatcaagggtgaagccggccagaatctgctggaaatgatggcctgcgaccgactgagtcagtcaggacatatgctcttgaacctgtcgagaggcaagcaggatttcttaaaggaggtggtggagacctttgctaataagagcggccagtccgtgctgtacaacgccctattttcttctcagtcttcgaaggatacttcctttctggggagcgacgatataggaaatattgacgtgcaggaaccagagctagaagatctggccaggtacgacgtgggggccattcaggcacacaacggctcactgcaacacctcacttggctgggtttacagtggaatagcctccccgccttacccgggatccggaagtggctgaaacagcttttccaccacttgccccaggagacaagccggttagagacaaatgcccctgagagcatctgcattctggatctggaggtgttcctgctgggggttgtgtatacatcccacctgcaacttaaggagaagtgcaacagccatcatagcagctatcagccactgtgccttcccctgccagtttgcaagcgactgtgcaccgaacggcagaaatcttggtgggacgcggtttgcactttaatccaccgaaaagcagtgccaggcaattctgcggagttgaggttggtggtgcagcatgagatcaataccctgcgcgcacaggaaaaacacggcctccagccagctctcctggtgcactgggccaagtgtctccagaaaatgggcagaggactgaattcaagttatgaccagcaggagtacattggtcgctctgtgcactattggaaaaaggtcctaccactgctgaagatcatcaaaaagaattctattcccgaacccatcgaccctctcttcaagcatttccacagcgtagatattcaagccagtgaaatcgttgaatatgaggaagatgcacacattacttttgccatcctcgatgctgtgcacggtaacatagaagacgcggtcaccgcattcgagagcatcaaatctgtggtttcatactggaacctggccctcatttttcacaggaaggccgaggacattgagaatgatgccgtttttcccgaggagcaagaagaatgtaagaactacctcaggaagacgagggactatttgataaagatcatagatgatagcgactcaaatctgagtgtcgtgaagaaactcccagtcccgcttgagtctgtgaaagaaatgctcaagtctgttatgcaggaattagaagactattcagagggtgggcccctgtataaaaacggttctttacgcaatgccgactctgagatcaagcattccactccctccccgaccaaatattctctatctccgtctaaatcctacaagtatagtccaaaaactcctcctaggtgggcggaagaccaaaatagtctgagaaaaatgatctgccaggaagttaaggctatcaccaagcttaacagctccaaatcggcctccagacaccgatggccaaccgaaaattacggaccagacagcgtccccgacgggtaccagggatctcaaacattccatggagcacctctcacagtggctacgactggcccatctgtgtattacagtcaatctcctgcttataactctcaatatctgctgcgccctgcagccaatgtgacgcccacgaaggggtctagtaacactgagttcaaaagcactaaagagggtttcagcatcgcagtgtcagccgatggatttaaattcggcatttctgaaccgggaaaccaggagaaaaagagcgaaaaacctctggagaatgataccggatttcaggctcaggacatctctggacagaaaaacggccgcggcgttatcttcgggcagacctcgagcacttttacctttgctgatgtggccaaaagcaccagtggggaaggattccagtttgggaagaaagaccccaatttcaaaggattcagtggtgcaggggagaagttgtttagctcacagtgcggcaaaatggccaacaaagccaacacctctggagattttgaaaaagatgatgacgcatgtaagaccgaggatagtgatgatattcacttcgagcccgtcgtccagatgccggagaaggtggagctagtcacaggtgaagaaggcgaaaaagttctgtactcccagggcgtaaaactgttccggttcgacgccgagattagtcaatggaaggagagaggcctgggaaatctcaaaatccttaagaatgaggtcaatggcaaacctaggatgcttatgcgaagggatcaagtactgaaggtgtgtgctaatcactggattacaaccaccatgaatctcaagccactctctggcagtgaccgggcgtggatgtggcttgccagcgactttagtgatggtgacgcaaagctggaaaggctggccgctcaattcaagactcctgagctggccgaagaattcaagcagaaatttgaggagtgccagcggctcctactcgacatccccctgcagactccacataagcttgtcgacacaggacgggcggctaaactcatccagcgcgcggaggaaatgaaaagtggcctgaaggatttcaaaacatttttaaccaatgatcaaaccaaggtaaccgaggaagagaataagggctccggcaccggcgctgcaggcgcgagcgacaccacaatcaagccaaaccctgaaaacacaggccccacgttggagtgggataattatgatctcagggaggatgctttggacgataacgtatcctcaagctcagtgcacgacagccctctggcctcgtcacccgtgaggaagaacattttccgattcgatgaatccacgaccggctttaacttcagcttcaagtcagccctgtcattatcaaagagccctgcgaaactgaatcaatcgggaacctcggttgggacagacgaggaatcagatgtaacccaggaggaggaacgcgatggacagtattttgaacccgtggtgcccctgcctgacctggtagaggttagtagtggggaagagaacgagcaggtggtcttctcacacatggccgaactgtataggtacgataaggacgtgggtcagtggaaggagcgtggtatcggggatattaaaatcctccagaattatgataacaaacaagtccggatcgttatgaggagggatcaagtgctgaaactgtgtgctaaccatcggatcacacctgacatgtcgctgcaaaatatgaagggaaccgaacgtgtgtgggtgtggacagcctgcgattttgcagacggcgaacgcaaagttgaacacctagctgtgcgctttaagttgcaggatgtggccgactcttttaagaagatctttgatgaagcaaagaccgctcaggagaaagactccctgataactccacacgtgagccgcagctcaaccccacgtgaatcaccgtgtggcaaaattgctgtggccgtattggaggagactactagagaacgaaccgatgtcattcagggcgatgacgtcgcggatgccgcgtcagaggtggaggtatcttctacgagcgagacaactactaaggccgttgtgtcgccaccaaaatttgtcttcgggagcgagtccgtgaagcgaatattctcttcagaaaaatccaacccatttgcgttcggcaactcatcggccacaggaagcttgtttggcttctccttcaacgcgccactgaagagcaatgactcagagacctcttctgttgcacagtccggcagtgagtcaaaagtggaaccaaagaagtgtgaattatccaaaaattcagacatagagcagagctctgactccaaggtgaagaatctgagtgcttctttccccatggaggagagcagcataaattatacattcaaaacacccgagaaggagcctccactttggcacgccgagtttaccaaggaggagctcgtgcagaagctctcctctacaactaagagcgcggaccagcttaacggtctgttgagagagacagaggcaacttctgctgtcctaatggagcaaattaagttgttgaaaagtgagattaggcggctagaacggaatcaagaggaaagtgcagcaaatgtggaacacctgaagaacgttctcctgcagttcatctttctgaagcctgggagtgagagagagagcctcctccccgtgattaatactatgctgcagctgtcaccagaagagaaagggaagcttgctgcagtcgcccaggggttacaggaaacttccatcccgaagaagaaatag

SEQ ID NO: 202502 - DNA, 1935 bp, Artificial Sequence
  Description of Artificial Sequence: Synthetic coding sequence
atgctgatgcggcgggaccaggtgctgaaggtgtgcgccaaccactggattactacaactatgaatcttaaacctttgagcggctctgaccgtgcgtggatgtggctcgccagcgacttctctgacggggacgcgaaactcgagagactggcagcacagttcaagactcccgaactcgccgaggagttcaaacaaaagttcgaagagtgtcagcgtctgctgctcgacatcccccttcagactccacataagctggtagatacagggagagccgccaagcttatccagcgcgcagaggagatgaaatccggcttaaaagacttcaagactttcctaaccaacgatcagaccaaggtgaccgaagaggagaataaaggctccggcacaggcgcggccggcgcaagcgacaccacgataaagcccaacccagaaaacactggcccaactctcgaatgggataactatgatctgcgcgaggatgcccttgacgataacgtgtcttcctctagcgtgcacgacagcccactcgcaagcagtcctgtgcgcaagaatattttccggttcgacgagtctaccaccggcttcaacttcagtttcaagtccgctctttcccttagtaagagtcctgccaagttaaatcagagcggaacatctgtagggactgacgaggaatccgatgtcacccaggaggaagagagggatggccagtactttgagcccgtagtgcccctaccagacctggtcgaggtgagtagtggggaggagaatgaacaggtcgtgttctctcacatggccgaactctaccgctatgataaagatgtagggcagtggaaggagcggggtataggagacatcaagatcctccagaattacgacaacaagcaggtacgtattgtgatgcgacgagaccaggtcctgaagctttgcgccaatcatcgcattacccccgacatgtcattacagaacatgaaaggcaccgaacgggtatgggtgtggaccgcctgcgactttgccgacggcgagagaaaggtagagcatctggcagtgcgttttaaactacaggacgtcgccgactcttttaaaaagatatttgacgaggccaaaaccgcccaggagaaggactctcttattacacctcacgtatccaggtcctctaccccgcgagaatccccttgcggcaaaattgctgtggctgttctggaggagactaccagggagcgcaccgacgtgattcaaggagacgatgtcgcggatgcagctagcgaagtggaagtgagtagcacctcagagaccaccaccaaggccgtggtaagcccacctaaatttgtgttcggttctgaaagtgtgaagcgtatcttcagctcagaaaaatcaaatccctttgcttttggtaactcttcagcgaccgggagcctgtttggtttttcctttaacgctcctcttaaatcaaatgatagtgagactagcagcgtagctcaatctggctcggaatccaaagtagaacccaaaaagtgtgaactatcaaaaaactcggacatagaacagtcctccgacagtaaggtcaagaatttgtcagcttcatttcctatggaagagagttccatcaactacacctttaaaacgcctgagaaggaacctcccctttggcacgccgagttcacgaaggaggaattagtccagaagctaagctccactacaaagagtgctgatcagctgaacggactgctgagggagacagaggctacctccgctgtgctgatggaacagattaagctgcttaaatcggagatcaggaggctggaacggaaccaggaggagagtgcggcgaatgtcgagcaccttaagaatgtcctcctgcagtttatttttttgaaaccaggtagtgaacgggagccgtcttcgtgctataagtacgatgtcgctgctcagccttag

SEQ ID NO: 202503 - DNA, 5301 bp, Artificial Sequence
  Description of Artificial Sequence: Synthetic coding sequence
atgagctgcagcaaggcctacggcgagcggtacgtggccagcgtgcaggggagcgcccccagtccccgaaagaagtcgactcgcggattttatttcgctaagttatactatgaggcaaaagaatatgatctagccaaaaaatatatctgtacttacattaacgtgagggagatggatccacgagctcaccgattcctgggcttgctgtacgagttggaggagaacacagaaaaggccgtggagtgctatcgtcggtccgttgagctcaacccaacgcagaaagacctggtgctaaaaatcgccgagctgttatgcaaaaacgacgtaaccgacggacgggccgaatactgggttgaaagggctgctaagctgtttccaggatctcctgccatttacaaattaaaggagcagctcctcgactgtgagggtgaggacggctggaacaaacttttcgatctgatacagtccgagctgtatgtgagaccagatgatgtccatgtcaacataaggctcgtcgagctgtaccggtcaaccaaaaggcttaaagatgccgttgcccgctgtcacgaagcagagcgtaacatcgccctgaggagctcgctggaatggaacagctgtgtggtgcagaccttaaaagagtacctggaatctctgcaatgcctcgaaagcgataagagtgattggagggccacaaacacagatcttctgctagcatatgctaacctcatgctgctaaccctctcaaccagagacgtgcaggagagtagagagcttctcgaaagctttgattcggccctccagtcagctaagtcaagtctcggcggaaacgacgaattgagcgctacattcctagaaatgaaggggcatttttatatgcatgccggctcattactgctgaagatgggacagcacggcaataacgtgcagtggcgcgctctgagtgaattggccgctttatgttatctcattgcattccaggtccctaggcccaagattaaactcatcaaaggtgaggctggacaaaacttactggagatgatggcgtgtgatagactgagtcagagcggacatatgctgctgaacctgagcaggggtaagcaagatttcttaaaggtggttgtggaaacctttgccaacaaaagcggtcaaagtgctctgtatgacgcactcttcagctcacagtcccctaaagatacttcatttctgggttctgatgacattggaaacatagatgtgcaggaaccagaactggaggatctcgcgaggtacgacgtgggcgctattcgagctcataacggatctctgcaacacctgacctggttgggactacaatggaactcattgcccgctcttcctggaattagaaaatggcttaagcagcttttccaccacttgccccaggagacctcgcgattggagacaaatgcaccagagagtatttgtatcctggacctagaggtttttctcttgggcgtggtctacacaagtcatttgcagctgaaggagaagtgcaattctcatcactctagttaccagcccctatgcctcccactgcccgtgtgtaagcaactgtgcactgaacgccaaaaatcatggtgggatgcagtttgtacacttatccacagaaaggccgtgcccgggaatagtgcaaagctacggctgctagtgcaacacgaaattaatactctaagagcgcaggagaaacatggattgcagcccgcactcttggtccattgggcaaagtgtctgcagaagatggggagtggcctcaactcgttctatgaccagagagaatacatagggcgatcagtgcattattggaagaaagtcttaccactcttaaaaattatcaagaagaagaattcgattcccgagcctatcgatccgttattcaagcactttcattctgttgacatccaggcttcagaaatagtcgagtatgaagaggatgctcacgtaacgttcgcaatcctcgacgcggtgaatggtaatatcgaagatgctatgacagcatttgagtctatcaaatcagttgtttcttactggaacctagctctcattttccataggaaggcagaggatattgccaacgatgccctgtcaccagaggaacaggaggaatgcaagaactacctgaggaaaacacgaggttacttgataaagatcctcgacgacagcgactccaacctctccgtggttaagaaactgcccgtgcctctggagagcgtgaaggaaatgctgaagtctgtgatgcaggaactggaaaattattcggagggcggccccctttataaaaacgggtccttgcggaacgccgactccgagatcaagcattctactccatctcctacaaaatactccctaagtccatccaagtcttacaagtactcccccaagacacccccgcggtgggccgaggatcaaaacagcttgttgaagatgattcgccaggaagtgaaagccattaaggaggaaatgcaggaattaaaattgaactcgtccaagtctgcttcgcaccacagatggccgaccgagaactacggccctgacagcgtgccggatgggtaccaaggcagccagacgtttcatggagccccgctgactgtggccacaactggtccatctgtgtactacagccagagcccagcttataacagccagtatctcttgaggccagcagccaatgtcactccaaccaagggtagtagcaacactgagttcaaaagcactaaagagggatttagtatcccagtttccgcagatggtttcaaatttggaatctccgagcctggcaatcaggagaaaaagtccgagaagcctctagagaacgacaccggtctacaggcacaggatatttcaggacggaaaaaaggccgcggagtgatcttcgggcagacatcgagcacctttacattcgccgacgttgctaaaagtactagtggagagggctttcagtttggcaagaaagatctgaatttcaaaggattttcgggagcaggcgagaaacttttttcctcccagtatgggaagatggctaacaaggccaatacttcaggggactttgaaaaggatgatgacgcctacaagaccgaggatagcgatgacattcattttgagcctgtggtgcaaatgccagagaaagtggaattagtgacaggcgaagagggtgaaaaagtgttgtattcccaaggggtgaaactattcaggttcgacgctgaggtctctcagtggaaagagcggggcctgggcaacctgaagatcctgaagaacgaggtcaatggcaaagtgcgcatgctgatgcagcgtgagcaggttttgaaagtatgcgctaaccactggataactaccactatgaacctgaaaccattatcaggatcagatagggcatggatgtggtccgcatccgacttcagcgacggcgatgcaaagctggagcggctggcggccaagtttaagacccccgagctcgcagaagaatttaaacagaagttcgaagagtgccagcgcctgctcctcgacatcccactgcagactccacataaactagttgatactggaagggccgcgaaattaatccagcgcgccgaagagatgaagtccggcttaaaagatttcaagacttttctcactaacgaccaaaccaaggtggccgaggaggaaaataaggggtcaggcaccggcgcagcgggcgcctctgatacaaccatcaagcccaacgctgagaacactggtcccaccctggaatgggacaactatgacctgcgagaggatgctctggatgactctgtctcctcctccagcgtgcatgcttctccactggcttctagtccagtcaggaaaaacctgtttcactttgatgaatccacaaccggtagcaatttttctttcaaaagcgcactctccttgagcaagagccctgcaaaacttaatcagagcgggacctcagtggggaccgacgaggagagcgatgttacacaggaagaggaaagagacggccaatattttgagcccgtggtgcctctgcccgatctggtcgaagttagctccggggaggagaacgagcaggtggttttttctcacagagccgagttctatcggtacgacaaagatgtcggccagtggaaggagcgggggatcggggacatcaaaatcctgcagaattacgacaacaaacatgtgaggatcctcatgcggagggaccaggtacttaaactttgtgctaatcacagaattaccccggatatgagccttcaaaatatgaaaggcaccgaacgtgtttgggtttggactgcatgcgacttcgcggatggagaacgaaaggtggagcacttagcggtacgctttaagctgcaggacgttgcggacagttttaagaaaatcttcgacgaagctaaaaccgctcaggagaaggactcactcattacacctcatgtctcccgctcctccacccccagagagtctccttgcggcaagatcgccgtcgccgttttggaagagactactcgggaacggacggacgtgatccagggagacgacgttgctgatgctgcatctgaggtcgaggtctcatctacgtctgagacaaccaccaaggccgtcgtaagcccgcccaagtttgtgtttggaagcgagtctgttaaacggatattctctagcgaaaagtccaagcctttcgcctttgggaactcttctgctaccggctcattatttggattttcttttaatgccccactcaagagcaataactcagagaccagctctgtggcccagtctggatcagagtcaaaggttgagcctaaaaagtgtgaactttcaaaaaactctgatatcgaacagagctccgactccaaagtcaagaacctctccgcaagctttcctactgaggagagtagcatcaattacacctttaaaacacctgaaaaggagccaccactctggtatgctgaattcacaaaggaagaactcgtgcagaaactgagttcaacaactaaatcagccgatcacctaaatggccttctgagggagatcgaggcgacaaacgcggtgttgatggaacagatcaagctgctcaaatctgaaatccgaagacttgagaggaatcaggaacaggaagtcagcgccgcaaacgtggaacatttgaaaaatgtcctcctgcagttcatctttctcaagccggggtccgaacgtgaaaggttattgccagtgatcaacactatgcttcagttgtctctggaggagaagggcaagctcgccgccgtggcacaggccgaacgcgggtttgttttaaactctacattctag

SEQ ID NO: 202504 - DNA, 471 bp, Artificial Sequence
  Description of Artificial Sequence: Synthetic coding sequence
atggacccccgggcccaccggttcctgggcctgctgtacgagctggaggagaatactgaaaaggcggttgagtgttataggcggagtgtggagctgaaccccactcagaaggatcttgttctgaagatcgctgagctgctgtgcaagaacgatgtaaccgatgggagagcagaatattgggtggagagagctgctaagctgttccccggctcacctgccatctataagctgaaagagcaactgctagactgcgagggagaagatggctggaacaaactctttgacttgattcagtccgagttatatgtgcgcccagatgatgtgcacgtcaatattcgattggttgagttgtaccggagcactaaacgtctgaaggacgcggtggcccgatgccatgaggccgagaggaacatagcactgaggtcctctctcgagtggaattcctgcgtggtccaaacattgaagttctag

SEQ ID NO: 202505 - DNA, 3378 bp, Artificial Sequence
  Description of Artificial Sequence: Synthetic coding sequence
atgctgctgaccctgagcacccgggacgtgcaggagagccgggagctcctagagtctttcgattccgccctccagtcggccaagtcttcactgggggggaatgacgaattaagtgccacttttctcgagatgaaggggcacttctatatgcatgccggcagccttcttctaaagatgggccagcacggaaacaatgtccagtggcgtgcacttagtgaattggcagctctatgctacctcattgcctttcaggtgccccgacccaaaataaagctaatcaagggtgaagccggccagaacctgttagagatgatggcctgtgacagactgtctcaatccggccacatgctgctgaatttaagccgcggcaagcaggactttttaaaagtggtggtggaaacctttgcaaataaaagtggtcagtcagcgctttatgatgccttatttagctcacagtctccaaaggatacgagctttctgggaagtgacgacatagggaatatagacgtgcaagagcccgagctggaggatcttgctaggtatgacgtaggcgccatccgagctcataacggaagcctgcaacacctgacttggctaggactccagtggaacagccttccggctttgcccggcattcgcaaatggttaaagcagctgtttcaccacctgccccaggagacttcccgcctagaaacaaacgcacccgagtctatctgtatcctcgatctggaggtcttcctactaggtgtcgtttatacttcgcaccttcaactcaaagagaaatgcaacagtcaccatagtagctatcaacctttgtgcctgcctttaccggtgtgtaaacaactatgcacagagcgtcagaaatcttggtgggacgctgtgtgtaccctgatccatcgaaaagcggttcctggcaatagcgccaagctgcggctgttggtccagcatgaaatcaacaccctccgagctcaagaaaagcatgggctgcagccagctctgctggtgcattgggcgaagtgtctgcagaaaatggggtccgggctgaattctttctatgatcagagagagtacatcggtaggtctgttcactactggaagaaggttttgccacttttgaaaatcattaaaaaaaagaatagcatccctgagccgatagatcctctttttaagcactttcactccgtcgatatccaggcatctgagatcgtggaatacgaggaggacgcccatgtaaccttcgctatccttgacgcggtgaatggaaatattgaggacgccatgactgcttttgagagcatcaagagtgtggtctcttactggaacctggcactcatcttccataggaaggctgaagatattgctaatgatgctttgtcacccgaagaacaagaggaatgtaaaaactacctgcggaaaacacggggatacctaattaaaatcctagatgactcagacagcaacctctccgtcgtgaagaagctgcctgtccctttggagagcgtcaaggaaatgctgaagtctgtgatgcaggagctggagaattacagcgagggtgggcccctgtataaaaacgggagtctgcgtaacgccgattccgagataaagcacagcacaccatcacctacaaagtatagtttgtccccctccaagtcctacaagtatagccctaaaacgcccccaaggtgggccgaagaccaaaacagcctgctgaaaatgattcgacaggaggtgaaggccataaaggaggaaatgcaggaactgaaactcaattcctccaagtctgcatcccaccatcggtggcccaccgagaattatgggcccgatagcgtcccggacggctatcaagggagccagacctttcatggtgcaccactgaccgtggcaacaaccggccctagcgtgtattacagtcaatcccctgcctataattctcagtacctcctcagacctgcagctaatgtgacccccaccaaaggctcgtccaacactgaattcaaatccacaaaagaagggttctcaatcccagtcagtgccgatggattcaaatttggaatttcggagccggggaatcaagagaagaaaagcgagaaacccctggagaacgacacaggcttgcaggcgcaggatatctcggggcggaagaaaggccgtggggtgattttcggccagacgtcttcaacttttacatttgccgacgtggccaagtcaacttctggcgagggctttcaattcggaaaaaaggatttgaatttcaagggcttcagtggtgccggcgaaaaactgttctctagccagtacgggaagatggcgaacaaagctaacacctctggcgattttgagaaagacgacgacgcctacaaaacggaagactccgatgacattcacttcgaacccgtcgtgcaaatgcccgaaaaagtggaactagtgaccggagaggagggcgaaaaggtgctgtacagccagggggtcaagctgtttcgatttgatgccgaggtcagccagtggaaagagagagggcttggcaatctgaaaatactaaagaacgaagtgaacggaaaagtgcgcatgctaatgcagcgagagcaggtgctgaaagtctgcgcaaatcactggattaccaccactatgaatctgaaacctttaagtggctcagatcgagcctggatgtggtcagccagtgacttttcagacggagatgccaaattagagcgtttggccgcgaaattcaagacccctgaactggcggaagagtttaagcagaaattcgaggaatgccagcggctgcttttagacatccccttacagactcctcacaagttggttgatactggcagggcagctaagctaatacaacgcgcagaggagatgaaatcaggaagcgaatcaaaggtggagcccaagaaatgtgagctgagtaaaaactctgatatagagcaatcaagcgactcaaaggtaaagaacttgtctgctagctttccgaccgaagagtcaagcatcaattatacattcaagaccccagaaaaggagccacctctatggtatgcggaatttactaaagaagaactggtccaaaaattgtcatctactacgaagagcgcagaccacctcaacggtctgctgcgcgagatcgaggcgaccaatgcagtgcttatggagcagatcaagctgctgaagtctgaaatccgccgactggaaaggaatcaggaacaggaagtttccgcggctaatgtggagcatttgaagaacgtgctattgcagtttatctttctgaagcccggctcagaacgagagaggctactccctgtgatcaatacaatgctacagctgagtttggaagagaaggggaaactcgccgcggtggctcagggtgaggagtag

SEQ ID NO: 202506 - DNA, 423 bp, Artificial Sequence
  Description of Artificial Sequence: Synthetic coding sequence
accgaggagagcagcatcaactacaccttcaagacccccgagaaggaaccccccttgtggtacgctgagttcaccaaggaggaactcgttcaaaaactgagttccactacgaagtcggccgatcacctcaatggactccttagggaaatcgaggccacaaacgcagtgcttatggaacagattaaattgctcaaatcagagatcaggcgtctcgagaggaaccaagagcaagaagtgtctgccgctaatgtggaacacctgaagaacgtcctcttgcaatttatcttcttgaagcccgggtcggaacgggagcggcttctgcccgtaatcaatactatgctccagcttagcctcgaagagaaagggaagctggctgcagtagcccaggggctacaggagacatcgatcccgaaaaagaaatag

SEQ ID NO: 202507 - DNA, 5277 bp, Artificial Sequence
  Description of Artificial Sequence: Synthetic coding sequence
atgagctgcagcaaggcctacggcgagcggtacgtggccagcgtgcaaggctctgctccctctccccgcaaaaagtccacccgtggtttctacttcgcgaagctgtactacgaagccaaagaatacgatctcgcaaaaaaatacatatgtacgtacatcaacgtgcgtgaaatggaccctagggcgcaccggtttctcggcttgctgtatgagctggaagagaatacggagaaagctgtcgaatgttacaggcgttccgtcgagctaaatcccacgcagaaagatctggttttgaagatcgctgagctcttgtgtaagaatgacgtcacggacgggcgagcggagtactgggtggaaagagccgccaaactgttccccgggtccccagcgatctacaagcttaaagagcagcttctggactgtgagggtgaggatggctggaacaagctctttgatctcatccagtctgaactttacgtacgacccgacgacgtgcacgtcaatatcagacttgtagaactatatagatccaccaaacgcttgaaggatgctgtggcgagatgccatgaggctgaacggaatatcgccctccggtcaagcctcgaatggaatagctgcgtggtgcagactctgaaggagtacttagaaagcctccagtgtttagagtctgacaagtccgactggagagccacaaacacagatctgctcttagcatacgcaaacctgatgcttttgaccttgtctaccagagatgttcaagaaagccgggaactgctggagagctttgacagcgctctgcaatccgccaagtcttctcttggcggcaatgatgagctgagcgcgacattcctggaaatgaaaggccacttttatatgcatgctgggtcactgctactgaagatgggccaacacgggaacaatgtacaatggcgggcactgtccgaactggccgccctgtgttacttgatcgcatttcaagtccccaggcccaaaatcaaattgattaagggtgaggccggacaaaatttactggaaatgatggcttgcgaccgtctgtctcagagcggccacatgctgctgaacctctcgagaggaaaacaggactttttgaaggttgtggtcgagacatttgctaataagagcgggcagagtgctctatacgacgcactgttctccagccaaagtcccaaagacaccagtttcctgggaagcgatgacattggaaatattgacgttcaggagcccgagctggaggatctcgcacgatatgacgttggcgccattcgtgcacataacggatctctccagcacctgacatggctgggcctgcaatggaattccctgccagccttgccagggattcggaaatggctgaaacagttgtttcaccatttgccccaggagacaagcaggctcgaaactaacgcccccgaaagtatatgcatcctggacctcgaggtgtttctccttggcgtcgtgtatacctcccatttacagctgaaggaaaagtgtaactctcaccactcaagctatcaacccctgtgcctgcccctgccagtctgcaagcagctctgcacagaaaggcagaagtcatggtgggatgccgtgtgcacattgattcacaggaaggctgtgcccgggaatagcgccaagctgcggctcctggtccaacacgagattaatactttgcgggcgcaggagaaacacggtcttcagcccgctctgttggttcattgggccaagtgcctgcaaaagatgggctcaggcctgaacagcttctatgatcagagagaatacatcggccgctcagttcactattggaaaaaggttctgcctctcctcaagatcataaagaagaaaaattccatacccgaaccaattgaccccttgttcaagcacttccactcagtagatatccaggccagtgaaattgtcgaatatgaggaagatgcccatgttacgttcgccattctggacgccgttaatggcaatatcgaggatgcaatgaccgcgtttgaatccatcaagtccgtcgtcagctactggaatctggccttgatttttcaccggaaagccgaagatatagccaatgatgctcttagtcccgaagagcaggaagaatgtaaaaactatctgcggaaaacacggggatatctgattaaaatcctcgacgactccgattccaacttgagcgtggtgaagaagctgcccgtgcctttagaatccgtcaaagaaatgcttaagtcggtcatgcaggaattggaaaactactcagagggtggacccctgtacaaaaacgggtctctgagaaacgccgacagtgagatcaagcactccacgccgagcccaacaaagtactcactgtccccatccaaaagctacaagtattcccctaagacacccccccgctgggcggaggatcaaaattccctactcaagatgattaggcaagaagttaaagccatcaaggaggaaatgcaagagctgaaattaaatagctccaagtcagctagccatcaccgctggcctacagaaaactacgggcccgacagcgttccagatggctatcaaggttcacagactttccacggtgcccctcttacagtggccacaacgggaccctccgtgtactacagccagtctcccgcatataacagtcagtatttactgcgccctgcagctaatgtcaccccaacaaaaggctcttccaatacggagttcaagtctaccaaagaaggcttcagtatacccgtgagtgctgacggatttaagttcggcatatccgaacccggcaaccaagagaagaagtcagagaagccccttgagaacgacaccggcttgcaggcccaggatatcagtggacgaaaaaaggggcggggtgtgattttcggacaaacctctagtacattcacattcgccgacgtcgcaaaatctacgtctggtgaggggtttcaattcggtaagaaggatctgaacttcaagggctttagcggcgctggcgagaagttgttctcctcacaatatggcaaaatggccaacaaagccaacacctccggggatttcgaaaaagatgacgatgcttataaaacagaggattctgacgacattcatttcgaacctgtggtccagatgcccgaaaaggtggagctcgtaacgggcgaggaaggcgagaaggtgctttatagccagggcgtcaagttattccgctttgatgctgaagtaagccaatggaaggagcgtgggctaggaaacctcaaaattttgaaaaacgaagtgaatgggaaggtgcgcatgctgatgcagagagaacaggtgctcaaggtatgtgcaaaccattggatcacaacaactatgaatctaaagccactgtcagggagcgatcgtgcttggatgtggtcagcaagcgacttttccgacggggatgcgaaactggaacgtctggccgctaagttcaagacgcccgagctagcggaagagttcaagcaaaaattcgaagagtgtcagaggcttttacttgatatacctctgcaaacacctcataagctggtggacaccgggagggcagcaaagctgatccaaagagcagaggagatgaagtctgggctgaaagactttaaaacatttttaacaaacgaccagactaaagttgctgaggaggagaataaaggatccggcaccggggcagccggggctagtgatacaacgatcaaacctaatgcagagaataccgggcccaccttagagtgggacaattatgatctgcgcgaggacgctctggacgatagcgtcagttcaagcagcgtgcatgcctctcccctagcaagcagccctgttagaaagaacctctttcacttcgatgagtcgactaccggctcgaattttagctttaagagcgccctcagcctatctaagagtccagcgaaactcaaccagagtggcacctctgtaggaaccgatgaagagagcgatgtgactcaggaggaggaacgcgacggacagtactttgagcccgtagtgccacttcccgatcttgtggaggtgagcagcggcgaagagaatgagcaggtcgtgttttcgcatcgggccgagttttatcgctacgacaaggatgtgggccagtggaaggaacgaggtatcggggatataaagatcctgcagaactatgacaataagcacgtccgcattctgatgcggagggaccaggtgctgaagctctgtgccaaccacagaataactcccgacatgtcacttcagaatatgaagggcaccgagcgggtttgggtctggactgcctgtgattttgccgacggtgaacgcaaagtggagcatttagccgtgaggttcaaactgcaggatgttgcagacagcttcaagaaaatttttgatgaagcgaaaacggcacaggaaaaggattcccttataacccctcacgtttcgcggtcgtctacacctagagaaagtccttgtggcaagattgccgttgctgttcttgaagagacaacccgagagcgaacagatgtgattcagggcgatgacgtagccgatgcagctagtgaggtggaggtctcctcaacgtcggagaccactactaaggctgtggtgtcacctccaaaatttgtcttcggaagcgagtcagtgaagcgtatcttcagctccgaaaaatccaagcccttcgccttcggcaactccagcgccaccggatctctcttcggattttctttcaatgcccccctgaagtccaataattcagagaccagtagcgtagcccagtctggctccgagagcaaggtggagcctaaaaaatgtgagttgtcgaaaaacagtgacattgagcagagtagcgactccaaggtcaagaacttgtcagcctcctttcccaccgaggaaagctctataaattacacattcaagacacctgagaaggagcctcccctgtggtacgctgagttcaccaaagaggagcttgtacagaagttgagtagcactacaaaatctgcagatcacctgaatggtctgctacgtgaaattgaggctactaatgcagtgttaatggaacagatcaagctgctgaagtccgagatccggcggctggagcggaatcaggaacaagaagtctctgcggctaacgtagaacatctcaagaatgtcctgttgcagttcatatttctcaaacctggcagcgagcgcgaacgtctcctcccagtgatcaatacgatgttgcagctctctctggaggagaaaggcaagttagccgcagtcgcccagggtgaagagtag

SEQ ID NO: 202508 - DNA, 5301 bp, Artificial Sequence
  Description of Artificial Sequence: Synthetic coding sequence
atgagctgcagcaaggcctacggcgagcggtacgtggccagcgtgcaggggtcagcaccatccccaaggaaaaaatctacccgtgggttttactttgccaagttgtactacgaggcaaaggagtacgacttggccaaaaaatacatctgcacatatataaatgtaagagagatggacccaagagcccaccgattcctgggcctgctatacgagttggaagagaacacagagaaagccgtggagtgttaccgccggtcggtagagttgaatccaacccaaaaagacctcgtgctaaagatcgccgaactcttgtgtaaaaacgacgttacagatgggcgggctaaatactgggtggagagggccgccaaactgtttcctggttcgccggccatctataagttgaaggaacagttgctcgactgcgaaggcgaagacggttggaataagttgttcgatttgatccagagcgagttatacgtcagacccgatgacgtgcacgtgaacatcagacttgtagaattgtaccggtcaaccaagcgtctaaaggacgccgtcgctcgctgccatgaggcagagcgaaatatcgcgctgagaagcagcctcgaatggaattcctgtgtggtacagaccctgaaggagtacttggagtccctgcagtgcctggagtccgataaatctgattggagagcaactaatactgacctgttacttgcgtacgccaatctgatgcttctgactctgtccacccgcgacgtgcaagaaagtcgagagctccttgagtctttcgatagcgctcttcagtccgctaagagctccctgggagggaacgatgaactaagcgctacttttctagagatgaaggggcatttctacatgcatgctggctccctgcttcttaagatggggcagcatggcaacaatgttcagtggagagctctgagcgagcttgccgccctgtgctacctcatcgccttccaagtgcccaggcccaaaattaagctaataaaaggggaggccgggcagaacctgctggaaatgatggcctgtgaccgcctctctcagtccgggcacatgctacttaacctgtcgagaggaaagcaggacttcttaaaagtggtcgtggaaacttttgccaacaagagcgggcaaagtgctttgtatgacgctctcttttcttctcaatctccaaaggatacctccttcctcgggagcgacgacatcggtaacatcgacgtgcaagagcctgagttggaggatctggcacgttacgatgtaggggctatccgggcccataacgggtctctccagcacctcacatggctgggcctacagtggaactctcttcctgccctgcccgggatacggaagtggcttaagcaactgttccatcacctacctcaggagacatcccggctcgagactaatgcacccgagagcatatgtattctcgatctggaggtgttcctcctcggtgtagtgtatacttcacacttacagctgaaagagaaatgcaactcccaccatagctcttaccagcccctgtgtttgcctttgcccgtctgcaaacaactttgtacagaaaggcaaaagagctggtgggacgccgtgtgcactctgatccaccggaaggctgtccctggtaactctgctaagctgcgcctgctggttcagcacgagatcaatactctccgtgcccaggaaaagcacggtctgcaacccgcgctgcttgtccactgggctaagtgcctccaaaagatgggttccggactgaatagcttttacgaccagagagagtacattggtaggtctgtgcactattggaaaaaggttctgcctctgctgaagattatcaagaaaaaaaattcgattcccgaacccatcgacccattatttaaacatttccacagtgtggatattcaggcaagcgagatcgtggagtacgaggaagacgcgcatgtgaccttcgcaattttagacgccgtcaatggaaacattgaggacgcaatgactgcgttcgagagcatcaagagtgtggtcagctactggaacctggcccttattttccatcgcaaggcggaggacatcgccaacgatgctctgtcccccgaagaacaggaagagtgcaagaactatctaaggaagaccaggggctacctaataaaaatcctggatgatagtgattctaatctatctgtggttaagaagctgccagtgcccctggaatccgtcaaagagatgctcaaatctgtgatgcaagaacttgaaaattactcggagggcgatccactatataaaaacgggtccttgcgcaacgcagatagtgaaattaaacattcaactcccagcccaactaagtactccctgtcacctagcaaatcatataaatattctccaaagacaccccctcgatgggcggaggatcagaactctcttctgaagatgattcgccaggaagtgaaggccataaaagaggagatgcaggaattgaagttaaacagtagcaagagcgccagtcaccatcgctggcccacagagaactatgggcctgactcggttcccgatggctaccagggtagccagacatttcacggagcccctctcaccgtcgctaccaccggccctagcgtttactattcacagtccccggcatataatagtcaatatctgttgaggcctgcggcaaacgtcactcccactaaagggagctctaataccgagttcaaaagtacaaaagagggattcagtatccccgtgagtgccgatggcttcaagttcggaataagcgagcccggaaaccaggaaaaagaaagtgagaagcccttagagaacgacacaggcttccaggcccaggatatatctggccagaagaacgggagaggagtgatctttggacaaacatctagcacttttactttcgctgatgtcgcgaagtctacaagcggggaaggcttccagttcggaaagaaggatcccaatttcaaaggattttccggggcgggggaaaagctcttttctagtcagtgtggcaagatggctaacaaggcaaatacaagcggagacttcgaaaaagacgacgacgcttacaaaaccgaagactccgacgacattcattttgaaccagtggtccagatgccggaaaaggtcgagctcgtgattggagaagaaggggagaaagtgctgtactctcaaggcgtgaagctttttaggttcgatgccgaggttaggcaatggaaggagaggggtttgggtaaccttaaaatcctcaagaatgaggttaacgggaagccccgaatgctgatgcgccgggagcaagtgctgaaggtctgtgctaatcactggattacgactactatgaaccttaagccactctcgggatccgacagagcatggatgtggtccgccagtgatttcagtgacggcgacgctaaattggagcggctggccgccaagttcaagacgccggagctggccgaagagtttaaacagaagtttgaggagtgccagcagctcttattagatattccccttcagaccccacacaaactggtggatacaggccgtgcagctaagttgattcagagggccgaggagatgaagagtgggttgaaagacttcaaaacctttctgacgaatgatcagaccaaggtgactgaagaagagaataagggatctggtaccggtgcagctggagcatccgataccaccatcaagccgaacccggagaacaccgggcccaccctggagtgggacaattgcgatctgagagaggacgcgctggatgatagcgtgtcttccagcagcgtgcatgcttctccgctcgcaagcagtccagtccggaaaaatcttttccattttggcgagtccactacagggagcaacttctcttttaagtcagccctgtcaccaagtaagtcccctgccaagctaaatcagagcggcacctcggtgggaacggatgaagagtctgacgtgactcaggaggaagaacgtgacggccaatacttcgagccagtagtgccactgccggacctcgttgaagtctccagcggcgaggaaaacgaaaaagttgtcttttcacacagagcagaactataccgctacgataaggatgttggccaatggaaagagagggggatcggcgacatcaaaattttgcaaaattatgataataaacaggttcgaatagtgatgagacgggatcaagtcttgaagctgtgtgccaaccatacaattaccccagatatgagcctccagaatatgaaagggaccgagcgtgtttgggtctggactgcgtgcgacttcgcagatggcgagagaaaggtggaacatttggccgttcgattcaaacttcaggatgtcgctgattcattcaaaaaaatcttcgatgaggccaagacggctcaagagaaggacagcctgatcacccctcacgtgagcaggagtagtaccccccgggaatcaccttgcggtaagatcgctgttgcagttttagaggaaactaccagggaacggactgacgtgatccagggcgatgacgttgccgacgctgctagtgaggtggaagtgagctctacttcggagaccactaccaaggccgttgtcagtcctccaaagttcgtcttcggctccgagagcgtgaagaggatcttctctagcgagaagtctaaaccgtttgcatttggtaatagctcggctacagggtctctgttcggatttagctttaatgcctctctcaaatccaataatagtgagacttcttccgttgcccaaagtggatccgaatctaaagtcgagcctaagaaatgcgagttgtctaagaactctgacatagaacaaagctccgatagcaaggttaagaatctgagtgctagctttcctatggaggaaagctctatcaactacacttttaagacccccgagaaagagcccccgctctggcacgccgagttcaccaaagaggagctggtacagaaactttcgtccactactaaaagcgcagaccacctgaacgggctgctgcgtgaggcagaggccacatcagctgtactgatggaacaaatcaagcttttgaagtctgagatccgtcgcctcgaacgaaaccaagagcaagaggagtctgctgctaatgtggaacatctgaagaacgtcctactccagttcattttcttgaagcctggctccgagagagaacggttgcttcccgttatcaatacaatgttacagctctctccagaagagaaaggcaaacttgcagccgtcgcacaggccgaacgtgggtttgtgcttaatagtacgttttag

SEQ ID NO: 202509 - DNA, 3378 bp, Artificial Sequence
  Description of Artificial Sequence: Synthetic coding sequence
atgctgctgaccctgagcacccgggacgtgcaggagagccgggagctgctggagagcttcgatagcgccctgcagtccgcaaaatcctcccttggcggcaacgacgaactctctgctacctttttggaaatgaagggtcatttctacatgcatgccggctcccttctgttaaaaatgggccagcatggtaacaatgtgcaatggagggccttatccgagctggccgccctgtgctacctcatagctttccaagtaccgaggccaaagattaaactgattaaaggtgaagccgggcagaatttactcgaaatgatggcttgtgatcggctgtcccagtctggtcatatgctgctaaacttatctagaggaaagcaggacttccttaaagtggtggtggaaacgtttgctaataaaagcggccaatcggcactgtacgacgctttatttagttcccagagcccgaaagacactagtttcctgggaagcgacgatatcggcaacatagacgtgcaggagcccgagcttgaggacctcgccagatacgacgtgggcgccattcgagcccacaatggaagcttgcaacacctgacctggcttggtttgcaatggaactcgctgccagccctgcccgggatccggaagtggctgaaacagctgtttcaccatctcccccaggagacaagccggctagagaccaacgctccagagtccatctgcatactggatttagaagtattcctgctgggcgtggtctatacaagccacctgcagctcaaagaaaaatgcaattctcaccatagctcataccaaccgctatgcctgccgctccctgtgtgtaagcagctttgtacagaaagacaaaaaagctggtgggacgctgtatgcaccttaatccataggaaggccgttccagggaactccgctaaactgcgactgctcgtacagcacgaaatcaatactctgagagcccaagagaaacatggtttgcagccggccctgttggttcactgggcaaaatgcttgcagaaaatggggtcaggactgaacagcttctacgatcaacgagagtatattggcagaagcgtccactattggaagaaagtgctcccactgctgaaaattatcaaaaaaaaaaatagcatcccagaaccaattgaccccctgtttaagcacttccactccgtcgacattcaagcatccgagatcgtggagtacgaagaggacgcccacgtgacctttgctatcctggatgctgttaacggcaacatagaagatgccatgactgcgtttgaatccatcaagagtgtagtaagctattggaatttagcgctcattttccacagaaaagccgaggacatcgcgaatgacgctcttagcccagaagaacaggaagaatgtaagaactacctaaggaaaacacggggataccttatcaaaattttagacgactctgattctaatctctcagtggtgaaaaaactgcccgttcccctggagtccgtgaaagaaatgctgaagtcagtgatgcaggagctggagaactactccgaaggcgacccgctgtataaaaatggaagcctacgcaatgcagattctgagatcaaacacagtaccccctcgccaaccaagtattccctatccccatctaaaagttataagtacagccccaagacccctccacgctgggccgaagaccagaactctctgctgaagatgattaggcaagaggtaaaggcaatcaaggaagagatgcaagaactgaagctgaatagctcgaagtccgcaagtcatcacagatggcctacggagaactatggccccgattccgtgcccgacggctaccagggtagtcagactttccacggtgcaccactgaccgtggccaccactggaccttccgtatattattcgcagagccccgcctataattcacaatatctactgcggcctgcagccaatgttactcccaccaaaggctcgagtaataccgagtttaagtcgaccaaagaggggttctctattccagtgtctgcggacggtttcaaatttggcatcagtgaacctggtaatcaggaaaaggaaagcgaaaagcctctggagaacgatacaggttttcaggcccaagatatcagtggacagaagaacggccgaggagtgatcttcggacagacatctagtacgttcaccttcgccgatgttgctaaaagcacctccggagagggttttcagttcggaaagaaagatccaaactttaagggattctccggcgctggggagaagctctttagttcccagtgtggaaaaatggcaaacaaggccaacacttcaggcgatttcgagaaggacgatgacgcttacaagactgaggacagtgatgatatacactttgagcctgtggtgcagatgcccgagaaagtggagctggtgatcggagaggaaggggagaaagtcctttactctcaaggcgtaaagctctttcgcttcgacgccgaggttaggcaatggaaggagcgaggtttaggaaacttaaagattctgaagaacgaggtgaacggcaagccaaggatgcttatgcgtcgcgagcaggtgctcaaggtctgtgccaatcactggataacaacaaccatgaatctgaaacccctgtctggttcagatcgcgcatggatgtggtctgcaagtgacttcagcgacggcgacgccaagttggagcggctcgctgcaaagttcaagacccccgagttagctgaggagtttaagcaaaagttcgaggaatgccaacagctgcttctggacatcccacttcaaaccccacataagctggtagacactggaagggctgcaaaactgattcagcgcgccgaggaaatgaaatccggctctgagtccaaggtggaaccaaagaagtgcgagttatcaaagaattcggacatcgaacagagcagcgattccaaggtcaaaaatttatctgcctctttccctatggaggagtcttccataaactacaccttcaaaacacccgaaaaggaaccaccactctggcacgctgagttcaccaaggaagaacttgtccagaagttatcttcgacaactaaatcggcggaccacctgaacggcctgctgagagaggctgaagccacttccgcagtcttgatggaacagatcaaactcctcaaaagtgaaattagaagactggaaagaaaccaagagcaagaggaatccgcggcgaacgtggagcatctcaagaacgtgcttctacaattcattttccttaagcctggctctgaaagagaacgcttgctgcctgtgattaatacaatgctccagctgagtccggaggagaaaggcaaactggcagcggtggcacaaggggaagagtag

SEQ ID NO: 202510 - DNA, 471 bp, Artificial Sequence
  Description of Artificial Sequence: Synthetic coding sequence
atggacccccgggcccaccggttcctgggcctgctgtacgagctggaagaaaacaccgaaaaagccgtcgagtgttaccggcgctctgtggagttgaaccctacacagaaggatctggtcctgaaaatcgccgagctgttgtgcaagaatgatgtaaccgatggccgagctaagtattgggtggaacgggctgccaaacttttccccggctcccctgcaatatacaagctgaaagaacagctcctggactgcgagggcgaggacggttggaacaagttgttcgacctaatacagtcagaactgtacgtgagaccagacgatgtgcacgtgaatattcgattagtggaactgtacaggtcaactaagaggctcaaggatgctgtggcccgctgtcatgaggctgaacggaacatcgctctccgaagttcactggagtggaattcatgcgtggttcagacactcaagttttag

SEQ ID NO: 202511 - DNA, 5277 bp, Artificial Sequence
  Description of Artificial Sequence: Synthetic coding sequence
atgagctgcagcaaggcctacggcgagcggtacgtggccagcgtgcagggatcggctccatctccgagaaagaaatctacacgagggttttatttcgccaagctgtactatgaagccaaagaatacgacctagcaaagaagtacatctgcacgtacatcaacgtgagagagatggaccccagggcacaccgattcttgggactgctgtacgaattggaagagaacacggagaaagcggtcgagtgctaccggcgatccgtggaactgaacccgactcagaaggatttagtgctcaaaattgctgagctcctttgtaagaatgacgtgacggatggtagggctaaatactgggttgagcgggccgctaagcttttccccggaagcccggccatttacaagctcaaggagcagctgcttgattgcgaaggtgaggatggctggaacaagttgttcgacctgatccaatcggagctgtatgtccggcctgacgacgtgcatgttaatatcagattggtggaactatacaggtcaacgaagagactcaaggacgcagttgcccggtgccatgaggcagaaaggaacattgctctaagaagctctctagagtggaattcgtgtgtcgtccagacactcaaggaatacctagaatccctccaatgcctggaaagtgataagagcgattggcgagccacaaacactgacctgctgcttgcctatgctaatctcatgctgttgacactcagtacacgagatgttcaagagagtcgagaactgctggaatcgtttgacagcgcattacaatcagctaaatctagcctcggaggaaatgatgaattgtctgccacctttctggagatgaaagggcacttttatatgcatgccgggagtctgcttttaaagatgggccaacatgggaacaacgtccaatggcgagcactctccgaactggccgctctctgttacctaatcgcgtttcaagtgccaaggcctaaaataaagctcatcaagggggaagcaggtcaaaaccttctggaaatgatggcctgcgaccgactgtctcagtctgggcacatgctactgaacctgtcccggggtaagcaagactttctgaaggtggtagtggaaactttcgcgaacaaatccggccaaagcgcgctgtatgatgcactgttctctagccagagccctaaggacactagctttctgggatccgatgacataggcaatatcgacgtccaggaacctgagctcgaagacttggctcggtatgacgtcggagcaatacgagcccataatggctccctgcaacacttaacatggctcgggctgcagtggaactcactccctgccctcccaggtatacgcaaatggttgaagcaattgtttcatcacctacctcaggagacctcaaggcttgaaaccaatgccccagagtcaatctgcattctggaccttgaagtgtttttacttggggtcgtttatacatcgcatctgcagttaaaggagaaatgtaattcccaccacagctcatatcaacccttgtgtctgccgctgcctgtgtgcaagcaactctgcaccgagaggcagaagagttggtgggacgcagtatgtacacttattcaccgcaaggcggtccccggaaattctgctaagttaaggctgctagtgcagcatgaaatcaatacattgcgggctcaagagaaacacgggctacaacctgcgctgctcgtgcattgggctaaatgtctgcagaagatgggatccgggctgaactctttttatgatcagcgtgagtatatagggcggtccgtacattattggaaaaaagtcctgccactgctgaagatcattaaaaagaagaactctatcccagagccgatcgacccactcttcaagcattttcactctgttgacattcaggcttctgagattgtcgagtacgaggaggatgctcatgtgactttcgccatcttagacgctgtgaatggcaatattgaggatgctatgaccgcattcgaatccatcaaatcagttgtatcatactggaacctggctttgatctttcaccgcaaggcagaggatatcgctaacgatgctctgagccccgaagagcaagaagaatgcaagaactacctgcgcaaaacaaggggttacttgattaaaatactggacgacagcgacagcaacctcagcgttgtgaaaaagctgccggtccccctggaaagtgtaaaagagatgttgaaatccgtcatgcaggaattagagaactactctgagggcgatcctctgtataagaacggatctctccgcaatgccgatagtgagattaaacacagtaccccatcccccaccaagtactctctctctccaagcaagtcttacaaatactcacccaagacccccccgagatgggccgaggatcagaattccttgttgaaaatgatccggcaggaggtgaaggcaatcaaggaggagatgcaagagttgaaattgaattcttcgaaatccgccagtcatcatcggtggccaaccgaaaattacggacccgacagtgttcccgacggataccagggttcccagactttccacggcgcgcccttgactgtcgctaccacaggtccgtctgtatattattcccagagtccagcatataactctcagtatctgctcaggccagcggccaatgtgactcctactaaggggtcctcaaacaccgagtttaagtcaaccaaagaagggttttcaatccctgtatccgctgacggatttaagttcggaatcagcgagccaggaaaccaggaaaaggaatccgagaaacctctggagaatgacacgggctttcaagcgcaagacatctccgggcagaaaaatggccgcggggttattttcggccagacaagcagcacttttactttcgctgatgtggccaagagtactagtggagaagggtttcaatttggaaagaaggatcccaacttcaaaggttttagcggagcaggggaaaagctcttttcttcccagtgcgggaagatggccaacaaagcaaacacctctggggacttcgaaaaggacgacgacgcctacaaaacagaagacagcgatgacatacattttgaacctgttgtccaaatgccagagaaagtggaacttgtaatcggagaagagggtgaaaaagtgctatattctcaaggtgtaaagcttttccggttcgacgcggaggtcagacagtggaaagaacgggggttgggtaatctcaagatattgaaaaatgaggttaacgggaagcctcgcatgctgatgcggagggagcaagtgcttaaggtctgcgccaatcactggatcaccacaacaatgaatcttaagcccttgtccggttccgaccgggcatggatgtggtccgcttcagattttagtgacggggatgctaagctcgagaggctggcggctaagttcaaaaccccagaactggccgaagagtttaagcagaagttcgaagaatgtcaacagcttctgctggatatcccactgcagaccccacataaactggtggataccggtagggcagctaagctgatccagcgagctgaggagatgaagagtggcctgaaggacttcaaaacatttctcactaatgaccagacaaaagttacagaagaggaaaacaaaggctcggggaccggcgctgccggcgcctcggatactaccatcaagcctaaccccgagaatactggaccaacacttgaatgggacaactgcgacctgcgagaggatgcgctggatgactcagtcagtagcagcagtgtccacgcctcaccactggcatctagccctgtgagaaaaaacctttttcactttggtgagtctacgacagggtctaacttcagcttcaaatctgccttatcccctagcaagtcacccgccaagctgaatcagtccggaaccagcgtggggaccgacgaggaatcagatgtcacccaggaggaggaacgggacggtcagtatttcgaacccgtggtgcctttaccagatttagttgaggtgagttccggcgaagaaaacgaaaaggtggtcttctctcatcgggcagaactgtatagatacgacaaggatgtgggccaatggaaagagcgcggtatcggagacatcaaaattctccaaaactacgataataaacaagtgagaatcgtaatgaggagggatcaggtgctgaagttatgtgccaaccacacaattacacctgacatgagtcttcagaacatgaagggaactgaacgggtgtgggtgtggacagcctgtgatttcgcggacggcgagagaaaggtcgagcatttggcagtgcgattcaagcttcaggacgttgccgatagctttaagaagatcttcgatgaggctaagacagcgcaagagaaggatagcttaatcactcctcacgtgtctagatcctccacccccagggagagcccctgcggaaagatcgccgtagctgtactcgaggaaaccacacgtgaaagaacagatgtcattcagggggacgacgttgccgatgccgcctcagaggtggaagtgtcttcaacgtctgagactaccaccaaagctgttgtaagcccaccgaagtttgtctttggaagcgagtctgtaaaacgaatttttagcagtgagaaatccaaaccctttgcgtttggcaactcctcagcaacaggttcacttttcggtttttcatttaatgctagccttaaaagcaacaactccgaaacctccagtgtcgctcagtcaggatctgaatccaaggtcgaaccgaagaaatgtgaactatccaagaatagcgatattgaacagtcgtctgactctaaagtgaagaatctgtcagcctcatttccaatggaggaatcgagcataaattacaccttcaaaacaccggagaaggagcctcccctgtggcacgccgaattcacaaaagaggaacttgtccagaagcttagctccaccaccaaatctgcagaccacctgaatgggctgctgagggaggccgaggctacatcagctgtgctcatggaacagatcaaacttctcaaatccgagataaggcgacttgaacgtaaccaggagcaggaagagagtgctgcgaatgtagagcacctcaagaatgtgttattacaattcatttttctcaagcccggcagtgaacgggaaaggttactgccagtgatcaacacaatgcttcagctgtctcctgaagagaagggcaaattagccgccgtcgctcagggcgaggagtag

SEQ ID NO: 202512 - DNA, 5298 bp, Artificial Sequence
  Description of Artificial Sequence: Synthetic coding sequence
atgcggcggagcaaggccgacgtggagcggtacgtggccagcgtgctgggactcactccttctcccagacaaaagagtatgaaaggtttttactttgcaaagctgtactacgaagctaaagaatacgacctggcgaaaaaatatatttgtacatatatcaacgtgcaggagcgagatccaaaggcacaccgatttctcggactgctttatgaactggaggagaatactgagaaggccgtggaatgttaccggcgctcagtggaactcaatcctacacagaaggatctcgtcctgaaaatcgcggagctgctgtgtaagaacgacgtcacagacggcagggcgaagtactgggtagaacgggcggcgaaactgttccccgggtcacccgccatctacaagctgaaggagcagttgttagattgtgaaggagaggatgggtggaataaactgttcgatctcattcagtctgaactctacgtgaggcccgatgatgttcatgtgaacatccgactggtagaactgtatcgttccacgaagagactgaaagatgccgtggctcactgccacgaagcagaaaggaatatcgcccttcgtagtagccttgaatggaactcatgcgtagtccagacgcttaaggagtatctcgagagccttcagtgtctggaatccgataagagcgactggcaggcaacaaacacagacttgctgctggcctatgccaatcttatgcttctaacactgtccactagggatgtccaggaaaatagagaactgttagagagtttcgattccgcacttcaatcagccaagtcttcgctcggcggcaatgatgagctcagcgccaccttcctggagatgaaggggcacttttacatgtacgctgggagtctcctcctgaaaatgggtcagcatggaaacaacgttcagtggcgggccctgtctgagctggccgcgctttgctatcttatagcctttcaagtgccacggcctaagatcaagctgagagagggtaaggcaggacagaacctcctcgaaatgatggcctgtgacagactgagccaatctggtcacatgctgctctctctgtcgcggggtaagcaggactttctgaaagaggtcgtcgagacttttgccaataagatcggccagtctgcattatacgatgcactcttctcatcgcagtcccctaaggacacgagcttcctgggctccgatgacattgggaaaatagacgtgcaagagcctgaactggaagatcttgccagatacgacgtgggcgccataagggcacacaacggttccctgcagcaccttacttggttaggcttgcaatggaatagtttgccagccttgcccgggatccgtaagtggcttaaacaattgttccacagactgccccatgaaacctctagattagagacgaacgcacccgaatccatctgcattctggacctggaggtgttccttctgggtgttgtgtacacaagtcacctccagctcaaagagaagtgcaactcacatcactccagctaccagcccctttgccttccattccccgtgtgtaagcagttgtgcacagagcgacagaaatcttggtgggatgctgtgtgtactctgattcatagaaaagccgtgcccggaaacctggctaagctcagactgttggtgcagcatgagatcaacactctgagagcacaggagaagcacgggctccagccggcattgctcgtgcactgggccaagtatctccaaaagactggatccgggcttaattctttctatggccagctcgagtacatcggtcgcagtgtccactactggaaaaaggtcctgcctttactgaagatcattaaaaagaactctattccggagcccattgatcccttatttaaacacttccactcagtcgatatccaggcaagcgagatcgtggagtacgaggaggacgctcacattacattcgccatgctggatgcagtgaacggcaacatcgaagacgctgtaacggctttcgaaagcatcaagtcggtggtgtcatattggaacctggctctgatctttcatcgcaaagccgaagacattgagaacgacgccctgtcgcccgaggagcaggaagaatgtcgcaattaccttactaaaacccgcgattatctaataaaaatcatcgacgacggcgattccaacctctcggttgttaagaagctgccggtgcccctcgagagcgtaaaacaaatgctgaactctgtgatgcaggaactggaagactattcggagggagggcccctctacaagaatggttcactgagaaatgctgactcagagattaaacacagcactccaagtcctactaagtactctttaagtcctagcaaatcttataaatactctcctgaaacccctccgcggtggacggaggaccgaaacagccttctgaatatgatctgtcagcaggtggaagccatcaagaaggaaatgcaggagcttaaattaaattcaagcaagtcagcctctagacatagatggcccacggaaaactatggccctgatagcgttccagatggctatcagggctcccagaccttccacggagctcctttgacagtggcaacaacagggccaagcgtttattacagccagtcccctgcctataatagccaatatttactgcgccccgcagccaacgtgacccccactaagggttcttcaaacaccgagtttaaatctacgaaggaggggttctcaattcctgtcagtgctgatggatttaaattcggcatctctgagccgggtaaccaggagaaaaagagggagaaacccctggagaatgatacaggatttcaggctcaagacatctccggacgaaaaaaggggagaggtgtgattttcggccagacatcttcaacctttacattcgcggatgtggccaagtcaactagcggcgaaggattccagtttggaaagaaggacctcaactttaagggcttcagtggagccggggaaaaacttttcagttccaggtacggaaagatggctaataaggctaatacctcgggcgatttcgagaaggatgacgacgcttacaaaaccgaggatagtgacgacattcactttgaaccagtggtccagatgcccgaaaaggtggaactcgtgaccggggaagaaggagaaaaggtcctatacagtcagggagtgaagctgttccggttcgacgccgaagtgcgtcagtggaaagagcgaggtctggggaatctgaagatcctgaagaacgaggtaaatggaaagctgaggatgctgatgcggcgggagcaggtgctgaaggtatgtgctaatcactggattacgaccacaatgaatctgaagcctctgtccggttctgaccgagcttggatgtggagcgcgagtgacttcagcgacggagacgcgaagctggagcgcctcgccgctaagttcaagaccccagaactcgccgaagaattcaaacagaaattcgaagaatgccagaggctgttgttggacatccctctacagacacctcataagctggttgatactggacgggcagccaagttgattcagcgtgcagaagagatgaaaagtggcctgaaagattttaagacgtttctgacaaacgaccaaaccaaggtcacggaggaggaaaataaaggctccggcacgggggcagctggagcgagcgatactaccatcaagcccaatgccgagaacaccggccctacacttgaatgggacaattacgaccttagggaagacgctttagatgacagtgtaagttcatccagcgttcacgcctctcccctggcttcttcccctgtccgtaagaacctcttccggttcgacgaatctacaactggatctaacttctccttcaagtcagccctgtccctctcaaagagtcccgccaaactgaaccagagtggtacttctgtgggcaccgatgaggaatctgtcgtgactcaggaagaggagcgtgacggccagtattttgagcccgtcgtgcccctgcccgacctcgtggaggtctccagtggcgaggagaatgaacaggtggttttctcccacagggctgaaatctacaggtacgataaggacgtcggacagtggaaagagaggggaattggcgacatcaagatcctccagaactacgataacaagcaagttcgcattgttatgcgtagagatcaggttctcaaactctgcgctaaccatcgaatcacacctgatatgtccctgcagaatatgaagggcactgagagggtttgggtctggactgcatgcgatttcgctgatggagagcgtaaggtggagcatctcgctgtacgcttcaagctccaggacgtcgcagattccttcaaaaaaatattcgacgaagccaagactgcccaagagaaggacagcttgatcacgccgcacgtatctagatcgagtacaccgcgtgagagtccttgtggaaaaattgccgtggccatacttgaagagacaaccagagagaggacggatgtgattcagggcgacgacgtggctgatgcagcaagcgaagttgaggtgtcaagcacctccgagactactactaaggccgttgtgagcccgcctaaattcgtctttgtttccgagtctgtgaagaggattttttctagcgagaaatctaaaccatttgtcttcggaaacagtagcgccacgggctctctgttcggcttttcttttaatgctccacttaaatcgaataattcagagaccagcagcgttgctcagagcgggagcgagagcaaggtcgagccgaaaaaatgcgagctcagcaagaacagcgacattgaacagagtagtgacagcaaggttaaaaatttgagtgcgtccttcccgactgaggaatctagcatcaactatacgttcaagacaccggagaaagaacctcccttgtggcacgccgagtttacaaaagaagaactggtgcaaaaacttcgtagtacaacaaagtctgccgatcatctgaatggcttactgcgggaaattgaggcgactaacgcagttctcatggagcaaattaagctcctgaagtccgagatcagacgcctggaaagaaaccaggagagggagaagtccgccgctaacttggaatacctgaaaaacgtactcctgcagtttatcttcttaaagccaggatcggagcgagaaagactgctgcctgtgattaacacaatgctccagttgtccccagaggagaagggcaagctcgcagccgttgctcaagacgaggaggaaaatgcaagtaggtcttccgggtag

SEQ ID NO: 202513 - DNA, 2715 bp, Artificial Sequence
  Description of Artificial Sequence: Synthetic coding sequence
atgcggcggagcaaggccgacgtggagcggtacgtggccagcgtgctgggactgaccccctccccaagacagaagtctatgaagggcttctattttgctaaactgtactatgaagccaaagagtatgacctcgccaaaaaatatatctgtacctatattaacgtgcaggagcgagatcccaaggcacatcggtttctgggtttattgtacgaactcgaagaaaacactgaaaaagcagtcgaatgctaccgtagaagtgttgaactaaatcccactcaaaaggacctggtgctgaagatcgcagagcttctgtgcaagaacgatgttacagacggacgagcaaagtattgggtggagcgggctgctaagctcttccccgggagtccggctatctacaaactaaaggaacaacttctcgactgcgaaggggaagacggctggaataagttgtttgacctgatacagtctgagctgtacgtgcgccccgatgacgtccacgtcaacatccgcctagtagagttgtacagaagtactaagcgacttaaggatgcagtagctcactgccacgaggcagagcgaaacattgcactgcgatcatctctcgagtggaactcttgcgtggtgcagacactgaaagagtacttggaatcccttcagtgcctggagtctgacaaaagtgattggcaggccaccaacactgacctcctcttagcgtacgctaacctgatgctgctgaccttgagtaccagagatgtgcaggaaaatcgcgagctgttagagagttttgactccgctctccaaagtgcaaagagttctctcggagggaatgacgaactttctgctactttcctggaaatgaagggacacttctatatgtacgctggctcccttctcctgaagatgggccagcacgggaacaacgtacagtggcgggcgctgtccgagctggctgcactgtgctacctgattgcctttcaggttccccggcccaagattaagctacgagagggcaaagctggtcagaacctgctggagatgatggcctgcgatcggcttagtcagtcgggacacatgctcctctctttgagccgcgggaagcaggatttcctgaaggaggtcgtggagacattcgccaacaaaattggacagtcagcgttatacgatgctctgttctcttctcaatccccaaaggatactagcttcctcgggagcgacgatattgggaaaatcgacgtgcaggaacccgaactcgaagacctagcacgatatgatgttggagctattcgcgcacataacggcagtttacaacacctaacctggttaggattgcagtggaattccctgccagcgctcccagggattcgcaagtggctgaaacaactgttccaccgactgccccacgagacaagtcggttagagactaatgcccccgagtccatatgcatattagacctggaggtttttcttctcggtgttgtgtatactagccacctgcaattaaaggaaaagtgtaatagccaccactcatcctaccagccgctgtgtttaccctttccggtgtgcaaacaactgtgcactgagcgccagaagagctggtgggacgccgtttgtactctcatccaccgcaaggccgtgcccggtaacctcgccaaactgcgcctcctggtccagcacgaaattaacactctgcgtgcccaggagaagcatgggttgcagcctgctctcctcgtgcattgggcaaaatacttgcaaaagaccggatcaggcctgaattcattttacgggcagctggagtacattggccgttcagtgcactactggaaaaaagttctgcccctacttaaaatcattaagaaaaattctatccccgagcctattgatcctctattcaaacattttcactccgtggacatccaggcgagtgaaatcgttgagtacgaggaagacgcccatatcacctttgccatgctggacgcggtgaacggaaatatcgaggacgctgtgacggcttttgaaagcataaagtcagtagttagctactggaacttagccctgatttttcataggaaggctgaagatatcgagaatgacgctttgtccccagaggaacaggaagaatgcagaaattatttgactaaaaccagagattacctaatcaagatcattgatgacggggactctaacctgagcgtcgttaaaaagctgcccgtaccactcgagtccgtgaagcagatgctaaattctgtgatgcaggaattggaagactattccgagggcggcccgttatacaagaacgggagcctgcggaacgcggactctgaaattaagcattcaacgcctagccccaccaagtactctctgagtccctctaaaagctataagtactcacctgaaactcccccaagatggacagaagacaggaactcacttctgaacatgatatgccagcaagtggaggctattaaaaaggaaatgcaagagctgaagcttaacagcagtaagtccgcctcacggcaccggtggcctacagaaaactatgggccggattccgtgcccgatggttaccaagggtcccaaacctttcacggcgctcctcttaccgaagccgctcaccggcactttacgatcgaaaagcatggcgactctaagtggatcatataccgttttaccaaacagctctgcggcaccgaacgagctcgggcaaagatttcctag

SEQ ID NO: 202514 - DNA, 459 bp, Artificial Sequence
  Description of Artificial Sequence: Synthetic coding sequence
atgtggagcggcaccagcccccggtgctgggtgagcccccggcggctcgaccgctacatttgtacctacattaatgtgcaggagagagaccccaaagcccaccgcttcttggggctcctgtatgagcttgaggagaataccgagaaagccgttgaatgctatagacgctctgtagagttaaatcctactcagaaagacctcgtgttgaagatcgccgagctgctgtgcaaaaatgatgtgacagatggaagggcaaagtactgggtagaacgcgcggccaagctgttccccgggtcccccgcaatctacaaactgaaggaacagttgctcgactgcgaaggcgaggacggttggaacaagctgtttgacctgatccaatctgaattgtatgtgaggcccgacgacgtgcatgtgaatatacgactagttgaattatatagatctacaaagcgcctgtag

SEQ ID NO: 202515 - DNA, 2715 bp, Artificial Sequence
  Description of Artificial Sequence: Synthetic coding sequence
atgcggcggagcaaggccgacgtggagcggtacgtggccagcgtgttgggcctcacaccctctcctaggcaaaaatcaatgaagggattttatttcgccaaattatactacgaggcaaaggagtacgaccttgccaagaaatacatctgcacctatattaacgtccaggaacgggatcccaaagcccaccgctttctgggtctactttatgagttagaggagaatacggaaaaggctgtggaatgttacaggcggagtgtcgagttaaaccccacccagaaggacctggtgctgaagatcgccgagctgttgtgcaaaaacgacgttacagacggtagggccaaatactgggtggaaagggcggccaaacttttccccggatcacctgcaatctataaattgaaagagcaattgctggattgtgaaggggaagacggctggaataagctctttgatctcatacagtctgagttatacgtcagaccagacgatgtacatgtcaacatccggttggtcgagctgtacagaagcaccaaacgcctgaaggacgcggtggctcattgtcacgaggccgagcgcaacatagccctaaggagctccttggagtggaactcttgcgtagtgcagactctcaaggaatacttggagagcctgcagtgcctagagtctgacaaatcggactggcaagctactaacacagatctcctgctggcttacgcaaatcttatgttactgacactgtctacacgtgatgttcaggagaaccgcgagctgctggaatcgttcgatagcgcccttcagagtgccaaaagctccctggggggtaacgacgaactgtccgctacatttttagagatgaaaggccatttctatatgtatgctgggagcctgctgctcaaaatgggccaacatgggaataacgtgcagtggcgagcactctctgagttggccgccttgtgctatctgattgcatttcaggtgcccagaccaaagatcaagttgcgggagggaaaagctgggcaaaatctattggagatgatggcatgcgacaggctaagtcagagcggccatatgctcctcagcttgtcccgaggaaagcaagactttttgaaggaagtggtcgaaacattcgctaataagataggacaaagcgctctctacgacgcactgttcagtagccaatccccaaaggatacgagctttctgggcagcgacgacatcgggaagattgatgtgcaggagcctgaattggaggacctcgccagatatgacgttggtgctatccgggctcacaatggcagcctccagcacctgacttggctgggtctgcaatggaacagcctgcccgcccttccagggatacggaaatggttgaagcaactgtttcaccgcctgccacacgaaacatcccggctggagactaacgcacctgagtctatctgtatccttgatctggaagttttcttgctgggcgtggtttacacgtcccacttacaactgaaggaaaagtgcaatagccatcattctagttatcagcctctttgtctcccttttcctgtttgtaagcaactctgcacagagcggcagaagtcttggtgggacgccgtatgcacattgattcatcgtaaggccgttcccggtaatctagcaaaactccgacttctggtccagcacgagattaatacacttagagcccaggagaagcacggcctccagccagccctgctagttcattgggccaaatatctacagaaaacgggctcaggcttaaacagcttctacggccagctggaatatattggtcgttccgtacactactggaaaaaggtgctaccactgctgaagatcatcaagaaaaattccattccagaacctatcgacccattgtttaaacactttcattcagttgacattcaggcttctgagattgtggaatatgaggaggacgctcatatcactttcgcaatgctcgatgctgtgaacgggaacatcgaagacgccgtcactgcattcgagtctattaaatctgtggtttcttactggaatctggcacttatttttcaccgtaaggctgaagacattgaaaacgatgccctgtcacctgaggaacaggaggagtgccgaaactatctgacgaaaacgagggattacttaataaagataattgatgacggcgattctaatctgagtgttgtcaagaaacttccagttcctttggaaagcgtaaaacagatgctgaatagcgtcatgcaggagctcgaagattacagcgaggggggtcccctgtataaaaatgggagcctgagaaatgcggatagtgagatcaaacacagcacaccgtcccccaccaaatatagcctctctcccagcaaaagctataaatacagccccgaaactccgccaagatggacagaagatcgcaattctcttctgaatatgatatgtcagcaggtggaggctattaagaaagaaatgcaggagctgaaactgaacagcagtaagagcgcgagccgtcatagatggccgactgaaaactacgggcctgacagcgtcccagatggctatcaaggttctcagacattccacggcgctccgttgaccgaagcggcccatagacactttaccattgagaagcacggcgacagcaaatggatcatctataggtttacaaaacaactgtgtggcacagagagagcccgtgccaaaatctcttag

SEQ ID NO: 202516 - DNA, 5298 bp, Artificial Sequence
  Description of Artificial Sequence: Synthetic coding sequence
atgcggcggagcaaggccgacgtggagcggtacgtggccagcgtgcttggcctcaccccaagcccaagacagaagtccatgaagggcttttactttgcaaagctgtactatgaggccaaggaatatgatctggctaagaagtacatctgtacgtacatcaacgtgcaggagcgcgaccccaaggcacatcgcttcctcgggctgttatatgagctggaggaaaacaccgaaaaagcagtcgaatgctaccgtcgttccgttgaactgaaccctacacagaaagatcttgtgttgaaaattgcggagctcctctgcaaaaatgacgttactgacggccgtgcgaagtattgggtggagcgggcagccaagctctttccaggtagccctgccatctataaacttaaagaacagcttctcgactgtgagggagaagacggatggaacaagctcttcgaccttattcagtcggagttgtatgtgaggcctgatgatgttcacgtcaatattaggctagtggaactctatcggtctacaaagcgtctaaaggatgctgtagcccattgtcatgaggccgaaaggaatatagccttaagatcgtctttagagtggaattcctgtgtagtgcagaccttaaaggagtaccttgagtcactgcaatgcctggagtcggataaatccgattggcaggctacaaacacagacctcctgcttgcatacgccaacttgatgctccttaccctctccacgagggacgtgcaagaaaatagggaattgctggaatcattcgacagcgctttgcagtccgccaagtctagtttgggcggcaatgatgaactgtccgcaaccttcctggaaatgaaaggtcatttctacatgtacgctggaagccttctgttgaaaatgggtcagcacggcaacaatgtgcaatggcgcgctctgtccgagctcgccgctctgtgttacctgatcgcttttcaggtaccccgacctaagattaaactacgtgagggtaaggccggccaaaatctccttgaaatgatggcgtgcgaccgactctcccaatcagggcacatgctgttatctctaagccgaggtaagcaggatttcctgaaagaagtggttgagactttcgcaaacaagatcggccaatccgccctgtacgatgccttgttttcttcccaatcacccaaggacacatctttcctgggcagcgacgacatcgggaagatagacgttcaggagcctgagctcgaggacctggctcgttacgatgtgggcgcaatcagagcgcataatgggagcctccagcacttgacttggctgggactacagtggaattccctccccgccctcccaggcatccgcaaatggcttaaacaacttttccatagattgccacacgagacatctcgattggagaccaacgcccctgaaagtatatgtattctggacctggaggtgttcttgctcggagtggtctacacctctcacctccagctgaaggaaaagtgcaattcacaccactcttcttatcaacctctgtgtctgcccttcccagtctgcaagcagttatgtacagagcgtcagaagagttggtgggatgccgtgtgtacccttatccatcggaaagccgtgcctggcaacttggccaagctgcgactcctagtgcagcatgagattaataccctgcgcgcacaggagaaacacggtctccagcccgcactcttggtgcactgggccaagtatctgcaaaagaccgggagtggcctgaacagcttttacgggcagctggagtacattggcaggtcagtgcactactggaaaaaagttcttcccttactcaaaattattaaaaagaattccattcctgaacccattgatcctctcttcaaacatttccactccgtagacatccaagcttctgaaatcgtggagtacgaagaggacgcgcatattacgtttgctatgctcgacgcagttaacggcaacatagaggatgccgtgactgcttttgagtctatcaagtccgtggtgtcatactggaacctggccctgatctttcaccgcaaggctgaagatatcgagaacgatgccctgtcacctgaggaacaggaggaatgtcgcaattacctgaccaagacacgggactatctcatcaagattatcgacgatggggattccaacctgtccgtggttaagaaactaccagtgcccctagagtcagtaaaacagatgctcaactccgtgatgcaggaactggaggactatagcgaaggcggaccactgtacaagaatggaagtctccggaatgcggacagcgaaatcaagcatagtactccttctccgacaaagtacagtttgagcccaagcaaaagttacaaatacagtccggaaactccacccaggtggactgaagatcggaactccctgttgaatatgatctgccagcaggtggaagcaattaaaaaggagatgcaggagcttaaactgaactctagtaaatcagcctccagacataggtggccaacggaaaactatgggcctgatagcgttccagatggctaccagggttctcagactttccacggcgcaccactcacagtcgccaccacagggccaagtgtttactattctcagagcccggcctataactcccagtacctgctacggcctgctgccaacgtgacaccaactaaaggctccagcaacacagagttcaagagtactaaagaaggtttttcaattccagtgtcagccgatgggttcaagtttgggatctctgaacctggtaatcaggaaaagaagcgcgaaaaaccactggagaatgacactggctttcaggcacaggatatttccgggcggaaaaaagggcgaggtgtcatctttggccaaactagtagcacgtttacgttcgcagacgtcgctaagtctacctccggtgaaggatttcagtttggtaagaaggatctcaattttaaaggattctctggagctggggagaaactgttcagcagcagatatggtaagatggcaaataaggcaaatacaagtggagattttgaaaaggacgacgacgcttacaaaacggaagactccgacgacatacatttcgagccagtggtacaaatgcccgagaaggttgagcttgtgaccggtgaggaaggggagaaagtgctgtactcccagggcgttaagctcttccgctttgatgccgaggtgaggcagtggaaagaaaggggcctggggaacctaaaaatcctgaagaacgaagtgaatggaaagctaagaatgctcatgcgacgcgagcaggtcctcaaagtttgtgctaaccactggattactacgacaatgaatctcaagcctctaagcggaagtgacagggcctggatgtggtcagcctcagacttctctgacggtgatgctaagctagaacgattagctgcaaaattcaagacccctgaattggctgaggagttcaagcagaagtttgaagaatgtcaaaggttgttactcgatatccccctgcaaaccccacacaagctggtggacactggccgagccgccaaactaattcagcgcgccgaagagatgaagtccgggctcaaagacttcaagacgtttctgacgaacgaccaaaccaaggttacagaagaggagaataagggatctggcacaggagctgcgggagccagtgacacaactattaaaccaaacgccgagaacacaggaccaacgttggaatgggacaactacgatttaagggaggacgctctcgacgattccgtgtccagctctagcgtgcacgcaagtccgctggcgtctagcccagttcggaagaatctgttcaggtttgacgaatcaaccacaggcagtaatttctcctttaaaagtgccctatctctgtccaagagcccggctaagctgaaccagtcaggcacctccgttgggaccgatgaagagtccgttgtaacacaggaggaggagcgcgatggccagtattttgagcctgtcgtccctctccctgacctggtggaggtgtcttctggggaggagaacgaacaggtcgtcttttcccatagggctgagatctaccgctacgacaaggatgtcgggcagtggaaagagcgggggattggagacatcaaaatactccagaattacgacaacaagcaggtccgcatcgtgatgaggcgggaccaggtgttaaaactttgtgccaaccataggattacccccgacatgtcactccagaacatgaaagggactgaaagagtttgggtttggaccgcctgcgatttcgccgatggtgagaggaaggtcgaacatctcgccgttcgattcaaactgcaagatgtagccgatagcttcaagaagattttcgacgaggcaaagaccgcgcaggaaaaagacagcctgataaccccccatgtgtccaggtcgtctactcctcgagaaagcccctgcggcaagattgctgtagctattcttgaggaaactacaagggagagaacagatgtgattcaaggagatgatgtggccgatgctgcatctgaagtggaggttagcagcacctccgagacaacaactaaggctgtggtatccccacccaagttcgtcttcgtctcagaatcggtaaaaagaatcttttcatccgagaaatcaaagccatttgtattcggaaatagctccgccaccggctccttgtttggtttcagctttaacgccccccttaagtctaataactccgaaacgagctctgtggcacaatctggcagtgagtccaaggtcgagcccaaaaagtgcgaattgtccaaaaattcagatatagagcaaagctccgactccaaagtgaagaacctttcagcatctttcccaacagaggagtccagcatcaactatacctttaaaacaccagaaaaggagcctcctctttggcacgccgagtttactaaggaggagcttgtgcagaaacttcgctctacgactaaaagtgctgaccatttgaatgggctgctccgggaaatcgaggccactaacgctgttctgatggagcagatcaagctcttaaagtcagaaataagacggctggagcggaatcaggagagagaaaagagcgccgccaatttggaatatcttaagaatgtgctcctgcagttcatctttctcaaaccaggaagcgaacgggaaagactgctgcccgtcattaacacgatgctgcaacttagcccagaggagaagggtaagttagccgccgtcgctcaagatgaagaggaaaacgccagccgatccagcggttag

SEQ ID NO: 202517 - DNA, 2715 bp, Artificial Sequence
  Description of Artificial Sequence: Synthetic coding sequence
atgcggcggagcaaggccgacgtggagcggtacgtggccagcgtgctgggcttgacccctagtcctcgtcagaagagtatgaaagggttctattttgcaaaattatattacgaagctaaagagtatgacctcgctaaaaaatacatctgcacatatataaacgtgcaggagcgcgatccaaaagctcacaggttccttggtctcctgtacgagcttgaggagaatacagaaaaagccgttgaatgttacagacgttctgtcgagcttaaccctacccagaaggatcttgtactgaagatcgccgagctgctctgcaagaacgacgttaccgatggacgtgcaaagtactgggtggaacgcgctgccaagctgttccccggtagccccgccatctataaacttaaagaacagttgttggactgtgagggggaggatggttggaataagctcttcgatcttatccagtcagagctgtacgtcagacctgacgatgtccacgttaacataagactggtggagttatatcggagcacgaaacgcctgaaggatgctgttgcccactgccacgaggctgaaagaaacattgccctgcgcagttccttagagtggaactcttgcgtggttcagacactgaaagagtaccttgagagtttacagtgcctggaatcagataagagtgattggcaggccaccaataccgacctcctgctggcatatgccaatctgatgttgctgaccctgtcaaccagggacgtgcaggagaatcgggagttgctggaaagtttcgatagcgcactgcagagcgccaaaagcagtcttggaggaaacgacgaattgagtgccactttcttggaaatgaaaggtcatttctatatgtatgcaggcagccttctgctgaagatggggcagcatggtaacaacgtgcagtggcgcgccctatcagagctggctgctctgtgttacctgattgcgttccaagtccctagaccaaagatcaagctgcgggagggaaaggcggggcagaacctccttgaaatgatggcctgcgacagactgtcgcagtccggtcacatgctgttaagcctttcccgaggcaaacaggacttcttgaaagaggtcgttgagacatttgctaacaaaatcgggcagagcgcactctacgatgcccttttttcttcacagtctcctaaggacacatcttttttgggctctgacgatatcggcaagatcgatgtgcaggagcctgaacttgaagatctagcccggtacgacgtaggagctataagggcacataatggttcccttcagcatttgacctggctggggttgcagtggaacagcctgccggccctgccgggaataagaaagtggcttaaacaactcttccatagactcccccacgaaacttcacggttggaaacgaatgccccagagagcatttgtatcttagacctggaagtgtttctgctaggtgttgtgtacacgtcccacctccagcttaaggaaaaatgtaattcacatcacagcagttaccagcctctttgtttaccctttcccgtgtgtaagcagctttgtacagagaggcagaaaagctggtgggacgcggtctgcaccttgatacaccggaaggccgtaccagggaacctggccaaattgcgtttactcgtgcagcacgagatcaatacactgagggcgcaggaaaaacacgggctgcagccagctctgctcgtacactgggccaagtacttgcaaaagaccggttctggcttgaattcgttctacggccagctggaatacatcggtcgatctgtgcactattggaaaaaggtgcttcccctgttgaagattatcaaaaaaaattcgattcccgaaccaatcgacccattattcaaacacttccactcagtggacatccaggcctccgaaatcgttgaatatgaggaggacgcacatatcacattcgcaatgctggacgccgtgaacgggaatattgaagacgctgtgacagcattcgagtctatcaaaagcgtggtgagctactggaatctcgcattgatctttcatagaaaggccgaggacattgagaacgatgctctgtcccctgaggaacaggaggagtgcaggaactacctcaccaagacccgggactatctgatcaaaataatcgatgacggcgatagcaatttaagcgtagtcaaaaagctgcccgtcccgcttgagagcgtgaagcagatgctgaacagtgttatgcaagaactcgaagactatagcgaaggcggccccttatacaaaaatggatccctccgcaacgccgatagtgagatcaaacactctaccccctcaccaacaaagtactccctgagccctagcaagtcttacaagtattcacccgaaactcctccccggtggaccgaagacagaaattcactgcttaatatgatttgccagcaggtggaggcaattaagaaagaaatgcaagagctgaaactgaactcttctaaatcagcctctcgtcaccgctggcctaccgagaattatgggcccgacagtgtgcccgacggttaccaaggttcccagacatttcacggcgcaccactgacagaggccgcccaccgacattttaccatcgagaagcacggagatagtaaatggatcatatataggtttactaagcaactctgcggaactgagcgggcacgggccaaaatctcgtag

SEQ ID NO: 202518 - DNA, 5298 bp, Artificial Sequence
  Description of Artificial Sequence: Synthetic coding sequence
atgcggcggagcaaggccgacgtggagcggtacgtggccagcgtgcttggtctcacgcccagtcctcgccagaaatctatgaagggattttatttcgcaaaactctactacgaagcaaaagagtatgatctagccaaaaagtacatctgtacctatattaacgtccaggagagggatcccaaggcccatcggtttcttggcctgttatacgagctggaagagaacacggagaaggccgtggaatgctacaggcggagcgtcgagctgaacccaactcagaaggacctagtgttgaaaatcgccgaactcctgtgtaaaaatgacgttaccgatggacgcgccaagtactgggtggaacgcgctgccaagttatttcccggttcccctgctatttacaagctaaaggagcagttactggactgcgagggggaagacggctggaataagctgtttgatttaattcagtccgaactttatgtgagaccggatgacgttcacgtgaacatccgtctggtcgaattgtatcgctcaactaaaagacttaaggatgcggtcgcacactgtcacgaagcagaacgaaacatcgctttacggtcctctctggaatggaacagttgcgtggtgcaaacactgaaggaatatctcgaaagtctccagtgccttgagagtgataaatccgactggagagcaactaatacagatctgctgctagcctacgccaatcttatgctattgacgctgagcacccgagacgtgcaggagaacagagaattactggagagcttcgacagcgccttacagagcgctaaaagcagcctgggggggaacgacgaactttcggctacattcttggagatgaagggtcacttttatatgtacgctgggtccttgctactgaagatgggtcagcacggtaacaatgtgcaatggagggcactgagcgaactagcagcactgtgttatctcatagcatttcaggtgccaagacccaaaatcaagttgcgagaaggtaaggctggccagaatttgcttgaaatgatggcttgtgacagattgtctcagagcgggcatatgttgctgtcactcagccgaggtaagcaggactttctgaaagaggtggtggagaccttcgcaaataagatagggcagtcagcactttacgacgctctgttttcttcccaatccccaaaggatacctcatttctgggatctgacgatatcgggaagatcgacgtccaagagcccgaattggaagacctcgcaaggtacgatgtgggggcaattcgggcgcacaatggctccctacagcacctgacatggcttgggctccaatggaattccctccctgcactgcctggcatccgcaagtggctcaagcagctgttccatcgcttaccacacgagactagcaggctggaaacaaacgcccccgaatcaatttgcatcttagatctcgaggtctttctcctgggcgtagtgtacaccagtcatctacagttaaaggaaaaatgtaatagccaccacagcagctaccagcctctgtgtttacctttccccgtgtgtaagcagctctgtactgagcgccagaaatcctggtgggacgcagtctgcactctgatccatcgcaaggcagtacccggtaatctggccaagctccgattgttggtgcagcatgagatcaacaccctcagggcccaggagaagcatgggttacagcccgctcttctggtgcactgggccaaatacttgcagaaaactggaagtgggttgaattctttctacgggcagcttgagtacatcggacgctctgttcactactggaagaaagtgctgccactgttgaaaattattaagaagaattccatacccgaaccgatcgaccctctcttcaaacattttcactccgttgacattcaggcatcagagatagtcgagtatgaggaagatgcacatatcacattcgcgatcctggacgcggtaaacggcaacatcgaagatgccgttacggcattcgagtccataaagtctgtggtttcgtactggaatctggccctgatctttcaccgcaaggctgaggacattgagaacgacgcactgtcaccagaagaacaagaggaatgccgaaactatttgactaaaacccgcgattaccttattaagattatagacgatggagactctaacctgtccgtggtcaaaaagttgcctgtcccactggagagtgttaagcagatgctcaacagcgtgatgcaggagcttgaggattactccgagggcggccccctgtataaaaacggctctctcaggaacgctgactctgaaattaagcacagtacaccatctccaacaaagtattctctgagcccctcaaaatcctataaatattcaccagagacccctcctcgttggacggaggacaggaacagtctgctgaatatgatttgccagcaggtggaggctattaaaaaggagatgcaggagttaaaactcaatagcagcaagagcgcatcccgacaccggtggcctacagaaaactatgggcctgattccgtgcccgacggttatcagggcagccagacttttcatggcgcgcctttgactgttgctactacaggtcctagcgtctactattcccagtcaccggcttacaattcccagtacctactgagacccgctgcaaacgtaaccccaaccaagggtagttccaatacagagttcaagagtacaaaggagggcttttcgatccccgtgtcagccgacggttttaaatttggcatttcagagcccgggaaccaggagaagaaacgggagaagcccctagagaatgacaccggacttcaggcccaggacatacgagggaggaaaaagggcagaggggtaatctttgggcagacaagtagtacgtttaccttcgccgacgtagccaaatccactagcggtgagggcttccagtttgggaaaaaagatctgaatttcaaggggttcagcggcgcgggtgagaaactcttctcatcacgctatggcaaaatggcgaacaaggctaacacaagtggggatttcgaaaaggacgacgatgcgtacaagactgaggacagtgacgatattcattttgagcccgtggtccagatgcccgagaaggtcgagctggtcaccggcgaggaaggcgagaaggtgctctatagccagggtgtgaagctctttcggttcgatgccgaggtgagacagtggaaggaacgcggactgggtaacctgaagattctgaaaaatgaggtgaacggtaaactccggatgcttatgaggagagagcaggtactcaaagtctgcgccaaccattggataaccaccactatgaatctgaaacccctgagcgggagcgaccgagcgtggatgtggagtgcaagtgacttttcagatggggacgccaagctcgagagactggccgctaagttcaagacacccgaactggccgaagaattcaaacagaagttcgaagagtgtcagcggttactgctggacattcccttgcaaactcctcataaattggtggataccgggcgtgccgcaaaactaatacagcgagcggaagaaatgaagagcgggctgaaggacttcaagacatttttgaccaacgaccagacaaaagtcacagaggaggaaaataaaggatcgggaactggtgtagctggagcctctgacacaacgatcaaacccaacgctgagaataccggtcccactttggagtgggataactatgacctgcgtgaagacgcactcgacgacagcgtttccagtagctcagtgcacgctagtcccctggcgtcctcccccgtccgcaagaacttgtttaggttcgatgaaagcaccacgggtagcaattttagcttcaagtcagcactaagtctctctaaaagccccgctaagctgaaccagagcgggacctctgtggggacggacgaggagtcggttgtgacgcaggaagaggagcgcgacggccagtacttcgaaccagttgtacctcttccggaccttgtggaggtgagcagcggcgaagaaaatgaacaggttgttttcagccatagagccgagatctatcggtatgataaggacgtgggacagtggaaagagaggggcatcggagacataaagattctgcagaactacgacaataagcaggtcagaattgtgatgcgcagagatcaagtgttaaaactgtgtgctaaccataggattacccccgacatgtccctgcagaacatgaaagggacggagagggtctgggtctggaccgcctgcgacttcgcggatggagagcgtaaggtggagcacctcgctgtccggttcaaacttcaggatgtggcagatagctttaagaaaatatttgatgaagccaaaaccgcccaggagaaggacagtctgatcactcctcatgtatcaaggtcctccacacccagagaaagtccttgtggcaaaattgcggtggccgtgctggaggaaataacgcgtgaaagaactgacgtgattcagggggacgatgtagcggacgccgcatcagaagtggaagtgagttcaacgagcgaaaccaccaccaaggcggtggtgagtccaccgaaatttgtctttgtctcagagagtgtcaagaggatattctcttctgagaagtcgaaacctttcgctttcggcaacagtagcgcgacaggatctctgttcggcttctcctttaacgcccctctaaagagcaataattcggagacatcaagcgtggcgcagagcggctcagaatctaaagtcgagccaaagaagtgcgaactgtctaagaatagcgatattgagcaatcttctgattcaaaggtgaagaacttgtcggcttccttcccaacggaagaatcatcaattaactacacttttaaaacacccgagaaagaaccacctctctggcacgccgagttcactaaagaagaactggtccagaaactgcgctcaactacgaaatctgctgatcacctcaatggcctcctaagagagatcgaggccactaacgccgtcttgatggaacagatcaagctccttaagagcgaaatacgccgcctcgagaggaaccaagagcgtgaaaagagcgctgccaacctggagtaccttaagaacgtgttgttgcagttcattttcctcaaacctggaagcgaaagagagcgactcctccctgtgatcaacaccatgctgcagctgagccccgaggagaaaggcaagttagccgccgtggcccaggatgaggaggaaaatccatcccgcagcagcggatag

SEQ ID NO: 202519 - DNA, 1407 bp, Artificial Sequence
  Description of Artificial Sequence: Synthetic coding sequence
atgggcaccgccacccccgacggccgggaggaccaggagcggctgtgggtgagcgtcgaagatgcgcagatgcataccgttactatatggctgaccgtacgcccagacatgaccgttgccagcctgaaggatatggtcttcctggattatggtttccccccggtgttgcagcagtgggtcatcggtcaacggcttgccagagatcaggaaacactgcactctcacggcgttcggcaaaacggcgattccgcctatctctacctcctttctgctcgaaacacatcactgaacccccaggagttgcagagggaacgtcagctgcgcatgctcgaggatctggggttcaaggacttgacactgcagccccgcgggcccctggagcctggaccgcccaagccaggcgtcccccaagagccaggacggggccagcccgacgcagtccctgagccgccacctgtcggatggcagtgccccggttgcaccttcattaacaaacccacaagaccaggttgtgaaatgtgctgtcgagctcgacctgaagcgtaccaggtccctgctagctaccagccggatgaagaggagcgagcacggctcgccggcgaagaagaggcactgaggcagtaccagcaaaggaaacagcagcaacaggaaggcaattaccttcagcatgtccagctagaccaacgctccctggtgctgaacacggaacccgcggagtgtcctgtgtgctattccgttcttgccccaggggaagccgttgtcttgcgcgaatgtctccacactttctgccgtgagtgcctccaagggactattcggaatagccaggaagcagaagtatcatgcccatttatcgacaacacctatagctgcagtggaaagctgctcgaaagagagatcaaagccctgttgacccctgaagactatcagcgctttttggatctcggtatctccatcgcagaaaacaggagcgctttttcataccactgtaaaacaccagactgcaagggctggtgtttttttgaggatgatgtaaatgaattcacatgccctgtgtgttttcacgtgaactgtctgctgtgtaaggctatacatgaacagatgaactgtaaggaatatcaagaggacctggccttacgcgctcagaacgatgtggctgcccgacagacaaccgaaatgcttaaggtgatgcttcagcagggagaggcaatgagatgcccgcagtgtcagattgtcgtgcagaaaaaggatggatgcgactggattagatgcacagtgtgtcacactgaaatttgttgggttaccaaaggaccacggtgggggcctggcggcccaggcgacacctctggcggatgtagatgtagggtgaacggaattccttgccacccatcctgtcagaactgtcactag

SEQ ID NO: 202520 - DNA, 1533 bp, Artificial Sequence
  Description of Artificial Sequence: Synthetic coding sequence
atggacgagaagaccaagaaggccgaggagatggccctgagcctgaccagggcagtggccgggggcgatgagcaggttgccatgaaatgcgcaatctggctggccgaacagcgcgtgccattgagcgtccagttgaagcctgaagtatcccctacccaggatataagactgtgggtctcagtcgaggatgcccagatgcacactgtcactatatggctgaccgtgcggcccgacatgacagtggccagcctgaaggacatggttttcttggattatggttttcctcccgtgcttcagcaatgggtcatcggacaacggctggcgagggaccaagagacccttcacagccatggagtcaggcaaaacggagatagcgcttatctctatctgttgtccgcacgtaatacatcactgaatccccaggagctccaacgcgagcggcaattgcgtatgctagaggacctggggtttaaggacctaactctgcagccacgaggaccactggagccaggtccacctaaaccaggggtaccacaggagcctggacgtggccagcctgatgctgtacctgagcctccaccagtcggttggcagtgcccaggttgtactttcataaataagccaacgagacccggatgtgaaatgtgttgccgcgcccggccagaagcttatcaggtgcctgcctcttatcagccagatgaggaggaacgtgccaggcttgcaggtgaagaggaagctttaaggcaataccaacagcgaaaacaacagcaacaggagggaaattacctgcaacatgtgcaattggatcaacgctctctggttctgaatactgaaccggctgagtgtcccgtttgttatagtgtattggcccccggtgaggccgttgtcctgagagagtgcttgcatacattttgccgcgagtgtctgcaagggactattcggaactcacaggaggcggaggtgagttgtcccttcatcgacaacacatacagttgtagcggcaagctgcttgagagggagataaaagcgcttctgacaccagaggattaccagcggttcctggacctgggtatatccatcgccgaaaatagaagcgcattttcctaccattgcaagacccccgattgcaaaggctggtgcttcttcgaagacgatgtgaacgaattcacttgtcccgtgtgctttcacgtcaactgtcttctttgtaaagctattcacgagcaaatgaactgtaaggaatatcaggaagacctggcacttcgcgcccaaaacgatgtggcagccagacagactacagagatgctgaaagttatgctccaacaaggggaggctatgcgctgcccccagtgccagattgtggttcagaagaaagatggatgtgactggataaggtgtactgtgtgtcacacagagatatgttgggttacgaagggcccacgctggggccctggcggtccaggggacacatcgggggggtgtaggtgtcgagtcaatggtataccctgccacccatcatgtcagaactgccactag

SEQ ID NO: 202521 - DNA, 1011 bp, Artificial Sequence
  Description of Artificial Sequence: Synthetic coding sequence
atggacgagaagaccaagaaggccgaggagatggccctgagcctgacacgagctgtcgctggcggggacgagcaggtggccatgaaatgtgcaatctggcttgccgagcagcgcgtgcctctgagcgttcagctgaagcccgaagtctcccctacacaggatattagactgtgggtgagtgtggaagatgcccagatgcacaccgtgactatatggctgacggttcgccccgacatgactgtggcctccctgaaagatatggtctttctagactatggattcccgcctgttcttcaacagtgggtaattggacagagattagccagagatcaagaaacgctccactcacatggcgtgcggcagaatggagactccgcttacctctatctcctgagcgcgcgtaacacttccctgaatcctcaggagctgcagcgggagcgacagctcagaatgctcgaggacctgggattcaaggacttgaccctgcagccgaggggtcctctggaacccggcccccccaagcccggggtgccacaggagcctgggagaggacaacctgatgctgtccctgagccaccaccggttggctggcagtgccccggatgtacattcattaataaaccaacacgtcccggatgcgaaatgtgctgccgggctaggcccgaagcctatcaagtgccggctagttaccagcccgacgaggaggagcgggcacgtcttgccggtgaagaggaggccctccgccagtatcagcagcgcaagcaacaacagcaggaagggaactacctccagcatgttcagctggaccagaggtctttagtgctgaacactgaacctgccgaatgtcctgtatgctattccgtcctggcccccggagaagccgtcgtgcttcgtagtgcttgtagggctccttccgctactgcacgcagacgcagaagcccagcaccaagtctcactacaccgacccgcgccagggcaagttgttggcgcgggcgctcccgcagaagctag

SEQ ID NO: 202522 - DNA, 792 bp, Artificial Sequence
  Description of Artificial Sequence: Synthetic coding sequence
atggacgagaagaccaagaaggccgaggagatggccctgagcctgaccagggccgtggccggcggcgacgaacaggtggccatgaagtgcgcaatatggcttgctgagcaacgcgtgcctttgtcagtgcagcttaagcccgaagtgtctcccacccaggacataaggagcaggggcgaaaagaccgaagaggtcggtgaagtgagagaggtacctgaccatggaggtcctcgtgtattgcccagagtggacagtaagtcctctgtagagccattggaaggcccaaactggttgtgggtcagcgtggaagacgcacagatgcatacggtcacaatatggctgacagtgaggcccgacatgactgttgcttcccttaaggatatggtcttcctggactatgggttccccccggtccttcaacagtgggttattggccaaagactcgcgagagatcaagaaaccttgcattcacatggcgtacgtcagaacggcgatagtgcctatctttacctcctgtctgctcgtaacacctcactcaacccacaggagcttcagcgagaacggcagttgcggatgctggaggaccttggctttaaggacctgacactgcagcccagaggacctctggagccgggtcctccgaagcctggcgtgccccaggagcccgggcgggggcagcctgatgccgtgcctgaacccccacccgtggggtggcaatgcccaggctgcacctttatcaataagcctactcgccccgggtgtgagatgtgctgtcgcgccagacctgagtag

SEQ ID NO: 202523 - DNA, 819 bp, Artificial Sequence
  Description of Artificial Sequence: Synthetic coding sequence
atggacgagaagaccaagaaggccgaggagatggccctgagcctgacccgcgcagtcgcaggaggtgacgagcaggtggccatgaaatgtgcaatttggttagccgaacagagggtgcccctctcagtccaactaaagcctgaggtgtcgcctacacaggatatccgcctctgggtgtcagtggaggacgcgcagatgcacactgttacgatctggctgacggtgcggccggacatgaccgtggcttccttgaaggacatggtttttctcgactacggctttccgccagtactccagcagtgggtgatcggccagcggctggcccgagatcaggaaaccctgcactcacacggcgtgagacagaacggcgatagtgcatatctctatctgctgtctgcgaggaatacctcactcaacccccaggaactccaaagggaaagacagttgcgaatgctagaagacctgggctttaaggatctcactctgcagccccggggcccgttggaacccgggccaccaaaaccgggcgtgcctcaggaacctgggagaggtcaaccggacgccgtacctgaacctcctcctgtcggctggcagtgccccggttgtacattcatcaacaaacccaccaggcccggctgcgaaatgtgttgccgtgccaggcccgaggcttaccaggttcctgcctcgtaccagcctgatgaggaagagcgggcccgcttagcaggagaagaagaggctctgcggcagtatcagcagggggtcccagccggacatcacccacaacagcctggcggcggcgggctccttccattgcactag

SEQ ID NO: 202524 - DNA, 354 bp, Artificial Sequence
  Description of Artificial Sequence: Synthetic coding sequence
atggacgagaagaccaagaaggccgaggagatggccctgagcctgacaagagctgtggctggaggcgatgagcaagtagcaatgaagtgtgccatctggctggcggagcagcgggtacccctgtcagtacagctcaagcctgaagtaagccccactcaggatattcgcctctgggtgagcgtggaggacgctcaaatgcacaccgtgacaatctggctcactgtgcgccctgatatgacagtggcttccctgaaggatatggtgttcctggactatggctttccccctgtgctgcagcagtgggtaataggccagagactcgcacgggatcaggagacacttcattcccattag

SEQ ID NO: 202525 - DNA, 768 bp, Artificial Sequence
  Description of Artificial Sequence: Synthetic coding sequence
tgagagatggccctgagcctgacccgggccgtggccggcggcgacgagcaggtggcgatgaagtgcgccatctggctcgcggaacagagagtgccccttagcgtacagctgaaaccagaagtgtccccgacacaggacattagaagccggggcgagaaaactgaagaagtcggtgaggtgcgcgaagttccggaccatgggggcccacgggtgctacctagagtggatagcaagtcctctgtggagccgctcgaggggcccaactggctttgggtttccgttgaagacgcccagatgcataccgtcacaatctggctcaccgtgcggccggatatgacggtcgcatcactgaaggatatggtgtttctcgattacggttttcccccagttctccaacagtgggtcattgggcaacgcctcgccagggaccaggagacactgcattcccacggtgtgagacagaatggggatagcgcgtacctttatttactcagcgctcgcaatacatctctaaatccccaagagctccagcgggagcgccagcttcgaatgcttgaggatcttggctttaaagatctgacccttcagccccgcgggcctttagagcccggcccccctaaacccggagtcccacaggagcccggtagggggcaacccgatgccgtgcccgaaccaccgcccgtgggttggcagtgtcccggatgtactttcattaacaagcccactcgccctgggtgcgaaatgtgctgcagagctagacctgagtag

SEQ ID NO: 202526 - DNA, 819 bp, Artificial Sequence
  Description of Artificial Sequence: Synthetic coding sequence
atggacgagaagaccaagaaggccgaggagatggccctgagcctgacacgcgccgtggcagggggagatgaacaggtcgccatgaagtgcgcgatttggctagcggagcagagggtccccctgtccgtgcagctgaagcccgaagtgagccctacccaggacatcaggttgtgggtgtcagtagaggatgcacaaatgcacactgtgacaatatggctgacagtgaggcccgatatgaccgtcgcttcattgaaagatatggttttcctggactacggatttccgccagtattgcagcaatgggtgatcggccagcggctagcccgcgaccaggagaccttgcatagccacggcgtgcgtcagaacggcgatagcgcttatttgtatcttctaagcgcccgaaacacctcgttgaacccccaggagctccaacgagaaaggcagctgagaatgcttgaagatctgggatttaaagacttgacactccagccgcggggccctttagagcctggtccccccaagccgggggtaccccaggagccaggccgcgggcaaccagatgctgtacctgagccaccaccagtaggatggcagtgtcctggctgcactttcattaataaacctacaagaccaggatgcgagatgtgctgtcgggcaagacccgaagcctatcaagtgcccgcctcctaccagcccgacgaggaggagcgtgctagactggctggggaggaagaggccctccgccagtatcagcagggggtgcctgctgggcaccatcctcagcagcccggcgggggcggacttttgccactgcactag

SEQ ID NO: 202527 - DNA, 4830 bp, Artificial Sequence
  Description of Artificial Sequence: Synthetic coding sequence
atgaacagccccgtggaccccggcgcccggcaggccctgcggaagaaacctccagagagaactcccgaagatctgaataccatttattcctacctgcatgggatggagatcctgtcgaatctcagagaacaccagctaagactgatgagcgcccgggccaggtatgaacgatatagcgggaatcaggtgcttttttgttccgagaccatagctcgctgctggtacatattgttgagcggaagcgtgttagtgaagggctccatggttcttcctccgtgctctttcggaaagcagtttggcggtaaacgaggatgcgactgtctagtgctggagccttctgaaatgattgtggtcgagaatgccaaggataacgaagactcgatcctgcagagggagattcctgcccgtcagagcagacggagatttagaaagattaactataagggcgagaggcaaacgattaccgacgatgttgaggtcaactcctacctatcactacctgccgatctcacaaagatgcacctcacagagaatccacacccccaagtcactcatgtctccagttcccagagcgggtgcagcatcgcttccgatagcgggtctagctccctatctgatatttaccaggcgacagaatctgaggtaggagacgtggacttgactcgactgccagagggtcccgtggatagcgaagacgacgaggaggaggatgaggagatcgaccgtactgaccccctacagggaagggatctcgttcgggaatgtttggaaaaggagccagccgacaagaccgatgatgacatagagcagctcctcgagtttatgcatcaattacctgccttcgcaaatatgaccatgtctgttagaagagagctttgttccgtcatgattttcgaggtggtcgagcaggctggggccatcatcctcgaggatggccaagaactggactcatggtacgtgatcctcaacggtactgtagagatctcccaccctgatggtaaagttgaaaatctgtttatgggcaattcatttggcattaccccaaccctggataaacagtacatgcatggcatcgtgcggacaaaagtggatgactgccagttcgtctgtatcgcccagcaggactactggcgaatcctcaatcatgtcgaaaaaaacacacataaggtggaagaagagggtgaaatagttatggtgcatgagcatcgcgaactcgaccgcagcgggactcggaagggacatatcgtgatcaaagccacccccgagcgactcatcatgcacctgatcgaggagcacagcatcgtggatccaacgtacatcgaggattttttgctgacctatcggacatttctcgaaagtcccttagatgttggtatcaagctgctagaatggttcaagatcgattccttaagggacaaggtgactcggatcgttcttttgtgggtcaataaccatttcaacgatttcgaaggggaccctgccatgacccgctttctggaggagttcgaaaaaaacctggaggatacaaaaatgaacggacatctgaggctgctgaatattgcctgcgctgccaaagcaaagtggagacaggtcgtgctgcagaaggcttcgcgcgaatcacccctccagttctcattaaacggagggagtgagaaaggcttcggcattttcgtagagggggtggagcctggttccaaggcagccgatagcggcctaaagaggggggaccaaattatggaagtaaacggccagaattttgagaatattacatttatgaaggccgtggaaatcttgcgaaacaacacccacttagctctgacagtgaaaacaaacatctttgtattcaaggagttactgtttagaacagagcaggagaaatccggcgtgccgcacattccgaagattgctgaaaagaagtctaatcgccactcaattcaacatgtccctggggacattgagcagacgtcccaggagaaaggaagcaagaaggtgaaagcaaacaccgtcagtggagggaggaacaagattagaaaaattttagataagacacgcttttctatcctgccacccaagttgttcagcgatggcggactgagtcaatctcaagacgattcaatcgtaggcacccggcactgcaggcatagtttggctattatgcctatacccggcaccctatccagctcatcccccgacctgctgcagccaactaccagcatgctagatttttcgaatcccagtgatatccccgaccaggtgattagggtttttaaagtcgaccagcagtcatgctatatcattatcagtaaggatacaaccgctaaagaagttgtgtttcacgccgtgcacgagttcggtctaaccggagccagcgacacttattctttgtgcgaggtgagtgttacccccgagggcgtgattaaacaacgccgactccccgaccagttctcgaaactggcggaccgcatacagttaaatggccggtattacctcaagaataatatggagactgagaccctctgcagtgacgaagacgcccaggagctggtcaaggagagccagctatcaatgctgcagctctctacgatagaggtagccacccagctgagcatgagagattttgacctgttccggaacatcgaacccacagaatacattgatgatctgtttaagttaaattccaagaccggaaacacccaccttaagagattcgaagacatcgtcaatcaggaaaccttctgggtcgctagcgaaattctgactgaggccaatcaactgaaacgtatgaagatcataaagcatttcattaagatcgctctccactgcagagagtgcaaaaacttcaactccatgttcgctattatctccggtctgaacctcgccagcgtggcccgattgagaggaacttgggagaagctgccctcaaagtacgagaagcacctgcaggatttacaagatattttcgacccctcgaggaatatggcaaagtatcgtaacattctgtcaagccaaagtatgcagccccccatcatcccgctgttccccgtcgttaaaaaggatatgacctttctgcacgaaggcaacgactctaaggttgatgggttagtcaattttgaaaagctgagaatgattagtaaggagatacgacaagttgtgcggatgacctccgcaaatatggacccagctatgatgttcagacagcgcaagaagaggtggaggagcctcggtagcctttcccaaggatccacaaacagtaacatgctggatgtacaaggcggtgcccacaagaagagggcgcgccggtccagccttctgaatgccaaaaaactgtatgaggatgcccagatggcccgaaaggtgaaacaatacctaagctctctggatgtggaaaccgatgaggaaaaatttcagatgatgagtcttcaatgggaaccagcgtacggaacactaacaaaaaacctgagcgaaaagcggtcggctaaaagctctgagatgtcacccgtgcccatgcggagtgccgggcagaccactaaagcgcacctacatcaaccccatcgagtgtcgcaggtgctccaagttcctgcagttaacctgcaccccatccggaagaaaggccagactaaagaccccgccctgaatacctctctgccccagaaagtcctaggcactaccgaggagataagtggtaaaaagcacaccgaggacacgatttcggtggccagctccctgcactcaagccccccagcatcgccacaaggttctccccataaagggtacaccttgatccctagcgcaaagtctgacaatctgtctgacagttctcatagcgagataagctccaggtcgtcaatcgtgagcaactgcagcgtagactcgatgtctgctgccttgcaagacgagcgatgctcctcgcaagccttagctgtaccggagagcaccggcgccctggagaagaccgagcacgcttctgggataggcgatcattctcaacacggccccggttggacgttgctcaaaccatccttgattaagtgcctggctgttagttcatcggtttccaacgaggagattagtcaggagcacatcattatagaagccgctgactcgggtcggggcagttggactagctgttcttcatcctcacacgataatttccaatccttgccaaatccgaagagttgggatttcctgaatagctaccgccatactcacctcgatgaccccatcgccgaggtggagccaacggactccgagccctatagctgttctaagtcctgtagtcggacctgtgggcagtgcaaaggttccttggaaagaaagtcatggacttctagctcaagcctctctgatacatacgagcctaactatgggactgtgaaacaaagagtcctcgaatcaacacccgcagagtcgtccgaggggctcgaccctaaggacgcgaccgatcccgtatataagactgtgacgtcttctaccgagaaggggctgatcgtgtactgcgtcacctccccgaagaaagacgatagataccgagaacctccgccgacacccccgggctatcttggtatcagcctggccgatctaaaagagggtccccatacgcacctgaaaccccctgattactctgtggcagtgcagagatccaaaatgatgcataactctttatcccgcctcccaccggcctctctctcatcgaaccttgtcgcgtgtgtgccttccaaaatcgttacacagcctcagaggcacaatttacagccatttcatcctaagcttggtgacgtcaccgatgccgatagcgaggcagatgagaacgagcaagtctcggctgtttag

SEQ ID NO: 202528 - DNA, 4530 bp, Artificial Sequence
  Description of Artificial Sequence: Synthetic coding sequence
atgaacagccccgtggaccccggcgcccggcaggccctgcggaagaagccaccagagagaacacctgaagacctcaacactatttattcttatctgcatggcatggagatcttatctaacttgcgtgaacatcagcttcggctgatgtcggcccgcgctaggtacgaaaggtactccggtaatcaggtccttttctgctctgaaacaatagcaagatgttggtacattttactgtccggttccgtgctcgtgaagggttctatggtgcttcccccatgctcgttcggcaagcagttcggggggaagcggggatgcgactgcctggttctcgagcctagcgagatgatcgtggttgaaaacgcgaaagataacgaggactctatccttcagagggagatcccagctaggcaaagtaggaggaggtttagaaagattaactacaagggcgagagacaaactatcacagacgatgtggaggtgaacagctatctcagccttccagccgatctgaccaaaatgcatctgaccgaaaatccgcaccctcaagtcacccacgtttcaagctcacaatctggatgctccatagcgtccgattctggctcttcaagcctatcagacatttatcaagcaacagagtccgaggtcggtgacgttgacctgactagactgccggaaggaccagtggattctgaggatgatgaagaagaggacgaggagattgatcgcacagatcctctacagggcagagatctggtgcgcgagtgtctggaaaaggagccggccgacaaaactgatgatgatatcgagcaattactcgaatttatgcaccagctgcccgcattcgccaatatgaccatgagcgtgaggcgtgagctttgtagcgtgatgatatttgaggtggttgagcaggccggcgccattattttggaggacggccaggaactggattcatggtatgtgattctgaacgggacagtggaaatttctcatcccgatggcaaagttgagaatctgtttatggggaactcctttggcataacacctactctggataaacagtacatgcatggtattgtacgtaccaaggtggacgattgccagttcgtttgcatcgcccaacaggattactggaggatactgaatcatgtggaaaaaaacacacacaaggtagaggaagagggtgagatcgtcatggtacatgagcatcgggaattagaccggtcgggtaccaggaagggacacatcgtgattaaggccacacccgagcgcctgatcatgcatttaattgaggaacacagcattgtcgacccaacctatatagaggacttcctgctaacatacaggacattcttggagtctccactggatgtggggatcaaattactcgaatggttcaagattgacagcctcagggacaaggtgacgcgaatcgtgttattatgggtgaacaatcattttaacgacttcgagggggacccggccatgacacggtttcttgaagaattcgagaagaatctggaggacacgaagatgaatggtcatctacgacttctgaatatagcttgcgcggcaaaagccaaatggcgccaggtggtcctgcaaaaggcgtccagggagagtcctctgcagttcagcctgaacgggggcagcgaaaaaggctttgggatcttcgttgagggagtggagcccggtagcaaagctgccgactccggactgaagcggggagaccaaattatggaagtcaacgggcaaaatttcgaaaatatcacctttatgaaggccgtcgagatactccggaataacacccatctggccctgaccgtgaagaccaacattttcgttttcaaggagctgctgttccgaactgagcaggaaaagagcggagttcctcatatcccaaaaatcgccgaaaaaaagagcaatcgtcatagtatacagcatgtcccaggtgacatcgaacagacaagccaagagaaaggcagtaaaaaagtgaaagcaaacaccgtgtcagggggtcgcaacaaaatcagaaaaattttggataaaacacgttttagcatcttgcccccgaaattattttctgatgggggcctgtcacagagccaagatgatagcattgtgggtacgagacactgcaggcattccttagcaataatgccgatcccaggtacgctgtcatctagcagccccgacctgttacaacccactactagtatgctggatttctctaatccctcagcggttggcttctattacatccccgaccaagtgataagagtgttcaaagtggatcagcaaagctgctatattataataagcaaagatactaccgcaaaggaagttgtgtttcacgccgtccacgagttcggtctgaccggtgcctcagatacttactcattgtgtgaagtatctgtcacgcccgagggcgtgatcaagcaacgccgattgccagatcagttcagtaagttggctgatcgcattcagctgaacggaaggtattaccttaagaacaatatggagacggagactttatgtagcgatgaagacgcgcaggagctggtcaaggagtcccaactcagtatgctccagttgtccacaatcgaagtggccacacagcttagcatgagagactttgatctgtttcggaacatcgagccaacagaatacatcgacgacctgttcaagttgaactccaaaaccggcaatacgcatctcaaaagattcgaggatatagtcaaccaggagaccttctgggtggcatctgagatactcaccgaagccaaccagcttaagcgcatgaaaattataaagcatttcatcaaaattgcgttacattgccgggaatgtaagaacttcaacagcatgttcgccatcatctcaggcttgaacctggcctctgtcgcaaggttgcgcggtacctgggagaagctgcccagcaagtatgagaagcaccttcaggatttacaagacattttcgatccatcccggaacatggccaagtacaggaacatcctgtcttcacagtcaatgcagccacctatcatccctttatttcccgtggtgaagaaagatatgacctttctgcacgagggaaatgatagtaaggtcgatggtctggtcaattttgagaaacttaggatgatcagcaaagaaatccggcaggtggtgagaatgacctctgccaatatggaccccgcaatgatgtttagacagagaaagaagcggtggcgtagcctgggcagcttgtctcagggaagcactaatagtaacatgctggatgtgcaaggaggggcgcacaaaaagagagccagacggtcatctttgctgaatgccaaaaagctttatgaggacgcgcagatggcccgcaaggtgaagcagtatctgtccagccttgacgtggaaacagatgaggagaaatttcagatgatgtctctgcaatgggagccagcatacggtacgttgaccaaaaacctttccgagaaacgatccgccaaaagctcagaaatgtccccagtaccgatgaggagtgctggccagaccaccaaggctcacctccatcagccccacagggtctctcaagtgctgcaggttcccgccgtcaatctgcatcccatcaggaagaaaggccagactaaagaccccgcactgaatacctccctgccccaaaaggtgctcggaacgaccgaggaaatctcaggaaagaaacacactgaggataccattagtgtagcctccagtttgcatagcagcccccctgcgtcgccacagggatctccgcataaaggctataccctgatcccatcggccaagtccgacaatctatctgattcaagccactctgaaatttcttctaggtcctccatcgtgagcaattgcagcgttgattcaatgtcagcagccttacaggatgagaggtgctcctcgcaagccctcgctgttcccgaaagtaccggggccttggagaagactgaacatgccagcggaataggagatcactcacagcatggaccaggatggacactgctgaaaccgagtctgattaagtgcttagctgtcagctctagcgtgtcgaatgaagaaatttctcaggaacatatcattatcgaggccgcggattcaggaagaggatcgtggactagctgcagttccagctctcacgataatttccagtccttgccgaatccgaaatcatgggattttctgaactcctatcgccacactcacctcgatgatccgatcgcagaggtggagccgacagattccgaaccctatagctgtagcaaatcctgcagtcgcacctgcggacagtgcaagggaagccttgagagaaagagctggacatccagttcatctctgtcagatacatacgaacctaactatgggactgtaaagcagcgcgtgctggaatccactcctgccgaatcaagtgagggacttgacccaaaggatgctaccgatccagtctacaaaaccgttacatcaagtactgagaaaggcctcattgagaacgaacaggtaagcgctgtctag

SEQ ID NO: 202529 - DNA, 4530 bp, Artificial Sequence
  Description of Artificial Sequence: Synthetic coding sequence
atgaacagccccgtggaccccggcgcccggcaggccctgcggaagaaaccgccagagaggacccccgaggatctcaacacgatctatagctatctgcatgggatggaaatcttgagcaatctgcgcgaacatcagctgcgcctcatgagcgcccgggctcggtacgaaagatatagtggaaatcaggtgcttttctgctccgaaactatcgctagatgctggtatatcctgttgtccgggtctgtccttgttaagggttcaatggtacttccaccgtgctcgttcgggaagcagtttggtggaaagagaggctgcgactgccttgtgttagagccgtcagagatgatagtcgtggaaaatgctaaggacaatgaagactccatcctacaacgcgagatccctgctagacaatctagaaggcggtttagaaaaattaattacaagggagagcgtcaaaccattaccgacgacgtggaggtcaactcctatttgtcactgcctgcagacctgacaaaaatgcatcttacagagaaccctcacccacaggtgacacatgtgtctagcagccagtctggatgctctattgcctcagattcggggtcctcaagtctcagtgatatctaccaggctacagagagcgaggttggagatgttgacttgaccagactccctgaagggcctgtcgattctgaggacgatgaggaagaagacgaagaaatcgatagaacagaccccctgcagggccgggacctggtgcgtgagtgcctggagaaagagccagcagacaaaaccgacgacgacattgagcaactgctggagttcatgcaccagctgcccgcgtttgctaatatgacaatgtcagttaggcgggaactgtgttctgtaatgatcttcgaggtagtggagcaggccggagctatcattctggaagatggccaggaactggatagctggtacgtgatacttaatggtaccgtggagatcagccaccccgatggcaaggtggaaaatctgtttatgggtaacagcttcggcattacacccaccctggacaaacagtatatgcatgggattgtccgcactaaggtcgatgactgccaatttgtgtgcatcgcacagcaggactactggcgaattttaaatcacgtggaaaaaaacactcataaagtagaggaagagggagagatcgtcatggtccacgagcatcgcgagttagacagatccggaacccggaaaggtcacattgtaatcaaggctacacccgaacggttgattatgcacttgatcgaggaacattcaatagtcgatccgacttatattgaagatttcctcctgacttacaggacttttctggaaagcccactcgatgtcggcataaagctcctggagtggttcaaaattgatagcttgcgagacaaggtgacccgcattgtacttctctgggttaacaaccacttcaatgattttgagggcgatccggccatgactcgtttcctcgaagagtttgagaaaaatttggaagatacaaagatgaacgggcacttgcgcctgttgaacatcgcctgtgccgctaaagcaaagtggcggcaggtcgttcttcaaaaagcctctagagaaagtcctctgcaattcagcctaaatggcggatccgagaagggttttggcatattcgtggaaggagtcgagccaggaagtaaagcagcagattctggtcttaagcgcggggaccagattatggaagtgaacggtcaaaattttgagaatattacgtttatgaaggctgtcgaaattctgcgtaataacacacacctcgcgctgacagtgaagaccaacatcttcgtgtttaaggagcttttgttccgtactgaacaggagaagtctggagttccacacattcctaagatcgcagaaaaaaagagcaatcgccactctattcagcacgttcccggcgacatagagcagacaagtcaggagaaaggaagtaagaaagtgaaggctaatactgtgtcaggaggcaggaataagattcggaagatcctggataagacaagattctccatactcccacccaaactattctctgatggaggactgtcacaatcgcaggatgattccatcgtcggcactcgccattgccgacactccttggccattatgccgatccctggcacgttaagtagcagctcacccgatttgctgcagcctactacatctatgctagacttctccaatccttcggctaaagggtttaagaatataccggaccaggtgattagagttttcaaagtggatcagcagtcttgttacatcatcatctcgaaagatacaacagcaaaggaggtcgtgtttcacgccgtgcacgagttcggcctgaccggtgcatccgacacatactcactctgtgaggtgagcgttaccccagaaggagtgattaaacaacgcagactgccagaccagttctctaaactcgccgatcgcatccagctcaacggccggtactatctaaagaacaatatggaaaccgaaactctgtgctccgacgaggatgcacaagagctagttaaagaaagtcaactaagtatgttgcagctgagcaccatcgaggtcgccacacagcttagtatgcgcgactttgacctttttcgaaatatagaacccacagagtacattgatgacctgttcaagttgaactcaaaaaccggcaacacccatctgaagaggtttgaggatatcgttaaccaggagacattctgggtggcgtccgagatcctgactgaggccaatcaactaaagcggatgaaaattataaagcactttatcaagatcgccttgcattgtagagagtgcaaaaactttaacagcatgttcgccattatcagcggcctgaacctggcatccgtagcccgccttcgcggcacctgggagaaactgcctagcaagtatgagaaacatcttcaggatctgcaggatatttttgacccctcaaggaatatggctaagtacaggaatatcctctccagccaatctatgcagccccctatcattcccctctttccagttgtcaagaaggatatgaccttcctgcatgagggtaatgattccaaagttgatggcctggtgaatttcgagaaactcaggatgatcagcaaggagatcaggcaggtcgtgcggatgacctccgctaatatggatccagccatgatgtttaggcagagaaaaaagcgctggcgcagcctcggaagcctttctcagggatctacgaacagtaacatgctcgacgttcaaggcggtgcacacaaaaagagggccagacgctccagcctgcttaacgcaaagaaactctatgaagatgcccagatggccagaaaagttaagcagtacttatccagcctggacgtcgagaccgacgaggaaaagttccaaatgatgtctctgcagtgggaacctgcctatggcaccctgacaaaaaatctgagcgagaaaaggagcgctaaaagcagcgagatgagtccagtgccaatgcgatccgcaggccagaccaccaaggcacacctgcaccagccccatcgcgtgtctcaggtgctgcaggtgcctgccgtgaacctgcaccctatcagaaagaaaggccaaacaaaggacccagctttgaatacttcgctgcctcagaaggtactcgggacaacggaggagattagcgggaaaaagcacacagaggataccatttctgtcgcatcatccttgcattcttcaccgcccgccagcccccagggatcgcctcacaaggggtacactctcatcccttccgcaaaatctgataatttgagcgatagctcacactccgagattagctcacgatcctccattgtctctaattgctctgtcgactcaatgagtgccgccttacaggatgaaaggtgtagttctcaggccttggcggtccctgaatccactggagcgctggaaaagacggagcatgcgtccgggatcggagaccactctcagcacgggccgggatggaccctgctgaaaccatcgctgataaagtgtttagccgtgtcaagttctgtttcgaacgaggagatttcacaggaacatatcatcattgaggctgctgattccggccgcgggagctggaccagttgtagtagctcctctcatgacaattttcagagtttaccaaaccctaagagctgggacttcttaaattcctacaggcatacccatttagatgacccaatagccgaggtagagcccactgactcagaaccctactcatgtagcaaatcatgcagcaggacctgcggccagtgtaagggctcgttagaacggaaaagctggacctcttccagctctctgagcgacacatacgagcctaattatggaacagtgaaacaaagggtgttggagagtactcccgctgagtccagcgaaggcctggaccccaaggacgctacagacccagtatataaaacggtaactagcagcactgagaagggcttgatagggaagaagcagacctcatatttttag

SEQ ID NO: 202530 - DNA, 4515 bp, Artificial Sequence
  Description of Artificial Sequence: Synthetic coding sequence
atgaacagccccgtggaccccggcgcccggcaggccctgcggaagaaacctccagagcgtacccccgaagacttgaacaccatctacagctatctgcatggaatggagatcctgagcaatctcagagagcatcagctgcgattgatgtcagcgcgggcaagatacgagagatattccggaaatcaggtgctgttttgctccgagaccatcgcccgatgttggtacattctgctttctggtagtgtcctggtgaaagggtccatggtgttgccaccttgcagctttggaaaacagttcggcggcaagcgcggttgcgattgtctcgtgctcgaaccgagcgagatgattgttgttgagaacgctaaagacaacgaggactccatcctccaaagagaaatccctgccaggcagtctaggagaagattcaggaaaatcaactacaaaggcgaacgtcaaaccattaccgatgatgtcgaagtgaattcttacttatctctacctgccgacttaactaaaatgcacctcacagaaaacccccacccccaggttacacacgtttcttcctcccagtcaggatgttccatagccagtgattctggcagttcttcactgtctgacatatatcaggccaccgagtctgaggtcggcgacgtagatcttacgcgcctccctgagggccctgtcgacagtgaggatgacgaagaagaagacgaagagatcgataggacggaccccctccagggccgggacctggtacgggagtgtctggagaaagagccagccgacaagactgatgatgatattgaacagctgctggagtttatgcaccagcttcctgcattcgccaatatgaccatgtccgtgcgacgcgagttgtgttccgtgatgatatttgaagtggtcgaacaggccggcgctatcattcttgaagatggccaggaattggactcgtggtatgtgattctgaatggcaccgtggaaatatcccatccagatggaaaggtagaaaatctgtttatgggtaattcgttcgggatcacgcccacacttgacaagcagtacatgcacgggatcgtgcggacaaaagttgatgactgccaattcgtttgtattgcacagcaggattactggcgcatcttgaaccatgtggagaaaaacacccacaaagtcgaggaagagggggagatcgtaatggtgcacgaacaccgggagctggaccgctcaggaacgagaaaaggacacattgtgataaaggctactcccgagaggctgattatgcatctcatagaggagcactccatcgtggatcccacatacattgaggactttttgctaacttatcggaccttcctggagagccctctcgatgtggggatcaaactgctggaatggtttaagatagatagcctcagagacaaggttactagaatcgtcttgctttgggttaacaaccactttaacgacttcgagggggatcctgctatgacccgatttctcgaggagtttgaaaaaaatctggaagatacaaagatgaacgggcatctccgcttgctcaacattgcttgcgccgcgaaggccaaatggagacaagtcgtcctccaaaaagcctcccgcgagtcaccccttcaattctccttaaacggagggagcgagaaggggtttggaattttcgtggagggggtcgagcccggctcaaaggctgccgattcaggattgaagagaggagatcagattatggaagtgaacgggcagaatttcgaaaacattaccttcatgaaagccgttgagatcctgcggaataatacacacttagccctcaccgtcaaaacgaacattttcgtgttcaaagagctgctctttcgcacagagcaagagaagtctggagttccgcatatacccaaaatcgccgagaagaaatcgaatcgccacagtatccagcacgttccaggggacattgaacagacctctcaggaaaaagggtctaaaaaggtgaaggccaataccgtgtccggagggcgcaataaaatccgtaaaattcttgacaagactaggttcagcatcctgccaccaaagttgttcagtgacggaggcttgtcacagagccaagacgacagtattgtcgggacaagacattgtagacattctctggccattatgccaattccagggacactgtctagcagctctccagacctactgcagccaaccacctctatgctggatttttccaacccctccgatattcccgaccaggtaataagagtgttcaaagtcgaccaacagtcttgctacatcataatcagtaaagatactaccgctaaggaagtggtctttcatgctgttcatgaatttggtctgacaggcgcgagtgatacttacagcttgtgtgaagttagcgtgactcccgagggggtgattaagcagcgaagacttcctgaccagttcagcaaattggccgaccggatccagctgaatgggagatattacctcaaaaataacatggagacagagaccttgtgcagtgacgaagacgcacaggagctagtgaaggagtctcagctctcgatgctacagttatctaccatcgaagtggccactcagctcagtatgagagatttcgacctgttccggaacatcgagccaaccgaatatatcgatgatctgtttaaacttaattccaagactggtaatacgcacctcaagagatttgaagatattgtcaaccaagagacattctgggtcgcatcagaaattttaaccgaggctaatcagctgaagaggatgaaaatcattaagcactttatcaaaattgccctgcattgtcgcgaatgcaagaacttcaattccatgttcgccattatttccggcctgaatttggccagcgttgcccgtttgaggggaacttgggagaaactgccttccaagtatgaaaaacaccttcaggatctgcaggacatctttgacccgagccggaacatggctaaataccgaaatatccttagttcccagagtatgcagcctccgatcattcctctgtttcccgtcgtgaagaaagacatgaccttcctgcatgagggtaatgacagtaaggtagatggtctcgtcaactttgaaaagcttcgaatgattagtaaggaaatccgacaggtcgtcagaatgactagtgccaacatggaccccgcaatgatgttccgccagaggaagaaaaggtggcgatccctgggatctctttcccagggatccaccaattccaacatgctggatgtgcaagggggggcccacaagaagcgcgctcgtcggtcgagccttctgaatgctaaaaagctgtacgaggacgcccagatggcgcgaaaggtaaaacagtacctatcctctctggacgttgagacagatgaagagaagttccagatgatgtctttacagtgggaacccgcttatggcacacttacaaaaaatctatctgaaaaacgcagtgctaaaagctccgaaatgtcccctgttccaatgagatcagccggacagaccacaaaagcgcacctccatcagcctcacagagtttctcaggtacttcaggtgcctgcagtgaatttacatcctatccggaagaaaggtcagacaaaagaccccgccttgaacacgagcctgccccagaaggtgctgggcaccaccgaggagatctctggtaagaaacacaccgaggacacgattagcgtggcttcttcgctacactcaagccctcccgcttcaccacagggtagtccccacaagggctacacgctgatcccgagcgcgaaaagcgacaacctgagcgatagcagccattccgagatttcatctaggtcctcaatcgtctcaaactgctccgtggacagcatgagtgcagctctgcaggacgagcgctgctcctctcaagcactggccgttccagaaagtaccggcgctctcgaaaaaacggagcatgcctctggaattggtgatcatagccagcacggccccggctggactcttctgaaaccatccctgattaagtgcttggcagtcagtagcagcgtcagtaacgaggaaatttcccaggagcatatcatcatcgaggctgccgactccggcagaggatcatggacttcgtgctccagcagcagccatgacaatttccaaagcctgccaaatcccaaatcctgggacttcctgaatagctataggcatacacacctggatgaccccatcgcagaggtcgaacctactgacagcgaaccttactcctgttcgaagagctgctctaggacctgcgggcagtgcaaaggatctttggagaggaagtcttggacgtcttccagctccctgtcagatacctacgagccgaattacggcactgtgaagcaaagagtgctggagagcactcctgccgagtctagcgaggggctcgacccaaaagacgccactgatcctgtgtacaaaactgtcacctcctctacagaaaagggtctcatcgagaacgagcaggtgtcagccgtgtag

SEQ ID NO: 202531 - DNA, 4806 bp, Artificial Sequence
  Description of Artificial Sequence: Synthetic coding sequence
atgaacagccccgtggaccccggcgcccggcaggccctgcggaagaagccgccagaacgcacgcccgaagacctcaatactatatactcttatctgcatggcatggagatcctctcaaatttacgggaacatcagctacggctcatgtctgccagagcaagatatgaaagatattctgggaatcaagtgctgttctgctcagaaactattgctcgctgttggtatatcctactgtcggggagtgtgctcgtcaaggggtccatggtgctgccaccttgttcctttggcaagcaattcggcggaaaaaggggatgcgactgtctggttctcgagccctctgaaatgattgttgttgagaacgctaaggataacgaggactctatactacagcgagagatacccgctcgccaatctcggcgcagatttcggaaaataaactataagggagaaaggcaaactatcactgatgatgtggaggtaaactcttatctgtctctgcccgcagacctgaccaagatgcacctgaccgaaaaccctcatccccaggtgacccacgtgtcttcatcccagagtggctgttccatcgcatcagacagtggatcctctagcctgtccgatatctatcaggctacagagagcgaggtaggagacgtggacctgacccgattgccagagggacctgtcgacagcgaagacgacgaggaggaggacgaagagatcgataggacggaccccctgcagggccgagatcttgttcgggagtgtctggaaaaggaaccagcggacaagacggacgacgacattgaacaactgctcgagtttatgcatcagctgccagcttttgcaaatatgacgatgagtgtgcgcagggagctctgctcagtcatgatctttgaagtggttgagcaggccggagctataatcctggaagatggccaggagctggatagctggtatgtcatattgaatgggaccgtggagatttcccatccagatggcaaagttgagaaccttttcatggggaatagtttcgggattactccaaccctggacaagcagtacatgcacggaattgtgcggactaaggtggacgattgtcagtttgtgtgtatagcccagcaagactactggcggatcctgaaccacgtggaaaaaaacacccacaaagttgaagaagagggagagatcgtaatggtgcacgaacatagggaacttgataggtccggaaccaggaagggtcacatagtgattaaggctaccccggaacgcttaatcatgcatctaattgaggagcactccattgttgacccgacatacatcgaagacttcttactgacttataggacattcctagagtcacccctggatgtaggcatcaagctgctagagtggttcaaaatcgatagcttgagagataaggttacccgcattgtgctgttatgggtaaataaccatttcaacgattttgaaggggaccccgccatgactcgtttcctggaagagtttgaaaagaatctcgaggatactaaaatgaacggacatctaagattgctgaacatcgcttgcgccgccaaggctaaatggcgtcaggtggtcctgcagaaagcgtctagggagagccctctgcagttcagccttaatggtggttcggagaagggattcgggattttcgtggagggagtagagccgggctctaaggccgctgactctggacttaaacgcggggatcagattatggaggtcaacggccaaaactttgagaatatcacttttatgaaagccgtggaaatattaagaaacaacactcatctcgctctaactgttaagacaaatatattcgtcttcaaggaactgctgtttcgaacggagcaggaaaagtccggggttccacacattcccaagatagccgagaagaaatctaataggcatagcattcaacacgtacctggtgatattgagcaaaccagtcaagaaaaagggagcaaaaaggtgaaagctaacactgtgagcggcggccgcaacaagattaggaagatactcgataaaactcgattttccattctgccacccaaactctttagtgacggggggttgtcacagagtcaggatgatagcattgttgggacccgacactgtcgacactctcttgcaattatgccaatcccaggtaccctttctagctcaagtcccgacttactgcagcccactacctctatgttagactttagcaatcccagtgacattcccgatcaagtgattagagtttttaaagttgaccagcagtcctgttatataatcatctctaaggacacgacggccaaagaagttgtctttcacgccgttcacgagttcgggttgaccggagcgagcgacacgtacagtctgtgtgaagtctctgtgacacccgagggtgtcattaaacagcgacgcctccctgaccagttcagtaaattggctgatcggattcagctgaatggacgttattacctgaaaaataacatggagactgaaactttgtgctctgatgaggacgcccaggaactagtcaaggaatctcagctgagcatgctgcagctgagcactatcgaggtggcaacccagctgagcatgagggatttcgatctgttcaggaatatagagcctactgaatatatagacgatttgtttaagcttaactctaaaaccggcaacacccacctgaaaagatttgaagatattgttaatcaggagactttctgggttgcaagtgagattcttacagaggctaaccaactgaagcggatgaaaattatcaagcatttcatcaagatagccctgcattgtagggagtgcaaaaatttcaattcaatgtttgccattatttccgggttgaacctcgcctcggtggcacgccttcgcggtacatgggagaaattaccctcgaagtacgaaaagcatctgcaggaccttcaggacattttcgacccgtctcggaacatggccaagtatcggaacatcctgagctcacaatctatgcagccgcccattataccgctgtttcctgtggtgaaaaaggatatgacatttctccacgaggggaatgattcaaaagtcgatggcctggtcaacttcgaaaaactgaggatgatatctaaggaaattcgccaggtcgttaggatgacgtcagcgaatatggaccccgcgatgatgtttcgccagcggagtctcagccaaggatctaccaacagtaacatgctcgacgtgcagggcggagctcataaaaaaagggctagacgctcttctctgctcaatgcaaaaaaactgtatgaggatgctcagatggcaagaaaggtgaagcagtacctgtcctcccttgacgtcgagactgacgaagagaaatttcagatgatgagtttgcagtgggaacctgcttatggtacgctcaccaaaaacctctctgaaaagcggtctgcaaaaagctcagaaatgtctcccgtacctatgaggtctgctggccagaccacgaaggcccatctgcaccaaccccaccgggtgtcacaggtactgcaggttcccgccgtgaacctgcatccaatccgcaaaaaaggtcagacaaaagatcctgctctcaacaccagtctgccacagaaagtcctcggcactaccgaggagatcagcggtaaaaagcacacggaggacactattagcgtcgcttcatctcttcattccagtccccccgcttccccacaggggagcccacataaaggatacacattgattccttcagcaaaaagcgacaacctgagcgactcctcgcacagcgaaatcagttctaggtcctccatagtttctaattgttccgtggactccatgtctgcggctcttcaagatgagcggtgcagcagccaggctttggcagtgccagagtcaaccggcgccctggagaagacagagcatgcgtcgggtatcggcgatcattctcagcatggccctggctggacattgctgaagccatctctgattaaatgcctggccgtcagttcttctgtatcaaatgaagagattagccaagaacacataatcatcgaggcggctgactcaggtcgcggatcctggacctcatgctctagctccagtcacgacaattttcagagcctgcccaatcctaagtcttgggactttctgaacagctatcgccacactcacctcgatgaccccatcgctgaggttgagcctaccgattcagagccttactcatgcagcaaaagctgcagccggacatgcggccagtgcaaaggcagcctggaacggaaatcctggactagctcctcatccctctctgacacctacgaacccaattatggtaccgtcaagcaacgcgtgctggagtctactcctgctgagagtagcgaaggtctcgaccccaaggatgctaccgacccagtgtataagactgtgacttcttcaactgagaagggactgatcgtgtattgcgtcacatcccccaaaaaagacgaccgctatcgggagccgccccctaccccccctggctatcttggcatctctctggctgacctgaaggagggaccgcacactcaccttaagccacccgattacagtgttgccgtgcagaggtccaagatgatgcataatagcctctctagactgccccccgccagcctcagcagtaatttagtggcatgtgtgccctccaaaatcgtgactcagccccagcggcacaatctgcaacctttccatccaaagctgggtgatgtgaccgatgctgactctgaagccgacgaaaacgagcaagtgagtgccgtctag

SEQ ID NO: 202532 - DNA, 3615 bp, Artificial Sequence
  Description of Artificial Sequence: Synthetic coding sequence
atgaacagccccgtggaccccggcgcccggcaggccctgcggaagaagccccccgaaagaactcctgaagatttaaatacaatttacagctacctccacggcatggagatcctctctaacctccgtgagcaccagttacgactaatgagtgcgagggcaagatatgaacggtacagcggtaatcaggtgctgttctgctctgaaactattgcccgatgctggtacattctactcagtgggtccgtcctggtaaagggcagtatggtgctccccccttgtagttttggtaagcagttcggtggaaaaagagggtgtgactgcctggttctggagccatctgaaatgatcgttgtcgagaatgccaaagataatgaagattccatcctgcaaagggagattccagctagacagtctcgcagaagattcaggaagatcaattacaagggcgagagacagactatcaccgacgacgtcgaggtgaattcctatctcagtctccctgcggatttaaccaagatgcacctcactgagaatccccatccccaagtgactcacgtatccagctcacagagcggatgctcgattgctagcgactctggcagcagcagcctgtcagatatctatcaggctaccgagagcgaggtgggggatgtggacttgactcgcctgccggaaggccccgttgattctgaggacgacgaggaggaggatgaagaaatcgataggacagaccctctccaggggagggatctcgtgagagagtgcctggagaaggaaccagccgacaagacagatgacgatatcgagcagctacttgagtttatgcaccaattgccagcctttgcaaatatgactatgagtgtccggcgcgagctctgcagtgtgatgatcttcgaggtggtagagcaggccggtgctatcattctggaagatggccaagagctagattcttggtacgtgatcctgaatgggaccgtagaaatcagccaccccgatgggaaggtggagaacttatttatgggcaactcatttggaattacacccactctggataaacagtacatgcacggcattgttagaacaaaggtggatgattgccagttcgtgtgtatagcccagcaggactattggcggatcctgaaccacgtggaaaagaatactcacaaagtggaggaggagggtgagatagtgatggtgcatgagcatcgcgaactcgaccgatcaggcaccagaaaggggcacattgtcatcaaggccaccccagaacgcctgatcatgcacctgatcgaagagcattcgattgttgatcctacgtatattgaggactttctcctgacataccggacgttcctggagtcacctctggatgtgggcatcaagctgttagagtggttcaagattgactccctccgcgataaggtaacacggattgtgttactgtgggtcaataaccactttaatgattttgagggagaccccgcaatgacacgctttttggaagaatttgaaaagaacctggaggacactaaaatgaacggacacctgagattactgaacatagcgtgcgctgccaaggctaagtggcgtcaagtggtcctgcaaaaagcatctcgcgagtctcccctgcagttcagcctgaacggaggatccgaaaaggggtttgggatatttgtcgaaggtgtggaaccaggctccaaggcggcggacagcggattaaaacgcggggaccagatcatggaggtgaatggtcagaactttgaaaatattaccttcatgaaagccgtggaaatcctgcgtaacaacacgcatctggcgctcactgtgaaaacaaatatcttcgtattcaaagagctacttttccgtacggaacaggagaaatctggcgtgccccatattcccaagattgccgagaaaaagagcaaccgccactctatccaacatgtgcccggggacattgagcagactagtcaggaaaaaggttccaaaaaagttaaggcaaacaccgtttcaggggggcgaaacaaaatccgcaagatattggataaaacacgctttagtatcctccctccaaaactcttctcagatggaggtctcagccagagccaggacgacagcattgtggggacccggcattgccgccactctctggcgatcatgcctatccccggcactctgagttcaagctcccctgacctgcttcagcccaccacctcaatgttggatttttctaatccatctgacattcctgatcaggtgattagagtgttcaaggttgatcagcagtcatgctatatcatcatctccaaggataccaccgccaaggaggtggtttttcacgccgttcacgaattcggcttaacaggtgccagcgatacatactctctctgtgaagtttccgtgacacccgaaggggtcataaaacagaggcgattaccagatcaatttagtaaactggccgatcgcatacagctgaacgggaggtactatctgaaaaacaacatggagacggagaccctgtgctcagatgaggacgctcaggagctagtcaaggaaagccaactatcaatgctacagttgagtacgatcgaagtggctactcagttgagcatgcgcgactttgacctcttccgcaatatagaacctaccgagtacatagacgacctgttcaagttgaactccaagaccggaaatacacacctcaaacgctttgaggacattgtgaaccaggaaactttctgggttgcttccgaaatcctgactgaagcgaatcagttgaaaagaatgaaaattattaaacatttcattaaaatagccttgcactgccgcgaatgtaagaatttcaatagcatgttcgccatcatcagcggtttaaacctggccagcgttgcaaggttgcgcgggacctgggagaagttgcctagcaaatatgaaaaacatctacaggatctgcaggacatatttgatccaagtaggaatatggctaagtatagaaacatactctcgtcccagagcatgcagccaccgatcattcccctgttccctgtagttaaaaaggatatgacatttctccatgaggggaatgacagcaaagttgatggtctcgtgaatttcgagaagctgaggatgatttctaaagaaatccgacaagtagttcgcatgactagtgctaacatggaccccgccatgatgtttaggcagagaagcttatctcaaggttcaaccaatagcaacatgttggatgtccagggcggggctcataagaagagggcgcggcgcagctctctgctcaacgcgaaaaagctgtacgaggacgcacaaatggcccgcaaggtcaagcagtatctttcctctcttgatgttgagactgacgaggaaaagtttcagatgatgagtctgcagtgggaacccgcatacggtacgctgacgaaaaatctgtcagagaagcggagcgccaaaagctcagagatgtcaccagtgccaatgcgctccgcaggacagaccactaaagctcatttacaccagccacatagagttagccaggttctgcaggtgccagccgtgaatcttcaccccatacggaagaaagggcagaccaaagatcccgcactgatgtag

SEQ ID NO: 202533 - DNA, 4176 bp, Artificial Sequence
  Description of Artificial Sequence: Synthetic coding sequence
atgaacagccccgtggaccccggcgcccggcaggccctgcggaagaaaccgccagaacgtacgcccgaggatctgaacaccatttacagctatctgcacggcatggagatcttgagtaatctgcgagagcaccagctgcgtcttatgtcagccagagcccggtatgagagatacagcgggaaccaagtgctgttctgcagtgaaactatcgcacgctgctggtacatactgctgtctggctctgttctggtcaagggaagcatggttctccctccatgttcctttggcaaacagttcggtggcaagagaggctgtgattgcttagtcctcgagccgtcagaaatgattgtcgtggagaatgctaaggacaatgaagattcaatcctccagcgcgagattcccgctcgccagtcgcggaggcgcttcaggaagatcaactataagggagagaggcagactattaccgacgatgtagaggtaaacagctacctgagcctcccagctgatctgaccaaaatgcacctcactgagaacccccacccccaggtaacccatgtgtcaagctctcagtctggctgtagtattgcctctgacagcggttcttccagcctgtcagatatctaccaggctacagagagtgaagtgggtgatgtagaccttacacgcctgcccgaaggaccggtcgactcagaagacgacgaggaagaggacgaggagattgatcggacagacccattgcaaggacgggacctggtccgcgaatgtcttgaaaaggagccagctgataagaccgatgacgacatagagcagcttttggagtttatgcaccagctgccggcgttcgcaaatatgacgatgtcagtgcgacgggaattgtgttccgtgatgatcttcgaggtggtcgagcaggcgggcgcgataatactggaggacggacaggaactggattcctggtatgtgattctcaacggtacggttgagatctcgcaccctgacgggaaggtggagaatttgtttatgggcaacagcttcggtatcactcctaccctggacaagcagtatatgcacggcatcgtccgaacgaaggttgatgactgccagttcgtatgtatcgcacagcaggattattggcgcatcctgaatcatgtggagaaaaacacccacaaggtcgaggaggagggtgaaatcgtgatggtacacgagcatcgcgagctggatcgatctggaactcggaagggtcatattgtgatcaaggccacgccggagcgtttgatcatgcatcttattgaggagcattctatagtggatccaacctacattgaagacttcctgctcacctacaggacattcttggagtctcccttggacgtgggaatcaaactccttgagtggttcaagatcgattctctccgagacaaagtgacgagaatcgtgctgctctgggttaacaaccacttcaatgattttgagggcgatccggcaatgaccagatttctcgaggaattcgaaaaaaatctggaggacacgaagatgaatggccacctgcgcctgcttaacattgcctgcgctgctaaggcaaaatggagacaggtggtgttgcagaaagcttcgcgggagagccccctccagttttccttaaacggcgggagtgagaaaggatttggcattttcgtcgaaggtgtcgaacccggcagcaaggctgctgatagcgggcttaagcgcggcgaccaaattatggaggtgaatgggcagaactttgaaaacattacgtttatgaaagccgtcgagatcctgcggaataatactcacctggcgctcactgttaaaaccaatatcttcgtgtttaaagagctcctgttccggactgagcaagaaaagtccggcgtcccccacatacctaaaatcgcggagaagaaatctaacaggcactctatccagcacgttcccggagacatagagcagacatcacaagagaaagggagtaagaaagtaaaggccaatacagtgtctggggggcgaaacaagatcaggaagatcctcgataaaacaaggtttagcattctgcctcctaaactgttcagcgacggagggctctctcaatctcaggacgactccatcgtgggaacaagacattgtcgtcatagtttggctataatgcctattcccggaacgctgtcatccagttcccccgacttacttcagccaaccacaagcatgctggacttttctaacccctctgatatccccgatcaggtcatcagagtcttcaaggtagaccagcagtcttgctacataataatcagcaaagacactacggcaaaggaagtggtgtttcatgcagtccacgagtttggcttaacaggcgcttccgatacctacagtctttgtgaggtaagcgtgacgcccgaaggagtgatcaagcagcggagactccccgatcagttctcaaaactagctgatagaatccagctcaatggccgctactaccttaaaaacaatatggaaaccgagacgctgtgtagcgatgaagatgcgcaagagttggtgaaagagagtcagctctcgatgcttcaactatccacaattgaggtggcaacccagctatccatgagagatttcgatctgtttcgaaatatcgaacctacggagtacattgacgacctgttcaaactgaatagcaagaccggcaacacacaccttaagcgcttcgaagatattgtgaaccaagagactttctgggttgcctcagagatactgactgaagcaaatcaactcaaaaggatgaagatcatcaaacatttcatcaagatcgccttgcattgccgggagtgcaagaattttaactctatgttcgctatcatctccggcttgaatttggcaagcgtggcacgattgcggggcacgtgggaaaaacttccaagcaagtatgaaaaacaccttcaggacctgcaggatatcttcgatccttcacgcaatatggccaaatatcggaatatcctgagctcacaatccatgcagccgcccattatcccattgttcccagtggtgaaaaaagacatgacattcttgcatgagggaaacgattctaaagttgacgggctcgtaaattttgagaaactccgtatgatcagtaaggagattagacaagtggtgagaatgacttccgcgaacatggaccctgctatgatgttccgacaacggtctcttagtcagggctccaccaatagcaatatgctcgatgtacaggggggcgctcataagaaacgcgcacgccgatcctctctgctgaacgccaagaagttgtatgaggacgctcagatggcccggaaagttaaacagtacctatccagtctggacgtcgagacagatgaggaaaaattccagatgatgtccttgcagtgggaaccagcttatggcaccctcaccaaaaatctgagcgagaaacgaagtgcgaaatcttcagagatgtccccagttccaatgcgaagcgctggtcaaacaaccaaagctcacctccatcagcctcatcgggttagccaggtactgcaggtacctgcggtaaacctccaccctatccggaagaagggccaaacaaaggatcctgccttgaatacctctctgccacaaaaggttctgggaactactgaggaaatttccgggaagaagcatacagaggatacaatatccgtcgccagttctctccacagttctccacctgcaagcccccagggcagcccgcacaaggtcggctccattatttccgaccattcctccaagatctcaggtcagagctgccccggcataggcggggcctatctgcagaagaagattctgcagattacgcgcagcacagccaagagaacagacagcactgagaaagccaccgaggaaaacagggacagaacgtcctgcgagaataccacgaggaaacggatgacctcccctttccgccgcttgagggaaaggatgctgtctcgtgagagactggtgaactctcaaaaagaagacaccgatcataatcaagccaccgagagttgcgaaaaggtcaaagatgtgggaagtaatatcaaagatgagaagggaagcgccatctttaattcaaatagccaggggaactcaaacacactcaattgtttttacacacgcttcaagtccaagaggagaaaaaccctctag

SEQ ID NO: 202534 - DNA, 2484 bp, Artificial Sequence
  Description of Artificial Sequence: Synthetic coding sequence
atgaacagccccgtggaccccggcgcccggcaggccctgcggaagaaacctcctgagcgcaccccagaggatcttaatacgatatattcatacctacatggcatggaaatcttgagcaatctgcgcgaacaccagctgaggctgatgagcgcccgagctcggtacgaacgatactccggaaaccaggttctcttctgcagcgaaaccatcgctcggtgttggtacatcctgctgtcaggctctgtgctggtcaaaggtagcatggtgcttcccccctgctcttttggaaagcagttcgggggcaagcgcgggtgcgattgtcttgtgctggagccatccgaaatgatcgtggtggaaaacgctaaagacaatgaagattccattctgcagagagagattcctgccagacagagtagaaggcggttcaggaagatcaattacaaaggagagcgacagaccattacggacgatgtagaggtgaactcctacctaagtcttcccgccgacctgactaagatgcacctaaccgaaaacccacaccctcaggtgacccacgttagcagtagccaatcaggctgtagcattgcctctgacagtggatcatcatcgctgagtgatatctatcaggccacagaatctgaagtcggggacgtcgatttgacccgcctgccagagggccctgttgacagcgaagatgacgaagaagaagacgaggaaatagaccgcactgacccactgcaagggcgagatcttgtgagagagtgcctcgaaaaggagccagcagataagacagatgacgatattgaacagctattggagtttatgcatcaattaccagcttttgctaacatgacgatgtctgtgcggcgcgaactttgctcggtaatgatttttgaagtcgttgagcaggccggcgctatcattttagaggatggccaggaactcgactcttggtatgtgatacttaatgggactgtagagatcagtcaccccgacgggaaggtcgaaaatctgttcatgggcaacagtttcggcattaccccaactctcgataagcaatacatgcacggtatcgtgcggactaaggtggacgactgtcagttcgtatgcatcgcacagcaggactactggcgcatactgaatcacgtggagaaaaacactcataaggttgaggaagagggcgaaatagttatggtgcacgaacatcgagagttggacaggtcaggcacacggaagggccacatcgtcattaaagccacccccgaacggcttatcatgcacctgattgaggagcacagcattgtggatccaacctacatagaggactttctcctaacttataggacctttcttgaaagcccactggatgtagggatcaaactgctagagtggttcaagatagatagccttcgcgataaggtgacacggatagttctgctgtgggtgaataatcattttaatgattttgagggcgacccagctatgactagatttcttgaggagtttgaaaagaatctggaggacactaaaatgaatggacacctgaggctgctcaacatcgcgtgtgcagcaaaggctaaatggaggcaggtcgtccttcagaaggcttcccgggagtctcctctgcaattttctctgaacggcggttcagagaaaggtttcggaattttcgtagaaggtgttgaaccaggttcaaaagccgcagattccggcctgaagagaggagatcaaattatggaggtgaacggccagaacttcgagaacattacatttatgaaggctgttgagatcctgcggaacaatacacacctggccctgacagttaagactaacattttcgtttttaaggagcttctgtttcggaccgagcaggaaaagtctggcgtccctcacatcccaaagattgctgagaagaagtctaatagacactctatacagcatgtgccaggcgatattgagcaaaccagtcaggaaaaggggtccaaaaaagtgaaggctaacactgtatcaggtggccgcaataaaatacggaaaatcctggataaaacgagattctccatcctccctcccaaattattctccgacggaggactgtctcagtcccaagatgactctatagtgggaacaaggcattgtcgtcattcactggcaataatgcccattcccgggacgttgtctagctcctcccccgaccttctgcaacctaccacctctatgctggatttcagcaatccatctgacatacccgaccaggtcatccgcgtgtttaaagtcgaccagcaaagttgctacattataatctcaaaagacactactgcaaaagaagtggtgtttcacgctgtgcatgagtttggattaacaggtgcttctgatacctactccctctgcgaagtttcagtgacacctgagggcgtgataaaacagaggagactgccggatcagttctcgaagttagcggatcgaatacagcttaatgggcggtag

SEQ ID NO: 202535 - DNA, 1551 bp, Artificial Sequence
  Description of Artificial Sequence: Synthetic coding sequence
atggccgacaacctgagcgacaccctgaagaagctgaagatcaccgcagttgataagactgaggattcactagaggggtgcctcgattgcctcttgcaagcgctggcgcagaataatacggaaaccagcgagaagatccaagccagcggcatcctacagctgttcgctagcttactgacacctcagagcagctgcaaagccaaagtagccaacattatcgcggaagtggccaaaaacgaatttatgagaattccttgcgtagacgcaggactcatctcacctttggtgcagctactcaactccaaggaccaggaggtcctgttgcagacggggcgggccctcggtaatatatgttacgactcccagagcagcaaggagcaattcgcctctacaaatatcgctgaggaactggtcaaactattcaaaaagcagatcgagcacgataaacgggagatgatctttgaagtactcgcccctctagctgagaacgatgctattaagctccagctggtggaggcggggctggtggagtgtctcctggaaatagtacagcaaaaagtcgattcagacaaagaggatgacattactgaacttaagaccgggagtgatctgatggtcctactacttttgggggatgagagtatgcagaagttgttcgaaggcggcaagggttcagtgttccagcgagtgctgtcctggataccttccaacaaccatcagctgcaactggcgggggcccttgccattgctaactttgctcgtaatgacgctaattgtatccacatggtggacaatggcatagttgaaaaactgatggatctgcttgatagacacgtcgaggacggtaatgtcacagtgcagcacgctgctctctccgcactgcgcaatctggcaatccctgttatcaacaaagccaaaatgctctccgctggagtcactgaagctgtacttaaattcttgaagagcgaaatgcctccagttcaatttaagctcctgggcactttgcgcatgcttatcgatgcacaggcagaggcggcggaacagctagggaaaaatgtgaaactcgttgagaggttggtcgagtggtgtgaagcgaaagaccatgcaggcgtcatgggagaatccaatcggttactgagtgccttgatccgccatagcaagagtaaagatgtgatcaaaaccatcgtgcagagcggtggcattaagcatctggttaccatggccacgagcgaacacgttatcatgcagaacgaggcactggtagccctggccctgatagcggccctggaacttggcacagcagaaaaggacctcgagagcgccaaattggtgcagatactgcacaggctgcttgccgatgagcgcagcgccccggaaatcaagtataactctatggtgctaatctgcgcactaatggggtccgagtgtttgcacaaggaagttcaggacttggcatttctggacgtagttagcaaactccgatcacacgaaaataagagtgttgctcagcaagccagtctgacggagcagcgccttactgtggaatcctag

SEQ ID NO: 202536 - DNA, 1827 bp, Artificial Sequence
  Description of Artificial Sequence: Synthetic coding sequence
atggccgacaacctgagcgacaccctgaagaagctgaagatcaccgcagtggacaagacggaagattctctggaaggatgcctggactgtttgttgcaggctctcgctcaaaacaacactgaaacctctgaaaagatacaggcttcagggatcctgcagctgtttgcaagcttattaactccccaatcttcttgtaaggctaaggtcgccaatattatcgcagaagttgccaaaaatgaattcatgagaatcccatgtgtggatgccggcttgatttctcccctggtccagctcctgaattcaaaagaccaagaggtgctgctgcagaccggccgtgctctgggcaacatctgttacgatagtcatgagggaaggtcggccgtcgaccaggcagggggcgctcagattgtgatcgatcatctgcgaagcctatgcagtattactgacccagcaaatgaaaaactactgacagtgttctgtggcatgctgatgaattactcaaacgagaacgactccctgcaggcccagctgattaatatgggcgtgatacccaccttagtcaaacttcttggcattcattgccagaacgcagcactcaccgagatgtgcctggtggcttttggcaacctcgcagaactggagtcctctaaggagcagttcgcgagcactaacatagccgaggagctggtgaagctgttcaaaaaacagatcgagcacgataagcgcgagatgatctttgaagtcctcgcccctcttgctgagaatgatgccattaagttacagctggtggaggctggcctggtcgagtgcctgctggaaatcgtccaacagaaagtggattccgataaggaggacgatattactgaactcaagactggctcagatctgatggtactgctcttgctcggcgacgagtccatgcagaaactattcgaggggggcaaaggcagcgtgtttcagagggtgttgtcctggataccctctaacaatcaccagctgcagctggcaggggccttagctatcgccaactttgcacggaacgatgccaattgcatccacatggtagataatgggatcgtcgaaaagctgatggaccttctcgaccgacacgtggaagacggaaacgttaccgtgcagcacgccgccctctctgccttgcggaatctggcgataccagtgatcaataaagctaagatgctcagcgccggagtgaccgaggccgtgttgaagtttctaaaatcggaaatgccccccgtgcagttcaagctacttgggacgcttaggatgcttatcgatgctcaggccgaagccgctgaacagctcgggaagaatgtcaagctggtcgaacgcctagtggagtggtgcgaagctaaagaccatgccggcgtaatgggcgagtcaaacaggctactctctgctctaattcggcacagtaaatccaaagacgtgatcaaaactattgtgcagtccgggggcattaaacatctggtgactatggccacatcagagcatgtgattatgcaaaacgaagcccttgttgcactcgctctgatagccgctctcgaactcggcaccgccgaaaaagacctggagtccgccaagctggttcagattctgcatagattgttggcagatgagcgctctgccccagagataaagtacaactctatggtcctgatatgtgctctgatgggatcagagtgtctgcacaaggaggtgcaggatctagcttttctggacgtggtatcaaaactccggtcacacgagaataaatccgttgcgcagcaagcctcccttaccgaacagaggttaaccgtggaatcatag

SEQ ID NO: 202537 - DNA, 1680 bp, Artificial Sequence
  Description of Artificial Sequence: Synthetic coding sequence
atggccgacaacctgagcgacaccctgaagaagctgaagatcaccgctgtggataaaacagaggacagtctggaggggtgtctggactgtcttcttcaggcccttgcacaaaacaacactgagacatcagaaaaaatccaggcatccggcatacttcagctgttcgcctctctattgactccacagtcctcttgtaaagctaaagtggcgaatattatcgcagaagtcgctaaaaatgagttcatgcgcataccatgtgtagacgccggactaatttcaccactggtgcagctcctgaatagcaaggatcaggaggtattactccagacggggcgggccctcggcaatatttgctatgacagccactcactgcaggcccaactgatcaacatgggcgtgatccctacacttgtaaagctgctcggaattcattgccagaatgccgctctcaccgagatgtgtctggttgccttcggcaacctggccgaattagagtcttctaaagagcaattcgcatccacaaacatcgccgaggagctggtgaagttgttcaagaagcagattgagcacgataaacgggaaatgatttttgaagtccttgctccgctggcggagaatgatgcaattaaattacagctagtggaggccggactggtcgagtgcctcttggaaattgtccagcagaaagtggactctgataaagaggatgacattactgaactaaaaaccggctcagatcttatggtcctgctcctcctgggtgacgaatccatgcaaaagctctttgaggggggcaaaggctcagttttccagcgagtcctttcctggattccaagtaacaaccaccaactgcagcttgctggggctctagccatcgctaattttgctcggaacgacgcgaattgcatccatatggtcgacaatggtattgtggagaaactaatggatctcctggacagacacgtggaggacggaaacgttaccgttcagcacgcagctctgtccgccctacgcaatttggctatccctgtgattaacaaagccaagatgctttcagcaggggttacagaggctgtgttgaaattcctgaaatcggagatgccacctgtgcagtttaaactgctcggtaccctgcgcatgttaatcgatgcccaggctgaggccgccgagcagctgggaaaaaatgtgaagctggttgagcgactggtcgagtggtgtgaggctaaggatcacgcgggggttatgggagagtctaataggctgctgagcgccctcattcgacattctaaatccaaagatgtgatcaagacaattgtgcagagcgggggcatcaaacatcttgtaaccatggccacctcagaacatgttataatgcaaaacgaggccttggtggcattggccctcatcgcggcactcgaactcggaaccgcggaaaaggatttggaaagcgctaaattggtgcagattttgcaccgcctgttggcggatgaacgaagtgccccggagattaaatataattctatggttttgatttgcgcactgatgggatcggaatgcctacacaaggaagtccaggacctcgcgtttttggacgtggtcagcaaactgcggagccatgaaaataaaagtgttgcacagcaggcaagcctcactgagcagagactgaccgtggagtcctag

SEQ ID NO: 202538 - DNA, 1677 bp, Artificial Sequence
  Description of Artificial Sequence: Synthetic coding sequence
atggacaacctgagcgacaccctgaagaagctgaagatcaccgccgtagataagaccgaggatagcctggaaggctgtttagattgtctgctgcaggctctggctcaaaacaatacggagacatcagaaaagattcaggccagcggcattcttcagctgttcgcttctctgctgacaccacagagcagttgtaaagcgaaggtggctaacatcattgccgaggtcgccaagaatgagtttatgaggattccatgtgtcgacgccggcctcatcagtcccctggttcagctgctaaattctaaggatcaggaagtgctgttgcagacggggagagctttaggaaatatctgctatgacagtcattctctacaggctcaattaattaatatgggagttatccctacactggtgaagctcctcggcatccattgtcagaacgccgccctcaccgagatgtgccttgtggcatttgggaatctggcggagctggaatcctctaaagagcaatttgcctcaaccaacatcgctgaggagctcgtgaaactgttcaaaaagcaaatcgagcacgataagagagaaatgatcttcgaagttctggccccgctggcggagaatgacgctattaaactccagctcgtagaagcaggccttgtggaatgtttactggaaatcgttcaacaaaaggtcgatagtgacaaggaagacgatatcacagagctgaaaacgggcagcgatctgatggtgttattattattgggcgatgagagtatgcagaaactgtttgagggagggaaaggctccgtctttcagcgggtcctttcctggatcccttcaaataaccaccaactccagcttgcaggcgcactggcgatcgctaatttcgccagaaacgacgcaaattgcatacatatggtcgataacggtatagtggagaaactcatggacttactggaccgtcacgtcgaagatggcaacgtgaccgttcagcacgcggctctgtccgcgttgaggaacctggcaattccagtcattaataaggcgaaaatgctgtcagccggtgtgaccgaggcagtactaaagtttctaaaaagcgagatgcctccggtgcaatttaagctcctgggcacgctccggatgctgattgacgcccaggccgaggcggccgaacagctcggaaaaaatgtcaagctggttgaacgcctcgtcgaatggtgtgaagcaaaagatcacgcaggagttatgggagagtccaacaggcttctttctgcgctgattcgccactccaagtcaaaagacgtaattaagactatagttcagtccggcggtatcaagcacttggtcaccatggctactagcgaacacgtgattatgcagaacgaagctctggtggccctggctctgatcgccgcactcgagttgggcaccgccgaaaaggacctagagtctgctaaactggtgcaaatcttgcacagattgttggcggatgaacgtagtgcaccagagataaaatataatagcatggtcttgatctgcgctttaatggggtccgagtgtttgcataaggaagtccaggatctagcgtttctggatgtcgttagtaagctacggagtcacgaaaacaaatccgttgcccaacaggcatctctgactgaacagcgtctcaccgtggagtcttag

SEQ ID NO: 202539 - DNA, 1824 bp, Artificial Sequence
  Description of Artificial Sequence: Synthetic coding sequence
atggacaacctgagcgacaccctgaagaagctgaagatcaccgccgtggacaaaacagaggactctctcgaagggtgcctggactgcttactgcaggcactagcacagaataacacagaaaccagtgagaaaatccaagcgagcgggatcctgcagcttttcgcatcattactgacccctcagtcttcctgtaaagccaaggtggccaatattatcgccgaggtggcaaaaaacgagtttatgcgtatcccttgtgtggatgctggtctcattagcccactggtacagctgctcaactccaaagaccaagaagtattgttgcagacgggtagagccttaggcaatatctgttacgacagccacgaagggcggagtgcagtcgaccaggccggtggtgcgcagatcgtgattgatcatcttcgcagcctatgttccattaccgacccagccaacgagaagctcctaaccgtcttttgtggtatgctgatgaactatagcaacgaaaatgattcattgcaggcccaactgatcaatatgggcgtcattccgacactggtaaagctgttagggatccactgccagaacgcagccctgacagaaatgtgccttgtggctttcggcaatctcgcagaactggaatcatctaaggaacaatttgctagtactaacatcgccgaggaattggtgaaattgttcaaaaagcagattgagcacgataaacgagaaatgatattcgaggtactggcccctttggccgaaaatgacgctattaagctgcagctggtcgaggcgggactagtggaatgcctgcttgagatagttcagcagaaggtagatagcgacaaggaggacgacattaccgagttgaaaactggctcagacctcatggtcctcctgctcttgggtgacgagagcatgcagaaactcttcgagggtggcaaagggtctgttttccagagagtgctttcctggattccatccaataatcatcagctccagttagccggagcgctggccatagccaatttcgcaaggaatgacgctaattgcattcacatggtcgataacggcatcgtggagaagctgatggacctcctagacaggcatgtggaagacggaaatgttactgtgcagcatgctgctctgtcagccctacgcaatctcgctatccccgtgattaacaaggccaagatgttgagcgccggcgtaaccgaagcagtgctgaagtttctgaaatctgaaatgccacccgtgcagttcaagttgttaggtactctgagaatgttaatcgacgctcaggctgaggcagcagagcagctggggaaaaatgtgaaactggtggaaaggctggtggagtggtgcgaagcaaaagaccacgcaggcgtgatgggagagtctaacagactgctcagcgccctgattcgtcactcgaagagtaaagacgtgatcaagacgattgtgcagtcaggaggcatcaagcatctggtcaccatggcaacttcagagcacgtgataatgcagaacgaggcgttggtggcgttggctctgatcgcagcactcgagcttgggaccgcagagaaggatttagaatccgcaaagctcgtgcagatcctgcatcgactgttagcagacgagcgttccgcaccagagattaaatataattcgatggtgctaatttgcgcgttaatgggctcagagtgcttacacaaggaagttcaggatctcgctttccttgacgtggtgagcaagcttaggagtcatgaaaacaagagcgtggcccaacaggcaagcctgacggaacagaggttgacggtcgagtcctag

SEQ ID NO: 202540 - DNA, 1824 bp, Artificial Sequence
  Description of Artificial Sequence: Synthetic coding sequence
atggccgacaacctgagcgacaccctgaagaagctgaagatcaccgccgtagacaagaccgaggactcgctggagggctgccttgactgtctgctgcaggccctggcacagaataatactgagacgagcgaaaagatccaggcctccggtatactgcagctgtttgccagccttttgaccccgcagagcagttgcaaagcgaaggtggccaatattatcgctgaggtcgccaagaacgaatttatgcgcattccatgtgtcgatgctggtctgatcagccccctggtacagctactcaattcgaaggaccaggaggtgctcctacagaccggacgcgcccttggtaacatttgctacgatagccacgaaggaaggagtgccgtcgaccaggccgggggagctcagattgtcattgaccacctccggtcactgtgcagcatcacagatccagccaacgagaagctcttgaccgtcttctgcgggatgctcatgaactattccaatgagaatgactctctacaagcccagctaattaacatgggggttattcctactctggtgaaactcttgggcatacactgtcaaaacgccgccctgaccgaaatgtgtctggtggcattcgggaatctggcagaactggaatcatctaaagagcaattcgcatccactaatattgcggaggaactggtaaagctttttaagaagcagatcgagcacgacaagcgggagatgatcttcgaggttctggcccctctcgccgagaatgatgcaattaaactacaactagtggaggcaggcctggttgagtgcctgctggaaatcgttcagcagaaagtggactccgataaagaggacgacatcaccgagctcaagacggggtccgacctgatggtcctgctccttcttggtgatgaatccatgcagaaactctttgagggcgggaagggtagcgtttttcagcgtgttctctcctggatcccttcaaacaaccaccagttacagctggccggagccctggcaatcgcaaattttgccagaaacgacgcgaactgcatccacatggtcgataatgggatcgtggagaaactgatggacctgctggaccggcacgtagaggatggtaacgtgacagtgcagcacgctgccctttccgcgctgaggaatctggctatcccggttatcaacaaagccaagatgctttccgcaggagtaaccgaagctgtgctgaagttccttaagtccgagatgcctccagtccagttcaaactgctcggaacgttgagaatgcttattgacgctcaggaagctgccgaacagttaggtaaaaatgtcaaactggtggagagacttgttgaatggtgtgaggcgaaagaccatgcaggagtgatgggagagtctaacagattactgagtgccctgattagacattcaaaaagtaaggatgtgataaaaacgatcgtgcagtcagggggaattaagcacctcgtaacgatggcaacatccgagcacgtgataatgcagaacgaagctcttgtagcactggcactgattgccgccctagaactcggcacagccgaaaaggacttggagtccgccaagctcgtgcagatcttgcacagactgttggctgacgaacgctctgcacctgaaattaaatacaactctatggtcctcatctgtgccttgatgggaagtgaatgtttgcacaaagaggtgcaggacctcgcctttctcgacgtcgtcagtaaactgaggtcacacgagaataagtctgtggcccagcaggcttcgctgactgagcagcgcctgacagttgaaagctag

SEQ ID NO: 202541 - DNA, 555 bp, Artificial Sequence
  Description of Artificial Sequence: Synthetic coding sequence
atgcgggagtacaagctggtggtgctgggcagcggcggcgtgggcaagtccgccctcacagtgcaatttgtgcagggcatcttcgtcgagaaatacgaccccacaatcgaggacagttaccggaagcaagtagaagtggatgcccaacagtgtatgctagagattctcgatactgcaggaacagaacaatttacggcaatgcgtgacctttacatgaagaatggccagggtttcgccctggtgtacagcatcacagcccaatcaactttcaatgatctgcaggacttacgtgagcagatcctgagggtgaaggatacggacgatgtgcctatgatactcgtcggaaataagtgcgatctggaggacgaacgcgtagtgggaaaggaacagggtcaaaacctcgcacggcagtggaacaactgcgcatttttggagagctctgctaaaagtaaaatcaatgttaatgaaattttctacgatttggtccggcagattaacaggaaaaccccagtgccaggaaaggccaggaagaagagttcctgccagctcctgtag

SEQ ID NO: 202542 - DNA, 555 bp, Artificial Sequence
  Description of Artificial Sequence: Synthetic coding sequence
atgcgggagtacaagctggtggtgctgggcagcggcggcgtgggcaagtccgctctgactgtgcagtttgtccagggcatcttcgtagaaaaatacgaccccacaattgaagacagctatcggaagcaggtcgaggttgatgctcagcagtgtatgcttgaaattctggacacagcaggaacggagcagttcactgcaatgcgggatctgtacatgaagaacggccaagggttcgcacttgtgtatagtatcaccgctcagagcacattcaacgacctgcaggacctgcgtgagcaaatcctccgcgttaaggacacagacgacgtaccaatgatactggtggggaataaatgcgatctggaagacgagagagtggtcggcaaggaacagggacaaaacctagcccggcagtggaacaactgtgctttcttggaaagcagtgccaagtccaagattaatgttaatgagatcttctacgatctggtgcggcaaattaacagaaagacgcccgtccccggcaaagctcggaaaaagtctagttgtcagttgctgtag

SEQ ID NO: 202543 - DNA, 357 bp, Artificial Sequence
  Description of Artificial Sequence: Synthetic coding sequence
atgcgggacctgtacatgaagaacggccagggcttcgccctggtgtactcaatcaccgcccagtccacattcaacgatctgcaggaccttcgagaacagatccttagggtaaaagacacggatgacgttcccatgatactcgtgggtaacaagtgcgaccttgaagacgagcgtgttgttggtaaggagcagggacagaacctggctaggcaatggaataattgtgccttcctggaatcatcggcaaagtctaagattaacgtgaatgagatcttttacgatctcgtgagacagatcaacaggaaaacccccgttcctggcaaggccagaaagaaatctagctgccagcttctgtag

SEQ ID NO: 202544 - DNA, 555 bp, Artificial Sequence
  Description of Artificial Sequence: Synthetic coding sequence
atgcgggagtacaagctggtggtgctgggcagcggcggcgtgggcaaaagtgcactgactgtgcagttcgtgcaaggaatctttgtcgagaaatacgatcccaccatcgaagactcttacagaaaacaggttgaggtggatgcgcagcagtgcatgctggagatacttgacacggctggtactgagcaatttaccgcaatgagagatctctatatgaagaatggccagggtttcgcgctcgtttattctattaccgctcagagtacctttaacgatctccaggacctgcgcgaacagatcctgcgggtgaaggatacagatgacgtgcctatgatcctggttggcaataagtgtgacctggaagacgaacgggtggtcggtaaggagcaagggcaaaacctggcacggcagtggaacaattgtgccttcctggagagcagcgccaagagcaaaatcaatgtcaacgaaattttttacgacttggtgcggcagatcaacaggaagacgcccgttcctgggaaagcacggaagaaatccagctgtcagctgttgtag

SEQ ID NO: 202545 - DNA, 99 bp, Artificial Sequence
  Description of Artificial Sequence: Synthetic coding sequence
atgcgggagtacaagctggtggtgctgggcagcggcggcgtgggcaaatccgccctgaccgtgcagtttgtgcagggtatcttcgtggagaaatactag

SEQ ID NO: 202546 - DNA, 429 bp, Artificial Sequence
  Description of Artificial Sequence: Synthetic coding sequence
atgcgggagtacaagctggtggtgctgggcagcggcggcgtgggcaagtcagccctggaacaattcactgccatgcgggacctatacatgaagaacgggcagggctttgcactggtgtatagcatcacggcccagtccactttcaacgacctacaagatctgagggaacagatattaagagtgaaggatacagacgatgttccaatgattctcgtggggaataagtgtgatttagaggatgaacgggtggtggggaaggagcagggtcagaacctggccaggcagtggaacaactgcgccttcctcgagagcagtgcaaaatctaaaataaatgtgaatgagattttctatgatctggtgcgacagataaatagaaagactccagtgcccggaaaggcccggaagaaatcatcttgccaactgctgtag

SEQ ID NO: 202547 - DNA, 384 bp, Artificial Sequence
  Description of Artificial Sequence: Synthetic coding sequence
atgcgggagtacaagctggtggtgctgggcagcggcggcgtgggcaaaagcgctctgacagtgcagtttgtgcaggggatatttgtggagaagtatgaccccacaatcgaggactcctataggaagcaagtcgaggtggatgcccagcagtgcatgctggagatcttagacacggctggaacggaacagttcacagctatgcgcgacctttacatgaagaatggtcagggcttcgctctcgtgtacagcatcacagcacaaagtactttcaatgacctccaagacttgcgggaacagattctaagggtgaaggacactgatgatgtccctatgatccttgtcggaaataagtgcgatctggaagacgaacgtgttgtaggctag

SEQ ID NO: 202548 - DNA, 429 bp, Artificial Sequence
  Description of Artificial Sequence: Synthetic coding sequence
atgcgggagtacaagctggtggtgctgggcagcggcggcgtgggcaaaagcgctctcacggtgcagttcgtacagggaattttcgttgagaaatacgatccgacaatcgaagactcataccgtaagcaggtggaagtcgatgcccagcagtgcatgctggagatcctcgacacagccggcaccgagcagttcaccgctatgcgggatctctatatgaaaaacgggcaaggtttcgcccttgtttacagtatcacagcccaatctactttcaatgacttgcaagaccttagggaacagattctgagagtgaaggacacagatgatgtaccaatgattttggtgggaaataaatgtgatctcgaagacgaacgtgtggtcggtaaggaacagggacagaatctggacaacggcaccactgtgcactcctag

SEQ ID NO: 202549 - DNA, 147 bp, Artificial Sequence
  Description of Artificial Sequence: Synthetic coding sequence
atgcgggagtacaagctggtggtgctgggcagcggcggcgtgggcaaaagtgcattgaccgtccagtttgttcaaggcatcttcgtggagaagtatgacccgactatcgaagacagctacagaaagcaggtggaagtggatgcatag

SEQ ID NO: 202550 - DNA, 36 bp, Artificial Sequence
  Description of Artificial Sequence: Synthetic coding sequence
atgcgggagtacaagctggtggtgctgggcagctag

SEQ ID NO: 202551 - DNA, 264 bp, Artificial Sequence
  Description of Artificial Sequence: Synthetic coding sequence
atgcgggagtacaagctggtggtgctgggcagcggcggcgtgggcaagagcgctctcacagtccagttcgtgcaagggattttcgtggaaaagtatgaccctaccatcgaggacagctacagaaaacaggtggaagtggatgctcaacagtgcatgctggaaatcttggacacagcggggacggagcaatttacagcaatgcgcgacctctacatgaaaaacggacaaggctttgctctggtgtactccatcactgcccaatag

SEQ ID NO: 202552 - DNA, 555 bp, Artificial Sequence
  Description of Artificial Sequence: Synthetic coding sequence
atgcgggagtacaagctggtggtgctgggcagcggcggcgtgggcaaatccgcactgacagtacagtttgtgcagggaatatttgtggagaagtacgaccccactattgaagacagttaccgcaaacaggtggaagttgatgcccagcagtgtatgttggaaattctcgacacggctgggacggagcagttcacagccatgcgcgacctttacatgaagaacggccaggggtttgccctggtttactctattaccgcccaatccacttttaacgacttgcaagacttgagagagcagatccttagggttaaggatacagatgacgtgccaatgattctggttggaaataagtgcgacttagaggacgagcgagttgtgggcaaggagcaaggacagaacctcgccagacagtggaataactgtgctttcttagagagtagtgccaaatctaagattaatgtgaatgagatcttctacgacctcgttagacagatcaaccgtaaaactccggttcctggcaaggcacgaaagaagtcctcctgccagcttctgtag

SEQ ID NO: 202553 - DNA, 306 bp, Artificial Sequence
  Description of Artificial Sequence: Synthetic coding sequence
atgcgggagtacaagctggtggtgctgggcagcggcggcgtgggcaaaagcgcactgaccgttcagtttgtccagggaattttcgtcgaaaaatatgaccccacaatcgaggactcttatagaaagcaagtggaagtggacgcccagcagtgtatgttagagattctagatactgccggcaccgagcaatttacagcgatgcgtgacctttatatgaaaaatggccaggggttcgcgcttgtgtactcaattacagctcaaagtacattcaacgacttacaggacctgcgcgagcaaatactctag

SEQ ID NO: 202554 - DNA, 162 bp, Artificial Sequence
  Description of Artificial Sequence: Synthetic coding sequence
atgcgggagtacaagctggtggtgctgggcagcggcggcgtgggcaagagtgccctgaccgtccagtttgtgcaagggatcttcgtcgagaaatacgacccgaccattgaggactcttacaggaagcaagtcgaggtcgacgcacagcagtgcatgctgtag

SEQ ID NO: 202555 - DNA, 429 bp, Artificial Sequence
  Description of Artificial Sequence: Synthetic coding sequence
atgcgggagtacaagctggtggtgctgggcagcggcggcgtgggcaagtccgcgttggagcaattcacagcaatgcgagacctgtacatgaaaaacgggcaggggttcgcgctggtttatagtatcacagcgcagtcgactttcaacgacctccaagacctaagggagcagatactccgggttaaggacaccgacgatgtacctatgattttagtgggaaataagtgcgatctggaggacgagcgggtggttggcaaagagcagggccagaatctggctcgccagtggaacaactgcgcctttctcgagtccagcgcgaagtccaaaattaatgtaaacgaaatcttttacgacctagtgcggcagataaacaggaaaacacctgtgcccggtaaggctcggaagaaaagttcctgtcaactcctgtag

SEQ ID NO: 202556 - DNA, 498 bp, Artificial Sequence
  Description of Artificial Sequence: Synthetic coding sequence
atgcgggagtacaagctggtggtgctgggcagcggcggcgtgggcaagtctgccctaacagtccagtttgtgcaaggcatttttgtggaaaagtacgaccctaccatagaagactcctatcggaaggagcagttcacagccatgcgggacctttatatgaagaacggtcagggattcgcgttggtctattcgattacagcccagtcgacattcaacgaccttcaagacctcagagagcaaatcttgagagtgaaagatactgatgacgtccctatgattctggttggtaacaagtgtgatctcgaagacgagagagtggtgggcaaagaacaaggtcagaatctggcccggcagtggaataactgtgccttcctggagtcgtctgctaaaagtaagatcaacgttaatgagatcttttacgacctggtacggcagataaatcgcaaaacccctgtcccaggcaaggccagaaagaaatctagctgccagctcctctag

SEQ ID NO: 202557 - DNA, 420 bp, Artificial Sequence
  Description of Artificial Sequence: Synthetic coding sequence
atgcgggagtacaagctggtggtgctgggcagcggcggcgtgggcaaatcagccctgacagtgcaattcgtacaagggatcttcgtagaaaagtacgatcccaccatagaggattcctatcgaaagcaagtggaagtcgatgcccagcagtgcatgttggaaattctggacacagctggtacagagcagttcaccgccatgcgcgatctctacatgaaaaacggccagggtttcgccctggtgtatagtatcactgctcaaagcacttttaacgacttgcaggacctccgagaacagattctccgagtgaaggataccgatgacgtacctatgatcctcgttggaaacaagtgtgacctggaagatgagagggtggtcggtaaggaacaggggcagaacctcgctcgtcagtggaattag

SEQ ID NO: 202558 - DNA, 282 bp, Artificial Sequence
  Description of Artificial Sequence: Synthetic coding sequence
atgcgggagtacaagctggtggtgctgggcagcggcggcgtgggcaagtcagccctcacggtgcagtttgtgcaggggatctttgtcgaaaagtacgaccccacgatcgaagatagctaccgaaaacaagtcgaggttgacgcacaacagtgtatgttagagattctcgataccgcaggcacagagcagttcactgccatgagggatctgtatatgaaaaacgggcagggtttcgccttggtctactccatcaccgcccagtccactttcaatgacctgtag

SEQ ID NO: 202559 - DNA, 36 bp, Artificial Sequence; identical to SEQ ID NO: 202550
  Description of Artificial Sequence: Synthetic coding sequence

SEQ ID NO: 202560 - DNA, 297 bp, Artificial Sequence
  Description of Artificial Sequence: Synthetic coding sequence
atgcgggagtacaagctggtggtgctgggcagcggcggcgtgggcaagtcagccctgaccgttcagttcgtccaggggatctttgtagagaagtacgaccccacaatagaagactcataccgcaaacaggttgaggtagacgcccaacagtgcatgctggaaatcctcgataccgcagggaccgagcagtttacagcgatgcgagacttgtacatgaagaatggccagggatttgctctggtgtatagcataacggcacagagcacgttcaatgacctacaggatctgagggagtag

SEQ ID NO: 202561 - DNA, 414 bp, Artificial Sequence
  Description of Artificial Sequence: Synthetic coding sequence
atgcgggagtacaagctggtggtgctgggcagcggcggcgtgggcaagagcgcactgaccgtacagttcgtgcaggggatcttcgtggagaagtacgaccccaccatcgaagatagctacaggaaacaggtggaagtggacgcccaacaatgtatgctggagatcttagataccgctggcactgtacccatgatcctggtgggcaataaatgcgacctagaggacgaacgtgtggtgggtaaggagcagggtcagaatctcgccaggcaatggaataattgtgcattccttgagtcttcggctaagtccaagattaatgtcaatgagatcttttatgatctggtgcggcagatcaatcgcaagacgcctgtgcctgggaaggcacggaaaaagtcatcgtgtcagcttttgtag

SEQ ID NO: 202562 - DNA, 357 bp, Artificial Sequence
  Description of Artificial Sequence: Synthetic coding sequence
atgcgggacctgtacatgaagaacggccagggcttcgccctggtgtactccatcacagcacagagtactttcaacgaccttcaagatctccgcgaacagatcctgcgagtgaaagacacagacgacgtgccgatgattcttgtcgggaataagtgcgacctagaagacgagagggtcgtaggcaaagagcaagggcagaatcttgctcgacaatggaacaactgcgcgttcttggagagcagtgccaagtcaaagattaatgtgaatgagatcttctacgatctggtccgacaaatcaatcggaagacacctgtacctggcaaggccaggaagaaaagcagctgtcaactgctatag

SEQ ID NO: 202563 - DNA, 369 bp, Artificial Sequence
  Description of Artificial Sequence: Synthetic coding sequence
atgcgggagtacaagctggtggtgctgggcagcggcggcgtgggcaaatccgccctaaccgttcagttcgtgcaggggatctttgtcgaaaagtacgatccaaccatcgaggactcttacagaaagcaggttgaggtggatgcgcagcagtgtatgctggagatcttagacactgccggcactgaacagtttaccgccatgagagacctgtacatgaaaaatggtcaaggttttgccctcgtgtactcaatcactgcacagtcgacattcaatgacttacaggatctccgggaacagatcctacgggtgaaggacacagacgatgtcccaatgatcctggttggaaacaaatgcgatctggaagactag

SEQ ID NO: 202564 - DNA, 258 bp, Artificial Sequence
  Description of Artificial Sequence: Synthetic coding sequence
atgcgggagtacaagctggtggtgctgggcagcggcggcgtgggcaaatccgcactgactgtacagtttgtgcagggcattttcgtggaaaagtacgatcccacgatagaggattcataccggaagcaggtggaggtggacgcccaacagtgcatgctggaaatactggacaccgccgggaccgaacagttcaccgccatgcgagacctctacatgaagaatggacagggcttcgcacttgtttacagtatcacatag

SEQ ID NO: 202565 - DNA, 552 bp, Artificial Sequence
  Description of Artificial Sequence: Synthetic coding sequence
atgcgggagtacaaggtggtggtgctgggcagcggcggcgtgggcaaaagcgccttgacagtccagttcgttacgggaacatttattgaaaaatacgatcctacgattgaggacttttatagaaaggaaattgaagtggactcgtctccctcagtgctagaaatactggacacagccggcacagagcagttcgcttcgatgcgggacctgtacatcaaaaacgggcagggctttattttagtttactcactagtgaatcaacagtctttccaggacattaagccaatgcgggaccagatcatccgcgtaaagcggtacgagaaggtgcccgtgattcttgtcgggaacaaagtggatctcgagtccgagcgagaagtgagctcttctgaaggcagggctttagccgaggaatgggggtgccctttcatggaaacctcagccaagtcgaagaccatggtggacgagctctttgctgaaattgtgagacagatgaactatgctgctcagccagacaaggacgacccttgttgctctgcttgtaatattcagtag

SEQ ID NO: 202566 - DNA, 1671 bp, Artificial Sequence
  Description of Artificial Sequence: Synthetic coding sequence
atgaacgagggcgcccccggcgacagcgacctggagaccgaggcccgcgtcccctggagtatcatgggccattgcctccgaaccggacaggcgcggatgtccgcaactcccactcccgcaggcgaaggtgctcgtcgggacgaattgtttggaattttacaaattttgcaccagtgtatcctcagctccggggacgcttttgtgctaaccggagtgtgctgttcttggcgacagaacggcaagcctccctacagccagaaagaggataaggaggtgcaaacaggttatatgaatgcccagattgaaattatcccgtgtaagatctgcggggacaaaagtagcggaattcactacggtgtgatcacatgcgaaggctgcaaaggattctttaggcgatctcaacagagcaacgccacctacagctgtccccgacagaaaaattgtcttatcgacagaacctcccgtaataggtgtcagcattgcaggctgcagaaatgcctggctgtgggcatgagtagagacgccgtgaagtttgggaggatgagcaaaaagcagcgggattccctttatgccgaggtacagaaacaccgcatgcaacagcagcagcgggaccaccagcaacagcccggtgaggcagaacctttaacccccacttacaatatcagcgcaaatggcctcacagagctacatgatgatctgtccaactatatcgacgggcacaccccagaaggaagtaaggcagacagcgccgtgtcatccttttatcttgacattcagccaagccctgaccagtctgggttggacataaacggtattaagcctgagcccatctgcgactatacaccggcctccggcttttttccatactgcagctttaccaacggagaaaccagtccaactgtgagcatggccgaactggagcacctggcccagaacatatccaagtcccacttggagacatgccagtacctcagagaagaactacaacagataacatggcagacatttctgcaagaggagatcgagaattatcagaacaagcagcgtgaagttatgtggcaattgtgcgctatcaaaatcacagaggctatccagtacgtagtggagtttgccaagcgcatagacgggtttatggagctgtgccaaaacgatcagatcgtgctgctgaaggcaggcagtctcgaggttgtctttattcggatgtgtagggctttcgacagccaaaataatacagtgtatttcgacggcaagtatgctagcccagacgtgtttaaaagcctgggctgcgaggactttatttcctttgtctttgagtttgggaaatcactgtgctccatgcacctcaccgaggacgaaatcgccctgttcagcgctttcgtgttaatgagtgcagacaggtcttggttgcaggagaaggttaagatcgaaaagctgcagcaaaaaatccagcttgcgctgcagcatgttctgcagaagaaccacagagaggacgggatcctaacaaagctgatatgtaaggtgagtacactgagagcattatgtggcaggcataccgaaaagcttatggcattcaaggctatctacccagatatcgtgagactgcactttccccccctctataaggaactgtttacgagcgagttcgaacccgcaatgcagatcgatggttag

SEQ ID NO: 202567 - DNA, 1647 bp, Artificial Sequence
  Description of Artificial Sequence: Synthetic coding sequence
atgaacgagggcgcccccggcgacagcgacctggagaccgaggcccgagtgccctggagcataatgggccactgcctgagaacaggccaggcccggatgtccgcaacccccactccagcgggcgagggggcgaggagctcttccacctgttcgagcttgtctcgcctcttttggtctcagctggagcacatcaattgggacggggctacagctaagaatttcatcaatctaagagagttcttttcgtttctgctgcccgcccttaggaaagcccagattgagatcatcccctgtaagatatgtggggacaagtcctctggtattcactatggcgttatcacatgcgaggggtgtaaaggattctttcgcaggagccaacagtccaacgctacctattcgtgtccacgccagaaaaattgtttaatagatcgaacatccaggaataggtgtcagcactgcagactgcagaaatgcctggctgtgggaatgagccgcgacgcagtcaaattcggcaggatgtccaagaagcagcgggattccctatacgccgaggtgcaaaagcatcggatgcagcagcagcaaagagaccaccaacagcaaccaggcgaggccgagcccttgaccccgacttataacatctcagccaacggtttaactgagttgcacgatgacctcagcaattatatcgacgggcatacacctgaaggaagcaaagctgacagcgcggtatcatccttttatcttgatatccagccttcgccagaccaatctggcctcgatatcaacggtatcaagcccgagcctatctgtgattacactccagcgtctggttttttcccctattgcagttttaccaatggggagacctctcccactgtgtccatggcagagctagaacatctagcgcagaacattagcaagagccatttagaaacatgccagtatttgagggaggaactgcagcagatcacgtggcagacgttcctgcaggaagagattgagaattatcagaacaagcagcgggaagttatgtggcagctgtgtgccattaagatcaccgaagcaatccagtatgtcgtcgagttcgcaaagcgcatcgatggtttcatggagctgtgccagaacgaccagatcgtgctgcttaaagcgggctcattggaggtggtttttattcgtatgtgcagagcctttgattcccaaaacaataccgtatattttgacggcaagtacgcaagtcccgatgtgtttaagagcttgggctgtgaggacttcatctcctttgtgttcgagttcggaaagagcctctgttccatgcacttgacagaagacgagattgccctgttttctgcctttgtgctgatgtcagccgacaggagctggctgcaggaaaaggttaagatagagaagcttcagcagaagatccaactggcccttcaacacgttctgcagaagaaccatagagaggacggaatacttacaaagctgatttgtaaggtctcaacactgagggctctatgtggccgccacactgagaagctgatggcatttaaggcaatataccctgatatagtcagattgcatttccctcccctgtataaggagctcttcacctcagaattcgaacccgctatgcagatagacggatag

SEQ ID NO: 202568 - DNA, 1572 bp, Artificial Sequence
  Description of Artificial Sequence: Synthetic coding sequence
atggagagcgcccccgccgcccccgaccccgccgccagcgagcccggctctagtggtgctgatgctgccgcgggaagccgggagactcccctgaatcaggagtcagctcggaaatccgagccacccgccccagtgcgccggcagtcctattccagcacatctagaggcatctcagtgacaaagaaaacgcatacatctcagatagaaatcatcccttgtaaaatttgtggcgataagagttcagggatccattacggcgtcatcacatgcgagggatgtaagggatttttccgaagatcacagcagtccaatgcaacatacagctgtcccaggcagaaaaattgtctgatcgacagaacatcacgaaacaggtgtcaacactgtagactacagaagtgtcttgcagtggggatgtctagggacgcagtcaagttcggccgtatgagtaaaaagcagcgggattcattatatgctgaggttcagaagcacagaatgcaacagcagcagagggatcaccaacagcaaccaggggaagctgaaccactgacgcctacttacaacatcagcgcgaatgggctgacagagcttcatgatgacctcagcaactatatcgacgggcacacccctgaggggagtaaggccgactcagccgtgtcatccttctacctagacattcagccaagcccagaccagtcaggcctcgacattaatggcattaaaccagaacccatctgtgactataccccagctagcggcttctttccctattgtagcttcacaaacggcgaaacatctcccactgtctcaatggctgagctcgagcatctagctcagaacatttctaaatcccaccttgaaacatgtcagtacttgcgggaagaactgcagcagataacatggcagaccttcctgcaagaggagattgagaattaccagaacaagcagcgtgaagtcatgtggcagttatgtgccatcaaaatcacggaggcaatccagtacgtggtagagtttgctaaacgcattgatggctttatggagctgtgtcagaacgatcagatagtgctgctcaaagcgggtagcctcgaggtggtcttcatcagaatgtgccgggcttttgactcacagaacaatacagtttactttgatggaaaatacgcaagccccgatgtatttaagtctctcggctgcgaggacttcatatccttcgtgttcgagtttgggaagtcactctgttctatgcatctgaccgaagacgaaatagccctctttagtgcctttgtgctgatgtcagccgaccggtcctggttgcaggagaaagtcaaaattgaaaagctgcaacagaaaattcaactggcactgcagcacgttctgcagaagaaccacagagaggacggaattttgacgaagctaatctgcaaagtaagcacactccgggctctttgcggccgacacacagagaagttgatggccttcaaagctatctatcctgatatcgttagactccacttccctccgctctataaggagttgtttacaagcgaattcgagcccgcaatgcagatcgatggttag

SEQ ID NO: 202569 - DNA, 1407 bp, Artificial Sequence
  Description of Artificial Sequence: Synthetic coding sequence
atgatgtacttcgtgatcgccgccatgaaggcccagatcgagatcattccatgcaagatctgcggggacaaaagtagcggtatccactacggcgtaatcacatgtgagggttgcaaggggttcttcagacgctcccagcaaagcaacgcgacctattcctgcccgcggcagaaaaattgtcttatcgaccggaccagccggaaccgatgtcagcactgtcggttgcaaaagtgccttgccgtgggtatgtcccgggatgcagtgaaatttggaagaatgagcaagaaacaacgagacagcctctacgccgaggtccagaaacatcgaatgcagcagcagcagcgggaccaccagcaacagcccggcgaagcagaacctctcacacccacatacaatattagtgccaacgggcttacagaattacatgatgatttgtctaactacatcgatggccacacccccgagggctcaaaagccgatagcgccgttagcagcttctacctggatatccagccttcccctgaccaaagcggcttagatatcaacggtataaagccggagcctatttgtgactatactccggccagcggcttcttcccctattgcagctttaccaatggagagacctcgccaactgtgtctatggccgaacttgagcaccttgcccagaacattagtaagagccacctggaaacctgccagtacctccgtgaagagcttcaacagatcacttggcagacgttcctacaggaagaaattgagaactaccaaaacaagcagagggaggtgatgtggcagctgtgcgctatcaaaatcactgaggccatacaatacgttgtcgaattcgcaaagcggatcgatgggtttatggagctatgccagaatgaccaaatcgttctgctgaaagctgggagtctcgaggtcgtatttatccgcatgtgccgcgccttcgactcgcagaataacacggtctattttgatggaaagtacgcctcacctgacgtgtttaagtcgctgggttgtgaggattttatctccttcgtcttcgagttcggcaaatccctatgttctatgcacctgacagaagatgaaatcgccctattttccgcgttcgtactgatgagtgccgaccgtagctggctacaggagaaggtgaagattgaaaaattgcagcagaagattcaacttgccctccaacacgttctgcagaaaaaccatagagaagacgggattctcacaaagctaatctgtaaggtttccactctacgagccctgtgtgggaggcatactgaaaagttgatggcctttaaggccatctacccggacattgtcaggttacactttccacctctatataaagaactgtttactagcgaatttgagcctgcgatgcaaattgatggctag

SEQ ID NO: 202570 - DNA, 1557 bp, Artificial Sequence
  Description of Artificial Sequence: Synthetic coding sequence
atggaccgggccccccagcggcagcaccgggccagccgggagctgttggctgcgaagaagacgcacactagtcagatagaggtcattccttgcaagatttgcggggacaaatcatcaggaattcactacggcgtgatcacttgcgagggctgtaaaggcttctttcggcgaagtcagcgatgcaatgcagcttactcctgtaccagacagcagaactgtcccattgatcggacctcccgcaataggtgtcagcactgtcgacttcagaagtgcttagctctcggcatgtcacgggatgctgtgaaatttggccggatgagtaaaaagcagagggatagcctccatgccgaggttcagaagcagctgcaacaaagacagcagcaacagcaggagccagtcgtcaagacacctccggcgggcgcccagggagcagacacattgacgtacacccttggcctccccgatgggcagctcccgttaggttctagccctgatctccctgaggcctcagcctgcccgcccggtcttcttaaggcctcaggctcgggaccctcatatagcaataaccttgccaaggcaggacttaatggtgcatcatgccatttggagtattctcctgaaagaggcaaagccgagggacgggagagtttctactcgaccggcagccaactgacacctgaccggtgtgggcttcgctttgaggaacaccgtcaccccggcctgggcgagctcggccaggggccagatagctacggcagtcccagcttccgctcaactccagaggccccctatgccagcctgacggagatcgagcaccttgtacagtctgtctgtaaaagttatcgagagacctgccaattaagattggaggatcttctccgacagaggagcaatatcttctcccgagaggaggtgaccggctaccagcgcaagtccatgtgggaaatgtgggaaagatgtgctcaccacctgacagaagcgatacagtatgtggttgagttcgcgaagcgactgtcaggcttcatggagctatgccaaaacgaccagatagtgctcttaaaggcaggcgctatggaagtcgttctcgtgaggatgtgtcgcgcttataatgcagacaatagaaccgtcttttttgagggcaagtacgggggtatggagctcttcagggctctgggatgctccgaactcatcagttccatctttgacttttcacatagcctgtccgccttacattttagcgaggatgagatcgcactgtatactgctctcgtgttgataaatgctcacaggcctgggctacaagaaaagcgtaaggtcgagcagctacagtataacctcgaactggcctttcatcaccacctgtgtaagacccataggcagagtatactagcaaagctcccaccgaaagggaaactgcgttctttgtgctctcaacatgtggaaaggctccagatatttcagcacttgcaccccatcgtcgtccaagcagcatttccacctctgtataaggaactgttctctacagagaccgaaagccctgtgggactgtccaagtag

SEQ ID NO: 202571 - DNA, 1494 bp, Artificial Sequence
  Description of Artificial Sequence: Synthetic coding sequence
atgcggacccagatcgaggtgatcccctgcaagatctgcggcgacaagtctagtggaattcattacggcgtgattacctgcgagggatgcaaaggattctttagaagatcccagagatgcaatgctgcttattcttgtacaagacagcaaaattgcccaatcgaccgcacttcgcgtaatcggtgccagcactgccggctacagaaatgtctagccctgggcatgagcagagacgctgtcaagttcggcagaatgagtaagaagcagagggactccctgcacgcagaggtccagaagcagctgcagcagagacagcagcagcagcaggaacctgtggtcaagacacccccggccggtgcccaaggggctgatacactcacatatacgctcggccttcctgacggtcagctgccattgggctccagcccagatctccccgaggcctctgcatgtcccccgggtttgctaaaggccagtgggagcggtccatcctatagcaataatcttgccaaggccggtctgaacggggcaagttgccatctggagtacagtcccgagagaggcaaagcagaaggtagagaatctttttactccacaggcagtcagctgactccggacagatgcggactcaggttcgaggagcaccggcacccagggctgggagagctgggccagggtcctgattcctacggctcccctagcttccggagcacccccgaggccccttatgcaagtctgaccgagattgaacatctggttcaatccgtgtgcaagtcttaccgggagacgtgtcagctgaggcttgaggacttgctacggcaacgctccaacatattttctagggaagaagtgacggggtaccagaggaaatcgatgtgggaaatgtgggaacggtgcgctcatcacctgacagaggccatccaatacgtggtcgaatttgctaagagattgtcaggattcatggagctgtgccagaatgatcagatagtgctgcttaaagcgggcgctatggaagttgtgttggtcagaatgtgcagggcctataacgcggacaataggacagtattcttcgagggcaagtatgggggtatggagttattccgcgccctcgggtgcagcgagctgattagctctatctttgatttttcccactcattatcggccctgcacttctcggaggacgagatcgccctatacaccgccctggtgcttatcaacgcgcatagaccaggcctacaagaaaaaagaaaggttgaacagctacagtacaacctggagcttgcttttcatcaccatctctgcaagactcatcgccagtccatcctggctaagcttcccccgaaagggaaactcagaagcctctgcagtcagcacgttgaaagacttcagattttccagcatctgcatcctatcgttgtgcaagctgcatttccgcctctatataaggaacttttcagtaccgagaccgaatcacccgtaggcctatcaaaatag

SEQ ID NO: 202572 - DNA, 1719 bp, Artificial Sequence
  Description of Artificial Sequence: Synthetic coding sequence
atgtggggcaccggccccagcgccggcaaggaccggatgagcggccggccttggcctcatccttggtcgaaatccggaaccccctctgagcaggaccgacgggcaaccgggctcgtgagttgcgagcacgggggaggcaaattcgaggggcagtcgcaccaggccccaggtcctccgggtggcggcaggacggggtgcttggaactcctggcagcaaaaaagactcatacaagccagatcgaagtgatcccttgtaagatttgtggagacaagagcagtgggattcactacggggtcataacatgtgagggctgcaagggtttcttcaggcgcagccaaaggtgcaacgcggcatacagttgcactcgccagcagaattgtcccattgatcgcacatcacggaaccggtgccagcattgccgtctacagaaatgtcttgcactgggcatgtcaagagatgcagttaagttcggccggatgagcaagaaacagcgggacagcctgcacgccgaagtccagaagcagttacagcagaggcagcagcagcagcaggaacccgttgttaagaccccaccagctggcgcacaaggggccgacacgctgacttatactctcggactccccgatggacagctgcccctgggcagcagccccgacctgccagaagcttccgcatgtccgcctggccttctgaaagcaagcggttctgggccaagctatagtaataatcttgctaaggcagggctgaacggtgcaagttgtcatctcgaatacagccctgaacgagggaaggctgaagggagggagagtttctactccactggttcccagctgacacctgacagatgcgggctgcggtttgaagaacatcgccatcccgggctcggcgagctgggccaagggcctgatagctacgggtccccgagttttcggtccactcctgaggctccttatgcctcccttactgagatcgagcacttggttcagtcggtgtgtaaaagctacagggagacctgccaactgcgtctggaagacttattgcggcagagatcaaacatattctctagagaagaggtcaccggataccagcgtaaatcaatgtgggaaatgtgggagcggtgcgcccatcatctgacagaagccatccagtatgtggtggagtttgctaaacggctatctggcttcatggagctgtgtcaaaacgatcagatcgtgctgcttaaagccggtgctatggaggtggttctggtgcggatgtgccgagcatacaatgctgataaccgcaccgtgttctttgaggggaagtacggcggcatggagttattcagagcactcggatgctccgagctaatctcatctatatttgacttctctcacagtctgagtgccttacatttttccgaggacgagatcgcgctttatactgcattggtcctgataaatgctcatcgcccaggcttacaggagaaacggaaggtagaacagctgcagtataatctggagctcgcctttcaccaccatttgtgcaaaacccacaggcagtctatcctggcaaagctcccaccaaaggggaagctgcgctccctatgtagccagcatgttgaacggttgcagatcttccagcatctgcatcccatagtggtccaggccgcctttcctcccctctacaaagaactgtttagtaccgaaacagaatcacctgtggggttaagtaaatag

SEQ ID NO: 202573 - DNA, 2835 bp, Artificial Sequence
  Description of Artificial Sequence: Synthetic coding sequence
atgctggacagcttcagccaggagagcaccctgcccttccgggaggctcggaaacgaacaagcttccagcctgttcaggtatggaggaatttcactgcctcgcaaacgactgagagccccgcctgtagtggggctagcctgggagagatgacggcttggaccatgggagcacgagggctggataagcgcggatcgttttttaaactcattgatactattgcatctgagatcggcgagttaaagcaggagatggtccggactgatgtgaacctcgaaaacggccttgaacctgccgaaactcactccatggtgcgacacaaagacggcggttattcggaggaggaggatgtgaagacgtgcgcgcgtgatagtggttatgacagcttgagcaatagactttccatcttggaccgcctcctgcacacacaccctatctggttacagctgtctttatccgaagaagaggcggccgaggtgctgcaggcgcagcctcccgggattttcctggtacataagtcgactaagatgcagaaaaaagttctctcactacggctgccttgcgagttcggcgccccactgaaagaattcgccataaaagaatccacctatacgttttccctggaggggtccggcatcagcttcgcagacctgttcagactgatcgccttctattgtatcagtcgggatgtgctcccctttaccctgaagcttccctatgccatcagcactgccaagtccgaagcccagcttgaagagttggctcagatgggactcaatttctggtcgagccctgccgactcaaagcctccaaacctgcctcctcctcacagacctttgtcatcagatggcgtttgccctgcctccttgcggcaactgtgcctaatcaatggcgtgcactccatcaagacaaggactccctcggagctggaatgttctcagacgaatggagccctgtgtttcattaatcctcttttcttgaaggtgcatagtcaggatctgtccggaggattgaaaagaccttcaactcgtacccccaacgccaatggcacggaacgtacccggtcgcctcctcctcgacccccaccgccagcgattaactctctgcatacaagtcccaggttggcgagaacagagacgcagactagcatgcccgagacggtgaatcataataaacatggcaacgttgcgctgccagggaccaagcctacaccaatccctccacctagactgaagaagcaagccagcttcctggaagctgagggtggcgctaagaccctaagcggcgggcggcccggtgcaggtccggaactggagctcgggacagccggaagcccaggcggggctccgcctgaggctgccccgggggattgcacacgcgccccccccccctccagtgagtcccgacccccttgccatggcgggcgccagagactttccgatatgtcaatttctaccagctcaagtgacagccttgaatttgacagaagtatgccactatttggctacgaagcagacaccaacagttcactcgaggattacgagggcgagtccgatcaagaaactatggcacccccaatcaaatccaaaaaaaaaagaagctcttctttcgttctgcctaagcttgtgaagtctcagctgcaaaaagtgtccggggttttcagctcttttatgacacctgaaaaacgcatggtgcgcagaattgccgagctgtctcgcgataaatgcacttacttcggctgcctcgtgcaggactatgtttcctttttgcaagagaataaggagtgccatgtgagctccacggacatgcttcagaccattcgccagtttatgacccaggtcaagaattacctgtcacagtcgagtgagctggaccctccgattgagtcacttatacccgaggatcagattgacgtcgtgctcgagaaggccatgcataaatgcattctgaagcccctgaaggggcacgtggaagctatgctgaaagactttcacatggccgacgggtcttggaagcaactgaaagagaacctacagctcgtacgccagcgaaacccccaggaactgggggtctttgcacccacacccgacttcgtagacgtagaaaaaattaaagtgaagttcatgacgatgcagaagatgtactctcctgagaaaaaggtgatgctcctccttcgcgtatgtaaactcatttacacggtcatggaaaacaacagcggtagaatgtacggtgccgacgattttctgccagtgcttacctacgtcattgcccagtgcgacatgcttgagcttgacacagagatcgaatacatgatggagcttcttgatccctccctgttacacggagagggcggttactatcttacatccgcctatggcgcactttctctgattaaaaacttccaggaggaacaggcggctagactgttatcctcagaaactagagacaccctgcggcagtggcataaacgccgcacaaccaaccggaccattccgagtgttgatgattttcagaattacctcagagttgcctttcaggaagtgaacagcggatgcactggcaagaccttgctggtcagaccttacattactacagaggacgtatgccagatttgcgccgagaaatttaaagttggcgaccctgaggaatattccctcttcttattcgtcgacgagacttggcagcagcttgccgaggacacttacccacagaaaatcaaggctgaactccactccagaccacagccccatatcttccacttcgtttataagcgcattaaaaacgatccttacggcatcatcttccagaacggggaggaggatctcacaacatcatag

SEQ ID NO: 202574 - DNA, 1389 bp, Artificial Sequence
  Description of Artificial Sequence: Synthetic coding sequence
atgaccgcctggaccatgggcgcccggggcctggacaagcggggctctttcttcaaactcattgataccattgcctctgaaatcggagagctgaagcaggaaatggtcagaaccgatgtgaacctcgaaaatggtctagaacctgcggagactcacagcatggtgcgccataaagatggcggttattccgaagaagaagacgtgaagacttgcgctagagatagcggctacgacagcttatccaaccggctgagcatcttggacagactgttgcacacccacccaatctggctccagctgtccctttccgaggaggaagccgccgaggtcctccaggctcagcctccgggcattttcctagtgcacaagagcaccaagatgcagaaaaaggtgctgagccttcggctgccttgcgagttcggcgccccactgaaggaattcgcaataaaggagagcacctataatgtcgtcctggaaaaggctatgcacaaatgcatcttaaagccactcaaagggcatgtcgaggctatgcttaaggactttcacatggccgatggttcctggaagcagctgaaggagaacctgcagcttgttcgtcagagaaatccgcaagaattaggagtttttgccccaactcctgattttgttgatgtcgaaaagatcaaggtcaagtttatgactatgcagaaaatgtacagtccggaaaagaaggtgatgctgctgctgcgcgtgtgtaagctcatctatacagtcatggaaaataattccggacggatgtacggcgctgatgattttctgcccgtgctaacctatgtgatagcacaatgcgacatgcttgaactggacaccgaaattgaatacatgatggagctgctggacccatcattgctacatggtgagggcgggtattacctgacatctgcttatggcgcgctgagcctgatcaaaaatttccaggaggagcaggccgcacggttgctctcctctgaaacgcgggacaccctgcggcagtggcacaagcggagaacgactaaccggacaattccctcagtcgatgatttccagaattatcttagagtggccttccaggaggtcaacagtggttgcactgggaagaccctcctggttcgcccgtatattacaacagaagatgtctgccaaatctgtgcagaaaagttcaaggtgggcgaccctgaagaatactctctctttctgttcgtcgacgaaacttggcaacaactagccgaagacacctaccctcagaagatcaaagcagagctgcattcaagaccccaacctcacatcttccactttgtgtacaaacggattaagaatgacccatacggcattatctttcagaacggagaagaggacctgacaacatcatag

SEQ ID NO: 202575 - DNA, 717 bp, Artificial Sequence
  Description of Artificial Sequence: Synthetic coding sequence
atgagcagcggctacagcagcctggaggaggacgccgaggacttcttctttaccgcccggactagcttctttcggcgtgcgccgcagggcaaacctagaagcggacagcaggatgttgaaaaggagaaggaaacacacagctatctgtctaaagaagaaatcaaggagaaagtccacaaatacaatctggcagtcacggataagctaaaaatgacccttaactccaatggtatctatacgggcttcattaaggtgcagatggagttatgcaaaccgcctcagacctccccaaattcagggaaactttccccctctagcaatgggtgcatgaacaccctgcacatctctagtacgaacacagtgggggaagtgattgaggcgctgctaaagaagtttttggtgactgaatccccggccaaattcgccctatacaagagatgtcaccgggaggatcaagtgtatgcctgcaaactgagtgatcgcgagcatcctctgtatctccgactcgttgcaggacctaggactgacactttatccttcgtgctccgagagcatgagatcggggaatgggaagccttctcccttccggagctccagaattttctgaggatcctagataaagaagaggacgaacaactgcagaacctgaagcgaagatacacagcctatcggcagaagttagaagaggctttacgggaggtatggaaaccagattag

SEQ ID NO: 202576 - DNA, 507 bp, Artificial Sequence
  Description of Artificial Sequence: Synthetic coding sequence
atgaccctgaacagcaacggcatctacaccggcttcatcaaggtgcagatggagctttgtaagcccccgcagacatcacccaactccggtaagctgagtcccagtagtaatgggtgcatgaacacactgcacatctcatcgaccaatacagtgggggaggtcatagaggccctccttaaaaagttcctggtaacggaatctccagctaagttcgccctgtataaacgttgtcatcgggaggatcaggtgtacgcttgcaaattgagcgatcgggaacacccactctatctgagactggtcgcaggccctcgtacagatactctgtctttcgtgctaagggagcatgaaatcggggagtgggaggcattcagtctgcctgaactccaaaactttctgaggatcttagacaaagaggaagatgaacagctgcagaacctcaaacgcaggtacaccgcgtacagacagaagctagaggaggctctgcgggaggtgtggaaacccgattag

SEQ ID NO: 202577 - DNA, 717 bp, Artificial Sequence
  Description of Artificial Sequence: Synthetic coding sequence
atgagcagcggctacagcagcctggaggaggacgccgaggacttcttttttacggcccggacttccttttttaggagagcgccccagggcaaacctcggtcgggacagcaggacgtagaaaaggaaaaggagacgcactcttatttgtctaaagaagaaatcaaagagaaagtacacaagtacaatctggccgttactgataaactaaagatgaccttgaactccaacggcatctatacagggttcattaaagtacagatggagctctgtaaaccaccacaaacctcacccaatagtggcaagttatcacccagctctaacggttgcatgaacaccttgcacatatcctccactaataccgtaggtgaggtgattgaagccctactgaagaaattcctggtaaccgaatctcctgccaaatttgctctctacaaacggtgccatagggaagatcaagtgtacgcctgcaaactgtctgacagagagcaccccctgtacttaaggctcgtggcaggaccgagaaccgacaccctttcttttgttctgcgcgagcacgagatcggcgagtgggaggcctttagcttgccagagctgcagaattttctgcggatcttggataaggaggaagacgagcagctacagaacctcaaaagacgttatacggcctacagacagaaactggaggaggcacttagagaggtgtggaagcctgattag

SEQ ID NO: 202578 - DNA, 1014 bp, Artificial Sequence
  Description of Artificial Sequence: Synthetic coding sequence
atgaccatgatggcccaccagtaccccagctggatcttcatcaacgagaagaccttcattactagggaacagctgaactccctcctcaagacctacaacatcttctacgagaaccaaaagaatttgcatattctgtatggcgagaccgaggacggaaaactaattgttgaaggcatgctcgatattttttggggcgtgaagcggccaattcagctgaaaattcaggacgagaagccattcagcagcttcacatcaatgaaaagcagtgacgtatttagctccaagggaatgacgcgttggggcgagtttgatgacttgtatagaatcagtgagctggaccgcacccaaattccaatgtctgaaaagcggaattcacaagaggactatctctcctatcactccaacactttaaagcctcacgcgaaagacgagcccgactcccctgttctgtacaggaccatgtcggaggccgcgctcgttcggaaacggatgaagcctttaatgatggatcgcaaggaacggcagaagaacagggcatcaatcaacgggcacttctacaaccacgaaacatccatcttcatcccagccttcgagtcagaaaccaaggtgcgggtgaatagcaatatgcgcacagaagaggtgattaagcagctgttgcagaaattcaaaatcgagaattctcctcaggactttgccctacatatcattttcgcaaccggcgagcagaggcggcttaagaagacagatatccctctcctgcagcgcttgttacagggtccgtccgaaaaaaacgcgcggatcttcctgatggacaaggatgccgaggagatctcatccgatgttgcccagtacattaatttccatttttcactgctcgagagtatactgcagcgattaaatgaggaggagaagagagaaattcagcggatagtgaccaaatttaacaaagagaaggccattatacttaaatgtctccagaacaagctagttattaaaacagagactaccgtgtag

SEQ ID NO: 202579 - DNA, 978 bp, Artificial Sequence
  Description of Artificial Sequence: Synthetic coding sequence
atgctgtgggaggagaccggcgccgcccccgcccccgcccgggccagtgatctcccctacaggatccatttcctgagctccggcctcattctggtgactcgccaattgaccgaggacggtaagcttattgtggaaggcatgcttgacattttttggggcgtgaaacgcccgatacagctgaaaatacaagatgagaagcctttttcttcttttacgtctatgaagtcttcggacgtgttttcttcaaaagggatgacccgctggggggaatttgatgacttgtacagaatcagcgagctagataggacgcagatccctatgagtgagaaacgcaacagccaggaggactacctatcctaccattccaacactctgaagcctcacgccaaagacgagccagacagccccgttctgtaccggacaatgtcagaggctgctctcgttcggaagagaatgaagccgctaatgatggatagaaaggagaggcagaaaaaccgggcctccatcaatgggcacttttacaatcacgaaacgtccatcttcatccccgcattcgagtcagaaactaaagtgagggtaaacagcaatatgcggaccgaagaagttataaagcagctgctacagaaattcaagatagagaattcaccccaggactttgccttgcatataatatttgctaccggggaacagaggagactcaaaaaaacagacatacctctgctccaacgactcctacagggaccgtcagagaagaatgcccgaatcttcctgatggacaaagacgccgaggagatttcttcagacgttgctcagtatatcaatttccacttcagcctcttagaatctatcctgcagaggttaaatgaagaggaaaagcgagagatccaacgaatagtgacaaaatttaacaaggagaaagctatcatcttgaagtgtctgcagaataagctcgttatcaaaaccgagacaacagtttag

SEQ ID NO: 202580 - DNA, 1110 bp, Artificial Sequence
  Description of Artificial Sequence: Synthetic coding sequence
atgctgtgggaggagaccggcgccgcccccgcccccgcccgggcctctgacctgccatacagaatctcttctgaccacctgaaaaaggaggaaaaaatgaccatgatggctcaccagtatcccagctggatcttcattaatgagaagacctttattacccgagagcagttaaattctcttttaaaaacctataacattttctacgagaatcaaaaaaacttacatattttgtatggcgagacggaggatggtaagcttattgtcgaggggatgctggatatcttctggggggtcaagaggcccatccagctaaagatccaggacgaaaaacccttttctagctttacctccatgaagtcatccgatgtgttttctagcaagggcatgactaggtggggagaattcgatgacttatatcgcatcagtgaactcgatagaactcagattccgatgtcagagaagcgcaatagccaagaggattacttgtcttaccactccaatacattgaaaccccatgccaaagacgaaccagatagtcctgtgctgtaccggacaatgtctgaagccgccctggtgcggaaaaggatgaaaccgctcatgatggaccgcaaggagcggcagaaaaaccgcgcgagcatcaatggccacttttacaaccacgaaacgagcatcttcatccccgcttttgaaagtgagaccaaggtgcgagtcaattctaatatgagaactgaggaagtgatcaaacagctcctccagaagttcaagatagagaatagcccacaagattttgcccttcatattatcttcgcaacaggcgagcaacgccggctcaagaagaccgatataccactgctgcagcggctgctgcaggggccgtcggagaaaaatgcacgcatcttcttgatggataaggatgcggaagaaatctcttccgacgttgcacaatacattaatttccacttctcattgcttgagtccattctccagaggctcaacgaggaggagaagcgcgagatccagaggatagtcacaaaatttaataaagagaaagcgatcattctgaaatgcctgcagaacaagctcgtgatcaagacagagaccaccgtttag

SEQ ID NO: 202581 - DNA, 912 bp, Artificial Sequence
  Description of Artificial Sequence: Synthetic coding sequence
atgaccatgatggcccaccagtaccccagctggatcttcatcaacgaaaagacctttattacccgtgaacagctcaacagcttgctgaagacatacaatatattttacgagaatcagaaaaacttacacatcctgtacggagagaccgaagatggcaaacttatagtggagggaatgctcgacatattctggggcgtgaagcgaccaattcagctgaagattcaggatgagaagccgtttagcagctttacttctatgaaatcttcagatgtgttctcatcgaaagggatgacgcgctggggggaatttgacgatctgtaccgcatatcagaattggatcgtacgcagatcccaatgagcgaaaaaagaaacagccaagaggattacctgtcttaccactccaacacattgaagccccacgcaaaagacgaaccggattcgccagtcctgtaccgaacaatgtcagaggcagcgttggtcaggaagcggatgaagcctctcatgatggacagaaaagagcgtcagaaaaatagggcaagcattaacggacatttttacaaccacgagatcgagaacagtccgcaagattttgcgttgcatattatcttcgccacaggtgaacagcgcaggctgaaaaagacagatattccactgctacagaggctgcttcagggcccgtcagagaagaatgcaagaatatttctgatggataaggacgcagaggagattagctcagacgtggcccagtacatcaacttccacttcagcctgctggaaagcatcctgcagcggctgaacgaggaggaaaaacgggagatacagcggattgtaacaaagttcaataaagaaaaagccataattttaaaatgcctgcagaataagctggtgatcaagaccgagactacagtgtag

SEQ ID NO: 202582 - DNA, 3141 bp, Artificial Sequence
  Description of Artificial Sequence: Synthetic coding sequence
atgctgagccggaccctgagctacaagtaccgggacctggacagcacctttagcagcttaggcgcatcagacgaccctgcagaactgagtacccagctgagcgcccccggagtgctgaaggtgttcggtgactctgtttgtactggtactcattataagagtgtgcttgccactggcacatcttcagcacgagagctggtgaaagaagctctcgaacgctatgcactggaccctagacaggctgggcagtacgttttgtgcgatgtagtcgggcaggccggagacgctggacaaaggtggcaggcacgctgttttcgcgtgttcggtgatagcgagaagcccttactgatacaggaactttggaagccccgcgaggggttatctagaagattcgaactgcgcaaacgctccgacgtcgaagaacttgcggctaaggaggtggacacaatcacggctggaattaatgcacaggcaagacggttacagcggtctcgcgctaagggtacacctacaccagccctgggtgatgcccggtcttcaccgccccctaggctcagacgcacagtgagcgaaactagccttagtcctgtgaatgctcttccagctgccgcacagggtcccgaggagcccggtcctgacgctatgcgatactctctttaccagtctccacatcttctattactgcaggggtattcccagcaacaccctggagtgtgtgcgcagcccggccctgcccacggaggaccagccgacccaagcaagcctagcatttcactcagcgctcctgacatcctgccattgcattgtaccatccgccgtcagccgctccccgatagcgggcaggccgcaggtcgactggtacttgaacccattcctggagcccacatctcagtgaactttagtgaggtcggtcaccggaccgtcgttctccatcacggtgacctgttgagcctgggactgtactatttgctactttttaaggatccggcacaggctcagcccctcccagcacgggcactagctcggctccgcgctgtgccccaaagctgtcgcttgtgcggagctgctctgggcgccagaggggccgcatcccccactcaggcggctctgccacgccggcaacagctcctgctcgagtttgagccccatctggaggacacactgctgcagcgtatcatgacactaatcgagcctggcggggacgatcacaagctgacacccgcgtttttgctttgtctgtgtatccagcacagcgccactcacttccagccaggtacttttggtcagctcctattgaagattgcgcggctgatccgggagaccgtgtgggagaagactaaagaattggctgaaaagcaagcacagttgcaggagccgataagcctggccagctgtgctatggcagacctggttcctgacttgcagcccattttgttctggatgagtaactctatagagctgctatatttcatccagcagaagtgtcccctgtatatgcagtctatggaagaacaacttgatatcactggcagcaaggaatctctgtttagttgcacactaacagcctcggaggaagccatggcggtactggaagaagtcgtgctgtatgcgtttcagcaatgtgtgtactatgtgtcaaagtctctttatatctgtctccccgcgctcctggaatgtccccccttccagacggaaaggagagagtcgtggtcatccgccccagagctgccagaagagctgagacgcgtcgtcagcgtctatcaggcagccttggatcttctgcgccagctccaagttcatcccgaagtggcttcacagatgctagcatatttgttcttctttagcggtacactgttacttaaccaactgctagaccggggaccttccctttcttgtttccattggccaaggggcgtccaggcgtgcgcccgacttcagcaattacttgagtggatgcggtcagctggcttcggcgcagccggtgagcacttctttcagaaactctcttgtacgctgaacttgctggcaacgccacgggcccagcttatccagatgtcctggaccgcacttcgcgcagccttccctgccctaagtcccgctcagcttcataggcttttgacccactaccagctcgcttctgcgatgggccccatgagcacctgggaacccggtgcacaggacagccctgaggcttttcgcagcgaggacgtgctggagagctacgaaaaccctccccccattgtactgccgagtgacgggtttcaggtggacctagaggcaaattgcttggacgattccatttatcaacacctcctatatgtccggcacttcctgtgggggctgcgtagcagggctagcccaggatctccaggccgaccaggcagtggcgcaagccagcctgtatgtcccgagggcatgcaccatgtggtactcgacggccacttggaggctccctcgtgcccactggccccaagagatccgggcccggcggcccgcgaagtagcccccgagcgtacattgcctcttagaggcgccccttgggcccaggctccccctggacggcagcctagtcgcggagggagccaggccggtcctccgcacaccgattcctcctgtctactgactccgccatccacaccgctggggccggagccaggggaccccgactggcctgagagcgggggaccctgtggcaaggcccttcccgaacgccaaagaaacggtctgtccggtttgcgcggagccgcccctgaaggagacagcgcagctctcgctgaagaatccccacccgcccccagttccaggagtagcagcacagaggatttttgttatgtgtttaccgtggaactggaacgaggaccatccggactgggtatggggctgatcgacgggatgcacacccacctcggggcccccggtctctacatccagacgctccttccagggtctcccgcagccgccgatggacgcctctcattgggggataggattctcgaagtcaacggatcaagcctcctcggtttagggtacctcagagcggtggatctgatcaggcacggggggaaaaaaatgagattcctggtagccaagagtgatgttgaaactgccaaaaagattcatttccgcactcccccattatag

SEQ ID NO: 202583 - DNA, 3228 bp, Artificial Sequence
  Description of Artificial Sequence: Synthetic coding sequence
atgttctacggcacccacttcatcatgagcccccccaccaagagcaaacttaagaggcagtctcagttgctttcgagcatgctaagtaggacgctttcctacaaatacagggatctggactcaactttctcgagtcttggggctagcgatgatcccgccgagcttagtacacaactcagtgcacctggcgtcctcaaggtgttcggtgattccgtctgcaccggtactcattataagtcagtactcgcaactggaacctctagtgcaagagagcttgtaaaggaagctctagagcgctacgcattagaccctcggcaggcagggcagtatgtcttgtgtgatgtcgtgggacaggccggggacgctggacaacgctggcaggccaggtgcttccgggtgtttggggacagcgaaaagccgcttcttatacaggaactgtggaaaccaagggagggacttagcagaaggttcgaactgagaaaacgtagcgacgtggaagagctcgcggcaaaggaggttgataccatcaccgcgggaattaacgctcaggctagacgacttcagagaagccgtgcaaaaggaacacctaccccagcattgggggacgcacggagtagccctccgcccagactgcggcggactgtgtcagagacttcgctgagccccgtcaatgcactgcccgcagctgcccagggcccggaagagcctggaccagacgcaatgcgctattcgctgtaccaaagtccccacctgctgctgctccagggctactctcagcaacatgacagcttggtgtacgtcctgaatagggaccggcatacagtgggtcaaaggaccccgtcatccaagccttctatctccctgagcgctcctgatattctgccgcttcactgtactatccgacgtcagccccttcccgattcaggtcaagctgcaggtaggctagtcctcgagccgatcccgggcgcgcacatctccgtgaacttttcagaggtaggacacagaaccgtcgtgctacatcatggcgacttgctgagtctggggctctattacctgctcttattcaaggatccagctcaggcccaaccactgcctgcccgcgctctggcaaggctgagagcggtgccccagtcttgccgcctctgtggcgctgccctcggcgcccgcggggctgcaagtcccacccaggctgcactgccacgaagacaacaactgctgctcgagtttgaacctcatctggaggatacattgttacaacggatcatgacgctgatcgaacctggaggagacgaccacaagctgacccccgcttttcttctgtgtctttgtattcagcacagcgccactcattttcaacctggcacatttgggcaactcctcctcaagattgcaaggcttattagggagactgtctgggagaagacaaaggagctagccgagaagcaggctcagctccaggagcctatctctttggcatcctgcgcgatggctgatcttgtgcccgatctgcagccaatcctcttttggatgtctaacagtatcgaactcctttacttcattcagcagaaatgcccactctatatgcagagcatggaggaacagttggatatcacgggcagcaaagagtcactcttttcttgtacgctgacagcctcagaggaagctatggccgtgctggaagaggtggttctttatgcgttccagcaatgtgtctattatgtgagcaaaagtttgtacatatgtctccctgcattgctcgagtgccccccatttcagacagaacggcgtgagagttggagctccgcccctgagctgccagaagaactcaggagagtggtctctgtgtaccaggccgcactggatctcctgaggcagctccaggtccacccggaggttgctagccagatgctggcctatctgtttttttttagtggaacactgctgcttaatcaactgctcgaccgggggccatcactgtcatgctttcattggccccgcggcgtccaggcctgcgctcgcctacagcagctgctggagtggatgcggtccgcagggttcggagccgctggagagcattttttccagaagttaagctgcactttaaaccttctggcaacccctagagcccagctgattcagatgtcttggaccgctttgagagccgccttccccgccctgagcccagcacaactacataggttgcttacacattaccagcttgcctccgccatgggtcctatgagcacatgggagccaggcgcccaggatagcccagaggcctttaggagcgaagacgtcttggagagctatgaaaacccaccccccattgtccttccttcagacggtttccaggtggaccttgaagcaaattgcttagacgacagtatataccagcacctcttgtacgttagacatttcctgtggggactgcgttctcgggccagcccaggctcccccggccgtccagggtccggtgccagccagcccgtgtgccccgagggcatgcatcatgtggtgctggatggccatttggaagctcctagctgtcctttagcaccgcgagatccaggccccgccgctcgtgaagtggcaccagaaaggactttgccactgcggggagctccctgggcacaggcaccgcccggtcgccaaccaagcagaggaggttcccaagccggcccaccacacacagatagtagctgcctcttaacaccaccaagcactcctctcggccccgagccaggagaccctgattggcccgagtctgggggaccttgtggaaaagcacttcccgaacgtcagagaaatggtctgagtggtctcagaggagccgctcctgagggggatagcgccgctctcgccgaggagtccccacccgcaccttcttctaggtccagttcaacggaggatttctgttatgtgttcacagtagagcttgaacggggcccttccgggctgggcatgggcctgattgacggaatgcacactcatttaggcgcgccaggactctatatacaaaccttgctgcctggctccccggctgctgctgacggccgactttcgctgggtgacagaattcttgaggtgaatggctcctctctgctggggctcgggtatctgcgagcagtcgatttgatacgtcatgggggcaagaaaatgcgtttccttgtggcaaaatccgacgttgagaccgccaaaaagatccatttcagaactccaccactttag

SEQ ID NO: 202584 - DNA, 405 bp, Artificial Sequence
  Description of Artificial Sequence: Synthetic coding sequence
atgttctacggcacccacttcatcatgagcccccccaccaagagcaagctgaaacgacaaagccagcttctgtcatctatgctgagtcgcaccctgtcatataagtaccgggatcttgacagtaccttttcatccctgggagcttccgatgatccagccgagctgtcaacccagctgagcgcccccggggtgttgaaagtcttcggagattccgtttgtacgggtacccactacaagtccgttctggccactggcacctcttccgccagggagctggtcaaggaggcgttggagcgatatgcactagatcccagacaagcaggacagtatgttttgtgtgacgtggtcggccaggcgggggatgcagggcaacgatggcaagctcgatgtttccgggtcttttag

SEQ ID NO: 202585 - DNA, 1629 bp, Artificial Sequence
  Description of Artificial Sequence: Synthetic coding sequence
atgttctacggcacccacttcatcatgagcccccccaccaagagcaaactgaaacggcagagtcagctattgtctagcatgctgagccgtacacttagctacaaatacagggacctggattccacctttagtagtctcggggcgtccgacgacccagcggaattgtccactcagctgagcgcacccggggtcctgaaggttttcggcgattccgtatgtaccggcacccattacaagtccgtcctggccaccggaacctcgagtgcgagagagttggtgaaagaagcccttgaacggtacgccttggatcctaggcaggccggacagtatgtgctgtgtgacgtcgtggggcaagctggtgacgcgggccagaggtggcaggcacgttgcttcagggtttttggtgactctgagaaacctctgcttattcaggaattgtggaagccaagggagggactgtccagacgctttgagctgcgcaagaggagtgatgtggaagagctcgcagccaaggaagttgacactatcaccgcaggaatcaatgcccaggctagaagactccagcggtcgagggccaaggggacaccaaccccggccctaggcgacgctcgaagcagccctccccctagattaaggcggaccgtgtctgaaacgagcctgtccccagtgaacgctcttccggcggcagctcagggtccagaggagcctggcccagacgccatgcgatactcgctatatcagagccctcatttactgctgctgcaaggctatagtcagcagcacgacagtctggtgtacgtactgaaccgtgacaggcacacagttggtcagaggaccccaagttcaaaaccatctatttcgctgtcagctcctgatattcttcccctgcactgtacaatcaggcggcagcccttgcctgatagtggacaggccgccggcaggctggtgttagaaccgattcctggcgcccacatctccgttaacttttctgaggtggggcacaggacagtagtgctgcaccacggcgatctgctctctctcggactatactacctgctccttttcaaagatcctgcccaggctcagcccctgccggccagagctctagccaggctacgggcggtaccgcagagttgtaggctgtgtggagcagcactgggcgcgaggggcgcggccagccctacacaagcggcattaccacggcggcagcaactacttctcgagttcgagccacacctggaggatactctcctgcaaagaatcatgaccctgattgagcctgggggggatgaccataaacttacgcctgccttccttctctgcttgtgcatacagcacagcgctactcacttccagcctggcacctttggccaactcctgcttaaaatcgctcgcttaattagagaaacagtgtgggaaaagactaaggaactggcagagaaacaggcccagctgctggagggcatcgccgtgcttctacacgccgacgggcagaggggcgggcatggaggagctggcggcggtggcgcggttagactgccagccgtacggctgctctgtctgcaggtccctgtgcatttgccccctgggaccccgggggtgcccgcaattcccgacggagctccctag

SEQ ID NO: 202586 - DNA, 2508 bp, Artificial Sequence
  Description of Artificial Sequence: Synthetic coding sequence
atgcggtacagcctgtaccagagcccccacctgctgctgctgcagggttactcacagcagcacgattccctggtgtacgttctgaaccgcgacaggcatacggtggggcagcgcacacccagctctaagccatctatcagtctttcggcccctgacatcctgcctctgcattgtaccataaggcggcagcctctgccagattcaggtcaagcggccgggagactcgtgttggaacccatccctggagcccatatttctgtgaatttcagcgaagtaggtcatcggaccgtagtccttcatcacggggacctcctgagtctcggcctttattaccttttgctttttaaagacccagcacaggctcagcctctgcctgctagagcactagctaggctgcgggcagtcccacaatcttgtcgcctctgcggggccgcattgggcgcacgtggcgccgcttctcctacacaggctgccttacccaggagacagcagctccttctcgagttcgagcctcatctcgaggacactctgctgcagcgtatcatgacactcatcgagcctggaggcgacgatcataagcttactcccgccttcttattgtgcctctgtattcagcactccgcgacgcactttcagcctgggactttcgggcaactcctactcaagatcgcgcgcttgatcagggagacagtgtgggaaaagaccaaggagctggccgagaagcaggcccagctccaagaaccaatcagcctcgctagctgtgcaatggcagacttggtccctgatttgcagcccattctgttctggatgagcaactcaatcgaacttctctactttatccagcagaagtgtcccttatatatgcagtctatggaagaacaactggacattaccgggtccaaggaatccttgtttagctgcacgctgacagcgagtgaggaggctatggccgtattggaagaggtggttctgtacgcgttccagcagtgtgtctattatgtgtctaaatctttgtacatttgcctcccggcgcttctggaatgccccccatttcagactgagaggagagagagttggagctcagcccctgaactgccagaagagctgagacgggtcgttagcgtgtatcaggcagccctggatctacttagacaactgcaggtgcatcccgaggttgcgagccagatgctcgcctaccttttttttttctctggaacactgttgttgaaccagctgttagaccgtgggcccagcctgtcgtgctttcattggcccagaggcgtccaagcatgcgccagattgcaacagctcctggagtggatgagaagtgctgggttcggggccgcgggtgagcatttctttcagaagctgagctgcaccctcaatctgttagccaccccacgcgcacagcttatccagatgtcctggacagccttaagggcagcctttccggctctgagccccgcacaacttcatcgactgcttactcattaccaactcgctagcgcaatgggacctatgtccacttgggaaccaggcgcccaagattctcccgaagcttttcggagtgaagatgtcttagagagctacgagaatcctccaccaatcgtgctgcctagtgatggctttcaggttgatctcgaggccaactgtttggatgatagtatataccagcacctcctgtacgtgagacactttttatgggggctgcggagcagggcctcacctggctctccaggtcgtcccgggagtggagcttctcagccggtctgtccagagggtatgcaccacgtcgtgctggacggacacctcgaagctccgagctgccccctggctcctcgggaccctgggcccgcggcccgagaggtagcgccagaacgcaccctgcccctaagaggagcgccctgggcccaagcaccacccggccgccagccatctagaggcgggagtcaagccggtccccctcacactgactccagttgcctcttaacccccccctccacccccttgggtcccgagcccggcgatcccgactggcccgagtcaggcggcccatgcgggaaggcgctcccagagaggcagcgcaatgggctgagtggtctgcgcggtgcagcccccgagggtgacagtgctgccctggcagaggaaagtcctccggcaccttcttcccgctcatcctctacggaagacttctgttatgtcttcacagtggagttggagcgggggcctagcggactgggcatggggttgattgacgggatgcatacacacctcggcgccccaggtctctacatccagacactgttacccggcagcccagccgcggccgatggtcgcctgtctttgggggaccggattctggaggtgaacgggtccagcctgctcgggcttggctatctgcgggccgtggacctgatacgtcacggtgggaagaagatgcgatttctcgtggctaagtctgatgttgagaccgctaaaaagattcatttccgtaccccaccactatag

SEQ ID NO: 202587 - DNA, 2085 bp, Artificial Sequence
  Description of Artificial Sequence: Synthetic coding sequence
atgtgcagcaccggcaccggcacccggtgggccagcggccccccccccgcttccccagcctctgcctcccaacctccaacgtcttgcctgtacacagctccctccgccggtaaccggtcaaggactgccgctcgccctagaggcggatggctggagcccatccctggggctcatatctctgttaacttttcagaagtcggccatcggaccgtggtgctccatcacggtgacctccttagcctgggattgtattatctcctgctgttcaaagatccagctcaggcacaaccgctgcccgctagagcactggctagactccgggcagtacctcaaagttgtcgactgtgcggcgccgccttgggagccaggggggctgcctcccccacacaggcggcactgccacgcaggcagcagctcctacttgaattcgagcctcacttagaggatactttgcttcaacggattatgacgctgatcgaaccggggggagacgaccataagctcactcctgccttcctgctgtgcctgtgtatccaacatagtgctacacacttccaacctgggaccttcggccaactactcttgaagatcgcccggttgattagggaaactgtctgggagaaaactaaggaactggcagaaaaacaggcacagctccaagagccaatttccctggcatcctgtgccatggccgacctagtgcctgatctccagcccatcttattttggatgagcaattcaattgagctcctgtattttattcaacagaagtgtcctctgtatatgcagtccatggaggagcaacttgacattacaggatcaaaggagagtctattttcctgcacgctcacagcctccgaggaagccatggccgttctcgaggaagtcgtgctgtatgcttttcaacagtgtgtctattacgtgtcaaagagcctgtatatctgtttgcccgccctcctcgagtgtcccccattccagacagaaaggcgggagagctggtccagcgcacccgagctgccagaagagcttaggagggttgtctccgtatatcaggcggcactggacctacttcgacaactccaggtgcacccagaagttgcgagtcagatgcttgcatacttattctttttttctggaactctgctgctgaaccaactcctggataggggccctagtctctcctgtttccattggcctcggggagtgcaagcatgtgcacgccttcagcaactcctggagtggatgcggtctgcgggttttggagctgctggggagcacttctttcagaagctgagttgcactctgaaccttttggcaacaccaagagcccaactgatccaaatgtcttggacagctctgagggccgctttccctgcgctgagccccgctcaactgcaccggctgctcacccactatcaactggcctccgccatgggaccaatgtccacttgggaaccgggtgcacaggattcacccgaagcgtttcggtccgaagacgtgctggaatcctacgagaatccaccacccattgtgctcccttcagacgggtttcaggtggacctcgaagccaattgtctcgacgactccatctaccagcatctgctgtacgtgcgccattttctgtggggattaagatcccgtgcgtcgcccgggagtcccggtagacccgggtcaggtgcttcccaacctgtatgtcccgaagggatgcaccacgtcgttttggacgggcacttggaagccccgtcttgcccattagctcccagagatcccggtccagcagctagagaggttgccccagaacgcactcttcctctgcgtggggcgccatgggcccaggcacctccaggaaggcagcctcccggcctatatattcagacactcctgccgggatcccccgctgcggccgacggacgtttgagcctaggtgatcgaattctcgaggtcaacggatcttctctgctgggcctagggtacctcagagctgtggacctgattagacacggtgggaaaaaaatgcggttccttgtggccaagagcgatgtggagacagccaaaaagatccactttcgcactcctccactgtag

SEQ ID NO: 202588 - DNA, 369 bp, Artificial Sequence
  Description of Artificial Sequence: Synthetic coding sequence
atgaagctggccgccatgatcaagaagatgtgccccagcgacagcgaattgtcaataccagcaaaaaactgttataggatggttattctcgggtcttccaaagtcggaaaaaccgccatcgtgagccggtttttaaccggacggttcgaggatgcttacacaccgacaattgaggactttcacagaaagttttatagcatcaggggagaggtttatcaactcgatattctggacactagtggaaatcacccattccctgctatgcgacggttaagcatattaactgaccctcgccaccaggtgcttccccaagagcaaaaccagggtgaaagaggaagggccccggggcaccttcgacagcaggggtag

SEQ ID NO: 202589 - DNA, 2394 bp, Artificial Sequence
  Description of Artificial Sequence: Synthetic coding sequence
atgggcaccctgggcaaggcccgggaggccccccggaagcccagccatgggtgtagggctgcgtcaaaagcccggctcgaggccaagccagccaactcgccatttccgtcgcacccatcactggcccatataacgcagttcagaatgatggtgtcattgggacacctcgccaaaggagccagtctagacgatcttattgattcttgcatacagagcttcgatgcggatggaaatttgtgccggagcaatcagcttctgcaagtgatgctaacaatgcaccgtattgtgatctcaagcgcagaactgttgcagaaagtcatcaccctctacaaggatgccctggcaaagaattccccagggctctgcttgaaaatatgttactttgttcgctactggatcactgagttctgggtgatgttcaaaatggatgcatcactgacagacaccatggaagagttccaggaactggtcaaagcaaagggcgaagaactgcactgtaggctgattgatacgacccagataaacgcccgagactggagtagaaagctgacccaaagaattaagagcaatacaagtaaaaaaagaaaagtgagtttattatttgatcatctcgaaccagaagagttaagcgagcacctcacgtaccttgagtttaagagcttccggagaataagcttcagtgactaccagaactacctggtgaactcctgtgtcaaagagaatcccaccatggaacgcagcatagccttgtgcaatggtatctctcagtgggtccaacttatggtattatctcgcccaaccccacagctccgggctgaagtgttcattaagtttatccaggtggcccagaaactgcaccaactgcagaacttcaacacactgatggccgttattggtggcctgtgccatagctccatcagccgactcaaggaaacaagctcccacgtgccacacgagattaataaagtgctgggtgagatgaccgaactcctcagtagttccagaaactacgacaactataggagagcttacggcgagtgtacggatttcaaaatcccaattttgggggttcacctcaaagatttgatctccctgtatgaggcaatgccagattatcttgaagacggaaaggtgaacgtgcataagctactcgcgctatacaaccacataagtgaactggtccagctgcaagaagtggccccacctctggaggccaacaaggatctggtgcacctgctgacactgtcgctggacctctactataccgaagatgagatctatgaactgtcatatgcccgggagccccggaaccaccgggcgccccccctcacaccatctaaacctccagtggtggtagattgggcatctggcgtgtcccccaaacccgacccaaaaactatctcaaagcatgtgcagagaatggttgacagtgtgtttaaaaactatgaccacgaccaggacgggtacatctcgcaggaagagtttgagaagatcgcagcatcttttccattctctttttgcgtgatggacaaagatagggaaggtcttatttcccgcgacgagattacagcctacttcatgagggctagcagtatttacagcaagctgggcctcggcttccctcacaatttccaggaaactacttatctgaaacctaccttctgtgacaattgtgcaggcttcctttggggagtgatcaagcaaggctatcgttgcaaagactgtgggatgaactgtcacaagcagtgcaaggatttggtagtgttcgaatgcaagaagagagctaagaatcccgtggcccctactgagaataacaccagcgtggggcccgtttccaacctttgttctttaggggcaaaggacttactgcacgcgcctgaggagggtccattcaccttcccaaacggtgaagccgtggaacacggcgaggaatctaaggaccgcacaataatgctgatgggtgtctctagccagaaaatatcgttacgactaaagcgcgccgtggcccataaagcaacacagacagagtcccagccttggatcggatccgagggccccagcggccctttcgtcctatcttctccccggaagacagcacaggacacactgtacgtccttccttcacctacatccccctgtccgagcccagtgctggtaagaaaacgagcttttgtcaagtgggagaataaggattctcttatcaagtctaaggaagagctccgacatttgagactgcccacttatcaggaactcgaacaggagattaacacacttaaggcggacaatgacgctctgaaaattcagttaaaatacgcccagaagaagatcgagagtctccaacttgagaagtccaaccacgtcctggcacagatggagcaaggagactgctcatag

SEQ ID NO: 202590 - DNA, 1794 bp, Artificial Sequence
  Description of Artificial Sequence: Synthetic coding sequence
atgggcaccctgggcaaggcccgggaggccccccggaagcccagccacggctgccgtgctgcaagcaaggcaagattagaagctaagcccgcaaactcccctttcccctcacaccccagtctcgcgcatattactcagtttcggatgatggtcagccttggccatcttgcaaagggtgcaagcttggacgacctgattgatagttgcatccagtcctttgacgcagatgggaatctttgccggtcgaatcagctgctgcaggtcatgctgacaatgcatagaatcgtgatcagtagcgccgagctgctccaaaaggtgataactctgtatcctgacgccctggcaaagaattctccggggctctgtctcaaaatctgttatttcgtgaggtactggataaccgaattttgggtgatgtttaagatggatgcgagcttgaccgacacaatggaagaattccaagaactagtgaaagcaaaaggcgaggagctccactgtagactcattgacaccactcaaattaacgcgcgtgactggtctcggaagctgacccaaagaatcaagtccaatacatcaaaaaaacggaaggtgagtctcctgtttgatcatctggagcccgaagaacttagtgagcacctaacatacctggagtttaaaagctttcgccgcatttcattttcagattatcaaaactacttagtgaattcctgtgtcaaggaaaaccctaccatggagaggtcaatcgcactgtgtaatgggatcagtcagtgggtgcagctcatggtactgtcccgcccaactcctcagttgcgtgccgaggtctttattaagttcattcaggtggcacaaaaacttcatcaactgcaaaattttaacacgctgatggccgttatcgggggcctctgccatagcagcatctccagactgaaagaaacctcctcacacgtgccacatgaaatcaacaaggttcttggagagatgaccgagcttctctcatcgtcgcggaactacgacaactataggagagcctacggcgagtgcaccgatttcaagattcctatactgggtgtgcatctgaaagatctcattagtttgtatgaggcaatgcccgactatctggaagatggaaaggttaacgtacataagcttcttgccctgtacaaccatataagcgagctcgtacaactgcaggaggtggcacctcctctggaggccaacaaagaccttgtccacttgctgacgctgtcgctggacttgtattatacggaggatgaaatatacgagctctcctacgcacgggagccacggaaccaccgtgctcctagtgtatttaagaattacgatcacgatcaagacggctacatttcccaggaggaatttgagaagattgcagcaagcttccctttttccttttgtgtgatggataaagatagagagggactcatttctcgcgatgagattaccgcttattttatgcgggcctcaagcatatatagcaaattgggcctgggctttccgcacaacttccaggagactacctatctcaagcctactttttgcgacaattgtgccggatttctgtggggcgtcattaagcaagggtatagatgcaaggactgtggaatgaactgtcataaacagtgtaaagaccttgtggtgttcgagtgcaaaaagagagcgaagaaccctgtggcgccgacggagaacaatactagcgtgggtcctgtcagcaatctgtgctccctaggagcaaaagatttactgcacggtaacaaatacagcgaaagccgctag

SEQ ID NO: 202591 - DNA, 1641 bp, Artificial Sequence
  Description of Artificial Sequence: Synthetic coding sequence
atgggcaccctgggcaaggcccgggaggccccccggaagcccagccacggttgcagggcagcttcaaaagccagactggaagcaaaacccgccaactccccctttcccagtcatccctccctcgctcatatcacacaattcagaatgatggtctccctgggccacctggctaaaggagcaagcctcgacgacctgatcgattcctgcatccagtcttttgacgccgatggcaatctctgcagatctaatcagctgctccaggtcatgcttaccatgcaccggatcgtgatttcgagcgccgaattgcttcagaaagttattacgctgtacccagacgctctagcaaaaaacagtcccggactctgcctgaaaatctgttatttcgtgagatactggattactgaattttgggtgatgtttaagatggacgcgtctttaactgataccatggaagaattccaggaattggtcaaggctaagggggaggagctccactgccgactgatcgacaccacacagattaacgcgcgagactggtctcggaaactcacccagcgtattaagtccaacacgtctaaaaagcggaaggtttctctgctatttgatcatctggagcccgaagaactctcagagcacctcacttacctcgagtttaaaagttttcggcgcatctccttcagcgattaccagaactatcttgtgaattcctgtgtcaaagaaaaccccaccatggaaagatccatcgccttgtgtaatggtataagccagtgggtacaactgatggtgttatcacggcctaccccacaactacgagccgaggtgttcattaagtttatccaagtggcccagaaactgcaccagttacaaaactttaataccttaatggccgtcataggaggcctctgtcattcaagcatcagtcgtctgaaagagacctcatcgcatgtgccacacgagataaacaaagttctgggcgagatgaccgagcttctctcctccagtaggaactacgacaactacaggagggcctatggtgaatgtacagactttaagattccaattctgggcgtgcatctaaaggacctaatttcattgtatgaagccatgcccgactacctcgaagatgggaaagtcaatgtgcacaaactgctggccttgtacaaccacattagcgagttagtgcagctccaggaagtagccccacccctggaggccaataaagacctggtgcatctcctcaccctatccctggacctctactacactgaggatgaaatttatgagctgtcatacgcaagagagccacgtaatcatcgggccccttcagtttttaagaattacgatcatgaccaagacggttacattagccaggaagagtttgagaaaatcgccgcctcctttcctttctccttctgcgtaatggacaaagacagggaaggactgatctcccgcgatgagattaccgcctattttatgcgtgcctcaagcatctattcgaaactggggctgggtttcccccacaatttccaggaaacaacgtacctcaaacccaccttttgcgacaactgtgcggggtttctttggggagttataaaacagggatatagatgtaagggcaacaagtacagtgaaagtcggtag

SEQ ID NO: 202592 - DNA, 2289 bp, Artificial Sequence
  Description of Artificial Sequence: Synthetic coding sequence
atgggcaccctgggcaaggcccgggaggccccccggaagcccagccacggctgcagagcagcctctaaggcacgcttggaggccaaacctgccaacagccccttcccatctcacccttctctggcacatatcacccaatttaggatgatggtttcacttggacatctcgctaagggggccagtctggacgacctcatcgactcttgcattcagagctttgatgcagacggcaacctttgccgaagcaaccagctgctccaggtcatgttgaccatgcacagaatcgtgatctccagtgccgagctcctacagaaggtcattacactgtataaggatgcactggccaaaaatagccctgggctgtgcctgaagatttgttattttgtgaggtactggattaccgaattttgggtcatgttcaagatggatgccagcctaaccgatacaatggaagagttccaagagctggtgaaggccaagggcgaggagctgcactgcagactcattgacacaacacagataaatgccagagactggtccaggaagttgacacagagaattaagtctaacacctcgaaaaagcgtaaagtcagtctgctcttcgatcaccttgagcccgaggaattaagcgaacaccttacatatctcgagtttaagtctttccgacgcattagttttagtgactaccagaactacctggttaacagctgtgtcaaagagaacccgacgatggaaagatctattgccctgtgcaatgggattagccagtgggtgcagctgatggtcctgtccagaccaaccccacagctgagagcagaggtcttcataaaattcattcaagtagctcagaagcttcatcagttgcagaatttcaatacactcatggctgtgatcggtggcctgtgccacagcagtatctccaggttgaaggagacttctagccacgttcctcatgaaattaataaagttctgggcgaaatgaccgagcttttgagctcctcgcgaaattatgataactacagacgggcctacggggagtgcacagactttaagattcccattctcggcgtacatctcaaagacttgatctccctgtacgaggcaatgcctgattatctggaagacgggaaagtaaacgttcacaagctactggccttatacaaccacattagcgaactggttcagctccaggaagtcgcacccccattagaagctaataaggatttggttcaccttctgacattgagcctggatctgtattatactgaggacgaaatatatgagctttcctacgcacgagagccacggaaccaccgtgccccttctgtgttcaagaactacgatcacgatcaggacgggtatatcagtcaggaagaattcgagaagattgcagctagttttcccttttccttctgcgtgatggataaggacagagagggactgatctcccgagacgagattacagcttattttatgcgcgcttcctctatctactcgaaattgggtctgggcttcccacataacttccaggagaccacctatctgaagccaacattttgcgataattgtgcaggatttctgtggggagtcatcaaacagggttatcgctgcaaagattgcggcatgaactgccataaacaatgcaaggacctggttgttttcgagtgcaagaagagggcaaaaaaccccgtagctcccactgagaacaacacttcagtgggaccagtctcaaatttatgctcactgggcgcaaaagaccttttacatgctcctgaagagggcccgtttaccttccccaacggtgaggctgtcgagcatggagaagaaagcaaagacaggaccattatgttaatgggtgtaagctcacagaagattagtctacggcttaaaagggcggtcgcacataaagccacccaaaccgaatcccagccatggattggaagcgagggtccctccggcccattcgtgctctcttcacctagaaagaccgcacaagacaccctttacgtgcttccgtcaccaacgtctccatgtccttccccagtgcttgtccggaaaagagcttttgttaagtgggagaataaagactctcttataaagtcaaaggaggaactgaggcacctgcgcttgccaacctaccaggagttggagcaggagatcaacacactcaaggctgataatgacgcattaaagattcagttgaaatatgcgcagaagaagattgagtccctacagctggaaaaatcgaatcacgtcctcgcccagatggaacagggcgactgttcctag

SEQ ID NO: 202593 - DNA, 2250 bp, Artificial Sequence
  Description of Artificial Sequence: Synthetic coding sequence
atgatggtgagcctgggccacctggccaagggcgccagcctggacgacttgatcgattcctgtatccaatccttcgacgccgatggaaacctctgtcgatcgaatcagttgctccaggttatgctcactatgcacagaatcgtgatctcgtccgccgagctcctgcaaaaagttatcactctgtacaaggatgcactggccaagaattctccaggactgtgtctcaagatctgctattttgtgcgatattggataactgagttttgggtcatgttcaagatggatgctagcctgacagacacaatggaggagttccaggaattagtgaaggctaagggggaagaactacattgcaggcttattgacactactcagattaatgcccgggattggtctcgcaaactcactcagaggatcaagtcaaatacgtctaaaaaaagaaaagtttccctgctgtttgatcatcttgagcccgaggaactttctgaacaccttacatacctggagttcaaatccttccgaagaatctccttctcagattaccagaactatctcgtgaattcttgtgtgaaggagaacccaaccatggagagatccattgccctgtgtaacggtattagccagtgggtccaactcatggtgctgtcacgccctaccccacaattgcgggcagaggtctttataaaattcatccaggtcgcccagaagttgcaccaactccaaaatttcaacaccctgatggccgtgattggcggtctctgtcatagtagcatatcaagactaaaagagaccagttcacacgtcccacacgagatcaacaaggtcctgggcgaaatgacagagctcctcagcagttctcgtaactatgacaactaccgtagagcgtacggcgagtgcaccgactttaaaatccctatactgggcgtccatctgaaagatctgatttcgctctatgaggccatgcctgattacctggaggatggtaaagtgaatgtgcataagttactcgctctttacaatcacatcagcgaacttgtacagctccaggaggtcgcgccacccctggaggctaacaaggaccttgtgcatctgctcacgctatcattggacttatactataccgaggacgagatttatgagctgtcatacgcaagagagccaagaaaccacagggccccccccttaacccccagcaagcccccagtcgtggttgactgggcctctggtgttagcccaaaacccgaccccaaaacaatttccaagcatgtccagcgaatggtcgactccgtgttcaagaactacgatcacgaccaggacggctacatttcacaggaggagtttgagaagatagctgcgagcttccccttctcattttgtgtaatggacaaggatcgggagggactgatatcccgtgatgagatcaccgcctactttatgagggccagctctatttattctaaactgggactcggcttcccgcataacttccaggagaccacctacttgaagccgacgttctgcgataattgcgccggattcctgtggggcgttataaagcagggctacaggtgcaaggattgtggcatgaattgccataagcagtgcaaagaccttgtggtgtttgagtgcaagaagagagctaagaacccagtagctccaaccgagaacaacacctccgtggggcccgtctcgaacttatgcagcctcggcgctaaggatctgctgcacgcacccgaagaaggaccgtttacattccccaacggtgaagctgtggagcacggcgaggagagtaaggacagaaccatcatgctcatgggggtatcaagccagaagatctctctccgcttaaagcgcgccgtcgcacataaagcaacacagacggagtctcagccttggatcggcagcgaagggcctagtggtcctttcgtcctttctagcccgcggaagaccgcccaggacacactgtacgttctcccctctccgacctcaccctgtccttcacccgtcctggtccgtaaaagagccttcgtcaaatgggaaaataaggattccctcataaagagtaaagaagaattgcgccacctccgacttccaacgtaccaggagctggagcaagaaataaatactcttaaggctgacaatgatgccctgaaaatccaactcaagtatgcccagaagaagatcgagtccctgcagcttgaaaaaagcaaccacgtgctcgcccagatggaacagggtgactgctcatag

SEQ ID NO: 202594 - DNA, 1446 bp, Artificial Sequence
  Description of Artificial Sequence: Synthetic coding sequence
atgggcaccctgggcaaggcccgggaggccccccggaagcccagccatgggtgtcgagcggcttccaaagctaggttggaagccaagcccgcgaactcaccttttccgagtcatccctccctggcccacattacccagttccgaatgatggtaagtctggggcacctagccaagggcgcatcactggatgacctgatagacagctgtatccaaagtttcgacgcagatggcaatctgtgccgtagtaatcagctgctgcaggtcatgctcacaatgcaccggatcgtgatctcttccgccgagctgctccagaaggtcatcaccctgtacccagatgctctcgccaaaaattcccccggcctctgcctgaaaatctgctatttcgtccggtattggattacagagttttgggttatgttcaaaatggacgcatctctgacggacaccatggaggaattccaggagctggtgaaggcaaagggtgaagaactgcactgtcggctgattgataccacccagattaacgccagagattggtcgcgaaaactgacgcaacgcataaaatctaatactagcaagaagcgcaaggtgagtcttttatttgaccacctcgaaccagaggagctgtcggaacatttaacctacctcgaattcaaatcctttaggagaatttcattctctgattatcagaactacttggtcaactcatgcgtgaaggagaatcccaccatggaaagaagtatcgccctgtgcaatggaatctcccagtgggtccagctcatggttctgtctaggcctaccccacagctgagagcggaagtctttatcaagttcattcaggttgcccagaagctgcatcaactgcagaattttaatacgctgatggcagtgatcggagggttgtgccattcatccatttccagattgaaggagaccagttcgcacgtgccgcatgagatcaacaaggtcctgggagaaatgactgagctactgtcctcctcaaggaactacgacaattataggagggcctatggcgaatgcaccgattttaagatccccatcctcggagtccatctgaaagatctgatctcgctgtacgaagcgatgcccgattatctggaagatggtaaagtaaatgtgcataaactgctggccttgtataaccacatttctgaactagtgcagcttcaagaggtcgctccccccctggaggcaaataaagatttggtccatcttcttacgctctcactcgatctgtactatacggaggacgagatttatgagctatcttacgctagggagcccaggaaccaccgcgccccctccgtgttcaaaaattacgaccatgatcaggacggctatatatcacaggaggagtttgaaaagatcgcagcctccttccccttttctttttgtgtgatggacaaggatagatccggcgcctag

SEQ ID NO: 202595 - DNA, 1641 bp, Artificial Sequence
  Description of Artificial Sequence: Synthetic coding sequence
atgggcaccctgggcaaggcccgggaggccccccggaagcccagccatggctgcagagccgccagcaaggctagactggaggccaaaccagccaactctccttttccgagtcaccctagtttggcccatatcacccagttccggatgatggtgtctctcggacacctggctaagggagcatctttagacgacttgattgactcttgcattcaaagtttcgatgctgatggcaatttgtgccggtcaaaccagctgctgcaggtcatgcttaccatgcaccgcattgttatttcctctgccgaactcctacagaaagtgatcacattgtataaggatgcgctagccaaaaattctccaggtctgtgccttaagatctgctactttgtcagatactggataactgagttttgggtcatgttcaagatggatgcctccctgaccgacactatggaggaattccaagagctggtcaaagccaagggtgaggaactgcactgtcgactcatcgacacaacccagatcaatgcacgggattggtcccggaagttaactcagagaatcaagagcaatacctcaaagaaacgcaaggttagtctgctgtttgatcatctcgagccagaagaactgtctgagcatctgacctacctggaatttaaatcctttaggagaatttcattctccgactatcagaattatcttgtgaactcttgtgtgaaggagaatcccactatggagcgcagtatcgcactttgcaacggtatttcccagtgggtgcagcttatggtactttcacggccgaccccccagttgcgcgcggaggtctttatcaagtttatccaggtagcccagaaactccatcagttgcagaacttcaataccctaatggcggtgattggcggcctgtgtcattccagtataagtagactcaaagagacctcctcccatgtaccccacgagattaacaaggttctgggcgagatgacagagctgctctccagtagcagaaattacgataactatcggcgcgcttatggcgaatgtacagactttaagatccctatcctcggggtccatctcaaggatctgatctccctctacgaagctatgcctgattacctcgaagatggtaaggtgaacgtgcacaaacttctagcgctttataaccatatcagcgaactggttcagctccaggaagtggccccaccactggaggccaacaaagatctggtgcacctgctgacactgagcttagacttgtattacacggaagatgaaatctatgaactgtcatacgctcgagagcctcgtaatcacagagcgccctccgtttttaaaaactacgaccatgaccaggacggctatatctcccaggaggagttcgaaaagatcgccgccagtttcccattcagcttctgtgtgatggacaaagaccgtgaaggactgatttcccgggatgaaatcactgcctattttatgagagcctcaagcatttattctaagctgggcctcggcttcccccacaactttcaggagacaacatatctgaaacctactttttgtgataactgtgccggtttcttgtggggagtaataaaacaaggctacagatgtaagggcaataagtactccgaaagccgttag

SEQ ID NO: 202596 - DNA, 1794 bp, Artificial Sequence
  Description of Artificial Sequence: Synthetic coding sequence
atgggcaccctgggcaaggcccgggaggccccccggaagcccagccatgggtgccgggccgcctcaaaggcaaggcttgaggctaagccagcgaactcccccttcccctctcacccttccctagcacacatcacccagtttaggatgatggtgagcctgggtcacttggcaaagggcgctagtctagatgatttaatcgactcttgcatccaaagcttcgacgccgatggcaacttatgcagatcgaaccaactactccaggtaatgctcacaatgcataggatcgtcattagttcagctgaactgctccagaaagtgattacattgtacaaagacgccctcgcgaaaaatagtcctggcttatgccttaagatatgttattttgtccgttactggatcaccgaattctgggtgatgtttaagatggacgctagccttactgatacaatggaagaattccaggaactggttaaagcgaaaggcgaggagctgcactgcaggttgatcgatactactcagatcaacgcgcgcgattggagtaggaaacttacccaacgaatcaaatcgaacacatctaagaaaagaaaagtaagcctgctgttcgaccatctcgagcccgaagaactgtccgagcacctcacgtacctggaatttaagtctttcagacggatatccttcagcgattatcagaactatctggtgaattcttgcgtaaaggagaacccgaccatggagaggagcattgcgctgtgtaacggcattagtcaatgggtgcagctgatggtgttaagtagacctacccctcaactcagggccgaagtgtttattaaatttattcaggttgcccagaagctgcaccagttgcagaattttaacacacttatggccgtgatcggcggcctgtgccattccagcatctcgagacttaaagaaacaagttcacacgttccacatgagatcaataaggtgctcggtgaaatgactgagttactttctagttcacgcaactacgataattaccggcgagcctatggggaatgcaccgactttaagatccccatcctgggggtccatctgaaagatctaatatcactgtacgaggccatgccagactatttagaagacggaaaagtcaatgttcataagctgctcgccctttacaaccacatcagcgagttagtgcagttgcaagaagtagctcctcctcttgaagctaacaaagacctggtgcacctgctcaccctctcgctggacctttactatactgaggacgagatatacgagctctcatacgcgcgtgagcctcgcaatcaccgggccccatccgttttcaagaactacgaccacgaccaggatggatacattagccaggaagagttcgagaagatcgcagcttccttccctttcagcttctgcgtgatggacaaagacagggaaggtctgattagccgcgacgagatcactgcctacttcatgcgagcatcgagtatttactcaaagctgggtcttgggttcccacacaatttccaggaaacgacatacctgaagcctacattctgcgacaattgcgccggctttttgtggggcgtgattaagcagggttacagatgcaaggactgtggaatgaattgtcacaagcaatgtaaagatcttgtcgtatttgaatgcaaaaagcgcgcaaagaaccctgttgcccctacggaaaacaacacctccgtcgggcctgtaagtaacctgtgctccctcggtgccaaggatctgctgcatgggaataagtactctgagagcagatag

SEQ ID NO: 202597 - DNA, 1830 bp, Artificial Sequence
  Description of Artificial Sequence: Synthetic coding sequence
atggccggcaccctggacctggacaagggctgcaccgtggaggagctgcttcgggggtgtatcgaggcattcgacgactcaggcaaggttcgtgacccccaactggtgagaatgttcctgatgatgcacccctggtacattccctcatctcagttggcggccaaactgctccacatctaccagcagtctcgaaaagataactccaactccctgcaggtcaaaacatgccatctcgtgcgctactggatctctgccttccctgccgagttcgatctaaatcccgaactggctgaacaaatcaaagagttgaaggccctcttagatcaggaggggaaccgcaggcacagttccttgattgatatcgattcagtccccacgtacaagtggaaaagacaggttacccagcgcaatccagtcggtcaaaaaaagcgaaagatgagcctgctgtttgaccatttagagcctatggaactggctgagcatctgacctatctagaatatcgcagcttctgcaagatcctgtttcaggattaccatagcttcgtgacacatggctgcaccgtggataatcctgtgctcgagcgctttatcagtcttttcaactctgtgtcacagtgggtgcagctgatgattctgagcaaaccgacagccccccaacgagccctggttattacacactttgtgcacgtcgccgaaaaacttctacaactgcagaatttcaacacactaatggctgtcgtgggcgggctgagtcactccagtatctcacgtcttaaagagacacactcccatgtgagtcccgaaactatcaaactttgggagggcttaaccgaactggttaccgcaacagggaactacgggaactaccgccgcaggctggcggcttgcgttggcttccgttttcccatcctgggggtccatctaaaagatttggtcgctctgcagctcgccttgcccgattggctggatcctgctaggacccggcttaatggcgcgaagatgaaacagctgttctccattctggaagaacttgctatggtgactagcctgcgacccccagttcaggcaaaccctgatctgctgtctctcctgacggtgtccctggatcagtatcagacagaggacgagctataccagctgagcttgcagcgggagcctaggagcaaaagtagtccgacatcacccacttcctgtacccccccgccccgccctcccgttctcgaggaatggacatccgccgctaagccaaaactggaccaggctttggtggtagaacacatcgaaaagatggtggaatcggtcttcaggaactttgacgtcgacggagacggtcatatctcccaggaggagttccaaatcatccggggcaacttcccataccttagtgctttcggcgacctggaccaaaaccaggacgggtgcatcagccgcgaggagatggtctcttattttctccgcagttcatccgtgctggggggccggatgggcttcgtgcacaacttccaggaatccaatagcctgaggccagtggcatgccgccactgcaaggcactaatactgggcatctataaacagggcttgaagtgcagggcgtgtggtgtgaattgccacaagcagtgcaaggacagacttagtgtggagtgtcggcgacgcgctcagagtgtcagcctggaagggtcggctccctcaccttcacccatgcattcccaccaccaccgggccttttctttttccttgcctcgccccggccgcagaggaagcaggccaccagagatccgggaggaggaagtccagacagtggaggatggcgtcttcgacattcatctgtag

SEQ ID NO: 202598 - DNA, 1833 bp, Artificial Sequence
  Description of Artificial Sequence: Synthetic coding sequence
atggccggcaccctggacctggacaagggctgcaccgtggaggagcttcttagaggctgcatagaggcttttgatgacagcgggaaagttcgcgatccacagctcgttcgcatgtttctcatgatgcatccttggtacattcccagctctcagctcgcggccaagctcttgcacatctaccagcaaagccgcaaggacaatagcaattccttacaggtgaaaacatgccacctggtacgttactggatatccgcattcccagcggagttcgaccttaaccccgagcttgccgagcaaattaaggaattgaaggctcttttggaccaagaagggaataggcgccactcctccttgatcgatatcgattcagtgcctacctacaagtggaagcggcaagtcacacagaggaaccctgtcgggcagaaaaaaagaaagatgagcctgctgttcgatcaccttgagcctatggaactggccgagcacctgacctatttggaatatcgatccttctgtaagatcctgttccaggactaccactccttcgtcactcacggctgcacagtcgataatccagttctagaacgttttatttccctcttcaactctgtgtcacagtgggtgcaactcatgatcttgagcaaacctaccgctcctcagagggcactggtaatcacgcactttgttcacgtggccgaaaagctcctacaactgcagaatttcaacaccctgatggccgtcgtgggcgggctgtcccattcatccatctctcggctgaaggagactcattcgcacgtttcacctgaaacaatcaaactctgggagggattgactgagctggtcaccgccaccgggaactatggcaactaccgaaggcggttggccgcgtgcgtgggatttaggtttcccatcctcggcgtgcacctgaaagacttagtggccctccaactagctctgccagactggctggatcctgctaggacaagactcaacggggccaaaatgaaacagcttttttcgatactggaggagctggccatggtcaccagtctgaggccccccgtacaggctaatccggacttattgagcctcctcactgtctctttggaccagtatcagaccgaggacgaattgtatcagctctcactgcagagagagcctaggagcaagagcagccctacatctcctacatcctgtacccctcccccgcgaccaccagtgctggaagaatggacctccgctgctaagcctaagctagaccaggccctcgttgttgagcatatcgagaaaatggtggagtcggtgtttagaaactttgatgtggatggggacggccacatctcacaggaagagttccagataatccgcggtaatttcccatatctaagtgccttcggagatcttgatcagaatcaggacgggtgcatttcccgtgaagaaatggtgagctactttctacgcagttccagtgtcctaggaggtcgaatgggcttcgttcacaacttccaagagagcaactcccttcgaccagtcgcatgccggcactgcaaggctcttattcttgggatttataaacaaggccttaagtgtagagcctgcggagtcaattgtcacaagcagtgcaaggaccggctgtctgtggaatgccgccgaagggcgcagtcggtgtcattagagggaagcgccccctctcctagtcctatgcatagtcatcatcatcgagccttctctttctctctaccaaggcctggcagacggggctctaggccacctgcagaaattagggaggaggaagtgcaaacggtggaggacggggtctttgatattcacctgtag

SEQ ID NO: 202599 - DNA, 1830 bp, Artificial Sequence
  Description of Artificial Sequence: Synthetic coding sequence
atggccggcaccctggacctggacaagggctgcaccgtggaggagttgctgagaggatgtattgaagctttcgacgattccgggaaagtgcgggatccacagctggtaaggatgttcctaatgatgcacccttggtacattcctagctcccagctggccgccaagctgctgcacatctatcagcaaagccggaaagacaatagcaactccctgcaggtaaagacttgccacctggtgagatattggatcagtgcctttcctgccgagttcgatcttaatcctgagctggctgaacaaattaaggagcttaaggccctgcttgatcaggagggaaacagacgacactcgtcgctgattgacattgatagtgtccctacgtacaagtggaagaggcaagttactcagagaaaccccgtgggccagaagaagaggaaaatgagcctcctgttcgaccatttggagcctatggagttagccgaacaccttacctatctggagtataggagcttctgcaaaatcctattccaggactaccactcttttgtgacacacggttgtaccgttgataaccctgtcctcgagcgctttatctccctattcaactccgtgtcccagtgggtccagctgatgatcctcagtaagccgaccgctccacagcgggccctggtaatcacccatttcgtgcacgtggctgaaaaactactacagctgcaaaattttaatactctgatggcagtggtcggaggcttgagtcacagtagcatctctcgcctcaaagagactcactctcatgtctcccctgagactattaaattatgggaggggctgacagagctagtcacggccacaggtaactacggaaattatcgaaggagactcgccgcctgcgtgggttttcgcttccctatcttgggcgtgcatcttaaggacttagtcgcactacagctggccttgccagattggcttgatccagctagaactcggctaaatggagccaagatgaagcaactgtttagcatcttggaggaactggctatggtgaccagtctccgcccacctgtccaggccaatccagaccttctttctctgttgaccgtctccctggaccagtaccagacggaggatgagctataccagttatctctacagcgagagccacgctccaagtcatcccccacaagtcctactagctgcacgcctcctccaagaccaccagtgctggaagaatggacttcagccgctaagccaaagttagaccaggctctggtagtggagcacattgagaaaatggttgaaagcgtgtttaggaattttgatgtggatggcgacggacacatcagccaggaagagttccagataatcagaggaaatttcccctaccttagcgcatttggagacctggaccagaatcaggacgggtgtattagtcgagaagagatggtgagctacttcttacggagctcgagcgtgttaggcgggagaatgggctttgtgcacaatttccaagagagcaactcactccgccccgtcgcatgtagacactgcaaagcgctgattctgggaatctataagcagggcttaaaatgtagggcatgcggtgtaaactgccacaagcagtgcaaagatcggctgagtgtggaatgccgcaggcgggcacaatccgtctcactcgaggggtcggcccctagcccctcacctatgcactcccatcaccacagagccttctctttctctctcccaagacccggccgaagaggctcccggccgccagagatcagagaggaggaggtgcagactgtggaggacggcgtcttcgacattcacctatag

SEQ ID NO: 202600 - DNA, 1830 bp, Artificial Sequence
  Description of Artificial Sequence: Synthetic coding sequence
atggccggcaccctggacctggacaagggctgcaccgtggaggagctgctgaggggctgtatcgaggcctttgatgattcgggtaaggtacgagacccacagctcgtgagaatgtttctgatgatgcacccctggtacataccttctagccagcttgcagccaaactgctccatatctaccagcagagtcggaaggacaattctaattcactgcaagtgaagacctgccacttagtgcggtactggatttccgctttccctgccgaatttgacctgaaccctgagctggcagagcagattaaagagctcaaagccctgttggatcaggagggtaatcgaaggcactcttctcttattgacatcgactcggttccaacctacaagtggaaacggcaagtgacacagcgcaatcccgtcgggcagaaaaaaaggaagatgtcccttctgtttgatcatctggagcccatggaactggcggagcacctgacatatctggaataccgctccttctgcaagatcttgtttcaagattatcactcatttgtgacccacggatgcactgtggacaacccggtcctcgagcggttcatctccctttttaattcggtgtctcaatgggtccagcttatgatcctctcaaagccaacagccccccagagagcattagtaattacacatttcgtgcatgtcgcagagaagttgctacagcttcagaactttaataccctgatggccgtggtcgggggactctctcattcttccatctcgcgcttgaaggaaacgcacagccatgttagtcctgagaccataaagttatgggagggcctgactgagctggtcacagcaacaggaaactacggaaattacaggcgccgacttgccgcctgtgtgggtttcagatttcccattctgggcgtgcacctgaaggacctggttgcccttcagctcgctctgcctgactggctggacccagcacgaacacgcctcaacggagcgaagatgaagcagctgttcagcatacttgaagagctggcaatggtcacctccctaagaccacccgtgcaagccaacccagaccttttaagcctgctaacagtttctctcgaccagtatcaaacggaagatgagctatatcagctttccctgcaaagagagcccagaagcaagtcgagtcccacatcaccgacgtcgtgtacaccacctcccagaccacccgttctggaggagtggacaagcgccgcaaagcccaagctggaccaggccctcgtcgtagagcacatagagaagatggtggagagcgtgtttcggaattttgacgttgatggagatggacacatctcccaggaggaattccaaataatcagggggaattttccttacctgtccgccttcggcgacctggaccagaatcaggatggctgtattagcagggaggagatggttagttacttcctccggagctcatccgttctgggtggcaggatgggattcgtgcacaacttccaggaatccaactcattacgtcctgtggcatgccgccactgcaaggctctcattctggggatttataagcaggggcttaagtgtcgcgcctgcggggtcaattgtcacaaacagtgcaaagaccgactgagtgttgagtgtcggaggagagctcagagcgtctccttagagggttctgctcctagccccagtcctatgcactctcatcaccatcgcgccttctccttctcattaccccggcccgggcgccggggctctaggcccccggaaataagagaggaagaagtgcaaactgttgaggacggcgtttttgacattcatctgtag

SEQ ID NO: 202601 - DNA, 432 bp, Artificial Sequence
  Description of Artificial Sequence: Synthetic coding sequence
atggccggcaccctggacctggacaagggctgcaccgtggaggagctgttgaggggttgtattgaggcatttgacgattcgggcaaagttcgggacccacagttggtgcgaatgtttctcatgatgcacccttggtatatacctagttctcagctggctgcgaaattgttgcacatctaccagcaatctcgaaaggacaactctaatagcttgcaggtgaaaacttgtcatcttgtccgctactggatttctgccttccccgctgaattcgacctcaaccccgagttggccgagcagattaaggagctaaaggctttgctagaccaagagggaaatcggcggcattctagtttgattgatatagactctgtttgtgtgggggaacatcgcggattgggaggacactcagttagttacaccatctgtgcctag

SEQ ID NO: 202602 - DNA, 1731 bp, Artificial Sequence
  Description of Artificial Sequence: Synthetic coding sequence
atgaaccggaaggacagcaagcggaagagccaccaggagtgcaccggcaaaattggtggacgaggcagaccccggcaggtgcggaggcataagacctgtccatccccacgtgaaattagcaaagtaatggcaagtatgaatctggggctactgtcagagggagggtgtagtgaagacgagctgctggaaaagtgtattcagagctttgacagcgccggctcattatgtcacgaggaccatatgctcaatatggtcctcgcgatgcattcatgggttttaccaagcgccgatctcgccgcccgactgctgaccagttaccagaaggcgacaggggatactcaggaactgcgaaggctgcagatttgccacttagtccgttactggctcatgaggcatcccgaagtgatgcaccaggaccctcagctcgaggaagtgattggcagattctgggccacagtcgctcgcgaggggaactccgcgcagcggaggcttggcgacagcagcgacctcctctcccccggcgggccggggcccccattaccgatgtctagccccggcctgggaaagaagcgcaaagtgagcctgctgtttgatcatctggagaccggggagctagcacagcatctgacctacttagaattcagaagtttccaggccattacggcactcttagaactgaccgaactcttggcaagccacaacaactatgcgcggtacaggaggacctgggcggggtgtgctggctttaggttgcctgtgcttggagtgcatttgaaagacctggtctcgctccatgaagcacaaccagatcggcttcctgacggacggttacacttaccaaagcttaataatctctacctccgcctgcaggagttagtggctctccaaggccagcatcccccttgctccgcaaacgaggacctgctgcatctgctcaccctttctctggatctgttttacacagaggatgagatctatgaactgagctacgcgcgagaaccccgatgtccaaaaagcctgcccccgagccccttcaacgcccctctagtggtggaatgggctcctggcgtgacaccgaaaccagacagggttaccctcgggcggcacgtggagcagctcgtggagtctgtattcaagaattatgacccggaaggacgcggcactatctctcaggaggacttcgagcgactgagtgggaactttcctttcgcatgccatggcctgcacccgccacctagacagggtcggggctctttctcacgggaggagcttactgggtacctgctccgcgcttcagctatctgcagtaaactgggtctggcttttttgcatacttttcatgaggtcacattccgaaaacccaccttctgcgacagctgtagcggtttcctttggggagtgacaaaacaggggtaccggtgtcgggaatgcggcctgtgttgccataagcactgtagagatcaggtcaaagtggagtgtaaaaagcgtccgggcgccaaaggcgatgccggacccccgggcgccccagttcccagtactccagctccacacgcctcatgtggctctgaggagaatcactcttataccttgtccctggagcctgaaaccggctgccagctcaggcatgcatggacacaaactgagtcccctcatccaagctgggaaaccgacactgttccctgtcccgtaatggacccgccatccacggcttctagcaaactggattcttag

SEQ ID NO: 202603 - DNA, 1854 bp, Artificial Sequence
  Description of Artificial Sequence: Synthetic coding sequence
atgaaccggaaggacagcaagcggaagagccaccaggagtgcaccgggaagattggaggcagaggccgccctcgccaggtccgcaggcataagacatgtccttcaccacgggagatctcgaaagtaatggcatctatgaatctgggcctcctttcggaaggcgggtgctcagaggatgaactgttagagaaatgcatccaaagctttgacagcgccggctcactctgccatgaagaccatatgctgaatatggtcctagccatgcatagctgggtgttaccctcagccgacttggcagcaagactactgacctcttatcagaaagcaaccggagacacccaagagctgcggcggttacagatctgccatcttgtcaggtactggctgatgcgtcatcccgaagtgatgcatcaggatccgcaacttgaagaggtcataggccggttttgggcaacagtggcaagggaaggtaactctgcgcagcggcgcctgggcgactcctccgacctcctttcaccaggcggcccagggccccctctgcctatgtcatcccctggactggggaaaaaacggaaggtatcgcttctgtttgatcacctggaaacaggcgagctcgcccaacacctcacatacctagagttcaggtcgtttcaggccataacgcctcaggacctcaggagctacgtcctgcagggatcagtcaggggatgtccagcactggagggttctgtgggattatcaaatagtgtatctcgatgggtgcaggtaatggtgctgagccggcctggccccttgcagagggcccaagttctcgacaaattcatacatgtcgctcaacgcttgcatcaactgcaaaattttaacactctcatggcagtcactggcgggttatgtcattcagcaatctctcgtctgaaagactcccatgcccacctgtcccccgattcaacgaaggccttgctggagttgactgaattgttggctagccacaacaactatgcccgctataggcggacgtgggccggatgcgcaggattccggctgccagtgctgggtgtccatctgaaggacttggtatcactacatgaggcccagcccgaccgacttcccgacgggaggctgcacctgcccaagctcaataacttatacttgaggctgcaggagctggttgcactgcagggacagcaccctccctgcagtgcaaacgaagatttactccacctgcttacgctgagcctggacctgttctatacagaggacgaaatctacgaactaagttatgccagagaaccacgatgccctaaatccttgcccccgtcacccttcaacgcccccctggttgtagagtgggcacccggcgtcaccccaaaacccgatagagtgacgctggggcggcacgtggagcagttagttgaaagcgtcttcaagaactatgaccctgaggggcggggcaccatctcccaagaagattttgagagattatcgggtaacttcccatttgcctgccacggcttgcatccgccacctcgacaagggagaggaagtttcagtcgagaggaactgacagggtacctgctgcgtgctagtgcgatttgcagtaaactggggctggccttcctgcacacgttccacgaggtcacctttcggaagcccaccttctgtgattcctgctccgggttcttgtggggcgttacaaaacaggggtaccgatgcagaggcgagtggggtgtgagcgagtgggagggctccctgggaccccaagccggtcgcatggacgataccgaccggacgcctgccgccgcgttccctcagtccgctggatgcgtggctacaaacacagcggagacaaggtag

SEQ ID NO: 202604 - DNA, 1455 bp, Artificial Sequence
  Description of Artificial Sequence: Synthetic coding sequence
atgaaccggaaggacagcaagcggaagagccaccaggagtgcaccgggaagattggtggtcgaggcaggccaaggcaggtgagacggcacaagacctgtcctagtccacgcgaaatatccaaggtaatggcttcaatgaatttgggccttctttcagagggcggctgtagtgaagatgagctactggagaagtgcattcagtcgttcgacagcgccggatctttgtgccacgaagaccacatgcttaatatggtcctcgccatgcatagctgggtgctcccttcagcggatctggctgctcggctgctgacaagctaccagaaggccaccggcgacactcaagaattgcgccgccttcagatatgccatctggtccgttactggctgatgcggcaccccgaagtgatgcaccaggacccccagctggaggaagtgattggccggttctgggccactgttgccagggaggggaacagcgcccagagaagactgggagatagttctgatttgctaagccctgggggtcccgggccccccctgccaatgtcatccccgggactcggtaagaagcgaaaggtgtctctgctgttcgaccatctcgagacaggggagttagcccagcacctgacgtatctcgaattcaggagcttccaggccattaccctgtccctggacctgttttatactgaagacgagatctatgagctgtcctatgctcgggagcccaggtgcccaaagtctttgccaccctcgcccttcaacgccccgctagttgtggagtgggctcccggcgtaacacccaagcctgatagggtgacactgggtaggcatgtggagcagcttgtggaatccgttttcaagaattacgaccctgagggacggggtaccatatctcaagaagatttcgaaagactgtctggcaatttcccatttgcgtgtcacggcctgcacccgcctccacgacaaggacgtggttctttttctcgggaggaactgaccggctatttattacgggcaagcgctatatgctcaaagttaggcttggcttttctccacacttttcacgaagtaacatttcgaaaaccaaccttctgtgacagctgttccgggttcttatggggggttaccaagcagggctatcgatgcagggagtgtggcctgtgctgccataaacattgtcgggaccaggtcaaagttgaatgtaagaagcggcccggtgccaaaggcgatgccgggccccccggcgccccagttccaagtacacccgcaccccatgccagctgtggcagcgaggaaaatcactcctatacgttatctttggagccagagaccggatgtcaattgcggcacgcttggacacagacagaatctccacaccctagctgggaaaccgacactgttccctgtcctgttatggaccccccatctaccgccagtagtaaattagactcatag

SEQ ID NO: 202605 - DNA, 1746 bp, Artificial Sequence
  Description of Artificial Sequence: Synthetic coding sequence
atgaaccggaaggacagcaagcggaagagccaccaggagtgcaccggtaagataggcgggcgaggcagacctcgtcaggttcgtaggcataagacatgtccgtcaccaagagaaatctccaaggtgatggccagcatgaatctgggactgctgagcgagggaggatgcagtgaggacgagcttctggagaagtgcatccagagtttcgactctgctggcagcctctgccacgaggaccatatgctgaacatggtgctcgccatgcactcttgggtgcttcccagcgcggatctggctgctcgcttactgacgtcttatcaaaaagcaaccggggatacccaagagctgaggaggctgcagatttgccacctggtacgctattggctgatgagacaccccgaagtgatgcaccaggatccccagctcgaagaggttattggccggttttgggccacagtggctcgggaaggaaacagcgcgcagcgcagacttggggattctagcgacctcctgtctcctggtggccccgggccccccctaccaatgtcttctcccggcttaggaaaaaagcggaaggtctcactgctgttcgaccatttggaaactggagaactggcacagcaccttacgtatttagagttccggtcttttcaagccatcaccccacaagacctgcgaagctacgtcctgcagggctcagtgagagggtgccctgcactggaagggagtgttgggcttagcaattccgtttcacgctgggtccaagtgatggtactgtcacggccgggccccctgcaacgagcgcaggtactagataagtttatccacgtcgctcaacgcctccatcagctgcagaatttcaatacattaatggccgtgacaggtggcctgtgccattctgcgatcagtaggctgaaagattctcatgctcatctgtctcccgattccactaaactatcgctggaccttttctatacagaggatgagatatatgagctgagctatgcccgcgagccacgatgccctaagagcctgcccccctctccattcaatgctccgctggtggtcgaatgggcccccggcgtgaccccgaagcccgatcgtgtgacattggggcgacacgtggagcagctggtggaatcagtctttaagaactacgatcctgaaggcaggggtactatctcccaggaagatttcgagcggttatccggcaacttccctttcgcatgtcatggcttgcacccacccccgagacagggccggggatcgtttagcagggaagagctcacaggatacttactgagagcatccgccatctgcagtaaacttggactcgcattcctgcacactttccatgaggttacattccgcaagcccacattttgtgacagttgttccggctttctatggggagtcactaagcaaggatatcgctgcagagagtgcgggctgtgctgccataagcattgcagagatcaagtgaaggtggagtgcaaaaaaagacctggcgccaaaggcgatgctggaccaccgggggccccagtgccctccactcctgctcctcatgcaagctgcgggtcggaagagaatcactcctataccttgtccctggaacccgagacaggatgccaactgcggcacgcctggacacagacagaatccccccatccttcttgggagacagatacggtgccctgcccagtgatggacccacctagcacagccagtagcaagttagattcctag

SEQ ID NO: 202606 - DNA, 2022 bp, Artificial Sequence
  Description of Artificial Sequence: Synthetic coding sequence
atgaaccggaaggacagcaagcggaagagccaccaggagtgcaccgggaaaatcggaggcaggggaaggcctcgccaggtccgcagacataagacatgcccctctccaagagagatctcgaaggtgatggcttccatgaacctgggtctgctaagtgagggtggctgttcagaggatgagctcctggagaagtgcatccagtcattcgatagtgccgggagcctgtgtcatgaggatcatatgctcaatatggtgctggctatgcatagctgggtcctgccatctgcagatctcgccgcgcggctgctcactagttatcagaaggctactggggatacgcaggaattgaggcgcttacagatctgtcacctggtacggtactggctgatgcgacaccccgaggtgatgcaccaagaccctcagctggaggaagtgatcggccgcttctgggctacagtggccagagagggaaactctgcccagcggaggctgggcgactcctccgacctcctgtctcctggagggcctgggccgccactccccatgagctctccaggacttggaaaaaaaaggaaggtttctcttttattcgatcatctcgagaccggggaactggcacagcacctcacatatctggagttccgctccttccaggccatcacacctcaagacctgcgttcatacgtactccaggggtctgtacgtgggtgccctgctctggaaggcagcgtggggctctccaattctgtgtcccgatgggtgcaggtaatggtactatcgcggcccgggcccctgcagagagctcaggtcctcgataaattcatccatgtcgcgcagagactccatcaactgcagaatttcaatacactgatggccgtgactggcgggctgtgccacagcgctatttcaaggctgaaggacagtcatgcccacctctccccagacagtacaaaggcgctgctagagctaaccgagctgttggcctcccacaataattatgcaaggtacagacggacctgggcagggtgtgctggctttcgcctgccagttctgggggtgcatcttaaggatctggtgtcgcttcacgaagcgcagcccgataggttgcccgacggccggctgcacctcccgaagttgaacaacctctatttgaggctgcaggaactcgtagctttgcagggccagcacccaccttgcagcgccaatgaggacctgcttcatttgttgaccttgtctctggacctcttctacaccgaggacgaaatctatgagttgtcctacgccagagagcctcgatgccccaagagcttaccgccgtctcctttcaatgcacccctcgtggtcgagtgggcccctggggtgactcccaagcctgaccgggtgactttggggaggcacgtggaacagttggtggagtccgtgttcaagaattacgatccagaaggccgaggcaccatttcccaagaagacttcgagagattgtctgggaactttccttttgcttgccacggcctgcacccaccgccccgccagggcagaggatctttctctcgagaagagctgacggggtacctgctgcgagcatccgctatttgttctaagctcggcttagcattcctccacacctttcatgaagtcacatttcggaagccaaccttttgcgactcgtgttctggctttctctggggagtcaccaagcagggatatagatgcagagagtgcggcctctgctgccataagcattgtcgagaccaggtcaaggttgaatgtaagaaacgccctggggcaaagggggacgccggtccgccaggggctcccgtaccctctacccctgcaccacacgcttcctgcggctccgaagaaaatcacagctacaccctaagccttgagcccgagactggatgccaactccggcacgcttggacccaaacagaatctccacacccttcttgggagaccgatactgtgccctgcccagtgatggatcccccttcaacagcatcctctaagctggactcatag

SEQ ID NO: 202607 - DNA, 1980 bp, Artificial Sequence
  Description of Artificial Sequence: Synthetic coding sequence
atgaaccggaaggacagcaagcggaagagccaccaggagtgcaccgggaagatcggcgggcggggccgtccccggcaggtgcgtaggcataaaacatgtcccagtccaagggaaataagtaaggttatggcctctatgaacctgggcctgctgagtgagggcggatgcagtgaagatgagctgttggagaaatgcatacaatcattcgatagtgctgggtcgctgtgtcacgaagatcacatgctcaatatggtattagccatgcactcttgggttctgccaagtgccgacctggcagcccggttgctaacttcataccagaaagcaacaggggatacacaggagctccggagactccaaatttgccacctcgtacgctactggctcatgaggcatccggaggtgatgcaccaggacccccagcttgaggaggtgatcggccgtttctgggcgaccgtagcaagagaggggaactccgctcagcgccggctcggagacagcagtgacctcccgggcctcggaaagaaacgcaaggtctccctgctttttgaccacttagagacgggcgagctagcccaacaccttacttacctagaatttcggagctttcaagccattactcctcaggatctgaggtcctacgtccttcagggtagtgtccgcggatgccctgcccttgaaggttcggtgggcctgtcaaattctgtcagcaggtgggtacaggtgatggtcctgtctcgcccagggcccttgcagcgtgcccaggtccttgataaattcattcacgttgcacagcgcctgcaccagctacagaactttaataccctgatggcagtgaccggcgggctatgccattccgccatctcacgccttaaggactcacatgcacatctgagtccggactcaaccaaagcgctgctagagttgacagaactcttggcaagtcataataattatgcacgctaccggcgtacttgggctggctgcgcaggtttcaggctgcccgtcctgggggtccacctgaaggatttggtgagcttgcacgaagctcaacccgacaggctgcctgatggtaggttacatctccccaagctgaataacctctacctgagactccaggaattggtagcccttcagggacaacatccaccttgctctgccaacgaagatttactccatctattaacactgagcctcgatttgttctataccgaagatgagatctatgaactgtcctacgcacgagaaccgcgatgcccaaagtccctgcctccttcccccttcaatgctcccctggtggtggagtgggccccaggtgtgacccccaagccagacagagtcacactggggcggcacgtagagcagctagtggagtctgtgtttaagaattatgacccagaaggaagaggcacaattagccaggaggacttcgagcgactctctggcaactttccatttgcctgtcatggtctccatccccctccacggcagggaaggggaagtttctccagggaggaactcaccggctacttgctgcgcgcatcagcaatttgtagtaaactaggactcgcattccttcacaccttccacgaagttacatttcggaaaccaaccttctgtgatagctgtagcgggtttctctggggcgttacaaaacagggctaccgctgccgggaatgcggcctttgctgccataaacattgcagagatcaggtcaaggtggaatgcaaaaaaaggccaggtgcgaagggagacgcagggcctcccggtgctccagttccttccactcctgccccccatgcatcttgcggctcagaagagaatcattcgtacacactttccttagagcccgagacagggtgtcagctcaggcatgcctggactcagacagagtccccacatcccagttgggaaacagatactgttccttgccccgttatggatccccctagcaccgcttcaagtaaactggactcctag

SEQ ID NO: 202608 - DNA, 1815 bp, Artificial Sequence
  Description of Artificial Sequence: Synthetic coding sequence
atgaaccggaaggacagcaagcggaagagccaccaggagtgcaccggtaagatcggcggccgcgggagaccgagacaggtgcgccgacacaaaacctgcccaagtccacgagaaattagcaaagtcatggcttccatgaatttaggcttgctgtcagaggggggctgcagtgaggacgagctgctggaaaaatgtattcagagttttgattcagctgggtccctctgccacgaagatcacatgctcaacatggttcttgctatgcactcatgggtgctccccagcgctgatctcgcagcccgtcttctgacctcataccagaaagccacgggagacacacaggaactacgacgcctgcagatttgccatctggttcggtactggttaatgaggcaccctgaagttatgcaccaagacccgcagcttgaagaagtcatcgggaggttttgggctactgtggcacgagaagggaactctgcacagcgcaggctgggagactcctccgacctgcttagtccagggggaccaggaccacccctgcccatgagtagccctgggctgggcaagaaaaggaaagtgtcacttctgttcgaccacctggaaacaggggagctggcccagcatctgacctatcttgagttccggtcttttcaggcaatcacaccccaagatctgcgctcatacgtgcttcaagggagtgtgagaggttgccccgccctagaggggtccgtgggcctctccaattcagtgtcacggtgggtccaagtgatggtactaagcaggccgggtccactacagcgagcacaggtcctggataagtttatccacgtcgcccagcggctgcatcagctccaaaatttcaacactctgatggccgtcaccgggggactgtgtcactccgctatcagcaggctgaaagactctcacgcgcatttatctccagattcgaccaaggagctggtggcgctgcagggccagcatcctccctgcagtgctaatgaagacctgctgcatctgttgacactatctctggatctgttttatactgaggacgaaatttacgaactgtcgtatgcccgcgagccacgctgccctaagtccctgccaccctcaccattcaacgcacctctcgttgtcgaatgggcccctggcgtgacgccaaagcctgacagagttacgctgggaaggcacgttgagcagctggtggagtccgtgtttaagaattacgaccctgagggccgggggaccatatcacaggaagatttcgagcgattatctgggaactttccattcgcctgtcacggtcttcatccacccccccggcaggggagggggtctttttcgagagaagaacttacgggatatctgctgcgggcctccgcgatttgctccaaattgggcctggcattcctccataccttccacgaggttacattcagaaagccgaccttctgtgatagctgctccggctttctgtggggtgtgacaaaacagggttatcgctgtcgcgagtgcggactctgctgtcataagcactgcagagaccaagtgaaagtcgaatgcaagaaacggcccggcgccaagggggacgcgggacctccgggagccccagtgcccagcactcccgccccgcatgcgagctgtgggagcgaagaaaaccacagttacacgctatccctggagcctgagactggctgccagttgcggcacgcatggacgcagaccgaatctccccatccaagctgggaaactgataccgtgccctgccccgttatggatccgccatctactgcttcctcaaaactcgactcatag

SEQ ID NO: 202609 - DNA, 1857 bp, Artificial Sequence
  Description of Artificial Sequence: Synthetic coding sequence
atgaagaaggacgtgcggatcctgctggtgggcgagccccgggtgggaaagacctccctgattatgtcgctggtctctgaggagtttcctgaggaggttcctcccagggccgaagagattacaatccctgccgacgtgacccctgagcgtgttcccacccacatcgtggactactccgaggccgagcagtcagatgaacaactgcatcaggagatctcccaagcaaatgttatctgtatcgtgtacgccgtgaacaataagcattcgatcgataaagtgaccagccggtggatccccttaatcaacgagagaaccgataaggactcccgcctccccctcattcttgtggggaacaaatctgatctggtggagtactcctcaatggagacgatcctgcccattatgaatcagtatactgaaatagagacctgtgtggagtgcagcgccaaaaacttgaagaatatcagcgagctgttctattatgcacagaaagccgtgctccatcctaccggccctctgtactgtcctgaggagaaagaaatgaaacccgcgtgcattaaagcgctcacccggatattcaagattagcgatcaggataatgacggaacgctgaacgacgcagagttgaactttttccagcggatttgtttcaataccccactggcacctcaggccttggaagacgtcaagaacgtggtgcgcaagcatatttccgacggggtcgcagatagtggactcaccctgaaggggtttctgtttcttcacaccctgttcattcaaagaggtcgacacgaaacaacgtggaccgtcctgagacggttcgggtacgacgacgacctagatctcactcccgaatatctctttccactgctcaagatccccccagattgtacaacagagctgaaccatcacgcctacctgtttcttcaatctactttcgataagcatgatctggaccgggactgcgccctgtctcccgacgaactgaaggacctctttaaagtgtttccatacattccctggggaccagatgtgaacaacaccgtgtgcacaaacgaacggggttggattacctatcagggattcctgtcacagtggaccctgaccacttatctagatgtacagagatgcctcgagtatttgggctatctgggctacagcattctgaccgaacaggaaagccaggcgtcggccgtgactgtgacgcgagacaaaaagattgatctccagaagaagcaaacacagaggaacgtctttcgatgcaacgtgattggggtgaaaaactgtggaaaaagcggcgtactgcaggctcttctgggtcgaaatcttatgaggcagaaaaagatccgggaagatcacaagagctactatgccataaatacagtatatgtttatgggcaggaaaaatatctgctgctccacgacattagtgaatcagagtttttgaccgaggccgaaataatttgtgatgtcgtatgcctggtgtacgatgtaagtaatcccaaatcatttgagtattgcgcacgaatcttcaaacagcacttcatggattcaaggatcccttgcctgattgttgcagctaaaagcgatttgcacgaggtgaaacaggaatactccatctctcccaccgacttctgtcgcaagcataagatgcctcccccccaggcttttacatgtaacaccgccgatgcaccctctaaggacatatttgtaaaactcacaacaatggccatgtacccccacgtgacacaagcggatttaaagtccagtaccttctggctgcgggcctcctttggggctacggtcttcgccgtgctgggcttcgcaatgtacaaagccctcctgaagcagcgctag

SEQ ID NO: 202610 - DNA, 1980 bp, Artificial Sequence
  Description of Artificial Sequence: Synthetic coding sequence
atgaagaaggacgtgcggatcctgctggtgggcgagccccgggtggggaagacctctctcatcatgtctttagtaagcgaggagttcccagaggaagttcctcccagagctgaggaaatcacgatccccgcagacgtcacccccgagagggttccgacccacatcgtggattactcagaagctgagcagtctgatgaacagttgcatcaggagatctcacaagccaacgtcatctgtattgtgtacgcggtgaataacaaacacagtatcgataaagtaacctctagatggattccattgatcaacgagcgcacagacaaggactccagacttcctctaattttggtcggaaacaagtctgatttagtcgagtacagcagcatggagacaatcctgcccatcatgaatcagtatactgagatagaaacgtgcgttgaatgctcagccaaaaacctaaaaaatatctctgagcttttctactacgctcagaaagccgtacttcacccaactggccccttatactgccccgaggagaaggagatgaagccagcttgtattaaggcccttacccgcatcttcaaaatcagcgatcaggataatgacgggaccctcaacgatgctgaactaaactttttccagcgcatctgttttaacacgcccctggccccacaggcactggaagacgtgaagaacgtcgttaggaagcacatctccgatggggtggccgactctggacttacgctgaaaggtttcctcttcttgcatacgctgttcattcagagagggcgacacgaaaccacctggaccgttcttcggcgattcggctacgacgatgatctggaccttacccccgagtacctgtttcctctcctgaaaataccgccggactgcacaaccgaacttaaccatcacgcataccttttcttgcaaagcacttttgacaaacacgatctggaccgggattgtgccctgtctccggatgagctgaaggacttgttcaaggtttttccatacatcccctggggacctgacgtgaacaacactgtgtgtactaacgagaggggctggatcacttaccagggctttctgtcacaatggactctaaccacctatcttgatgtgcagaggtgtctggaatacctaggctaccttggctactctatcctcaccgagcaggagagtcaggccagcgcggtgactgtaacccgcgataaaaaaatcgatctccaaaagaaacaaacccaaagaaacgtcttccgttgtaacgttattggagtaaagaactgtggaaaaagtggtgtcttgcaagccttattgggccgcaatctgatgagacagaaaaagatcagggaagatcacaagagttactatgcaataaacactgtatacgtgtacgggcaagagaagtacctgttacttcacgatatctcagagtctgagttccttacagaagccgaaatcatatgtgatgtggtatgtctcgtctacgacgttagcaatccaaagtcctttgagtattgcgctaggattttcaaacaacatttcatggatagccgcatcccttgtctcatcgtggccgccaagagcgatctccatgaagtaaaacaggagtacagtatttctcctacagacttttgccggaaacacaagatgccccccccacaggcatttacttgcaataccgccgatgccccaagcaaggacatatttgtcaagctgaccacaatggccatgtaccctcatgctcgtctgcgctgcatgtgcacttgcaatcggtgtacgttctgtatttgccaaaacttcctgaattccgatcttctccagagcgtaaaaaacaaaattttcacggccgtgctgaataggcatgtcacacaggcagacctcaaaagctcgaccttctggctgagggcctcctttggcgcgactgtctttgcggtgttgggattcgccatgtacaaagctctattgaaacagagatag

SEQ ID NO: 202611 - DNA, 2076 bp, Artificial Sequence
  Description of Artificial Sequence: Synthetic coding sequence
atgaagaaggacgtgcggatcctgctggtgggcgagccccgggtggggaagacctcgctgatcatgtcactggtctccgaggagtttccagaagaagtcccacccagggctgaagagattaccatccccgccgatgtcacacccgagcgggtccccacccacatcgtggactactccgaggctgagcagtctgacgagcaactgcaccaggaaatctctcaagctaacgtgatttgtatagtatatgctgtaaacaataagcacagtatcgacaaggtgacttcacgttggataccactgattaatgagagaacggataaagatagtaggctcccccttatactggttggcaacaagagtgaccttgtggaatactcaagcatggagaccattctgccaattatgaatcagtatactgaaattgaaacatgtgtggagtgtagcgctaagaatctgaaaaacatcagcgagctgttctattatgcccagaaggcagtgctccatccgacggggccattgtattgccccgaggaaaaggagatgaagcctgcctgcatcaaagcattaaccagaatttttaagatctccgaccaggataacgatggaacgttgaacgatgccgagttgaactttttccagcgaatttgctttaacacccctttggccccacaggcattagaggatgtcaagaacgtggtgcggaagcatattagcgatggtgtggcagatagcggcctgacactgaaagggtttctcttcctacataccctcttcattcagagaggacgacatgaaaccacgtggaccgtgctgagacggttcggatacgatgacgaccttgatcttaccccagagtacctgttccccttactgaaaataccacctgactgcaccacggaattaaatcaccacgcgtatctctttcttcagagtaccttcgataagcacgatctcgatcgcgactgcgccctgtcgccagatgagctgaaggacctcttcaaagtgtttccctacatcccctggggtcctgacgttaataatacggtctgcactaatgaacgagggtggattacttatcagggttttctttcccagtggaccctcaccacgtaccttgacgttcagcggtgtctagagtaccttggctaccttggatactcaatccttacagagcaagagtcccaagcctctgccgtgactgtgacaagggacaaaaaaatagacctgcagaagaaacaaacccagcggaacgtgtttcggtgcaatgttatcggcgtgaagaattgcggcaaaagcggagtgctgcaggcgctactggggagaaacctcatgaggcagaagaagattcgggaggatcacaaatcctactacgctatcaataccgtctacgtctacgggcaagagaagtacctgctgttgcatgacattagtgagagcgaattcctgacagaggctgagataatatgtgatgtggtatgcttggtgtacgacgtaagtaatcctaagtctttcgagtactgcgcgcgcatttttaagcagcactttatggactcgcgcattccttgtttgattgttgccgctaaaagtgatctgcacgaagtcaagcaggaatactccatatcgcctactgatttctgcaggaaacacaaaatgcctcccccgcaggcattcacctgcaatacagccgacgctccctcaaaagacatctttgtgaagctgacaaccatggccatgtatcctgaggaccattaccgtgaccggttaagtagggatatgggtcacaccgaccggatcgagaacttgcggaagatctgggttttcctaaaaaccgccttccatgccaggctgagatgcatgtgcacatgtaatagatgtacattttgcatatgccagaacttcctcaactctgatctcctccagtcagtgaaaaacaaaatttttactgccgtcctgaacaggcatgtcacccaggcggacctgaagagcagtacattttggctgagagcgagcttcggagctacagtttttgccgtcttaggattcgcaatgtataaggccttacttaagcagcgatag

SEQ ID NO: 202612 - DNA, 1953 bp, Artificial Sequence
  Description of Artificial Sequence: Synthetic coding sequence
atgaagaaggacgtgcggatcctgctggtgggcgagccccgggtgggtaaaacatcgctgattatgagtctagtgtcagaggaattccctgaggaagttccgcctcgggccgaagaaattacaatacctgccgacgtgacccctgagcgcgtacctactcatattgtcgactactccgaggctgagcagagcgatgaacagttgcatcaggaaatttctcaggctaacgtgatctgcatagtgtacgctgtgaacaacaaacattctatcgacaaggttacctcccggtggatcccgctgataaacgagcgtacggacaaggatagccgccttccccttattctggtgggaaacaaaagtgacctcgtcgaatattcaagcatggagacgatcttgcccattatgaaccagtacacagagatcgagacgtgtgttgagtgcagtgcaaagaacctaaagaacatcagcgaactgttttactatgctcaaaaggctgttctgcacccaacaggaccgctgtactgtcctgaggagaaagagatgaaacctgcgtgtataaaggccctaaccaggatattcaagattagcgatcaggacaacgacggcacattgaatgacgcggagctgaactttttccagcggatctgcttcaacactccccttgcccctcaagctctcgaggacgtaaagaacgtggtgaggaagcatatctcagatggagtcgctgattcgggcctcaccttaaagggttttctgttccttcacacactgtttattcaaaggggacggcacgaaaccacctggacggtccttaggcggttcggatatgatgacgatcttgatctcactcctgaatacttattccctctgcttaaaattcctcctgattgtacaacggagctcaaccatcatgcatatctgttcctgcagtcgaccttcgacaaacacgacctggaccgggattgcgccctgtccccagacgagttgaaggatctcttcaaggtatttccttatattccatggggaccagatgtaaacaatacagtttgtaccaacgaaaggggttggataacctatcaggggttcctgagtcaatggaccctgacaacttacctcgacgtgcaacgctgtcttgaatatctcgggtacctgggctattcaatattgacagagcaagagagtcaagccagcgctgttactgtgactcgtgataagaaaattgacctccagaaaaagcagacccagcgcaacgtgtttagatgtaacgtgatcggtgtcaagaattgtgggaaatccggagttctgcaagcactgctgggccggaatctcatgagacagaagaagatccgggaagatcataagtcatattatgctatcaacacagtatatgtttacggacaggagaagtacctgctcctgcacgacatttcagaatccgagttcctaacagaagctgagatcatctgcgatgtcgtgtgccttgtctacgatgttagcaaccccaaatcttttgagtactgcgcccggatcttcaagcagcatttcatggactctaggatcccatgccttatcgtcgcagccaaatcggatctccatgaggtcaaacaggaatattccatctctccaactgatttttgcagaaaacataagatgcctccgcctcaggcttttacttgcaacaccgccgacgcccccagcaaggacattttcgtgaagcttacaacaatggcaatgtacccagaagaccattatcgcgatcgcctaagccgggacatgggacacacagatcgcatcgaaaacctgaggaagatctgggtgttcctgaaaacggctttgcatgtgacacaggccgacctgaagtcgtcaacattttggttgcgcgcaagttttggcgccaccgtctttgcagtgctggggtttgccatgtataaggccctcttgaagcagcgatag

SEQ ID NO: 202613 - DNA, 744 bp, Artificial Sequence
  Description of Artificial Sequence: Synthetic coding sequence
atgaagaaggacgtgcggatcctgctggtgggcgagccccgggtgggaaaaacatctctgattatgtcgttagttagcgaagagttccctgaagaggtgcccccccgagccgaagagatcaccatccctgctgacgtaacacccgagcgcgtccccacgcacatcgtagactacagcgaggcggagcaaagtgacgaacagctgcaccaggaaattagtcaggcaaatgtcatttgcatcgtatatgccgtgaataacaagcattccatagacaaagtgacgtcccggtggatccctctgatcaacgagcggacggacaaggactctaggttacctttgatcctcgtcggcaataagtctgacctagtggagtactcctctatggagaccattctgcctatcatgaaccagtacacagaaattgaaacctgtgtggaatgctcagctaagaacctgaagaacatctctgagctcttttactatgcccagaaggcagtgcttcatcccactggtcctctctactgcccagaggagaaggaaatgaagcccgcttgcattaaggccttgaccaggatttttaaaatctcggatcaagacaacgatgggactctgaatgacgcagagcttaattttttccagcgaatctgttttaacacaccattggcaccaagatttgggttcgagcaggtgctagtgctgctgtttctgcagttttgggccctcctctgtactaaacactactag

SEQ ID NO: 202614 - DNA, 1857 bp, Artificial Sequence
  Description of Artificial Sequence: Synthetic coding sequence
atgcggcgggacgtgcggatcctgctgctgggcgaggcccaggtgggtaaaacctctttgatcctcagcctcgtcggagaagagttccccgaagaagtcccaccccgggccgaggagattactatccccgcagacgtgactcctgagaaggttcccacccatattgtggattattccgaagcggaacagacggacgaggaattgcgagaggaaattcacaaggctaatgtggtgtgtgtggtgtacgacgtttccgaggaagctactatcgaaaaaatacgaaccaagtggattccacttgtcaatggcggaacaacccagggtcctagagtacctatcatcttggttgggaataaaagcgacctccgatcagggtcttccatggaggcagtgctgcctattatgagtcaatttccggaaatcgaaacgtgcgtggagtgctcagctaagaatctgagaaacatttctgagcttttttactacgcacagaaagcagtgctgcatccaacggccccactgtatgaccctgaggcaaaacagctgcgcccggcgtgtgcccaagccctcaccagaatcttcaggctctccgaccaggacctcgaccaggcactctctgacgaggaactgaacgcttttcagaaaagctgttttggccacccactggccccccaggcacttgaggacgtgaagaccgttgtttgccggaatgttgccgggggggttagagaggacaggcttaccctggacggctttctgttcctgaacacactcttcattcaacggggcagacacgagaccacctggaccatcctccgcaggttcggatatagcgacgcactggaacttacagccgattatctttctcccctcatccatgtgcccccaggctgctcaactgaactcaatcatctggggtatcagttcgttcagagagtctttgaaaagcacgatcaagatcgggatggtgctctgtcacctgtggagctacaaagtctgtttagtgtattccctgctgccccttggggacctgagcttccacgcactgtccggaccgaggcaggccgcctgcctcttcatggatatctgtgccaatggacgctcgtcacatacctggatgtaagatcctgtctcggacaccttgggtacctgggatatccaaccctgtgtgagcaagaccaggcacacgctataaccgtaacaagagaaaaaagactcgatcaggaaaaaggccagactcaacggtcagtgctgctctgcaaagtggtcggagcccggggtgtaggtaagtccgccttcttgcaggcttttctaggccgggggttgggccatcaagatacgagagaacagccccctggctacgcaattgataccgtacaagtgaatggacaggaaaagtatttaatcttatgcgaggtgggaaccgatggactcctcgccactagtttggatgccacgtgtgacgtggcctgcttgatgttcgatggttccgatccaaagtcattcgctcactgtgcctctgtgtacaagcatcattacatggatggtcaaacaccatgtctgttcgtaagctccaaggctgacttaccagagggagtggccgtttcaggtcccagcccggctgagttctgccggaaacaccgtctcccggctcccgtgcctttttcttgtgctggccctgcagagcccagcaccacaattttcactcaactggctaccatggcggctttccctcacctggttcacgctgaactccatccctctagcttctggctgcggggtctgcttggggtggtaggcgctgccgtggcagccgtcctatctttcagcctgtacagggtgctggtcaaaagccagtag

SEQ ID NO: 202615 - DNA, 777 bp, Artificial Sequence
  Description of Artificial Sequence: Synthetic coding sequence
atgcccccccagcagggcgaccccgccttccccgaccggtgcgaggctccccccgtgccaccccggagggaacgcggaggtaggggcggacgaggcccaggagagcctggaggcaggggccgagctggaggggcagagggccggggagttaagtgtgtcctcgttggggatggcgcggtgggtaagacgagcttggtcgtgagctatactacgaatggctaccccacagagtacatccctacggccttcgacaatttcagcgccgtggtgagcgttgatggaagacccgtccgcctgcagctgtgcgatacggctggacaggacgagttcgacaagctacggcccctttgttataccaacactgacatcttcctcctgtgctttagcgtggtgtcacccagcagtttccagaatgtttctgagaagtgggttcccgagattaggtgccactgccccaaagccccgatcatcctcgttggcactcagtccgacctgagggaagacgtgaaggtgctgattgagctggataaatgcaaggagaaaccagttcctgaggaagctgccaagttgtgcgccgaggagattaaagctgcatcgtacatcgagtgttccgctctgacacagaagaacctgaaggaggtgtttgatgccgctatagtggccgggattcagtacagcgatacgcagcagcagccaaagaagagtaagagtcgcacaccagataagatgaaaaacttgagcaagagttggtggaagaaatactgctgcttcgtctag

SEQ ID NO: 202616 - DNA, 1527 bp, Artificial Sequence
  Description of Artificial Sequence: Synthetic coding sequence
atggaccacctgggcgccagcctgtggccccaggtgggcagcctgtgcctgctactggccggggccgcatgggcccccccgcctaacctgccggaccccaaatttgaatccaaggcagcactgttagcagctcgcgggcccgaggagcttttgtgttttacagagaggctggaggatctcgtatgcttttgggaagaggccgcttcggccggagttgggcctggcaactattctttttcctaccagctcgaagacgaaccctggaagctgtgcaggctgcaccaggcacctacagcacgtggcgctgtgcgtttctggtgttcacttcccacagcagacacatcgagctttgtgcctctcgaactccgggtgaccgcggcaagcggagcaccaaggtaccacagggtgatccacatcaatgaggtggtgctgttggatgcaccagtgggcctcgtcgctcgcctggctgacgagtcaggccatgtggtcttgcggtggctcccgccgcccgaaactcctatgaccagtcatattcgctacgaagtggatgttagtgctggcaatggcgccggctctgtccaaagagttgagatactagaaggccgaaccgaatgtgtgttatctaacctacggggcaggacccggtacacatttgccgtgcgggcgcgcatggcagaacccagcttcggagggttttggagtgcatggagtgaacccgtgtcactgctgaccccttctgatctcgacccattgattctcactttatccctgatactcgtggttatcttggtgttgctgaccgttctcgctttgttgtctcaccgccgggctctgaagcagaaaatctggcccgggattccatccccagaatccgagtttgaaggcctgtttaccacccataaaggcaactttcagctgtggctctaccagaatgacggctgtttgtggtggtctccttgcactccgtttaccgaagatcctcctgcctcactagaagttcttagtgagcgatgttggggaaccatgcaagccgtggaacctggcacggatgatgaaggccctctattggaaccagttggctccgagcatgcccaggatacctatctggtgctggacaagtggctcctgcctagaaatccaccatctgaggatcttcctggcccaggcggcagtgtcgatatcgtagcaatggacgaggggtctgaggcctcctcatgcagttccgccctggcttctaagcctagccccgaaggtgcctctgctgcttcttttgaatacactattttggacccctccagccagttgctccgcccatggaccctatgtcctgaactcccccccaccccaccccacctcaaatacctgtacctggtggtcagcgactctgggatttcaacggattactcatcaggcgattcccagggcgcccagggtggactatctgatggcccatactcaaatccatatgaaaattctctgattcctgccgctgaacctctacccccctcgtatgtggcctgctcttag

SEQ ID NO: 202617 - DNA, 2550 bp, Artificial Sequence
  Description of Artificial Sequence: Synthetic coding sequence
atggccgccgccgcccccgccgccgccgccgccagcagcgaggcccctgcagcgtcggcaaccgccgaacccgaggctggggatcaagacagcagagaggttcgggtgctacagtccctgcgcggcaaaatctgtgaggcaaagaacctcctgccttacctgggccctcataaaatgagagactgcttctgtacaattaacctcgaccaggaagaggtatatcgtactcaggtggtggagaagtccctgtcccccttctttagtgaggaattctactttgaaatcccccggacctttcagtacctgtctttctacgtttacgacaagaatgtcctgcagagagacctgcgaatcgggaaggtggcaatcaagaaggaggacttgtgtaatcactctggaaaggagacctggttctcgctccagcctgtggactctaatagcgaggttcagggcaaagttcatttggagctgaaactgaacgaacttattactgaaaacggaaccgtatgccagcagctggtcgtacacattaaggcttgccatggccttcctcttattaatggacagtcttgtgacccgtatgctacagtctcactcgtcggaccttccagaaatgatcagaaaaaaacaaaagtcaaaaaaaagacctctaacccccaatttaatgagatcttctactttgaggttacccgcagtagcagctacacaaggaaatcccagtttcaggtggaagaggaggacattgagaaactggagatccgcatagacctgtggaataacggaaatctggtgcaagacgtgttcctgggtgagataaaggtacctgtcaatgtcctgcgcactgactcttcacaccaggcttggtatctccttcagcctcgtgacaacggcaacaaaagttccaaaacagacgatcttggttcactacgactgaacatatgctacaccgaggattatgttctgccctccgagtactacggacctctgaagaccttgctgttgaagagcccagatgtacaacctatatctgcgagcgcagcctatattctgtcagaaatatgcagagacaagaacgatgcagttctacccctcgtacgactgctgctccatcacgacaaactagtaccttttgcaacagcagtcgctgagctggacctgaaggacacgcaggatgctaacaccatatttcgcggcaacagtctggctacacgctgcttagatgagatgatgaaaattgtgggtggacactatttaaaagtgactctgaagcccattttagacgagatttgcgactcttctaaaagctgtgaaattgatccaataaaactgaaggagggagacaacgttgagaacaataaggaaaacctgagatactacgtcgacaagctgttcaatacaatcgtcaagtccagtatgtcatgtcctactgtcatgtgtgacatcttttacagcctgaggcaaatggcgacccagcgattcccgaatgatccccacgttcaatattcagccgtgagcagctttgtgttcctgcggttctttgctgtggccgtggtgagtcctcacaccttccatctccggccgcaccatccagatgctcagacaattcggacccttaccctcatctcaaaaacgattcagaccctgggctcttggggctccctgtccaaaagcaaatccagctttaaagagaccttcatgtgtgagttcttcaaaatgtttcaggaagaaggctatatcattgctgtaaaaaagttcttggatgagatctcatccacagagacaaaggaatcatccggcacatccgaacccgtccaccttaaggaaggagagatgtacaagcgggcgcaggggcgaactaggatcggaaagaagaacttcaagaagagatggttctgcctgacttcacgggagttaacttaccacaagcaacccggcaaagacgcaatatatactatccccgtgaaaaatattttagcagttgagaagctggaggaaagttcattcaacaaaaagaatatgtttcaggtcatccacaccgaaaagcctctgtatgttcaggctaataactgcgtggaagcaaatgagtggatcgacgttctctgccgggtcagccggtgtaaccaaaatcggttatccttctatcacccctcagtttacctgaatggaaattggctgtgctgtcaagaaactggggagaatactctgggttgtaagccatgtaccgcgggggtacctgctgacatccaaattgacattgacgaggatcgcgagacggaaaggatttatagtctgttcacactttctttgttaaaattgcagaaaatggaagaagcatgcgggactattgccgtttatcaggggccccagaaggaacccgacgattatagcaacttcgttatcgaggactccgtaaccacttttaaaaccatacagcagataaagagtataatagagaaacttgacgagccacatgaaaagtaccggaaaaagcggagcagcagcgcaaaatacgggagcaaggagaatcctatcgtggggaaggcaagctag

SEQ ID NO: 202618 - DNA, 834 bp, Artificial Sequence
  Description of Artificial Sequence: Synthetic coding sequence
atgatgaagatcgtgggcggccactacctgaaggtgaccctgaagcctatattagacgaaatttgcgatagttccaaaagctgcgaaattgatcctatcaaactgaaagagggtgataatgtggagaacaataaggaaaacttaaggtattatgtcgacaaactgttcaacactatagtgaaaagctccatgtcctgtccgaccgtgatgtgcgatatattttactctctgagacagatggcaactcagaggtttcctaacgatcctcatgtccagtatagcgctgtgagttcctttgtattcctgcgctttttcgccgtagccgttgtgtcaccccacaccttccaccttaggccgcaccatcctgacgctcagaccatcaggacgctgacccttatctctaagaccattcaaaccctggggagctggggatcgctgagcaaatctaagtccagcttcaaggagaccttcatgtgcgagtttttcaaaatgtttcaagaagaaggatacataatcgctgtcaagaaattcctggatgagatctcttccacagaaaccaaggagtcaagtggaacctcggaaccagtgcatctgaaggaaggggaaatgtacaaacgggcacaaggacgaacacggatcggcaagaaaaactttaaaaagaggtggttttgcctcacttcccgcgagcttacctaccacaagcagccaggatcctgtgtctacgccctcctgtggggcttttcttggttttctgtcaaagtaagcctccccctgatcgttactctggtgaacccattttctaacataacagtggtgtacgggttctctcattag

SEQ ID NO: 202619 - DNA, 2553 bp, Artificial Sequence
  Description of Artificial Sequence: Synthetic coding sequence
atggccgccgccgcccccgccgccgccgccgccagcagcgaggccccagccgcctccgcaacagcagagcccgaggccggggatcaggattcacgggaggtccgcgtattacagtcgttgcgaggaaagatctgtgaagcgaaaaacctgttgccttatcttgggccccataaaatgcgtgactgtttttgcaccattaacctggatcaggaagaggtgtaccggacccaggtagttgagaaaagcctgagcccattcttttccgaggaattttattttgaaatcccccgcacctttcagtacctctctttctacgtctatgacaaaaatgttctgcagcgggaccttcggatcgggaaggtggctattaagaaggaggacctgtgcaatcatagcgggaaggagacatggttttcactgcaacctgtcgacagtaattctgaggttcagggaaaagtccacctagaactgaaactgaatgagctgattactgaaaacggcaccgtctgtcagcagctagtggtgcacatcaaggcatgccacggattaccgttaattaatggccaaagttgcgacccgtacgccaccgtaagccttgtcggcccctccagaaatgatcagaagaagactaaagttaagaaaaagacgtccaaccctcagtttaatgagatcttctactttgaggtgactcggagttcttcatacaccaggaagtcccagtttcaggtggaggaagaggacattgagaagctcgaaatacgcatcgacctgtggaataacgggaacctagtccaggacgtcttcctgggcgaaatcaaggtacctgtgaacgtgcttaggacggattcttcccatcaggcctggtatcttctgcagccccgggataacggcaataaatccagtaaaacagatgatctaggctctctgcggttgaacatctgttatactgaggactatgtgctgccatccgaatactacggtcccctgaagacactgctcctcaaaagcccagatgtacagcccatcagcgcatcagccgcctacatcctgagtgagatctgccgagataagaacgacgccgttctgcctctggtccgcttgctcctgcatcatgataagctggtaccgtttgcaacggccgtggctgagttggacctcaaggacactcaggacgccaatactatcttccgagggaactctcttgccactcgctgtctcgacgagatgatgaaaattgtaggcgggcattatttgaaggtgacattgaaacccattctcgatgaaatttgcgattcttccaaatcgtgtgagattgatccaattaagctgaaagagggtgacaacgttgagaacaacaaagagaatcttcgttactacgtggataagctgtttaacaccattgtcaaatcttccatgtcctgccccacagtaatgtgtgatattttctacagccttagacagatggctactcaacggttccccaacgacccccacgtgcagtactctgcagtttcgtcctttgtttttttacgattcttcgcagttgctgtcgtgagtccgcatacattccacttgcgtccccaccatcccgacgcccagaccatacggacactgacgcttattagcaaaactatccagactttaggaagctggggtagtttgagcaagtccaagagctccttcaaggaaacctttatgtgcgagttcttcaaaatgttccaggaggaaggatatataatcgcggttaaaaagtttttggatgagattagttcaaccgagaccaaggagagctcgggaaccagcgaaccggtgcacttgaaggagggggaaatgtataagcgggcgcaggggagaactaggataggcaaaaagaatttcaaaaagagatggttctgtctgacttcgagggagctgacctatcacaagcaacccggctcaaaggatgctatatacacaataccagtgaaaaacattctcgctgttgagaaactggaggagtccagctttaataaaaaaaatatgtttcaggtgattcacacagagaagcccctctatgtgcaagcaaacaactgtgtcgaggccaatgaatggattgacgttctctgtagggtgtcacgctgtaatcagaatagactgagtttttaccatccctccgtttacctgaacggcaactggctctgttgccaggaaaccggcgaaaataccttaggctgcaagccatgcacggctggagtcccagccgacattcaaatcgacatcgatgaagatcgcgagactgagaggatctattccctcttcacattgtcgctcctcaaattgcagaaaatggaggaggcctgcggtacaatcgcagtttaccaggggccccagaaggagcccgatgattatagtaactttgtgatcgaggattccgtcacaaccttcaaaaccatccagcagattaagtcgatcattgagaagctggatgaaccccatgaaaagtatcgtaagaaaagatcttcttctgctaagtatggctccaaggagaacccaatcgtgggaaaagcaagttag

SEQ ID NO: 202620 - DNA, 2505 bp, Artificial Sequence
  Description of Artificial Sequence: Synthetic coding sequence
atggccgtggaggacgagggcctgcgggtgttccagagcgtgaagatcaagatcggagaagcgaaaaaccttcctagttatccgggaccttcaaaaatgcgcgattgctactgtacagtgaacctggaccaggaagaggtgtttaggacaaagatagtagagaagtccctgtgtcccttctatggcgaggatttttactgtgaaatccctaggtcctttcggcatcttagtttttacatattcgaccgcgacgtctttaggcgcgatagtattatcggaaaggtcgcgatccagaaagaagacctgcagaaataccacaatcgcgacacctggttccagctacagcatgtcgacgcagattccgaggtccagggaaaggtccacctggaattaaggctgtcagaagtgattacagatacaggggtagtgtgtcacaaactcgcgacgaggatcgtggagtgccaggggctgccaattgtgaacggccagtgcgacccttacgccactgtcactctggccggccccttccggagtgaagccaagaaaactaaagtgaaacggaaaacaaacaacccccagttcgacgaagtattctattttgaggtcaccaggccttgttcttactctaagaagtcacactttgattttgaggaggaagacgtggataagctagagataagagtcgacctgtggaacgcatccaacttgaaattcggggacgaatttcttggtgagctccggatcccgttaaaggtgctgcgtcagtccagcagctacgaagcatggtatttcctgcagccaagagacaacggcagcaaatctttgaagccagacgatctgggatccttgcgactcaatgtggtgtatacggaagaccatgttttctcttccgattactattctcctctcagggaccttctgctcaagtccgccgacgttgagcccgtgtctgctagcgctgcacacatcctgggggaggtctgtcgggaaaagcaggaggccgcagtgcctctcgtccgcttatttctacattacggccgggtggttccattcatctccgcaattgcatccgctgaggtaaagaggactcaggaccctaacacaatttttcgcggcaacagcctagcctccaagtgcatcgatgaaactatgaagctggctggtatgcattatctgcacgtgactttgaagccagcaattgaggaaatctgtcagtcccataagccctgcgagatcgatccagtgaagttgaaggatggcgagaaccttgagaacaatatggagaacttacggcagtacgtcgatagagtgtttcatgctataactgagagcggtgtgtcttgtcccaccgttatgtgtgacatatttttcagccttagagaggctgccgctaagaggttccaggacgacccggatgtccgctacaccgccgtctccagcttcatttttctgaggtttttcgccccggccattctgtctccaaatttgtttcaactcacacctcatcacacagacccccagacatcacgcacgctgacgctgatctctaagacggtgcagaccctggggagcctctcgaagagcaaaagtgcttcgttcaaagagtcatacatggccaccttctatgagttcttcaacgaacagaagtatgccgacgccgtcaaaaactttctagatctgatctcttcttcgggcagacgggatccaaagtctgtggaacagcctatagtgctgaaggagggttttatgatcaaacgagctcagggcagaaagcggttcggaatgaagaatttcaaaaagcggtggtttaggctcacaaaccatgaattcacctaccataaatctaagggtgatcaaccactctacagtatcccaattgagaacatcctcgccgtcgagaagctggaggaggagagcttcaagatgaagaacatgtttcaggttatccaacctgagagggctctgtacatccaagcgaataattgtgttgaagccaaagattggatagacatcttaaccaaggtgagccagtgcaaccagaagcggctgactgtatatcatccttccgcctacctgtctggacattggctttgttgtagagccccttctgactctgcccctggttgctcaccgtgcactggtggtctgcctgcaaacattcaactagatatcgatggcgatagagaaacggaacgtatttatagtctttttaacttatatatgagcaagctggagaagatgcaggaggcatgcggctccaagtcagtctatgacgggccagaacaggaagaatacagtacctttgttattgatgatcctcaggaaacgtacaaaacactcaaacaggtgatagccggggtaggtgctttggaacaagagcatgcccagtacaagcgggataagtttaaaaagaccaaatacggctctcaggagcatccaatcggcgacaaaagctttcagaactacatacgccagcaatcggagacatcaactcacagcatctag

SEQ ID NO: 202621 - DNA, 2409 bp, Artificial Sequence
  Description of Artificial Sequence: Synthetic coding sequence
atgcgggactgctactgcaccgtgaacctggaccaggaggaggtgtttaggacgaagatcgtcgagaagtccctgtgcccattttatggagaagacttttactgcgaaatccctagaagctttaggcacctctcattctatatctttgacagggatgtattccggcgagactctatcattggcaaagtggcaattcagaaagaagacttgcagaagtatcacaaccgtgacacatggtttcagctgcagcatgtggatgcagattcagaagtacagggcaaggttcatctggagctgcggttatccgaggttatcacagataccggggtggtttgccataaactagccaccaggatcgttgagtgtcagggcctcccaattgtaaacgggcagtgtgacccctacgcaaccgtgaccctcgccggacctttcagatctgaagcgaagaaaacaaaagtcaagcgaaagactaacaaccctcagtttgacgaggtgttttactttgaagtaacccgaccatgttcatacagcaagaaatctcactttgactttgaggaggaagatgtggataaattggaaatccgggtcgatctatggaacgcctcaaatctcaagttcggtgacgaattcttaggagaactgcgaatacctctgaaggttctgcgccagtctagctcttacgaggcatggtactttcttcagccccgcgacaacggtagtaagtctctgaaacctgatgatttgggatccttgcgcttgaacgtggtatatactgaggaccacgttttcagtagtgactactactctccccttcgcgaccttctactgaaatcagcagatgtcgagccagtgtcggcttcggccgcccacatacttggtgaggtctgccgggagaaacaggaggccgctgtaccactcgtgcgactgttcttacattacggcagagtcgtcccattcatcagcgccatcgcctcagcagaggtgaaacggacccaagatccgaacaccatcttcaggggaaattcactcgcatccaagtgtatcgacgagaccatgaagctggctggcatgcattacctgcatgtgaccctgaagccagccatcgaggaaatttgccagagccataaaccttgcgaaattgaccccgtgaagctcaaagacggcgagaatctggaaaataatatggaaaatttgagacagtatgtggacagggtattccacgcaataactgaaagcggagtcagttgccccaccgtgatgtgcgatatattcttctcgctgcgggaggcagctgctaaaaggtttcaggatgatcccgacgtccgctacaccgccgtgtcctcatttatttttctgcgctttttcgcaccagctatcctgagtccgaatctgttccagctcactcctcatcataccgacccgcagacctcccgcacactgaccctgattagtaaaacagttcagaccctgggaagtctgtccaaaagcaaaagcgcttcgtttaaggaatcttatatggctactttctatgaattttttaatgagcaaaagtacgccgacgcggtgaagaactttttagatttaatcagctccagcggaaggcgtgaccctaagtctgtggagcagcccatcgtccttaaagaggggttcatgataaaaagggcccagggccggaagagattcggaatgaagaattttaagaagcgatggttccgcctgacaaatcatgaatttacataccacaaaagtaagggagaccaacccctgtacagcataccaatcgaaaatatccttgctgtcgagaaactggaggaggagtcgttcaagatgaaaaacatgtttcaagtcatccagcccgagcgtgcattatacatccaggctaataactgcgtggaggccaaagattggatagacatcctgacgaaagtgagtcagtgtaaccaaaaacggctaacagtctatcacccgtccgcctacctctcaggccattggctgtgctgtcgtgctccgtctgacagtgcacctggctgctcaccatgtaccggcggtctccccgccaacatccaactggatattgatggagatcgagaaaccgaacgaatttacagcctattcaacttgtacatgtctaagctcgaaaaaatgcaggaagcctgtgggtcaaagtcagtttatgatgggcccgaacaggaagaatattcaaccttcgttatcgacgatcctcaggagacctataaaactcttaagcaggtgattgctggggtcggggctctggaacaggagcacgcgcaatataagcgagacaagttcaagaaaacaaagtatgggtcgcaagagcaccccatcggagacaagtcttttcaaaactatataaggcagcaatccgaaacatccacccattcgatatag

SEQ ID NO: 202622 - DNA, 399 bp, Artificial Sequence
  Description of Artificial Sequence: Synthetic coding sequence
atggccgtggaggacgagggcctgcgggtgttccagagcgtgaagatcaagatcggggaagcgaagaatcttccatcttaccctggtccatcaaagatgagagattgttactgtacggtcaatttggaccaagaagaggtcttcaggactaagatagtggagaaatccctctgccccttttacggcgaggatttttattgtgagatcccacgcagctttcgccatctgtcattttatatattcgatcgggatgtgtttcgcagggacagcataatcgggcaatctgctccaggtgctgccgccgaacgcggccaccatcggcactggggcagattgccacaggcccgacatacgcatcggcgtgtgcccggccctccccatagggaatgggccatgtag

SEQ ID NO: 202623 - DNA, 2412 bp, Artificial Sequence
  Description of Artificial Sequence: Synthetic coding sequence
atggccaagcggagcagcctgtacatccggatcgtggagggcaagaacttacctgctaaagacattacgggctcttcagacccttattgcatcgtgaaagtggataacgagccaattatcagaacagctacagtttggaagacactctgccctttttggggagaggaataccaagtgcacctgccccctactttccatgccgtagccttttacgtcatggatgaggacgctctcagcagagacgatgtgatcgggaaggtatgcttgacccgggacaccatcgcatcccaccctaaggggttctcgggatgggcccacctgacagaggtcgacccggacgaagaggtgcaaggagagattcacttacgattagaggtctggcctggggcccgagcatgccggcttcggtgtagcgtactcgaggcccgcgatctggcccctaaagatcgaaatgggacgtctgacccttttgtacgggttcgatacaaagggaggacgcgtgagacttctatagtcaagaaaagttgttatccgcggtggaatgaaacattcgaatttgaactgcaagagggcgcaatggaggcactctgcgtcgaggcatgggattgggatctcgtgagcaggaacgacttcctgggtaaagtggtcatcgacgtgcagcgactgagggtcgtgcagcaggaagagggctggttcaggctgcagcctgatcaatctaaatcccggcggcacgatgaaggaaacctgggatccctgcagctcgaggtgcgcctgcgtgatgagaccgtcctgccgtcaagctattaccaacccctggtgcatctcctctgccatgaggtgaagctcggcatgcagggtcccggacagcttattccgcttatcgaagaaacgacgagtactgagtgtagacaggatgtggctaccaatctgctaaagcttttcctgggtcagggcctcgcgaaagatttcttggatctgctgtttcagctggagctgagtcggactagtgagactaatactctgtttcgatccaactcactggcttccaagagcatggagtcattcctgaaggttgccggaatgcagtacttgcacggcgttctgggccccattatcaacaaagtgtttgaagagaaaaagtacgttgagctggacccgtccaaggttgaagtgaaagacgtcggctgttccggcctgcaccgccctcagaccgaagccgaggttctggagcagtccgcccagaccctgcgcgcccatctcggcgctcttctcagtgccctatccagatccgtccgggcgtgtcccgccgtagtccgcgcgactttccggcaactgttccgtagggtgcgggagaggttcccaggtgcccaacacgagaatgtgcctttcatcgccgtgacttcctttctctgcttacgcttcttctcccccgcaatcatgagccctaagcttttccaccttcgcgagcggcatgccgacgcccggacatccagaaccctgcttcttttggccaaagctgtgcagaatgtaggcaacatggatacgcctgctagcagggccaaggaggcatggatggaaccccttcagcctacagtccgtcaaggggtggcccaactgaaagattttattacaaagctcgtggacatcgaggagaaggacgagctggacttgcaacggacactgtctctgcaggcgccccctgtaaaagaaggccccttgtttatccacaggacaaagggaaaagggccattgatgagctcatcctttaaaaagttgtatttcagtctgacaaccgaggccctctcattcgcaaaaaccccgtcttccaagaaaagcgcgctgatcaaactggcaaacattagggctgcagagaaggtggaagaaaagtccttcggaggcagccatgtgatgcaagtgatctatacggacgatgcagggcgtcctcagaccgcctatctccagtgtaaatgcgtgaacgagctcaatcagtggctctctgctctgagaaaagtgtccattaataataccgggttgctcggaagttaccacccaggggtattcaggggtgataagtggagctgttgccaccagaaggaaaaaaccggccaggggtgcgataaaactaggagtagagtgaccctgcaggagtggaatgacccattagaccatgatttagaagctcagctaatttaccggcacctcctgggtgtggaagccatgctgtgggaaaggcatcgggagctatccggaggtgcagaggctgggaccgtaccaacttctccgggcaaggtccccgaagacagcttagcccgcctgctgagggtgctgcaggacttaagggaggcacattcttccagtcctgctggatctcccccctccgagccaaactgtcttctggaactccaaacctag

SEQ ID NO: 202624 - DNA, 2274 bp, Artificial Sequence
  Description of Artificial Sequence: Synthetic coding sequence
atggccaagcggagcagcctgtacatccggatcgtggagggcaagaaccttcctgctaaggatatcactggctcttccgatccatactgtatcgtgaaggttgataacgaacctattatccgaaccgcgacagtttggaagaccctctgccctttttggggtgaggagtatcaggtgcatttgcccccaacattccatgctgtggcattctacgttatggatgaggatgccctgtcccgggatgacgtgattggaaaggtctgcctgaccagagacaccattgcctctcaccccaagggcttttccggctgggctcatctgaccgaggttgaccccgacgaggaagtgcagggagaaatccatctcaggcttgaagtatggcccggcgcacgggcctgtaggctcagatgctccgtgctggaggctcgcgacctcgccccaaaggaccgcaacggcacctccgatccctttgtgagagttcgctataagggacggacccgcgaaacatcaattgtgaaaaaatcatgctatcctcggtggaacgagacatttgagttcgagctccaagaaggagctatggaggccctgtgcgtagaagcttgggattgggacttggtgtcacggaatgacttcctgggaaaggtcgtgatagatgtgcaacggctgagggtggtgcagcaagaagagggctggtttaggttacagcccgatcagtctaagtcacggcggcacgatgagggaaacctcggtagtctgcaactggaagtgcggctccgcgacgagactgtgctcccaagctcgtactaccagccactggtccaccttctttgccacgaggtcaagctcggtatgcaggggcccggccagctcattccgctgattgaggagacaacttcaaccgagtgtaggcaggatgtggccactaatctcttaaagctgttcctaggacaaggactggccaaggattttttggaccttctgtttcagctcgagctgagtcggacttcagagacaaacactctgttccgatcaaacagcctcgcctcaaagtctatggaatccttcctaaaggtagcgggcatgcagtacctgcatggagtattaggccctatcatcaacaaggttttcgaggaaaagaagtatgtagagctcgacccttccaaagtggaggtgaaggacgtggggtgctctggtctgcatagaccccagacagaagcggaagtgctcgaacagtccgcacagacacttcgagcccatctgggtgccctgttgtccgcgttaagtaggtcagtgcgagcttgtcccgcagttgtccgcgctaccttccgccagcttttccgtagggtcagagaaaggttccctggagcccagcacgagaacgtgcctttcattgccgtgaccagctttttgtgcctgagattcttcagcccagccatcatgagtcccaagctctttcacctgcgggaaagacacgctgatgccaggacatccaggacattattattactggctaaggcagtacagaacgtaggtaatatggatacccctgcatcccgggctaaagaggcttggatggagccactgcagccaaccgtgcggcagggggtagcccagctaaaggactttataacgaagttagtggacattgaggaaaaagacgaactggatctgcagagaaccctttccttacaagctcccccagtcaaggagggccctctcttcatccatagaacaaaggggaagggcccactaatgtcatctagctttaaaaagctttacttctcgctcacgaccgaggcacttagcttcgcaaagactcctagttccaagtgtgtgaatgaactgaatcagtggctttccgcattgcgcaaagtgagcatcaacaataccgggttgcttggaagctatcacccgggcgtgtttaggggcgataagtggtcctgttgccatcagaaagagaagacaggacaaggttgcgataagacccggagccgtgttacccttcaggaatggaatgatcccctcgatcacgatttggaggctcaattgatatatcgtcatttactgggcgtcgaggctatgttgtgggaacggcacagagaactcagtggtggagctgaagctggcaccgttcccacctcaccaggaaaggttcccgaggactcccttgccagactgttgagagttctccaggacctgcgcgaggctcactcgagcagtcccgccggaagccccccctccgagccgaactgcctgctggaactccagacctag

SEQ ID NO: 202625 - DNA, 2196 bp, Artificial Sequence
  Description of Artificial Sequence: Synthetic coding sequence
atggacgaggacgccctgagccgggacgacgtgatcggcaaggtgtgtttgacccgggacaccattgcttcccaccctaagggatttagtggttgggctcacctgaccgaggttgaccctgacgaggaggtccagggggagatccatctgagactggaagtgtggccaggtgcaagagcctgtcgattgaggtgctcggtactggaagcacgggacctcgcacccaaggaccgcaatggaacctccgacccatttgtccgagtacggtacaaaggccgtacgcgcgagacctctattgtaaagaaaagttgttatccacggtggaatgagactttcgagtttgagttgcaggagggcgcgatggaggcgctgtgtgtcgaggcatgggactgggatcttgttagtcgtaacgacttcctgggcaaagttgtcatagacgttcagcgcttgcgcgtggtgcagcaagaggagggatggtttagactgcagcccgaccagagcaagtccagaaggcatgacgagggtaatctgggatccctccagctcgaggttagactccgagacgaaacagtgctgccctccagctactaccaacctttggtgcacttgctctgccatgaggtgaaactgggtatgcagggccccggtcaactaatccccctgattgaggagacgacttcaacagagtgccgccaggatgtcgcaacgaaccttctgaagctgttcctcggacaggggctggcgaaggattttctggacctgctgtttcagctagaactgagccgaactagcgagaccaacaccctttttagatccaactctctcgcctcgaagagcatggaaagctttctcaaggtcgcagggatgcagtatctccacggcgtcttaggacccatcatcaacaaggtgttcgaagaaaagaaatatgttgagttggatcctagcaaagttgaagtcaaagacgtggggtgtagtggacttcatcgcccacaaaccgaagccgaagtcctggagcagagcgctcagactctgcgtgcccacttgggcgcgctgctgtctgcgctgtcacgttccgtgagagcctgccccgcagtggtgcgggcaacatttcgtcagctttttcggcgtgtgcgagaacgatttccaggagcacagcatgagaacgtgcctttcattgcggtcacctcatttttgtgcttgaggttcttcagccctgccattatgagtcccaagcttttccaccttagggaacgacacgctgatgcaagaacttcccgaaccctactgttgctggccaaggccgtgcagaacgtgggtaatatggacactccggcttcaagggctaaggaagcctggatggagcccctgcagcctacggtgaggcagggcgtggcccagctgaaggacttcattacgaagctggttgacatcgaagaaaaagatgagctcgatctccaacgaactctctcccttcaggccccacctgtaaaagaggggcctctgttcatccatcggactaagggtaagggtcccttaatgtcatcttccttcaaaaagctgtacttctcgctgactacagaggccctaagtttcgcaaagactccctcatcaaagaagagtgcactgatcaaactggcaaacataagggctgctgagaaagtcgaagaaaagtccttcggaggttctcatgtgatgcaggtgatttacactgatgacgcggggagaccacagacagcttacctccagtgcaagtgtgtaaacgaactgaaccagtggctgtctgctttgcgtaaagtgtcaattaataacaccggcctcctcggatcataccacccaggcgtgttcaggggggacaagtggtcttgctgccaccagaaagaaaaaacagggcagggatgcgataaaacacgcagccgggtaacactgcaggaatggaatgacccgctcgaccacgacctcgaggcacaacttatttatagacacctgctcggagtcgaagctatgctctgggaacgtcatagagagttgagcggcggcgcggaagccggcactgtccccaccagtccggggaaggtgccagaggactctttagcccgcctgctcagggtcttgcaagacctgagagaagcccactcaagttcaccagccggaagccccccctccgagcctaattgtcttctggaactgcagacctag

SEQ ID NO: 202626 - DNA, 2415 bp, Artificial Sequence
  Description of Artificial Sequence: Synthetic coding sequence
atggccaagagcagcagcctgaacgtgcgggtggtggagggccgggccttgcccgccaaggacgtgagtggttcaagcgacccatactgcctcgtaaaggtcgatgacgaggtggtggcacggacggcaacagtctggcgtagtctcggtccgttttggggcgaggaatacactgtgcatctcccgctggattttcaccagttggcgttctatgttctggacgaggatactgttggacacgatgatattatcggtaagatcagcctcagccgagaggcaatcaccgctgacccccgcggcattgatagctggattaacttatccagggtcgaccctgatgctgaagttcagggcgagatttgcctgtcagttcaaatgttggaagatggccagggaagatgtctacggtgtcatgtcctgcaagcgagggacctcgctcccagggatatttccggcacgtctgaccctttcgcaagagtcttttggggttcccagagtctggagacgagcacaattaagaaaaccaggttcccgcattgggacgaggtcctcgaactgcgagaaatgccgggtgcgccatctccattgcgtgtggagttatgggattgggacatggttggcaagaatgatttccttggcatggtggaatttagccccaagaccctgcagcagaaacctcccaaggggtggttcagactccttccgtttccccgggcagaagaagatagtggcggcaatttgggcgcccttagggtgaaggtacgactgattgaagaccgcgtgttgccttctcagtgctatcaaccactcatggagctcctgatggagagcgtccaaggcccggcagaggaagacaccgccagtccacttgccctgttagaagagctgactttgggtgactgcaggcaggacctggctacgaagctggtgaagctgtttctggggagaggacttgcaggtcggttcctagattacctcacaaggcgtgaagtggctaggaccatggaccctaacacactgttcaggtccaacagtcttgcaagcaagagtatggagcagttcatgaaactggtgggaatgccctatctccatgaggtgttgaaaccagtaataagtagggtgttcgaagaaaagaaatatatggagctcgacccttgtaaaatggaccttggaagaactagacggatctcttttaagggcgctttaagcgaggagcaaatgcgcgagaccagccttggactactcaccggctaccttggccccatcgtcgacgccatagtgggatctgtgggacggtgcccccccgcaatgcggctcgccttcaaacagctccaccgtagggttgaagaacggtttcctcaagctgagcaccaagacgtcaagtacctggcaatctccgggttcctgttccttagatttttcgccccggctattttaacgccaaaactgttcgaccttagggaccagcacgcagacccacagacatccagatctctcctgctgctggctaaggcggttcagtctatcggcaacctgggccagcagctgggccaggggaaggagttatggatggctccccttcacccctttctccttcagtgtgtatccagagttcgggatttcctggatagactcgtggacgtcgatggagatgaggcaggggtccctgcaagggctctcttccccccctctgccatcgtgagagagggttatctgctcaaacgcaaggaagaaccagcagggttggcaacccgttttgcattcaaaaagagatacgtctggctgtccggagagacgctgagcttttccaaaagcccagaatggcagatgtgtcactccatccccgtttcgcatatccgcgccgtggaacgggttgatgaaggggccttccagttgccccacgttatgcaggtagtcactcaggatggcacaggggcgttgcacacaacttatctgcaatgtaaaaacgtaaatgaactgaatcagtggttgagcgccctgaggaaggctagcgccccgaaccctaacaagctggctgcatgtcaccctggcgccttccgctccgctcgttggacttgctgtttacaggcagagcggtcagccgccgggtgcagccggacccacagtgccgtcactttgggagactggtccgatcccctggacccggatgccgaggcccaaaccgtgtacaggcagcttctcctgggccgggaccaactcaggctaaaactgctcgaggatagcaacatggatacaaccctagaagccgacacaggagcctgtcctgaggtcctcgctagacagcgggccgccaccgcaagactgctagaagttctagctgacctggaccgagcccacgaggaattccaacaacaggagagagggaaggcagcactcgggccattgggaccctag

SEQ ID NO: 202627 - DNA, 2331 bp, Artificial Sequence
  Description of Artificial Sequence: Synthetic coding sequence
atggccaagagcagcagcctgaacgtgcgggtggtggagggccgggctctaccagcaaaggatgtgagcgggtcaagcgacccctattgtctggttaaagtggatgatgaggtcgttgctcggactgctacagtgtggcgatccctgggcccgttctggggcgaggagtatactgtgcacctccccctcgacttccaccagctggctttctatgttctcgatgaagacaccgtcggtcacgatgatatcatcggtaaaatcagtcttagcagggaggccattacggctgatcctcgcgggatcgactcatggataaatctatccagggttgatcccgatgccgaagtgcagggtgagatttgtttaagcgtgcagatgctggaggacgggcagggacgctgtctcagatgtcacgtactgcaggcccgcgatctcgcccccagggatataagtggtacctcagaccctttcgccagagtcttctggggtagtcaaagtctggagaccagcacaatcaagaaaacaagatttccacattgggatgaagtcctcgagctacgggaaatgccaggcgccccttcgccccttagagtcgagttgtgggactgggatatggtgggcaaaaacgattttctggggatggtggagttcagcccaaaaaccctgcagcaaaaaccacccaaaggctggtttcggctgttgccatttccacgcgccgaagaagactcaggcggaaacctcggggcgttgagagtgaaagtgcggctaattgaagatcgagtgctaccctcccagtgttatcaacctcttatggagctgctcatggaatccgtccagggccctgccgaggaggataccgcttcacccctagctctcttagaagagctcacactgggcgactgtcggcaagatttagctaccaagttagtgaagctattcctcgggagaggacttgccgggcggttcctggactacctgacaaggcgtgaagtcgcccgtactatggatcccaacacactattcaggagtaattctttagcatcgaaatctatggagcagtttatgaagttggtgggaatgccctacttacatgaggtgcttaaaccggtgattagccgtgtattcgaggagaaaaagtacatggagttggacccatgcaaaatggacctggggaggacaaggcgcatcagcttcaagggggccctgtctgaagaacagatgagagagacctcattggggctactgacgggatatctgggcccaattgtcgacgcaatcgtggggtcggtcgggcggtgcccaccagccatgaggctggcgttcaaacagctgcatcgccgggtagaggagcggttcccacaagcggagcaccaggacgtaaaatatctggcaatatctgggttcctgtttctgcgcttcttcgctcccgcaattctcacaccgaagcttttcgacctccgcgatcagcatgcagatcctcagacttcacgttcactgctgctcctggcaaaagccgtgcagtccataggcaacctgggccagcagcttggccagggcaaggaactctggatggctcctttacaccctttcctcctgcagtgtgtgtcacgtgtccgtgatttcctggaccggcttgtggacgttgatggcgacgaggccggagtgcctgccagagctctattcccaccctctgccattgtccgagagggctatctcctcaagcgcaaagaagagccggcaggattggccacgagattcgcgttcaagaaacgttatgtatggttatctggcgagactctgagcttcagtaaaagccccgagtggcaggttgtaactcaagatgggactggggcgctacacacaacctaccttcagtgtaagaatgtgaatgaactaaaccagtggctttctgccctgcggaaggcttccgccccaaatcctaacaagttggccgcttgtcaccccggggcctttagatcggcgagatggacttgctgtctgcaagccgagcgctcggctgcagggtgtagccgcacccactctgcagtgaccctgggcgattggtcagacccgttggacccggacgcagaagctcagactgtctacagacagctactcctggggcgtgaccagctcagattaaaattgttagaggactcaaatatggataccaccctcgaggccgacaccggggcgtgcccggaggtgctggctaggcagcgcgccgccacagcgagacttttggaagtgcttgcagacttagacagggcccacgaggaattccagcagcaggaacgggggaaagccgcattaggacctctcgggccttag

SEQ ID NO: 202628 - DNA, 2421 bp, Artificial Sequence
  Description of Artificial Sequence: Synthetic coding sequence
atggccaagagcagcagcctgaacgtgcgggtggtggagggccgggcccttcctgcaaaggacgtcagtggctctagcgatccttactgcctcgtaaaagtcgacgacgaagtagtggcaaggacggccactgtgtggcgttcacttggccccttttggggcgaggaatataccgttcatcttccgctggacttccaccagctggctttctacgtattggacgaagatacagtgggtcacgacgatatcatcggcaagataagcctgtcccgcgaggctattacggcagacccgcgcgggattgattcctggataaacctgagccgtgtggaccctgacgcagaggtgcagggcgagatttgtctgtccgtgcagatgttggaggacggccagggccgctgcttgcggtgtcacgtgctacaggcacgagatctggccccgcgcgatataagcggtacatctgatcctttcgctcgggtgttctgggggtcccagtcccttgagacatctacgattaagaagacacggtttccccactgggacgaggtgttggagctgcgcgaaatgcccggagcgccgtcccccctgagggtagagctgtgggactgggatatggtcggcaaaaatgattttctcggtatggttgagtttagtcctaaaactttgcagcaaaaaccccctaagggttggtttcggctgctgccatttccacgggccgaggaggactctggtggtaatctgggcgcattacgggtgaaagtaaggttgatcgaagacagagtactgccctcacagtgctaccagccactcatggagttgctgatggaatcagtccaaggccctgcggaagaggatacagcaagtcctctggctctgttggaggaactgacacttggtgattgccgacaagacttggccaccaagctcgtcaaattgttcctgggtaggggtttggccggtagatttctcgattacctcacacgacgagaagtggcccggacaatggacccaaacaccttgtttcggagcaactccctggcttcaaaatcaatggagcagttcatgaagttagtcgggatgccttacttgcacgaagtccttaaaccagtcatctccagggtgttcgaggaaaagaagtacatggaattggacccatgcaaaatggatctcggaaggacgagaaggatcagctttaaaggagcactgtcagaagagcagatgcgcgagacctctctgggccttttaaccgggtatctggggcctatcgtcgacgcaattgtcgggagtgttggccgctgcccccctgccatgcggcttgcattcaaacagcttcataggagagtggaggagaggttcccccaggctgaacatcagcaggacgtcaagtatttggccattagcggattcctgtttctgcgcttttttgcccccgccatcctaacccccaagctgtttgacctgcgagatcaacatgctgatccccagacaagccgttctctgctattgcttgccaaagcagtacagagtattggcaacctgggccaacagctaggtcagggaaaagaactctggatggcgccgctgcaccctttcttactgcagtgcgtatcaagagtcagagatttcctagacaggctagttgacgtcgatggcgacgaggaagccggagttccagcacgagcactgtttcccccctctgccatagttcgggaggggtatctcctgaagcgtaaggaggaacccgccgggctggccacacggttcgcctttaagaagcgttacgtctggttgtccggagagacgctttcattttcaaaatctccagagtggcagatgtgtcattcaatccctgtctcacatataagagctgtggagagggtggatgagggagccttccagctacctcacgtaatgcaggtggtgacccaagatggcactggcgccctccacacaacatatctccagtgcaagaacgtaaacgaattaaaccagtggctgagcgcacttaggaaagcctcagctcccaatcccaacaagctggccgcctgtcaccctggggcttttcggagcgcccgctggacctgctgccttcaggctgagcgaagtgccgctgggtgctcaaggacccattctgcagttactctgggagactggtcggacccgttggacccagacgcagaggcccagactgtctaccgtcagttgttactgggcagggaccagttgaggctaaagcttctcgaagactcaaacatggacacaacattggaggctgacaccggagcatgcccagaggtgttggcccgccagagagcggctacggcccggctgctggaggtcttagctgatttggatcgcgctcacgaggagtttcaacaacaagagagaggtaaagcagcccttggaccactggggccgtag

SEQ ID NO: 202629 - DNA, 3714 bp, Artificial Sequence
  Description of Artificial Sequence: Synthetic coding sequence
atgcagaagagcgtgcggtacaacgagggccacgccctgtacctggcttttctggccaggaaggagggtacaaaacgtggcttcctgtcaaaaaaaaccgctgaagcctcgcgctggcatgagaaatggttcgcactgtaccagaatgtactgttttacttcgaaggtgaacagtcctgtcggcccgccgggatgtacctgttggagggatgtagttgcgagaggactccggccccaccacgcgcaggcgccgggcagggcggagtccgagacgccctggacaagcagtattattttacagtgttgttcggccacgaaggtcagaagcccctggaactgcgttgcgaggaggagcaggatggcaaagagtggatggaggccatacaccaagcctcctacgccgacatcttgattgaacgggaagttttaatgcagaagtatattcatcttgtccagatcgttgagaccgaaaagatcgccgccaaccaattacggcaccagctggaagatcaggataccgagatcgagcggctgaaatcagagattatcgctcttaataagaccaaagagaggatgagaccgtaccagtcgaatcaggaagatgaagaccccgacataaagaaaattaaaaaggtgcagtcctttatgcgtggctggctgtgccgacggaaatggaaaactattgtccaagattatatctgttcaccccacgccgagagtatgaggaaacggaaccagatagtctttacaatggtggaggcagaatccgagtacgtgcaccagttgtacatcctggtcaatggatttctgcgccctctgaggatggcggccagtagcaagaaaccacctatatcacacgacgacgtttcgagcatatttttaaacagtgagactatcatgttcttacatgaaattttccatcagggcttgaaagccaggatcgcgaattggccaaccttgatcttagcggacttattcgacatcctgttgccaatgctgaatatttaccaggaatttgtgaggaatcatcagtactctctgcaggtccttgccaactgcaagcaaaatcgcgacttcgataagcttctgaagcaatatgaggctaaccctgcctgtgagggacggatgctggaaacatttctgacctatcctatgttccagatccctcgctacataattactctgcacgagctgttggctcacacaccacatgagcacgtggaaagaaagagtttagaatttgccaaaagtaagctcgaggagctctccagggtcatgcatgatgaagtgtccgacaccgagaacatccgaaaaaatctggctatcgaacgaatgatagtggagggctgcgacatactgttagacacctcccaaacattcatccgccagggtagcctgatccaggtcccatcagttgagagaggcaaactttctaaagtgaggctcggttctctgagcctgaaaaaggaaggagaacgtcaatgctttttatttaccaagcacttcctgatatgtactcgttcaagcggaggcaagctacacctcctcaaaacggggggcgtgctcagtctgatcgattgtaccctcatcgaagaacccgacgcctctgatgacgattcaaagggttctgggcaggtgtttggtcatttagactttaagatcgtcgtggagccaccagatgcagccgctttcacagtggttctcctggcaccttctcggcaggaaaaggcggcctggatgagcgatatttctcagtgcgtggataacattaggtgcaacggcttaatgaccatcgtttttgaggaaaactcaaaggttacagtgcctcacatgatcaaaagtgacgcccggctccataaggatgacaccgacatctgcttttccaagacgttaaattcctgcaaggtaccccagataaggtacgcctcagtggagaggcttctcgagcggctgacggatctccgctttctctcaatcgacttcttaaacacatttctgcacacatatcggatctttaccacggctgccgtggtactcgggaaactgtccgacatttataaacgcccctttacctcgatccccgtgcggtccttagaactgttctttgcaacaagccaaaacaataggggtgagcacctggtggatggaaaaagtccacgcctgtgtagaaagttctcaagtcctcccccactggctgtttcccggaccagctctcccgtgcgcgctaggaaattgagtcttacatcccctctgaactctaaaatcggagcactggatttaacaacgtcttctagtccgacaaccacaacacagtcaccagccgcatcccctcctccgcacaccgggcagatcccactcgatctttcaaggggactgtcgtcaccagaacagtctccaggcaccgtcgaggagaatgtggacaacccaagagtcgacctgtgtaacaagttaaagcggagcattcagaaagcagtactggagtccgctcctgccgatcgcgccggagttgagtccagcccagcggctgacaccaccgagctgtccccttgtagatcaccgagcacccccaggcatctgcggtaccgccagcccggagggcagacagctgacaacgcgcactgctcagtctcaccagcctccgcattcgctattgctaccgctgccgccgggcatggatcccctccaggattcaataataccgagcgcacctgcgataaagaatttattattcgacgtaccgccaccaaccgtgttttgaacgtgctcaggcactgggtgagcaaacacgcccaggacttcgagctgaacaacgagctcaaaatgaacgttcttaatttgcttgaagaagtcttgcgcgaccctgatctcctacctcaagaaaggaaggccgctgccaatattttgagggccctgtcccaagacgaccaggatgacattcacctgaagctcgaggatattattcaaatgaccgattgtatgaaagcagaatgtttcgaaagtctgagtgccatggaattagctgaacagatcactctactcgaccatgtaatattccgaagcatcccttacgaagaatttctggggcagggatggatgaaactcgacaaaaatgagcgcacaccttatataatgaagacttcccagcattttaatgacatgagcaacctggtcgcctctcaaattatgaattacgcagacgtgagctcaagagccaatgcaatcgaaaagtgggtagccgttgctgacatatgccgatgcctgcacaactataatggagttctggagatcacgagcgcgctgaacaggtccgcaatctaccggttgaagaagacctgggccaaagtttccaagcaaacaaaggctctgatggacaaactgcaaaaaaccgtgagcagtgagggacgttttaagaacctgagggaaaccctgaaaaattgcaacccccctgctgtaccctatctgggtatgtatctaactgacctggctttcattgaggaggggactcccaattttactgaggagggcctggtgaacttcagcaaaatgaggatgattagccacatcattagagaaatcaggcagttccagcagacgagctatcgcattgaccatcagcccaaggtcgctcaatatctgctcgacaaggacctcattatcgacgaagacaccctgtatgaactgagtttaaaaattgaacctcgcctccccgcctag

SEQ ID NO: 202630 - DNA, 4431 bp, Artificial Sequence
  Description of Artificial Sequence: Synthetic coding sequence
atgaccagcagcagccccgccggcctggagggcagcgacctgagctccattaacactatgatgtccgcggtgatgagcgtgggaaaagtgacggagaacggcggatcgccccagggtatcaaatcgccaagcaaacctccgggtcctaaccggatcggccgtcggaaccaggaaactaaagaggaaaagtcaagctataactgcccactctgtgaaaagatttgcactacccagcaccagctcacaatgcacatcagacagcacaacaccgatactggcggggccgatcactcttgttcaatctgcggcaaatcgttatcctccgcaagcagtctggacaggcatatgctagttcactccggcgaaagaccttacaagtgcactgtctgcggacagtcctttactaccaatggcaacatgcacagacacatgaagatacacgagaaggacccaaatagtgctaccgccacagcacctccaagccctctcaagcggcgcaggttgagctcaaagcgaaaattgtctcacgacgcagagagcgagagagaggatccggctccagccaaaaaaatggttgaagacgggcagtctggggacctggagaagaaggcggacgaggtgtttcactgccctgtgtgtttcaaggaatttgtgtgtaagtatggactggagacccacatggaaacccattcagataatcccttgagatgcgacatttgctgcgtgacgtttcggacacatagaggcctgctccgacacaacgcgttggttcacaagcagctgcctagagatgccatgggaaggccgtttatccagaacaacccttccattcctgccgggtttcatgacctcggatttaccgatttctcttgtaggaaatttccacgtatctcacaagcctggtgcgagactaatctaagaaggtgcatttcagagcagcatcgatttgtgtgcgacacttgcgacaaagcatttcctatgctgtgctccctggccctgcacaaacagacacacgtcgctgctgaccagggacaagagaagccccaggccactccactgccgggagacgctctggaccagaagggattcctcgctctgctcggccttcagcatactaaggacgtcaggccagcgccggctgaggagccactgcctgatgacaaccaagccattcaacttcagaccctgaaatgccagttgccccaggatccaggatgcacaaacctcctatccttatccccgtttgaagccgcatccttgggggggagcctgactgtgctccccgctacgaaagacagcatcaagcacctcagccttcaaccctttcagaaggggtttatcatccaaccagactcaagcattgtggtcaagcctatatccggtgaaagtgccatagaacttgccgacatccagcagatcttgaagatggcagcatcagcacccccacagatatcactcccccctttttccaaagcgcctgccgctcctctgcaggccatatttaagcacatgcctccattaaaacctaagcctctggtcactcctaggaccgtcgttgcaacctcgactccacctcctcttatcaatgcgcaacaggctagcccaggttgcatctccccatctcttccgcctccccctctgaagctgctaaaaggcagcgtggaagctgcctccaatgcccacctgctgcagtctaagagcggaactcagccacacgcagcaacgaggctttcactgcaacagcctcgcgccgagctgcccggtcagccagagatgaagactcagcttgaacaggatagtattatagaagcactgctacctctgagcatggaagccaaaattaaacaggagataacagagggggaactcaaggccttcatgactgccccggggggaaaaaagacccccgcaatgaggaaagtgctctacccctgtcgcttctgcaatcaggtgtttgccttttccggcgtcctgagagcccatgtgaggtcccacctgggcatatccccgtatcagtgtaacatctgcgattatatcgccgccgataaggcagctctgataaggcaccttcggacacattccggggaaagaccgtacatctgcaaaatatgtcattaccctttcacggtgaaggctaattgcgagaggcatttgaggaaaaaacacttaaaagctacacgaaaggatatcgaaaagaatatagaatacgtgagctccagtgctgcggagctcgtcgacgctttctgcgcacccgatacagtgtgccgcctttgcggagaggatctcaagcattatcgggccctcaggatccacatgagaacccactgtggtaggggactgggcggcgggcacaagggcaggaagccgtttgaatgtaaagagtgcagtgccgctttcgctgctaagcgtaattgtatccatcatatcctgaaacaacacctgcacgtgcctgagcaggacattgagagttacgtgttagctgctgacggactcggtccagccgaggcccccgcggctgaggcaagtggtcggggcgaagactccggctgcgcagcactcggggattgcaaaccactgaccgcatttctggagcctcagaatggattccttcaccgaggtccaacccagcctccaccaccccatgtctccattaagctcgaaccagcctcctcatttgccgtggatttcaatgagccactcgatttttcccagaagggcttagcactggttcaggtgaagcaggagaatatcagctttctttcaccttccagtctggtaccttatgattgttccatggagcccatcgacctctcaatccctaaaaatttccggaagggtgacaaggatctggcaacaccatctgaagcaaagaagcctgaagaggaagctggctcaagtgagcaaccctccccgtgcccagctcccgggccgtccctcccagtcactctcgggccatctggcatactcgagtcacccatggcacccgcgccggctgctactcccgagcccccggcccagcccctgcaaggaccagtgcagctggccgtgcccatttattcttcagcgttagtctcgtctccaccactcgtcggcagctccgcactcctgtccggcacagcactgctgaggccactgagacccaaaccccccttgctgctccctaaacctcctgtgaccgaggaattgccacccctggcatccatcgctcagattatttcgagcgtgtccagcgcacccaccttgcttaagacaaaggtcgctgacccaggccccgcttccacaggctctaataccacggctagtgactcactgggcggatccgttcctaaagccgcaacaacagcgaccccagctgctaccaccagtcccaaggaatcttcagagccgccagcgcctgcatctagtcctgaagctgcttcacccaccgaacaggggcccgctgggactagcaaaaaaagaggtcggaaaagaggaatgagatcgaggcccagagccaattcaggcggcgtagacctagactcaagcggagagtttgccagcatagagaagatgcttgctaccaccgatacgaacaagttctccccttttttgcagactgccgaagacaatacacaggatgaagtggctggggcccctgccgatcatcacgggccatctgacgaggagcagggaagcccccccgaggataaattactcagagcaaaaaggaattcctatacaaattgcctccagaaaattacttgcccgcattgtcctagagtcttcccatgggcgagctccctgcagcgtcacatgctaacccacaccggccagaaacccttcccctgccagaaatgtgatgcttttttcagtactaagagcaattgtgaacggcaccaacttcgaaagcacggcgttacaacatgtagcctccgccgtaatggtcttatcccacagagcaaggagtctgacgtgggatcacatgattctacgggcgagagaccttacaagtgtcagacatgcgaacgcaccttcaccctgaaacattctctggtgcgtcatcagaggatccaccaaaaggctaggcatgctaagcaccatggaaaagacagtgataaggaggaacgaggcgaggaagacagcgaaaatgagtctacccacagcgggaacaacgccgtgagcgagaatgaggccgagttggcaccgaacgcgagtaaccacatggccgttacccggtctaggaaggaaggcctggctagcgccaccaaggactgcagtcatcgcgaggagaaggtgaccgctggttggccttctgaacctggtcagggtgaccttaaccctgagagcccagctgccctcggacaggacctccttgaacctcgcagtaaaaggcctgcccacccaatccttgccacagctgatggagcttcccagctggtcggaatggagtag

SEQ ID NO: 202631 - DNA, 5064 bp, Artificial Sequence
  Description of Artificial Sequence: Synthetic coding sequence
atgaccagcagcagccccgccggcctggagggcagcgacctgagcagcatcaacactatgatgtccgccgtgatgtcagtgggcaaggtgactgaaaacgggggttcaccccaaggcatcaaatccccctctaaacctccggggcctaacagaatcggccgaaggaatcaggaaaccaaggaggagaagtcatcatataattgtcccctgtgtgagaagatatgtaccactcagcaccaactgacaatgcatatccgccagcacaatacagacacaggtggggcagatcactcctgcagtatttgtgggaaatcattatcctccgcttcttccctcgacagacacatgctcgtccactccggcgagaggccttataagtgcaccgtgtgcgggcagagctttacaaccaatggaaacatgcatcggcacatgaagattcatgaaaaagacccaaattcggcgacagctaccgcgccgccttcaccccttaagagacgccggctaagttcaaaaaggaaattaagccacgacgctgaatccgaacgcgaagaccctgcacccgcgaagaaaatggtagaggatggccagtctggagatctggagaaaaaagctgacgaggtgtttcactgtcctgtatgcttcaaagagtttgtttgcaagtatggcctcgagactcatatggaaacccatagcgataaccctctgcggtgtgacatctgctgcgtgacattcaggacacataggggtttgctgcggcacaacgccctagttcataaacagctgccacgcgacgcaatgggccgccccttcattcagaacaacccctctataccagccggcttccacgatttaggattcaccgattttagctgccgtaagttcccccgaataagccaggcttggtgtgaaacaaaccttagaagatgtatcagtgagcagcatagatttgtctgcgatacatgtgataaagccttcccgatgttgtgttcactggcactccataaacagactcatgtcgccgccgatcaggggcaagaaaagccgcaggccactcctctgccaggagatgctctcgatcagaaaggattcctcgccctgctgggcctgcagcacactaaagacgtgcgtcccgcccccgccgaagaaccacttccagacgataaccaagcgattcagctccagacgttgaaatgtcagcttcctcaggacccagggtgcacaaatcttctctctctgtccccctttgaagctgcctcactaggcggcagtctgacggtgctccccgctaccaaggatagcattaagcacctgagcctgcagccattccagaaggggtttatcattcagccggattcctctatcgtggtgaaaccgatttccggagaaagcgccattgaattggcagacattcagcaaatactcaagatggccgcctcagcaccacctcagatatcactgccccctttttccaaggcgccagccgcccccctccaagccatatttaaacacatgcctcccctgaagccaaagccactcgtgacacctcgaaccgttgtagccaccagcacacccccacctctgatcaacgctcagcaagcgtctcctgggtgcatctcgcctagcctgccgccaccgcccctgaagctgcttaaaggatcagtcgaggctgccagcaatgcccatctgttacagagtaagtccggcacccaaccccacgctgccaccagactgtccttacagcagccccgggccgagcttcctggtcagccagaaatgaaaacacagctggagcaggattccattatcgaggccctgcttcctctgagcatggaagcaaagatcaagcaagaaatcaccgagggcgaactcaaagccttcatgaccgcccctggcggtaagaaaaccccagcaatgcgcaaggtgctctatccttgtagattctgcaaccaggttttcgctttctctggagtcctgcgggctcacgtacggtcacacttggggatcagtccataccagtgcaatatctgtgactacatcgctgccgacaaggccgcccttataaggcatctgcgcacccattccggggaacggccatatatctgcaagatatgtcattacccattcactgtcaaggcgaattgcgagcggcacctccgcaaaaagcatctcaaggcaacccggaaggatattgagaagaatatcgagtatgtgtcttcttctgccgcagagctcgtagatgcattttgtgcacccgataccgtgtgccgactgtgcggggaggatctgaaacactatagagcccttagaatccacatgcgcacacactgcggtagaggtttagggggtggccataaaggacgaaaaccatttgagtgcaaggagtgcagcgctgcctttgccgcaaagcgaaattgcattcatcacattcttaagcaacacctgcatgtcccggagcaagatattgaaagttacgtactggctgccgacgggctgggaccagccgaggctcctgctgctgaagcaagtggcaggggagaggattccggctgcgctgcactgggagactgcaaaccactgactgccttcctggagccccagaatgggtttctgcacagaggacctacccagccacctcctccacatgtttccatcaaactggaaccagcatcctcctttgcagtggactttaacgagcctctggactttagccagaagggcctagccctagttcaagtcaagcaggagaacattagctttctcagcccctcctcactggtcccatacgactgctctatggaacccatcgacttgagcattcccaagaattttcggaaaggggacaaagaccttgctacaccctccgaggccaagaagcccgaagaagaagctgggtcatctgaacagccctccccatgtccagcgcccggaccatccctgccagtcactcttggcccatctggcattcttgaaagccctatggcccccgctccagctgccacccccgaacctccagcgcaacccttgcaggggcccgttcaacttgccgtaccaatctattcatccgctttggtgagctctcctccactcgtgggctcgtctgctctgctgagcgggaccgccctgctcaggcccttgcgccccaagccccctctattactgcctaagcccccagtcacagaggaactgcccccgcttgcgagcatcgctcagatcattagctctgtgtccagcgctcctactctgctgaagaccaaagtcgcagaccctggacctgccagcactgggtccaataccactgcaagtgacagcttgggaggaagcgtacctaaggcggccactactgccacaccagccgctacgacgtcacctaaggaaagctccgagccccccgcgccggctagctccccagaagctgcttcgcccacagagcagggtcccgctggcacctcaaagaaacgtggcagaaagcggggaatgagaagccgaccccgggcgaactcaggcggcgtcgacctggattcatccggcgagttcgcaagcattgagaagatgctggccacgacagatactaataagttctcgccctttttacagaccgctgaggataacacacaggatgaggtggccggagcccccgctgaccatcatggccccagtgatgaggagcaagggagccctcctgaagataagcttctgcgggctaagcgcaactcttacaccaactgtctgcagaagattacatgcccccattgccccagggtgttcccgtgggcctcttcccttcagaggcatatgctgactcacaccgattctcagagtgacgcagagacagccgctgcagcaggcgaggtgctggatttaaccagcagagatagagagcagccttccgaaggggcaaccgagctgcgacaggttgccggcgatgcacctgtggaacaggctacggcggagacagccagccccgtccatcgcgaggaacatgggagaggggaatcacatgaaccagaagaggaacacggaaccgaggaaagcaccggcgatgcagacggcgctgaggaggatgcgagttccaatcaaagtttggacctggacttcgctacaaagctgatggacttcaagctggccgagggcgacggagaagctggagctggaggtgctgcctcccaggaacagaagctggcctgcgacacctgtggaaagagttttaaattcctaggtaccctctctcggcatcgcaaagctcatggcagacaggaaccaaaggatgaaaaaggtgacggagcctccactgccgaagaaggacctcaacccgcccccgagcaggaagagaaacctcccgaaactcccgcagaggtggtggagtctgccccgggggccggagaggctccagccgagaagctcgctgaggagacagagggaccgtccgacggggagtcagctgctgagaagcgaagctcagaaaagtctgacgatgacaagaagcccaaaaccgactcacctaagtcggtagcttcgaaagccgataagaggaagaaagtttgctcggtttgtaacaagcggttctggagcctacaagaccttacccgtcatatgcgctctcacacaggtgagagaccctacaaatgccagacctgcgaacgaaccttcactctgaaacatagtcttgtacggcaccagcggattcaccaaaaggccagacacgccaaacatcatggcaaagacagtgacaaggaggaacggggtgaagaagactctgagaatgaaagtactcattctggcaataacgctgtgtccgaaaacgaggccgagttggcaccaaacgctagcaatcacatggccgtgactagaagccggaaagaaggcctggcctctgccactaaggactgttcgcatagggaggagaaggtaacggctggatggccgagtgaaccagggcagggggacttgaatcccgagtcacctgcagctttgggacaggatctgctggagcccagatccaaaaggccagcacatcccatactggcaacggccgacggggcatcgcagctggtgggcatggagtag

SEQ ID NO: 202632 - DNA, 5064 bp, Artificial Sequence
  Description of Artificial Sequence: Synthetic coding sequence
atgaccagcagcagccccgccggcctggagggcagcgacctgagcagcatcaatactatgatgagtgcagtcatgtccgtggggaaagtgacagagaatggcggcagtccgcaaggcatcaaaagcccatcgaaacctcccggtcccaatagaatagggagaaggaaccaggaaacgaaagaagaaaaaagcagttacaactgcccgctgtgtgaaaaaatctgtacaacccagcaccagcttacaatgcacatccgacagcacaataccgacacaggaggtgcagatcactcttgctctatatgtggcaagtcgctgtcctctgcgagttccctggacagacatatgttagttcactccggagagcgcccctacaagtgcacggtgtgcgggcaaagctttacaacgaatggaaacatgcatcgacatatgaagattcatgaaaaggatccaaattccgcaactgccaccgcaccacctagtcctctgaaaaggcgtagactgagctcaaaaaggaagttatcacatgacgccgaatctgaacgggaagatccagcaccagccaaaaagatggtcgaggacgggcagagcggagaccttgaaaagaaggcagatgaggtgttccattgcccagtgtgcttcaaagagtttgtgtgcaagtatggtcttgaaacccacatggaaacccattcagacaatccccttagatgcgacatctgctgcgtcacctttagaacgcaccgcgggttgttgcgccacaatgctctcgtgcacaagcagttgccgcgtgatgccatgggccgacctttcatacaaaacaatccctccatccccgccgggtttcatgacttggggtttaccgacttcagttgtaggaagttccccagaatttcacaggcctggtgcgaaactaatctccgtcggtgtatttctgagcagcaccgatttgtgtgtgacacatgcgacaaggccttccccatgttatgttcactggcattgcacaaacagacccatgtcgcagcagaccagggccaggagaaaccccaggccactccactgccgggagacgccctcgatcagaagggatttctggcgctgcttggcctgcagcatacgaaggatgtccggccagcccctgccgaagagcctttacctgatgacaatcaggcaatccagctgcagaccctgaagtgtcagctgccccaggatccaggctgtacaaacctgctgtccctcagtccgttcgaggcggctagcctggggggttcattgacggtgctgccagctacaaaggattccatcaaacatctgtcactgcagccattccagaaaggcttcatcattcagcccgatagctccatcgtagtgaagccgatctctggcgagtccgccattgaacttgccgatattcaacagattcttaagatggccgcgagcgcgcctccccagatctcactgcctccattctcaaaagccccagccgcccctctccaggccatttttaagcacatgcctcctctaaaaccgaagcccctggtcacacccagaaccgtcgtggccacatcaactcctcctccacttatcaatgcacaacaggcctcacccggttgcatctctccgagtctcccaccacccccgctaaaattgctgaaagggtcagttgaggctgctagtaacgctcatctcctgcaatcaaagtctggcactcaacctcatgcggcaacccggttaagcctccagcagccccgcgccgagctacccgggcagccagaaatgaaaactcagttggagcaggacagcatcatcgaggcgctgcttccactttctatggaggcaaaaataaagcaggaaataactgaaggtgagctgaaagcattcatgacagctcccggcggcaaaaaaacacccgccatgcggaaggtgctttatccctgcaggttctgtaaccaggtcttcgcctttagtggagtcctgagagctcacgtgaggtcccacctcggcatttctccttatcagtgtaatatctgtgactacatcgctgcagataaagcagctctcattcgccacctgaggactcactccggcgagcgaccctacatctgtaagatatgtcattatcccttcacagtaaaagccaactgcgaacgccacttgcgcaagaagcacctgaaagcgacacgtaaggacatcgagaagaatatcgagtacgtgtcgagctcagccgctgaactggtagacgctttttgcgcgccagatactgtctgcaggctgtgcggcgaagatctgaagcactacagagctcttaggattcatatgcgcacccattgcggtaggggtctgggcggcggccataaggggcgaaaaccttttgaatgcaaggagtgcagcgctgcatttgctgccaagcgtaactgtattcaccacatcctcaagcaacacctgcacgtgcccgaacaggatatcgaatcatacgttcttgccgctgatgggttgggccctgccgaggcacctgcagccgaggccagtggtagaggggaggacagcggttgcgcggctctgggtgattgcaagccccttaccgccttcctcgagccccaaaacggatttcttcaccgggggccgactcagcctccgccaccacatgtgtcaatcaagctggaacccgcctcttcctttgccgtggatttcaatgaaccattggacttctctcagaaagggttagcactggtccaggtcaaacaggagaacatctctttcttgtctccatctagtttagtcccctatgattgtagcatggaaccaattgatctgtcaattcccaaaaacttcaggaagggagacaaagacttagcgacgccatcagaagccaaaaaacctgaagaagaggcgggatccagcgagcagccctctccctgcccagcccccggaccctcactgcccgttaccttggggccttctggaatactggagtctcctatggctcctgctccagctgccacaccagaacctccagcacagcccctgcaaggtccagtgcaactagcagtgcccatctactcttccgccttggtttcctcccctcctctggtaggcagttctgccctccttagcggcacagctcttcttagaccattaaggcctaaaccgccactgctcttgccgaaaccacctgtgaccgaagagttaccccccctggcctcaattgctcagataatcagctctgtgtcaagtgcaccgaccctgctcaagaccaaagtggctgaccccggccctgcatcaaccggctccaatacgaccgcatccgactcccttggtgggagcgtgccaaaagcagccacaaccgccacacctgccgcaactacaagtcctaaagaaagctccgaaccacccgcccccgcaagtagcccggaagcagcctcacccactgaacagggaccggccggaacctccaagaagcgcggccgcaaacgggggatgaggtcccgtcctagggctaatagcggcggtgtggacctcgattcatctggtgagttcgcttctatcgaaaagatgctcgccacaaccgataccaataagttttctccttttctacagactgccgaggacaacacacaagacgaagtcgccggagcgccagccgaccaccacggaccctcggatgaagagcaggggtccccgcctgaggacaagcttcttcgtgctaagcggaatagctacacgaattgtctgcaaaaaattacttgtccccactgcccccgtgtgttcccgtgggcttctagtctgcagcgccacatgctgactcacactgattcccagagcgacgccgagacagcggcggccgctggtgaagtcctcgatctcacatccagagatcgcgaacagccgtcggaaggcgccacggaactgaggcaggtagccggggacgctcctgtggagcaggcgactgccgaaacagcttctcctgtccaccgggaggaacatggccgcggagagtcacatgagcctgaagaagaacatggcacagaagagtccacaggggatgctgacggcgcagaggaggatgcatcttccaaccagtctctggacctagacttcgccaccaagctgatggattttaagctcgctgagggcgacggtgaagccggagccggtggcgcggcgagtcaggagcagaagttggcatgtgacacatgtgggaaatctttcaagtttctgggtaccctgagccgccacagaaaggctcacggtagacaggagccaaaggacgagaaaggagatggagcctctactgctgaagagggtccccaacccgctcctgaacaggaggaaaaacctccggaaacccccgccgaggtggtcgaaagcgcccctggcgccggcgaagcccccgccgagaagctcgccgaagagacagagggacctagcgatggcgagtccgcggctgaaaagagatcttccgagaagagtgacgatgataagaagcctaagacagatagccctaagtccgtggcctctaaggctgataagcgtaaaaaagtgtgcagtgtatgtaacaaacgcttttggagcctgcaagacctcactagacatatgaggtcccacacaggtgaacggccatacaaatgccagacttgtgaacgcaccttcacacttaagcattccctggtgcgccatcaacgtatccaccagaaggcaagacacgccaagcaccatgggaaagattctgacaaggaagaacgcggagaagaggatagcgaaaacgaatcaacccacagcggcaacaatgcagttagcgagaacgaggccgagctcgccccaaatgcaagcaaccacatggccgttaccagatcccgaaaggaggggcttgccagtgctaccaaggattgcagtcatcgcgaggaaaaggttactgccggatggccgtccgagccgggacagggcgatctgaacccagagtcgcctgctgccctcgggcaggatctcctggaaccgcgttccaagcggccagcacacccaattttggccacagcagacggcgcttcccaactggtggggatggagtag

SEQ ID NO: 202633 - DNA, 5229 bp, Artificial Sequence
  Description of Artificial Sequence: Synthetic coding sequence
atgaccagcagcagccccgccggcctggagggcagcgacctgagctccataaataccatgatgagtgcagtgatgtccgtcggtaaagtgactgaaaacgggggatctcctcaaggcatcaagagcccaagcaagcctcccggtccaaacaggattgggcgcagaaatcaagagacaaaggaggagaaatccagctacaattgccctctttgtgagaagatttgtacaacccagcaccagcttaccatgcacatcaggcagcacaacaccgatacagggggtgctgatcattcttgttcaatctgcggaaaatcgttaagtagtgcctcctccctggacagacatatgctcgttcattctggagagaggccatataagtgtaccgtgtgtggacaaagctttaccactaatgggaacatgcacaggcatatgaagatccatgagaaagatcctaatagcgccaccgcaacggcgccaccttctccattgaaaagacgccgtctttcaagcaagcggaagctttcccatgatgccgagtccgagagagaggaccctgcccctgctaaaaagatggtagaggacgggcagagtggagacttagagaaaaaggccgacgaagtattccattgccccgtctgtttcaaagaattcgtatgcaagtatgggctggagacacacatggagacacattcagacaatccactacggtgtgatatttgctgcgtaacttttcgtactcacaggggccttttacgccataatgccttggttcataagcagctgccacgtgacgccatgggtcggccctttattcaaaataacccctcaatcccggctgggtttcatgacctgggttttactgattttagctgcaggaaatttccacgaatttcgcaggcttggtgtgaaaccaacctcagaaggtgtattagcgagcaacaccgatttgtgtgcgatacttgcgataaagctttcccaatgctgtgctcattagccctccacaaacagacacatgtggcagctgaccaaggacaggagaaacctcaggcgacacccctgccgggtgacgcactcgaccagaaaggctttctcgccctgctcggcctccagcacacaaaagatgtgcgccctgcacctgccgaggaacctctccctgacgacaatcaagctattcaactccagacgctcaaatgccagttgcctcaagaccccggctgtactaacctgcttagcctgagcccatttgaggccgcatctcttggaggctcactgaccgtgctgccagctacaaaagattctatcaaacatctgagtctgcagccctttcagaagggattcattatccagcccgacagtagcattgttgttaagcccataagcggtgagagtgcgattgagcttgctgatatacagcaaatcctgaaaatggccgcctcagccccaccgcagattagtctgcctccattcagtaaagctcctgcagcacctctgcaagctatctttaaacacatgccccccttaaagccaaaacctctggtgactccacgtaccgtagtcgctacctcaaccccacctccactgatcaatgcacagcaggcttctcctgggtgcatttcaccttcactgccgcccccaccactgaaactcctgaagggctccgtggaggccgcttcaaacgctcatcttctgcagtctaagtctggcacgcaaccacacgcggccaccagattgtcgttgcagcagcccagggctgagttgcctggccaacccgagatgaaaacccagttagaacaggactccattattgaagcacttctgccactcagcatggaagccaagataaagcaggaaattaccgagggggaattaaaagccttcatgactgcacctggcgggaagaagacacctgcaatgaggaaagtgttgtatccgtgtcgattttgtaatcaggtcttcgccttctccggcgtgctaagggcccacgtgcggagccatctgggaatctctccttaccaatgcaacatttgcgactacattgctgctgataaagccgccctcattagacacctaagaactcactccggagagaggccatatatttgtaaaatatgccattacccattcaccgtgaaggccaactgcgagcgacacctgcgaaaaaaacaccttaaagccacacggaaagacatcgaaaaaaacattgaatatgtctcttcctctgccgctgaactggtcgatgctttttgtgcgcccgatactgtatgtcgtctttgcggcgaagacttaaaacattatagggctctgagaatacatatgcgcacacactgcggaaggggcctcggagggggacacaaagggagaaaaccctttgagtgcaaggagtgttcagccgcgtttgctgccaagaggaattgcattcaccatatacttaaacaacacctgcacgtgccggaacaggacatcgagagttatgtgcttgctgcagatggattagggcctgccgaagcccctgccgccgaggctagcggtagaggtgaggacagcgggtgtgcggctctaggcgattgtaaacccttgactgctttcctggaaccccagaatgggtttttgcatcgcggcccaacccagccccctccccctcacgtctctattaagttagaaccagcctcaagctttgccgtggacttcaacgagccactcgattttagccagaaaggactcgccctagttcaggttaaacaagaaaacataagttttctgtcgccctctagtctcgttccatacgactgctccatggaaccaattgatctgtctattcccaaaaattttcgtaaaggagacaaggacctcgcaactccatcagaagcaaagaagcccgaagaggaggctgggtcttctgaacagccatctccttgtccagctccaggcccctccctgccagtgactctcggcccatctggcatcctcgaaagtcccatggcccccgccccggctgcgacacctgaacctcctgctcaaccacttcagggccccgtacagctcgctgttcccatttactctagcgccttggtaagcagccccccactggttggctcgagcgcccttctttcggggacggcacttcttcgacccctgcgccccaaacctccccttctgttgcccaaacccccggtgactgaggagctgcctccattggcgagtattgcccaaatcatcagctcggtatcatctgcaccaacgcttttgaaaacgaaagtcgctgaccctggacccgcctctaccgggtccaacactaccgccagcgacagtctaggcgggagcgtaccaaaggctgcgaccaccgccactccagcagccactacaagcccaaaagagtccagcgaaccccctgcacctgctagttctcccgaggcagcatcccctacagaacagggaccagcagggacttcaaaaaaacgagggcgaaaacggggaatgcggtcccggcccagagcaaattcggggggagtggatctggatagctctggagagttcgcatccatcgagaaaatgctggctacgactgacacaaataaatttagcccctttctgcagaccgcagaggataacactcaggatgaagttgctggtgctcccgcggaccatcacgggccctccgatgaggaacaggggtcgcctcctgaggataaactgctgagagccaagagaaatagttatacaaattgcttgcagaaaattacttgcccacattgtcctagggtcttcccttgggcaagctccttgcaaagacatatgctcacccatacaggccagaaaccttttccatgccagaagtgcgatgctttcttttcaactaagtccaactgtgaaaggcaccaactgcgaaaacacggcgtgacaacatgtagcctgcgacgtaacggcctcatcccccaatcaaaggaaagcgatgtgggaagtcatgattcgacagattcccaatctgatgccgaaaccgctgcggcagcaggggaagtgctggatcttacctccagagaccgagagcagccatccgaaggtgctaccgagcttcgtcaagtcgctggggatgctccggtcgaacaggcaacagcggagaccgcctctcccgtccacagggaagaacacggtcgcggtgaatcacacgagcccgaggaagagcatgggacagaagagagcaccggagacgcagacggcgccgaagaagacgcctcctctaatcagtctctcgatctggattttgctactaaacttatggatttcaaactcgcagaaggagacggagaggccggggccggaggcgccgcttcacaagaacagaagcttgcttgcgacacgtgcggcaaaagttttaaatttctgggtaccctgagccgacatcgcaaggcccatggacgtcaagagcccaaggacgaaaagggggatggcgcctcaaccgccgaggagggcccccaaccggccccggagcaggaagaaaagccacctgagacacctgcagaagtggtcgaatcagcacccggggccggcgaagcccctgcagaaaaactcgctgaagagacagaaggcccttctgatggggaatccgctgctgaaaagcgctcgtctgagaagtcggatgatgacaaaaaacccaaaactgactcaccaaagagtgttgcctcaaaggctgacaagaggaaaaaggtctgctcagtgtgtaataagcggttctggtccttgcaggatctaaccagacacatgcgcagccacacaggagaaagaccgtataagtgtcagacctgtgaaaggacattcaccctgaaacactcactcgttcgacaccagagaattcatcagaaagcccgccacgcgaagcatcacggcaaagactccgacaaagaggagcgaggggaagaggacagtgagaacgagtcaactcatagcgggaacaacgctgtgtcagagaatgaggctgagctcgcccctaatgcaagtaaccatatggcagttactagatcccggaaggaagggcttgcatcggccaccaaggactgcagtcaccgggaagaaaaagtcaccgcaggctggccatccgagcctggtcagggggatctaaatcccgagtcaccggcagctctcggacaggacctcctcgagcccagatctaagcgtcccgcccacccaatactggccacagccgatggagcatcccagctcgtcggtatggaatag

SEQ ID NO: 202634 - DNA, 15 bp, Artificial Sequence
  Description of Artificial Sequence: Synthetic coding sequence
atgaccagcagctag

SEQ ID NO: 202635 - DNA, 495 bp, Artificial Sequence
  Description of Artificial Sequence: Synthetic coding sequence
atgaccagcagcagccccgccggcctggagggcagcgacctgagcagtatcaacaccatgatgtctgccgttatgagcgtgggcaaagttactgaaaatggcggcagtcctcagggcataaagtcccccagcaagccccccggcccgaacaggataggaaggcgcaaccaggagactaaggaggaaaaaagcagctacaactgtcctttatgcgagaagatttgcaccacccagcatcaattgacaatgcatatcaggcagcataacactgataccggaggagcagatcacagttgttccatctgtgggaagagtttgtcctctgcgagcagtttggaccgtcacatgttggtacattcaggtgaacgaccatataaatgtactgtctgcggccagagttttacaaccaatgggaatatgcacaggcacatgaaaattcatgaaaaggaccctaactctgcaaccgcaactgccccgccatcccctctgaagtag

SEQ ID NO: 202636 - DNA, 2337 bp, Artificial Sequence
  Description of Artificial Sequence: Synthetic coding sequence
atgaccagcagcagccccgccggcctggagggcagcgacctgagctctattaacaccatgatgtccgctgtaatgagcgttgggaaggtgaccgagaacgggggctcccctcagggtatcaagtcccctagcaagccccccggtccaaatcgaataggtcggcgtaaccaggaaactaaagaagagaagagtagctataattgcccgttgtgcgaaaagatatgcacaacccagcaccagctgactatgcacattaggcagcacaacaccgacaccggcggcgccgatcacagttgctctatttgtggaaaatctctgagcagcgcctcctccctcgaccgccacatgcttgttcatagcggagagcgtccctataagtgtacagtttgtggacagagcttcactaccaacggcaacatgcatcgccatatgaaaattcacgaaaaggaccctaattctgcaactgctacagcacccccaagtcctcttaagcggaggcgcctcagcagtaagcgaaaactgtcgcatgatgcagagagtgagagagaagatcccgccccagctaaaaagatggtggaggacggacagtctggagacctcgagaaaaaggccgacgaagtgttccattgccccgtgtgctttaaggagttcgtttgcaaatacgggcttgagacccacatggagactcattctgataatcctctcagatgcgatatttgttgcgtaacatttcgaacacacaggggactgttgaggcacaacgcattagtgcacaagcagctgccacgtgatgccatgggcagacccttcattcagaacaatccgagcataccggcaggcttccacgacctgggatttaccgatttttcctgtaggaaattccctcgcataagccaggcatggtgtgaaacaaacctgcgtcgatgcatatcagagcagcacagatttgtgtgcgacacctgcgataaagcttttccaatgctgtgcagtttagccctgcacaagcaaacgcatgtagccgctgatcaagggcaggagaaacctcaggccactcctctccccggcgacgctctggaccagaagggctttctcgctctgttgggcctgcagcacaccaaggatgtaagacctgccccagcagaagaacctctgcccgatgacaaccaggccattcaactgcagacgttaaaatgccagctccctcaggaccctggttgcacaaatctgttatctctgagcccgttcgaggcagcatctctgggaggatctcttacagtgcttcctgctaccaaagactccattaagcatctgtccctccagccttttcagaaaggatttatcatccagccagactcttccatcgttgtgaagcctatctcaggcgaaagcgccattgagctcgcagatatccagcagatattgaagatggctgcaagtgcaccgccgcaaataagtctgccccctttttccaaggcaccagccgctcctctccaagcgatctttaaacacatgccccccctgaaaccaaaaccactggtgactccccgtactgtcgtggcgacaagcacgccacctcctctaatcaacgcccagcaggcaagcccagggtgcatctctccttctttgccgccacctcctctcaaactgctgaaaggcagtgtggaggccgctagtaacgctcacctcctgcagagcaaaagcggcactcaaccacatgccgcaactcggctgagcctgcagcaacccagggctgagctgcctggtcagcccgaaatgaagacacagttggagcaggattccatcattgaggccctgctgcccctgtccatggaggcgaagatcaagcaagagatcacagaaggcgaactaaaggcctttatgaccgcaccagggggaaaaaaaacacctgcaatgcgaaaagtcctgtacccctgcaggttctgtaatcaggtgtttgctttctcaggcgttctgcgcgctcatgttcggtcgcacttggggatttcaccttaccagtgtaatatttgcgattatattgctgctgataaggccgctttgataagacatttgagaacacattccggggaaagaccctatatctgtaaaatttgtcattacccattcacagtgaaggctaattgcgaacgtcacctccgcaaaaagcacctgaaggctacccgtaaagatatagagaagaacatcgagtatgtatcctctagcgcagcggagctcgttgacgcgttttgtgctccagacacagtctgtaggctctgcggagaggacctgaagcattatcgagccctaagaatccacatgcggacgcactgcggacgatag

SEQ ID NO: 202637 - DNA, 411 bp, Artificial Sequence
  Description of Artificial Sequence: Synthetic coding sequence
atgaccagcagcagccccgccggcctggagggcagcgacctgagctccataaatacgatgatgagcgctgtcatgtccgtcgggaaggtgaccgaaaatggcggatctccccaggggataaagtctccttcgaaaccgcccgggcctaatagaattgggaggcgaaatcaagagacaaaggaagagaaatccagctacaattgccccctgtgcgagaaaatctgcactacacagcatcagttgactatgcacattaggcaacataataccgacacaggcggagcagaccattcgtgttcgatctgcggcaagtctctctcctctgcatctagtcttgatcgccacatgctggttcacagcggggaaaggccttataagtgtacagtttgcggacagtccttcacgacttag

SEQ ID NO: 202638 - DNA, 189 bp, Artificial Sequence
  Description of Artificial Sequence: Synthetic coding sequence
atgaccagcagcagccccgccggcctggagggcagcgacctgagctccatcaacactatgatgagtgcagtgatgagcgttgggaaggtgaccgaaaacggtggatcacctcaaggcataaaatctcccagcaaacctcctggccccaatcgaatcggccgcaggaaccaagtcagtgtacacacatag

SEQ ID NO: 202639 - DNA, 834 bp, Artificial Sequence
  Description of Artificial Sequence: Synthetic coding sequence
atgagcaagagcctgaagaagctggtggaggagagccgggagaagaaccaaccagaggtggatatgtcggatcgcggcattagtaacatgttggacgtaaacggcctttttacattgtcacacatcacgcagctggtgctaagtcataacaaacttacaatggtacctcccaatatcgcagaactgaagaatttggaggtcctcaattttttcaataatcaaatcgaagagttgcctacacaaataagcagcttgcagaagctgaagcacttgaatctggggatgaataggcttaatacccttcctcgcgggtttggctcactgccagctctagaagtgttagatttgacctacaacaacctgtccgagaattcattgcccggtaacttcttttatcttacaactctgagagctctgtacctctctgataatgactttgaaatacttccacccgacatcggcaagctgacaaagctgcagatattgtccctccgggataatgacttgatatccctgcccaaggagatcggagagctcacacagttaaaagagttacatatccagggtaacaggctgacagttctaccgcctgagctcggcaacctggatctcaccgggcagaaacaagtctttaaggccgagaacaacccctgggtgacaccgatagcagatcagtttcagctgggcgtcagccatgttttcgagtacatccggtccgagacttacaagtatctgtatgggcgtcatatgcaggcgaatcccgagccccccaaaaaaaataacgacaagtccaagaaaatcagccggaaacccctcgcagccaagaaccgctag

SEQ ID NO: 202640 - DNA, 675 bp, Artificial Sequence
  Description of Artificial Sequence: Synthetic coding sequence
atggtgccccccaacatcgccgagctgaagaacctggaggtgctgaattttttcaataaccagatcgaggaactcccaacccagatttccagcctccagaaactcaaacatttaaaccttggaatgaatagacttaatacattgcctcgtggatttggctcactgcccgcattagaggtgctggatcttacctacaataacctgtctgagaacagcctgcccgggaactttttctatctgaccaccttgagggcactgtatctgtccgacaatgatttcgagattctgcctccagatataggaaagctcaccaagctccagattctgagcctgagagacaatgatttgatctccctgcccaaggaaatcggcgaactcacacaactgaaagagctgcacatccagggtaaccggcttacagtcctgcccccagaacttggaaatttggacttgacaggccaaaagcaggttttcaaagccgagaataacccctgggtgaccccaatcgcagatcagttccaactgggagtctctcacgtgttcgagtatattaggtcagagacctataaatacttatacggacggcacatgcaggcaaaccccgagccgcctaagaagaataacgacaagagcaaaaaaatatcacggaagcctcttgccgccaagaatagatag

SEQ ID NO: 202641 - DNA, 834 bp, Artificial Sequence
  Description of Artificial Sequence: Synthetic coding sequence
atgagcaagagcctgaagaagctggtggaggagagccgggagaagaaccagcccgaggtggatatgtctgaccggggaatttctaatatgttagatgtcaacgggttgttcactcttagtcacatcactcaactcgtgctgtcccacaataagttgaccatggtgccccccaacatcgctgagctgaagaatctcgaagtgctaaacttctttaacaaccagattgaggaactgcctacccagatctcttctttgcaaaaactcaaacacctgaacttggggatgaaccggctgaataccttgccacgtggctttgggtcactgccagcactcgaagtcttagatttgacatataacaacctttctgagaatagtctaccgggaaacttcttctacctgaccacactccgtgcgctgtacttatccgacaatgacttcgagattcttccgcctgacattggcaaactgactaagctccagatactgtcactgcgcgataatgatcttatctctttgcccaaagagatcggagagctgactcagttaaaagagttgcacattcagggaaatcgtctgacggtcctgccccccgaattagggaaccttgacctgacgggccagaagcaggtgttcaaagcagagaataacccttgggtaacaccaatcgccgatcaatttcaactcggtgtgagccacgtgtttgagtacattcgatccgaaacttacaaatacctctatggcaggcatatgcaggcgaaccccgaacctccaaagaagaataacgacaaaagcaaaaaaattagcaggaaaccactcgccgcgaagaatagatag

SEQ ID NO: 202642 - DNA, 945 bp, Artificial Sequence
  Description of Artificial Sequence: Synthetic coding sequence
atggccgccaccgccagcgccggcgccggcggcatcgacggcaagcccaggacctcaccgaaatcggtcaagtttctgttcggaggactcgcgggcatgggcgcaactgtatttgtccaacctctggatctggttaaaaataggatgcagttgtccggcgaaggagccaagactcgggaatacaaaacctccttccatgctctcacatcgatcctgaaggctgaagggctgcgggggatctatacaggactgtccgctgggctcctacgccaggccacgtacactactacgaggttagggatctacacagtcctgtttgaacggctgaccggcgcggatggaaccccacctgggttcttgctgaaggcggtaatcgggatgactgcaggcgccacaggcgccttcgttggaacacctgccgaggtcgctctgatcagaatgaccgctgatggccggctccccgccgaccagcgccgtggctataagaacgttttcaatgccctaatcaggatcacacgagaggagggcgtgttgactttgtggcggggctgcattcctactatggctcgcgccgtggtggtgaatgcagcccagctggcttcctacagccaatccaagcagtttttgctggactcaggatatttttctgacaatatcttgtgtcacttttgcgccagcatgatcagtggcctggtcacaaccgctgccagtatgcctgtcgatatcgcaaagactagaattcagaacatgcgaatgatcgacggcaagcccgagtacaagaacggactcgacgttcttttcaaagtcgtgagatatgaaggctttttttcactctggaaggggtttactccgtattacgcccggctgggtccacacacagtgctgacctttatcttccttgaacagatgaataaggcctataaaaggctcttcctgtctgggtag

SEQ ID NO: 202643 - DNA, 1530 bp, Artificial Sequence
  Description of Artificial Sequence: Synthetic coding sequence
atgagcatgggcgccccccggagcctgctgctggccctggccgccggacttgctgttgcgcggccacccaacatagtccttatctttgccgacgacctcgggtatggggatctgggatgttacggccaccctagcagcaccactccaaatctcgatcagctggcagccggcgggctcaggttcacagatttttatgtccccgtgagtctgtgcacgccatcccgggcagcgctgctgaccggccgtctgcccgtgaggatgggtatgtaccccggggttctggtgccttcaagtcgaggaggactgcctcttgaggaggtcacagtggctgaggtactggctgcccgtgggtacctcactggtatggctgggaaatggcacctgggggtgggacctgagggagcatttttacccccccaccaaggcttccacagattcctggggattccatactcccacgaccagggcccgtgccagaatctgacttgtttcccccccgcgactccatgtgacggcggctgcgatcaaggacttgtccctatcccactgctggcaaatctgtctgtggaggcccagcccccttggctccctggactagaggctcgctacatggccttcgcacacgatctcatggccgatgcccagcgccaggacaggcctttttttttgtactacgctagccaccacacacattaccctcagttttcaggacagtcttttgcagagagatcaggcaggggcccatttggagactctttaatggaattggacgccgccgtagggaccctgatgaccgctatcggtgacctcgggctgctcgaggagactctcgtgattttcacagccgataacggcccggagactatgcggatgtctaggggcggctgcagcgggctgctgcgttgtgggaaaggcacaacctacgagggaggtgtgcgggaaccagcccttgccttctggcctgggcacatcgcaccaggggtaacccatgagctcgctagttccctggacctattacctacactggcggctttggctggggcacccctgcccaatgtcacacttgacgggttcgacctgagcccactcttgcttgggaccggtaagagcccacgccagagtctctttttttacccctcctaccctgacgaggtgagaggcgtttttgccgtacggactgggaaatataaggcacacttttttacccaaggttcagcccatagcgataccaccgccgatcccgcatgtcacgcatcctcgtctctcaccgcacatgagccacctctgctttacgacttgtcaaaagaccccggagaaaattataatctactaggcggtgtggccggagctaccccagaagtactgcaggctttgaagcagctgcagctccttaaagctcaattagatgcagcagtcacttttggccctagtcaggtagcacgaggcgaagaccctgcccttcagatctgttgccaccctggatgtacaccccggcctgcgtgttgccattgccccgatccccacgcatag

SEQ ID NO: 202644 - DNA, 600 bp, Artificial Sequence
  Description of Artificial Sequence: Synthetic coding sequence
atggccaagagcgccgaggtgaagctggccatcttcggccgggccggggtgggcaagagtgctttagtggtgagattcctcaccaagaggtttatctgggaatatgatcctacccttgaaagtacctatcgtcaccaggcaacaatcgacgacgaagttgtcagcatggaaatactggacaccgccggtcaggaggacaccatacaaagagaggggcacatgaggtggggggagggttttgtcctcgtgtacgatatcactgacagagggtctttcgaggaagtgctacccctgaagaatatcttggacgagattaagaaacccaagaacgtcacacttatcttggtggggaataaagcagatctggaccattccaggcaagtgtccactgaagagggcgaaaagttggcaaccgaattggcgtgtgccttctacgaatgtagcgcgtgcaccggagagggcaacataactgagatcttttacgagctgtgccgggaggtgcgccgacggaggatggttcagggcaaaacccggcggagatctagcaccactcacgtcaaacaggccatcaacaagatgctgaccaaaatctcctcatag

SEQ ID NO: 202645 - DNA, 120 bp, Artificial Sequence
  Description of Artificial Sequence: Synthetic coding sequence
atggccaagagcgccgaggtgaagctggccatcttcggccgggccggcgtgggtaaatccgccctggtggtgaggtttctgaccaaacgatttatttgggaatacgatcccacattatag

SEQ ID NO: 202646 - DNA, 600 bp, Artificial Sequence
  Description of Artificial Sequence: Synthetic coding sequence
atggccaagagcgccgaggtgaagctggccatcttcggccgggccggagtgggcaagtctgccctcgttgttcgattcttaaccaagcgcttcatctgggaatacgatccgactctggagagcacatatcgtcaccaagccactattgacgatgaggtggtttccatggagattctggataccgcgggacaagaggataccattcaacgcgaggggcacatgcgctggggcgaaggattcgttctggtctatgatatcacagataggggttcctttgaggaagtactcccactgaagaacattcttgacgaaatcaaaaaaccaaagaacgtcacccttatcctggttggaaataaggctgatctggaccactcaagacaggtgtctaccgaagagggcgagaagctcgccactgaattagcctgcgctttttacgagtgttctgcctgtaccggtgaggggaacattaccgagattttttacgagttatgccgggaggtgagaagacgccgtatggtgcagggtaagacccggagaaggagcagcacgacacacgtgaaacaggcaattaataagatgctaacaaagatcagttcgtag

SEQ ID NO: 202647 - DNA, 600 bp, Artificial Sequence
  Description of Artificial Sequence: Synthetic coding sequence
atggccaagagcgccgaggtgaagctggccatcttcggccgggccggggttggtaaaagcgcccttgtcgtgaggttcctgacaaagcgattcatctgggagtatgacccgaccctcgaatccacttaccggcaccaggcgacgattgacgatgaggtagtcagcatggagatccttgacaccgctggccaggaggataccattcaaagggagggccacatgcgatggggcgagggattcgtactcgtgtacgatataacggatcgaggaagctttgaggaggttctgcctcttaagaacatactggatgaaattaagaaaccaaagaatgtgaccctcatactggtggggaataaagcagacttggaccattccagacaagtctcaactgaagaaggcgagaaactcgccacagaacttgcttgtgcattctatgagtgttccgcctgcacaggggagggcaacatcacagaaattttctatgaactctgtagggaagttcgccggcgcagaatggtacagggaaaaacacgtagaaggtcatccaccacgcatgtgaaacaggcgattaacaagatgcttacaaagatttcaagttag

SEQ ID NO: 202648 - DNA, 543 bp, Artificial Sequence
  Description of Artificial Sequence: Synthetic coding sequence
atggccaagagcgccgaggtgaagctggccatcttcggccgggccggggtgggtaagtccgaaagcacatatcgccaccaagcgacaatcgacgacgaggtggtttcaatggaaatcttagacaccgccggccaagaggatacgatccagcgcgaaggccacatgcgatggggtgaagggttcgtcctcgtgtacgatataactgaccgtggatcgttcgaagaagtcctgccactgaagaacattttggatgagataaagaagccaaaaaacgtcaccctgatccttgtgggcaataaggcagatttagatcacagtaggcaagtgtccactgaggagggagagaagctggccacagagctggcatgtgccttttatgagtgttctgcatgcactggcgaaggcaatatcactgaaatcttttatgagctgtgccgcgaggtcagacggcggagaatggtgcagggcaagactagaaggcggtcaagtaccacacatgtgaaacaagccatcaataagatgctgactaaaatctctagttag

SEQ ID NO: 202649 - DNA, 612 bp, Artificial Sequence
  Description of Artificial Sequence: Synthetic coding sequence
atggtgagcacctaccgggtggccgtgctgggcgcccggggcgtgggcaagagcgctatagtgcgccaattcctctacaatgaattttctgaggtttgtgtgcccaccaccgctcggcgcttgtacttgccagccgttgtgatgaacggccacgtgcatgacctgcaaatcttagactttccccctatttctgctttccctgtcaacaccctgcaggaatgggctgatacgtgttgccggggattgcgaagcgtgcatgcatatatcctggtgtatgatatctgttgtttcgattccttcgagtacgtgaagacaataagacagcagattttagaaaccagggtgattggcacaagcgaaacgcccattatcatagtgggaaataaaagagacctgcagcgaggacgcgtcattccaaggtggaatgtatctcacctggtgcggaagacctggaaatgtgggtacgtggagtgttccgcaaagtacaactggcatatattattgctgtttagcgaactcctgaagtccgtcggttgcgcccgttgtaaacatgtccacgccgccctgagattccagggggccttgcggaggaacaggtgtgccataatgtag

SEQ ID NO: 202650 - DNA, 729 bp, Artificial Sequence
  Description of Artificial Sequence: Synthetic coding sequence
atgcggcccctgagcatgagcggccacttcctgctggcccccatcccagagtcctcctctgactaccttctgcctaaggatatcaaacttgctgtccttggcgccgggagggtaggcaagagtgcaatgatcgttcgattcctcactaagaggttcattggcgattatgagccaaacacaggaaagctgtactcaaggcttgtatacgttgagggtgatcaactgtcactccagatccaagataccccaggcggcgtccagatccaggactctctgccccaggttgtggattctctgagcaaatgcgttcaatgggcagagggctttttgctcgtgtatagcatcactgattacgattcatatctgagcattcgccctttataccagcacatccgcaaggtgcatccggacagtaaggcccccgtgatcatcgttggtaataagggcgacttgttgcacgcgcgccaggtccagactcaggatgggatccagctcgccaatgaattgggatccttgttcctggaaatctccacctctgaaaactacgaggatgtttgtgacgttttccagcacttgtgtaaagaggtctccaaaatgcacggcctgagcggggagagacgaagggcgtctatcatcccacggcctaggtcccccaacatgcaagatctgaaaaggagattcaaacaggcactgtctcccaaggtcaaggcaccctccgccctcggatag

SEQ ID NO: 202651 - DNA, 747 bp, Artificial Sequence
  Description of Artificial Sequence: Synthetic coding sequence
atgcggctgatccagaacatgtgcaccatcgccgagtaccccgccccaggcaacgctgctgcctctgattgttgcgtgggggctgccgggaggagattggtgaaaatcgccgtcgttggagcatctggagttggcaagaccgcgcttgtggtgaggttcctcaccaaacgtttcatcggtgattatgagcggaacgctggaaatttgtatacacggcaagtacagatcgaaggagagaccctagcactgcaggtgcaggacaccccaggcattcaggtgcatgaaaactccctctcgtgctctgaacagctcaatagatgcatccggtgggccgatgcagtggttattgtgttctcaataacagactacaaatcatatgaactgatcagtcaacttcatcagcacgtgcagcagctccatctcgggacgcggctgcctgtggtagttgtagccaacaaagccgatttactgcacattaaacaggtggatccacagctaggcttgcagcttgcaagtatgttagggtgcagcttctatgaagtgagcgtgtccgagaactataatgacgtgtattctgcattccatgtattatgcaaagaagtatcccataaacagcagccgtcctcaacaccggagaaacgcaggacaagcctcatcccccgtccgaagagcccgaacatgcaggatctcaaaagacggttcaaacaggctctatcagcaaaagttagaaccgttactagcgtttag

SEQ ID NO: 202652 - DNA, 927 bp, Artificial Sequence
  Description of Artificial Sequence: Synthetic coding sequence
atgaccctgaacggcggcggcagcggcgccggcggcagccggggcggcggtcaggaaagggaacgcaggcggggctctaccccttgggggcctgcccccccactgcaccggaggagcatgccagtggacgagagggaccttcaagccgccctgactccaggagctctgacagccgctgccgctggaaccggtactcaaggaccaagactcgactggcccgaagatagcgaggatagtctatcctccggagggagcgacagcgatgaatctgtctataaggtacttttgctgggagcccccggagtcggtaagagtgccttggcccgcatttttggcggggtcgaggatgggcccgaggctgaagccgcaggccatacatacgaccgatccatcgtggtggacggggaagaagcctccctgatggtctatgacatctgggaacaggacggggggcggtggctgcctgggcactgcatggccatgggggacgcttacgtaatcgtgtacagtgtgactgacaaggggtcttttgagaaggcctcagagctgagagtccagcttcgccgtgcgcgccagaccgacgacgtgcccattatcttggtgggcaacaagtcagacctcgtgcgaagcagggaagtaagcgtggacgaggggcgtgcatgcgccgtcgtgtttgactgcaaatttatcgagaccagcgccgccttacaccataatgtgcaggccctcttcgaaggcgtcgttcgacagattagactgaggagagattctaaggaggcgaacgcccgtaggcaggccggcacccgaagacgggagtcgctgggcaagaaagccaagcggtttctcggccggattgttgcaagaaatagcaggaaaatggcattcagagccaagtccaagagctgccacgacttgagcgtactttag

SEQ ID NO: 202653 - DNA, 927 bp, Artificial Sequence
  Description of Artificial Sequence: Synthetic coding sequence
atgaccctgaacggcggcggcagcggcgccggcggcagccggggcggtggacaagaacgtgaacgccgccgcggcagcacaccttggggaccggctccccccctgcaccgccgctcaatgcctgtcgacgagcgggacctgcaggccgctcttactccgggagcgctgaccgctgccgcagccggcactggcacgcagggccctaggctcgactggcccgaggatagtgaggactctctgagctcaggcgggtcagacagcgatgaatctgtgtataaagtgctgttgctgggtgcccctggcgtcgggaaaagcgcactggcacggatttttggcggggtggaggatggcccggaggccgaggcagcagggcatacttacgaccggagcatcgtggtggatggagaggaagcatccctgatggtatatgatatctgggagcaagatggaggaagatggctccccgggcactgtatggctatgggggatgcctatgtgatcgtttactcagtgacggacaaaggatctttcgagaaggcatctgagctgcgggtgcaattgcgtcgtgctcgccagacagatgacgtcccaataattctggtaggtaataaaagcgacctggtgagatctcgggaagtcagtgtggatgagggaagggcctgcgccgtcgtgttcgattgtaaattcatagagacatccgcagcgcttcaccataacgttcaggctctgttcgagggcgtggtgaggcagataaggttacgcagggattcgaaggaggccaacgctcgacggcaggcagggactcggcggagagaatccttaggaaagaaagctaaacggttccttgggaggattgtcgcgagaaattcccggaagatggcttttcgcgccaagtctaagtcctgccacgacctttctgtgctctag

SEQ ID NO: 202654 - DNA, 579 bp, Artificial Sequence
  Description of Artificial Sequence: Synthetic coding sequence
atgcaggccatcaagtgcgtggtggtgggcgacggcgccgtgggcaaaacctgccttctgatctcttatacgacaaacgcgtttccaggagaatacattccaaccgtgttcgacaactattccgcgaatgtgatggtagacgggaagcctgtgaatctgggattgtgggacactgccggacaagaggactacgacaggttgcggcccctttcctacccccagaccgacgtgttcttgatctgttttagtcttgtttcacccgccagctttgagaacgtgcgcgcaaaatggtacccagaggtaaggcaccactgtccccacacacccatacttctggttggtacaaagctagaccttcgagacgacaaagacacgatagagcgcctcagagataaaaaactggccccaatcacttacccacaaggtctggccatggcccgggagatcgggagcgtgaagtacctggagtgtagcgccctgacacagagaggcttgaaaacagtgtttgacgaagcaatcagggccgtcctatgcccacctccagtcaagaagcctggcaagaagtgtacagtcttctag

SEQ ID NO: 202655 - DNA, 942 bp, Artificial Sequence
  Description of Artificial Sequence: Synthetic coding sequence
atgcccaacaccgccatgaagaagaaggtgctgctgatgggcaagtctgggtcaggaaagacaagcatgagatcaattatctttgcgaactacattgcccgcgacactcggagactaggcgccaccatcgatgtcgaacactcccacgtccgcttcctggggaacctcgtgctcaatctgtgggattgtgggggccaggacaccttcatggagaactatttcacaagccaacgcgacaacattttccgcaatgtagaggtccttatttacgttttcgacgtcgaaagccgggaactggagaaggatatgcactactatcaatcttgcctggaagcaatcttgcagaatagcccagatgctaaaatcttttgcctagtgcacaagatggatctcgttcaggaagaccagcgggacctcattttcaaggagcgagaagaagacctccgccggctgtcgaggcctcttgaatgtgcatgtttccgaacctccatatgggacgagactctgtataaggcatggagctccatcgtgtatcagctcatcccaaatgtccagcagctggagatgaacttaagaaattttgcacagatcatagaagctgatgaggtgttgctgttcgagcgtgccacgtttctcgttatctctcactaccagtgcaaggagcaaagggatgtgcacagattcgagaagatctccaacatcatcaaacaattcaaactctcgtgttccaagctcgcagctagctttcagagcatggaggtgcgcaattccaattttgctgcttttatagacattttcactagcaatacatatgtaatggtggttatgtccgatccttctatcccctcagccgctacactgataaacatacggaacgcccggaagcacttcgagaagttggagagagtcgacggtccaaaacattcactactgatgagatag

SEQ ID NO: 202656 - DNA, 1125 bp, Artificial Sequence
  Description of Artificial Sequence: Synthetic coding sequence
atggaggagagcgacagcgagaagaccaccgagaaggagaacctgggcccccgtatggacccccccctgggagagcccgaggggtcactcggatgggtgctacccaatactgctatgaaaaagaaggtacttctcatgggcaagagtggcagcgggaaaacatccatgcgatctatcatttttgcgaactacatcgcccgggatacacggcggctcggggcaacaatcctggaccgtatccactccttacagattaactcttctcttagcacctacagtctagtggactccgtggggaacaccaagacattcgacgtggagcatagtcatgtgagattcctgggaaatcttgtactcaatctgtgggactgtgggggccaggatactttcatggagaattattttacctcgcagcgggacaatattttcaggaacgtagaggtgcttatttatgtcttcgatgtcgaatcgcgggagctcgagaaggacatgcattactaccagtcttgcctggaggcaatccttcagaactcccccgatgccaagattttctgtctcgtccacaaaatggacctggtccaagaagatcagcgagaccttatattcaaagaacgagaggaggatctgagacgcctgtctcggcctctggagtgctcttgcttcaggacaagcatatgggacgaaacactctacaaagcctggtcctcaatcgtgtaccaattaatcccgaatgtgcaacaactcgagatgaatttgcgcaactttgccgaaatcatagaggccgatgaagtccttctattcgaaagggccacatttttagtcatttcacactaccagtgcaaagagcagcgggatgcccatcgtttcgagaagatttctaatattatcaagcaatttaaactctcctgctcgaagcttgctgccagcttccaatccatggaggtgcggaattcaaacttcgccgcattcatcgacatcttcacatccaacacctacgttatggtggtgatgagcgacccgagcatcccttctgccgctactttaattaacattcggaacgctcgtaagcacttcgagaaactggagagagtggacggtcctaagcagtgcttactgatgcgctag

SEQ ID NO: 202657 - DNA, 1041 bp, Artificial Sequence
  Description of Artificial Sequence: Synthetic coding sequence
atggaggagagcgacagcgagaagaccaccgagaaggagaacctgggcccacgaatggaccccccgctcggagaaccggagggaagtctagggtgggtcctgcccaacaccgcgatgaagaagaaggtcttattgatgggcaaatctggatctggaaaaactagtatgcgctcaattatctttgcaaattatatagcacgggatactcggagactaggggccactatcgacgtcgagcattcgcatgttcgctttctggggaatttagttctgaatttgtgggattgcggaggccaggacacttttatggagaactacttcacttctcagagggataatatcttccgcaacgtggaggtactgatttacgtcttcgacgttgagagccgggagctcgagaaggatatgcattactaccaatcgtgcctggaggctatcttgcagaactcaccggacgctaaaattttttgtctggtgcacaagatggatctggtgcaggaggatcagcgtgacctaatctttaaggaaagggaagaagatcttcgacggcttagcaggcctttggaatgtagttgctttagaacttctatttgggacgagaccctttacaaggcctggagtagcattgtctatcagcttatcccaaatgtccagcaactggaaatgaacctgcggaacttcgctgaaatcatcgaagcagacgaagtgctccttttcgaaagggcaacctttttagttatctctcactaccaatgcaaagaacagcgagatgcacaccggttcgaaaagatatcaaatataattaagcagtttaaactgagctgtagcaaattagcagcttctttccaatcaatggaggtgagaaacagcaattttgcagccttcattgacatcttcacatcgaacacatacgtaatggtggtcatgtctgatccctccatcccgtcagcggccaccttgataaacatacgtaacgctcgtaaacactttgagaaacttgagagggtggacggacctaaacagtgtctgctgatgaggtag

SEQ ID NO: 202658 - DNA, 585 bp, Artificial Sequence
  Description of Artificial Sequence: Synthetic coding sequence
atgaagaagaaggtgctgctgatgggcaagagcggcagcggcaagaccagcatgcgctccattatatttgcaaattatatagccagagatacccgtcggttgggcgcaactatcgacgtggaacacagccatgtccgcttcctgggtaacctggttctcaatctctgggactgcggcggacaggacaccttcatggaaaattacttcacctcacagagggataatatttttcgcaacgtcgaggtgctcatctacgtcttcgacgtggaaagtagggagctggaaaaggatatgcactactatcaatcatgcctcgaagctatcctccagaatagcccagatgctaagatattttgcctggttcacaaaatggatcttgtgcaggaggaccagcgggacttgatattcaaggagcgggaagaggaccttcggagactaagccgacctttggaatgttcttgcttcagaactagtatttgggacgagaccctgtacaaagcgtggtctagcatcgtttaccaactgatccctaatgtgcaacagctggagatgaatctgaggaattttgcggaaattatcgaatag

SEQ ID NO: 202659 - DNA, 1200 bp, Artificial Sequence
  Description of Artificial Sequence: Synthetic coding sequence
atgagcctgcagtacggcgccgaggagacccccctggccggcagctatggggcggccgatagtttcccaaaagattttggatacggggttgaagaggaggaggaagaagccgccgccgctggaggcggggtgggagcaggggccggcggaggttgcggccccgggggagctgactcatccaaacctcgtatattgctgatgggacttcgtagatctggaaagtcttccattcagaaggttgtttttcacaaaatgagtccgaacgaaacgctgtttctggagtcaacgaacaagatctacaaagacgatatctccaactccagcttcgtcaattttcaaatatgggactttcctggacagatggacttctttgatccaactttcgactacgagatgatattcagggggaccggggctctgatatacgttattgatgctcaggacgattacatggaagcattaactcgactccatatcaccgtttctaaagcatacaaggtgaacccggatatgaactttgaggtgtttattcacaaggtagacggcctttctgacgatcacaagatcgagactcagcgggatattcatcagagagccaacgacgatctggctgatgcaggtctggagaaactgcaccttagtttctacctgacatctatctacgaccattcgatattcgaggcgtttagtaaggtggtccagaagctgatacctcagcttcctacgttggagaacctcttgaacatattcataagtaacagcggtatcgaaaaagcgttcctgtttgatgtggtgtccaagatctacattgctaccgattcgtccccggtggacatgcaatcttacgaactatgctgtgatatgattgatgtggtaatagatgtaagttgcatctatggtcttaaagaggacggttccggtagtgcttacgataaggaatcaatggccatcatcaagctgaacaataccaccgtcctctatctgaaggaggttacgaagttcctggccttggtgtgcatccttcgggaggaaagctttgagcggaaaggcttgatagactataacttccactgtttccgtaaagctatccatgaggtgtttgaggttggtgtgacaagccatagatcatgcggacaccagacgagtgcctcctcactcaaagccctgacccataatgggaccccccgaaacgccatatag

SEQ ID NO: 202660 - DNA, 750 bp, Artificial Sequence
  Description of Artificial Sequence: Synthetic coding sequence
atggaggccctggcccggctgcacctgaccgtgacccgggcctacaaggttaacactgacattaattttgaggtgttcatacacaaagtcgacggactgagcgacgatcacaaaattgagacccagagagatattcatcagagggccaatgacgacttagccgatgccggactcgaaaaaatccacctctccttctacctcacaagtatttacgatcactccattttcgaagctttttcaaaagtcgtccagaaactgatcccccagctgcccaccttggaaaatttgcttaacatatttatctccaactcaggaatcgaaaaggcgtttctgtttgacgtagtcagcaagatctatattgctacggactccacccccgtcgacatgcagacctacgagctctgctgcgatatgattgatgtagtcattgatatatcttgcatctacggcttgaaggaagatggtgccggaaccccatacgacaaagaatccaccgccatcattaaactcaacaataccactgtgttatacctgaaggaggtgactaaattcctcgctctggtgtgctttgtcagagaggaatcattcgaacggaagggccttatcgattacaatttccactgttttcgaaaagctatacacgaggtcttcgaggtcagaatgaaagttgtgaaatccagaaaagtccagaatcggctgcaaaagaaaaagagggccacccctaacgggacgcctcgcgtgttgctgtag

SEQ ID NO: 202661 - DNA, 1203 bp, Artificial Sequence
  Description of Artificial Sequence: Synthetic coding sequence
atgagccaggtgctgggcaagccccagccccaggacgaggacgacgctgaggaagaagaagaggaggatgagctggtgggactggccgactacggtgacggacctgacagcagtgatgcagatcctgacagcggcaccgaagagggggtgctcgacttttcagatcctttttccacggaggtgaagccacgaatcttgctgatgggtctgcgcaggtcaggcaaatcttctatccaaaaggtggtcttccacaagatgtctcctaatgagacacttttcctagagtcaacaaacaaaatttgccgggaggatgtctcgaattctagtttcgtcaattttcagatttgggacttccccggacagatcgactttttcgaccccacctttgactacgagatgatttttcgcggaactggagcactgattttcgtgatagacagccaggacgactatatggaagcactggcgcgcttgcaccttacagtcacgagagcatataaagtgaacacggatattaattttgaagtctttatccacaaagtggacggcttaagcgacgatcataagattgagacccagagggatatccaccaaagagcaaacgatgatctggctgatgccggtctcgagaagattcacctctccttttatctgacctctatctacgaccatagcattttcgaggcgttcagcaaggtggttcagaagctaatcccacaactccccacgctggaaaatcttcttaatatcttcataagcaattctggtattgaaaaggccttcctatttgacgtagtatccaagatctacatagcaacggattctacacccgtagacatgcagacctacgagctgtgttgtgacatgatagatgtggtcatcgatatttcctgcatctatggcctgaaggaagacggggcaggaaccccttacgacaaagaaagtacggctattattaagctcaataacaccacagtcctgtatcttaaagaagtgaccaagttcctcgccctggtttgctttgtgagggaggaaagtttcgagaggaaagggctgatcgattataacttccactgttttagaaaagccatccatgaagtgtttgaggtgcgaatgaaggtagttaagtcacggaaggtccaaaaccgattacagaagaaaaaaagagccacacctaatgggaccccccgcgtcctactgtag

SEQ ID NO: 202662 - DNA, 348 bp, Artificial Sequence
  Description of Artificial Sequence: Synthetic coding sequence
atgctgcgggacaccatgaagagctggaacgacagccagagcgacttgtgcagtactgaccaggaggaggaggaggaaatgatttttggggagaacgaagatgaccttgacgaaatgatggatctcagtgacttgcccacgtcactctttgcctgttccgtgcatgaggccgtcttcgaggcgcgagaacagaaagagagaaatatgaattttactagagagcagtctcgacatcctgcctggtggttcatgagcgttaaagttaaacttaagcgcaagaaacgccaaaaaactccaaaccgtaagcttcccagaagaggagctccgactctccggccccagagatag

SEQ ID NO: 202663 - DNA, 726 bp, Artificial Sequence
  Description of Artificial Sequence: Synthetic coding sequence
atgctgcgggacaccatgaagagctggaacgacagccagagcgacctctgttctacagaccaagaggaggaagaagaaatgattttcggggagaacgaagacgatctggacgagatgatggaccttagtgatctgccaaccagcttgttcgcgtgctcggtccacgaagccgtgtttgaggcccgggaacaaaaggaaaggttcgaggccctgttcaccatctacgacgaccaagtcacatttcagctcttcaagtcttttcgtcgtgtgcggatcaactttagcaaaccggaagctgctgctcgcgcccggatcgagctgcacgagaccgatttcaacgggcaaaagctgaagctctactttgcacaggtgcagatgtccggggaggtgagggacaaaagctacctccttcccccacagcctgtgaaacagtttctcatctcgccgccagccagccccccagtgggctggaagcagtctgaagatgcaatgcccgtcattaactatgatttgctgtgtgctgtgtccaagttggggcctggagaaaaatacgaacttcatgccggaactgagagtactccttccgtagtcgtccacgtgtgcgagtccgaaaccgaagaggaggaagagactaagaaccctaagcagaagatcgcgcagacgaggcggcccgatccaccaactgcggcacttaacgaaccccagaccttcgactgcgccctgtag

SEQ ID NO: 202664 - DNA, 522 bp, Artificial Sequence
  Description of Artificial Sequence: Synthetic coding sequence
atgctgcgggacaccatgaagagctggaacgacagccagagcgacctgtgctcgaccgaccaggaagaagaagaggaaatgatttttggggaaaacgaagacgatctggacgagatgatggacctgagcgacttacccacatccctgtttgcatgcagcgttcatgaggccgttttcgaagccagggaacaaaaggaaaggtttgaggctttattcactatttacgacgaccaggttactttccaactcttcaaatcgtttcggagagtgaggatcaacttctctaaacctgaggccgcagcccgcgcccgcattgagctgcacgagactgattttaatggtcagaaactcaagctctacttcgcccaagaaaggaacatgaacttcacgagggagcagtcccgacaccctgcttggtggttcatgagcgtaaaggtgaagctgaagcggaaaaagcggcagaagacccccaatcgcaagctccctcgaagaggggcccctaccctcaggccccaaaggtag

SEQ ID NO: 202665 - DNA, 198 bp, Artificial Sequence
  Description of Artificial Sequence: Synthetic coding sequence
atgctgcgggacaccatgaagagctggaacgacagccagagcgacttgtgttccactgaccaagaggaagaagaagaaatgatcttcggggaaaacgaagatgatctagacgagatgatggacctatcggatctgccaacatctctgtttgcttgtagtgtccacgaagccgtgttcgaggctcgcgaacaaaagtag

SEQ ID NO: 202666 - DNA, 696 bp, Artificial Sequence
  Description of Artificial Sequence: Synthetic coding sequence
atgctgcgggacaccatgaagagctggaacgacagccagagcgacttgtgtagcaccgaccaagaagaggaggaggaaatgatctttggggaaaacgaggacgatttggacgagatgatggatctctccgatcttcctacctcactgtttgcctgctccgttcacgaagcggttttcgaggccagagagcagaaggagcgtttcgaagcactctttaccatctacgatgaccaggtgacatttcagctgtttaagtcatttcgtagagtccgtattaacttcagcaagcccgaagccgcagcacgagccaggatagagcttcacgaaacagacttcaacggacagaagcttaaattatactttgcgcagtcctatctgctgcctccacagccagtcaaacagtttcttatcagtcccccggcctctcctcctgtaggttggaaacagtctgaggatgctatgccagtcatcaactacgacctcttatgtgccgtctccaagctggggcctggcgagaagtatgagctccatgcaggtaccgaatctactccctcagtcgtggtgcatgtgtgcgagtctgagacagaggaggaagaggagactaaaaacccaaagcaaaagatcgctcagactcgccggcccgatccacccaccgctgccctcaacgaaccccagaccttcgactgcgcgttgtag

SEQ ID NO: 202667 - DNA, 552 bp, Artificial Sequence
  Description of Artificial Sequence: Synthetic coding sequence
atgctgcgggacaccatgaagagctggaacgacagccagagcgacctctgctcaactgaccaggaggaggaggaagagatgatctttggggagaatgaggatgacctcgatgaaatgatggatctgtccgaccttccgacatctttgttcgcatgcagtgtgcacgaggcagttttcgaagcccgtgaacagaaagttcagatgagtggcgaggtcagggataagagttatctgctgcctccacagcctgtgaaacaattcctgatttcacccccggcgtccccaccagtaggatggaagcagtccgaagatgccatgcccgtgatcaattatgatttactgtgcgctgttagcaagcttggccctggggagaagtacgagctgcatgctggaaccgaatccacaccttcagtagtggtccatgtctgcgagtccgaaactgaagaggaggaggagactaagaaccctaaacagaaaatcgcccagaccagaaggccagatccaccaaccgctgcacttaacgagccccagaccttcgactgcgctctgtag

SEQ ID NO: 202668 - DNA, 900 bp, Artificial Sequence
  Description of Artificial Sequence: Synthetic coding sequence
atgcacagcctggccaccgccgcccccgtgcccaccaccctggcccaggtcgatcgcgagaagatttaccagtggataaacgagctctcatctcccgagacccgggagaatgccctgctcgaattgtctaagaaaagggagtcggtccccgatctcgctcctatgctgtggcactccttcggaactattgccgccctgctgcaggagatcgtgaatatctatccatcaatcaaccccccgaccctgaccgcacaccagtcaaaccgagtgtgcaatgccttggccttactacagtgcgtcgctagccatccagagacaaggagtgccttcctcgctgcgcatatccccctgtttctctacccatttcttcacactgtgtctaagacccgacctttcgagtacctcaggctgacgagtctcggtgttatcggagctcttgtcaagacagacgagcaggaggtgataaacttccttctgacaactgagattatccccctgtgcctgcggattatggaaagtgggagcgagctgtcgaagaccgtcgctacattcatactgcagaagatcctgcttgatgatactggtctcgcttatatctgccagacttatgaaaggttctcgcacgtcgctatgatcctgggaaagatggtcctgcaacttagtaaggagccctctgccagacttctgaaacatgttgtgcggtgttacctgaggctaagtgataaccctcgcgctcgggaggccctgcggcagtgtctccctgaccagttgaaagacacaacttttgctcaggttcttaaagacgacaccacaacaaaaaggtggcttgcgcagctggtgaagaatctccaggaagggcaagtgaccgacccacggggaatcccactgcctccacagtag

SEQ ID NO: 202669 - DNA, 996 bp, Artificial Sequence
  Description of Artificial Sequence: Synthetic coding sequence
atgcacagcctggccaccgccgcccccgtgcccaccaccctggcccaggtggaccgggaaaagatctaccagtggatcaatgaacttagcagcccagagacaagagagaacgccctgctggaactgtcaaagaaacgcgagagtgtccccgatctggcgcctatgctgtggcactcttttgggaccattgctgcccttcttcaggagattgtgaatatttacccatccatcaatcctcccacactaaccgcccatcagagtaatcgggtatgtaacgcgctcgcactgctccagtgtgtagctagccacccagagacgcgcagcgcctttctggctgcccacattccactctttctttacccttttttacacaccgtaagtaaaacccggccctttgagtatcttagattgacatctctcggtgtcatcgtagagactgggttccaccatgtgggacaagccgatctcgaactgcctactagctctgacctacccgcatcagccagccagagtgctggaattacgggcgcactggtgaagaccgatgagcaggaggtgattaattttctccttactactgagattatcccactgtgcttgcgaattatggaaagcggttcagaactgtctaagaccgtagcaactttcattctacaaaagatcctgctggatgataccggacttgcatacatctgccagacatacgaaaggtttagccacgttgctatgatccttggcaagatggtccttcaactaagcaaagaacccagcgccagactgctgaagcatgttgtccgatgctacctgcgcctgtcggacaaccctagagctcgggaggccttgagacagtgtctccctgaccaactgaaagataccacattcgcccaggtcctgaaagacgatactactactaaacgttggctagctcagttagtgaaaaacctccaagaaggccaggtgactgaccctcgggggattccactccccccacagtag

SEQ ID NO: 202670 - DNA, 900 bp, Artificial Sequence
  Description of Artificial Sequence: Synthetic coding sequence
atgcacagcctggccaccgccgcccccgtgcccaccaccctggcccaggtggaccgcgagaagatttaccagtggataaacgaacttagctctcccgagaccagagagaatgctctgctggaactgtccaaaaaaagagaatctgtccctgacctagcgcctatgctgtggcatagcttcggtacaatcgccgcactcctgcaagagatcgttaatatctacccctccataaatccacccaccctcaccgcgcaccaaagcaacagggtctgcaatgccctggcattactgcagtgcgttgccagtcatcccgaaactcgatcagccttcttggctgctcatatccccttattcctctacccctttctgcacacagttagtaagaccagaccctttgaatacctgcgcttgacttctctgggcgtgattggcgccttggtcaagaccgacgaacaggaagtgattaatttcctgttgacaacggaaattataccactttgtttgcggattatggagagcggctccgagctgtctaagaccgtcgcgactttcatcttacagaaaattttgctggacgacaccggcctcgcttacatttgccaaacctatgaacgttttagccatgttgccatgattctgggaaaaatggtgctgcagctgagtaaggaaccatccgcacgtttgctgaaacatgtcgtgagatgttatctgcggctgagtgacaacccccgggctagagaagcgctgaggcagtgtttgcctgatcaactgaaggatacaacctttgcacaggttctaaaggacgatacaacgaccaagcgttggctggcacaattggtcaaaaacttgcaggaaggacaggtgacggaccccaggggcattcctctcccgcctcaatag

SEQ ID NO: 202671 - DNA, 777 bp, Artificial Sequence
  Description of Artificial Sequence: Synthetic coding sequence
atgcacagcctggccaccgccgcccccgtgcccaccaccctggcccaggtcgaccgggagaaaatctaccagtggataaacgaactaagttccccagagacacgcgagaatgccttactagaactctccaaaaagcgcgaaagcgtgcctgacctggcccccatgctgtggcactctttcggcaccattgccgccctgctccaagagatcgtcaatatatatccttcaattaacccgccaacactgactgcccatcaatctaacagagtctgtaacgctctcgccttattgcagtgcgtcgcgtcacatccagagaccaggtctgcttttctggcggcacacatccccctgttcctctacccttttctgcacaccgtctccaaaacacgccctttcgagtatctacggctgacatcactgggcgtcattggtgccctggtgaaaactgatgaacaagaggtcattaattttctgctgacaacagaaattattccgctgtgcctaaggataatggaatcgggttcagaacttagcaaaaccgttgcaacctttattctgcaaaagattctcctcgacgacaccggtctggcttatatatgtcagacatacgaacgatttagccacgtagctatgatcctgggcaaaatggtgctgcagctgtcaaaggaaccttccgctaggctccttaaacatgtggtgcggtgctacctgcggctgtcagacaacccaagattttctgacctgaccttctgctggagcagttttcagcggaaatag

SEQ ID NO: 202672 - DNA, 990 bp, Artificial Sequence
  Description of Artificial Sequence: Synthetic coding sequence
atggccgccctgggcggcgacggcctgcggctgctgagcgtgagccgtccagagcgtccccccgagtcagccgcccttgggggccttggaccaggcctgtgctgttgggtgagcgtgttttcatgcctctctctggcatgtagctatgtgggctcattgtacgtctggaagtccgaactccctagagatcaccccgctgtgatcaagagacgctttacctccgtcctggtggtctcttccctcagcccgctctgtgtcctgctgtggcgggagctcacagggattcaacctgggacctcattactgaccctgatgggctttcgactcgagggaatcttccctgcggctctgctgccactgctactgactatgatactgttcctgggtccccttatgcagctgagcatggactgcccttgcgaccttgccgacggactaaaggtggtgctggcgccacgaagttgggcccggtgcttaaccgatatgagatggttgcgtaaccaggtgatagcaccgcttacagaggagttggtatttcgagcctgtatgctccccatgttggctccctgcatgggactcgggcccgccgtgttcacatgtcctctattttttggcgtggcgcactttcaccatatcatagagcaattacggtttcggcaatcttcagtaggtaatatcttcctgagtgcagcctttcaattttcttatactgctgtgttcggcgcctataccgcctttctctttattcgaaccggacatttgatcggaccagtgctttgccacagtttctgcaattatatgggatttcccgcagtctgcgctgcattggaacacccccagagaagaccactgttggctgggtacgctttaggcgtgggtctgtttttgctactgttgcaaccactgacagatcccaagctgtacggaagcctgccattatgcgtcctactcgagagggcgggtgattcagaggctccattatgttcatag

SEQ ID NO: 202673 - DNA, 927 bp, Artificial Sequence
  Description of Artificial Sequence: Synthetic coding sequence
atggccgccctgggcggcgacggcctgcggctgctgagcgtgagccggcccgagcgaccgcccgagtcagccgcactggggggattaggcccgggcctatgttgctgggtgagcgtcttttcctgtctgtccctggcatgtagttacgttgggtccctttacgtttggaaaagtgagctcccacgggaccaccctgccgttatcaagcggcggttcacaagcgtccttgtggtatctagcctctcaccgctgtgtgtgttactctggagagagctgacgggaattcagccgggtacaagcctcctcacccttatgggtttccgcctggaaggcattttcccagcagctctgctgcctctactgctcacgatgattttgttcctgggccctctcatgcagctgagtatggattgcccgtgcgacctagccgacggactgaaggtggtgctggctcctagatcatgggcaaggtgccttacagacatgaggtggcttcgcaatcaggtgatcgctccactgacagaggaattggtattccgggcctgtatgcttcccatgctggctccttgcatgggactgggccctgcagtctttacatgtcccttgttcttcggcgttgcgcatttccatcacataatcgagcagttgcgtttccggcagagcagcgtcggtaatattttcctcagtgccgggcacctgatcggccctgttctttgtcacagtttctgtaactacatgggcttcccagctgtgtgtgccgctcttgagcatccccagcgccggcctctccttgctggctatgctctcggggtcggactgtttttgctactgcttcagcctctcacagacccaaagctctatggatctctcccgctgtgcgtcctgctcgaacgggctggcgattccgaagcaccgctgtgtagttag

SEQ ID NO: 202674 - DNA, 1164 bp, Artificial Sequence
  Description of Artificial Sequence: Synthetic coding sequence
atggtgcccaagggcgccaccatgctggtgatcccccccggcctgtctgaagaagaggaagcactgcagaagaagttcaataagctgaagaaaaaaaaaaaggccctgctcgcgctgaagaagcagtcttccagttctactacttcccaagggggagtgaaacgatctctgagcgaacagcctgttatggacactgccaccgcaaccgagcaggctaagcagctcgtaaaaagcggggccatatctgcaattaaggccgagactaagaattccggcttcaaacggagcagaacgttagaggggaagctaaaagaccccgaaaagggcccagtgccgaccttccaacctttccagcgatctataagtgcggacgacgaccttcaggaaagctcccgacgtccacagagaaaatctttgtacgagagtttcgtatccagtagtgatcgcctgagagagcttggtcccgatggtgaagaagctgaaggtcctggcgctggggacggaccgcccaggagtttcgactggggatacgaagagcggtcaggggcccatagcagtgctagccccccacgttcgaggtctcgtgatagatcccatgaacgcaatcgagacagagatcgcgaccgcgagagagaccgggatcgggatcgagatcgcgacagagaaagggaccgcgacagagatcgcgatcgcgatagggacagagaaagggaccgcgatcgggagagagatcgcgatcgcgacagggagggtcctttccggagaagtgactctttcccagagcgcagggctccgcgcaagggtaataccctttatgtctacggggaagatatgacgcccactctgcttcggggcgccttctcccccttcggcaatattatagatttaagtatggaccctccgcgcaactgtgccttcgttacttatgagaagatggaatcggcggatcaggccgtggctgagttgaacgggacccaggtcgagagcgtgcaactgaaggttaatatcgccagaaagcagccaatgctcgacgccgccacaggaaaaagcgtgtgggggtcactggccgtacaaaattcgccaaaagggtgtcatcgggataagaggacccagatcgtctactcagatgacgtctacaaggaaaacctggtcgatggattttag

SEQ ID NO: 202675 - DNA, 1143 bp, Artificial Sequence
  Description of Artificial Sequence: Synthetic coding sequence
atgctggtgatcccccccggcctgagcgaggaggaggaggccctgcagaaaaaattcaacaagcttaaaaagaagaagaaggcactgctggctctcaagaaacaaagtagttcgtctactacctcacagggaggcgtgaagcgatctctgagcgagcaacccgtgatggatacagctacggccacagaacaggctaagcagctagtgaagtccggagcaataagtgccatcaaagctgagactaaaaattctggattcaagagaagtagaacgctggaaggaaaacttaaggaccccgaaaaggggccggtgccaacattccagcctttccaaaggtccatctctgcagacgacgacctacaggagtcttcaaggcggccacaaaggaagtcgctttacgagagcttcgtctcctcatccgataggcttcgggaactgggacccgatggcgaagaggctgagggcccaggcgccggggacggaccccccagaagttttgattggggttacgaagagcggtctggcgcccactcctctgcatcccccccacgatcaaggtcccgggacaggtcccatgaaagaaacagagaccgggatagagacagggagagggaccgagatcgggaccgggacagagatcgcgaaagagatcgggatcgcgaccgggatcgtgaccgcgaccgtgagcgggatcgcgacagggagcgcgaccgtgaccgggatcgcgagggacccttccgccgctccgactctttccccgagaggagagcccctagaaaaggaaataccctttacgtgtacggcgaggacatgacacccacgcttctgcggggggcgttcagtccgtttggaaacatcatcgatttatctatggaccctcctagaaactgtgcctttgttacttacgaaaagatggagtccgcggaccaagccgtggctgagttgaatgggactcaggttgagagtgtacagcttaaggtgaacattgctcgcaaacagcccatgctagatgcggccaccggaaagagtgtgtggggctcccttgcggtgcaaaacagccccaagggctgccatcgagacaaacgcacccagatagtgtattccgatgacgtgtataaggagaacctggttgatggcttctag

SEQ ID NO: 202676 - DNA, 1143 bp, Artificial Sequence
  Description of Artificial Sequence: Synthetic coding sequence
atgctggtgatcccccccggcctgagcgaggaggaggaggccctgcagaaaaaatttaacaaactgaagaagaagaagaaggccctgctcgctcttaaaaagcaaagctctagcagcacaaccagccaaggcggtgtgaagcgatccctttcagaacagcccgtcatggacaccgcaaccgcaactgagcaagccaagcagcttgtcaaatccggcgcaatttccgccatcaaagccgaaactaagaacagcggtttcaagagatcccgtaccctggaaggcaagctcaaggaccctgaaaagggccccgttcccacttttcagccctttcagcgcagcatatctgccgacgatgatcttcaggaatcatcacgaaggcctcagcggaaaagtctttatgagagttttgtgtcatcttccgatcggctaagagagctgggtcctgacggggaagaggccgaagggccaggtgcaggtgacggccctccacgaagtttcgactggggctatgaagagcgctccggagctcactcttccgcatccccgcctcggtcacgatcgcgcgatcggtctcacgaaaggaaccgggatcgcgatcgggatcgcgagagggaccgagacagagatcgggatcgagatcgagagcgcgacagagatcgagatcgagacagggaccgcgaccgcgagcgggaccgcgatcgtgagagggaccgtgaccgggaccgggagggcccctttcgccgcagcgactctttccccgaaagacgggcaccacggaagggtaacactttgtacgtgtacggcgaagacatgactcctaccctcttgaggggagccttctcccccttcgggaatataattgatctgtcaatggaccctccccgcaactgcgcattcgtgacctatgagaagatggaatccgctgatcaggcggtagccgagctgaacggaacccaagtggagagcgttcagttaaaggtgaatattgccaggaagcagccaatgctcgacgcagccacaggtaagtcagtgtggggctccctggctgtgcagaactcgccgaaaggatgccatcgggacaagaggacgcagatcgtttactccgacgacgtatacaaggaaaacctggtcgatggtttctag

SEQ ID NO: 202677 - DNA, 1143 bp, Artificial Sequence
  Description of Artificial Sequence: Synthetic coding sequence
atgctggtgatcccccccggcctgagcgaggaggaggaggccctgcagaagaaattcaacaagctaaagaagaagaaaaaggcactgcttgcccttaagaagcagagtagttcctcaaccacctcgcagggaggggtcaagcgatcactgtccgaacaacccgtgatggataccgccactgcgaccgaacaggccaagcagctggtcaagagcggagccatctccgccatcaaggccgagaccaagaacagcggcttcaagcggtcccggaccctggagggtaaactcaaggatccagaaaagggccccgtgccaaccttccagcctttccagagatcaatctcagctgatgacgacctgcaggaatcttcccggcgcccacagcggaagtcgttatacgagagctttgtgagttcatctgatagactgagagagttggggcctgacggagaggaggctgagggacctggcgccggagacggtcctcctcggtcctttgattggggatacgaggagaggtccggagcccacagcagcgcctcgcctccacggtcacgcagtcgcgaccgctcccatgaacggaacagggatcgggatagagaccgggagcgcgaccgagaccgggatagagacagggacagagagcgcgaccgcgaccgcgatcgcgatcgagatcgtgaccgcgagcgcgatagagaccgggaaagggaccgagatcgcgacagggagggtccatttaggaggagtgattccttccctgagaggcgagcccctcggaaaggcaacactctctacgtgtatggtgaggacatgacacccaccttgctgagaggtgcttttagcccttttggcaatatcatcgatctgtccatggacccccctcgcaactgcgcgtttgtgacgtacgagaaaatggagtctgccgaccaggctgtcgccgagttgaacgggacgcaggttgagtctgtgcagctgaaagtcaacatcgcacgcaaacagcctatgcttgacgctgctaccgggaagagcgtgtggggcagccttgccgtccaaaatagtcccaaggggtgtcacagggacaaacgtacccagatcgtgtactccgacgatgtatacaaggagaacctcgttgatggcttttag

SEQ ID NO: 202678 - DNA, 885 bp, Artificial Sequence
  Description of Artificial Sequence: Synthetic coding sequence
atgctggtgatcccccccggcctgagcgaggaggaggaggccctgcaaaagaagtttaataaactcaagaagaagaagaaagcattgctggctctgaaaaagcaaagttcctcatcaactacatcccaggggggggttaagaggagcttgagcgaacagcccgtgatggacactgctaccgccaccgagcaggctaagcagctggtcaagagtggcgcaatttcagctatcaaggcagagacaaagaatagtggcttcaaacggtctcggacactcgaaggaaagctcaaagaccctgagaagggccccgtccccacttttcaaccctttcaacggagcataagcgcggatgacgatttgcaagagtcatcacggcgcccgcagcgcaagtctctctacgagagcttcgtctctagcagcgatcgcttacgcgagctagggcctgacggagaagaggctgagggtccaggcgctggcgacgggccaccccgaagcttcgattggggatatgaggagcgaagcggggctcattccagcgcatcgccccctcgaagtcggagtcgggaccggtcccatgaaagaaaccgggatcgtgaccgagaccgcgaacgcgacagagatagggacagggaccgggatcgcgagcgggaccgggatcgggatcgcgatcgggaccgcgaccgggagagagatcgggatagggaacgggacagggacagggatcgcgagggcccttttaggaggtccgattccttccccgagagacgcgcccctaggaaggggaacaccttgtatgtgtacggcgaagacatgactcctactcttctaagaggggcattcagccctttcggtaatattatcgatctgtcaatggacccaccttag

SEQ ID NO: 202679 - DNA, 480 bp, Artificial Sequence
  Description of Artificial Sequence: Synthetic coding sequence
atgctggtgatcccccccggcctgagcgaggaggaggaggccctgcagaaaaagtttaataagctcaagaaaaaaaagaaagcactcctggccctgaaaaagcagtcaagctcctctactacttcccaggggggggtgaagcggtccctctctgagcagccagtgatggacacagctactgccaccgaacaggcaaaacagctggtcaaatcaggtgccattagcgccattaaagccgagaccaaaaattccggttttaagcggagccgcactctggagggaaaacttaaagatccggagaagggcccagttcccacattccagcctttccagaggagtatttcagcggatgatgatctgcaagagtcctcacggaggcctcagcgaaagagcctgtacgaatctttcgtgagttcaagcgacaggttgcgggagcttggacccgatggcgaggaagcggaagggcccggggctgggtag

SEQ ID NO: 202680 - DNA, 723 bp, Artificial Sequence
  Description of Artificial Sequence: Synthetic coding sequence
atgctggtgatcccccccggcctgagcgaggaggaggaggccctgcagaagaaattcaataaactgaagaaaaagaaaaaggctctgttggctttgaaaaaacagagctcatcctcaactacttcgcagggaggtgtgaagcggagcctctctgagcagcccgtaatggatacagctacggccaccgagcaggccaagcagctagtgaaatctggagccatctccgcgataaaagccgagacaaagaacagcggatttaagcgatccaggactctcgagggcaagctgaaagatcctgagaagggaccagtccctacttttcaacccttccagcgtagtatatcagcagatgatgacctgcaggaatcttcacgaagacctcagagaaagtccctgtacgaaagcgaccgactccgggagctgggacccgacggcgaggaagcagagggtcctggtgctggggatggacctccaaggtcattcgactggggatacgaagagagaagcggtgcccattccagcgcctctccacctcgcagtcggtcgcgggaccggtcacatgagagaaaccgagaccgcgatagggaccgagaacgggaccgggatagggatcgggatagagaccgggagcgcgatcgcgatcgcgaccgcgaccgggaccgagacagagaaagagacagagaccgagaacgggacagggatagggaccgcgaaggtccttag

SEQ ID NO: 202681 - DNA, 480 bp, Artificial Sequence
  Description of Artificial Sequence: Synthetic coding sequence
atgctggtgatcccccccggcctgagcgaggaggaggaggccctgcagaaaaagttcaataagttgaagaagaagaaaaaagcccttctggctttgaaaaaacagagtagttcttctacaacatcccaaggaggggtcaagcgctccctgtcagagcagccagtcatggacaccgccacagccacagagcaggctaagcaactcgtgaagagtggggccatatctgccataaaggccgaaacgaaaaactcggggtttaagcgctcccgcaccttagaaggaaaactgaaagaccctgagaaagggccggtccccacatttcagccattccagaggagcattagtgcggacgacgacttacaggagtctagccgccgcccccagaggaagtctctttacgagtcttttgtcagcagtagtgaccggctgagggagcttgggccagacggggaggaggccgagggccccggcgctggatag

SEQ ID NO: 202682 - DNA, 480 bp, Artificial Sequence
  Description of Artificial Sequence: Synthetic coding sequence
atgctggtgatcccccccggcctgagcgaggaggaggaggccctgcaaaagaagttcaacaagctcaagaagaagaagaaagcgcttcttgcccttaagaaacagagctcttcaagcacaacatcacagggcggcgtaaagcggtccctctcagagcagccagtgatggacacagcgaccgcaactgaacaggcgaagcagctcgtgaagtctggcgcaatttccgccattaaggccgagacaaaaaattccggcttcaagcgttcacggaccctagagggaaaactcaaagatccagaaaagggcccagtccctacttttcaacctttccagcgctctattagcgccgacgacgatctgcaggagtccagccgtcgcccccaaagaaaaagtctctatgagtcttttgtgtctagctcggaccgcctgagggaactcgggcccgatggcgaagaggcggaggggcccggcgccggctag

SEQ ID NO: 202683 - DNA, 1005 bp, Artificial Sequence
  Description of Artificial Sequence: Synthetic coding sequence
atgctggtgatcccccccggcctgagcgaggaggaggaggccctgcagaagaaattcaataagctcaagaaaaagaagaaggctctgctagcgttgaagaaacagtcctcctcaagcacaacatctcaggggggggtgaagcggagtttgagtgaacagcccgttatggacaccgccacggcaacggaacaggccaaacagttggtgaagagcggggcgatttccgccatcaaggccgagactaagaacagtggattcaagagatcacggaccttagaaggcaagctcaaggaccccgagaaagggcctgtgccgacctttcaaccctttcagagatcaatttctgccgacgatgaccttcaggagtcaagcagaaggccccagcgcaagagtctgtatgagagtgacaggctgagagagttggggcccgacggcgaggaagccgaggggcctggagccggcgacgggccaccaaggtccttcgactggggatatgaggaaaggtcgggagcccattctagtgcaagcccacccagatcccgctcacgcgacaggtctcatgaacggaatagagacagagatcgtgacagagaacgcgaccgggaccgcgatcgcgatagggatagggagcgggacagagaccgggaccgggaccgcgatagggacagggaacgggatcgggatagggaaagggaccgtgaccgggacagagaaggaccttttcgtcgcagtgactcatttccagagcgtcgggcacccagaaagggtaacactttatatgtttacggagaggatatgactccaaccttgctacgcggggcatttagcccattcggaaatattatcgatctttctatggaccccccccgcaactgcgccttcgtcacctacgaaaaaatggaaagcgctgaccaggccgtggctgaactgaatggcacacaggtggaatccgtacagctgaaggtcaacattgcccgcaagcaacctatgctggatgcagcatag

SEQ ID NO: 202684 - DNA, 723 bp, Artificial Sequence
  Description of Artificial Sequence: Synthetic coding sequence
atgctggtgatcccccccggcctgagcgaggaggaggaggccctgcagaaaaagtttaataaactgaaaaaaaagaagaaggccctccttgccttgaaaaagcagagctcctcttccaccacctcccaaggcggagtgaagcggtctctcagcgagcagccagtgatggatacggccacagctactgagcaggctaaacaactggtgaaatccggagctatcagtgcgataaaagccgagacaaagaactctgggttcaaacgcagccgcacccttgagggaaagctgaaggaccctgaaaagggccctgtccccacttttcaaccattccagaggagcatttccgccgacgatgacttacaggagtccagccgaagaccccaaagaaagagcctctatgaatcagacagactacgcgagctagggcctgacggcgaggaagccgagggtcccggggccggggacgggcctcctcgctcttttgactgggggtatgaagagcggagcggcgcacactcctctgctagtccaccccgctcacggtccagggatcgcagccacgaacgaaatcgggatagagatcgtgaccgtgagcgggaccgcgatcgggatagggatcgggatcgtgaacgggatagagaccgcgaccgggaccgcgacagggaccgggagcgggacagggaccgagagagagatagggacagggacagagagggaccatag

SEQ ID NO: 202685 - DNA, 480 bp, Artificial Sequence
  Description of Artificial Sequence: Synthetic coding sequence
atgctggtgatcccccccggcctgagcgaggaggaggaggccctgcagaagaaatttaataaattaaagaaaaagaagaaggcgttgttagcattaaagaagcagtcatcatccagcaccactagccaaggaggcgtgaaaagatccctgtctgagcagccggtgatggacactgcaacagctacggagcaggccaagcagctggtgaaaagtggggcgataagcgcgattaaggccgagaccaagaactccggattcaagcgctcccgcaccctcgagggcaagcttaaggacccagagaaagggccagtgcctacctttcagccatttcaacgttctatctctgcggacgatgatttgcaggaatcttcccgccgcccacagcgcaaatccctgtacgagagcttcgtcagcagctcagaccgactgcgggaacttgggccagatggtgaagaggctgaagggcccggcgccggctag

SEQ ID NO: 202686 - DNA, 1005 bp, Artificial Sequence
  Description of Artificial Sequence: Synthetic coding sequence
atgctggtgatcccccccggcctgagcgaggaggaggaggccctgcagaagaagtttaacaagctgaaaaagaaaaagaaagccctgctggctctcaaaaagcaatcttcaagttctacaaccagtcaggggggtgtgaagcgctctctatcagaacaaccagttatggacaccgctacagcaacagagcaagcaaaacaactggtcaagagtggcgcaatctccgccatcaaagctgaaacgaagaactcgggcttcaagcggtcccgcacactcgaaggcaagttgaaggaccccgagaaaggacccgtcccaacctttcagccatttcagaggagcatctcagccgacgacgatcttcaggagtcttccaggaggcctcagcgtaaatcgctttatgaatcagatcggctgagagaattgggccctgacggagaagaagcagaaggtccgggagccggcgacggccccccccgctcttttgactggggatacgaagagcggagtggtgcacattcctccgcctcaccccctagatcacgtagtagagaccgctctcacgagagaaatcgggacagagatagagaccgggaacgtgatcgagaccgagacagggatagagatagagaaagggacagagaccgagaccgtgatagagaccgcgatcgggagcgcgaccgagatagagaaagagatagagatagagatagggaagggccgttccgtcgcagtgatagcttcccagaaaggagggcgccacggaaaggcaatactctctacgtgtacggcgaggacatgaccccaactctgctgaggggagctttttctccattcgggaacattattgatctttccatggatcctcccagaaattgcgctttcgtcacctacgagaagatggagtctgccgatcaggctgtcgccgaattgaatggtactcaggtcgagtctgtgcaactaaaagtcaacattgccagaaaacagccgatgctggatgcagcctag

SEQ ID NO: 202687 - DNA, 480 bp, Artificial Sequence
  Description of Artificial Sequence: Synthetic coding sequence
atgctggtgatcccccccggcctgagcgaggaggaggaggccctgcaaaagaaatttaacaagttaaagaagaaaaaaaaagcactgcttgccctgaaaaagcagagctcgtccagcacgacctcacaaggaggcgtgaagcgcagcctctcagaacaaccagtgatggacacagctaccgcaactgaacaagctaaacagctggtgaaaagcggggctatcagcgccatcaaagcagaaacaaaaaatagtggattcaagcggtctcggactttagaaggcaaactgaaagatccagagaagggcccagtccccacttttcagcctttccaacggtctatttccgccgacgacgacctgcaggagagctctagaagaccccaacgtaagagcttgtatgaaagcttcgtctcatcctctgatcgtctcagggaactcggaccagacggagaagaggccgagggccctggggccggttag

SEQ ID NO: 202688 - DNA, 1143 bp, Artificial Sequence
  Description of Artificial Sequence: Synthetic coding sequence
atgctggtgatcccccccggcctgagcgaggaggaggaggccctgcaaaagaagttcaataagctgaagaaaaagaagaaagctctccttgccctgaaaaagcagtcttcatcctcaacaacctcgcaagggggtgtgaagcgcagcctgagtgagcagccggtcatggacacagcgaccgccaccgagcaggccaaacagttggtaaaaagcggcgccattagcgcaatcaaggccgagacaaagaactctggattcaagaggtccagaacactcgagggcaaacttaaggatccagagaaaggaccagtgccaacattccagcccttccagcggtctatcagcgctgatgatgacctgcaagagtctagccggaggccacagcgcaagtcgctgtacgagtcttttgtatccagttcggatcgccttagggagctcggccctgacggagaggaggccgaagggccaggcgccggggatggcccacctcgatcatttgactggggctacgaggagcgctccggagctcattcaagcgcctcgccaccccgtagccgttctcgagataggagccatgagaggaaccgtgatcgggatcgcgaccgcgagcgggatagggatcgggacagggatcgcgacagagagagagacagagatcgagatcgggatcgtgacagagaccgggagcgcgatcgggatagagaacgggatcgggaccgggaccgcgaaggtccgttccgcaggagtgattcttttcctgagcggcgcgcgcccaggaagggaaataccctctatgtgtatggcgaagatatgacacccaccctcctgagaggagccttttcccccttcgggaatataattgatctgtcgatggaccctccccgtaattgcgcatttgtgacatacgagaaaatggagtctgccgaccaagctgtcgcggaattgaatggcacccaagtggagtctgtccagctcaaggtgaatatcgccagaaaacagcctatgttggacgcggcaacaggcaaaagtgtttgggggtcacttgccgttcagaacagtcctaaaggctgccaccgggacaagcggactcagatcgtctacagcgacgacgtgtacaaagaaaaccttgtggatggtttttag

SEQ ID NO: 202689 - DNA, 885 bp, Artificial Sequence
  Description of Artificial Sequence: Synthetic coding sequence
atgctggtgatcccccccggcctgagcgaggaggaggaggccctgcagaagaagttcaataagcttaagaagaagaaaaaagcgctgctggcactgaaaaaacagtccagtagcagtaccacctcccagggaggcgtgaaacgcagcctgtctgagcagccagtcatggacaccgcgacagcaaccgagcaggccaagcagttagtgaagtcaggcgccatcagcgctattaaagccgagactaaaaattccggcttcaagcggtcccgtacgttggagggcaagttaaaagatccagaaaaaggccctgtccccacgtttcagcccttccagcggagtatcagtgccgatgacgacttacaggagagctccagaagaccacagcggaagtccctctatgagtcgttcgtctcttcctccgaccgtctgcgtgagctgggcccagacggagaagaggcagagggtccgggtgctggagacggaccgccccgctctttcgattgggggtacgaagaaagatcgggagctcattcgtccgcctccccgccccggtccagatctagggacaggtcccatgaaagaaatagagatcgggatagggacagagaacgagaccgcgaccgagacagggatcgggacagggaaagggaccgcgaccgggatagggaccgcgatcgagacagggagagggatagggatagagagagggatagggacagagaccgggaaggccccttcaggcgtagcgattcatttccggaacggcgtgccccccgtaaggggaacaccctgtacgtgtacggtgaggatatgactccaacgttacttcgtggcgcctttagtccttttggcaacatcatcgacctgagtatggatccgccctag

SEQ ID NO: 202690 - DNA, 723 bp, Artificial Sequence
  Description of Artificial Sequence: Synthetic coding sequence
atgctggtgatcccccccggcctgagcgaggaggaggaggccctgcaaaagaaattcaacaaactcaagaagaaaaaaaaagccctgttagcactgaagaaacaatcaagttcctccactacatcgcaaggaggcgttaagcgctcactgagcgagcagcccgtcatggacactgcgaccgctaccgaacaggctaagcagctggttaaaagcggggcaatcagcgctatcaaggctgagactaaaaacagcggattcaaacgttcacgcaccttagaaggaaagctgaaggaccccgagaaaggacccgtaccaacgtttcagcctttccagcgatcgatcagtgccgatgacgacctacaagaatcgagccgtcggccacagcgaaaatcattatacgagagcgacaggcttcgcgagctgggacccgatggcgaggaagccgaaggacctggggccggcgacggaccccctcgttctttcgactgggggtatgaggagcggtcaggagcccactcctctgcaagcccaccccggagtcggagccgtgaccgcagccatgagaggaatcgagatcgtgatagggatagggaacgtgatcgagatcgcgatcgcgatagggaccgcgagcgggatagagatagggatcgcgatcgggatcgcgacagagaaagagacagggaccgagaaagagaccgcgatagggacagagagggcccttag

SEQ ID NO: 202691 - DNA, 885 bp, Artificial Sequence
  Description of Artificial Sequence: Synthetic coding sequence
atgctggtgatcccccccggcctgagcgaggaggaggaggccctgcagaaaaagttcaataagttgaagaagaagaagaaagcactgctcgcactgaaaaagcagagtagctctagcaccacatcccaagggggcgtaaaaagaagcctgtcggagcagccagtgatggacacggcaacagcgacagaacaagctaagcaacttgtcaaatccggagcgattagcgccatcaaagccgaaaccaagaattcaggattcaaaaggtccaggacactggaaggcaagttaaaggaccccgaaaagggccccgttcccactttccagccctttcagagatctatctcggcagatgatgacctgcaggagagctctcggaggccccagagaaagtcactgtatgagtctttcgtttccagcagtgaccgtctccgcgagttaggccctgatggcgaagaggccgagggccctggggccggagacgggcctcctagaagttttgactggggctacgaagaacgatcaggtgcacacagcagcgcttcccccccccgatcccggagtcgtgatcgaagtcatgagcggaatcgcgatcgcgatagagacagagagcgtgacagggatagagatagggaccgcgaccgggaacgtgaccgagacagggacagggacagagaccgcgacagagaaagagaccgggatagagaaagggatagagatcgagatcgagaagggccatttagaagaagtgactccttcccagaacggagagcgcctaggaaaggcaacaccctttacgtctatggagaagatatgacccccacccttctccgtggcgctttttcacccttcggtaatatcatagacctgagcatggatcctccctag

SEQ ID NO: 202692 - DNA, 1005 bp, Artificial Sequence
  Description of Artificial Sequence: Synthetic coding sequence
atgctggtgatcccccccggcctgagcgaggaggaggaggccctgcagaagaagtttaataagctcaaaaagaagaaaaaagccttgctggccctgaaaaaacaaagcagttccagcactacttctcagggtggggttaaacgctcattgtccgagcagcccgtcatggacacagcaacggcaactgagcaggcaaaacagctggtgaagtccggggctataagcgctattaaagctgagacaaaaaactcaggcttcaaacggtcccgtactctggaaggaaaactgaaagatccggagaagggaccagtgccgacatttcaacccttccagagatcaatctctgccgacgacgacctacaggagagctcaaggagacctcaacggaaatctctgtatgagagcgaccgactgagggagctgggcccagatggagaagaggcagaaggacccggggccggggatggacccccaaggagcttcgattgggggtatgaggagcggtccggggcacattccagcgctagccctcctaggtcccgctccagagaccgatcccacgagcgtaatcgagaccgggacagggacagggaaagggatcgcgaccgcgaccgtgaccgggatcgggagcgtgatagggacagggatagggaccgggatcgcgacagggaacgcgatagagatcgcgaaagagatagggatagggaccgcgaaggacccttccgccgctccgacagttttccagaacggagagccccacggaagggaaatacgctctacgtgtacggcgaagacatgacaccaacgctgctgcggggcgcctttagcccattcggcaacattatcgatttatccatggatccaccacgaaattgcgcatttgtaacatacgaaaagatggaatccgcagatcaggccgtagcagaactcaacgggacccaagttgaatcagttcagctgaaagtgaacatcgctcggaaacaaccaatgctggatgccgcatag

SEQ ID NO: 202693 - DNA, 1005 bp, Artificial Sequence
  Description of Artificial Sequence: Synthetic coding sequence
atgctggtgatcccccccggcctgagcgaggaggaggaggccctgcagaaaaaattcaacaagctgaagaagaagaaaaaggccctcctagccctgaaaaagcagtcgtcaagtagcacaacgtcacaggggggggttaaacgtagcctttcagagcagcctgtgatggacaccgctactgccacagaacaagcgaagcagctggtcaagtcaggcgcaatctctgctatcaaagccgaaactaagaattccgggtttaagagatccaggacgttagaggggaagttgaaagacccagaaaaaggccccgtgcctacattccagcccttccaaaggagcatttcagccgatgacgacctgcaggaatcatcccggaggccccagcggaagtctctttacgagtctgaccgacttagagaacttggacctgatggcgaggaagccgagggcccaggggctggtgacggacctcctcgctctttcgattgggggtatgaggagaggagcggagcacatagctctgcctccccacctaggtccaggagcagggataggtctcatgagaggaatcgggaccgcgacagagaccgtgagagagatagagacagggatagggaccgcgaccgcgaacgcgaccgagaccgtgaccgcgaccgggatcgggaccgtgaacgggacagagacagggagagggatcgcgaccgggatcgtgaagggccgttcaggagaagcgactctttcccagagaggcgcgccccgcggaaggggaatacactatatgtctatggcgaggacatgacccctaccttactcaggggcgcattctctcctttcggaaatatcatagacttaagcatggacccccccagaaactgtgccttcgtgacctacgaaaaaatggaatcagcagatcaggctgtagccgaactgaacggaacccaagttgagtccgtgcagcttaaggtaaacattgcgaggaagcaacccatgcttgacgccgcctag

SEQ ID NO: 202694 - DNA, 1005 bp, Artificial Sequence
  Description of Artificial Sequence: Synthetic coding sequence
atgctggtgatcccccccggcctgagcgaggaggaggaggccctgcagaaaaaatttaacaaactgaagaagaaaaagaaggcccttctggcccttaaaaagcaatcatcatccagtactacctcccaaggcggtgtaaagcgaagtctgagcgagcaacccgtgatggacactgcaactgcaactgagcaggcgaagcagctggtgaaatctggggctatctctgctatcaaggcggagactaagaacagcgggtttaagaggagtcggactcttgagggcaaactcaaagatccggaaaaaggcccggtgcctacctttcagccctttcaaagatctatctcagcagacgacgatctgcaggaaagcagcagaaggccacagagaaagtctttatatgaatccgatcgcttaagggagctgggtcccgatggagaagaagccgagggtcctggagctggggatggcccacctcgatcattcgattggggatatgaggaacgctctggggcgcactctagcgctagccccccccggtccagatcacgagatcgctcccatgaaaggaacagagaccgagacagagaccgtgagcgggacagggatcgggatcgagaccgcgatagggagagggacagggacagagacagagatagagatagagaccgcgaacgggatcgggacagggagcgggatagggatcgagatcgggaagggccttttcgccggtcagacagcttccccgaacgccgggccccaagaaaaggaaataccctgtacgtatacggtgaggacatgacacctacactgttgcgcggggcgttcagcccatttggcaatattattgacctgagtatggacccgccaagaaattgtgctttcgttacctatgaaaaaatggagagcgccgaccaggctgtcgcagagctgaacggaacccaggttgagtcagtccagttgaaggtgaacatcgcccgaaaacaacctatgctagacgctgcatag

SEQ ID NO: 202695 - DNA, 1053 bp, Artificial Sequence
  Description of Artificial Sequence: Synthetic coding sequence
atgctggtgatcccccccggcctgagcgaggaggaggaggccctgcagaaaaagttcaataaactgaaaaaaaagaagaaagccctactagctttgaagaagcaaagctcttcttccaccacgagtcaggggggagttaaacgctccctatcggagcagccagttatggacacagctaccgcaacagagcaggccaaacaactggttaagtcgggagccatttcagccatcaaagctgagacaaagaattctgggttcaaaaggtctaggacccttgagggaaagttaaaagaccctgaaaagggccccgtgccaaccttccaaccttttcagcgctccatctccgctgatgatgatcttcaggaatcttctcgcaggccccaacggaagtcattgtacgaatctttcgactggggatacgaggagcgtagtggagcccacagctctgcgagtcctcctagaagccgttcccgggatcgtagccacgaacgcaaccgtgaccgagatcgcgatcgcgaacgggatagggatagggaccgggatcgggacagagagcgagatagggaccgggaccgtgacagagacagagatagagagcgcgatcgggaccgcgagcgggatagggatcgtgatagagagggcccgtttcggagaagtgactcgttccccgagagacgggctcccaggaaaggaaatactctgtacgtctacggcgaagatatgactccaacattgctgagaggcgccttcagcccttttgggaacattatcgacctgtctatggatccacccaggaattgtgcctttgttacttatgagaaaatggaaagcgcggatcaggccgtcgcagagcttaacgggacgcaggtcgagtccgtgcagctgaaagtaaatatcgctagaaagcagcctatgcttgatgcagccactggaaagtcagtctgggggtctttggcggtgcaaaattctccaaaaggatgtcaccgcgataagaggacgcagatcgtctacagcgacgatgtatataaggagaatctcgtggacgggttttag

SEQ ID NO: 202696 - DNA, 1143 bp, Artificial Sequence
  Description of Artificial Sequence: Synthetic coding sequence
atgctggtgatcccccccggcctgagcgaggaggaggaggccctgcagaagaagttcaataaactaaaaaaaaagaagaaagctctcttagctctgaagaaacagagctcttcgtccaccacctcccaaggcggtgtgaagcgatctttaagtgaacagccagtcatggatacagccactgctacagagcaggccaagcaactagtgaaatctggcgctatttcggctattaaggcagagaccaagaacagcggattcaaaaggtccaggacgctggaaggcaaactgaaggatccagaaaagggccccgtccccaccttccagccatttcagcggagtatttctgcagacgatgacctgcaggaatcgagcaggcgtccacagcgcaaatccctgtatgagtcgttcgtcagctcaagtgatcgcctccgagagctgggacccgatggcgaggaagccgaggggcccggcgccggagatgggccgcccagatccttcgattgggggtacgaggagaggtccggcgctcactcaagcgcctcacctcccaggtccagaagtcgcgatcgctcacacgagaggaaccgggatcgggatagagatagggaaagagaccgcgacagagaccgagatagggaccgggagcgagacagggatagggatcgcgacagagatcgtgatcgggaaagagatcgcgaccgggaaagagaccgcgatcgtgaccgcgaaggacccttccgcagatcagacagcttccctgagagaagagctccgcgcaagggcaatacactctacgtgtacggggaggacatgactcccaccctcctgagaggcgcgttttccccattcggcaacattatcgacctgtctatggatccacccagaaactgcgccttcgtgacctatgagaagatggagagcgctgaccaggccgtggccgaactgaatggaactcaggttgagagtgtgcagctaaaagtgaatatagctcgaaaacagccaatgctcgatgccgcaacaggtaagtccgtctggggatctctcgccgtgcagaacagtcctaaaggatgtcaccgcgacaaacgaacacagatagtctacagcgatgatgtctataaggagaatctcgtggatggcttttag

SEQ ID NO: 202697 - DNA, 723 bp, Artificial Sequence
  Description of Artificial Sequence: Synthetic coding sequence
atgctggtgatcccccccggcctgagcgaggaggaggaggccctgcaaaaaaaatttaataaactaaagaaaaagaaaaaggctctactggctttgaaaaaacaatcatctagcagcacaacctctcaaggaggagtcaaacgcagtctgagcgaacagcccgtgatggacacagctaccgccacagaacaggcaaagcagctggtgaagtcaggggccatatccgcaatcaaggcggaaaccaagaactccggatttaaaaggtcacggaccttagaaggcaagctaaaagacccggagaagggacccgtacccacattccagcccttccaacggagcatttctgccgatgatgatctacaggaatcctcacggcgaccccagagaaagtctctgtatgagtccgatcggttacgcgagctggggcccgacggggaggaagccgagggacccggagccggtgacggccctccaaggtcttttgactgggggtatgaagagcggagtggagctcattcctctgctagccctcctcggagccgatcccgcgatcgtagccacgaaaggaaccgcgaccgcgaccgagaccgtgagcgggatcgggatagagacagggaccgggatcgggaaagagacagagaccgggaccgcgatcgagaccgcgatcgcgagcgagatcgtgatagagagcgcgacagggaccgggaccgcgaggggccctag

SEQ ID NO: 202698 - DNA, 1005 bp, Artificial Sequence
  Description of Artificial Sequence: Synthetic coding sequence
atgctggtgatcccccccggcctgagcgaggaggaggaggccctgcagaaaaagtttaataaactgaagaaaaagaaaaaggcgctgctcgcattaaagaagcaatctagcagtagcaccacctcgcaggggggtgtgaaacggagcctctctgagcagcccgtgatggacaccgccacagccactgaacaggcaaagcagctggtcaaaagtggagccatttctgccatcaaagccgagaccaaaaactccggttttaagaggtctagaaccctagaggggaaattgaaggatccggaaaaaggaccagtgcctaccttccaacccttccagcgttctatcagcgcagacgacgatctgcaggaatcaagtagacggccacagcggaaaagcctttacgagtccgatagactgagggagctgggacctgacggagaagaagctgaggggccaggagccggtgatgggccgccacggagcttcgattggggatacgaggagcgctccggcgcgcacagtagcgcttctcccccacgcagccgctctcgcgatcggagccacgaaagaaacagagatcgcgatcgggatcgcgaaagggatcgggacagagatagggatagggacagagaaagagatcgcgaccgagatagagatcgtgaccgggatcgggaacgggatagggatcgtgagcgagatcgcgatagggacagagaaggacctttcagaaggtccgacagtttcccagagagacgcgccccacggaaagggaatacattatatgtgtacggcgaggacatgacccccaccctgctgcgcggtgccttcagcccatttggcaacattattgatttgtccatggacccgccaagaaactgtgctttcgtgacttacgagaaaatggagagtgccgaccaggccgtggctgaactaaacggcacgcaggtcgaatcggtgcagctgaaagtgaatattgcacgcaaacagccaatgctggacgcagcctag

SEQ ID NO: 202699 - DNA, 885 bp, Artificial Sequence
  Description of Artificial Sequence: Synthetic coding sequence
atgctggtgatcccccccggcctgagcgaggaggaggaggccctgcagaagaagttcaataagctcaaaaagaagaagaaggccttgttagctctcaaaaagcagagcagttcctctacaacctcacagggaggcgtgaaacgctcgctgagtgagcagccagtgatggacaccgctactgccaccgaacaggccaaacagcttgtaaaatccggagctatatccgctattaaggcagagactaagaattccggctttaagcgctcccggactctggaaggaaaactaaaggatcccgagaaaggccccgtgccaacatttcaaccctttcagagaagcatctccgcagatgacgatctgcaggagagttccaggcggccacagagaaagtcactctacgaatcatttgtcagctcatccgaccgcctgcgtgagttgggtcccgacggtgaggaggcggagggtccgggggctggcgacggtccacccagatcctttgactgggggtatgaggaacgatcaggcgctcactcctccgcatctccaccaaggagccgttctagagatcgctcacatgagcggaatagagacagggatagggaccgggagcgagaccgcgatcgagaccgcgatcgagacagagaaagggatagggaccgggatcgcgaccgggatcgggaccgcgagcgtgatagggaccgggagcgcgatagggatcgcgaccgggaggggccgttcaggagatcggacagttttcctgagagaagggctcccagaaagggcaatacactgtatgtctatggcgaagatatgacccctaccctcctgcgaggtgccttttccccttttggtaacataattgatttaagtatggatcccccttag

SEQ ID NO: 202700 - DNA, 885 bp, Artificial Sequence
  Description of Artificial Sequence: Synthetic coding sequence
atgctggtgatcccccccggcctgagcgaggaggaggaggccctgcagaaaaaattcaataaactcaagaaaaaaaagaaagccctcctggcccttaaaaaacagtcctcgtcttccactacctcccagggcggagtaaaacggtcgctttctgaacagccggttatggataccgccacagccacggaacaggctaagcagctggtgaagtctggagctataagcgccataaaggccgaaactaagaacagcggctttaagcgcagtcgcaccctagaagggaagctgaaggatcctgaaaagggccccgtacctaccttccaacccttccagcgatctatttccgctgatgacgacttacaggagtctagcagaaggccacagcgaaagtcgctctatgagagctttgtctcttcttctgaccggctgagggaactcgggcctgacggcgaggaggctgaggggcctggggccggagatgggcccccacgctcctttgactggggctacgaagagcggtctggtgcccacagtagtgccagtccacctaggagtcgaagccgcgacagaagccacgaacgcaatcgggacagggaccgggatcgagagagagacagggacagggatcgggatcgtgacagggagcgtgatcgcgacagagacagagaccgtgatagggatcgagagcgggatcgcgacagagagagagatcgcgatagggatcgcgagggtccttttcggcgaagtgacagtttcccggaacgacgggctccccgtaagggaaacacactttatgtctatggcgaagacatgacacctacgctccttaggggagccttttccccctttggtaacattatcgatttatccatggaccctccctag

SEQ ID NO: 202701 - DNA, 885 bp, Artificial Sequence
  Description of Artificial Sequence: Synthetic coding sequence
atgctggtgatcccccccggcctgagcgaggaggaggaggccctgcagaagaaatttaacaaattgaagaaaaagaagaaagctctgttggctttaaaaaagcaaagcagcagcagcacaaccagccagggtggagtcaaacgcagtctttccgagcagcccgtgatggatacagctactgcaaccgaacaagcgaagcagctggtcaagtctggcgccatcagcgccattaaagccgagaccaagaattcaggcttcaaaagaagtcggaccctcgaggggaagctgaaggaccctgagaaaggtcctgttccgacatttcagccttttcagcggtccataagtgctgacgatgacttacaggaatcatcaagacggccgcagagaaaaagcctgtatgaatcctttgtcagttctagtgaccgcttgcgtgaacttggcccagacggggaggaagctgagggcccaggcgccggagacgggccgccgcggagcttcgactggggatatgaagagcgttcgggagcccactcctccgcctcaccgcccaggagccgctcccgggatagatcccacgagagaaaccgtgaccgggaccgcgatcgcgaacgagatagggatcgcgacagggaccgagacagggagagagacagagatagagatcgggaccgcgatagagaccgggagagggatagagatcgggagcgggaccgcgaccgggaccgcgagggccccttcaggagaagcgattcttttcctgagagaagggcacccagaaagggaaacaccttatacgtctacggggaggatatgactcccacccttctgagaggagccttcagcccatttgggaatattatagacctaagcatggacccaccctag

SEQ ID NO: 202702 - DNA, 723 bp, Artificial Sequence
  Description of Artificial Sequence: Synthetic coding sequence
atgctggtgatcccccccggcctgagcgaggaggaggaggccctgcagaagaagttcaataaacttaagaagaagaagaaggccttgctggcactgaaaaagcagtcaagtagctcaactacatcccaaggcggggtgaagcgatcactctctgagcagccagtgatggacacggccactgccactgagcaggctaagcaattagtcaagtcaggcgccattagcgccatcaaggccgagacaaaaaattcaggcttcaaacgctcacggactctggaagggaagctgaaggacccagaaaagggaccagttcccacatttcagcccttccaaaggtcgatcagtgccgacgacgacctgcaagagtcaagtcgacgcccacaaaggaagtctctgtacgaaagcgaccgcctgcgggagctggggcccgatggagaggaagctgaaggcccaggagctggcgatggccctccccgcagtttcgattggggatatgaggaaagatcaggcgctcattcaagcgcctccccacctcggtctaggagccgggatcggtcgcacgaacgcaatcgagaccgggatagagatcgggaaagagatcgcgatcgtgatcgtgaccgtgaccgcgaacgagatagagacagagacagagatagggatagggaccgagagagggacagagatcgggagcgggaccgggaccgggaccgggagggcccttag

SEQ ID NO: 202703 - DNA, 1143 bp, Artificial Sequence
  Description of Artificial Sequence: Synthetic coding sequence
atgctggtgatcccccccggcctgagcgaggaggaggaggccctgcaaaagaaatttaataaactgaaaaagaagaagaaggcattgctcgccctgaagaagcagtccagttcctccacaacatctcaagggggagtgaagcgaagtctgagcgagcagccagtgatggacaccgctaccgctactgaacaggccaagcagctcgtcaagagcggtgctatctctgcaataaaagccgaaacaaagaattccggcttcaagcgctctagaactctggaaggcaagctgaaggatcctgagaaggggcctgttccaacctttcagccgttccagaggtccattagcgccgacgacgacttgcaggagagcagcagacggcctcaaaggaagagtctgtatgagtcctttgtgtcttcctcagacaggctacgggaactgggcccagatggtgaagaagctgagggccccggggctggtgacgggccaccacggtctttcgactgggggtacgaggaaagatctggggctcatagttcagcctctccgcccaggtcccgttcacgtgatagatcacatgagcgtaatagagacagggacagggacagggaaagggatcgcgatcgtgaccgggatagggatagagagcgggaccgagatagggatagggacagggatagggacagagaaagagatcgagaccgagagcgtgatagagaccgggatcgggaggggccattcagaagaagtgacagcttccctgagaggagagcgcctaggaaagggaatactctttacgtttacggtgaagatatgacccccactctcttaagaggagcgttctcaccatttggaaatatcatcgacctgagtatggatccaccccgaaattgcgcctttgtcacctacgaaaagatggaatccgcggatcaagcagtggcggagctaaacggaacccaggtcgaaagcgtccagctgaaagtgaacatcgccagaaagcagccaatgttagacgccgcgaccggtaagtcagtgtggggatctttagcagtgcagaatagtcccaagggctgtcaccgggacaagcgcacccagatcgtatattcggatgatgtatacaaggagaacctcgtggatgggttctag

SEQ ID NO: 202704 - DNA, 480 bp, Artificial Sequence
  Description of Artificial Sequence: Synthetic coding sequence
atgctggtgatcccccccggcctgagcgaggaggaggaggccctgcaaaaaaaatttaacaagctgaagaaaaaaaaaaaggcgctgcttgcactgaagaaacagtcatctagctccacgaccagtcaggggggggttaagcgttctctgagcgagcaaccggtgatggacacagccaccgcaacagagcaggctaaacagctggtgaaatcaggagctatctctgctattaaggcggagaccaagaacagtgggttcaagcggtcccgtacgcttgaggggaaacttaaggatcctgaaaaagggccggtccccaccttccagcctttccaaaggagtatctctgcagacgacgacttacaggagtcatccaggcgccctcaacgaaaatctttatatgaatcattcgtctcttcatcggaccgcctgagggaactaggtcccgatggagaggaagccgaaggccctggagccgggtag

SEQ ID NO: 202705 - DNA, 1164 bp, Artificial Sequence
  Description of Artificial Sequence: Synthetic coding sequence
atggtgcccaagggcgccaccatgctggtgatcccccccggcctgtccgaggaagaagaggctctgcagaagaagtttaataaactgaagaagaagaaaaaggccctgctggctctgaagaaacagagttcctccagcacaacgagtcagggaggggtgaaacgatcattatctgagcagcctgttatggatactgccactgcaaccgagcaagctaagcaactggttaaatctggagccatctccgctattaaggctgaaaccaagaattctggattcaagagatctagaacgctggaaggaaagttgaaggatcccgaaaagggccctgttccgactttccaaccattccaaaggtctatttcggcagatgatgacctccaggagagtagcaggcgccctcagaggaagtctttgtacgagtcctttgtgtccagctcagaccggttgcgcgaactgggacctgacggcgaagaggctgagggacctggcgcaggcgatggcccacctcggtctttcgattgggggtacgaagaacggagcggagcccactcatccgcctctccccctagatctaggagcagggataggtcacacgagcgcaacagagatcgcgatagggaccgcgagagagaccgtgatcgggatcgggaccgggacagagagagagatagagatcgtgatagggatcgggatagagaccgggagcgagatcgcgatagggagagggaccgagacagggatcgcgaaggcccctttcggaggtcagattcctttccagagcgcagggccccccgcaagggcaatacgctctatgtctacggtgaagatatgacacctaccttgttacggggcgcatttagcccttttgggaacattattgacttaagtatggaccctccgagaaactgcgcatttgtgacctatgaaaagatggaatcagcagaccaggctgtggctgaactcaacggtacccaggtcgagtccgtgcagctcaaggtcaacatcgcccgtaagcagcctatgttagatgccgcgaccggaaaaagtgtttgggggtcccttgccgtgcagaactctccaaagggatgtcaccgcgacaaacggacgcagatagtgtacagcgatgacgtttacaaagagaacctggtcgacggtttctag

SEQ ID NO: 202706 - DNA, 1164 bp, Artificial Sequence
  Description of Artificial Sequence: Synthetic coding sequence
atggtgcccaagggcgccaccatgctggtgatcccccccggcctgtccgaggaagaggaggccctccagaagaagttcaacaagctcaaaaaaaagaaaaaggcactgttagcacttaaaaaacaatccagctcgtctactacaagccagggcggagtcaaacggtccctcagcgaacagccagtcatggacaccgcaaccgcaaccgagcaagccaaacagctagtaaagtccggggcaatctccgccattaaagccgagaccaaaaactccggatttaagcgcagtcgcacactggaggggaagctgaaagatccagaaaagggccccgtgcctacattccagccttttcaacggagcatatcagccgatgacgacctgcaagagagttcccgcagacctcagagaaagtccttgtatgaatccttcgtcagcagttcagatcggttgagggaactgggacctgacggggaggaagccgaagggcccggcgccggcgatggacctcccaggagcttcgactggggttacgaagaacgcagcggcgcacacagttctgcctcccctccccggagtaggagccgtgaccgatcgcacgagaggaaccgcgacagggaccgggatcgcgaacgcgaccgagatagggatagggaccgagatcgggagcgagatagggaccgggatcgggacagagatcgtgatcgggaacgagacagggatagagagcgcgatagggatagagatcgtgagggcccctttaggagatcagactcctttcccgagcgacgagctcctagaaaagggaataccctgtatgtatacggagaagatatgactcccaccttattgcggggggccttcagtccattcggaaatataatcgatcttagcatggaccccccgaggaactgcgcattcgtgacctatgagaaaatggaaagtgcagatcaggccgtggcagagctcaacggtacacaggtcgagagcgtgcaactgaaagtcaacatcgcccgaaaacagcccatgctcgacgccgctaccggcaagagcgtgtgggggagcctggctgttcagaacagtcccaaagggtgccaccgggacaaacgtacgcagattgtttacagcgacgatgtgtacaaagagaatcttgttgatggtttttag

SEQ ID NO: 202707 - DNA, 1164 bp, Artificial Sequence
  Description of Artificial Sequence: Synthetic coding sequence
atggtgcccaagggcgccaccatgctggtgatcccccccggcctgagcgaggaagaggaggcgctccaaaaaaagttcaataagctcaaaaagaagaaaaaggctttgcttgctctgaagaaacagagcagttcaagcacaaccagccagggcggagtgaagcgcagcctgtccgagcagcctgtgatggacactgcaacagctactgagcaggctaagcaattggttaaatccggagccatctcagccataaaagcagagaccaagaatagcggttttaaacgatctaggacattagaagggaaactcaaagaccctgagaaagggcccgtgcccacctttcaaccctttcagagatccatttctgcagatgacgacttgcaggaatcttcacggcggccccagcgcaagtccctgtatgagagtttcgtaagtagcagcgacaggctcagagaactgggtcccgacggcgaggaggctgaagggccaggagcgggtgacggccccccaagaagtttcgattggggctatgaagaacgctcaggggcgcatagctcggcatcgccacctcggtcaaggtcccgggacagatcacatgaaagaaacagggatcgcgaccgggacagggaacgcgacagagacagagatcgtgatagagatagggaacgggaccgcgatagggatcgtgaccgcgacagagatcgagagcgcgatcgggatcgcgaaagggaccgtgacagagatagggaagggccttttcggcgctcagattcatttcccgagcgccgggcaccaaggaagggcaataccctgtatgtgtatggcgaggacatgactcccacactgcttaggggcgctttctcgcctttcggaaacattattgatctatcaatggatcccccaaggaactgtgcttttgtcacttatgaaaagatggaatcggctgatcaagccgtagctgagcttaatggtacgcaagtggaaagcgtgcagctgaaggtcaacatcgccagaaaacagcctatgttagatgccgcaacgggaaagagcgtctgggggtcccttgccgtgcagaatagtccaaaggggtgccacagggacaagaggacccaaatagtttactcggacgatgtgtataaagagaacttagtggacgggttctag

SEQ ID NO: 202708 - DNA, 1164 bp, Artificial Sequence
  Description of Artificial Sequence: Synthetic coding sequence
atggtgcccaagggcgccaccatgctggtgatcccccccggcctgagtgaggaagaggaggccttgcagaaaaagtttaacaaactcaaaaaaaaaaagaaggccctcctggcgttaaagaaacagagtagctcatctacgacctcccagggcggcgttaaacgcagcctttcagaacagcccgtgatggacacagcgacagcaacagagcaggctaaacagctggtgaagtccggtgccataagcgctattaaagctgagacaaaaaactctgggtttaagcgtagcagaaccctcgagggaaagctgaaggatccggagaagggtcccgttcctacatttcaaccatttcagcgtagcatctccgcagacgacgacctgcaggaatctagtaggcggccacaaaggaaatcactgtatgagtcctttgtctccagttctgataggttacgggagctggggcccgacggtgaggaagctgagggacctggcgccggcgatggcccacctcgctctttcgactggggctacgaagagcgaagtggtgcacatagctcggcctctccaccaagatccagatccagggaccgcagtcacgaacgcaatcgggaccgcgaccgggacagggagcgggaccgcgaccgagatcgtgatagagatagagaacgggatagggaccgagatcgcgaccgagaccgcgacagagagcgggaccgagaccgggagcgtgatcgggaccgggatcgcgagggtccttttcgtagatccgacagttttcccgagcggcgcgcacctcggaaagggaataccttgtacgtgtacggtgaggacatgacccctacccttttgcggggggccttctcacccttcggtaacattatagacttaagcatggaccctcctagaaattgtgcgttcgttacttacgagaagatggagtccgcagaccaggctgtggccgagcttaatggaacgcaggtagagtctgtgcagctaaaggtcaatatcgcgaggaaacagcccatgcttgatgctgcgactggaaagtcagtttggggtagcctcgccgttcagaactcccccaagggatgtcacagggacaaacgaacacagatcgtatacagcgatgatgtatataaggagaatttagtcgatggattttag

SEQ ID NO: 202709 - DNA, 1164 bp, Artificial Sequence
  Description of Artificial Sequence: Synthetic coding sequence
atggtgcccaagggcgccaccatgctggtgatcccccccggcctgagtgaggaggaggaggctttgcagaaaaagtttaacaagctcaaaaaaaaaaagaaggccttactcgccctgaagaaacagagttcatccagtacgaccagccaaggtggggtgaaaaggtccctgtctgagcaaccggtgatggatacagcaactgctacagagcaggcaaaacagcttgtcaagtctggggcaatctccgccatcaaagccgaaactaagaacagcggatttaagcgcagtcggacattggagggaaagttgaaagatcccgaaaagggcccagttcccactttccagccctttcaaaggtcgatttccgctgatgacgacctccaagagagctctaggcgacctcagcggaagagcctctatgaaagcttcgtctccagtagtgatcgactgagggaactgggcccagatggagaagaggctgagggccctggcgcaggggatgggccccctcgctcattcgattgggggtacgaagagcggagtggagcccactcttccgcttcacctccaagaagccggagccgggatcggagccatgaacgcaacagggacagagatcgggatagggagagagacagagatcgtgaccgggatcgggacagagagagagatagggacagagaccgggacagagaccgagaccgcgagagagatagggacagggagcgggaccgtgatcgggacagggaaggacctttccggcgctctgactccttcccagagaggcgggctcccagaaagggaaacacgctctatgtgtatggagaggacatgaccccaacactgctacggggggcattttcaccgttcggcaatatcattgacctctccatggatcctccaagaaactgcgcatttgttacctatgaaaagatggaaagcgcagaccaggccgtagccgaactgaatggtactcaagtcgagtccgttcagcttaaggtcaacattgcgcggaagcagcctatgctggatgccgcaacaggcaaatctgtctggggatctttagctgtgcaaaacagtccaaaaggatgccacagagataaacggactcagatagtgtacagcgacgacgtttataaggagaacctcgtagacggattctag

SEQ ID NO: 202710 - DNA, 3294 bp, Artificial Sequence
  Description of Artificial Sequence: Synthetic coding sequence
atggccacccaggtgatgggccagagcagcggcggcggcggcctgtttacctcttcaggcaacatcggaatggccttgcccaatgacatgtacgacctgcacgacctcagcaaggcagagctggcagcaccacaactgattatgctagcgaatgtggcccttactggagaagtgaatggctcctgttgcgattatcttgtaggtgaggagcgccagatggccgaattaatgcctgttggggacaataattttagtgactctgaagagggggagggacttgaagagtcagccgacataaaaggcgagccccatggccttgagaatatggagctgaggtcactggaactgtcagtcgtggagccccagccagtgttcgaagcctctggcgcaccagacatctacagtagcaataaggaccttccccccgagactcctggcgcagaggataaaggaaagagcagcaaaacgaagccgttcaggtgtaagccctgccagtacgaggccgagtcagaagaacagtttgtccaccacatcagggtccactcagctaaaaaattctttgtggaggagagtgcggagaaacaggcaaaggctagggagagtgggtcaagcacagctgaagagggcgatttctccaaagggcctattcgttgtgacagatgcgggtacaacaccaaccgatatgatcactataccgctcacttgaagcatcacacgagagctggggataacgagcgagtgtacaaatgtattatttgtacatataccaccgtctcagagtatcactggcgaaagcatcttcgcaaccattttccccgcaaagtttatacctgcgggaaatgcaactatttttctgataggaagaataactatgtgcagcatgtacgaactcacacaggcgaaagaccatacaagtgcgagctatgcccatattcttcaagccaaaagactcatctgaccaggcatatgcgcacccactccggagagaagccgtttaaatgtgatcagtgtagctacgtggcctccaaccagcacgaagtgacacggcacgccagacaggtgcacaatggtccaaagccattaaactgcccccactgtgattacaagaccgccgacagatccaactttaagaagcacgttgaactgcacgtgaacccgcggcagtttaactgccccgtatgtgattacgccgcttcaaaaaaatgcaatttacagtaccacttcaaatcaaaacaccctacatgcccaaataaaacaatggatgtaagcaaagtaaaacttaagaagactaaaaaaagagaagcggaccttcccgacaacattaccaatgagaaaacagagattgaacagactaagatcaagggggatgtggccggcaaaaagaacgaaaaatccgtcaaagccgagaagcgggacgtctccaaggaaaaaaaaccctcaaacaatgtgtccgtcattcaggtgactaccaggaccagaaagtcagtgactgaggtcaaagagatggacgtgcacacaggaagcaatagtgaaaaattcagcaagaccaagaagtcaaagcggaaacttgaggtggactcccattccctacacgggcccgtaaatgatgaggagtcaagtacaaagaagaagaaaaaagtggagagtaagtccaagaataacagtcaagaggtgcccaaaggggacagcaaggtggaagaaaataaaaagcagaacacttgcatgaaaaagagcaccaaaaagaagacccttaagaacaaatccagtaaaaagagctccaagcccccgcaaaaggaaccagtcgagaagggatctgctcaaatggatccgccccaaatggggccagcccccaccgaggccgtacagaagggccctgtgcaggtcgagcctccaccaccaatggagcatgctcagatggagggcgctcagatcagacctgcccccgatgagccggtacagatggaggtggtgcaggaagggccagcccagaaggagctgctcccccccgtcgaacctgcacagatggtcggggcacaaattgtactggcacatatggagctgccaccgcctatggaaaccgctcagacagaggtggctcagatgggtcccgccccgatggagcctgcccaaatggaggtggcgcaggtagagtcagccccaatgcaggtggtgcagaaagagcccgtgcaaatggagctgagtccccccatggaagttgttcagaaggaacccgtacagatcgagctctctccgccaatggaagttgtgcaaaaagaacccgtgaaaatagaactgtcccccccaatcgaagtggtgcaaaaggagccggtgcaaatggagttgtcgccccccatgggcgtcgtgcagaaggagcctgcccagcgggagccaccccccccaagagagcccccacttcacatggagcctatttctaaaaaaccacccctgcggaaggacaagaaagagaaaagtaacatgcagtccgagcgcgcgcggaaggagcaggtactgatcgaggtagggctcgttcccgtcaaagactcctggttgttgaaagagagcgtgagcacggaagatctgtcccccccgtcccctcccttgccaaaggagaacctgcgtgaagaggcgagtggcgaccagaaactcctgaacaccggcgaaggcaataaggaagctcccctgcagaaggtgggagccgaagaggccgatgagtccctgcccggcttagctgcgaatataaatgaaagcactcacattagttcttcaggccagaacttaaatactcccgagggtgagacactcaatgggaaacatcagactgactcgatcgtgtgtgagatgaagatggatacggaccagaatactagagaaaatttaacaggcattaactctactgtggaagagcctgttagcccgatgctgcccccttccgccgtggaggaacgagaggcagtgagcaaaacggcattagcatccccgcctgcgacaatggccgccaatgaaagccaggagattgacgaagatgagggtattcactcccacgaggggtccgacctcagcgataatatgtccgaaggaagtgacgactctggcctccatggtgctcgacctgtgccacaggaatcttcccgtaagaacgctaaggaggcactcgccgtaaaggcggccaaaggcgattttgtttgtatcttttgtgaccggtccttccggaagggaaaggactatagtaagcatctcaataggcacttagtaaatgtgtattacttagaggaagctgcacagggccaggaatag

SEQ ID NO: 202711 - DNA, 3225 bp, Artificial Sequence
  Description of Artificial Sequence: Synthetic coding sequence
atggccacccaggtgatgggccagagcagcggcggcggcggcctgtttacttcatctggaaacatcggcatggctctgcctaatgacatgtacgacttgcatgacctgagtaaggccgagttagccgccccacagttgatcatgttagcgaacgtcgccctaaccggcgaagtgaatgggtcctgctgtgactatctcgtcggcgaagagcgccagatggccgaactgatgccagtcggcgacaacaacttttcagactccgaagagggcgaaggactggaagagtccgcagacatcaagggtgagccgcacggtcttgaaaacatggaattgaggtctctggaactatccgtggtagagccacagcccgtattcgaagcctctggtgcaccagacatttactcttctaacaaagacttaccaccagagactcccggggcggaggacaagggcaagtctagtaaaaccaagccctttcgctgcaagccatgccagtatgaggccgaatctgaggagcaatttgtgcaccacatccgagtgcactcagccaagaagttcttcgtggaagaatccgctgaaaagcaggctaaagcccgggaaagcggatctagcacagctgaggagggagatttctctaaaggccccatccggtgcgatcgttgtggctataatactaataggtacgatcattacacggcccatcttaagcaccacacacgggcgggagacaatgagagagtctacaagtgtatcatctgcacttacacaacagtgagcgaatatcactggagaaaacacctgcggaatcattttcctcgaaaagtgtatacgtgtggtaagtgcaattacttcagcgataggaagaacaattatgttcagcatgtgagaacccataccggaaaaagaccctctggagagaagccgttcaagtgtgaccagtgttcgtacgttgcatccaatcaacacgaggtgaccaggcacgctcgccaggtgcacaacggccctaaaccgcttaactgcccacactgtgattataaaaccgccgatcgtagtaattttaaaaaacacgtcgagctgcatgtaaacccaagacagtttaattgtccagtctgtgactacgctgccagtaagaagtgcaatctccagtaccacttcaaatccaagcaccctacctgcccgaataagactatggacgtgtcaaaagtgaaactgaagaaaaccaagaaacgcgaagccgaccttcctgataacataacaaacgagaagaccgaaatcgaacagaccaagatcaaaggtgatgtcgctggaaaaaagaacgaaaagtccgtgaaagcagagaagagagacgtatccaaagagaaaaagccaagtaacaatgtgagtgttattcaggttacgacccgcactagaaagagtgtcacagaggtgaaagaaatggacgtccatacaggcagcaacagcgaaaagtttagcaagacgaagaagtccaaacgcaagttggaggtcgatagtcactctctgcacggcccagtcaacgatgaagaatcatcaacgaaaaagaagaaaaaggtcgaatcaaaaagcaagaataacagtcaggaagtccccaagggagacagtaaagtagaggagaacaagaagcagaatacgtgtatgaaaaagagcactaagaaaaaaaccttaaaaaataaatcgtccaaaaagagttcaaagcctcctcaaaaagaacctgtcgaaaaggggtccgcccaaatggatccaccccagatggggcccgcaccaaccgaggccgtgcaaaagggccctgttcaggtagagcctcctccacccatggagcatgctcagatggagggagcccaaattcgtcccgccccagacgagccagttcagatggaagtcgtccaggaaggaccagctcagaaagagctcctgccccctgtagagccggctcagatggtgggcgcgcaaatcgtgctggcccacatggaactgccacctcccatggagaccgcccagacagaggtcgctcagatggggcctgctccaatggagcctgcacagatggaagtggctcaagtcgagagcgcaccaatgcaggtggtgcaaaaggaacctgtgcagatggagctgtccccccctatggaggtggtccagaaggagccggtacagattgaactgtccccccctatggaggtggtgcagaaggaacccgtgaagattgaattgtcccccccaatcgaggtggtgcaaaaggagccagtgcagatggaactgtcaccacccatgggagtggtgcaaaaggaaccggcacagcgcgagcctcctcccccccgcgagcctcctttacacatggagcctataagtaagaagccacctttgcggaaggataaaaaagaaaagtccaacatgcagtccgaacgcgcaaggaaggagcaagtgctcatcgaggtgggcctggtgcctgtaaaggactcctggctcctgaaagaaagtgtttctaccgaggatcttagccctccaagcccacctctgcctaaggaaaacctccgcgaagaggcttcaggggaccaaaaattgctgaatacaggggagggtaataaagaggcaccattacaaaaggtgggcgcagaagaagcagacgagtcgctgccggggctagctgccaacatcaacgaatctactcacatctcaagcagcggacagaatctgaatactcccgagggggagacccttaatggcaagcaccaaacagacagcattgtctgcgagatgaaaatggatactgatcagaatactcgcgaaaatctgaccgggatcaattccaccgttgaggagccagtgtcccctatgctcccaccctctgccgtggaggaaagggaagcagtgagcaaaactgcattggcctctcccccagctactatggccgccaatgaatctcaggaaatcgatgaagatgagggtatacattcccacgagggctcagatctgtccgacaacatgtccgaaggctcagatgatagtgggttgcacggtgcaagaccagtcccccaagaaagcagccgtaagaatgccaaggaggccctggccgtgaaggctgctaagggagacttcgtttgtatcttctgtgatcgatcatttcggaagggcaaggactattccaagcaccttaatagacacctggttaatgtgtattacttggaggaagcagcacaaggccaggaatag

SEQ ID NO: 202712 - DNA, 1383 bp, Artificial Sequence
  Description of Artificial Sequence: Synthetic coding sequence
atggccacccaggtgatgggccagagcagcggcggcggcggcctgttcacctcctccggcaatattggtatggcattaccgaacgacatgtatgatcttcacgatttaagtaaggctgagctggccgctccacagcttatcatgctggctaacgtggcattgaccggtgaagtcaatggtagctgctgcgattacctcgtcggcgaagagaggcaaatggctgagctcatgcctgtgggtgataataacttctctgatagcgaggagggcgaggggttagaggagtctgccgacatcaaaggcgagccccatggattggagaacatggagcttcgcagtctcgagctgagtgtggttgagccacaacctgtcttcgaagccagtggcgcgcccgacatttattcttcaaataaggacctgccacctgagactccaggggcagaagataaaggaaagtcgagcaagacgaaaccctttagatgcaaaccatgccagtacgaggcagagtccgaagaacagtttgtccaccacatcagagtgcactccgctaagaagtttttcgtcgaggaatccgccgagaagcaggctaaggcgcgggaaagtggctccagcacagcagaggaaggggacttctcaaagggccccatccgatgcgatcggtgcggctataacactaatcggtacgaccactatactgcccatttaaaacatcatactagagccggcgacaacgaacgagtctacaaatgcatcatttgtacctatactacagtgagcgagtatcactggcgcaaacacttacggaaccactttccgaggaaagtgtatacatgcggtaagtgcaattacttttcagatcgcaaaaacaattatgtgcaacatgtgaggacccataccggagaacgaccttacaaatgcgaactttgcccttacagctccagccagaagacacaccttacccgccatatgcgaacgcactccggcgaaaaaccttttaagtgcgatcaatgtagttatgttgcctcgaaccaacatgaagtgacccgccatgctcgccaggtgcacaacggcccaaaaccactgaactgtccacattgtgattacaagacagctgacaggagcaattttaaaaagcacgtggagttacacgtgaatccacgccagttcaattgccctgtgtgcgactatgcagcttctaagaagtgcaatctccagtaccactttaaatctaagcatccaacctgcccaaacaaaaccatggatgtcagcaaggtgaagcttaaaaagactaagaaaagggaagcggatctacccgataacattaccaatgaaaaaactgagatcgaacagacaaagaaaaagaaaaagaagaaaaaaaaatag

SEQ ID NO: 202713 - DNA, 5745 bp, Artificial Sequence
  Description of Artificial Sequence: Synthetic coding sequence
atggccgacggcaagggcgacgccgccgccgtggccggcgccggcgccgaggcgccggccgtggctggcgccggcgatggcgtcgagactgagagcatggtacgaggccacaggccggtctcacccgcgcctggagcgtccgggctgaggccttgcctgtggcagctcgaaacagagctaagggaacaggaggtgtccgaagtgtcatctctgaattattgcaggagcttctgtcagacactcttacagtatgcctcgaacaaaaatgccagcgaacatatcgtatacctgctggaagtataccgccttgccattcagtcgtttgcaagcgcaagaccatatttgaccacagagtgtgaagacgttttattagtgctcggcaggctcgtgttgtcttgcttcgaactattactgagtgtgtccgagagcgagctcccatgcgaagtctggctgccatttctgcagtctcttcaggaatcccacgacgcacttctggagtttggcaacaacaacctgcaaatcctggtccacgtgaccaaggagggcgtgtggaagaacccagtgctgctgaagatcctgagccagcagcctgtggagacagaagaagttaacaagctgatcgctcaggaaggccctagctttttgcagatgcggattaaacacttgctgaaaagtaattgtatccctcaggccacagcactcagcaaattgtgtgctgaaagcaaagagatctcaaacgtctctagtttccaacaggcgtacatcacctgtttatgtagtatgctgcccaacgaagacgccataaaggaaatagcaaaagtcgactgtaaggaggtgcttgacatcatctgtaatctcgagagcgagggacaggacaacacggcattcgtcttgtgcaccacatacctgacccagcagctgcagaccgcaagtgtctattgttcctgggagttgacactcttctggtcaaaactgcagaggcgcattgacccttcattggatacctttctcgaacgctgcaggcagttcggagtgatcgcgaagactcagcagcacctcttctgtctcatacgagtaatccagacagaggcgcaagacgccggccttggcgtatcaatcctgctttgtgttagagcactccaactccgaagtagcgaagatgaggagatgaaggcttctgtttgtaagaccatcgcatgtctactaccagaggatctggaagtacgccgggcttgccagcttacagaattcttaatcgagccttctttagatgggttcaatatgttggaagaactttatttgcagcctgatcaaaagttcgacgaagagaacgctccggtccccaactccttgaggtgcgaattattgttagctttaaaggctcattggcccttcgatcctgaattctgggattggaaaacactgaagcgccactgccatcaattgctaggccaggaagcctccgacagtgatgatgacctgagcggttacgagatgagcattaacgacacagatgtgttagagtcattccttagtgactatgatgaggggaaagaggataagcaatatagacggcgggacttgactgaccaacataaggagaaacgggacaaaaagcccattggatcctccgaacggtaccagaggtggttgcagtataagtttttttgcttgctttgcaagagagaatgcattgaagcacgaatactgcaccattccaaaatgcacatggaagatggaatctatacttgtcccgtctgcatcaagaagtttaagcgtaaggaaatgtttgtaccccatgtaatggagcatgtcaaaatgcctccatctagacgggatcggtctaagaagaagctcctacttaaaggctctcaaaaaggaatctgcccaaagagccctagtgctatcccagaacaaaaccatagtctcaacgatcaggccaagggtgagagccacgagtatgtgactttctctaagctggaggactgccacctccaagatcgcgatctctacccttgccccggaaccgattgttctcgggttttcaagcaattcaaatacttgagcgtacatctcaaggccgagcaccagaataatgacgagaacgcaaagcactacctggacatgaaaaatcgacgcgaaaagtgtacctactgtcgccgccacttcatgtctgcttttcacctgcgggaacacgagcaggtccactgcggcccacagccgtatatgtgcgtcagtatcgactgttacgccagatttggctccgttaatgagctgctcaatcacaagcagaaacacgatgacttacgatataaatgcgaactcaacgggtgcaatatcgtgttctccgacttgggccagctttatcaccacgaggcccagcattttcgggatgctagctatacgtgcaactttctcgggtgtaagaaattctactacagcaaaatcgaataccaaaatcatttgtccatgcataacgtcgagaactctaatggcgacatcaaaaagtcagttaaattggaagagtcagcaaccggggaaaaacaggactgtatcaaccaaccgcacctcctaaatcagactgataagtcgcatctcccagaagacctcttctgcgctgagagcgccaattcacaaatagataccgagactgccgagaacctgaaagaaaatagcgatagcaattcttctgaccaactcagccactcttcatccgcctccatgaacgaggagttaattgacaccctagatcattcagagaccatgcaggatgtgcttcttagcaatgaaaaggtctttggtcccagcagtttgaaagagaagtgctccagcatggccgtgtgctttgacggaacaaagttcacttgtggattcgacggttgtggctctacttacaagaatgctcgaggcatgcaaaagcatctgcgcaaggtgcacccttaccactttaagccaaaaaagatcaagactaaagatttattccccagtctcggaaacgaacataaccagactaccgagaagcttgacgctgagcctaaaccgtgctctgacacgaactcagatagcccagatgaaggcttagatcacaacatccacattaagtgtaagcgcgagcatcaagggtattctagcgaatctagcatttgcgcaagcaaaagaccctgtacagaagacaccatgttagaactgctgcttagattgaagcacctgtctttgaagaactcaattacccatggtagtttcagcggatccctgcaaggatacccatcttcaggggccaaatctctgcagtctgtgtcaagcatctctgatctgaattttcaaaatcaggacgagaatatgccaagtcagtatctcgcccagcttgctgccaaaccatttttctgtgagttgcagggatgcaaatacgaattcgtgacgcgcgaggccctgctgatgcactatctgaagaagcataactattccaaagaaaaggtcctgcaactgaccatgtttcaacaccggtattctcctttccagtgccacatttgccagagatccttcacgagaaagactcatcttcgaatccactacaaaaataagcaccagatcggcagtgacagagcaacacacaaactgctcgacaacgagaaatgtgatcatgagggaccttgctcagtggaccgcctgaaaggcgattgctccgccgagttagggggcgatccctcttcaaactcagaaaagccacactgtcatccaaaaaaggatgagtgttcatcagaaacggatcttgaatcatcctgtgaggaaacagagagcaaaacttctgacatttccagccccatcggttcgcatagggaggaacaggaaggccgtgaaggacgcggctccagaaggactgtggccaagggtaacctttgttacatcttgaacaagtaccataagcctttccactgcatacataaaacatgtaacagctcatttacaaatctgaaaggcctgatacggcattacagaactgtccaccagtacaataaggaacagctttgtctcgaaaaagacaaggctagaaccaaacgggagctagttaagtgcaagaagatctttgcgtgcaagtataaagagtgcaacaaaagatttctctgctcgaaggccctggcgaagcactgtagcgacagtcacaacctcgatcatattgaagaacctaaggtgctgagtgaggccgggagcgccgcgagattctcttgtaaccagccccaatgtcctgccgtgttttacacattcaacaaactcaaacaccacttaatggaacagcataacatagagggagaaatacatagcgattacgagatccactgcgatctgaacggatgcgggcagattttcacgcaccgttcaaactactcgcaacacgtgtattacagacacaaagattactatgacgatctttttagaagccagaaagtggctaatgagcggctgctgcggtctgaaaaagtctgtcagacggcagacacacaaggacacgaacaccagaccacaagaagatccttcaacgccaaatcaaagaagtgcgggttaatcaaagaaaagaaggcgcctatcagctttaagactcgcgcagaagctctgcatatgtgtgtagaacatagcgaacatacccagtatccctgtatggtccaaggatgcttgagcgttgttaagttggaaagcagcatcgtgagacactataagaggacccaccaaatgtcaagcgcatacctcgaacagcaaatggaaaatctcgtagtctgcgtgaagtatggcactaaaatcaaggaagagcctccgtctgaagcagacccttgtataaaaaaggaggagaatcgatcttgcgagtcagaaaggacagaacacagccatagtccaggagactcatccgcgcctatccagaataccgattgctgccattctagcgagcgtgacggggggcagaagggctgtattgaatcctcctcagtgttcgacgcagacacccttctctacagaggcacgttaaaatgtaaccactcatctaaaactacaagcctggaacagtgtaatatcgtgcagcctccccctccctgcaaaatcgagaactctattcctaaccccaacgggactgaatctggcacttactttacctcattccaactgcctctgcctcgcatcaaggagtccgagactcgtcaacactcttctggccaggaaaataccgtgaaaaaccccacccacgtgcccaaggagaacttccgaaagcacagccagccccgaagctttgatctgaagacgtataaacccatgggatttgagagctccttcctcaaattcattcaggagtctgaggagaaggaggacgatttcgatgattgggagccatccgaacacctgacactctctaattcttcccaatcttcaaacgacttgacaggcaacgtggtggccaacaacatggttaacgactctgagcctgaggttgacatcccccattcaagttccgactccaccatccacgagaacctgacagctataccaccactaattgtcgctgaaacaactactgtgccttctctggagaacctcagggtggtacttgacaaagcgctcaccgattgcggcgagctggcactaaaacagcttcactatcttagaccagtagtggtgcttgaaaggagcaaattctcaactcccatcctggacctgttccccactaagaagactgacgaactatgtgtgggaagttcctag

SEQ ID NO: 202714 - DNA, 4824 bp, Artificial Sequence
  Description of Artificial Sequence: Synthetic coding sequence
atgttctaccacgacctgttctaccgggagctgaccctgttctggagcaaacttcagcggcgcattgatccctcactggacacatttctagagcggtgtcggcagtttggtgtcattgcaaagacacagcaacacttgttctgtctgattagggttattcagactgaggctcaggatgcaggcctgggggtgtctattctgctgtgtgtgcgggcgctgcagctgagaagctctgaggacgaggagatgaaggcttctgtatgtaaaactatagcctgtttgctgccagaggacctagaggtccgcagagcttgccaactgaccgagttcctgattgagccaagtctggacggtttcaacatgctggaggaactttacttgcagcctgatcagaagtttgatgaggagaacgctccagtacctaattccctcagatgtgaactgctgctagcgttgaaagcccactggccttttgatcctgaattctgggactggaagacattaaaaagacattgccaccaactgctgggtcaggaggcctccgattccgatgatgatctgtcaggttatgaaatgtccatcaacgatacagacgtgctggagtcgtttttgtctgactacgacgaaggtaaggaagacaaacagtatcggagaagagatctgacagaccaacacaaggaaaagcgcgataaaaaaccgattggctccagtgaacgttatcagagatggctgcaatacaaattcttctgtctgctgtgtaaaagggaatgtatcgaggcccggatccttcatcattccaagatgcatatggaggatggtatatatacctgtcctgtctgtattaaaaagtttaaacgcaaggagatgtttgtccctcatgtgatggagcatgtcaaaatgcctccaagtcgccgcgacagatccaaaaaaaagctgttgcttaagggctctcagaagggcatttgtcctaagagcccctcagcaatccctgaacagaaccactcactgaatgatcaggccaagggtgaaagtcatgagtatgtcacgttttccaaattagaggactgccatcttcaagatcgggacctgtacccatgccccggtacagattgttctcgggtgtttaagcaattcaaatacctgagtgtgcacctgaaggccgagcaccagaacaatgacgaaaacgctaagcactacctggacatgaagaatcggcgggaaaagtgtacctattgtcgtcggcactttatgagcgccttccacttgcgcgagcatgaacaggtccattgtggcccacagccctatatgtgcgtatccattgattgttacgcgagatttggaagcgtgaatgagctcctgaaccacaaacaaaagcacgacgacctacggtacaaatgtgagctaaatggttgcaacatagtcttctcagacctgggtcaactttaccaccacgaagcccagcacttcagggacgcatcatacacctgcaacttcctgggctgcaaaaaattctactactccaagattgaataccagaaccatctgtctatgcacaacgtggaaaacagtaacggagacatcaaaaagtccgtgaaactggaagagtccgctacaggagagaagcaggactgcataaatcagcctcacctgctcaaccaaacagacaagagccatctgccggaggacttattttgtgccgaaagcgctaattcccagattgacacggagactgcggagaacttgaaggaaaattctgacagtaacagttccgatcagctgagccacagcagctcagcctccatgaacgaagagctgatagatacccttgatcacagcgagaccatgcaggatgtgctgctcagtaacgagaaggtgttcggccctagctccctcaaggagaagtgcagttctatggctgtgtgctttgatggaacgaagttcacatgtggatttgacgggtgtggatctacctacaagaacgcaagggggatgcagaagcacctgagaaaagtccacccgtatcacttcaaacccaagaagattaagaccaaagacctcttcccttcactgggtaatgagcataatcagactactgagaagctagacgcggagcctaagccatgcagtgacaccaattctgactccccagacgagggcctggatcacaatatccacataaaatgtaagagagagcaccaggggtactctagtgagtcctctatctgtgcgagtaagaggccatgcacggaggataccatgctggagctgcttttgaggctgaagcatttgtccctcaaaaatagcattacccacggtagcttttcaggctctttgcaagggtacccttcatcaggtgctaagagcctgcagtccgtcagctctatttctgatttgaactttcaaaatcaggacgagaatatgccatcccagtatctggctcagcttgcagcaaagcccttcttctgcgagctccagggctgtaaatacgagtttgtgacgagggaggcacttctgatgcactatcttaaaaagcacaattattcaaaggaaaaagtgctgcaactgacaatgttccagcaccggtactcaccttttcagtgccacatctgtcagagaagcttcactagaaagacacacttgaggatccactacaaaaataaacaccagatcggctccgatagggccacccataaactgctcgataacgaaaagtgcgatcatgaaggaccatgcagcgtcgacagacttaaaggggactgttcggctgagctcggaggagaccccagcagtaacagcgaaaaacctcactgtcatccaaagaaggatgaatgctcctctgagacagacctcgagtcgtcttgtgaggagaccgaatctaagacaagcgatattagctccccaataggatcccatagggaagaacaggaagggcgtgagggaagaggttcaagaagaacagtcgccaagggcaatctgtgttacattttaaacaaataccacaagccttttcattgtatccataagacgtgtaacagcagtttcaccaacttgaagggacttattcgacactacagaactgtgcatcagtacaataaggagcagctctgcctggagaaagacaaagctagaactaaaagagaactggtgaaatgtaaaaagatctttgcctgcaagtacaaagagtgcaataaaaggtttctgtgtagtaaggccctcgcgaaacactgctctgatagccacaatttggaccatatcgaagagcctaaggtgctgtcagaggcgggttctgcagctcggttttcgtgtaaccagccccagtgccctgccgtcttctacacctttaacaaactgaagcatcatcttatggagcagcataatatcgaaggagagattcatagcgactatgagatccactgcgacctgaacggctgcggtcagattttcacccaccggtcaaactatagccagcacgtgtattatcgccacaaagactactacgacgacctgttcagatctcagaaggtggcaaatgagagactgctccgctcagagaaagtctgtcaaacagcagatacccagggccacgagcaccaaaccactcggagatcgtttaatgcgaaaagcaaaaagtgcggactgatcaaagagaagaaggcccctattagcttcaagacacgggccgaggcactgcacatgtgcgtcgagcacagtgagcacactcaatatccctgtatggtccagggttgcctctctgtggtgaaactcgaatccagcattgtccgccattataaacgcacacaccagatgagctcagcatatttggagcagcagatggagaatttggtggtctgcgtaaaatacgggacgaaaattaaagaggaacctccaagtgaggcagacccctgcatcaaaaaagaagagaaccgatcctgcgagtccgaacgtactgagcacagtcattcgcctggcgattcgtcagcaccaatccagaacactgactgttgtcattctagcgagagagatggggggcaaaagggatgcattgaatccagcagcgtttttgatgctgacactctgctgtatcggggcaccttgaaatgcaaccacagctctaagaccacttcacttgagcagtgtaacatcgtgcagcctcctccgccatgcaagatcgagaactccatcccaaaccccaacgggacagaatccgggacatattttacttcctttcagctgcctctgccccgaataaaagagtccgaaacccgacagcacagctcaggccaggaaaatactgtgaagaatcctacccacgttcccaaggaaaatttccgtaaacatagtcagccaagaagcttcgacctaaaaacatacaagccaatgggatttgagagctcgtttctgaagttcatacaggaatcagaggaaaaggaggatgactttgatgactgggaaccctccgagcacctgaccctgtccaactcctcccagtccagcaatgacctaaccgggaatgttgtcgccaacaacatggtgaacgatagcgagcctgaagtggatattcctcattctagctcagactctaccatccacgagaacctgactgccatccccccccttatcgtggccgaaaccacgacagtgccttccctggaaaacctcagggtcgttctggacaaggccctcacagactgcggtgaacttgcactgaagcagctgcactacctcagacctgtagtagtgctggagaggagtaaatttagcactcccatattggacttgtttcccacaaaaaagactgacgagctgtgcgtaggatcctcatag

SEQ ID NO: 202715 - DNA, 1641 bp, Artificial Sequence
  Description of Artificial Sequence: Synthetic coding sequence
atgttctactaccccaacgtgctgcagcggcacaccggctgcttcgcaacaatctggcttgccgccacgcgaggcagccggctcgtgaagcgagagtatcttagggtcaatgtcgtgaagacttgcgaggaaatcttaaactatgtactagtacgcgtccaaccccctcagcccggtctccccaggccaaggttttctctgtaccttagtgcccagctgcagatcggggtcatccgcgtgtacagtcagcaatgccagtacctggttgaggatattcagcatatcctcgagcgtctgcatcgcgcccagttgcagattcggatcgacatggaaaccgaattaccatcccttttactgcccaaccaccttgccatgatggagaccctagaggacgcccccgacccctttttcggaatgatgtctgtagacccacggctgcccagcccgtttgatattcctcagatacgacacttactcgaagccgctatcccagagcgagtggaggaaatacccccggaggttccaacggaaccccgggagccagaacggattccggtgacagtcctgccgcccgaggccataacaattttggaggctgagccaatccgtatgttggaaatagagggtgagagagaactgcctgaagtgagcagaagagaactggacctgttaatagcagaggaagaggctatcttgctcgagattccccgcctgcccccaccagcaccagccgaggttgagggcataggcgaggcgcttgggcctgaagaactgcgcttgactgggtgggaacctggcgccctcctgatggaggtgactccccccgaggaactgaggctgcctgcccctccaagtcccgaaagaaggcctccagtgcctcctccacctcgcaggcgcaggcggcgacggctgcttttctgggacaaagagacgcaaattagtcccgagaaattccaggaacagttacagactagggcacactgttgggagtgtcctatggtgcagccacccgagcgcactatcagaggtccagcagaattgtttcgcacaccaacgttgagtggctggttgcctccggaacttctcgggctctggacacactgcgcgcagcccccccctaaggcgctgcggcgagagctgccagaagaggccgcggcagaggaagagcgcagaaagatcgaggtacccagcgagatagaggttcccagggaagcactcgaacctagtgtgcctcttatggtgagcctagagattagtctggaagctgccgaagaagaaaagtcaagaatttctcttatccctcccgaggagcgctgggcgtggcccgaggtggaagcgcccgaggcaccagctctccctgtggtgcctgagctgcccgaggtcccaatggaaatgccacttgtgctgccacctgagttagagctgctttcactagaagctgtgcaccgcgccgtcgctcttgagcttcaagccaaccgcgaaccggatttctcctctttagtgtcacccctcagcccaaggcggatggctgctagggttttttatttgctgctggtgttgtcagcacaacaaattcttcacgttaagcaggagaagccctatggcaggctactgatccaacctgggccacgtttccactag

SEQ ID NO: 202716 - DNA, 1590 bp, Artificial Sequence
  Description of Artificial Sequence: Synthetic coding sequence
atgttctactaccccaacgtgctgcagcggcacaccggctgcttcgccaccatatggcttgcagctactaggggctcaagactggttaagcgcgaatatcttcgggtcaatgtcgtcaaaacctgcgaagagattctgaactacgtcctggtccgggttcagccgcctcagcccggactacctaggcccagattttcgttatacctttccgcgcagctgcagattggggtcatccgtgtgtacagtcaacagtgccagtatctggttgaggacatccagcacatcctggaacgcctgcatagggcacaactgcagattaggatcgacatggaaacagagctgccctctttgctcctgcctaaccatttagcaatgatggagacccttgaggatgcgccagacccattctttggcatgatgtcagttgatccaagacttccttcaccattcgacatccctcagattagacacctcctcgaggccgctatccccgagcgggtggaagagattcctcccgaggtgccaacagagccgcgggagcccgagcggataccggttaccgtactgcctcccgaagcaatcacaattctggaagctgaacctattagaatgctggagatagagggcgaaagagagctaccagaggtgtcccggcgagaactggacctcctgatagcagaagaagaggctattctcctcgagattcctcgcctgccgccccctgcccccgctgaggttgagggaattggcgaggcactggggcctgaggagcttcgcctgaccggatgggagcctggtgccctcctgatgcggaggccacctgtcccacccccgccacgccggcgtaggcgacgcagactcctgttctgggataaagagacccagatttcacctgaaaaatttcaggagcagctgcagacacgggcccactgttgggagtgcccaatggtacaaccgccagagagaacgatacgggggcccgctgaactcttcaggacccctaccctgagtggatggctcccgccggagctgctcggactgtggactcattgcgctcaaccccctccaaaggctctgcggcgggagctccccgaggaagccgccgccgaggaggaacgtagaaagatagaggtgcctagcgagatagaggtcccacgagaggctctggaacccagcgtacctttaatggtctccctggagatctcactggaggcggccgaagaggaaaagtccaggatctcactcattccccctgaggaacgctgggcttggcccgaggttgaggccccggaggctcctgcgctgccagtagttccagagctgcctgaggttccaatggaaatgcctctcgtgcttccacctgaactggaactgttgtctctagaggcagtccacagggccgttgcgctcgaactgcaggctaacagagaaccagacttctcaagcttagtatcacctttgtccccccgcaggatggccgctcgcgtgttctatctgctgcttgtcctgtccgctcagcagatcctccatgtgaagcaggagaagccctacgggcgactgctgattcagccaggccctagatttcactag

SEQ ID NO: 202717 - DNA, 225 bp, Artificial Sequence
  Description of Artificial Sequence: Synthetic coding sequence
atgttctactaccccaacgtgctgcagcggcacaccggctgcttcgccaccatatggctggcagctactcgcggatctcgtctggtgaagagagaatatctacgcgttaatgtggttaaaacctgtgaggagatcctgaactacgtgctggtgcgcgtccagccgccacagccaggtttaccccgccccagattcagcctttacctttccgcacagctacagtag

SEQ ID NO: 202718 - DNA, 1641 bp, Artificial Sequence
  Description of Artificial Sequence: Synthetic coding sequence
atgttctactaccccaacgtgctgcagcggcacaccggctgcttcgctacgatctggctcgccgcgaccaggggcagccgtctagtcaaaagggagtacttgcgtgtcaacgtggtgaaaacctgcgaagaaattctgaattatgtgttagtgcgcgtgcagcccccacaaccaggtctcccccgccctaggttctctctttacctgtccgctcagctccagataggcgtcattagagtgtatagccaacaatgccaatatctagtcgaggatatccaacatatcctggagcgcctacaccgggcccagttgcagattcgcatagacatggagactgagctgcccagcctgctgttgccaaatcacttagcaatgatggaaacactcgaggatgcccctgatccgttctttgggatgatgtccgtggacccacgcttgcccagccctttcgacataccacagattcgacatttactcgaagcggccatcccagaacgagtggaggaaattcctcctgaggtgcctacggaaccacgggaacctgaacgtattcccgtgactgtcctgcctcccgaagctattaccatactggaagcggagcccatcaggatgcttgagatagagggagagagagaactccccgaggtgagtcgcagggaacttgaccttctgatcgctgaagaagaagcaattttgctggaaataccccgcctaccaccacctgcccccgccgaggtggagggcatcggggaagctttagggcccgaggagctccggttgacaggctgggagccgggcgccctcctgatggaggtaactccacccgaagagctgcggctgcccgctcctccttctcctgaaaggaggcccccggtgccacctcccccccggcgtcgccggcggagaaggttgttgttttgggataaagaaacccagatttcacctgagaagtttcaggagcaattacagacccgggcccattgttgggagtgccccatggtgcaaccacctgaacggaccatcagaggcccagcggagcttttccgcacaccaactctgagtggttggctgccccctgagctgctcgggctttggactcactgcgcacagccccccccaaaagcgcttaggcgagagctccctgaagaagccgcagctgaagaggaacgcaggaaaatagaggtcccgagcgagatcgaggttcctcgggaggccttggaacctagtgtacccctcatggtcagtcttgaaatttccctggaagcggcggaagaggagaagtcccggatcagcctgatccctccggaagagaggtgggcttggccagaagtcgaggctccggaggcgcccgctcttcctgtggttcccgagctgcctgaggtgccaatggagatgcctttagtgttgcctcctgaactggaactactttccttggaagccgtgcacagggctgttgcactggaattgcaggctaatagggaaccggatttctcatccctggttagccccctttccccaaggcggatggcagcccgtgttttttatctgctgctcgttctttcggcacaacagatcctccatgtgaagcaggaaaaaccatatggacggctgctcatccagcccggtcctcgattccattag

SEQ ID NO: 202719 - DNA, 699 bp, Artificial Sequence
  Description of Artificial Sequence: Synthetic coding sequence
atggccggcgacaccgaggtgtggaagcagatgttccaggagctgatgagagaagtcaagccctggcaccgctggacactcaggcccgacaagggactgttgcccaatgtgctaaagcctggatggatgcagtaccagcagtggacttttgcccggttccagtgtagtagctgttcgcgaaactgggcctcagcacaggtgctggtactgtttcatatgaactggtcggaggagaagtccagagggcaagttaagatgagagtatttacacaacggtgcaagaaatgtccgcaaccacttttcgaggaccccgaatttacccaggagaacatttctagaatcttaaaaaatctggtgtttaggatactgaagaaatgctaccgtggtaggttccagctgatcgaagaggtcccgatgatcaaagacatctcgctggagggcccgcataattcagataactgtgaagcctgtcttcagggcttctgtgccgggccaattcaggttacctctctgccaccttcacagaccccgcgagttcattctatatacaaggtcgaggaggtcgtgaagccatgggcctctggtgagaacgtttactcctatgcttgccaaaaccatatatgtagaaatctgagtattttctgctgctgcgttatcctcattgtgatcgtggtaattgtagtgaaaaccgcaatctag

SEQ ID NO: 202720 - DNA, 741 bp, Artificial Sequence
  Description of Artificial Sequence: Synthetic coding sequence
atggtggtggacttctggacctgggagcagaccttccaggagctgatccaagaagctaagccaagggcgacatggaccctgaagcttgatggtaacctgcagctagattgtcttgcccagggatggaaacaataccagcagagggcctttggatggtttcggtgtagctcctgccagagatcttgggcttcagcccaagtccagattttgtgtcacacatattgggagcactggacatcccaaggtcaggtccgcatgcgcctcttcggccagagatgtcagaaatgctcttggtcccagtacgagatgcccgagttttctagcgactccacaatgagaatcctgagcaatctggtgcagcatatcctgaagaaatactacggaaacggcacgaggaagagccccgagatgcctgtgattctggaggtctctctggagggttcccacgatacagccaattgcgaagcctgcactttaggtatctgtgggcagggtttaaagtcttgtatgactaagccatccaaatccctcttaccacaccttaagacggggaactcatctccgggaatcggcgctgtgtacctcgccaaccaggcaaagaatcaatcagctgaggctaaagaggctaaggggtcagggtacgagaagctcgggccatctcgtgacccagaccctcttaatatttgtgtgttcatcttgctcctggtgtttatcgtggtgaagtgcttcacctcagaatag

SEQ ID NO: 202721 - DNA, 447 bp, Artificial Sequence
  Description of Artificial Sequence: Synthetic coding sequence
atggcccgggccctgtgccggctgccccggcggggcctgtggctgttactcgctcaccacctttttatgactacggcatgccaggaagctaactacggcgctcttctgagggaactctgcttgacccagttccaggtcgatatggaggccgtcggcgaaactctctggtgtgattggggtagaacaatccggagctatagagagttggctgactgcacctggcacatggccgagaagctgggatgcttctggcccaatgccgaggtggatcgcttcttccttgcagtgcatgggcgctattttaggagctgtccaattagtgggcgagcagtcagggatcccccgggatcaatcctgtaccccttcatcgtggtacccatcaccgtgacactgctggtcactgcccttgtggtttggcagtctaaaagaacggaaggaattgtgtag

SEQ ID NO: 202722 - DNA, 381 bp, Artificial Sequence
  Description of Artificial Sequence: Synthetic coding sequence
atgaccaccgcctgccaggaggccaactacggcgccctgctgcgggagctgtgtttgacccagtttcaggttgatatggaagcagtcggcgagaccctgtggtgcgattggggcaggaccattcgcagctatcgtgaattagctgactgcacttggcacatggccgagaagttgggttgcttttggccaaatgcagaagtagaccgcttctttctggctgttcacggccgctacttccggtcttgtcccatcagcggacgcgctgtacgtgatccacccggtagcatcttataccccttcatcgttgtccccatcaccgtgacactgctggtgactgcgctcgtggtgtggcagagtaaacgcaccgaaggtattgtctag

SEQ ID NO: 202723 - DNA, 381 bp, Artificial Sequence
  Description of Artificial Sequence: Synthetic coding sequence
atgaccaccgcctgccaggaggccaactacggcgccctgctgcgggagctgtgcctgacccagtttcaggttgacatggaagcagtgggggagaccctctggtgtgactggggcaggacaattcgctcctaccgcgagttggctgactgtacgtggcacatggcagagaagctggggtgcttctggcctaacgcagaggtggaccgtttctttttagcagtgcacggccgatacttccgttcctgtcctatcagcgggagggccgtgcgcgatccgcctggctctatattatacccttttatagtggtacctatcaccgtcaccttgttagtgactgcactggtggtgtggcaatcaaagaggactgaaggaattgtctag

SEQ ID NO: 202724 - DNA, 381 bp, Artificial Sequence
  Description of Artificial Sequence: Synthetic coding sequence
atgaccaccgcctgccaggaggccaactacggcgccctgctgcgggaactgtgtctgactcaatttcaggtggatatggaggcggtcggtgaaaccttgtggtgcgattggggaagaaccatacggtcctatcgggagctggcggattgcacttggcacatggcggaaaagttagggtgcttttggcctaacgctgaggtggacaggttctttctcgctgtgcacggtcgatattttagaagctgtccaatatccggcagagcagtgagggatccaccgggatcaatcctgtatcccttcattgtggtcccaataaccgtcactttacttgtaaccgctctggttgtttggcagagtaagagaacggaggggatcgtgtag

SEQ ID NO: 202725 - DNA, 528 bp, Artificial Sequence
  Description of Artificial Sequence: Synthetic coding sequence
atggccagcctgcgggtggagcgggccggcggcccccggctgcccagaactcgggtgggtaggcccgctgccctccggcttttgctcctgttgggcgccgttctcaatccccacgaggccctggcacagcccttgccaacaaccggtactccaggatcagagggtggcaccgtcaaaaattacgagactgccgttcaattttgctggaatcactataaggaccagatggacccgatcgagaaggattggtgcgactgggctatgatttcaagaccttattccactcttcgcgactgcttagagcacttcgctgagctttttgatctgggcttccctaacccactcgcggagcgtataattttcgagacccatcagattcactttgccaattgctctttggttcagcccactttttcagacccgcctgaagacgtgctgttggcgatgatcatcgccccgatctgcctaattccttttctgataaccctggtggtgtggcggtccaaagactcagaggcacaggcctag

SEQ ID NO: 202726 - DNA, 447 bp, Artificial Sequence
  Description of Artificial Sequence: Synthetic coding sequence
atggagaccggcgccctgcggcggccccagctgctgcccctgctgctcctgttgtgtggaggttgtccacgtgctggcgggtgcaacgaaacgggtatgctcgagagactgcccctctgcggaaaagcgttcgcagatatgatgggaaaagtcgacgtctggaaatggtgcaatctgtcggaattcatcgtctactacgaatccttcacaaactgcaccgaaatggaagccaacgtggtggggtgctactggccaaacccactagctcagggattcatcacaggaatccatcgacagtttttttccaattgcacagttgatagagtgcatctcgaagatccgccagatgaggtgctcataccgctgatagtgatacctgttgtgttaaccgtcgctatggccggtctggtcgtgtggaggtccaagcgaaccgatacgctgctgtag

SEQ ID NO: 202727 - DNA, 447 bp, Artificial Sequence
  Description of Artificial Sequence: Synthetic coding sequence
atggagaccggcgccctgcggcggccccagctgctgcccctgctgcttcttctgtgtggcggatgcccgagggccgggggatgtaacgaaacagggatgctggaaagactgccgctctgtggtaaagcctttgccgatatgatgggtaaggtggatgtgtggaaatggtgcaatctgagcgagttcatagtctattatgaaagctttacaaactgcactgagatggaagccaatgttgtcgggtgttattggcctaaccccctggctcaggggtttattactgggatccaccggcagttttttagcaactgcaccgtggatcgggtgcacctggaggatccccctgacgaagtgctgatacccctaattgtaatcccggtggtgctcaccgtggccatggccggactggtcgtatggcggagtaagcggacagacactctcctgtag

SEQ ID NO: 202728 - DNA, 456 bp, Artificial Sequence
  Description of Artificial Sequence: Synthetic coding sequence
atggagaccggcgccctgcggcggccccagctgctgcccctgctgttgctcctgtgtggtggatgccccagggctggcggctgtaatgagacaggcatgctggagagactgcccctttgtggcaaagcttttgcggatatgatgggaaaggtcgacgtatggaagtggtgtaacttatccgaattcattgtgtactacgagtccttcacgaactgtactgaaatggaagctaacgtcgtgggttgctactggccaaaccccctcgcacagggtttcattacaggcatccatcgccagttctttagcaactgtactgtcgatcgggtgcacctagaggatccgcctgacgaagttctgattccactcatcgtgattccggttgtgctgaccgttgctatggctggtctggtagtctggaggagcaagaggacagacaccctcttatgtggtaactag

SEQ ID NO: 202729 - DNA, 606 bp, Artificial Sequence
  Description of Artificial Sequence: Synthetic coding sequence
atggtgagctggatcatcagccggctggtggtgctgatcttcggcactctgtacccagcctactactcgtacaaggctgtgaagagcaaggatatcaaggagtacgttaaatggatgatgtactggattatttttgcactgtttacaaccgcagaaacctttaccgatatttttttgtgttggttccctttctactatgaactgaaaatagcatttgttgcttggctgctcagcccctataccaaggggagttcactgctttaccgcaagtttgttcacccaacactcagctctaaagagaaggaaattgacgattgccttgtccaagctaaggatcgctcctacgatgccctcgtccacttcgggaagagaggccttaacgttgccgctacggcggccgttatggctgcctcgaaaggacagggtgccttgtccgaacgcctcagaagtttctccatgcaggatctgaccacgattcgaggtgatggggcccctgcccccagtggcccaccaccgccgggctccggtcgggcgagcgggaagcacggacagcccaaaatgtctcgttcagcttccgagtcggcttcttcgagtgggacagcttag

SEQ ID NO: 202730 - DNA, 525 bp, Artificial Sequence
  Description of Artificial Sequence: Synthetic coding sequence
atggaccacctgcaggccggcggcgtgaagtggatgatgtactggataatctttgccctgttcaccactgctgaaaccttcactgatatctttttgtgctggtttccattctactatgaattgaaaattgccttcgtcgcttggctgctttccccatatacaaaagggtcttccctgctttatcgtaagttcgtgcatccgactttgtcctctaaagaaaaggagattgacgactgtttggtgcaagctaaagatagaagctacgacgcgctcgtgcactttggcaaacgcggactcaatgtagctgccactgctgcggtgatggctgcgagtaagggccagggagccctcagcgagaggctgcggtcctttagcatgcaggatctgaccaccattaggggtgatggtgccccagcaccttcgggccctcctcccccaggctctggtcgcgcatcgggtaaacatggacagccaaagatgagccggagcgcctctgagtcagcttctagcagtggcactgcctag

SEQ ID NO: 202731 - DNA, 627 bp, Artificial Sequence
  Description of Artificial Sequence: Synthetic coding sequence
atgcagaaggtgctgagcaacggccagaccgaggaggtgcggagcggtagccggctcattttcggaaccctgtatccagcatattactcctacaaggcagtgaagtccaaggacattaaagaatatgtaaaatggatgatgtattggattattttcgctctgttcacaactgctgagaccttcactgatatttttctctgctggttccctttttattatgagctgaagatcgcttttgtagcctggctcctgtcaccgtacacaaaggggtcaagtttgctgtatagaaagttcgtgcacccgactctcagtagcaaagagaaagagattgatgactgtctcgtccaggccaaggatcgctcctacgacgcactagtccatttcggcaagcgtgggctcaatgtggccgctacagccgccgtcatggccgcaagcaaaggacagggcgctctgtccgagaggttgaggagcttttcaatgcaggacttaactaccattcggggtgacggagcccccgcaccctcggggcctcctccccctgggtcaggtcgggcctcaggcaaacatggacaacccaaaatgtcaagatctgcaagcgagagtgcatcctccagcggaaccgcgtag

SEQ ID NO: 202732 - DNA, 543 bp, Artificial Sequence
  Description of Artificial Sequence: Synthetic coding sequence
atgagcctgcacccctgccggctgaacaacctgcccaaccaggtgaagtggatgatgtattggatcatttttgcgctctttacaactgctgaaactttcacagatatatttctgtgctggtttccgttctactatgaactgaaaattgcatttgtggcttggctgctgtctccgtatacaaaggggtcttcactcttataccgtaagttcgtgcatccaacgctttccagcaaagagaaggaaatcgacgattgcttggtccaggccaaggaccgaagttacgatgcccttgtccactttggcaaacgcggtctcaatgttgcagctaccgcagcggtgatggctgccagcaagggtcagggcgctctctctgagagactgcggtccttttccatgcaagacctcaccacgattagaggtgatggcgcacctgctccaagcgggccccccccccccggctcaggccgggcatccgggaagcatggacagcccaagatgagtcgatcagccagtgagtctgcaagttcttcaggcaccgcgtag

SEQ ID NO: 202733 - DNA, 432 bp, Artificial Sequence
  Description of Artificial Sequence: Synthetic coding sequence
atggtgagctggatcatcagccggctggtggtgctgatcttcggcactctctatcctgcctattacagctacaaagcagtgaagtcaaaggacatcaaagagtacgtgaaatggatgatgtactggataatttttgctctctttacgaccgcagagaccttcacagacatttttctgtgctgggatcgtgtgccctatagacgtgactgcggtgcctctgcttgccggactagtcccccatcgggcgagaccgcccctctgctgccccgggccccacatcatagagggcttggcggccctgccgcaaacaccgcgtccctacgatgtccgggtgttctgctccgcgctcttgctgcccaggctcctcccaggattttgagaagccgcttcagaaagaagtcgacatcttcatccgcaacagagacgacttag

SEQ ID NO: 202734 - DNA, 759 bp, Artificial Sequence
  Description of Artificial Sequence: Synthetic coding sequence
atggtgagctggatcatcagccggctggtggtgctgatcttcggcacgttgtaccccgcctactcgagctacaaggctgtgaaaaccaagaatgtaaaagaatatgttaagtggatgatgtattggatcgtgttcgctttttttaccactgccgagaccctcacagacatcgtgctcagctggttccccttttactttgaactgaagatcgcattcgtaatctggcttctatctccatacactaaggggtctagtgtgctatatcggaaattcgtccaccccaccttgagcaacaaggagaaagagatcgacgagtacatcactcaggccagggataaatcttacgagacaatgatgcgcgtgggaaagcggggactgaatttagccgctaatgctgccgttacggccgcagcaaagggggtgctcagcgagaaactcaggagcttcagcatgcaggatctgactctgatccgcgatgaggatgccctcccactacagaggcccgacggtagactgcggccttctcctgggagtttgttggacacaatcgaggatttaggtgatgaccccgcacttagcctgcggagcagtacaaatccagccgacagtagaaccgaagcatctgaagacgacatgggtgacaaagctcccaagagggccaagcccattaagaaagcgcccaaagccgagccacttgctagcaaaacacttaagacacgacccaagaagaagacatctggcgggggcgacagcgcctag

SEQ ID NO: 202735 - DNA, 765 bp, Artificial Sequence
  Description of Artificial Sequence: Synthetic coding sequence
atggtgagctggatcatcagccggctggtggtgctgatcttcggcaccctgtaccctgcgtattcctcatacaaggccgtgaaaacaaagaatgtcaaggagtatgtgaagtggatgatgtactggatagtgttcgctttctttaccactgccgagaccctaaccgatatcgtcctaagttggtttcctttctattttgagcttaaaattgcttttgtgatctggctgctgagcccctatactaagggctcctccgtcctgtaccggaagttcgtgcaccccactctgtcaaacaaggagaaagagatcgacgagtacatcacccaggctagggacaagtcctatgaaacaatgatgagggtcggtaaacgcggtcttaatttagccgccaacgccgccgtgacagcagccgccaaagggcagggcgtactgtcagaaaagctgaggtcattctcaatgcaggaccttacactgattagagacgaggatgcactacctctccagaggcccgatggaagactgcgcccttcccccggatccttactggacacaatcgaggacctgggggacgacccggccctgtcccttagatcgtctactaatcctgcagacagtcggactgaggccagcgaggatgacatgggggataaagcccctaaacgagccaagccaatcaaaaaggcccccaaagccgagcctctggcatccaaaaccttgaagactcggccgaaaaaaaaaacctccgggggaggcgacagcgcatag

SEQ ID NO: 202736 - DNA, 723 bp, Artificial Sequence
  Description of Artificial Sequence: Synthetic coding sequence
atgctgtaccccgcctactacagctacaaggccgtgaagaccaagaatgtgaaggaatatgtaaggtggatgatgtactggatcgtctttgcactgtatacagtaatagagaccgtagcggaccagaccgtcgcctggttccctctgtactacgaattgaagatcgcgtttgtgatctggctgctcagcccctatacaaaaggagcctcgctgatctatcgtaagttcctgcatcctctcctgtcgagcaaggagagggagattgatgactatattgtccaggctaaggaaagaggatatgaaaccatggttaactttggacgacagggtctaaacctggccgccacagctgctgttaccgcagccgttaagagccagggggccataaccgagaggctgcgctcgttcagcatgcatgacttaactaccatacagggagatgaaccagtcgggcagcgtccctaccagcctctcccggaggccaagaaaaagtctaaacctgccccatctgagagcgccggatacggcattcccttgaaggacggcgatgaaaaaactgacgaagaggctgaggggccttactctgacaacgagatgctcacacataaaggactgcggcgaagtcagagcatgaaatctgtgaagacgacgaaagggcgcaaggaggtgcggtacggctccctgaagtacaaggtgaagaagaggccacaggtatacttttag

SEQ ID NO: 202737 - DNA, 768 bp, Artificial Sequence
  Description of Artificial Sequence: Synthetic coding sequence
atggtgagctggatgatcagccgggccgtggtgctggtgttcggcatgttgtatccagcatattattcctacaaagccgtgaaaacaaaaaacgtgaaggaatacgtgaggtggatgatgtactggatcgtgtttgcactctatacggtgatagaaaccgtggcggatcaaacagtggcttggttccctctctactacgagctgaagattgcgtttgtcatttggttactgagcccttatacaaagggtgctagtctgatttaccgaaaatttctccacccattactgtcttctaaggagcgagaaatcgatgactacatcgttcaggccaaagaaagaggatatgagacaatggtgaactttggtagacagggcctcaacttagccgctaccgcagccgtcactgcagccgtgaaatctcagggagccatcaccgagagactgagatctttcagcatgcatgacttaaccacgattcagggagacgagcccgttggccagaggccctaccagccactgcctgaagcaaagaaaaaatccaaaccggctccgtccgagtccgccgggtatggcatcccactgaaagatggagatgagaaaaccgacgaggaagctgaagggccttattcagacaatgaaatgctcactcataaaggactaagacggtcgcagtccatgaagtctgtgaaaactactaaaggaaggaaggaagtacgctacgggtcattaaaatacaaggtcaagaagcggcctcaggtgtacttttag

SEQ ID NO: 202738 - DNA, 774 bp, Artificial Sequence
  Description of Artificial Sequence: Synthetic coding sequence
ctgatgatgtggctgctggtggagcgggccctgatccagctggtgttcggaatgctctaccctgcttactatagctacaaggcggtgaagacaaagaacgttaaagaatacgtaagatggatgatgtactggatcgttttcgccctctacaccgttatcgaaactgttgccgatcagactgtggcatggttccccctgtattatgaactgaagatcgcattcgtgatctggctgctgtctccttatacgaagggagcctccctgatttaccggaagttcctgcacccactactgtcaagcaaggagagagagatagacgattacatagtacaagctaaagagagaggctacgaaaccatggtgaattttggtcgacaaggtctgaacctcgctgcaacagctgcagttactgccgccgtcaagtctcagggggccattacagagcgacttcgatccttcagtatgcatgacctgacaacaattcagggagatgagcctgtcggccagaggccatatcagcctctgccagaagctaagaagaagtcgaaacccgcgccttctgagagcgcaggctatgggattcctctgaaagacggcgatgaaaaaacagatgaggaggcagaggggccttactcagacaacgaaatgctgacccacaagggactccggaggtcccagtccatgaagagtgtgaagaccacaaagggcaggaaagaggtcaggtatggctccttgaaatataaggtgaaaaagcggccccaggtatacttctag

SEQ ID NO: 202739 - DNA, 774 bp, Artificial Sequence
  Description of Artificial Sequence: Synthetic coding sequence
atggtgagctggatgatctgccggctggtggtgctggtgttcggcatgctgtgcccagcatatgcttcctacaaggcagttaaaactaagaatattagagagtacgtgaggtggatgatgtactggattgtgttcgccctgttcatggccgctgagattgtaactgacattttcataagctggtttccattttactacgagatcaagatggcgttcgtcttgtggctcttatcaccttataccaaaggcgctagcctcctgtatcgtaagttcgtacacccttccttgtccaggcacgaaaaagaaatcgacgcctatatcgtgcaggccaaggagagaagctacgagactgtgttgtctttcggcaagagaggactgaatatcgccgccagcgcggcagtgcaggcggcgacaaaatcacagggagccctggccggccgcttgcgctccttctcaatgcaagacttaagatccatttcggatgctccagccccagcttaccatgaccctctgtatctagaggatcaggtatctcacaggcggccccccatcggatatagagcaggaggtctgcaggatagcgacaccgaggacgagtgctggtccgacacagaggctgttcccagagctccagctcgcccccgtgagaaacctttaatcagatcccagagcctgcgcgtcgtcaaaagaaaaccaccggtgcgagaaggaacaagccggagtctgaaggttagaacacggaagaagacggtgccatcggacgtcgactcatag

SEQ ID NO: 202740 - DNA, 522 bp, Artificial Sequence
  Description of Artificial Sequence: Synthetic coding sequence
atggtgagctggatgatctgccggctggtggtgctggtgttcggcatgctttgccccgcgtacgcttcttacaaagccgtgaagaccaaaaacatccgagagtacgtccggtggatgatgtactggatcgtatttgccctattcatggccgcggagatagtgacggacatttttatctcgtggtttccattctactacgagatcaaaatggcctttgtgctgtggctgctgtccccctacacgaaaggtgcatctctgctatataggaagtttgttcatccctcactcagtcggcacgaaaaagagatagatgcctatattgtacaggccaaagagcgttcctacgaaactgtgctatcctttggtaagcgtggattgaatatcgcggccagcgccgctgtgcaggcagctacaaaagggacgggacccggcgcttgtcgaacagcaactccgcgcatgtccgttgggcagatcctccggcagtcgccagggcgtcaacccggtcctgagaggtcaccctag

SEQ ID NO: 202741 - DNA, 570 bp, Artificial Sequence
  Description of Artificial Sequence: Synthetic coding sequence
atgagcgccgccatgcgggagcggttcgaccggttcctgcacgagaagaactgcatgactgacttgctcgctaagctggaggctaaaacaggcgtcaatcgctcattcatcgccctcggtgtgatcgggctagtggcactgtacctggtcttcggatatggggcctccctcctgtgcaatcttattggctttggttaccccgcgtatataagcattaaggccatcgaatctcccaataaggaagatgacactcagtggctgacatattgggttgtttatggggtgttcagcatcgcggaatttttttccgatatttttttgagttggttccccttctattacatgctcaagtgcggtttcctgctgtggtgtatggctccatcaccctctaacggtgctgaactgctgtataaaaggattattcggccattttttctgaagcacgagtcacaaatggactcagtggtgaaggacttgaaagacaaggcaaaggaaacagctgatgccataaccaaagaagccaagaaggctacggtgaacctgctgggtgaagagaagaaatcaacatag

SEQ ID NO: 202742 - DNA, 396 bp, Artificial Sequence
  Description of Artificial Sequence: Synthetic coding sequence
atgagcgccgccatgcgggagcggttcgaccggttcctgcacgagaaaaactgcatgactgacttactagcgaaactcgaggccaaaacaggagtcaacaggtcctttatcgccttgggcgtgatcggtctggtggccctgtatttagtgttcgggtatggggcaagcctgctgtgcaacttgattgggtttggatatcctgcctatatctccattaaggccattgagtctccaaataaagaggatgacacacagtggctcacttattgggttgtgtacggagtatttagtattgctgagttttttagcgacatattcctgtcttggtttcctttctactatatgcttaaggtgtggtcagggctgggtttcctacttccacgctgcttattatag

SEQ ID NO: 202743 - DNA, 1413 bp, Artificial Sequence
  Description of Artificial Sequence: Synthetic coding sequence
atgcacttcagcatccccgagaccgagagccggagcggcgacagcgggggatccgcctatgttgcctataatattcatgtgaatggggttctgcattgcagagtccggtactcccagctcctcgggttacacgagcagctgaggaaagagtacggggccaatgtgctccccgcgtttcctccaaaaaagctgtttagcctgacacccgcggaggtggagcaaaggagggagcaactggagaagtacatgcaagcagtccgccaggacccactgctcggcagttcggagacattcaatagctttctcagacgtgcacaacaggagacccaacaggtgcccacagaggaggtcagcctagaggtcttgcttagtaatgggcagaaggtcttagttaatgtactgacatccgaccagaccgaggatgtcctagaggcagtggctgcaaagttggatctgcccgatgatctaataggctattttagcctgttccttgttcgtgaaaaagaagatggcgcgttctccttcgttaggaaactccaggagtttgaattaccttatgtttcagtcacttccctgcgcagccaggagtacaaaatcgtgctgcgaaagagctattgggactcggcatacgatgatgatgtcatggagaatcgcgttgggcttaacctcctgtacgcccaaaccgtgtccgatatagaacgagggtggattctggtgacgaaagagcagcacagacagctgaaaagcctccaggagaaggtctctaagaaagaattcctgaggctggcacagacactgaggcactacggttatctgaggttcgacgcgtgtgtggcggatttcccagagaaagactgccccgtcgtggtcagtgcagggaatagcgagttgtctcttcagctgcggctgccaggccagcaacttagagaaggatcatttcgtgtcacacgcatgcgatgttggcgggtgacctcaagtgtacctttgccctcaggatctactagctctccaggtagaggcaggggcgaagtcagactcgaactggctttcgaatatttgatgtctaaggaccgacttcagtgggttacaatcacatcaccacaggcgataatgatgagcatttgcttacagagcatggtcgacgagttaatggtcaagaagagcgggggcagtatacgcaagatgctaaggcgcagggtaggaggtacgctaaggcgatccgatagccagcaggcggtaaagagtccacctcttctcgaatccccagatgccactagagaatctatggtgaaactctcctctaagttaagcgcagtttctctacgagggataggctcaccctctaccgacgcttccgccagcgatgtgcatgggaactttgccttcgaagggataggtgatgaagacctttag

SEQ ID NO: 202744 - DNA, 2814 bp, Artificial Sequence
  Description of Artificial Sequence: Synthetic coding sequence
atgcaccggccccggcggcggggcacccggccccccctgctggccttgttggccgccctgctgctggcagcccggggtgctgcagctcaagaaactgagttgagtgtaagcgctgagctggttccaacctcctcttggaacatctcttcagagctgaacaaagacagctacctgacgctggacgaacctatgaacaatattaccacatcccttggacaaaccgcagagttgcattgtaaagttagtggaaaccctccacctacaattagatggttcaagaacgacgctcccgttgttcaggaaccaaggcgtctttcttttaggagcactatttacggaagcagacttcggattcgaaacctggacacaactgacacaggctacttccaatgtgttgccacaaatggaaaggaggtggtttctagcacgggcgttttgtttgtcaaattcgggcctcctcccacagcgagccccggatactctgatgaatatgaagaggatggcttttgccagccttatagaggtatcgcttgcgctcgcttcataggaaatcgcacagtgtatatggagtccctgcatatgcagggagagattgaaaaccagatcacagcagccttcactatgatagggacatcgtcccatctgagcgataaatgttctcagtttgctattccttccctttgtcattacgccttcccttactgcgacgagacatcttccgtcccgaagcctagggacctgtgtcgcgatgaatgtgagattctggagaatgtgctgtgccagacagaatatattttcgccaggagcaaccctatgatcttaatgagactaaaactgcccaactgcgaggatctaccccagcccgagtccccagaggctgccaactgtattaggatcggaatccccatggccgacccgatcaacaaaaaccataaatgctataactcaacaggcgtcgactaccgcgggacagtgagtgtgacaaaatcagggcgacagtgccaaccttggaattctcagtacccccatactcatacctttaccgccttgcgattcccggagttaaacggcgggcactcatactgtcgcaacccaggaaatcaaaaggaggccccctggtgtttcacccttgatgaaaattttaagtccgatctctgcgatataccggcctgcgacagcaaagactccaaagagaaaaataaaatggagatcctgtatatcctcgtcccatctgtagccatccccctggctattgctctgctgttcttttttatttgcgtctgtaggaataatcagaagtcatccagcgcccctgtgcagcgccaaccaaaacacgtgagaggccagaatgttgaaatgtccatgctaaatgcttataaacccaaatcaaaagctaaagaactgccgctctctgcagtgcggttcatggaagagctgggggagtgcgcttttggaaaaatatataagggacacttatatttaccgggcatggatcatgcgcaattggtcgccattaaaacactgaaggattataacaatccacaacaatggacagaattccagcaggaggcgtcactcatggcagagctgcaccacccgaatattgtgtgtctgttgggagccgtcacccaggagcagcccgtctgcatgttattcgagtacataaaccagggggacctgcacgagttcctcatcatgagatcaccacacagtgacgtgggatgctccagcgacgaagacggcacagtcaaatcaagtcttgatcacggggattttctgcacattgctatccagattgcagccggaatggaatacctgtcttcacacttttttgtccacaaggaccttgccgcccgcaacatcctcatcggtgagcagctacacgtcaagatctccgatctgggactgtctcgcgagatatacagcgccgactattacagagtccaatccaagagcctgctacccatacgatggatgccccccgaagctatcatgtatggcaaatttagctctgattcagatatttggtctttcggggtcgtcctttgggagatattctcattcggactccagccatattatgggttctctaaccaggaggtaattgagatggtgcgcaaaagacagctactgccttgctcggaagattgtcctcctcgaatgtatagtctcatgactgaatgctggaatgagataccttcgagaagaccccggttcaaggatatccacgttcgactgcgctcttgggagggtctttcttctcacaccagctctaccacacctagtggtggaaacgctacaacccagactaccagcctcagcgcctccccagtatcgaatctgagcaaccccaggtatcctaattacatgtttccctcccaaggtataaccccacaggggcaaatcgcaggctttattgggccacccataccacagaaccagcgctttattccgatcaatgggtatcctatcccccctggctacgctgcctttcccgccgcgcactaccagccaactgggcctccgagggtaatccagcactgtcccccgcctaagtcaagatcaccatccagcgccagtggtagcacaagcactggacatgtgacttccctccccagtagtggcagtaaccaggaagccaatattcctctcctcccgcatatgtccatccccaatcatccaggggggatgggcatcaccgtttttgggaataagtcacagaaaccttacaaaatcgactccaagcaggcgagccttctcggggatgcaaatattcatggacacaccgagagtatgatctccgctgagctttag

SEQ ID NO: 202745 - DNA, 1182 bp, Artificial Sequence
  Description of Artificial Sequence: Synthetic coding sequence
atgcaccggccccggcggcggggcacccggccccccctgctggccttgcttgcagcactcctgctcgccgcacgcggggcggcggcccaggagactgaactgagtgtgtcagccgaactggtgcctaccagtagctggaacatctcttcagaactgaacaaagacagctatttgacactggacgagcccatgaacaacataacaacaagtttgggccagaccgccgagctgcactgcaaggtctcaggcaatccaccgcccacgattcggtggtttaagaatgatgctcccgtcgtgcaagaaccaagacgcctgagcttccgttcgaccatctatgggtcaaggttgcgcatccgcaacctggacacgacggatacggggtacttccaatgcgtcgccactaacggtaaggaagtcgtttccagcactggcgtgctctttgttaagttcggaccgccccctactgcctctcccgggtacagcgatgaatacgaggaggacggcttttgtcagccttatcgcgggattgcttgcgcacgctttattggcaataggacagtgtatatggaaagcctacatatgcagggggagatagaaaaccaaattacagccgctttcaccatgattggaacatcctcccatctgtctgacaagtgctctcagttcgcaataccctctctgtgtcactacgccttcccctattgcgacgagacttccagcgtgcctaagccacgggatctgtgtagagatgaatgcgagatcctggagaacgttttgtgtcagaccgaatatatctttgccagaagcaatcctatgatactgatgcgcctcaagttgcccaattgtgaagatctcccccagcctgagtccccagaggccgccaattgcatccggatcggtataccgatggctgatccaattaataaaaaccacaagtgctacaacagtacaggcgttgactatcgcggtaccgtttctgttaccaagtccggtagacaatgccagccttggaactcccagtatcctcatactcacacctttacagcccttaggttccccgagcttaatggagggcattcctactgccggaatccgggaaatcagaaggaggctccatggtgtttcacacttgatgagaatttcaagtccgacttgtgcgacatcccggcttgtggaaagtag

SEQ ID NO: 202746 - DNA, 2823 bp, Artificial Sequence
  Description of Artificial Sequence: Synthetic coding sequence
cgggcccggggctgcagcgcccggcggcggggcacccggcccccccttttagccctgcttgccgccctcttgctggccgcccggggcgccgccgcacaagagactgaattatccgttagcgccgaactggtgcccacttccagttggaacatatcttccgaactgaacaaggattcctaccttacgctggatgagccaatgaacaacatcaccacctccctgggccagaccgctgagctccactgcaaagtctctggaaacccaccacccactatcaggtggtttaagaacgatgcacctgtggtgcaggagcccagacgattgagcttccgctccacgatctacggcagcaggctgagaataaggaacctagacactacggacactggttatttccagtgtgtggccacgaatggcaaagaggtcgtcagtagcaccggcgtgctatttgttaagtttggacctccccccaccgcatcccccggttatagtgacgaatacgaagaggacggattctgccaaccgtaccggggcattgcttgtgccagattcatcgggaaccgaactgtctacatggaatctttgcatatgcaaggggagatcgagaaccaaattaccgccgcattcacaatgatcggcacatcctctcatctgagcgataaatgcagccagttcgcaatcccaagcctatgccactacgcattcccatactgcgatgagacgagctctgtgcccaaacctcgagacttgtgccgggatgagtgcgagatcttggaaaatgtgctgtgccagaccgagtacatctttgcgagatccaacccgatgattttgatgcgtttgaagcttccaaactgcgaggacctgccccaaccggagagccccgaggccgcaaattgtatccgcattggcataccaatggctgaccctattaacaagaaccataaatgctacaactccaccggagtcgattatcgcggcactgtgagtgtgacaaagtcaggccgccagtgtcagccttggaactcccaatatccacatacacacacatttacggccctccgttttccggagctgaatgggggccattcctactgccgcaatccagggaaccagaaagaagctccgtggtgttttaccctggatgagaactttaagagtgatctgtgcgacattccggcatgcgacagcaaggatagcaaggagaagaacaaaatggaaatactttatattctcgtgccgtccgtcgccattccgcttgcaatcgctctgttattctttttcatctgcgtttgtaggaacaaccagaagtccagttccgcaccagtgcagcgccagcccaagcacgttcgcgggcagaacgtggaaatgtccatgcttaatgcctacaagccaaagagtaaggctaaagaactcccactgagcgcagtaaggtttatggaagagctgggagaatgcgcgttcggaaaaatatataaggggcatctgtatctgcccgggatggatcacgcccagctggtagctattaaaacactcaaagactacaataatcctcagcagtggaccgagtttcagcaagaagcgtctcttatggcagagctccaccatcctaacatcgtctgcctgctcggcgctgtgacacaggaacagcccgtgtgcatgctcttcgaatacatcaatcaaggagacctccacgagttcctgattatgcgctcccctcactcagatgtgggttgcagttccgatgaggatgggacagtcaagtcaagtctggaccacggagactttctgcatatcgccattcagatcgctgccggcatggagtatctcagttctcacttcttcgtgcataaggacctggctgctagaaacatcctgattggagaacagctgcacgtgaaaataagtgatctcggattgtctcgggaaatctacagtgccgattattaccgcgtgcaatcgaagtctttgctgcccataagatggatgcccccggaggcaatcatgtacggcaaattctcatctgactccgatatctggagcttcggcgtagtgctctgggagatcttctctttcgggctgcagccttactacggctttagcaatcaggaagtgatcgagatggtgagaaagcgccaattattaccctgcagtgaggactgtccccctagaatgtattctttaatgaccgagtgttggaatgagatccctagtcgtaggccaaggtttaaagacatccacgtgcgcctgcgttcgtgggaaggtttatcttcccacacgagctctacaacgccttctggtgggaatgcgacaacacagaccacatcactttctgcgtcaccagtgtctaatttgagcaacccacggtacccaaactacatgtttccatctcaaggcattactccccagggacagattgccggattcatcggaccaccgattccccaaaatcagcgctttattccaattaatggataccccattcccccagggtatgctgctttcccggccgctcactatcagccaaccgggccgccacgagtgattcaacactgcccaccccccaagtcacgctcaccctcaagtgcatctgggtctacctccactggtcatgtgactagtttgcctagcagcggatccaatcaggaggcgaacatacctctgctgcctcatatgtccatacccaaccaccctggcggtatgggcatcacggtcttcggcaataaaagccagaaaccctacaagatcgattcgaagcaggcgagcctgcttggcgatgcaaacatccacggacacaccgagagcatgatctccgccgaactctag

SEQ ID NO: 202747 - DNA, 1167 bp, Artificial Sequence
  Description of Artificial Sequence: Synthetic coding sequence
atgctgttcgagtacatcaaccagggcgacctgcacgagttcctgataatgcgctcaccacattcggatgtcggatgttccagcgacgaagacggtaccgttaaaagtagcctcgatcatggtgactttcttcacattgcaattcagatagctgccggaatggagtacttgagttctcatttctttgttcacaaggacctcgcagctcgaaacatcctaattggcgaacaactgcacgttaaaatttcggatctgggcctgtcccgagagatatacagtgcagactattatcgagtccagagtaaaagcctcctcccaattagatggatgccgccagaggctatcatgtacggcaagttctcctcagatagtgacatctggtcatttggcgtcgttctctgggagatcttttccttcggcttgcaaccctattatggattttccaaccaggaggtcatcgagatggtgagaaagcgccagctgctgccctgctccgaggactgccctccgagaatgtactctctcatgaccgagtgttggaacgagatccccagtcgccgcccacgattcaaagatatccatgtgaggttgcgctcctgggaaggactttccagccacacttccagtaccaccccctccgggggaaacgcgactactcagaccacttcattaagtgcttctccagttagcaatctcagcaatccccgatatccgaattatatgttccccagccagggcatcactccgcaaggacagatcgcagggttcattggaccacctattccccagaaccagcggttcatccccatcaacgggtacccaataccaccaggatatgcagcattcccggccgcacactaccagcccacaggaccccccagagtaattcagcactgcccgcctcccaaatccaggtcaccctcgtctgcatccggaagtacctccacggggcatgtcacgagcctacccagcagtgggtcaaatcaagaagccaacatccctctgctaccccatatgtcgatcccaaatcatccaggtggaatgggaatcactgtgttcggcaataagtcacagaagccctacaagatcgactccaagcaagcctctcttcttggggacgcgaatatccacggtcataccgaatctatgattagcgcagagctctag

SEQ ID NO: 202748 - DNA, 2832 bp, Artificial Sequence
  Description of Artificial Sequence: Synthetic coding sequence
atggcccggggcagcgccctgccccggcggcccctgctgtgcatccccgccgtgtgggccgcagcagcattgctcctgtcagtttcacggacctccggcgaggtcgaggtgctcgaccccaacgatccactcggccccctggatgggcaggacggacctattcccacccttaagggatactttctaaattttctcgaacctgtgaacaacatcactatcgtccaaggacagactgcgattctgcactgcaaagttgccggtaatccgcccccgaatgtacgctggcttaagaacgatgctcccgtggtgcaagagccccggagaatcattatccgcaaaaccgaatacggatccaggctgaggattcaggaccttgataccacagacaccggatattaccagtgcgtcgccaccaacggaatgaaaaccataactgctacaggggtcctatttgtccgactgggccccacccattcccccaatcacaactttcaggatgattaccacgaagacgggttttgccagccttataggggaatagcttgcgcgaggtttattggaaatcggacaatctacgttgacagcctgcaaatgcagggggaaatagaaaatcgaatcactgcagcctttacgatgatcggtacatctacccacctatccgatcagtgttctcaatttgccatcccatctttctgtcactttgttttccctctctgcgatgctcgatcacggacgcctaagccccgtgaactgtgccgcgatgagtgtgaagtcttagagtccgacctctgcagacaggagtacaccatcgccagatccaatccactcatcctgatgaggttgcagcttccaaagtgtgaagctctgccaatgccagagagccctgacgctgctaattgtatgaggataggcattcccgctgagcgacttggtagataccaccagtgttataacgggtccgggatggactacagggggaccgcatctaccacaaagtccgggcaccagtgccaaccctgggccctgcagcacccacattcacaccatttgagctcgacagatttccccgaattgggcggtgggcatgcttattgccggaatccgggagggcagatggaggggccctggtgctttacacagaataagaatgtgcgcatggagctgtgtgatgtcccttcatgtagccccagagacagcagcaaaatggggattctgtatatattggtcccttctatcgcaatcccactggtgatcgcatgtttattcttcttagtgtgcatgtgtcggaataaacagaaggctagtgcctctaccccacagcgccgtcagctgatggcgagtccttcccaagacatggagatgcctctgatcaatcaacacaagcaggctaagcttaaggagataagtctctccgccgttcggttcatggaagaactgggcgaggacaggtttggtaaggtgtacaaaggtcacctatttggcccagcaccgggagaacaaactcaagccgttgccatcaaaaccctcaaagacaaggctgaaggccctctccgggaagagttccggcatgaagcaatgctgagggccagactgcagcacccaaatgtggtttgcctgttaggagtggtcaccaaagaccagcccctgtctatgatattctcatactgtagccatggggacttacacgagtttttggtgatgcgctcgccacactccgatgtgggctctacagacgatgatagaactgtgaaaagcgccctcgagcctcctgatttcgttcatctggtggcacaaatcgccgccggtatggaatatctgagttctcaccacgtagtgcacaaggatctggccacccgcaacgtgttggtgtatgataagctgaatgtgaaaatctcagacctagggctattccgagaggtgtacgcagcggattattacaagctgctgggtaattccttgctgcccattcgttggatggcccccgaagccatcatgtacggcaagttttcaatcgatagcgatatttggagttatggcgtcgttctgtgggaagtgttctcttacggccttcagccttattgtgggtactctaaccaagatgttgtggagatgattagaaaccgacaagtgctgccatgtcccgatgactgccctgcttgggtgtacgcactaatgattgagtgttggaatgagtttccaagtcgtcgaccccgtttcaaagatatccactctcgcctccgcgcttgggggaatctgagcaattataattctagcgctcagacctccggagcttccaacacaacccagacttccagtctctctacttcacccgtgtccaacgtctccaacgcccgctatgtggggcccaagcaaaaggctccacctttcccacagcctcagtttatcccaatgaaaggacagatacgtccaatggtgcccccaccccagctgtatgtgccggtgaatgggtaccaacccgtgccagcatacggggcctatcttccgaacttttatcccgtacagattcccatgcagatggcacctcaacaggtcccccctcaaatggttcctaagccaagctcccatcactccgggtctggatctacatcgaccgggtatgtaactacagcgcccagtaacacaagcatggctgatcgtgccgcattgctcagtgagggcgcggatgatacccagaacgcccctgaagatggggcgcagagcaccgttcaggaagcagaggaagaagaagagggatctgtgcccgaaaccgagctgctaggcgactgtgacaccctccaggtcgatgaagcccaggttcagctcgaggcttag

SEQ ID NO: 202749 - DNA, 1239 bp, Artificial Sequence
  Description of Artificial Sequence: Synthetic coding sequence
atgggccaggaccagaccaagcagcagatcgagaagggcctgcagctgtaccaatcaaatcagactgaaaaggctctccaggtgtggaccaaagtgctcgaaaagagtagcgatctcatgggacggtttcgcgtgctaggttgtctggtgactgcccacagcgagatgggccgatacaaagagatgctcaagtttgccgtggtgcagatcgacacggcccgcgagctggaagacgccgactttctcttagaaagctatctgaacctcgctcggtctaacgaaaagttgtgcgaatttcacaaaaccatttcatattgtaagacatgcctcggcctgcccgggacgagagccggggcccaactcgggggacaggtttctctgtcaatgggtaatgccttcttgggcttgtccgtgttccagaaagcgctggagtctttcgaaaaggcgctcaggtacgcccacaacaatgatgacgccatgttggaatgtcgcgtttgctgtagcctaggctccttctacgcccaggtgaaggattacgagaaagctcttttttttccatgtaaggcagcagaactcgttaacaattacggcaaggggtggagtctgaagtatagggctatgtctcagtaccatatggctgtggcgtatagactactgggaaggttgggtagtgctatggagtgttgcgaagagagcatgaaaatcgcattgcaacatggagaccggcccctgcaggctctctgcctgctatgcttcgctgatatccaccgttctagaggagaccttgaaactgccttccctagatatgattctgccatgagcatcatgacagagatcggcaatcggctggggcaggtgcaggccctgcttggcgtggccaagtgctgggttgcccgtaaggccctcgataaagcgctggacgctatagagagggctcaggacctggccgaagaggttgggaacaaattgtcccagctgaagcttcattgcttaagtgagagcatctataggtctaaggggcttcagagagaattgcgagcacatgtggtaagattccatgagtgcgttgaagagaccgaactgtactgtggcttgtgcggggagtcaataggagagaaaaacagccgactgcaagctcttccttgcagccacatttttcacctgagatgtctgcagaataatggcacaaggagttgccctaactgccgccggtcatcaatgaagcctggtttcgtctag

SEQ ID NO: 202750 - DNA, 1062 bp, Artificial Sequence
  Description of Artificial Sequence: Synthetic coding sequence
atgggccaggaccagaccaagcagcagatcgagaagggcctgcagttgtatcagagcaatcagaccgagaaggccctccaggtttggacgaaagtgctcgagaagtcttcggatttgatgggcaggtttagggtcctgggatgtctggtaactgcccactcagagatggggcgatacaaggagatgctcaagtttgccgtggtgcaaatcgacacagctcgtgaactggaggatgcagatttcctcctagagagctatctgaacctggccaggagcaacgaaaaactttgtgagttccacaaaaccatctcgtattgcaagacatgcctaggactgccaggaacccgggcgggcgcccagctggggggccaggtgagcctctcaatggggaatgcatttctcgggctttccgtgttccaaaaagctttggaatccttcgagaaggccctgaggtacgcacacaataacgacgatgccatgctggagtgcagagtgtgttgcagcttaggaagtttttatgctcaagttaaagactacgagaaggccttattctttccgtgcaaggcggccgagttggtcaacaattacggtaaaggctggagcctgaaatatcgcgcaatgtcccaataccacatggccgtagcgtataggctattgggtcgccttgggtctgctatggagtgctgtgaggaatccatgaagattgctttacagcacggagacaggccgctgcaggccctttgccttctgtgtttcgcagatatacaccggtctagaggcgatctcgagttgtcccagcttaaacttcactgtctttcagagagtatttaccggagtaagggactccagcgcgaactgcgtgcacatgttgtcagatttcacgaatgcgtggaggaaaccgaactctactgtgggctgtgcggagagtccattggcgagaagaatagccgcttgcaggcgcttccctgtagccacatctttcacctccgctgtctccagaataacggaacgaggtcttgcccaaattgcagacgatctagtatgaagccgggatttgtgtag

SEQ ID NO: 202751 - DNA, 2010 bp, Artificial Sequence
  Description of Artificial Sequence: Synthetic coding sequence
atgggcaccgccctggtgtaccacgaggacatgaccgccacccggttgctgtgggatgaccccgaatgcgagatcgagcgcccagagaggctgacagcagcgcttgaccggctgcggcagcgaggtctcgagcagaggtgcctgcgactcagcgccagagaagcttcagaggaggagctgggccttgtccatagcccggagtatgttagtctcgtgagagagacccaagtgttgggcaaggaggaactgcaagcattgagcggacagttcgacgccatatactttcatccgtccacctttcattgtgcccgcctcgccgctggagctggtctgcagcttgtggacgcagtgctgacaggagctgtacagaacggtctagcacttgtacgtccaccagggcaccatgggcaaagggcagccgccaacggtttctgtgttttcaacaatgtcgctatagcagcagcccatgccaagcagaaacatgggctccacagaatacttgtggtcgactgggatgtgcatcacggccagggcatccagtatctttttgaggacgaccctagcgttttatatttcagctggcaccgctatgagcatgggagattctggcccttcctgcgcgagtcagatgccgacgccgtggggcgaggtcaggggctcggctttaccgtgaatctaccatggaaccaggtcggaatggggaatgctgactacgtcgcggcattcttgcacttgctgctcccactggcgttcgagttcgatcctgagttggtcctggtgagtgcgggatttgactcggcaatcggggacccagagggacagatgcaagctactcctgaatgttttgcccaccttacccagctcctgcaggtgttggccggaggaagagtttgcgcagtactagagggcgggtatcatctagagagcctggcagagagtgtctgcatgacagtacaaactctcctgggcgaccccgctccacccctgtccggccctatggccccctgtcagtctgctctagagagtatacaatctgctcgggccgctcaggccccccattggaaaagcctgcagcaacaggatgtcaccgcagtgccaatgagcccatccagccatagtccagagggacgaccaccacccctcctgccgggaggcccagtttgcaaggccgcagcctctgctccgtcgtctctgctggaccaaccttgtctctgcccagccccatctgttcggaccgcggttgcactgactacccctgacataacccttgttctcccacccgatgtcattcagcaagaggcctccgcattgagggaagagaccgaagcctgggcccggccccatgaatcactcgcccgcgaagaagcgttgacagctctcggaaagctgctctacctcctggacgggatgcttgacggccaggtgaattctggaatcgctgcaacacctgccagcgccgcagcagcaaccttagacgtggccgttcggcggggccttagtcacggcgcccaacggttactatgtgttgcgctggggcaattggacagaccccccgatctggctcatgacggaaggagcctgtggctcaacatccgcggtaaggaagctgcggctctgagtatgttccacgtctcaactcccctgcctgttatgaccggtgggttcctctcatgcatattgggattggtcctccctctcgcttatggatttcagccggacctggttctcgttgctctaggacctgggcacggactgcaaggaccccacgctgcgcttcttgccgctatgctaagaggcctggccggcggacgcgtgctggcacttctcgaggagaacagtacaccacagttggcaggtatattagcgcgcgtgcttaatggggaagcacctccgtcactgggccccagctcggtagcttcgcccgaggacgtgcaagccttgatgtacctacgcgggcagcttgagccacagtggaagatgctgcaatgccacccccaccttgtagcctag

SEQ ID NO: 202752 - DNA, 1206 bp, Artificial Sequence
  Description of Artificial Sequence: Synthetic coding sequence
atgcagcggtgctggcagggcgacccccgggtgcggcccaccttccaagagatcacatccgagaccgaagacttgtgcgagaagcccgacgatgaagtgaaagaaaccgctcatgatttagatgttaagtcacctcccgagccacgcagcgaggttgtaccggcgcgcctgaagcgagcaagcgccccaaccttcgataatgactactctttgagcgagctcctgagccaactagacagcggtgtcagccaggcggttgaaggccctgaggaactctctcgtagctccagcgagtcaaaacttccttcctccggctccggtaaacggctgtcgggcgtgagttctgtggactcggcattttccagtagaggctccttgagcctatcgtttgagagggaaccttccacaagtgacctgggaacaactgatgtgcagaagaaaaagttggtcgacgccattgtcagcggcgatacttccaaactgatgaagatcctccagccacaggatgtcgacttggccctggattccggagcttcactgcttcacctcgccgtcgaggctggccaggaggagtgcgcgaagtggttattattaaacaacgcaaaccccaacttgtccaatagacgaggatccacccctctacacatggcagtggaacggagggtcagaggtgtcgtagagctgctgctggcaaggaagatctcagtgaatgctaaggacgaagatcaatggactgccttacatttcgcggcccagaatggtgacgaatcgtctactaggctgttacttgagaagaacgccagtgttaacgaggtcgacttcgagggccgcactccgatgcatgtggcatgccagcacggccaggaaaacatcgtgcggattctgctgcgccgaggggtggacgtgagcctgcaaggcaaggatgcatggcactgtaccaccctagcggggccccctgcccataggcaagctgctggtcaggctgctggtggagagtgcgagcgaccggacgccggttgggaagatgcaattgcccccggccgaacggcccgagcgttaccgaggggaccccacccccatagacccgtgctcagacgccaaaggctgcagccagccggcacggacacccccgcccgacctcgccgtaggggaaccagagccctgcctggatgctcttgcattggagcacttgcccgtaggccgtag

SEQ ID NO: 202753 - DNA, 2355 bp, Artificial Sequence
  Description of Artificial Sequence: Synthetic coding sequence
atggagggcgacggcggcaccccctgggccctggccctgctgcggacattcgatgctggagaattcactggttgggagaaagtgggaagtggtggattcggacaggtgtataaagtgaggcatgtccactggaaaacctggctggccattaagtgcagtccctccttacacgtggatgacagggagaggatggaattgctggaagaagctaaaaagatggagatggcgaagtttcgatacattctacccgtatacggaatttgcagggagcccgtgggcctcgtgatggaatatatggaaactggctcactggaaaaactccttgcctccgagcctttgccttgggatctgcgctttagaatcattcatgaaacggctgttggaatgaactttctgcactgcatggccccccctctgctgcatttagatctgaagcccgcaaacattctgctggacgcacactaccacgtcaagatctctgacttcggactggcaaagtgtaacggcctgtctcacagtcacgatctcagtatggatggcctgttcggtactattgcatacttgcccccggagcggatccgagagaagagcaggttgttcgacacaaaacatgacgtttatagtttcgctattgtgatctggggcgtacttacccagaagaaaccatttgcggatgaaaaaaatattctccacatcatggtgaaggtggttaaggggcacaggccagagttgcctccagtgtgcagggctagaccccgggcctgtagtcatttgatccgcctgatgcagcggtgctggcagggggatccgcgggtacggccaacattccaagagattaccagtgagacagaagatctctgtgagaagccagatgacgaagtgaaagaaaccgcccatgacctggatgtgaaatcgcctccagagccaagatccgaagtcgtgcctgctagactgaaacgcgccagcgctcccacgtttgacaatgactatagcttatctgagttgctctcacagctcgattcgggcgtgagtcaggctgtggaaggccccgaagaattgtctcgttccagtagcgaatccaaactgccatcttctggttcgggaaagcgactgagcggagtgtcatctgtggacagtgcatttagcagtagaggctccttgtccctgagtttcgaaagagagccatccacctccgacctgggcacgaccgatgtacagaagaagaagctggtggacgccatcgtgtctggggatacgagcaaactgatgaagatcttgcagccacaggatgttgacctcgcacttgattctggtgccagtcttttgcacctcgctgtcgaggccggacaggaggagtgcgctaaatggctgctgcttaacaacgctaatcctaacctcagcaatcgccgcgggtccacccccttacacatggccgtggagcgtcgggtgcggggggttgtggagctgctactggctaggaagatcagcgtcaacgctaaggacgaagaccagtggaccgccctgcacttcgctgctcagaacggtgacgagtcatcgactagactattactggaaaaaaatgcctcggttaatgaggtggatttcgagggccgaacccccatgcacgtggcctgccaacatggacaggaaaacatcgtcaggatcctgttacggcgtggcgtagacgtaagtctgcagggcaaggacgcttggcttcctctccattatgccgcctggcagggtcacttgcctatcgtgaaattgctagctaagcagccaggcgtgtccgtgaacgctcagaccctagatgggagaacccctctccacctggctgcccagcgcggccactatcgtgtggcgagaatcctgatcgatctgtgctcagacgtgaatgtctgttctctcctcgcccagaccccactgcatgttgcggcagagacggggcacaccagtaccgcccgactgttactgcatagaggagccgggaaggaagctatgacctccgacggctatacagccctgcacctggccgccagaaacggacatctcgccaccgtaaaactgttggtagaagaaaaggccgatgtgctcgccagggggcccttgaaccagaccgcccttcatctggccgcagcacacggccacagcgaagtcgttgaggaactggtttctgcagacgttatcgatctcttcgatgaacagggtctatctgccctccatctggccgcccagggacgacatgcccagaccgtggagacccttctcaggcacggagctcacattaatctgcagtccttgaagtttcagggcggccacgggcccgccgccacactgctccgaaggtctaagacatag

SEQ ID NO: 202754 - DNA, 2499 bp, Artificial Sequence
  Description of Artificial Sequence: Synthetic coding sequence
atggagggcgacggcggcaccccctgggccctggccctgctgcggaccttcgatgccggtgaattcactggatgggagaaggtgggctcaggagggttcgggcaagtgtataaggtgcgccatgtccactggaagacttggctagccatcaaatgttctccaagtttacatgtggatgaccgagaaagaatggaactcctggaagaagctaagaaaatggaaatggcaaagtttcggtacatcctcccagtctatggtatttgtcgcgagcccgtcggtctggtgatggaatatatggagacggggtcgctggaaaagctgctggcttcagaaccacttccctgggacctgaggtttcgtataattcatgagacagccgtgggcatgaatttcctacactgcatggccccacccttattacacttggacctgaagcctgctaacattctgctagacgcccactaccatgtaaaaattagcgatttcggcctggcaaaatgcaatggcctttcccactctcacgacttgtccatggatggcctgtttgggacgatcgcatacctaccacccgaacgcataagggagaagtcccgactgttcgacaccaagcacgatgtttactccttcgcaattgtcatctggggcgtactgacccagaaaaaaccatttgcagacgagaagaacatcctacacatcatggtgaaggtggttaagggacaccggcctgaactgccaccagtctgccgagcccggccaagagcctgtagccatttgatccgattgatgcaacgctgctggcagggagaccccagggtcagaccaacctttcagggtaacggactaaatggggagctcataagacaggttctggccgctctgctacctgtcaccggccgatggcggtcacctggagagggattccgtctggaaagcgaggttattattagagtgacctgccccctaagcagtccccaggaaattacgtccgagacagaagacctgtgtgagaagccggatgacgaagtaaaagagactgctcatgatctcgacgttaaatcccctcctgagcccagaagtgaagtggtgccagctcggctgaagagagccagtgccccaacatttgacaacgattatagtctttccgaactgcttagtcagctcgactctggtgtgagccaggcagtcgaaggtcctgaagaactctcccgtagttctagtgaatcgaagctgccttcctctggcagcggtaaaagactctccggggtcagttcagtcgattctgctttctcctctaggggatccctgagccttagtttcgaacgggaaccaagcacctctgatctaggaaccacagacgtacagaagaagaaacttgtcgacgccatcgtgagcggagatacaagtaagttaatgaaaattttgcagccccaggatgtggacctcgctcttgactcgggcgccagcctcctccaccttgctgtcgaagctgggcaggaagaatgcgcgaaatggctgctgcttaataacgctaacccgaatctcagcaatcgacgcgggtctaccccactgcacatggccgtggagagacgggttcgcggcgtggtcgaactacttttggcgagaaagatttctgtcaatgctaaagatgaagaccagtggacagcacttcactttgcagctcagaatggcgacgaaagctctacccgcttgctgctggagaaaaacgcatccgttaacgaggtggactttgaggggcgcaccccaatgcacgttgcttgccagcatggacaggagaacattgtccgcatcctgcttcggagaggtgtggatgtctccctgcagggcaaagacgcctggctgccactgcactatgcggcctggcaggggcacctccctatagtcaagctgcttgcgaagcagccaggcgtcagcgtgaacgctcagaccctggacggcagaacgccccttcacctggcagcacagcggggacactaccgagtggccagaatcctaattgacctgtgttccgacgtgaatgtgtgtagcctgctggcccagacccctctgcacgtcgcagcagagaccggccacaccagtacggcgcgcctgctattgcatagaggcgctggtaaagaagccatgaccagtgacgggtacactgctttacatttggcggctcgcaacggtcacctggcgactgtcaagttactggtcgaggaaaaagccgatgtcctagcccgcggaccgttgaaccaaaccgccctacatctcgcggctgcccatggccactccgaagttgtggaggagctcgttagcgcggacgtgattgatctttttgacgagcaagggttgtctgctctacacctcgcggcgcaagggcgacatgctcaaacggtggaaaccttgctgaggcacggggcccatatcaacctccaatccctgaagtttcaaggggggcacggccctgccgctactttgctgcggcgctctaagacttag

SEQ ID NO: 202755 - DNA, 2166 bp, Artificial Sequence
  Description of Artificial Sequence: Synthetic coding sequence
atggagctgctggaggaggccaagaagatggagatggccaagttccgatacatcctacctgtgtatggaatctgcagggaacctgtgggactcgtgatggaatacatggaaaccggatcgctggagaagctgttagcgtcagagcctctcccttgggatttgcgcttccgcattatccatgaaacggctgtgggtatgaattttttacactgcatggcaccacccctgctgcatctcgatctgaagcctgcaaacattttgctggacgctcactaccatgtcaaaatcagcgacttcgggcttgccaagtgtaacggtctgtcacatagccacgatctgagcatggatggtttgttcgggactatcgcctacttgccaccggagaggatccgggagaaatcccggctgttcgacacaaagcacgatgtctattccttcgcgatcgtgatatggggtgtgctgacacagaagaagccttttgccgatgagaagaatatactgcatattatggtcaaagtcgtgaagggccacaggcccgaactccccccggtgtgccgagccaggcccagggcgtgtagtcacctcattcgattgatgcaacgttgctggcagggtgaccctcgagtgcggccaaccttccaggagattacttcagagacagaggatttatgtgagaagcctgacgacgaggtgaaagaaacggcccatgacctggacgtaaagtcaccccctgagcctagatctgaggtcgtgcctgcacgtctaaaaagagcctctgcgccgacgttcgataacgattatagtctgtcagagttactaagccagctcgacagcggtgtttcacaggcggttgagggaccagaagagttgtctcggtcatctagcgagagcaagttacctagcagtggttctggtaagagattgagtggtgtctcatccgtcgactctgcattcagcagcagggggtcactatccctcagttttgaacgggaacccagcacgtctgacttgggcaccacagacgtgcagaaaaagaaactggttgacgccatagtgtctggcgatacctcaaagttaatgaaaatcttacagccacaggacgttgacctggccctagatagcggagcctcattgctgcatctggccgtcgaagctggtcaggaggaatgtgccaagtggcttctcctcaataacgccaatccaaacctaagcaatcgacgcggatccacaccactccacatggcagtggaaaggagggttaggggcgttgttgaactcctgcttgccagaaagataagtgtgaatgcgaaggatgaggaccagtggactgcactacattttgccgcccagaacggggatgaatcctcaacaaggctgctcctggaaaaaaacgcgagtgtgaacgaggtagactttgaagggcgtacccccatgcacgtcgcatgccagcatgggcaagaaaatatcgtgcgcatcctgctgagaaggggagtggatgtgagtctccagggtaaagatgcatggctccctctgcactacgctgcctggcaaggacacttgcctatcgtgaagctgttggcaaagcagccaggcgtgagtgtcaatgctcagactctagatggccgaaccccactgcacctggcagcccagaggggacattaccgagtggcccggatcctcatcgatctgtgtagtgatgtaaatgtgtgctccctactggcacagactccactgcatgtagcggctgaaacggggcacacatccaccgctaggctgctgctccatcgcggggcagggaaagaggccatgacgtccgacggctacacggcgcttcatctggccgctagaaacgggcatttagcaacggtgaaattgctggtggaggagaaggccgatgtcctcgcacgtggccccttgaaccagactgccctgcacctcgccgcagcacatggacattccgaagttgttgaggaactggtgtcagccgatgtcattgatctgtttgacgagcaggggctgtccgctctgcatctggcagcccaaggaaggcacgctcagacagtcgagaccctccttcggcacggggcccacattaacctacagtccctgaagtttcagggcgggcatgggccagccgccaccctgctcagacggtcaaaaacctag

SEQ ID NO: 202756 - DNA, 2166 bp, Artificial Sequence
  Description of Artificial Sequence: Synthetic coding sequence
atggagctgctggaggaggccaagaagatggagatggccaagttccgctacattctcccagtctatggcatttgcagagagcctgtgggactagtgatggaatacatggaaactggttccctcgagaagctgctggcctctgagccgctgccgtgggatctccggttcagaatcatacacgaaaccgctgtggggatgaactttcttcactgcatggcaccacccctgctacacctggaccttaagcctgcaaatattctcttggacgcccactaccacgttaagatatctgattttgggctcgcgaagtgcaacggactttcacacagtcacgatttaagtatggacggcttatttggaactattgcctacctgcctcccgagcggattcgcgagaagagtcgactcttcgacaccaaacatgacgtctactcctttgcgatcgttatttggggggttctcactcagaagaaacctttcgctgatgaaaagaacattctgcatatcatggtgaaggtggtgaaggggcacagacctgaactgccccctgtgtgtcgggccagaccaagagcatgctcccacctgatcagacttatgcaacgatgttggcagggcgatccccgagtcaggccaacatttcaggaaattacgtctgagacagaggatctctgtgagaagccagatgacgaagtaaaggagacagcccatgatcttgacgtgaaatctccacccgagcctaggagtgaggtggtcccagcccggctgaagcgggcatcagcacccacattcgataatgactactcactgtcagaacttctctcgcaactggactcaggtgtttcgcaagccgtcgagggaccagaggaactctcccgaagttccagcgagagcaagctgccatcgtctggcagtggtaaaaggttatccggtgtatcttccgtagactcggcgttctcatctaggggatccctgtccctgtccttcgagagagaaccatccacttcagatctaggtactaccgatgtccagaagaaaaaattggtggatgcaatcgtgtctggagacacatccaaattgatgaagatcctccagccccaagatgtggacttagcacttgacagtggagcaagtcttctgcatcttgcagtggaagccggtcaggaggagtgtgcaaaatggcttctgctgaacaacgcaaatccaaacctttcaaacagacgtggatccacccctctccatatggccgtagaaagacgcgtgcgcggggtggtggagttgcttctggcccgcaaaatcagcgtgaatgcaaaagacgaagaccaatggaccgccctgcacttcgcggcccagaatggcgacgagtcctctacccggctgctgctggaaaaaaacgcgagcgttaatgaagtagatttcgagggacgcacaccaatgcacgtggcttgccagcacggccaagaaaatatcgtgaggattcttctgaggaggggggttgacgtttccctgcaggggaaagacgcctggctacctctgcattacgcagcttggcaaggccacctgcccatagtgaagcttctggcaaagcaacccggtgtatcggtgaacgctcagactctggacggccgcactcccttacatttggccgcccagagggggcattaccgagtcgccagaattttaatcgacctgtgctctgatgtaaatgtctgctccctgcttgcccagacaccgctgcacgtcgccgctgagaccggccatacgtccacggctcgattgttactccaccgcggagctggcaaggaggccatgacatctgatgggtatacagctttgcatcttgcggctcgcaatggccacctagcaacagtgaaattgctggtggaggagaaagccgatgttctggcccgcggccccctgaaccagactgccctccatctggccgccgcacacgggcactccgaagttgttgaagaactagtctctgctgacgttatcgatctttttgacgaacaggggctttccgccttgcacctagccgcacagggtcggcatgcccagaccgtggaaaccctgctccgccacggggctcatattaacctccaaagcttaaaatttcagggcgggcatggccctgccgccactttgttacgacgaagcaagacttag

SEQ ID NO: 202757 - DNA, 3132 bp, Artificial Sequence
  Description of Artificial Sequence: Synthetic coding sequence
atggccgccagcttcccccccaccctgggcctgagcagcgcccccgatgaaattcagcaccctcatatcaaattcagcgagtggaaatttaagttgttccgcgtgagaagcttcgagaagaccccagaggaggcgcagaaggagaaaaaggatagcttcgagggcaagccgtcattggaacagagccccgccgttctagataaggctgacggtcagaagccagtccctactcagccactcctcaaagcccatcctaagttttcgaagaaattccatgataacgaaaaggcacgcgggaaagcgattcaccaggccaatctcaggcacctgtgtcgcatctgtggcaattctttcagagccgacgaacacaacaggaggtatcctgtgcacggccccgtagacgggaagacgcttggcttgctgcggaaaaaggagaaacgagctacgtcttggccagacctgattgctaaggtgtttcggatagatgtcaaggcagatgtcgattcaattcatccgactgaattctgtcacaactgttggagtatcatgcacagaaagtttagcagtgccccctgcgaagtttactttccacgaaatgtaacaatggagtggcatccccacactccctcctgcgatatttgcaacacagcacgcagaggtctcaaacggaaaagcctgcagccgaatcttcagctctccaaaaagctcaagactgtgttggatcaggcaaggcaggcgcggcagcacaagcgccgtgcacaggccagaatctctagcaaagatgttatgaaaaagatcgccaactgttctaaaattcatctgtccactaagttacttgctgtggacttccctgagcactttgttaaatccatcagctgtcagatctgtgaacatatcctggcagaccccgtcgaaacaaattgcaagcatgtgttctgcagagtctgcatcctgaggtgccttaaggtcatggggtcctactgtccgtcttgtcggtatccttgctttccaacagacttggagagtccggttaagtcattcctaagtgtcctcaactccctcatggttaaatgccccgccaaagagtgtaacgaagaggtttctctggagaagtacaaccatcatatctcgtcccataaggagagtaaggaaatatttgtgcacattaataagggagggcgaccccgccagcatcttctgtctcttactcgaagagcacaaaagcacagactgagggaattgaagctccaggtaaaggcgttcgccgataaagaggagggaggcgatgttaagtccgtctgcatgactctcttcctgctggccctccgcgctcgaaacgaacaccgacaagcggatgaacttgaagcaataatgcagggaaaaggtagtggccttcagcccgccgtatgcctggcaatacgggtaaatacattcctctcttgctcacagtaccataagatgtatcgtaccgtgaaggctatcacaggtcgccagatctttcagcctctccatgctctccgaaatgcggagaaggtgctactgcctggttatcaccattttgaatggcagcctcccctgaagaatgtgtcaagcagcaccgacgtggggattattgacgggctcagcggactttcaagctctgttgacgactatccagtggatacgattgctaagcgatttcggtatgactctgctctggtgagtgcactcatggacatggaggaggatatcctcgaaggcatgagaagtcaggaccttgatgactacctgaatggccccttcacagttgtggtgaaagagagctgtgacgggatgggtgacgtgtctgagaaacatggaagtgggcccgtggtgcctgagaaggctgtgcgcttctcctttaccataatgaaaatcaccatcgcccactctagccagaacgtgaaggtcttcgaggaggcaaagccaaactcagaactttgttgtaagcctctttgccttatgttggccgatgagtcagatcatgagacgctgacagccattctttctccattgatcgctgagagggaggcgatgaagtcatcagagctgatgctggagctgggaggaatactacgcacatttaagtttatatttagagggaccggctacgacgaaaagttagtaagagaagtagagggtctggaggcatcagggtctgtgtatatctgcacgctctgcgacgccacccgcctcgaggcatctcagaatctggtgtttcattcaattacacgcagccacgcagaaaatcttgagagatatgaggtttggcgcagcaatccctatcatgagtccgtcgaggaattgcgagaccgagtgaagggcgtctctgctaaaccctttattgaaaccgtgccctccatcgatgccctgcattgcgacatcggtaacgcagcagagttctacaagatcttccaactggagatcggcgaggtctacaaaaaccctaatgcatcaaaagaggaacggaagcggtggcaggctacattggacaaacaccttcgcaaaaaaatgaaccttaagcctatcatgcggatgaatggtaattttgctagaaaattgatgactaaggagaccgtggacgcggtgtgtgaattgattccatccgaggagaggcatgaggcactccgggagctgatggatctgtacctcaaaatgaaacccgtctggcgttcttcgtgtccggccaaggagtgccctgagtccctttgccagtattcattcaatagccagcggttcgcggagctgctttccacaaaattcaagtatcgttacgaaggaaaaattacaaactacttccacaaaaccctggctcatgtacccgagattatcgagagagatgggagtattggagcctgggcaagcgagggcaatgagtccggcaataagctttttcggagattccgcaaaatgaatgccagacagagcaagtgttatgagatggaggacgtgctgaagcatcactggctgtacaccagtaagtatctccagaaatttatgaatgcgcacaacgcactgaagacctccggttttactatgaatccacaggccagtctgggcgacccattaggtatcgaagatagcctggagtctcaggactctatggagttctag

SEQ ID NO: 202758 - DNA, 1584 bp, Artificial Sequence
  Description of Artificial Sequence: Synthetic coding sequence
atgagcctgcagatggtgaccgtgagcaacaacatcgccctgatccagccaggtttctccctaatgaacttcgacggtcaggtattcttctttgggcagaaagggtggccaaagaggtcgtgccccacaggggtttttcatctagacgtcaagcacaaccatgtgaagttgaagcccacaatcttcagtaaggactcttgctacctaccacctttgaggtatcctgctacatgtacctttaaaggctccctggagtctgagaagcaccagtacattatccacggcggcaaaacccctaataacgaggtatctgataaaatatacgtgatgagcatagtatgtaaaaacaacaagaaagtgacctttagatgcaccgagaaggacctagttggtgatgtgccagaggctagatacggtcactccatcaatgtcgtatactcgagaggtaagtctatgggcgttctgtttggcggtcgctcctatatgccttctacccaccggaccaccgaaaaatggaattctgtcgcagattgcctgccctgtgtcttcctcgttgactttgaattcggttgcgcaaccagctacattctgcctgaactgcaggatggactgagttttcatgttagtatcgccaagaacgacactatatacatcctcggaggccacagcctggctaacaacattcgcccagccaacctctatcgaatcagagtcgaccttcccctcggctcccctgctgtgaattgcacagtcctgccagggggcatttccgtatcctcggctatacttacacaaaccaataatgatgagttcgtgattgtgggggggtatcagcttgagaaccaaaagagaatgatctgcaatatcatttccctggaagataacaaaatcgaaattcgggaaatggagacccctgattggacacccgacataaagcacagcaagatatggtttggatcgaacatgggaaacggaacagtatttttggggatccctggcgataacaagcaggttgttagcgaaggcttctatttctatatgttaaaatgtgccgaagacgacaccaatgaagagcagacaacattcacaaattcccaaacttccaccgaggatccgggcgatagtaccccctttgaggactccgaggaattctgctttagcgccgaggctaatagttttgacggcgatgacgagtttgacacctataacgaggacgacgaagaggacgagtccgagacagggtattggattacatgttgccctacatgtgacgtcgatattaacacttgggtgcctttctactctaccgagctgaacaagcccgctatgatctactgtagtcatggggacggacattgggtgcatgcccagtgcatggacctcgctgaacgcacgttaatccatttgagcgccggcagtaataagtactattgcaatgagcacgtggagattgccagggcactgcacacaccacagcgggttctgccactgaaaaagcccccaatgaaatctctaaggaagaagggatcgggcaagattctgactcccgcaaaaaagtccttcctgcgacgtctgttcgattag

SEQ ID NO: 202759 - DNA, 216 bp, Artificial Sequence
  Description of Artificial Sequence: Synthetic coding sequence
atgagcctgcagatggtgaccgtgagcaacaacatcgccctgatccagcccgggttctccttgatgaactttgacggccaggtgttcttttttgggcaaaagggttggcccaagcgtagctgcccgaccggcgtgtttcatctggatgtcaagcataaccatgttaagctgaagcctaccatcttcagtaaggactcttgttatttgcctccatag

SEQ ID NO: 202760 - DNA, 453 bp, Artificial Sequence
  Description of Artificial Sequence: Synthetic coding sequence
atgagcctgcagatggtgaccgtgagcaacaacatcgccctgatccagccaggcttcagcttaatgaattttgatggtcaggtcttttttttcgggcagaagggatggcccaaacgctcttgccccactggcgtctttcacctggatgtgaaacacaatcatgtaaaactgaaaccaacgattttctctaaggatagctgttaccttccccccctcagatatccagcgacctgcacgttcaaggggtccttagaatccgaaaagcaccagtacatcatacacggagggaagactccgaataatgaggtcagcgataagatttacgtaatgagtatagtgtgtaaaaataataagaaagtgacatttcggtgcacggaaaaggacctggtgggagatgttcctgaagctaggtatgggcattcaattaacgttgtgtacagtagagggaaatag

SEQ ID NO: 202761 - DNA, 6 bp, Artificial Sequence
  Description of Artificial Sequence: Synthetic coding sequence
atgtag

SEQ ID NO: 202762 - DNA, 1503 bp, Artificial Sequence
  Description of Artificial Sequence: Synthetic coding sequence
atggaccacaccgagggcagccccgccgaggagccccccgcccacgctccctcgcctggaaagtttggcgagaggccacctcctaaaaggcttactagagaggcaatgaggaactatctgaaggagagaggcgaccagacggttctgatactccacgctaaggtggcccaaaaatcgtatggaaatgagaaacggttcttttgccccccaccgtgtgtgtatctcatggggtcagggtggaaaaaaaaaaaagagcagatggaaagagacgggtgctctgagcaggagagtcagccttgtgccttcatcggaattggcaactccgaccaggagatgcaacagcttaatctggaagggaaaaattactgtactgccaagacactctatatttccgactctgataagcgaaaacacttcatgttgtcagtgaagatgttctacggaaacagcgacgacatcggcgtgttcttgtcaaaacgaattaaggtcattagcaagcctagtaagaaaaagcaatctctgaagaatgcagacctatgtattgcaagcggaacaaaggtggctctcttcaataggctgagatcacagaccgtgtcaacgcgctatttgcatgtcgaaggcgggaacttccatgccagttcccaacaatggggagcttttttcatacacctgctcgacgatgatgaatccgaaggcgaggagttcaccgtgcgtgacggatacattcattatggacaaaccgtaaaactggtgtgctccgtcacgggcatggctcttcctcgtctcatcatccgcaaggtagataaacagacagcactgctcgacgcagatgaccctgtcagtcaactccacaaatgtgcattttacttaaaagatactgagcggatgtatctgtgtctgtctcaggaaaggattattcagtttcaggcaaccccgtgccctaaagaacccaataaagagatgattaacgacggtgctagctggactattatctccacagacaaagctgagtacaccttctacgagggaatgggaccagttctggctccagtgaccccggtgccagtggtggaatctctgcaacttaacggtggcggagacgtggccatgctggagctgacaggtcagaacttcacccccaatctccgcgtatggtttggtgacgtggaggcagaaaccatgtatcggtgcggagaatcaatgctctgcgtcgttcctgacatctccgcctttcgtgagggctggcggtgggtgcggcagccggtgcaggtgcctgtgacattggtccgaaatgacggcattatatactcaacttcactgaccttcacctacactccagaacccggacccagaccacattgtagtgctgccggcgcaatcctgcgcgccaactctagccaggtgccccccaacgagtcaaataccaattcagagggctcttacacgaatgccagcactaactcaacttcagttacatcctcgacggctacggtggtgtcttag

SEQ ID NO: 202763 - DNA, 1461 bp, Artificial Sequence
  Description of Artificial Sequence: Synthetic coding sequence
atggcctggatcaagcggaagttcggcgagcggcccccccccaagcgactcacccgagaagctatgcgtaactacctgaaggaaaggggcgatcagaccgttctcatcctccacgccaaagtcgcccaaaaatcttacggaaatgagaagcgcttcttttgccctcccccctgtgtgtatctgatgggcagtggatggaaaaaaaagaaggaacagatggagcgagacggctgctcagagcaggagtctcagccctgtgcgttcatcggaatcgggaactctgaccaagagatgcaacagctgaatttagagggcaagaattattgcacagccaagaccctttatatctctgactcggataaacgcaaacactttatgttgtccgtcaagatgttctacggcaattctgacgacattggcgtgttcctcagtaagcggataaaggttatcagtaaacccagtaagaagaaacaatccctgaaaaacgccgacctttgcatcgcgagcggtacaaaagtagcgctcttcaaccgccttagaagtcagacggtctctacgcgctatctgcacgtagaaggaggaaacttccacgcgagctcacaacagtggggagccttcttcatacatctactggatgatgatgaatcagagggcgaagaatttacagtccgggacggatatattcactacggccaaaccgttaagcttgtctgcagtgttactggtatggcacttccacggcttataatcaggaaagttgacaaacagaccgctttgctggatgcggacgatccggtgagccagttgcataagtgcgcattctacctgaaagatactgaacgaatgtacctgtgtttgtctcaggaacggatcattcagttccaggctacaccatgtccaaaggaacctaacaaggaaatgattaatgacggagcctcatggacgattatttctactgacaaggctgaatataccttctacgagggcatggggccggtgctagccccagtcacgcccgtgccagtggtcgagtcgcttcaacttaatgggggaggcgatgtggcaatgctggagcttaccggtcagaattttacaccaaacctgcgggtctggttcggcgacgtggaagctgagactatgtatcgctgcggtgagagcatgctctgcgtggtgcccgacatctccgcattccgcgaaggttggcgatgggtgagacaaccagtacaagtgcctgtgacccttgtcaggaatgacggcattatctactccacctcccttacctttacatatacccctgaaccgggtccaagaccgcactgtagtgccgcaggcgcaattcttcgtgcaaactcctctcaggtgccccccaatgagtcgaacaccaattctgaaggtagttataccaacgccagtactaattctaccagcgtcacgagtagcacggcaacggttgtgagctag

SEQ ID NO: 202764 - DNA, 1458 bp, Artificial Sequence
  Description of Artificial Sequence: Synthetic coding sequence
atgggcggctgccggaagttcggcgagcggcccccccccaagcggctcacccgggaagctatgcggaattacctgaaggagcggggtgatcaaacagttctcatcttacacgctaaggtggctcagaagtcgtacggtaatgaaaagagattcttctgcccgcccccatgtgtctatctgatggggagtggatggaagaaaaaaaaggagcaaatggaaagagacggatgctctgagcaggaatctcagccatgtgcttttatcggaatcggcaatagcgatcaggagatgcagcaactgaacctcgaaggaaagaactactgcactgcaaaaacactttatatttctgatagtgacaagaggaaacatttcatgttatcggttaagatgttttacggcaacagtgatgacatcggcgtcttcctgagcaaacggataaaggtgatatctaagcccagcaagaaaaaacagtctcttaagaacgcagatctgtgcattgcctccggcactaaggtggccctgtttaatcggttgcgctcacagaccgtcagcactaggtatttgcacgtggagggaggaaatttccatgcgtcatctcaacagtggggagcttttttcatacacctcctggacgacgacgaaagcgaaggcgaggaattcacagtcagggacggttacattcactatggccagaccgtgaagctcgtttgctccgtgactggaatggcattgcctcggctgattatccgaaaagtggacaaacagacggcgctgctagacgcagacgaccccgtttctcagctgcacaagtgtgcgttttatttgaaggacaccgaacggatgtatttgtgcctgtctcaagaacgaattattcaatttcaggctactccatgtcccaaggaacccaacaaggaaatgatcaacgatggggcgtcgtggactataatttcgacagataaagctgagtacacattctatgagggaatggggcctgttttggccccggtgacacccgttcccgtggtcgagagcctgcagttgaatggtgggggagacgtcgcaatgctcgagctaactggccagaacttcacaccgaatctccgggtgtggttcggcgatgttgaggccgagacaatgtataggtgcggtgagtccatgttatgtgtcgtccccgatatatccgccttcagggaaggatggagatgggtgcgtcagcccgtgcaggtgcctgtaacgttggtgaggaacgatgggattatttattctacatccctgactttcacatacacccctgaaccaggcccacggccgcattgcagcgccgcaggggccatcctgagagcaaattcctcacaggtcccccccaacgaatccaatactaacagtgaaggctcttataccaatgcgagcactaactctacaagcgttacatcgagtaccgccactgtggtcagctag

SEQ ID NO: 202765 - DNA, 1464 bp, Artificial Sequence
  Description of Artificial Sequence: Synthetic coding sequence
atggcccccgtggtgaccggcaagttcggcgagcggcccccccccaagcgtctcactagagaagctatgaggaactacctcaaagagaggggagatcaaaccgtcctgattctgcacgccaaggtcgcacaaaagagctatggaaacgaaaagcgatttttctgtcccccgccctgcgtttacttaatgggctccgggtggaagaagaaaaaagagcagatggaacgagatggctgcagtgagcaggagtctcagccatgtgctttcatcgggatcggcaatagcgaccaagagatgcagcagctcaacctggagggtaaaaattactgtaccgcaaaaaccttgtacataagcgacagtgacaagcgcaaacatttcatgctcagcgttaagatgttctacgggaacagcgacgacatcggggtgttcctttcaaagcgaataaaagtgatctccaagcctagtaagaaaaagcagtccctgaagaacgccgacctgtgtattgcctcaggaactaaagttgccttatttaatcggctgagatcacagaccgtgagcacccggtatctgcacgtcgaaggcggtaatttccacgcatcatcacagcagtggggcgccttctttatacaccttctggatgatgatgagagtgaaggcgaggagttcactgtgagggatggttatattcattatgggcagaccgttaaactagtatgttctgtcacagggatggcccttccgcgactgattatccgtaaggtggataaacagaccgcattgctggacgccgacgatccggtgagtcaactgcacaagtgtgcgttttatcttaaggacactgagcgcatgtacttgtgtctgagccaggagcggattattcaattccaggccaccccgtgccccaaggagccgaataaggaaatgatcaacgacggggcttcgtggactataatctccactgacaaggctgaatacaccttttacgaagggatgggtcctgtgctggctccagtcactccagtacctgtagtggagagcctgcaactgaacggtgggggagacgtcgccatgctggagctgacggggcaaaattttactcccaacctgcgagtttggttcggcgacgtggaggccgaaactatgtatagatgcggagagagcatgctgtgtgttgtacctgacatttccgcttttagagagggctggaggtgggtgcggcagccagttcaagtgcccgtcacccttgtgcgtaatgatgggatcatctacagtacaagtctaacgtttacttacactccagagcctggaccgcgcccgcactgtagtgctgccggggctatccttagggcaaattctagccaagtccctcccaatgagtcaaatacaaattcagagggctcgtacacaaacgcgtctaccaactcgacatcggtgacttcttcgactgctacagttgtgtcttag

SEQ ID NO: 202766 - DNA, 1461 bp, Artificial Sequence
  Description of Artificial Sequence: Synthetic coding sequence
atggcctggatcaagcggaagttcggcgagcggcccccccccaagcgcctgacgcgcgaagccatgcggaactatcttaaggaaagaggcgaccaaactgtgttgatacttcatgctaaggttgcacagaagtcatacggcaacgagaaaagatttttttgcccaccaccctgcgtttacctgatgggctccggatggaagaagaagaaggaacaaatggagcgcgacggctgttcagagcaagagtcccagccatgtgcgttcatcggaatcgggaattccgatcaagagatgcagcagcttaatctagaaggcaagaactactgtacagccaagaccctatacatttcggactcagataagagaaagcatttcatgctctcagtcaaaatgttctacggaaactctgatgacatcggtgtttttctcagtaaaaggattaaagtcatcagcaaaccaagcaagaagaagcagtcactcaagaacgccgatctttgcattgctagcgggacaaaagtcgcactcttcaaccgtttaaggtcacaaactgtcagcacacggtacctacacgttgagggaggaaatttccacgctagctcacagcagtggggggccttttttatccacctgcttgacgacgacgagagcgagggtgaggaattcacagtgcgcgatggatacatacactacggccagacggtcaagttagtgtgctctgtgacaggaatggcactacctcgcctcattatccgcaaagttgataagcagacggcgctgttggatgccgacgatcccgtgagccagctccataagtgcgcgttttatctgaaggatactgagagaatgtacctctgcctgagccaggagaggataattcagttccaagccacaccatgtccaaaggagcctaataaggagatgattaatgacggagcttcctggaccattatcagtaccgataaagccgagtacaccttctacgagggcatggggcccgtcctggcgccagttacaccagtcccagttgtagaaagtcttcagctcaacgggggcggcgatgtcgccatgttggagctgacggggcagaacttcacgcccaatctacgggtctggttcggcgatgtcgaggcagaaacaatgtataggtgtggtgaatcaatgctgtgtgtggtccccgatataagcgccttccgagaaggatggcggtgggtgaggcaaccagtgcaggttccagtgactttggttaggaatgacggcataatctattctacttcattaacctttacgtacacccccgaacccggaccaagaccacactgctctgcagccggcgcgattcttagagctaatagcagccaggtcccaccaaatgaatccaacaccaactctgagggcagttatacaaatgcttctacaaattcgacctccgtcacctccagcacagctacggtcgtctcgtag

SEQ ID NO: 202767 - DNA, 1503 bp, Artificial Sequence
  Description of Artificial Sequence: Synthetic coding sequence
atggaccacaccgagggcagccccgccgaggagccccccgcccacgccccatctcctggcaagtttggtgaacgaccaccccccaaacgtctgacccgagaggctatgcggaattatcttaaagagcgtggcgaccagactgtgctcatcctgcacgctaaagtcgcccaaaagtcttacggaaacgagaagaggttcttctgcccccccccatgtgtctacctcatgggcagcgggtggaagaagaaaaaagagcaaatggaaagggatggatgtagcgaacaggagtctcagccctgtgcttttattggcatcggcaattccgatcaggaaatgcaacagttaaacctcgagggcaagaattattgcactgcaaaaaccctgtatattagcgacagtgacaaaaggaagcacttcatgttgagcgtcaagatgttttacgggaatagtgacgatattggcgtgtttctgtccaaaagaatcaaggtgatcagtaaaccatccaagaaaaagcaatctttaaagaacgctgacctgtgtatcgcttccggaacaaaagtggcgctcttcaatcgattgcggagtcaaacggttagcacgagatacctgcacgtggaggggggcaattttcacgcatcttcccagcagtggggcgcattttttattcacctcttagatgatgatgaatccgaaggcgaggagttcactgtgcgcgacggatacatccactatggccagaccgttaagcttgtgtgctcggtgaccggaatggctcttccgcgcctcatcattagaaaagtggataaacagacggcgctgctggatgccgatgaccctgtcagccagctgcataaatgtgctttttatttaaaggatactgagcgcatgtacctttgcctgtcccaggaacgaattattcagttccaggctaccccatgtcccaaagagccaaataaggagatgatcaatgacggtgctagctggactattatcagcacggataaagccgaatacaccttctatgaggggatggggcccgtcctagcacctgtaactcccgtcccagtcgtggaatccctgcaattaaacgggggcggcgatgtggcaatgttggagctcaccggtcagaacttcactcctaacctgcgcgtttggtttggtgatgtcgaggcagagactatgtatcggtgcggggagagtatgctctgtgtggtaccggacatttcagcttttagagaaggctggaggtgggtgcgacagcccgttcaggtgccggtgaccctcgtacggaatgacggtatcatttactctactagccttaccttcacctatacaccagaacccggtccgcgcccgcactgctccgccgccggtgcaatcctgcgagccaactcctcacaggtgcccccaaatgaatctaataccaactctgagggttcctatacgaacgcatccaccaattccacaagtgtaactagttccacagctacagtcgtttcatag

SEQ ID NO: 202768 - DNA, 432 bp, Artificial Sequence
  Description of Artificial Sequence: Synthetic coding sequence
atgcggaactacctgaaggagcggggcgaccagaccgtgctgatcttgcatgccaaggttgcacaaaagtcctacggcaacgagaagcgcttcttctgcccacccccgtgtgtttatctgatgggctctggctggaagaagaaaaaggaacagatggagcgagacggctgttcagagcaggaaagccagccctgtgcctttataggcataggtaacagcgatcaggagatgcagcagctgaacctcgaaggcaagaattattgcacagccaagacattatacattagcgactccgacaaacgcaagcacttcatgctgtcagtaaaaatgttttatggaaacagcgatgatattggggtgtttctcagcaagcggatcaaagtgatttctaagccaagtaagaagaagcaatctctgaaaaatgcagattag

SEQ ID NO: 202769 - DNA, 87 bp, Artificial Sequence
  Description of Artificial Sequence: Synthetic coding sequence
atggcctggatcaagcggaagttcggcgagcggcccccccccaagcggcttacccgtgaagcaatgcggaactacctaaaggaatag

SEQ ID NO: 202770 - DNA, 294 bp, Artificial Sequence
  Description of Artificial Sequence: Synthetic coding sequence
atggcctggatcaagcggaagttcggcgagcggcccccccccaagcgcctgactcgagaggctatgaggaattaccttaaagagaggggcgatcagactgtgctgatcctgcatgctaaggtggcccagaagtcctatggtaacgagaagaggttcttttgtcctcccccctgcgtttacttaatgggaagcgggtggaagaagaaaaaggagcaaatggagagagacggctgctccgagcaggagagccaaccttgcgccttcatcggcatcggcaacagtgaccaggagtag

SEQ ID NO: 202771 - DNA, 1398 bp, Artificial Sequence
  Description of Artificial Sequence: Synthetic coding sequence
atgcggaactacctgaaggagcggggcgaccagaccgtgctgatcctacatgctaaggtggcccaaaagagttacgggaacgaaaaacgatttttttgcccacccccgtgcgtgtatctgatgggaagcggttggaaaaagaagaaagaacaaatggaaagagatggatgctcagagcaggagtcccagccttgcgctttcattggcattggaaacagcgatcaggaaatgcagcagttgaaccttgagggtaaaaattactgtacagctaaaaccctgtatatatcagactccgacaagcggaagcacttcatgctgtccgtgaaaatgttctatggcaactccgatgacatcggtgtctttctctccaagagaattaaagtgatttctaagccctcaaagaaaaaacagagtctcaaaaacgcagatctgtgtatcgcctcaggaacaaaagtagcactgttcaataggctccgaagccagaccgtgagtaccaggtatcttcacgtggagggaggcaactttcacgcctcaagtcagcagtggggggccttctttattcatcttttggatgacgatgaaagcgaaggcgaagagttcacagtgcgtgatggctatatccactacggccagaccgttaagctggtatgcagcgtaacaggaatggccctgccccgccttataatacggaaggtggataagcagactgctctattggatgccgacgaccccgtgagccagttgcacaagtgtgcattctacctgaaagacacagaacgcatgtacttatgtctgtctcaggaaaggatcatccagtttcaggcaacaccctgccccaaggagcctaataaggagatgatcaatgatggagcgagctggacgattataagtactgacaaggccgaatatactttctatgaaggtatggggccagtgctcgcgcccgtcaccccagtgccggtggttgaatccctccagctgaatggaggcggcgatgtggccatgttagagctgacaggccaaaactttacccctaatctgagagtttggtttggagacgttgaggccgagactatgtatcggtgcggagagtccatgttgtgtgtcgtgccagatatctccgccttccgcgagggatggagatgggtcagacagcctgttcaggttccggtgacccttgtacggaacgacgggatcatttactccacttctctgacgtttacttacacccccgaaccaggacccaggccccattgttctgcggctggggctatcctgagagcgaactcatcccaggtgcccccgaacgagtcaaatactaattctgagggcagctacactaacgccagcaccaactcaacctccgtcacttcgtcaactgctacggtcgtgtcatag

SEQ ID NO: 202772 - DNA, 474 bp, Artificial Sequence
  Description of Artificial Sequence: Synthetic coding sequence
atgcggaactacctgaaggagcggggcgaccagaccgtgctgatcctacacgccaaagttgcacagaaaagctatggaaatgagaagcggttcttctgtcccccaccttgcgtgtatttgatggggtcagggtggaagaagaaaaaagagcaaatggaacgggacggctgtagcgagcaggaaagtcagccctgcgcattcatcgggatcggaaacagtgaccaggagatgcaacaattgaacctcgaaggcaagaactattgtaccgctaagaccctgtacatttcagattctgacaagcggaaacactttatgttaagcgtcaaaatgttttatggcaattccgacgacattggcgtgttcctctccaagcgtattaaagtgataagcaagccaagtaagaaaaagcaatccctgaaaaatgctgacctatgtatcgccagtggcactaaggtagccctgtttaaccgctag

SEQ ID NO: 202773 - DNA, 150 bp, Artificial Sequence
  Description of Artificial Sequence: Synthetic coding sequence
atggcctggatcaagcggaagttcggcgagcggcccccccccaagcgcctgaccagagaggccatgagaaactatctgaaagagagaggagaccagactgtgctgattctacacgccaaggtggcacagaaaagctacggaaatgagtag

SEQ ID NO: 202774 - DNA, 324 bp, Artificial Sequence
  Description of Artificial Sequence: Synthetic coding sequence
atggcctggatcaagcggaagttcggcgagcggcccccccccaagagattgactagagaagctatgaggaattacctgaaggaacggggcgaccagaccgtgctgattctgcacgccaaggttgcccagaagagctatgggaacgagaaaaggttcttttgccctcccccctgtgtgtatttgatgggctctggctggaaaaaaaaaaaagagcagatggaaagggatggatgctctgagcaggaatcccaaccatgcgccttcattggcatcggcaacagtgatcaggaaatgcagcagctcaatttagagggcaaaaattag

SEQ ID NO: 202775 - DNA, 285 bp, Artificial Sequence
  Description of Artificial Sequence: Synthetic coding sequence
atggcctggatcaagcggaagttcggcgagcggcccccccccaagcgcttgacccgggaggctatgaggaattatctaaaggaacgaggcgaccagacggtgctaattttgcacgcaaaggtggctcagaagagctatgggaatgaaaaaaggtttttttgcccacctccttgcgtctatcttatgggaagtgggtggaagaagaagaaggagcagatggagagggacggttgttcagaacaggagtctcagccatgcgcatttattggcatcggtaacagctag

SEQ ID NO: 202776 - DNA, 537 bp, Artificial Sequence
  Description of Artificial Sequence: Synthetic coding sequence
atggaccacaccgagggcagccccgccgaggagccccccgcccacgccccttccccaggtaagttcggcgagaggcctccacctaagcggttgactcgcgaggccatgaggaattatcttaaagagagaggcgatcaaactgtgctcatccttcacgccaaagtggcacagaagtcctatggcaatgaaaagagatttttttgtcctccgccctgcgtttatctcatgggctccggatggaaaaaaaaaaaggaacaaatggagcgcgacggatgctccgagcaggagtcccagccttgcgcgttcatcggcattggcaatagcgatcaggagatgcagcagctcaacctggaaggtaagaactactgtacagcaaaaaccctgtatatctctgactccgacaaaagaaagcatttcatgctatccgtgaaaatgttctatgggaactccgatgatataggggtatttctctcaaagcgtataaaagtgatttccaaacctagtaagaagaagcagtcactgaaaaatgcggactag

SEQ ID NO: 202777 - DNA, 333 bp, Artificial Sequence
  Description of Artificial Sequence: Synthetic coding sequence
atggcctggatcaagcggaagttcggcgagcggcccccccccaagcggcttacacgcgaggctatgaggaactatttgaaagagcgcggggatcaaaccgttctgatattacatgcaaaagtggcccagaagtcctacggtaacgaaaagcggttcttctgccctcctccatgcgtctatctcatgggctcagggtggaagaagaagaaggagcagatggagagagacggctgctctgagcaggagtctcagccctgtgcctttatcggcatcggaaattcagatcaggaaatgcagcagctgaacctggaaggcaagaactactgtacctag

SEQ ID NO: 202778 - DNA, 342 bp, Artificial Sequence
  Description of Artificial Sequence: Synthetic coding sequence
atggcctggatcaagcggaagttcggcgagcggcccccccccaagcggctcacaagagaggctatgcgcaattacctcaaagaaagaggggatcagacagtgctcatcctgcacgccaaagtcgcccagaaaagttatggtaacgaaaaaaggtttttttgtcctcccccatgtgtctacctgatggggtcaggctggaaaaaaaagaaggagcagatggagcgtgatgggtgctctgagcaggagtcccagccatgtgccttcatagggatcgggaattcagaccaggaaatgcagcagctgaacctggaggggaaaaactattgcaccgctaaaacctag

SEQ ID NO: 202779 - DNA, 147 bp, Artificial Sequence
  Description of Artificial Sequence: Synthetic coding sequence
atggcctggatcaagcggaagttcggcgagcggcccccccccaagcggctcacacgcgaggccatgcggaattacctcaaagagcgtggtgatcagaccgttctgatcctccacgccaaggtcgcccagaagagctatggaaactag

SEQ ID NO: 202780 - DNA, 570 bp, Artificial Sequence
  Description of Artificial Sequence: Synthetic coding sequence
atgcggaactacctgaaggagcggggcgaccagaccgtgctgatcctgcacgccaaggtagcgcagaaaagttatggaaacgagaagcggttcttttgccctcctccatgcgtgtacctgatgggaagcgggtggaagaagaagaaggagcagatggaaagggacgggtgctctgagcaggaaagtcagccctgtgcctttatcggcattggcaactccgatcaagaaatgcagcaacttaatctcgaggggaagaattattgtactgccaaaactttgtatatcagtgactctgacaaacggaagcactttatgttgtctgtaaagatgttctacgggaattccgacgacataggagtcttcctctcaaaaaggattaaggtgatttccaaaccgagtaagaaaaagcagagcctcaaaaacgccgacctctgcatcgccagtggcacaaaggttgccctcttcaacaggctaaggtcccagactgtctcgacaaggtatctgcacgtggagggaggcaattttcacgcgtcaagccagcagtggggtgcgttcttcattcatctgtag

SEQ ID NO: 202781 - DNA, 600 bp, Artificial Sequence
  Description of Artificial Sequence: Synthetic coding sequence
atggccagcgtgagcgccctgaccgaggagctggacagcatcacctccgagctccacgctgtggaaatccaaattcaggaactgactgagcgtcagcaggaacttatacagaagaagaaagtgctaaccaagaaaattaaacaatgcttggaagactccgatgccggagcaagcaacgagtacgattccagccctgccgcctggaacaaagaagatttcccttggtctgggaaagtgaaggacattctgcagaacgttttcaagctggagaagtttcgtccattgcagttagaaacaataaacgtgaccatggcaggaaaagaagtgttcttagtgatgcctacgggcggcggtaagtctctatgctatcagctgccagctttatgcagcgacggatttacactcgtcatatgtccgttaattagtttaatggaagatcagctgatggtattgaaacaactcgggatctccgccacaatgctaaacgcaagttcatccaaggagcacgtgaagtgggtccacgcagagatggtcaacaagaattctgagcttaagctcatttacgtgactcccgagaagatcgccaaatccaagatgtag

SEQ ID NO: 202782 - DNA, 636 bp, Artificial Sequence
  Description of Artificial Sequence: Synthetic coding sequence
atggccagcgtgagcgccctgaccgaggagctggacagcatcaccagcgaactccatgccgtggaaatccagatacaggagttaacagaaagacagcaggagctcattcagaagaaaaaagtgctcactaaaaagatcaagcagtgtctggaagacagcgacgctggcgcctctaacgagtatgacagctctcctgccgcatggaacaaggaggatttcccttggtctggaaaggtgaaggacatcctccagaacgtattcaagctggagaagtttcgccctttacagcttgaaacaattaacgtaaccatggccgggaaggaggtatttctcgttatgcccaccggcgggggcaagagcctgtgctatcaattacctgccctctgttctgatgggtttacccttgtgatatgtccactgatctctctgatggaggatcaactgatggtgcttaaacagttgggtataagtgctacgatgctgaatgcaagctcctcaaaggagcatgtaaaatgggtgcacgctgaaatggttaataagaattcggagctaaagctgatctatgttactcccgagaaaattgccaagtctaaaatgtttatgagcaggttggagaaagcctatgaggcgcgctag

SEQ ID NO: 202783 - DNA, 1950 bp, Artificial Sequence
  Description of Artificial Sequence: Synthetic coding sequence
atggccagcgtgagcgccctgaccgaggagctggacagcatcacctctgagttgcatgcagtggagatccagattcaggaattgactgagcgtcagcaggagctaatccagaagaagaaagtcctcactaaaaaaataaagcagtgcctggaagacagtgatgcaggcgccagtaatgagtatgatagttcccctgccgcctggaacaaggaagattttccttggtcaggaaaggtaaaggatatcctgcagaacgtgttcaagctcgaaaagtttcgcccactgcagctagaaacaattaacgtgactatggcaggaaaggaggtatttctagtcatgcctaccggtggagggaagtccctatgttaccagctccccgcattgtgttctgatggctttaccctcgttatctgtccactgataagcctcatggaagatcagttgatggtgttgaagcaactcggcatcagcgcgaccatgctcaacgcatctagctctaaggagcacgttaagtgggtccatgctgaaatggtgaataaaaattccgagttaaagctaatttatgttacacctgagaaaatcgcgaaatcgaaaatgtttatgtcaaggctagagaaagcttatgaagctcggaggtttactcgaattgccgtcgatgaagttcactgctgttcccagtggggacatgactttcggcctgactacaaggctctggggatcctcaagaggcagtttcccaacgccagtcttattggcctcaccgcaaccgccactaaccacgtgctgaccgacgcccagaaaatcctttgtatcgagaagtgcttcacatttacagccagctttaaccgtcctaacctgtactacgaggtgagacaaaaaccatctaacactgaagacttcattgaggatatcgtaaaactcatcaacggcagatacaagggacagagtggcattatatattgcttcagccagaaagatagcgaacaggttaccgtgtccctacagaatctcggaatccacgccggagcatatcatgccaatctagaacccgaggataagacaacggtgcacagaaagtggagtgccaatgagatccaggtggtcgtggcaacagtcgcctttgggatgggcatagacaaaccggatgttcggtttgtaattcaccatagcatgagcaaatcaatggagaactactaccaagagtccggcagagccggcagagacgacatgaaagccgactgcattctctattatggattcggcgatatcttcaggatctcgtctatggtagtgatggagaacgtcggccaacagaagctgtatgaaatggtgtcctactgtcagaacatctctaaatgcaggagagtcctgatggcccaacacttcgacgaggtgtggaattctgaggcctgtaacaagatgtgtgataactgctgcaaggactcagccttcgagcgaaaaaatattactgaatactgtcgagatctcataaagatcctcaagcaggccgaggaactgaatgagaaactgaccccactcaaattgattgatagttggatgggcaaaggagccgcaaagttacgcgtggccggcgtggtggcccccacgttgcctagagaagatctggaaaaaatcatcgcccacttcttgattcagcaatacttgaaggaggattattccttcacagcctatgcaactatttcctacctgaaaatcggcccaaaggctaacttgcttaataacgaggcacacgccattaccatgcaggtgactaaaagtacccagaactcgtttagggccgagagcagtcagacatgccatagcgaacaaggcgataaaaagatggaggagaaaaacagtggcaattttcaaaagaaagcagctaacatgctgcagcaaagcggcagcaagaatacaggtgccaaaaaaaggaagatcgacgatgcctag

SEQ ID NO: 202784 - DNA, 1950 bp, Artificial Sequence
  Description of Artificial Sequence: Synthetic coding sequence
atggccagcgtgagcgccctgaccgaggagctggacagcatcaccagtgagctccatgccgtggagatacagattcaggaactgacagaacgtcagcaagaactgatacagaagaagaaagtgctaactaagaagatcaaacagtgtctggaggactcagacgcaggggcttctaacgagtatgatagctcgcctgcggcctggaacaaagaagactttccatggtcaggcaaggtaaaggacatccttcagaacgtcttcaagttggagaagttcagacccctgcagctcgagacaatcaatgttaccatggccggtaaggaagtcttccttgtgatgcccacaggcggaggcaagagcttatgctaccaattgccggctttgtgtagcgatgggtttactctcgtcatttgcccgctgatatccttgatggaggaccagttaatggtgcttaaacagctggggatctccgctaccatgctaaatgcgagttcctctaaggaacatgttaagtgggtccacgccgaaatggttaacaagaactctgaattaaaactgatatatgtaactcccgagaaaatcgctaaatctaaaatgtttatgtccaggctcgagaaggcatacgaggccaggaggttcacccgcattgctgtcgatgaagtgcactgttgttctcagtgggggcacgacttcaggccagattacaaagcgctcggcatactcaagagacagttcccaaatgcaagccttattgggctgaccgccacagccaccaatcacgttctaacagacgcccaaaagatcttatgcattgagaaatgttttaccttcacagcatctttcaatcgccccaacctctactacgaagtgaggcagaagcctagtaatacggaggatttcatcgaggacatagtgaaactgattaacgggaggtataaaggccagagcggaatcatatactgcttttcgcagaaagattctgagcaggttactgtctctctgcagaaccttgggatccatgctggagcctaccacgccaacctggagcccgaagataaaaccacagtacaccgcaagtggtccgcaaatgagatccaggtggtagtggccacagtcgccttcggcatgggtattgataagcccgatgtgcgctttgtaattcatcacagcatgagtaaaagtatggaaaattactatcaagagagtggaagggccggacgcgacgatatgaaggcagactgtattctctattacggatttggggatatattcaggatctcttctatggtagtaatggaaaatgtgggacaacaaaaattatatgaaatggtgtcatattgtcagaatatttctaagtgccgaagagttctgatggctcagcatttcgacgaggtttggaactctgaagcttgtaacaagatgtgcgacaattgttgcaaggactccgccttcgagcggaaaaatataaccgagtactgccgcgatctgatcaaaatactcaagcaggctgaagagctgaatgagaagctgaccccccttaagctgatagacagctggatgggaaagggagctgctaagctgagagtggctggtgtggtagcccccactctaccccgagaggaccttgagaagattattgcccactttcttatccaacagtacctgaaggaggattattctttcacagcctatgccaccattagctatctgaagattgggcccaaagcaaatctgttgaataatgaggcccacgccatcactatgcaagtcactaagtccacgcagaatagtttccgagctgagtcatcgcagacatgccacagcgagcagggcgataaaaaaatggaggaaaagaactccgggaactttcagaagaaggctgctaacatgttgcagcagtcaggatccaagaacactggcgccaaaaagcggaaaatagatgatgcttag

SEQ ID NO: 202785 - DNA, 321 bp, Artificial Sequence
  Description of Artificial Sequence: Synthetic coding sequence
atggccagcgtgagcgccctgaccgaggagctggacagcatcaccagcgagctccacgcggtcgaaattcaaattcaagagctgactgaacgacagcaggagctgatccagaagaagaaagtgctgacaaagaaaatcaaacagtgcctcgaggactcagatgccggagcctctaatgagtatgacagctcccctgcggcgtggaacaaagaggacttcccttggagcggaaaggtaaaagacattctacagaacgtatttaagttggaaaaattcaggcccctccagttggagactatcaatgtgactatggcggggtag

SEQ ID NO: 202786 - DNA, 294 bp, Artificial Sequence
  Description of Artificial Sequence: Synthetic coding sequence
atggccagcgtgagcgccctgaccgaggagctggacagcatcacctctgaactgcatgccgtggagatccagattcaggagcttacagaacggcagcaggaactgatacagaagaagaaggtcctgaccaaaaaaattaagcagtgtcttgaggatagcgatgctggtgcgagcaacgaatacgattcctcacctgccgcatggaacaaagaggattttccgtggagcgggaaagtcaaggacatcttgcagaacgtttttaagctagagaaattccgcccgctacaactctag

SEQ ID NO: 202787 - DNA, 219 bp, Artificial Sequence
  Description of Artificial Sequence: Synthetic coding sequence
atggccagcgtgagcgccctgaccgaggagctggacagcatcacctctgagctgcatgccgtggaaattcagattcaggagctgacagaaaggcaacaggaactcattcaaaaaaagaaggtgcttaccaagaagattaaacagtgcctggaggatagcgatgccggcgcaagcaacgagtacgattcctctccagccgcctggaacaaggaagactag

SEQ ID NO: 202788 - DNA, 396 bp, Artificial Sequence
  Description of Artificial Sequence: Synthetic coding sequence
atggccagcgtgagcgccctgaccgaggagctggacagcatcacctcagagttgcacgcagtggaaatccagatccaagagcttactgagcgacagcaggagctgatacagaaaaagaaagtcctaaccaaaaagatcaagcagtgtctggaagacagtgacgccggcgcatctaacgaatacgattcgagtccggccgcatggaacaaagaggattttccctggtctggtaaagtgaaggacattcttcagaacgtgtttaagctggagaaatttcgccctcttcagctggaaaccatcaatgtgacgatggctggaaaagaagttttcctagtcatgcctaccggcggaggcaagagtctgtgttaccagcttcctgccttgtgctctgactag

SEQ ID NO: 202789 - DNA, 2976 bp, Artificial Sequence
  Description of Artificial Sequence: Synthetic coding sequence
atgagcagccaccacaccaccttccccttcgaccccgagcggcgggtgcggtctaccttaaaaaaagtgttcgggttcgattctttcaaaacccccttacaagagagcgctacaatggccgtggtgaagggaaataaggacgtcttcgtctgcatgcctaccggagctggcaagtcactctgttaccaactccccgctctgctggcgaaaggcattaccattgtcgtctctcccctgatcgctctcatacaggatcaagtcgatcacctcttgacactgaaggttagagtgtctagtctcaatagtaagttatccgctcaagagagaaaagaactgttagccgacttggaaagagagaaaccccagacaaaaatcctgtacattacccctgaaatggctgctagcagttcgtttcaacctacccttaattccctcgtgtccaggcaccttctgtcttatttggtcgtggacgaagctcattgtgtgtcacagtggggacatgacttccgcccagattacctgcgtctcggggcgttgcggtctcgcctagggcatgccccctgcgtagcactgactgcgaccgctaccccccaggtacaggaggacgtatttgccgccctgcatctgaagaagcccgttgcaatcttcaaaacgccctgtttccgggccaacttgttctacgacgtacagttcaaggagctgatctctgacccttatggtaatttgaaggatttttgtctcaaagccttgggccaggaagctgataagggcttgagcggatgtggcatcgtgtactgccgaacccgggaggcttgcgagcaactggccatcgagcttagctgcaggggcgttaacgcaaaggcttaccacgccggacttaaggcctccgagcgaacactggtgcaaaatgactggatggaggaaaaggtaccagtcattgtcgccacaatctcgtttgggatgggggtggacaaggccaacgttaggttcgtcgcccactggaacatcgccaagtctatggccggctactaccaggagtccggtcgtgcgggcagagatgggaaaccatcatggtgtaggttatattattcaaggaacgatcgagatcaggtgtctttcctgattaggaaagaggtggccaaactccaagagaaaagaggtaataaggccagcgacaaagccactatcatggctttcgacgccttggtgaccttctgtgaggagctgggatgtagacacgctgccatagccaagtactttggagatgctcttccagcttgtgcaaaaggctgcgatcactgccagaaccccactgcggtcaggcggcggctggaggcactggagcgatcgtctagctggtcaaagacgtgcatcggcccatctcagggcaacggtttcgacccagagttatacgaaggagggcggaagggatatggagatttcagtcgctatgacgagggaagtgggggatccggcgatgaaggccgggatgaagctcataaaagggaatggaacttgttctatcaaaagcagatgcagctgcgaaaggggaaagaccctaagattgaggaatttgtaccccccgatgagaattgtccactcaaagaggcgtcaagtcggagaatcccaagactgactgtcaaggcaagggagcactgcctccgcctgcttgaagaggccctgagcagtaacaggcagagtactcgtaccgctgacgaggcggatctgagggctaaagctgtggagctggaacacgagacctttcgtaacgctaaggttgccaacctttacaaagcttcggtccttaaaaaagtggcagacatacatcgcgcttcaaaggacggacagccgtatgacatgggggggagcgcaaagagctgctccgctcaggccgagccacctgagcccaacgagtacgacatccctcctgcaagccatgtgtacagcctgaagcccaagagagttggagcaggcttcccaaaaggatcatgtccgttccaaaccgccaccgaactgatggagacaactcggataagagagcaagccccacagcctgaacgaggaggtgaacacgagccaccatcacggccatgcggactgctggatgaagatgggtcagaacccctccccggcccgaggggtgaggtccctggcgggtctgcacattatggggggccctcgcctgagaaaaaggcaaagtcctcaagcggcggatcgagcctcgccaagggacgggccagcaagaagcagcagctcttagcaactgcagcgcacaaggatagtcagagcattgcccgattcttttgccgaagagtggaaagccctgctctccttgcatccgcaccggaggcagaaggagcctgtccctcatgtgaaggggttcagggccccccgatggctccagagaagtacaccggcgaagaagacggtgctggtggccattctccagctccacctcagacggaggaatgtctaagggagaggcctagcacatgtccgccccgagatcaggggacgcctgaagtgcagccaacacctgccaaagatacatggaaggggaaacggccgaggagccaacaagagaaccctgaatctcaaccccagaagaggccccgaccatcggctaagcctagtgtcgtggccgaggttaagggatccgtgagcgcaagcgagcaaggaaccctgaaccccacagcccaggatccgttccagctcagtgcaccaggcgtaagccttaaggaagccgcaaacgttgttgtgaaatgcctcactccattctacaaggagggcaagtttgccagcaaggaacttttcaagggctttgcgaggcacctgagccacttgctcactcaaaagacctccccaggacggagtgtgaaagaggaggcgcagaacttaatccggcacttctttcacggccgagcgcgctgtgagtctgaggccgattggcacggactatgtggcccacaacgatag

SEQ ID NO: 202790 - DNA, 1308 bp, Artificial Sequence
  Description of Artificial Sequence: Synthetic coding sequence
atgagcagccaccacaccaccttccccttcgaccccgagcggcgggttcggagcactttgaagaaagtcttcgggttcgactcctttaaaacccctttgcaggagtctgccacaatggctgtggtgaaaggaaataaagacgtgtttgtgtgtatgccaacaggtgccggaaagtccttgtgttatcagcttcccgctctccttgctaagggcatcactatcgttgtgtccccactgatcgctttaatccaggaccaggtggaccacctcctgacgctcaaggttagggtgtcctcgcttaacagcaagctgtccgcacaggaaagaaaggaacttctggcagatctggagcgagagaagccgcaaactaagatactgtatattacaccagagatggctgctagcagctcatttcagccaaccctgaatagcctggtaagccgccatcttctgtcatacctggtggtggatgaggctcactgtgtgagccagtgggggcatgatttccggcctgactatttacgattaggagcactccggagccgactcggccacgcaccgtgcgtcgccctgacagccactgcaacaccgcaggttcaggaggacgtgtttgctgctctgcatctcaagaagcccgtggcaatctttaaaacaccctgtttccgcgcaaatctgttctacgacgtgcagttcaaagagctgatctctgacccttatggcaacctgaaagatttctgcctaaaggcgctgggacaggaggctgataaaggactgagtgggtgcggaattgtctattgtaggaccagggaggcctgcgagcagctggctatcgagctcagctgcaggggagtcaacgccaaggcctaccacgcggggttgaaagccagcgagcgcaccctggtccaaaatgactggatggaggagaaggtgcccgttatcgttgcgactatcagtttcggtatgggagtcgataaggccaacgttaggttcgtagctcattggaacattgcgaagtccatggccggctactaccaggagtccgggagggccggaagagatggaaagcctagttggtgtcgcctatactacagtcgcaatgatcgagatcaggtgagcttcctgattagaaaggaggtagcaaaacttcaggaaaagagggggaacaaggcatccgacaaagcaaccataatggcgtttgatgccttagtaacgttctgtgaagaactggggcggtggggacgaggccacggaaagtccctccgtgccgcctggtgttcccaggtggtgagccgacacgccgagctttag

SEQ ID NO: 202791 - DNA, 1233 bp, Artificial Sequence
  Description of Artificial Sequence: Synthetic coding sequence
atgagcagccaccacaccaccttccccttcgaccccgagcggcgggtacggagcactctgaaaaaggtcttcggattcgattcgtttaagacaccccttcaggaatcagcaacaatggcagtagttaagggcaataaagacgtattcgtgtgtatgcccaccggcgcaggaaagagcttgtgctatcagctcccagccctcctggccaaggggataacaattgtcgtgtctcccctgattgccctgattcaagaccaggtggaccatctgttgacgcttaaggtcagagtgtcttctctgaactccaagctttcggcgcaagagcgaaaggaattactggctgatttggagcgcgagaaaccccaaacgaagattctctacatcacacccgagatggctgcctcaagtagttttcagcctacacttaacagcctggtaagtcggcatttactttcgtacctggtggtggatgaggctcattgtgtctctcagtggggtcatgactttaggccagactacctgcgactcggcgccctcagaagtcgcttagggcatgctccttgcgtggccctcactgccaccgcaactccacaggttcaggaagacgttttcgctgccttgcacttaaaaaaacctgtagctatttttaagaccccatgtttccgggcaaatctcttctacgacgttcagtttaaggaactgatttcagatccctacgggaacttgaaagacttttgcctgaaggcccttggccaggaagccgataagggtctgagcggctgcggaattgtgtattgcagaaccagggaagcttgcgagcagcttgccatcgagttgtcttgtcgaggcgttaatgcaaaggcctaccatgccggactcaaggcgtccgaacggactctggtccagaacgactggatggaagagaaggtcccagtgattgtggccacaatctccttcgggatgggagtagacaaggcaaacgtgcggtttgtcgctcactggaacatcgctaagagcatggcaggatactatcaggagtcaggtcgcgcaggccgtgacgggaagcccagctggtgtcgactgtactatagccgtaatgacagagatcaggtgagtttccttatcagaaaggaagtagccaagctgcaggagaagcgaggaaacaaggccagtgacaaggctactataatggcgtttgacgctctggtcaccttctgtgaggagttaggctag

SEQ ID NO: 202792 - DNA, 3057 bp, Artificial Sequence
  Description of Artificial Sequence: Synthetic coding sequence
atgagcagccaccacaccaccttccccttcgaccccgagcggcgggtgaggagcactctgaagaaagtcttcggctttgattcctttaagacccccctgcaggagagcgcaacaatggcagtggtaaagggaaataaggatgtcttcgtgtgtatgcctacaggcgcagggaagagcctgtgctaccagctgcctgccctccttgcgaaagggattacaatcgtggtctcccccctgattgcattgatccaagatcaggtcgatcacctgcttactttaaaggttcgcgttagctctctgaattctaagctgagcgcccaggaaagaaaggaactgctggctgacctggaaagagagaaaccacagacgaaaatcctgtatatcacacccgaaatggccgcctcatcaagcttccaacccaccttgaattcccttgtgtcccggcaccttctgtcttatttagtcgtggacgaggcccattgcgttagccagtggggccacgacttcaggcctgactacttacgtctgggggctttgcgatcccgcctgggccatgccccatgcgtggcgcttacagctaccgctaccccgcaagtgcaagaggacgtcttcgccgctctccacctgaagaagcctgtcgcgatattcaaaacaccatgcttcagggctaacctgttttatgatgtgcagttcaaggaactgatttctgatccttatgggaatttgaaagatttttgtctgaaagccctggggcaggaggcggacaaagggctgagcggctgcggcatagtgtactgcaggactcgggaggcctgcgaacagttggctatcgaactgtcctgcaggggggttaatgcaaaggcctatcacgcaggcctgaaagcctccgagcgaacactcgttcaaaacgactggatggaagagaaggtgcctgtgatcgtcgccaccatctccttcggcatgggcgttgataaagcaaacgttcgattcgtggcacactggaacatcgctaagtccatggccggctactatcaggaatcaggccgggcaggacgagatggaaaaccatcctggtgcagactttattattcgaggaatgacagagaccaagtgtccttcctgatcaggaaagaagtagccaaactgcaggagaagcggggcaataaggcaagcgataaagctaccattatggcattcgacgcactcgttaccttttgtgaggagctggggtgcagacatgccgctatcgccaagtattttggtgacgcactccccgcatgcgctaagggctgcgatcattgtcagaatcctactgctgttcgtagacggctggaggccctggagcggtcctcttcatggtctaagacatgtattgggcccagtcagggcaacggctttgatcctgagttgtatgaaggcggcagaaagggatacggggacttcagcaggtacgatgaaggctccgggggaagcggggacgagggaagagacgaagctcacaaaagagagtggaacctgttttatcagaaacagatgcagctcagaaaaggcaaggaccctaaaatcgaagaatttgttccccccgatgagaattgcccgctaaaagaagcatcatcgcgcagaattcctcgtctcaccgttaaagcaagagagcattgtctacgcttactcgaggaagcactcagctctaaccgccagtccacccgcacggccgatgaagctgacttgcgcgcaaaagccgtagaacttgagcacgaaacattcaggaacgcaaaagtggcaaatctctacaaggccagcgtcctcaagaaagtggccgacatccatagggcttctaaagatggccagccatatgacatgggcggctccgccaagtcctgcagcgcccaggcagaaccgccagagcctaatgagtatgacatcccaccggcttctcacgtgtacagtctgaagcctaaacgcgtgggtgctgggttccctaagggttcttgtccgttccaaactgccactgagctgatggagacgacccgtattagagagcaggctccgcaaccggagcggggaggagagcacgagccgccaagcagaccatgcggactactggatgaagatggctccgagcctcttcctggcccaaggggggaggtgcctggcgggtcagctcactacggcggcccgagccctgaaaagaaagctaagtcctcctccggcgggtccagtctggccaaaggacgtgcgtctaaaaagcagcagcttcttgcaactgcagcacataaggactcccaaagcattgcccgctttttctgtaggagagtcgagtctcctgcgctactggcttccgcgcccgaagctgaaggtgcgtgtcccagctgtgagggggtgcagggaccccccatggcacccgaaaagtacaccggggaagaagacggcgccggagggcactccccagcaccaccccagacagaagaatgcttgagagaaaggcccagcacctgtcccccccgggaccaggggacccccgaggtccagccaacgcccgccaaggacacatggaaagggaaaagaccgcgtagtcaacaagaaaacccggagtcccagccccaaaaaaggcctcgcccatccgccaagccttcagtagttgcggaggtgaaggggtccgtgagcgcctctgaacagggaactttgaatcctacagcccaggaccctttccagctttccgcccccggcgtcagcctgaaggaagccgctaacgtcgtcgtgaagtgcctgaccccattctataaagaaggcaagtttgcatccaaagaacttttcaagggcttcgcacgtcatctgtcccacttactgactcaaaaaacttcccccggccggagcgtgaaggaagaagcacagaatcttattcgacacttctttcatggccgtgctagatgcgaatccgggccgcacgggtgggtcttttgggacacttgcagaggccaaaaagtcgaaggcgggggagccgcggccgggaggagaggaagaaaatccgggccctctccctccagcaagtccggctag

SEQ ID NO: 202793 - DNA, 1761 bp, Artificial Sequence
  Description of Artificial Sequence: Synthetic coding sequence
atgttcctggtgcggtgccggcacgccgccatcgccaagtacttcggagatgctctccctgcttgtgccaagggctgcgaccattgccaaaatcccaccgccgttagacgccggcttgaagcactggagagatcaagcagctggtccaaaacatgcattgggccttcacaaggaaacggatttgacccggagttgtatgaaggcgggagaaaggggtatggggacttcagcagatacgacgagggaagcggaggaagtggcgatgagggccgcgacgaagcccacaaacgtgaatggaatctgttttatcaaaaacagatgcaactgaggaaggggaaggatccgaagatcgaggaattcgttccgcccgacgagaattgtcctttgaaggaggcaagcagtcgtagaattccccgcttaaccgtgaaagcccgagagcactgcttgagactccttgaggaggctctgagcagcaacaggcagtcaactcgaacggccgacgaggcagacctacgtgcaaaggcagtggagctcgaacatgaaacctttcggaacgccaaagtggcaaacctatacaaggcctccgtgttgaagaaagtggccgacatccacagagcaagcaaagatggccagccatacgatatgggagggagtgctaagtcctgttctgcgcaggccgagccgccagaacctaatgagtacgacataccaccagccagccacgtgtatagcctgaagcccaagagagtcggggccggcttccctaaagggtcctgtcctttccaaaccgccacagaactgatggagacaacaagaatccgggagcaggccccccagcctgagcggggcggggagcatgagccacccagccggccttgcggattgctggatgaggatggatccgagcctctgcccggtccccgcggagaagtgccagggggctcggcccactacggaggtccatcccctgagaagaaagctaaaagcagttccggcggaagtagcctagcaaagggtagagcttcgaagaagcaacagctcctggccacagccgcccacaaggattcgcagtctattgcccggtttttttgccgtcgggtggagtcccctgccctgcttgcttcggcaccagaagccgagggagcctgtccttcctgcgagggcgtccagggaccccctatggcgccggagaagtacacaggcgaggaagatggcgccggtggccattctcccgcccccccccaaactgaagagtgcctgcgggagagaccatccacctgtccccccagggatcagggtacccccgaagtgcagccaactcccgccaaagacacctggaaggggaagaggccacggagccaacaggaaaatccggagtcacagcctcagaaacggccacggccctctgccaaacccagcgtggtcgccgaggttaagggctccgtaagtgcttcagagcaggggaccttgaacccaacggcgcaagatcccttccagctgtccgcaccaggcgtgtccctgaaagaggctgctaacgtggtggtcaaatgcctgacccctttttataaggaaggaaaatttgcaagcaaagagctgttcaaggggtttgctcgacacttgagccatttactcacgcagaagaccagcccagggcggagtgtgaaggaagaggcccaaaatctgatcaggcacttctttcatggccgcgcccggtgtgagtccgaggctgattggcatggtttgtgcggcccacagaggtag

SEQ ID NO: 202794 - DNA, 1200 bp, Artificial Sequence
  Description of Artificial Sequence: Synthetic coding sequence
atggcccagcgggccttccccaacccctacgccgactacaacaagagcttagctgagggatactttgatgctgcgggtcgcttgacaccggagttttcccagagactaactaacaagattcgtgagctgctgcagcagatggagagaggcttgaaatctgccgatccacgggatggtactggctataccggctgggctgggatcgccgttctttaccttcatctctacgacgtgtttggcgatccggcttacctccagctggcccacggatacgtgaagcagagtctgaactgccttacgaaacgcagcattactttcttgtgcggcgatgccgggccacttgccgtggcggccgttctctatcacaaaatgaacaacgaaaagcaggccgaggactgcatcacgaggctgatacacttgaataagatcgacccacacgctcctaacgagatgctgtatggtcgaatcggctacatctacgctctgctcttcgtcaacaaaaatttcggggtggaaaaaataccacagtcccacattcagcagatttgtgaaaccatcctcacctcaggcgaaaacctggcacgcaaacggaacttcacagccaagagtcctcttatgtacgagtggtatcaggaatactacgtaggagctgcccatggtctggccggcatctattactacttgatgcagcccagcctgcaggtgagccaaggtaagctgcactctctagtcaaaccgtctgtggattatgtttgccagctgaagtttccgagtggcaattatcccccttgtattggcgacaatcgggatctgctggtgcactggtgtcatggggcaccgggcgtaatttacatgctgattcaggcttacaaggtctttcgggaggaaaagtacctatgcgacgcatatcagtgtgctgatgtgatttggcagtacgggctactcaagaaggggtacggcctgtgccacggctcagccggcaacgcatacgcattcctgacactctataatttaactcaagatatgaaatacctctatcgggcctgtaagttcgcagaatggtgcctggagtatggggagcacggttgtagaacccctgatacgccatttagcctctttgagggtatggcagggacaatatacttcctggccgacctattagtgcctacaaaggctagattccccgcttttgagctgtag

SEQ ID NO: 202795 - DNA, 528 bp, Artificial Sequence
  Description of Artificial Sequence: Synthetic coding sequence
atgctgccccccatggccctgcccagcgtgagctggatgctgctgtcatgtctgatcttgctgtgtcaggtgcagggtgaagaaacccagaaggagctccctagcccacgcattagctgtccgaagggctcaaaggcatatggcagcccctgctatgcgctcttccttagtcccaagagctggatggatgctgatttggcgtgtcagaaacggcctagcgggaagctggtctcagtgttaagcggcgccgaagggtccttcgtctcaagcctggtcagatcgattagcaatagttactcatatatttggattggactgcatgatcccacccaggggagcgagcctgacggggatggatgggagtggtcttctactgatgtgatgaattacttcgcatgggaaaaaaatccctctaccatcctgaaccctgggcactgcgggagcctgtcccggagcaccggttttctcaaatggaaagactacaattgtgacgctaaactcccttatgtctgtaagttcaaagactag

SEQ ID NO: 202796 - DNA, 528 bp, Artificial Sequence
  Description of Artificial Sequence: Synthetic coding sequence
atgctgccccccatggccctgcccagcgtgagctggatgctgctgagttgtcttatcctcttatgccaggtgcaaggcgaagaaacccagaaagagctgccatcaccccgcatttcatgcccaaagggcagcaaagcctacgggagcccctgttacgctctgtttttatctcccaaaagttggatggacgcggatctggcgtgccagaagcgacccagcggtaaactcgtgtcagtactctctggagccgaaggctcatttgtgagttccttggtcaggtcaataagtaactcatattcttatatttggatcggacttcacgacccaactcagggctcagaaccagatggcgatggatgggagtggagctctacggacgtaatgaactactttgcttgggagaaaaacccctccactatcttgaacccaggccattgtggcagcttgagcaggtccaccggtttcctgaagtggaaggattacaattgtgatgccaagctcccgtacgtctgtaagttcaaggactag

SEQ ID NO: 202797 - DNA, 390 bp, Artificial Sequence
  Description of Artificial Sequence: Synthetic coding sequence
atgctgccccccatggccctgcccagcgtgagctggatgctgctgagctgcctgattctcctatgccaagtgcaaggggaggagacccagaaggagctgccctcacctaggattagctgtccaaagggatccaaagcctatggatctccttgctacgccttattcctcagtccaaagtcttggatggatgcagacggcagcgagcccgacggagacggctgggaatggtcctctactgacgttatgaactacttcgcctgggaaaaaaacccatctactatcctgaatccgggacattgtggcagtctctctcgttccactggctttcttaaatggaaggattacaactgtgacgcaaaactgccttacgtgtgtaaattcaaggattag

SEQ ID NO: 202798 - DNA, 477 bp, Artificial Sequence
  Description of Artificial Sequence: Synthetic coding sequence
atggccagccggagcatgcggctgctgctgctgctgagctgcctggccaagaccggagttcttggcgacatcattatgaggccgagttgtgcaccgggatggttctaccacaagtccaactgctatgggtattttcggaagctcaggaactggtcagatgcagagctggagtgtcagagctacggtaacggggcccatctggcgagtatccttagtctcaaggaggcctcaactattgccgaatacattagcgggtatcagcgttcccaaccaatatggattggccttcacgacccacagaagcggcagcaatggcagtggattgacggggccatgtacttgtatcggtcttggagtggcaagtccatgggagggaacaagcattgcgccgagatgtcttccaacaataacttcttgacctggagcagtaacgagtgcaataagcgccagcacttcctctgcaaataccgaccatag

SEQ ID NO: 202799 - DNA, 477 bp, Artificial Sequence
  Description of Artificial Sequence: Synthetic coding sequence
atggccagccggagcatgcggctgctgctgctgctgagctgcctggctaagaccggggtgctcggagatatcattatgagacccagctgtgctccaggatggttttatcataagtccaattgctatgggtacttccggaagcttcgcaattggtccgacgctgaactggagtgtcagtcctatggaaacggcgctcacctcgcttccatcctctctctaaaagaagctagtaccattgcggaatacatctccggctaccagaggtcacagcccatttggatcggcctccacgatccacagaaaaggcaacaatggcagtggattgacggcgcgatgtatctatacaggtcgtggagcgggaaaagcatgggggggaacaagcattgtgctgaaatgagcagtaacaacaactttttgacttggtctagtaacgaatgtaataagcggcagcatttcctgtgtaagtatcggccctag

SEQ ID NO: 202800 - DNA, 405 bp, Artificial Sequence
  Description of Artificial Sequence: Synthetic coding sequence
atggccagccggagcatgcggctgctgctgctgctgagctgcctggccaaaaccggggttttgggggatattatcatgcgaccaagctgtgctcctggctggttttaccataagtcaaattgttacggttactttcggaaattgagaaactggtccgatgccgaagtccgtaatcttctgccggcgtggccgggactttcgcgggccaaggaccagcccgagccccagatttcttttgattctgggtcttcagttctcccaggacattatgaggaaaaacctctgtggctcgtgaagtggcgagaagaggggtgcgtgtttaattcatttaattccgttagtatcgcggaagctggcgctgtgtgccagaccctcgatggactgcaagcccatactgacacctag

SEQ ID NO: 202801 - DNA, 375 bp, Artificial Sequence
  Description of Artificial Sequence: Synthetic coding sequence
atggccagccggagcatgcggctgctgctgctgctgagctgcctggctaaaacaggcgtgctcggagatattattatgcgaccttcatgcgctcctggttggttttatcataagtccaactgctacggatacttccggaaactccggaattggtcagatgccgaactggaatgccaaagctatgggaatggagcgcacctggcttctatcctttcgctgaaagaggcgagcaccattgcggagtacatttcaggctaccaacggagccagcctatatggataggcctgcatgacccacaaaaacaaccattaaatagttgcctgttcttcctgtggccgtgggaagggctccctgtggagtcactactggggtag

SEQ ID NO: 202802 - DNA, 900 bp, Artificial Sequence
  Description of Artificial Sequence: Synthetic coding sequence
atgagcagcatcaagatcgagtgcgtgctgcccgagaactgccggtgtggcgagtcacccgtctgggaagaagtcagcaatagcctgctgttcgtcgacataccagccaagaaagtgtgtcgatgggacagttttaccaaacaagttcagcgggtcaccatggatgctcccgtgtcctctgtagccttacgacaaagtggcggctacgtagccacaatcggaactaaattttgcgccttgaactggaaggaacagtctgccgtagtgctagcaacagtggataatgataagaagaataatagattcaacgatggcaaagtggatcccgcagggcggtacttcgctggtacaatggccgaggaaactgcccccgccgtgcttgagaggcatcaaggggccctatactccctgtttccagatcatcatgtgaaaaaatatttcgatcaggtcgatatatctaatggtctcgactggtccttagaccacaagatattctactacattgactcactgagctattccgtcgatgcctttgattacgacttgcaaaccggtcagatctcgaaccgaaggagcgtctataagctggagaaagaggagcagattcccgatggcatgtgcatcgatgccgaaggcaagctttgggtcgcatgctacaacggtggacgggttatccgcttggatccagttaccggtaagaggctgcaaacggtcaaactaccggtggataaaactacgtcctgctgctttggcggtaagaattactcagagatgtatgttacatgcgctagggatggaatggatccagagggcctcctccgtcagcccgaagccggcggcatattcaaaattaccggcctcggagtgaagggcatagccccctacagctacgccggttag

SEQ ID NO: 202803 - DNA, 900 bp, Artificial Sequence
  Description of Artificial Sequence: Synthetic coding sequence
atgagcagcatcaagatcgagtgcgtgctgcccgagaactgccggtgtggtgagtcacctgtgtgggaagaagtcagcaactctttactctttgtcgacatacctgctaagaaagtgtgtcggtgggatagctttactaaacaagtgcaacgagtgacaatggacgctcccgtttcaagcgtggccttacgccaaagcggtggttacgttgctacaattggcacgaagttttgtgcacttaattggaaggaacaatctgcagtcgtgctggccactgttgacaatgacaaaaaaaacaacagattcaacgacgggaaagtggacccagccggacgttactttgcgggcacaatggctgaagagaccgctcctgcagtgctcgagcgccaccagggagccctatactccctttttccagatcatcacgtcaaaaagtacttcgatcaggtggatatttctaacggactggactggtccctggatcacaagatcttctattatattgactccctgtcgtatagtgtcgacgcatttgactacgatcttcagaccggtcagattagtaaccgcaggtccgtgtataaactggagaaggaggaacaaatccccgacggaatgtgtattgacgcagagggtaagctgtgggtggcttgctacaacggtggacgggtgatccgtctcgacccagtcaccggcaagcgcctgcagaccgttaagctacccgtggataaaaccacgtcctgttgtttcggcgggaagaattactccgaaatgtacgtgacttgtgcacgggacgggatggacccagaaggcttgctgaggcaacccgaggctgggggtatctttaagatcacgggactgggcgtgaaaggaattgccccttactcttatgctggctag

SEQ ID NO: 202804 - DNA, 900 bp, Artificial Sequence
  Description of Artificial Sequence: Synthetic coding sequence
atgagcagcatcaagatcgagtgcgtgctgcccgagaactgccggtgtggagaatctccggtgtgggaagaagtgtccaattccttactattcgtagacatccctgcaaaaaaggtctgccgttgggacagtttcacaaagcaagtccagcgggtgaccatggatgcaccagtttcttccgtggcgttacggcagagcggcggctatgttgcgacaatcggaacaaagttctgcgcgctgaactggaaggagcagtccgctgtcgttcttgccaccgttgataacgacaagaaaaacaaccgctttaatgacggcaaggtcgaccctgcagggcgctactttgccggtacgatggccgaggaaaccgcccctgctgtgttagagcggcaccagggggccctttatagcctctttcccgaccatcacgtgaagaagtacttcgaccaggtggacatttctaatggactcgactggagtctcgaccacaaaatcttttactacattgacagccttagctactccgtggacgcgtttgactatgaccttcaaactggccagatcagtaaccggagatcagtgtataaactggagaaagaggaacaaataccggacggcatgtgcatcgatgccgaagggaaactttgggtggcatgctacaatggggggcgggtgattaggctggaccccgtcacaggcaaacgactgcagactgttaaactccccgtggataagaccacgtcatgttgttttggaggtaaaaactatagcgaaatgtatgtgacctgcgcaagggatgggatggaccccgagggcctgctgcgtcagcctgaggcaggcggtatctttaaaatcacgggcctaggtgttaaaggaatcgccccttattcttatgctggttag

SEQ ID NO: 202805 - DNA, 684 bp, Artificial Sequence
  Description of Artificial Sequence: Synthetic coding sequence
atgagcagcatcaagatcgagtgcgtgctgcccgagaactgccggtgtggcgagtccccagtatgggaggaagtatccaattcgcttctcttcgttgatattcctgccaagaaggtttgccggtgggattctttcaccaaacaagttcagcgcgtgacaatggatgccccagtgtctagcgttgctctacgccagtccggcggctacgtagcaacaattgggaccaaattttgtgcgcttaactggaaggagcagtccgctgtcgtcctcgctaccgtagataacgacaaaaagaacaacaggtttaacgatggcaaggtcgatcctgccggacggtatttcgctgcgaaccgtaggtctgtgtacaaactggaaaaagaagagcagatacccgacggtatgtgtattgacgcggaaggcaagttatgggtggcttgctataatggaggccgtgtcatcaggctggaccccgttactggaaaaagactgcaaacggtgaagctccccgtggataaaacaacgtcctgttgcttcggcggaaagaattattccgagatgtacgtaacctgcgcacgtgatggtatggatccagaggggctgctgagacagccagaggcaggcggcatcttcaaaataactgggcttggcgtgaaaggaatcgccccctattcctatgcgggatag

SEQ ID NO: 202806 - DNA, 3876 bp, Artificial Sequence
  Description of Artificial Sequence: Synthetic coding sequence
atgagcagcgccgtgggcccccggggcccccggccccccaccgtgcccccacccatgcaggagctgccagatttgtctcatctcaccgaggaggaacggaacatcattatggcagtgatggatcggcagaaagaggaggaggaaaaagaggaggccatgctcaaatgtgtcgtccgcgacatggccaaaccagcagcctgcaagacccctagaaatgccgagaaccagccacatcagccgtctcctcgccttcaccagcagtttgaatcctacaaggagcaagtaagaaaaatcggagaagaggctaggaggtatcagggagagcataaagacgatgcccccacctgtggtatctgtcacaagactaaattcgccgacggctgcggtcacctgtgttcatactgtaggaccaagttttgcgctaggtgtggcggtcgggtctcactgagatcaaataatgaggataaatacgtgatgtgggtttgtaatctgtgcagaaaacaacaggaaatcctgacaaagtctggggcctggttttttggaagcggaccccaacagacttctcaggatggcacactcagcgatacggccacaggtgcaggctctgaggtgccaagggagaaaaaagctcgcttacaggagcgatctaggtcccagacccctctttccacagccgcagcaagcagccaggacgccgctccgccctcagcgcctcctgaccgcagcaaaggcgccgagcccagccagcaagccctgggacctgagcagaaacaggcatctagccgcagtaggtctgaacctcccagagagagaaagaagaccccgggtctctccgagcaaaacggtaaaggtgcactcaaaagcgagcggaagcgggtacccaagacaagcgctcagccagtcgagggcgccgttgaggagagggagagaaaagaacggagagaatcgcgaaggctggagaaggggcgaagccaggattaccctgatactcctgaaaagagggacgagggcaaggcagcagacgaggaaaagcaacggaaggaggaagactaccagacgagatacagatctgatcctaatctggccaggtaccccgtgaaacctccccctgaggagcagcaaatgcgcatgcacgcgcgcgtctcacgcgcaaggcatgagcgaagacatagcgacgtagccctgccaagaaccgaagcaggagctgccttgcctgagggcaaggccggaaaaagggctccagctgctgctagagccagcccccccgactctccacgggcatactccgcggaacgaactgctgagacccgggctcctggtgctaagcaactcaccaaccattctccacccgcaccaagacatggaccagtccccgccgaggcacccgaactaaaggcccaagagccactgcgaaaacagtctcgcctcgacccctcatccgccgtactgatgcggaaggctaagagagaaaaggtggaaactatgttgagaaatgattcccttagcagcgaccaatcagaatcggtccggccaagcccccccaaaccccaccgctcaaaacgaggtggcaagaaaaggcagatgtccgtttcttcaagcgaagaagagggagtttctactcccgaatacaccagctgcgaggacgtggagttggagtctgaaagcgtgagtgaaaagggagatctggactactactggctggacccggccacatggcacagcagagagacaagtccaataagttcacatcccgtgacctggcagcccagcaaagaaggtgacaggctcattggaagggtcatactgaacaaaagaaccacaatgcccaaggattctggcgccctgctcggtctaaaagtggtgggcgggaaaatgaccgatctcgggaggctcggtgcttttattaccaaggttaagaaaggtagcctggccgacgtcgtgggccacctgcgggcaggcgacgaggtcctggaatggaatgggaagccgctgcctggcgctaccaatgaagaggtttacaacatcatcttggaatcaaagagcgaaccccaggtggaaattatcgttagccgcccgatcggagatattcccagaatccctgaaagcagtcatccgcccctggagagcagctcctctagttttgaatcgcagaagatggagaggccttctatctcggtaatcagccctacgagccccggagcattaaaagatgctccccaggtgttacccggtcagttgagtgtgaaactctggtacgacaaagtgggccaccagctcatcgtgaacgtactgcaggctactgacctgcctgccagggtagatggaaggcccaggaacccgtacgtcaaaatgtactttctgcccgatagatcagacaaaagcaagaggcgtactaaaacagtaaaaaagattctcgaaccgaagtggaaccaaaccttcgtatactctcacgttcatcgtcgggattttagagaaaggatgcttgagatcaccgtctgggaccagccccgcgttcaggaggaggaaagcgaattcctcggcgagatcttaattgagctggagacggcactgctcgatgacgagcctcactggtataaattgcagacccatgacgaaagttcactgccactccctcagcctagcccgttcatgccacgaaggcacatccacggagaaagctcctcgaagaagctgcagaggagccaacgtatttcggactccgacatcagcgactacgaagtagacgacgggatcggagtagtgccgcctggctacaggtccagcgcgagggagtccaagtctactaccctgaccgtgcccgaacagcaaaggacaacacaccatagaagccggagcgtctcccctcataggggtaatgaccagggaaagccgcggtcacgccttcccaatgttccccttcaaagatccctcgatgaaatccatcctacgcggagatcaaggtccccgaccagacatcacgatgcttcccgatctcctgtggaccaccgcactagggatgtcgactctcagtacctttcagaacaggatcgtatgcaccggcaacgttcccctactcaaagcccacccgctgacacctcgttctcttcccgccgcgggcggcagttaccccaggtgcctgtgcgctccggatcaattgaacaggagagtgggcacaaaaaactgaagtcaaccatacaaagaagcactgaaaccggaatggctgccgagatgcgcaaaatggttagacagccgtctagggaaagtacggatggctctataaattcttactcctccgaaggcaatctgattttcccaggagtccggctgggggccgactctcagttcagtgatttcctagacgggctgggtcccgctcagctcgtggggcggcaaaccctcgccacaccggcaatgggagacatccagatcggaatggaggataaaaaaggacagcttgaggtggaagtcatccgggctaggtcgttaactcagaagcccggctccaagagcacgcccgcaccatacgtgaaggtttatctgcttgaaaacggcgcatgtattgccaagaaaaaaacgaggatcgccaggaaaaccctggatcctttgtaccaacagtctctcgtatttgatgaatcaccccagggcaaggtattacaagtgatagtttggggagactatggaaggatggaccataagtgctttatgggcgtcgcacagatcctgctagaggagctggacctgtcgagcatggtgattggctggtataagctcttcccaccctccagcctagttgatcctaccttgacccctctgactcggagggcatcacagtcatccctggagtcaagcacagggccgccgtgtatcagaagttag

SEQ ID NO: 202807 - DNA, 4428 bp, Artificial Sequence
  Description of Artificial Sequence: Synthetic coding sequence
atgagcagcgccgtgggcccccggggcccccggccccccaccgtgcccccacctatgcaggaactgcccgatttaagccacctgacagaggaagaaaggaatatcataatggcagtaatggatcggcagaaggaagaagaggagaaagaagaggccatgctgaagtgcgtcgtgagggatatggcgaaacctgccgcgtgcaagacgccacgcaacgccgagaaccagccacaccagcctagccccaggctccatcagcagttcgagtcttacaaggaacaggtgcgcaagattggcgaggaggcccgtcgatatcagggggagcacaaagatgacgcccctacctgcgggatctgtcacaaaacaaaatttgctgacggctgcggtcatctctgctcatattgtcgaactaagttctgcgcaaggtgcggtggccgtgtcagcctgcggtctaacaatgaggacatctgcgtaatgtgggtgtgtaatttgtgcagaaagcagcaggaaatcctgactaagagcggcgcatggtttttcggatcggggccacagcagacatcacaggatggcactctttcggatacggcgacgggcgctggcagtgaagttccaagagagaagaaggcacgcctgcaggagaggtcacggtctcaaacacccctgtccacagccgccgcttcgtctcaggatgccgcacctccctccgcacctccggacagaagcaaaggcgcagaaccgagtcagcaggccttaggtcccgagcaaaagcaggcatctagtaggtcgcggagcgaacctccacgcgagaggaagaagacaccaggactgagtgaacagaatggaaagggcgctttgaagagcgaaaggaagagagtgcccaagactagcgcacaacccgtcgagggcgccgtggaagagcgggagagaaaagagcgacgcgaatctcgcagactggagaaaggccggagtcaggattaccccgatacacccgagaagcgagacgaaggcaaagctgcagatgaagaaaagcaacgcaaggaagaggactaccagacacgctaccggtctgatcccaatttagctagatatcctgtaaaacctcctcccgaggaacagcagatgcgcatgcatgcccgtgtaagccgtgctcggcatgaacgacgtcatagtgatgtcgcacttcctcgaaccgaggccggggcagccctgccagaaggtaaggcggggaaacgagccccagctgctgccagagcatcacccccggacagcccgcgcgcctatagcgccgagcgtacggccgagacgcgagctcccggtgccaaacagttaactaatcacagcccgcctgccccacgtcatggcccagtccccgcagaggcgccggagctgaaggctcaggagcctctcagaaagcaaagcaggttggatccaagctccgcagtccttatgaggaaggccaagagagaaaaggtcgagactatgctgagaaacgactccctctcttccgatcagtccgagtccgttaggcccagccccccgaaaccacaccggtccaagcgtgggggaaagaagcggcagatgtctgtctccagctccgaagaggagggggtgtccacccctgagtataccagctgcgaggatgtagaactggaatcagaatctgtgtctgaaaagggtgaccttgattactattggctggacccagccacatggcactcccgcgaaaccagtccaatctctagtcatccagtcacgtggcagccttcaaaagaaggggatcgactaattggacgagtcattctgaacaaaagaacaactatgccaaaggattctggtgccttgctcgggctcaaagtagtcggcggaaaaatgaccgaccttgggcggctgggggccttcatcaccaaggtgaaaaagggatctctcgctgacgtagttgggcacctgcgcgcaggagatgaggtcttagaatggaatgggaagcccctgcccggcgctacgaatgaggaagtctacaacatcattttagagagcaaatccgagccccaggtggagattatcgtgtcaagacccataggcgatatacctcgcatcccagagtcttctcacccaccattagagtcttcttcctcatccttcgagtctcagaaaatggaaaggccctctatatcggtgataagcccaacctctcctggagctctgaaggatgccccccaggttctgcccggccagctatccgtcaagttatggtacgacaaagtcggccaccaactgattgttaatgtgttgcaggcaacggacctgcctgccagggttgacggaaggccgcggaacccatatgttaagatgtattttctgccagatcgctcagacaagtcaaaaaggaggacaaaaaccgtgaagaagattcttgagcctaagtggaaccagacctttgtatattcacacgtccatagaagggactttcgcgaaaggatgctggagatcacagtgtgggatcagcctcgtgttcaggaggaagagagcgagtttctgggcgagattctcattgagctggagaccgctctcctggacgacgagcctcattggtacaagctgcagacacatgacgagagcagcctgccattgccccagccgagcccctttatgccccgtcgacatatacacggagaatccagttctaaaaagctgcaaagatcacagaggatttccgactcggacatttctgattacgaggtagatgatggaatcggcgtggtgccccctggataccggtcttccgcccgagagtccaaaagtaccactctgaccgtgcccgagcaacaacggactacacaccacagatcaaggagcgtgtcccctcatcggggaaatgaccaaggtaaacccagatcccggctccctaacgtgccactgcaacgaagcttagatgaaatccatcccacgagacgctcgaggtctccaactagacaccatgacgcttctcggagcccagtagaccataggacccgtgacgtcgactcacagtacctgagtgaacaggacagcgagctcttgatgctgcccagagccaaacgcggccggagtgcagagtgtttgcatactacccgtatgcaccgacaacgaagtcctactcagagtccccctgcagacacctccttcagcagtcggaggggaagacagttaccgcaggtccctgtgaggagtggatctattgagcaggcgagcttggtggttgaggagcgcacccgacaaatgaaaatgaaagtccacaggtttaagcagaccaccggctctggctctagtcaggaactagacagagagcagtattctaaatataatatccacaaagatcagtaccgatcgtgcgacaacgtcagcgcgaagtcttccgactccgatgtttccgatgtgtcagcaattagtaggactagcagcgcgagcagactttcttccacgagtttcatgagcgagcagtccgaacggccccgcggcaggatcagacgcatgggcacatccggaaggagcatcatgaagtcaacaagtgtctctggtgaaatgtatacactggagcataacgacggcagtcaatccgacaccgctgtgggaacagtgggggcgggaggaaagaaaagacgctccagcctgagcgcaaaggtcgttgctatcgtgtctcggcgaagccgatctacctctcagcttagtcagacagagagcggccataagaaactgaagtctactatacaaagatctacggagacaggaatggcagcagaaatgagaaagatggtgagacaaccgagtcgggagtcgaccgacggtagcattaatagctactctagtgaagggaatctgatcttcccaggcgtgaggctaggtgccgactcacaattctccgattttctagatggcttgggcccagcccagctggtgggacgccagaccctcgccacacccgcgatgggcgatatacagatcggcatggaggacaagaaagggcaattggaggtcgaggttataagggcaaggtctcttacccagaaaccaggatccaagtccacccctgctccatacgtgaaggtctatctgctggagaatggagcctgcatcgccaagaagaaaacaaggattgctcggaaaaccctcgatcccctctaccagcagagcttggtctttgacgagtccccccagggaaaggtgctgcaggtcatcgtatggggcgattacggcaggatggaccataaatgttttatgggcgtggctcaaatccttctggaggaactcgacctgagttccatggtgatcggatggtataagctttttcccccatcctccctggtcgaccccaccttaacccccctcaccaggagggcctcccagtctagtttggagtccagcactggaccaccttgcatccgcagctag

SEQ ID NO: 202808 - DNA, 4116 bp, Artificial Sequence
  Description of Artificial Sequence: Synthetic coding sequence
atgagcagcgccgtgggcccccggggcccccggccccccaccgtgccccctcccatgcaggaactgccggatctgtctcatcttacagaggaggaacggaacataataatggcggtcatggatcgtcaaaaggaggaggaggaaaaagaggaggctatgctgaagtgtgtcgtgcgcgacatggctaagcctgccgcctgtaaaacccccaggaatgctgagaaccagccccaccagccatcaccccggctgcaccagcagtttgagagctacaaggagcaggttaggaaaatcggggaggaagcacgccgataccagggggagcacaaagatgatgcccctacctgcggaatctgccacaaaacaaaattcgccgatggctgtgggcacctgtgctcctattgcaggacgaaattctgtgcgaggtgcggaggacgggtgtcccttcgcagtaacaacgaaaataagatcgttatgtgggtctgtaacctatgccgaaagcagcaggaaatattgacaaaatccggagcgtggttcttcgggagcggcccccaacagactagccaggacggcacgctcagcgatacagctactggagcgggtagcgaagttccccgcgagaaaaaggcacgcctacaggaaaggtcacggtcacaaacaccgttaagcacagcagccgcctcttcacaggacgccgcgccgccctccgcccctcctgatagaagtaaaggggcagagccctctcagcaagccttgggtcctgagcagaagcaggctagtagccggtcccggtctgaaccaccaagagaacgtaaaaaaacacctggactgtccgagcagaatggcaagggtgctctgaagagcgagcgcaagcgtgtgcccaaaactagcgctcaacccgtggagggggccgtggaggagcgggaacgtaaagagagaagagagtcaaggcggttagaaaaggggcggagtcaggactacccagatacaccagagaagcgcgacgagggcaaagctgctgatgaagaaaagcagcgcaaggaagaggactaccagacaaggtacaggagtgacccaaaccttgcgagatatccagtaaaaccaccccccgaggaacagcagatgaggatgcacgcgagggtttcaagggcaaggcatgaaaggcggcattccgatgtcgccctgccacgaaccgaggctggtgccgccctaccagaaggcaaggctggaaagcgagccccagccgctgcacgagctagtcctccagattcaccccgtgcctattcagccgagaggaccgctgagacacgggctcctggtgcgaaacagcttacaaaccacagcccaccagccccacggcacggtcccgtccctgctgaagcccctgagttgaaggcgcaggaaccgctacgcaagcagtccagactggacccttcatcagctgtgctgatgagaaaagcgaaacgggagaaggtggaaacaatgctgcgcaatgactcactgagctcagaccagtctgaatctgtgcggccgtcccctccaaaaccccaccgaagcaaaagaggcgggaagaagaggcagatgtctgtgagctcaagtgaggaggagggggtgtcgactcccgagtacacctcttgcgaggacgtggagcttgaatcagagagcgtgagcgaaaagggtgacttagattattattggcttgaccccgcgacgtggcacagtagagagactagccccatttcctcccacccagtgacctggcagccaagcaaagaaggcgatcggttgattggtagggtcatcttaaataagagaacaaccatgcccaaggattccggtgctctgctcggtctcaaggtcgtggggggaaagatgacggatttaggacgactgggtgcatttatcacaaaagttaaaaaaggttctctggctgacgttgtcggacatctgcgtgcaggcgacgaggtcctggagtggaatggcaagcctcttcctggagccaccaacgaggaggtctataatattattctggagtctaaatccgagccacaggtcgagataattgtgagccggcccataggggatattccacgcattccagagagcagtcatccaccattagagagcagctccagttcctttgagtctcaaaagatggagcggccgagtatttcagtgatttctcccaccagtcccggggccctgaaagatgccccacaggtgctgcctgggcagttaagtgtgaaactgtggtatgacaaagtgggccaccaactcattgtcaacgtgctccaggcaacagatctgccagcccgcgtggacggacgccctcgcaatccatatgtgaagatgtacttcctacccgataggtcagacaagtcaaagcgcaggaccaaaacagtgaaaaagattctagagccaaaatggaaccagacctttgtctatagccacgtccaccgcagagacttcagagaacgcatgctcgagattacggtctgggatcagcccagagtgcaagaggaagagagcgagtttctgggcgaaatcctcatcgagctagagaccgcgcttttagacgacgagcctcattggtataagcttcagacccacgatgagtctagccttccacttccccagccatccccattcatgccccggcggcatattcatggggaatcatcaagcaagaaactccagaggtcgcagcgcatcagtgattcggatatttccgattacgaggttgatgatgggatcggcgtcgtgcccccagtcggctatcgttcctcagcgcgtgagagcaagtcaactaccctgacagtgcccgaacaacagagaaccacccaccatcgatcgaggagtgtcagccctcacagaggtaacgaccaaggaaaacccagaagtagactgcctaatgtccctttgcagcggagtctggacgagatccaccctacacggcgttcaagaagccccacaagacatcatgatgcttctagaagccctgttgatcacagaaccagagatgttgattcccagtacttgtccgagcaggactcagaactgctgatgctccctcgggctaaacgaggtagatctgccgagtgcctgcacaccacctccgagctgcagccattcttggacagggcacggtctgccagtacaaattgtcttcggcctgatacatcactgcactcacccgagagggagagggggaggtggagtccatcactcgaccgaaggagacccccttcaccgaggatccagatacagcacgcctcccccgagaatgacaggatgcacaggcagcgcagtcctacccaatcccctcccgctgacactagttttagctccagaagaggccgacagctgcctcaagtccctgtgcggagtgggtctattgaacaagaatcagggcataagaaattaaaaagcactatccagaggagtaccgaaaccgggatggccgccgagatgcggaaaatggttcgccaaccaagccgagaaagcacagacggctccatcaactcctacagcagcgagggaaacctgatcttccctggcgtgagattaggcgccgactcccagttctctgatttcctggacggcttggggcccgcccagttggtcggccgacaaactctagctacgccagccatgggagatatccagattggcatggaggataaaaagggccagctagaggtggaggttatacgggctagaagcctgacccagaagccaggctcgaaatcgacccccgccccctacgtcaaggtgtatttactggagaacggcgcatgcatagccaagaaaaagacccggattgccaggaaaacactggaccccttatatcagcagtcacttgtgtttgatgaatctccgcaggggaaagttttacaggtgatagtctggggcgactacggccgaatggaccacaaatgctttatgggagtcgcccagatactgctcgaagaactcgacctgagcagtatggtaatcggctggtataaacttttccccccctcttccctagtagaccctaccctcactcctctgactcgcagagccagtcagtcttccttggaatcatcaactggtcccccgtgcattaggtcctag

SEQ ID NO: 202809 - DNA, 4626 bp, Artificial Sequence
  Description of Artificial Sequence: Synthetic coding sequence
atgagcagcgccgtgggcccccggggcccccggccccccaccgtgccaccaccaatgcaagagcttcctgacctgagccacctgacagaagaagaacgaaatattataatggctgttatggaccgccagaaggaggaagaggagaaggaggaggctatgctcaagtgtgtcgtgagggacatggccaaacccgctgcttgtaagaccccgcgcaatgcggagaatcagcctcatcaacccagcccaaggctgcaccagcagttcgaaagctacaaagagcaggtccggaagatcggagaggaggctagaaggtatcaaggcgaacataaagacgacgcccctacgtgtggtatttgtcataagactaagtttgctgacggctgcgggcacttatgctcctactgcagaaccaagttttgtgcgaggtgcggggggcgagtcagcctgcggtccaacaacgaggataagtatgtaatgtgggtctgcaacctgtgtcggaagcaacaggagatcctgacaaagagtggagcctggtttttcggatctggcccccagcaaacatcgcaggatgggacgttatctgatacagccactggagccgggagcgaagtcccaagggaaaaaaaagcccgattgcaagaacgttcccgtagccagacccccctgtctactgcggctgcctcgtcacaggacgccgcccccccatcagcgcctcctgatcgcagcaaaggagccgaaccatcccagcaggcactgggcccagagcagaagcaggcttcctcccgaagtcggtctgagcctcctagagagagaaaaaaaacccctgggctatccgagcagaacggaaaaggcgctctgaagtctgagcgtaagagagtcccaaagacctcagcccagcctgtggagggcgccgttgaagaacgagaaaggaaggaaaggcgcgagagcagaagattggaaaagggccgcagtcaggactatcccgatacacctgagaaacgggacgagggcaaagccgccgatgaggaaaaacagcggaaggaagaggattaccagactagatacagatctgacccaaatctggctaggtaccccgtgaaacccccccccgaagagcagcagatgcgtatgcacgctcgcgtctccagggcccggcatgaaagacggcattccgatgtggctctgccgcgcaccgaggcaggtgcagctcttccagaaggtaaggcaggtaaacgggccccggctgccgcccgagcgtcccctcctgactcacctcgagcatattctgccgagcgcactgccgagacacgggccccaggcgctaaacaactgacgaaccacagcccacctgccccccgccacggcccagttcccgccgaagctcctgagttgaaggcccaagaaccgctcagaaagcagtctcgactggatccgagctctgctgttctgatgcgcaaagctaaacgggaaaaagtggagaccatgctcaggaacgattccctgtcaagcgaccagtctgagagcgtccgcccctctcctccaaagcctcacagaagcaagcgaggtggtaaaaagaggcaaatgagcgtgtccagtagtgaggaggaaggcgtaagcacccccgagtacacaagttgtgaggacgtagaactcgaaagtgagtccgtcagtgaaaagggggacctggattattactggctggaccctgccacctggcattctcgggaaacctctcccatctcgagccaccctgtcacatggcagccaagtaaagagggcgatagactcatcggccgggtgattctgaataagagaactacaatgcccaaggattctggggctctgctcgggcttaaagtcgtcgggggaaagatgaccgatctgggcagactgggggcatttattacaaaagtcaaaaaaggttccctggcagacgtggtggggcacctccgcgcaggcgacgaagtccttgaatggaatggcaaaccactgcccggtgctacaaacgaggaggtatacaatatcatcctggagtcaaaaagcgaacctcaggtggagatcatcgtgagcaggccaattggtgacattccaagaatccctgagagtagccacccacccctggaatccagctccagcagctttgagagtcagaagatggaacgcccatccatctctgtcatctcccccacttctcctggtgccctcaaggacgccccccaggtgctgcccggtcagctgagtgtgaaactgtggtatgacaaagtggggcatcagctaattgtgaacgtccttcaggctaccgacctgccggccagggtagatggacggccaaggaacccatatgttaagatgtattttctgcccgatcgctcggacaaaagcaaaaggcggaccaagaccgtgaagaagattctggaaccaaaatggaaccagacttttgtgtactcacatgtccaccgccgtgatttcagagaacgaatgctggaaataacagtgtgggaccagccacgagtgcaggaagaagaatccgaatttcttggggagatcctcattgaactcgaaaccgccctgctggatgacgagccacattggtataaactccagactcacgacgagagcagtttgccactgccgcagccttcgccgttcatgcctagaagacacatccacggtgagagcagctccaaaaagctgcagcgatcccagaggatctccgattctgacattagcgactatgaagtcgatgacggaatcggagtagtaccacccgttggatacagatctagtgctagagaatcaaagtcgaccactttaacagttcctgagcagcagcggacaactcaccacagatcgcggtctgtttccccacacagaggcaacgatcagggcaaacctcgatctcggctgccaaatgtgcctttacagcgttcgttggacgagatccatcccacaaggcgctcccgctcgccgactcggcatcatgacgcaagcagatcaccagtggaccaccgtactcgcgatgtagatagccagtacctgagcgagcaggattcagaactgctgatgctaccaagagctaaacgggggagaagtgctgaatgtttacatactacccgccacctagttagacactacaagacgctcccaccaaaaatgccattgctgcagtcttcatcacactggaacatttattcagagctgcagcccttcttggatagggctcggtcagcctctaccaattgtctgcgaccagatactagcctgcattctcccgagagggaacgaatgcatagacagcgttcacctacacagagcccccctgctgacacctcatttagcagcaggcggggtaggcaactaccccaggtgcccgtacgatcggggtcgattgaacaggcctctctggttgtggaagaaagaacccggcaaatgaaaatgaaagtccataggttcaaacaaactactgggagcggatccagtcaggagttagaccgcgaacaatacagcaaatataacatacataaagatcagtaccgtagttgtgacaatgttagcgcaaagagctccgattcagacgtgtcagacgtgtctgcgatctcccgcacatctagtgcttcacgactcagctcgaccagcttcatgtctgagcagagcgaacgccccagaggacgtatttcttcctttacccccaagatgcaaggtagaaggatgggcactagcgggcgttcaattatgaaaagtacgtcggtttctggagaaatgtacacactagaacacaatgacgggtcccagagtgacacagcagtcgggacagtaggcgccggtggcaaaaagagacggtcaagtctgtcggcaaaagtggttgctattgtttctaggcgctcccgtagcactagccagctgagccagactgagagcgggcacaagaaactgaaaagtacaattcagaggagcaccgagacaggcatggctgccgagatgaggaagatggtgcgccaaccctcacgagaatccacagatggaagcatcaacagctacagctctgaaggcaacttaatctttccaggcgtgaggctgggagctgactctcaattctctgactttcttgacgggctgggtcccgcccagctggttgggagacagaccctggccacacccgccatgggcgatattcaaatcggtatggaggacaagaaaggacagttggaagtggaagtcattcgtgctcgatccctgacccaaaagcctggtagcaagagcactcccgccccgtacgttaaggtttatctgctggaaaatggggcctgtatcgccaaaaaaaaaacacgcattgctaggaaaacactcgaccccctgtatcagcaatctctggtctttgacgagtcacctcagggaaaagtgctgcaggtgattgtgtggggcgattacggtcggatggatcacaaatgtttcatgggcgtcgcacagattctgttagaggagctggatttgtcatcaatggtgatagggtggtacaaattatttcccccatcatcccttgtcgacccgacactgacccctctgactcgacgggccagccagagctcattagaatcttcaaccggccctccttgcattcggtcgtag

SEQ ID NO: 202810 - DNA, 4446 bp, Artificial Sequence
  Description of Artificial Sequence: Synthetic coding sequence
atgagcagcgccgtgggcccccggggcccccggccccccaccgtgccccctcccatgcaagaactccctgatctgtcgcacttaacagaagaggagagaaacatcattatggcagtcatggaccggcaaaaagaggaagaggagaaggaggaggccatgctaaaatgtgtggtgcgagacatggcaaagcctgctgcttgcaagacgcccagaaatgcagaaaaccagccacaccagccctccccccggctccaccagcagttcgaatcatacaaggaacaagtgaggaaaatcggcgaagaagcaaggcgctaccaaggcgagcacaaagatgatgctcccacatgtggcatttgccacaagaccaaattcgccgatggttgtggacacttatgtagctactgccggacaaaattctgtgcacggtgtggcggcagggtatcactgagatctaataacgagaataagatcgtaatgtgggtttgcaacttatgccggaagcagcaggaaattctgactaagtctggagcctggtttttcggcagcggacctcaacagacatcacaggatggaactctgagcgatactgcaacaggcgctggatcagaggtgcccagggagaaaaaagctaggctccaggaacggagccgttcgcagactcccctgagcaccgctgccgccagctcccaggatgcagcgcccccaagcgctccgcccgatcgatctaagggagccgagcctagccaacaggctcttgggcctgaacagaaacaggcttcatctagaagcaggagcgaaccgcctagagagcgcaaaaaaacacccggcctctccgaacagaatggcaagggagcactcaaaagcgaaaggaaaagggtgcccaagaccagtgcccagccagtcgaaggagccgtcgaagaaagggagaggaaagaacggagggagtctaggaggcttgaaaagggaaggtcccaggactacccggataccccagaaaaacgcgacgagggcaaagcagctgacgaggaaaaacagcgaaaagaggaggactaccagaccagataccggtcagatcccaatctcgcaagatacccagtcaaaccaccccctgaagagcagcaaatgcgcatgcatgctcgagtgtcccgcgctcgccacgagagacggcattcggatgtggccttgccaagaacagaagcaggggccgccctgcctgaaggtaaagctggaaagagagcacctgccgctgctcgtgcatcccctcccgatagccccagggcatattccgctgagagaacagctgagacgcgcgcccccggtgctaaacagcttacgaaccattctcctccagcaccacgacacggtccagtgccagcagaagcacctgaactgaaggcccaggagcctctgcgcaagcaatcgagactcgatccgagcagcgccgtcctgatgcggaaggccaagagggagaaagtcgaaacaatgctgagaaacgacagtctgtcatccgaccagtcagaatctgtccggccctccccaccaaagcctcaccggtctaaaaggggcggaaaaaaaaggcagatgagcgtcagttcatctgaagaggaaggagtgtcgaccccagagtacacatcatgtgaagatgttgagctcgagagtgagtctgtgtcagaaaagggggacctggattactactggttggacccagctacgtggcactctcgcgagacgagcccgatctctagccacccagtgacttggcagccctccaaagagggggatagactaattggaagagtgattctgaataaaaggaccacgatgcccaaggatagcggcgccttgcttggtctcaaggtggtcggggggaagatgactgatctaggtcgcctgggtgcctttataacaaaagtgaagaagggcagcctggccgacgtcgttggacatctacgagcaggggatgaagtgctcgagtggaatgggaaaccactgcccggcgctactaatgaggaggtctataacattatcctagagagtaagtctgagccacaagttgaaattatagtcagccgtccgatcggggacattcctaggatcccagagtcctctcatcctcccttggagagcagtagctcgagttttgaaagtcagaagatggaaagaccatctatctcagtaatttctcccacatctcccggggcactgaaagatgctcctcaggtgttgccgggacagctctcagtcaagctctggtacgataaggtcgggcaccagctcattgtgaatgtcctgcaggcgacagatcttcccgccagagtagatgggaggcctaggaacccttatgtgaagatgtacttccttccagatcggagcgataagagtaagcggcggacaaagaccgttaaaaagatcctggaacctaaatggaatcagacattcgtttactcacacgtgcaccgtcgggattttcgcgagcgtatgcttgaaatcaccgtttgggatcagcctcgcgtgcaggaggaagagtccgagtttttgggggaaatcctgatagaactggaaaccgcactgttagacgatgaaccccactggtacaaattgcagactcacgacgaatcctccttaccactccctcagccgtccccgttcatgccgcgacgtcacatccacggcgagtcgagtagcaaaaaactgcagcggagccagagaatatccgacagcgacatctctgactacgaagtggacgatgggatcggcgtcgtgcctccagtggggtatcgcagctcagcgcgtgaatcaaaaagcactacactcaccgtgccagagcagcagagaactacgcaccaccggtctagatccgtctcccctcacaggggaaacgaccaagggaagccccgctctcgcctgccgaacgttccattgcagcgcagtttagacgaaattcaccccacccgacgtagccgtagccccactaggcaccacgacgcaagccggtcgccagtggatcatcggactagggacgtggacagccagtacctgtccgaacaggatagtgagttacttatgctcccccgagccaaacgcgggcggagtgccgagtgcctgcacacaacaagcgagctgcagccatttcttgatagagctaggagtgcctctacaaattgtcttcggccggacacaagtctgcacagccctgaaagagagcgtatgcatcgccagcgaagcccaacccagtcacctccagccgacacttcgtttagttcaaggcgtggacgtcaacttcctcaagtcccagttcgttccgggagtatagaacaggcctctctggttgttgaggagaggacgcgtcaaatgaagatgaaggttcatcggtttaagcaaactacgggaagcggtagttcccaggagcttgacagggaacagtactcaaaatacaacatacacaaagatcaatacaggtcctgtgacaatgtgtcagcgaaatccagcgacagcgatgtttcagatgtcagtgcgattagcaggaccagttctgccagcaggttgagttccacaagctttatgtcagagcaatccgagcgcccccgggggagaattagcagctttacccccaagatgcagggacgccgtatgggcacgagcggacgcagcataatgaaaagtactagcgtgagtggggagatgtacacattggaacacaatgatggatcccagtcagacacggcagtgggcacagtcggagcgggcggtaaaaagcgaaggagctctctgagtgctaaagtggtggcaatcgtgagccggaggtctcggagtaccagccagctgtcgcagaccgaatctggtcacaaaaagctaaagtccacgattcagaggtctaccgagactggtatggccgctgaaatgaggaaaatggttagacagccttctcgggaaagcaccgatggcagtataaacagctactccagcgaaggcaatcttatcttcccgggggtgcggctcggagcagactcccagttcagcgactttctggacgggttaggacccgcacaactggtcggccggcagacattggcgacgccagcaatggccccgtacgtgaaagtgtatcttctggaaaatggggcttgtatagcaaagaagaagactaggatcgcccgcaaaaccctggatcctctataccagcagagtttggtgttcgacgaaagtcctcagggtaaggtgctgcaggtcatcgtgtggggtgattatggaaggatggatcacaagtgcttcatgggtgtggctcagatcctgctagaggaactagatctttccagtatggttataggatggtacaagctttttcccccatcttccctggtggatcccactcttactcctcttacaagacgcgctagccaaagttcgttggagtcgtctaccggccctccctgcataagatcctag

SEQ ID NO: 202811 - DNA, 4446 bp, Artificial Sequence
  Description of Artificial Sequence: Synthetic coding sequence
atgagcagcgccgtgggcccccggggcccccggccccccaccgtgcctccgcccatgcaggagcttccagatctctctcatctgactgaggaggagcgaaacataattatggcagtgatggatcgccagaaagaggaggaagaaaaagaagaagccatgctaaagtgcgtcgtgagagatatggctaagccagctgcatgtaagactcctcggaacgctgaaaatcaaccccaccagccttctccacgtctccaccaacagtttgaaagctataaagagcaggtgcgcaagattggagaagaagctcgccgctaccagggtgaacacaaggatgacgcgcccacttgtgggatttgtcataaaaccaagttcgcagacggttgcggacatctgtgctcttactgcagaacaaaattttgtgcccgctgtgggggtagggtgagtcttaggagcaataacgaggacaaagtggtgatgtgggtgtgcaatctgtgcaggaagcaacaagaaattctgactaagtcaggagcctggttttttggttcagggcctcagcaaactagtcaagatggaaccctgtcagataccgcgactggggccggatcagaagttccccgggaaaagaaggctaggctgcaggagaggtcacggagtcaaactcctttgtctacagccgctgccagttcgcaggatgctgctcccccctcggcaccccctgataggtctaagggcgccgaacctagtcaacaagctctggggcctgaacagaagcaggcatcatcccggagcagatccgaacctcctcgggagaggaaaaaaacacccgggctgtcagagcaaaacggaaaaggagccctcaagtctgagcgcaaaagagtgcctaagaccagcgcgcaacccgtggagggtgctgtagaggagagggaacgcaaggaaaggagggaaagccgccggctggaaaaggggcgaagtcaagattaccccgatacaccagagaagcgagacgaaggtaaagcagccgatgaagagaagcagagaaaagaggaggactaccaaactcgataccgttcagatcccaatctggcacggtacccggtaaagcccccgcccgaagaacagcaaatgagaatgcacgctcgggtttccagggcccggcacgagcgaagacacagtgacgtggcactgcccaggaccgaggctggggctgccctgccagaaggcaaagccggcaagcgggcacctgccgctgcaagagctagcccccctgatagtccacgggcttatagcgcggagagaacagccgagactagagctcctggggctaagcagctaaccaatcactccccgcccgccccccgacatggtccagtgccagctgaggcaccggaactcaaggctcaggaaccgctgagaaagcagtctcgactcgatccaagctctgcagtgctcatgcggaaagcgaagagagaaaaagtggagactatgctaaggaacgactctctttcttctgaccagagtgagagcgtgagacccagtccccctaagcctcaccggtccaagaggggcggaaagaaaaggcagatgtcagtcagttcctccgaggaggaaggcgtgtctacccctgagtacacgagttgtgaggatgttgagcttgaatccgaaagtgtgtccgagaaaggggacctcgactactattggctggaccccgcaacctggcacagcagggagacgagcccaatttcaagccaccccgttacatggcagcctagtaaagaaggcgaccgccttatcggacgggttattttaaacaagagaaccaccatgccaaaagatagcggagcgctcctggggctcaaggtggtaggcggaaaaatgactgatctgggccgactgggtgcctttatcactaaggttaagaaggggtccctcgctgacgtagtgggccatctgcgtgcgggggatgaggtattagaatggaatgggaagccgctcccaggggctaccaacgaagaggtgtacaacattattctcgagtccaagtcggagcctcaggtggagatcatcgtgtcaaggccaatcggagatattccacgcattccggagtcaagccatcctcctctagagtcctcatcatcaagctttgagagccaaaagatggaacggccaagcattagtgtcataagcccaacaagcccaggtgccctgaaagatgcacctcaggtgttgccgggacagctctcagtaaagctctggtatgataaagtcgggcaccagctaatcgtcaacgtgcttcaggcaacagacctgcccgctcgtgttgacggtcggcctcgcaatccatatgttaagatgtactttctgcccgatagatctgataaaagtaagagacgcaccaagactgtgaagaaaattctcgaacccaaatggaaccagaccttcgtctatagtcacgttcacagaagagattttcgcgaaaggatgttggaaattacagtttgggaccagccacgcgtgcaagaggaggagagcgagttcctgggtgagatcctgatagaactggaaactgctcttctcgacgatgagccgcattggtataagctgcagactcacgacgaaagtagcctgccattaccacagcctagccctttcatgcctcgccggcacatacatggggagagctcctcaaaaaagcttcagcgaagtcagaggatcagcgactctgatatcagcgactacgaagtcgatgacggaatcggtgtggtgccaccagtgggctacagaagctctgcacgggagtccaaatccaccacgttgactgtgcccgagcagcagaggaccacgcatcatagatcccggtctgtgtctcctcatcggggaaatgaccagggtaaacctcgatctagattgcccaatgtccctctccagcgctctctggacgaaattcatcctaccagaagatcccggtccccaactagacatcatgatgcatcccggtcaccggtggatcaccggacacgggacgtggactcacagtacctgagtgagcaggatagcgaattgctcatgttgccgagagcgaagagggggcgctctgccgaatgccttcacacaacaagcgagctccaaccctttctcgacagggctcgctccgccagcactaactgtttacggcctgataccagcttacacagtccagagagagaacgcatgcacagacagcggtctcccactcaaagcccgccggccgatacaagcttctctagtaggcgcggaaggcaattgcctcaggtccccgtgagatccggatcaatagagcaggcctcactggttgtcgaggagcgcaccagacagatgaaaatgaaggttcaccgcttcaagcagacgaccggttctgggtcatcccaagaactggaccgggaacagtattctaagtataatattcacaaagaccagtaccgcagctgtgataacgtatccgcaaagtctagcgatagcgacgtgtcagatgtgagtgctatctcccgaaccagctcagccagcagactctcaagtacctcctttatgtccgaacagagcgagagaccaaggggacggataagctcctttaccccaaagatgcagggcagacgtatgggaacttcgggcagaagtatcatgaaaagcaccagcgtgagcggtgaaatgtacaccctggaacacaatgacggctcacagagcgacacagctgtaggcactgttggagccggtggaaaaaagcggaggagcagcctgagcgccaaagtcgtggctatcgtctcaagacgaagcaggtccactagtcagctgtcccagactgaaagtgggcacaagaaactgaagtccactattcaaaggagcacagagactggtatggctgcagaaatgagaaaaatggtgcgccaaccttctcgagaatctaccgatggcagcatcaattcttatagtagtgagggtaatcttatcttccctggtgtaaggctcggggccgactctcagttctccgacttcttggacggcctggggcctgcccaattggtggggcggcaaactcttgccacacccgctatggccccttacgtcaaggtctacctgctggagaatggggcctgcatagctaagaaaaagactcggatcgcccggaaaacactggatcctctgtaccagcaaagtttggtatttgacgaatcaccacagggcaaagtgctgcaggtgatcgtatggggggattatggccgaatggaccataaatgctttatgggggttgctcagatactcctggaggagctcgacctgtcgtccatggtgatcgggtggtacaaattgtttcctccctcctctttggtggatcctactctgactccgttaaccaggagagcaagtcaaagcagcctggaaagtagtaccggccccccctgtatccgcagctag

SEQ ID NO: 202812 - DNA, 5079 bp, Artificial Sequence
  Description of Artificial Sequence: Synthetic coding sequence
atgagcagcgccgtgggcccccggggcccccggccccccaccgtgcctcctccaatgcaggagctgcctgatttgtcacatctgacagaagaagagcgcaatattatcatggcggtcatggaccgccagaaagaagaggaagagaaggaggaagctatgttgaaatgtgtggtgcgcgatatggcaaagcctgcggcctgcaaaactccaaggaacgctgaaaatcagccccaccagccaagtccgaggttgcatcagcagttcgaatcttacaaagagcaggtccgtaagataggtgaggaggcccgtcgatatcagggagagcataaagatgatgcccctacatgcgggatatgtcataagactaaattcgccgacggttgcggccatctatgttcttactgtaggactaaattctgcgcacggtgtggaggccgcgtgtccctgcgctcaaacaacgaggataaggttgtgatgtgggtatgcaacttgtgcagaaaacagcaagaaatcctgacgaaatccggtgcctggttcttcggtagtggaccccaacagaccagtcaggatggaacactgtccgatacggccactggcgccgggagcgaagtccccagggaaaagaaagcccgactgcaggaacgaagcagatcacagacacctctgtccaccgctgccgctagctcacaagatgccgctcccccatccgctcccccggacagaagcaaaggtgccgagccaagtcaacaggccttagggcccgaacaaaaacaggccagctcccgaagtcgctcagagcctccccgcgagcggaagaagaccccgggattaagcgaacagaacggcaaaggggccctgaaatcagaacgtaagagggtgcctaaaaccagcgctcagccggtggaaggggccgtcgaagagagagaacgtaaagagcgcagggaatcccgcaggctggaaaaagggaggagccaggactaccccgatacacctgaaaaaagagatgaggggaaagcggccgacgaggagaagcagagaaaggaggaggactatcagacacgctatagatcagatccaaatctggcgcggtatcccgtcaaacccccccccgaagagcagcagatgcgcatgcatgctcgcgtcagccgggcccgccatgaaaggaggcactctgatgttgcgctcccaagaaccgaggcaggggctgccctgcccgaaggcaaggcagggaagagagccccggctgcagcgagagcaagcccccccgatagcccacgggcctatagtgctgaacgaacggccgaaacaagagccccaggggcaaaacagctaacaaaccatagccctccggcgccgcgtcatggaccggtccctgccgaggcgcctgaacttaaggcccaggaacccttacggaagcagtcccggctcgatcccagctccgcagtacttatgaggaaagcaaaaagagaaaaagtcgaaaccatgcttcgaaacgactccctgtcatctgatcagagtgagtccgtccgaccgagccctccaaagccccatcgttcaaagaggggagggaagaaacgccagatgagtgtgagttcatccgaagaggaaggcgtatctacacctgaatacaccagctgcgaagacgtggagctggagtctgaaagtgtctccgaaaaaggagacctcgactattactggctagaccctgccacatggcatagtcgtgagacgtcccctatctcaagccatccagtaacatggcagcccagcaaggagggggatcgcctgattggaagagtcattctgaacaagcgaacaactatgcccaaggactctggcgcccttctcggattgaaagtcgtcggcggaaaaatgactgatctagggcgtctgggggccttcataacaaaggtcaaaaagggaagtctcgcagacgtcgtgggccatctcagggccggagatgaggtgctggaatggaatggcaaaccattacccggagcaacaaatgaagaggtttataatatcatacttgaatccaagtccgagcctcaggttgaaatcatcgtttcccggccgataggagatattccgcgaatccctgagagctctcatccccccctggagagctccagctcttcatttgaatcacaaaagatggagcgcccatcgatctcagtgatcagccctacttcccctggcgctctcaaggacgccccgcaggtccttcctggccaactcagcgtgaaactttggtacgataaggtggggcatcaactgatcgtcaatgtccttcaggctacagacctcccagcccgggtggacggtcgcccccggaatccatatgttaaaatgtacttcctgcccgaccggtctgataaatccaaacggcggaccaagaccgtgaagaagatcctggaacccaaatggaaccagacctttgtatactctcacgtgcatcgaagagactttagggagagaatgctggagatcacggtgtgggatcagccacgcgtccaagaggaagagagtgagttcttaggtgagattttaatagagctggaaacagcattgctcgatgacgagccacactggtataagctacaaactcacgacgagagtagcctgcctctcccccagccgtctccattcatgcccaggcgacacattcatggagagagctcttctaagaagttgcagcgctcacagaggatatccgatagcgatatttcagattacgaggttgatgacggtattggtgtcgtgcctcctgtgggataccgctcctccgcgcgcgagtccaagagcactactcttaccgtgcccgagcagcagcgaaccactcatcacagaagcagatctgtgagccctcacaggggcaatgatcaagggaagcctagatcccggttacccaatgtgccactccagcgaagtctggacgagatccatcccacccgccggtctcgaagcccaactagacaccacgatgcaagtagatcacccgtcgatcaccgcacacgcgacgttgatagccagtatttgagtgaacaggacagtgaactgctgatgctgccacgggctaaaagaggcagatcagccgagtgtctgcacaccacccgccatctggttaggcactataagactctccctcccaagatgccgctgttacagtcctcgagccactggaacatctactcaagcatccttccggcacacacaaaaactaaaagcgtgactagacaagatatatcgcttcaccacgagtgctttaactccaccgtcctgaggtttaccgatgaaatcctggtttccgagctgcaacctttcttagaccgcgctaggtccgccagcaccaactgcctgagacctgatacgagtctgcacagcccagaacgcgaaaggggacggtggtcaccatcacttgatcgccgcaggcctccttctccaaggatccagatccagcatgcatcaccagagaatgacaggcacagccgtaagtctgagcgatcctctatacagaaacagacacgcaaaggtaccgcttctgatgctgagagggtcctgccgacatgtctatcccgtcgcgggcacgccgctcctcgagcaacagaccaacctgtcattcggggcaaacatcccgcaagaagcaggagcagcgagcattcctccatccgcaccttgtgttctatgcaccatcttgtacccgggggtagcgcccctccaagtccactgttgacaagaatgcataggcagcgctcacccacacagagtccacctgccgacacatcatttagctctcgaagagggagacagctgccacaggtcccggtacggtctggctctatcgagcaggcaagcttagtggtggaggagcgtacccgccagatgaagatgaaagtgcatcggtttaagcagacaaccggcagtggctcctcacaagaattagaccgggagcagtacagcaagtacaatatccataaggaccagtatcgatcatgcgataacgttagcgccaagtcatccgatagtgatgtcagtgacgtgtctgccatctcacggacatcttcggccagcaggttgtcatctacctccttcatgagcgaacaaagcgagagacccagaggtagaatttcgagctttacccccaaaatgcagggccgcaggatgggaacaagtgggagaagcatcatgaaatccacctccgtgagtggcgagatgtacacactggaacataatgatggttcccaatcagatacggccgtgggtaccgtgggtgccggcggcaaaaagcgccgcagcagcctgtctgccaaagtggtggcaattgtcagtagaagatcacgtagcacatcacagctctctcagaccgaaagcggtcataagaaactcaagagtaccatccagaggtcaacagagacaggaatggcggcagagatgcggaagatggtcagacagccctcccgggaatcaacagatggatccattaactcctattctagcgagggaaatctgattttcccaggcgtccgcctgggggcggattctcagttctccgacttcctggatggcctcgggcccgcccagttggtgggacggcagactctcgccactcccgctatgggcgacatacagataggtatggaagacaaaaagggacagttggaggtggaggtcattagggcgagaagcttaacacagaagcctggcagcaagtctacaccggctccatatgtcaaggtttacctcctggaaaacggcgcatgtatcgccaagaaaaagacccggattgcacgcaagactctggaccctttgtaccagcagagcctggtgttcgatgagagtccccagggtaaggtcttgcaggtgatcgtgtggggtgactatggaagaatggatcacaagtgctttatgggagtcgcccagatcttgctggaagagctggatctgagtagtatggtgatcggctggtacaaactgtttccaccttccagtcttgtggacccaacgctgacaccactgacccgacgggcaagtcagtcttctttagagtcctcaaccggccctccttgtataaggtcctag

SEQ ID NO: 202813 - DNA, 1497 bp, Artificial Sequence
  Description of Artificial Sequence: Synthetic coding sequence
atgctgccccgggccaagcggggccggagcgccgagtgcctgcacaccacgagacactccaggaagtctgagagatcctcaattcaaaagcaaacgcggaaggggacagctagtgatgccgaacggatgcaccgacagagaagcccaacacagtcgccacccgccgacacaagtttctcctcgagaagaggccggcaactgcctcaggtccccgtgcggtctggatcaatagaacaggaacaggaaaaatacaactctagtacaaaagcatcacttgtggtcgaagaacgcactcgccagatgaagatgaaagttcaccggttcaagcaaacaaccggctctgggtccagtcaggaactggatagggagcaatacagcaagtacaatatacacaaggaccagtatcgatcctgtgataatgtcagcgcaaaaagctcagacagcgatgtctcagacgttagtgccatcagtcgcaccagctccgcttccaggctttctagtacaagctttatgagcgagcagtctgagagaccgagaggccggatttcctcatttacgcccaagatgcagggtcgtaggatgggaacctccggcaggagtatcatgaagagcaccagcgtgtccggcgagatgtacacgctcgagcataacgacggaagccagtcagataccgctgttggaacagttggagcaggcgggaaaaaaagaagatcttccctcagcgccaaggttgttgctatcgtgtctcgcagatcccgatcaacttcccagctgagtcagactgaatctggccataagaaacttaagtccaccattcagagaagcacggagactgggatggcagcagagatgcgtaaaatggtacgtcagccatcccgtgagtctacagacggatctatcaattcatatagtagcgaaggaaatctcatcttccctggcgtccgactcggcgccgattcacagttctcagacttcctcgacggtctgggcccggcacagctcgtcggcaggcagactttggcaactcctgccatgggagatattcagatcggcatggaagacaaaaaagggcaattagaggtggaggtcatacgagctagatccctgacccagaagccgggtagcaaaagcacccctgccccttacgtcaaagtgtatctcctggaaaacggtgcatgtatcgcaaagaagaaaacaagaattgctcgaaaaacactggatcctctctaccagcaatctctggtttttgacgaatctcctcagggtaaagttcttcaagtcattgtgtggggcgattatggccgcatggatcacaagtgtttcatgggggtcgctcaaattctgctcgaggagctcgacttgagctctatggtcattggctggtataagctgttcccccccagtagcctggtagatccgactctgacacccctcaccagaagggctagccaatcctcactggaatcgagtaccggtccgccgtgtatccgttcatag

SEQ ID NO: 202814 - DNA, 3039 bp, Artificial Sequence
  Description of Artificial Sequence: Synthetic coding sequence
atgtgcgcccccggcatccacgtgagcagcgagggctgggaggaggtccgctctgttgatagtgaagaagggactattgaagcacggcgtgccgtggcgggcgatctcgattactactggttggaccccgcaacctggcatagtcgagagacatcccctatttctagccaccctgtgacctggcagccctctaaagagggggaccgcttaatcggccgtgtcatactcaataagcggactaccatgccaaaggattccggggccttattaggccttaaggtagtcggcggaaaaatgactgatttgggcaggctcggcgcttttataacgaaagtcaagaaagggtcacttgccgacgtggtagggcacctaagagccggtgacgaagttctcgaatggaacgggaagccgcttcctggagcaacgaacgaggaagtttacaatattatcctggaaagcaaatctgaaccccaagttgagattattgtaagtcgccccatcggtgacatacctcggatccccgaatcctcccatcctccgttggagagttctagctctagctttgaatcacagaagatggaacgcccaagcatctcagtgataagccctacatcacctggcgcactgaaggatgctcctcaggttctgcccgggcagttgagtgtgaaattgtggtatgacaaggtgggccaccaactgattgtgaacgtacttcaggctacagacctgcctgccagggtggacgggagaccacggaatccatacgtgaaaatgtacttcctgcccgacagaagtgataaatccaagcgtaggaccaagacagtcaagaagattttggagccaaaatggaatcaaacattcgtgtatagccacgtccaccgtcgcgatttcagggagcggatgctggaaatcacagtctgggatcagccgcgggtacaggaggaagaatccgaattcctgggtgaaatactcattgaacttgaaacggccctgctggatgacgagccacactggtacaagctccagacacacgatgaatcctccctgccgctcccgcaaccgagcccattcatgcctcgaagacatatacacggcgaatctagctctaagaagttacagagatcgcagcgcatttctgactctgatatatcggactacgaagtggatgatggcattggcgtagtgccgcctggatatcgtagtagcgcaagggagagcaagagcacaacattaaccgttccagagcaacagaggaccacccaccatagaagtaggtctgttagcccacaccgcggaaacgatcagggtaagccaagatcgaggctgcccaacgtgccgctacagcgctctctcgacgaaatccaccctacgcgcagatctaggtcacccactcggcaccacgacgcgagtcgctcccccgtcgaccatagaacccgggacgtggactcccaatacttgtccgaacaggacagcgagctgctaatgctcccacgggctaagcgcggacgatctgcagagtgcctgcacacaacaagtgagctgcaaccattcctggaccgcgctcgaagcgcctctactaattgtctgagacccgacacttcccttcattccccagagagagaaaggcacagcagaaagtccgaaagatcatcaatccagaaacagacccgaaagggcactgcttccgatgcggagcggatgcatcgtcaaaggagtccaacccagtcccccccggccgatacctcgttttcctcaaggcgcggcaggcaactgccacaggtgcccgtcaggtctggatcaattgaacaggcctctctggtggtagaagagagaaccagacagatgaagatgaaagtacaccgctttaaacaaaccacaggttctgggtcaagccaagaattggatcgggaacagtactcaaaatacaacattcataaagaccagtacaggtcttgcgacaacgtgagtgctaagagcagtgatagcgacgtgagcgacgtgagcgctatcagcaggacaagtagtgccagccgcctgtccagcaccagcttcatgtctgaacagagtgagcgccccagagggcgcatcagctcatttactcccaagatgcaggggcgccgtatggggacctcagggaggagcatcatgaagtccacctccgttagtggagagatgtacacgttggaacataacgatggttcgcagagcgacaccgcggtgggcacagtcggcgccggcggaaagaagagacgaagttcactgagcgccaaggtggtggcgatcgtaagtaggcgttccagaagtacgtcacaactgagccagactgagtccggccacaagaaactgaaatcaactattcagagaagcacagaaacaggcatggccgccgagatgcgtaagatggtgcgccagccgtcaagggaatcaactgacgggtcaatcaactcatattccagcgagggaaacctgatttttcccggggttcgacttggggccgattcacaattctctgatttcctcgacggtctgggccccgcccagttggttggcaggcagactctggcaacacccgcaatgggagacatccagatcgggatggaggataagaaaggacagctggaggtcgaagtcattcgggcaaggagtctgacccagaagccaggttctaagtctacgccggccccatatgttaaggtatatttgttggagaacggtgcctgtattgccaaaaaaaaaaccagaattgctaggaaaaccctggatccgctttatcagcagagcctggtcttcgatgagtcaccccagggcaaagttctgcaggttatcgtgtggggtgattatggccgcatggaccacaagtgcttcatgggtgtggctcagattctgcttgaggagctggatttatcttccatggtgatcggctggtacaaactttttccacctagcagcctggtggatcccaccctgaccccacttacccggcgcgctagccagagctccctcgagagtagtacaggcccgccttgcatcagaagctag

SEQ ID NO: 202815 - DNA, 660 bp, Artificial Sequence
  Description of Artificial Sequence: Synthetic coding sequence
atggccgccgagatgcggaagatggtgcggcagcccagccgggagtcaaccgacggctcgatcaactcttattcctctgagggcaatctcatatttcctggtgtccgtctcggggcagactcccagttttccgatttcttagacgggttggggcctgcgcagcttgtcgggaggcaaactttggccactcccgctatgggtgacatacagatcggcatggaggataaaaaaggacagctggaggtcgaggttattcgagctcgcagcctgactcagaagcccggaagtaagtcgacaccggctccttatgttaaggtctacttgctggagaatggggcctgcattgctaagaagaagactcgaatcgccaggaagaccctcgatcctctataccagcaatccctggtctttgacgagtctccacagggaaaggttcttcaggtaattgtttggggcgattacggtcgcatggaccacaagtgctttatgggagtggctcaaattctgctggaagaattggaccttagctcgatggtgatcggttggtacaagctttttcctccgtcttcactggtggacccaactttgacccctctgactcggcgtgccagccagtcctccctggagtccagtactggccccccctgcatcagatcctag

SEQ ID NO: 202816 - DNA, 2283 bp, Artificial Sequence
  Description of Artificial Sequence: Synthetic coding sequence
atgcccaaggacagcggcgccctgctgggcctgaaggtggtgggcggaaagatgaccgacctcgggcgacttggggcattcatcactaaagtgaagaaggggtcattggccgacgtggtaggacatctacgtgcaggcgatgaggtgctggaatggaacggcaaaccactcccgggggcaactaatgaagaggtgtataatataatactcgagtcaaaaagtgagcctcaagtagaaataattgtgagtagacccatcggagacatcccacgcatacccgagtcaagccacccaccactggagagcagcagctcgtcctttgagagtcagaagatggaacgcccaagcatttcagttatctcgccaacctcgccaggggccctcaaagacgcgcctcaggtccttcccggtcagttgtctgtgaagttgtggtacgacaaagtaggacaccagctcatagtgaacgttctccaggcgaccgatctcccagccagagtagatgggcgtccacggaatccctatgtcaagatgtattttctgcctgacagaagcgacaagagcaaaagacgcaccaaaacagtcaagaaaattttggagcccaagtggaaccagacgttcgtttactcccacgtgcataggagggattttcgtgaacgaatgctggagatcactgtgtgggaccagccccgagtgcaagaggaagaatcagagtttctgggagagatcctgatcgagttggagaccgccctactggacgatgaacctcactggtacaaactgcagacgcatgatgagagctccctgccactcccccagccaagtccttttatgccccgtagacacatccacggagaatcgtccagtaagaagctacagcgctcccagcggatatccgactcagacataagcgactacgaggtagacgacgggatcggcgtcgtgccacctgttggctaccgctcgtctgcgagggaatcaaagtctactaccctcactgtcccagagcagcagaggaccacacaccatcgctctcggtctgtaagcccccaccgcggaaacgatcagggtaaacccagatccagattgcctaacgtacctcttcagagaagcctggacgagatccacccaacgcgtcggagccgaagtcccacaagacaccacgacgccagccggtcgccagttgaccacagaacccgcgacgtcgattcccaatatctcagcgaacaggactctgagctgctgatgttgccacgcgctaaacgcggccgctcagccgaatgcttgcacacaacctccgaattgcaacctttccttgaccgcgccaggagtgcctcgacgaactgcttgcgaccggacacatctctgcacagcccagagcgagaacgacactcacgtaagagcgagcggagttcgatccagaagcagacgagaaaggggacagcctctgatgccgagcgcatgcaccgccagcgtagtccgacccagtctcccccagcagacacttcattctcctccaggcgagggcggcagctcccccaggtacccgttaggtccgggtccatcgagcaggaatccggccacaaaaagcttaaatctacaatccaacgcagcaccgaaaccgggatggccgccgagatgcgtaaaatggtaagacagcccagccgggagagtaccgacgggtccataaacagttattccagcgaaggcaacttaattttccccggtgtgaggctgggcgctgactctcagttttccgacttcctcgacgggctgggcccagctcagctggtgggccggcaaaccctggccactcctgccatgggggacatccagataggaatggaggataaaaaaggccaactggaggtggaagtgattcgagcccgaagcctaacccagaagccaggatccaaatccacaccagcgccttatgttaaggtgtatttgttggagaacggcgcctgcattgccaaaaaaaagacccggattgctagaaagacgctcgatcccctgtatcagcagtctctcgttttcgatgaatctcctcagggtaaggttctgcaggtgatagtttggggggattatggccgaatggatcataaatgcttcatgggggttgcccagatcctgctcgaggagctggacctttccagtatggtaatcggttggtataagctcttccccccttcttctctcgtagatcctactctgacccccctgacaagaagggcctcccagtcatcgttggaatcgtctacaggacctccctgcatacgcagttag

SEQ ID NO: 202817 - DNA, 2481 bp, Artificial Sequence
  Description of Artificial Sequence: Synthetic coding sequence
atgttcgccggcttcctgcagttcctgctgctgcacaccctgcactcagggactggcgacctcgactactattggcttgacccggctacgtggcattctcgggaaacctccccaatatcttctcaccctgttacctggcaacccagcaaggaaggagaccgactgattgggagagtcattcttaacaaaaggacgactatgcccaaagatagcggagccctgctgggtctgaaagtcgtgggcgggaaaatgaccgacctggggcggctgggcgcatttatcaccaaagtgaagaagggcagcttggcagacgtggtcgggcacctcagagctggggacgaggtcctagaatggaatggcaagccactgccaggagcgactaatgaagaggtgtataacataattctggagtccaagagcgaaccccaggttgaaattattgtttcgcgccccattggagacattcctagaatccccgagagcagccacccacccctggagtcaagctcatctagttttgagtctcaaaagatggaacggccttccatttccgtgatctccccaacctcaccaggggcccttaaagacgctccacaagtgttgcccggtcaactgtcggtcaagttatggtacgataaagtggggcatcagctaatcgttaacgttctgcaggccactgatctaccagctcgggttgacggccggccaaggaatccttatgtgaaaatgtactttctgcccgaccggtcagacaagagcaagcgaagaactaagactgtgaagaagattctggaacctaagtggaaccagacgttcgtttacagtcatgttcaccgcagggactttcgcgagcgaatgctcgaaattacagtgtgggaccaacctcgagttcaggaggaggagtccgaattcctgggggagattctcatcgaactagagacagcacttctggacgacgagccacactggtacaagctgcaaacccatgacgagagcagcctgccactgcctcagccgtcaccattcatgcctaggagacacatccatggggaaagctcctcaaaaaagctccaaaggtcccagcgcattagcgacagcgacatttcagattacgaagtggacgacggcatcggggtggtcccgccggtcgggtatcgatcctctgcacgagaaagcaaatctacaacactcacggtgcccgagcagcagagaactactcaccaccgatccaggagtgtgtccccgcaccgcggtaacgatcaggggaaaccacgtagtaggctgcccaatgttccactgcagcgcagcttggacgagatccacccaacccggagatcaaggagccctactaggcatcacgacgccagcagatcccccgtggatcaccgcaccagagatgtggactcgcaatacctgtctgagcaggattccgagctgctaatgcttccgcgggccaaaaggggccggtccgccgagtgcttgcataccaccagtgagcttcagccatttctggatagagcaaggtccgcctccacgaactgcttgagacccgacaccagcttacactcgcctgaaagggagagacactcaaggaagtcggagagatcttctattcagaagcagacccggaaaggtacagcttcagatgccgagaggatgcataggcagcggtcgccaacacagtcgcctccagccgacacaagcttcagctcaaggcgggggaggcagctgccccaggtgcctgttcgatctggctcaattgagcaggagtccggtcacaaaaaactgaaaagcaccatccagcgctctaccgagacgggcatggccgccgaaatgcgcaaaatggttcgacagccttcccgagaatccactgatggatcaattaattcttactcaagcgaaggcaacctcatcttcccaggggtgaggctgggcgccgattcccagtttagcgatttcctcgatggcctaggccccgctcagctggtgggccgccagaccctagctaccccagcaatgggcgacattcagattggcatggaagataagaagggccagttagaagttgaggtcatccgtgccagaagcctcacacagaaacccggcagtaagtccactcccgcgccgtatgtgaaagtgtaccttctagaaaacggtgcatgtatagctaagaaaaaaaccaggatagcgcgcaaaactttggatcctctgtaccagcaaagcctggttttcgatgagtccccacagggcaaggtgctacaggtgattgtttggggagactacggcagaatggatcataagtgcttcatgggagtcgcgcagatcttacttgaggagctcgatctcagctcaatggtgataggatggtataaacttttccccccgagcagtctggtcgaccctacactgacgccacttacccggcgcgcatcccaaagcagcctcgagtcatccaccggtccgccatgtatccggagctag

SEQ ID NO: 202818 - DNA, 2454 bp, Artificial Sequence
  Description of Artificial Sequence: Synthetic coding sequence
atgtgcgcccccggcatccacgtgagcagcgagggctgggaggaggtacgttcagtggactctgaagaggggacaattgaagcgaggagagcagtggcaggagaccttgactattactggctggatcccgcaacctggcatagccgagagacaagccccatctcaagtcaccccgtcacatggcagccttctaaggagggagacagactcatcggcagagtgattctaaacaagaggacaacaatgcccaaagattccggagctctgctgggtctaaaggtggtgggcggcaagatgacggacctaggtaggctgggagctttcatcaccaaagtcaagaagggctccctggccgacgtggtgggtcacttaagggcaggagatgaggtccttgaatggaacggcaagcccttgccaggcgcaacaaacgaggaagtgtacaatattattctggagagcaagtctgagcctcaggtcgaaataatcgtatctaggccaatcggtgacattcccagaattccggaatcatcccacccacctctcgaaagctcatcgtcgtccttcgaaagtcagaagatggaacggccttcaatatccgttatcagccctacttctccaggagccctgaaggatgccccccaagtgcttcctggccagctgagtgtcaaactttggtacgataaagttggccaccagttgatcgtaaatgtgctacaggctaccgacctgcccgctagggtagacggccgtcctaggaacccctacgttaaaatgtatttcttaccagaccgatccgataaaagcaagaggagaacaaaaactgtgaaaaaaatcctcgagcccaagtggaaccagacatttgtttattctcacgtgcaccgtagggactttcgggagagaatgctggagataaccgtgtgggaccagcccagggtgcaggaggaagagtctgaattcctgggtgagattctgatcgagttagaaacggcgctgctcgacgacgagccacattggtataaattgcaaacccacgacgaatcatcacttccacttccacagcccagccccttcatgccccgacgtcacatccatggagagagcagctccaaaaagttgcagaggtctcagagaattagcgatagcgacatctctgactacgaggttgatgacggcatcggcgtggtcccaccggtgggataccggtcctcagcacgtgagtccaaatcaactacccttacagttccggaacagcagcgtacgactcatcacaggagccgttcagtatctccacatcggggaaacgatcagggaaagccaaggagcaggctgcctaacgtgccccttcagcgctctctggacgaaatacatcccactcggagaagccggtcccctacacggcatcatgacgcctcacgcagcccagtcgaccatcggacacgcgatgtcgactctcaatacctatctgaacaggattctgaattgctgatgctgccccgggctaagcgcgggagatccgcagagtgtttacacactacctcagagcttcagccattccttgaccgtgcgcgaagtgcgagcacaaactgtttacgccccgatacttcactacattctcccgaaagggaacgtatgcatcgtcagcgctcgccaacacagtccccaccagcagacacttccttcagcagcaggagggggcgtcaactccctcaggtgcctgtgcgctctggctcaatagagcaggagtccgggcataaaaagttgaaaagtactattcagaggtctacggagaccgggatggccgccgagatgagaaagatggttaggcaaccctcaagggaaagtactgatggctctatcaacagttattccagcgaagggaatctcatcttcccaggagtgcggctaggcgcggattcccagttttcagacttcctggatggactgggaccagctcagttggttggtagacagactcttgcaacgcctgcaatgggagacattcagatcggaatggaggataagaaaggccaactcgaggtggaagttattagggctagaagcctgactcaaaagcctggatcaaaatctacacccgctccctatgtgaaggtctatcttttggaaaatggagcctgcatagccaagaaaaagaccaggatagcacgtaaaactttagaccccttgtatcaacagtccctggtgttcgatgagagcccccaggggaaagttctgcaggtgatcgtgtggggggattatgggagaatggaccacaaatgcttcatgggcgtggctcagattctgctggaggaactggatttgtcttcgatggtaattgggtggtacaaattatttcccccctcctcactggtggatcctaccctgacccccctcaccagacgagcctcccagagctcactggagtcttccaccgggccaccatgcatccggagctag

SEQ ID NO: 202819 - DNA, 3567 bp, Artificial Sequence
  Description of Artificial Sequence: Synthetic coding sequence
atgcagttcgagaccctgcggcaggtgtgcaacagcgtgctgagccacttccacggcgtattctcatccccccccaacattctgcaaaacgaactgttcgggcaaaccctcaacaacgctcggaaacgctcaccgtccgtctcacgcgaccagaaccgcagatatgaccagagggaagagagagaggagtatagtcagtatgccacaagcgacaccgccatgcccagaagtccatccgattacgccgatcgcagaagccagcacgagccccagttttatgaggactctgatcacctcagctatcgtgatagcaaccgcagaagccatagacactctaaagagtatattgtcgacgatgaagacgtggagtctcgcgatgagtatgagcgccaacgcagggaagaggaataccagtcgcgataccgtagcgacccaaatcttgccagatacccggttaaaccacaaccatacgaagagcaaatgcgcatccacgccgaagtttcacgggcccgacacgagaggcgccacagcgacgtgtcactggcgaacgcggatttggaagactcccggatatccatgctgaggatggacaggcccagcaggcagcgaagtatcagtgagaggcgggccgccatggaaaaccaacgatcttactccatggaacgcacgcgggaggcacaggggccctcatcttacgctcagcgaacaaccaatcactcacctcccaccccaagacgaagcccactgcccatcgatagacctgaccttagacgtacagattcattgcggaagcagcaccacttggaccccagctcagcagtgagaaagaccaagcgggagaagatggagacgatgctgcgcaacgattctctgtccagcgaccagagtgagagcgtgcggcctcccccgccgaaaccacacaaatcgaaaaagggcggcaaaatgcgccaaatctctctctcctcctccgaggaggagttggcttccacccctgagtatacgagctgcgatgatgtcgagattgagtccgaatctgtgagtgaaaagggggatagccagaagggtaaaaggaagaccagcgagcaggccgtgttatcagacagcaacaccaggtctgaacgccagaaagagatgatgtatttcggcggccatagtctggaggaagacctggagtggtccgagccgcagattaaagactctggcgtcgatacatgctccagcacaacactgaatgaggagcactcccactctgataagcacccggtgacatggcagcccagtaaggacggcgaccggttgataggcaggatactgttaaataagagactcaaagatggttccgtgccccgggattctggcgccatgcttgggcttaaggtggtaggtggcaaaatgaccgagtctggaaggctgtgcgccttcatcactaaggtcaagaaggggtccctagctgacacggtgggccatttgaggcccggcgatgaagtgctggaatggaacgggcggctcctgcagggagcaacctttgaagaggtctacaacattatacttgagtccaaaccagaaccccaggtcgagctggtcgttagtcgcccaatcggtgacataccaaggatcccagactccacgcacgcacagctcgagtcttcttcctccagcttcgaatcccagaaaatggaccgcccatcaataagcgtgacctctccgatgtcccccgggatgctgcgtgacgtcccccagttcctgagcggacagctcagcatcaagctatggtttgacaaagtgggccatcaactcatcgttaccatactgggcgcgaaggacttgccgtcacgggaggatggccgacccagaaatccttatgttaaaatctacttcttaccggaccgcagcgacaaaaataaaaggagaaccaaaaccgtcaagaaaactttggagcctaagtggaatcagacctttatctatagtcctgttcaccggagagagttccgagagagaatgctcgaaatcacactgtgggaccaagcgagagtgcgtgaagaggaatctgaattcctgggcgaaattttgattgaactagagacggccctcctggatgacgagccgcactggtataaactgcagactcacgatgtgagttccctaccattacctcacccctccccgtacatgccacgtagacagctacacggggagtcccctactagaagattacagaggtcaaaacgcatctccgactctgaagtatctgactatgactgcgacgatgggattggagtagtgagtgactatagacacgatggccgcgatctacaatccagcactctgagcgtcccagagcaggtaatgtcctccaaccattgtagcccttcgggtagtccacatcgagtggatgtcatagggagaacacgcagttggtcccctagtgtgcctcctccgcaatcccgcaatgtcgagcagggcctgcgtgggacgaggacaatgaccggacattataatacaattagccgaatggaccggcatcgcgttatggatgatcattatagccccgaccgtgatagggattgtgaggccgctgacagacaaccctatcacaggtcaagatctacggagcaaaggccactcctggagaggaccacaacacggagtcgttccacagaacggcccgacaccaatctaatgcggtcaatgccttccctaatgaccggtcggtctgcgccaccctctcctgctctgtcccggtctcatcctcgtacaggatccgtgcagactagccctagcagcactccagtagccgggagacgcgggcggcagcttcctcagttaccacctaagggtaccctcgaccgtaaagccggcggaaagaagctgcgaagcacggtgcagagatccactgaaactggtttggccgttgaaatgcggaactggatgaccagacaagcttctcgcgagagcaccgacgggagtatgaatagctactccagcgaaggtaatctgatttttcctggggtgcggctcgcttcagactcgcaattctcagacttcttggacggactcggccccgctcagttggtggggcgccagacactggctacgcctgccatgggcgacatacaggtaggaatgatggacaagaagggacagctggaagttgaaattattcgggcccgtggactggtggttaaacctggatcaaagacactccctgccccatacgttaaagtgtacttgctagacaacggcgtatgcatcgctaagaagaagaccaaggtagcacggaagactctggaacccctctatcaacaattgctgagttttgaagagtcaccgcagggtaaagtgctgcagattatagtgtggggagattatggaaggatggaccataagtcgttcatgggcgtagcccagattctgcttgatgagttggagctgagcaatatggtcatcggatggtttaagctgtttcccccatccagtttggtggacccgacactggctcctctgacccggcgcgcttcccaatcgtctctggaaagctccaccggtccaagctattcccggtcatag

SEQ ID NO: 202820 - DNA, 4161 bp, Artificial Sequence
  Description of Artificial Sequence: Synthetic coding sequence
atgagcgcccccgtgggcccccggggccggctggcccccatccccgctgcctcacagccccccttacagcctgagatgccagatctctcgcacctgaccgaagaagagaggaagataattctcgccgtgatggacaggcaaaagaaagaggttaaggaagagcacaaaccccaactcacacagtggttcccgttttctggaattacagagttggttaataacgttctccagccacagcaaaaacagcagaatgagaaggaaccgcagacgaagctgcatcagcagttcgaaatgtacaaggaacaggtcaagaagatgggagaagagagtcaacaacagcaggaacaaaagggcgatgccccaacatgtggaatatgccataagactaaatttgctgatggatgcggacacaattgcagctactgccagacaaagttctgtgcccggtgtggtggcagggtgagcctcaggagcaacaaggtcatgtgggtctgcaacttgtgtcggaagcagcaggagatcctgactaagagtggtgcatggttttataatagcggctccaatacgccccagcaacctgatcaaaaagttctgcgcggcctgcgaaacgaggaggcgccgcaagagaagaaaccaaaactgcatgaacagacacagtttcagggaccttccggggacttatcggtgcctgccgttgaaaaaagccgttcacatggactgacccggcaacactccattaaaaatgggtcgggcgttaaacatcacattgcctcggacattgcctcggatcggaagcgttctccatctgtcagcagggaccagaataggcgctatgaccagagggaggaacgggaggaatattctcagtacgccacctctgatacagccatgccaagaagtccatcagactacgcagatcgtcggagtcaacacgaaccacagttttacgaagatagcgatcacctcagctaccgcgattctaacagacggtcacataggcacagtaaagagtacatcgtcgatgatgaggatgtggagtctcgggacgaatacgaaagacagcggcgcgaagaggagtatcagtctcgttacaggagcgatcctaatttggcccggtaccccgttaaaccccagccatatgaggaacaaatgcggattcacgcggaggtgtctagggctcggcacgagcgtcgccactcagatgtctccttggcaaatgcggacctggaggattcaaggataagtatgctcaggatggatcggccttcaagacagcgatccattagcgagaggagagcagcaatggaaaaccagcgttcttactccatggagcggacccgggaagctcagggccccagctcctacgcgcagagaactacaaaccattcacctcccactcctaggaggtctccactgcccatcgaccgcccagaccttaggagaaccgatagcctgcgcaaacaacaccacttggatccctctagcgccgtgcgtaaaaccaagagggaaaagatggagacaatgttacggaatgacagcctaagctcagatcaaagcgaaagcgtccgcccgccgccaccaaagcctcacaagagtaagaaaggaggcaaaatgcgccagatctccctgtctagctccgaagaggaactagcttctactcctgagtacacatcctgtgacgatgtcgagattgagagcgagtcagtgagcgagaagggcgatatggattataactggttggaccacacaagctggcacagctccgaggccagcccaatgtctctccaccctgtcacatggcagcccagtaaggacggagatcgactgatcggcagaatcctgctcaataaacgcctcaaggacgggagcgtgccccgggactctggagcaatgctcggacttaaagtggtgggcggaaagatgacggagagtgggcgcctgtgtgccttcataacaaaggtcaagaaaggttcgctcgccgacaccgtaggacatcttagacccggtgacgaggtactggagtggaacgggcggctcctgcagggtgccactttcgaagaggtttacaatattatcctggaatctaagcctgagccccaggtcgagctggtagtttcccggccaatcggtgacatcccccggatccccgactctacccacgcacaactggaaagttcttcctcgagcttcgagtcacagaaaatggacagaccgagtatctctgtcacatcacccatgtctcccggaatgctgcgcgatgttccacaattcctgtccggccaactgtctatcaagctttggttcgataaggtggggcatcagctgattgttactatactgggagctaaggatctgccttctcgggaggatggacgccccagaaatccttatgtcaagatttacttcctgcctgaccggagcgataagaacaagcgtaggacaaagactgtgaaaaaaactctcgagccgaaatggaaccagacttttatctattctccagtgcatagaagggagttccgagagagaatgctggaaataactctttgggaccaggctcgggtgcgcgaagaggagtcggaattcttgggagaaatcctgattgagttggaaactgccctactagatgacgaacctcactggtacaagctgcagacccacgacgtgagttcattgcctttaccccacccgtcaccctatatgccacgcaggcagcttcatggagagagccccacacggagactgcaacgtagtaaaagaataagcgattccgaggttagcgactatgactgcgacgacgggattggcgttgtctctgattacaggcacgacggcagggatctgcaatcatctacgctttccgtgcctgaacaggtgatgtctagcaatcattgctctcctagcggttccccccacagagtcgatgtcattggtcggacccggtcttggagcccgtcagtcccacctccgcagtctcgcaacgttgagcagggcctgcgaggcactcgcactatgaccggacactataacacgatatctcgaatggatcggcatcgtgtcatggacgatcactactcgcccgacagagacagccactttcttacccttccccggagccgctattcacagaccatcgaccaccaccaccgtgatggcagagattgcgaagcagccgataggcaaccctaccatcgtagccgctctactgaacaacgccctctgttagagcgtactaccacaaggtccagaagtacagagaggcccgacacaaatctaatgcggtctatgccaagcctgatgactggccggtccgccccgccatcgcccgctttatcaaggagccacccgagaacagggtcagtacaaacatcaccctcctcaacccccgttgcaggccggcgcgggaggcagctcccccaactccctccaaagggcacactggacaggaaggctggtggtaagaaacttcgtagtacagtacagcggagcacagaaacgggacttgccgtagagatgcggaactggatgactaggcaggcctcccgagagtcaacagacggttccatgaacagctacagtagcgagggcaacctcattttcccgggggttcggctggccagtgattcacaattctccgactttttggacgggctcgggccggctcagcttgtaggtcgccagacactcgctacaccagccatgggcgacatacaagtggggatgatggacaagaaaggtcagctggaagtggaaattatccgggcacgtgggttagtggttaaaccggggtctaagactctgcccgcgccttacgttaaggtctatttgcttgataacggagtgtgcattgccaaaaaaaaaacaaaggttgccaggaagactttagagccactttatcagcagcttctcagcttcgaggaaagccctcagggcaaagtccttcaaattatcgtctggggcgactacgggaggatggaccacaaatccttcatgggcgtggcgcagattctcctcgatgaactggagttatctaatatggttataggttggttcaagttgtttcctccatcttctctggtggaccccacccttgctcctttaacccgcagagcatcccaatcttcactggagtcatcaacgggcccttcgtacagcaggtcctag

SEQ ID NO: 202821 - DNA, 858 bp, Artificial Sequence
  Description of Artificial Sequence: Synthetic coding sequence
atgggccggcagggcctgggcggcgccagcgccgccggccggagcatgcaaaggtcccagtcaagatcttccctgagtgcttccttcgaggccttggcaggctattttccctgtatgaactcattagaagaagaagaaggtgaggcaggtgggaagaagttaaggtcaaccgttcaacgctccaccgagacaggtctggctgttgagatgcggaactggatgacccggcaggccagcagagagtctacagatggctctatgaacagttacagtagcgaaggtaacctgattttccctggcgtgcgacttgcgtcagattcccagtttagtgacttcctggatggactggggcccgcacagctagtgggccgccagactttggccacgcccgccatgggagatatacaagtgggaatgatggataagaaaggccaactcgaggtggagatcatacgcgctaggggactcgtggtgaaacctggcagtaagaccttacccgccccttatgtaaaggtctatttactggataatggagtttgcatagccaagaagaagacaaaagtagcgcgcaaaacactggagccactataccagcaactcctgtcctttgaagagagccctcagggcaaagtacttcagatcatagtgtggggagactacggtcgaatggatcataagtccttcatgggcgtggcccagatccttcttgacgagctagagctctcaaacatggttataggttggttcaagctgttccctcccagtagcctggtggacccaacgctcgcccccctgactagacgcgcctcgcagagctcactggagagttctactggtcctagctacagtcgcagctag

SEQ ID NO: 202822 - DNA, 384 bp, Artificial Sequence
  Description of Artificial Sequence: Synthetic coding sequence
atgaccgagagcggccggctgtgcgccttcatcaccaaggtgaagaagggctcgctcgcagacaccgttgggcacctgagaccaggcgacgaagttctcgagtggaacggacgcctcctgcagggggcaaccttcgaagaagtgtacaacatcatactggagagcaagccagaaccccaggtggaactggtggtgtcaaggccgattggagatatcccgcgcatccctgatagcactcacgctcaactcgagtcttcccttccaggcctagcttggtggctgacacgggtcatccctgctctgtgggaagcagaggccggcggcagtagagggcaagaaattgaaactatcctggctaatacagtaaaaccacggctatattag

SEQ ID NO: 202823 - DNA, 4236 bp, Artificial Sequence
  Description of Artificial Sequence: Synthetic coding sequence
atgagcgcccccgtgggcccccggggccggctggcccccatccccgcagctagccagcctcccttacaacctgaaatgcccgacctgagccacctgactgaagaggaacggaaaatcatccttgctgtaatggaccggcagaagaaagaggtaaaagaggagcataaaccacagctcacacaatggttcccatttagtggcatcactgagctagtgaacaacgtgcttcagccccagcagaaacagcagaatgaaaaggaacctcagacaaaactccaccaacagttcgagatgtataaagagcaggtcaagaagatgggcgaggagtctcagcagcagcaggaacaaaagggcgacgctccgacttgcggaatctgtcacaaaacgaaatttgccgatgggtgtggccacaactgctcctactgtcaaaccaaattctgcgctcgatgtgggggaagagtttctctgagatcaaataaggtaatgtgggtgtgcaacctgtgtaggaaacagcaggagatactgactaaaagcggcgcgtggttctacaacagcggcagcaatacaccgcaacagcctgatcagaaggttttgcggggcctccgaaatgaagaagcacctcaggagaaaaagcctaaactgcatgagcagacgcagtttcagggcccgtcgggagacttgtccgtgccagctgttgagaaatcgcggtcacacggcctgacacgacagcattccatcaagaacggctctggggtcaagcatcatattgcgagcgatatcgcaagtgatagaaaacggtccccctcagtctctagagaccagaatcggagatacgatcagagagaggagcgagaggaatactcgcagtatgcaacatcggatacggctatgcccaggtctccaagtgattacgccgataggagaagtcaacacgaaccccaattctacgaggactccgaccacctgtcataccgggattcaaatcggcgctcacaccgccactcaaaggagtatattgtcgatgatgaggacgtggaatcccgggacgaatacgaacgccagagacgtgaggaggaataccaatcacgttatcgtagtgatcctaatctggcccgctatccagtgaaaccgcagccatacgaagagcagatgcggatccatgctgaggtgtcgcgagctcgccacgaaaggcgtcactcagacgttagtctggccaatgctgatctggaagactccagaatatccatgctacgaatggaccgtccttccagacaaaggagcattagcgaacgcagggcagcgatggagaaccagaggagctattccatggagaggacgcgagaggcccagggacctagcagctacgcgcagagaaccactaaccactctccgcctactccacggcgctctcctttgccaattgatcgtccggacttgcgaaggacggacagcctgaggaaacagcaccatctggaccccagcagtgccgtccggaagacaaagcgagagaaaatggagaccatgctgaggaatgattccctatcaagcgaccagtcggagagtgtccgccctccccccccaaagccgcacaagtccaaaaaaggtggcaaaatgcgtcagatctcactgagcagctccgaggaggagctggccagcacccctgagtacaccagctgcgatgatgtggaaatcgaatcagaaagcgtgtcagaaaagggtgactcccagaaggggaagcggaaaacatcagaacaagctgttctgagcgacagtaacactaggtcagaaaggcagaaggagatgatgtactttgggggtcacagtctcgaggaagacttagagtggtccgaaccccaaattaaagactccggggtggatacttgcagcagcaccacccttaatgaggaacattcacatagcgacaagcacccagtgacttggcagccatccaaggacggagacagacttattggtcggatcctgctcaacaagcgcctaaaggatggctctgttccaagggattctggggcaatgctcggactcaaagtagttggcggcaagatgaccgagagcggtcgcttatgtgcttttattacaaaagtgaaaaaaggttcattggctgatacagttggacacctcaggcccggcgacgaagttctggagtggaatgggaggctcttgcaaggagctacattcgaggaggtgtataacattatcttagagtcgaagccagaaccacaagttgaacttgtggtgtcccgtcctataggggacattccccgtatacctgattcaacacatgctcaactagagtcttcctccagttccttcgaaagtcagaagatggaccggccatcaatctccgtaaccagcccaatgagtccaggaatgctccgggatgtgcctcagtttttatctggacaactgagtataaagctatggttcgataaggtggggcaccagctgatagtgaccatcctcggcgccaaggatctgcctagtagggaggacggcagaccacggaacccttacgtgaagatttattttttgccagataggtccgataaaaataaaagaaggaccaagaccgtgaaaaagacgttggaacccaaatggaatcagacattcatatactcccccgtacaccggagagagtttagagagcggatgcttgaaatcaccttgtgggatcaagcaagagttcgggaggaggaaagtgagttcttaggggaaattctcatagagctggaaacggccttactcgatgatgagccccattggtataaactgcagacgcacgatgtttcgtctctgcccctcccccatcccagcccttacatgccgcgccgccagctccatggggagtccccgaccagaagattacagaggtctaagcgtatttccgactccgaggtttcggattatgattgtgatgatggaattggagtggtgtccgattaccgacatgacggacgagatctgcagtccagcacactgagtgtgccagaacaagtgatgagctcgaatcactgctccccatctggcagcccacaccgagtggacgtgataggacgcacccgctcgtggtccccatcagtgccccctccccagtcccgcaatgttgagcagggtctgagggggacacgaaccatgaccggtcattacaatacaatctctaggatggaccgccacagagtgatggatgaccattattcccccgatagggacagagactgcgaggccgccgaccggcagccttaccaccgcagcaggagtaccgagcagcgacctctgctagagcggactacaactcgatcacgctccaccgaacggccagataccaacctaatgcgcagtatgccatctctcatgacaggacgtagtgcaccgccgtccccagctctctccagatctcatccccggaccgggtctgtgcagacttccccaagctccacaccggtagctggccgccgaggacgacaattgcctcagctcccacccaaaggaacattagatagaaaggccggcggaaaaaagttgcggtccactgttcaacgatctaccgaaaccggcctggccgtcgaaatgcgtaattggatgacgcgtcaagcctcaagggagtcaactgacgggtcaatgaactcctactcttctgaaggcaatttaattttcccaggagtgcgtctggccagcgattcacagttttccgacttcctggacggcctgggccccgcccaactcgtggggcggcaaactttagccacacctgctatgggcgacatccaggtaggtatgatggataaaaaggggcaattagaggtggaaatcatccgcgccaggggactggtggtgaagccaggatctaaaaccttgcccgccccctacgtgaaggtgtatctgctagacaacggagtgtgcatagcaaaaaagaagaccaaggtcgccaggaagacactcgagccgttataccagcaattactgagtttcgaagagtcccctcaaggaaaagtgcttcaaatcatcgtgtggggagattacgggagaatggaccacaagtcatttatgggtgtggcgcaaattctgctggacgagctcgagctttccaacatggtcattgggtggtttaagctgttccctccatcctctcttgttgacccaacattagcgcctctcactaggagagcgagtcagagttccctagagagcagtaccggtccatcctatagtcgttcatag

SEQ ID NO: 202824 - DNA, 4050 bp, Artificial Sequence
  Description of Artificial Sequence: Synthetic coding sequence
atgagcgcccccgtgggcccccggggccggctggcccccatccccgcagcctctcaacccccactccagcctgagatgcctgatctttcccacttgacagaggaggagcgtaaaatcattcttgccgtgatggaccggcagaaaaaagaggaagaaaaagagcagtcagtgctgaaaaagctgcaccaacagttcgaaatgtacaaggaacaggtgaaaaagatgggcgaggagagccaacaacaacaagagcagaaaggagacgccccaacatgcggtatctgccacaaaaccaagttcgcagatgggtgtggccataactgttcttactgccagaccaagttctgcgcaagatgcggagggcgcgtgtccctcaggagcaacaaagtcatgtgggtgtgcaacctatgtcggaaacagcaggagattctgaccaaatcaggtgcatggttctacaactccgggagtaatactccccagcagcccgatcagaaggttctgcgaggactgagaaatgaggaggccccccaggagaagaaaccgaagctccatgaacagacccagtttcaggggccgagcggcgatctcagcgttcctgcagtggaaaagtcccgctcccacgggctaaccagacagcacagtataaagaacggctccggcgtgaagcaccatattgcctctgacatagcaagcgatagaaagagatctccgtccgttagtagggaccagaatcgccgctacgaccagcgagaagaacgggaagagtactctcagtacgccactagcgacaccgcaatgccccgctcccctagtgactacgctgatagacgaagccagcatgaaccccaattttacgaggacagtgatcacctcagttaccgggactctaatcgtagaagtcatagacactcaaaggagtatatcgtcgatgatgaggatgtggagtcaagagacgaatacgagagacagcgccgcgaagaggaatatcagtctaggtaccgcagcgatcccaacctagcacgatatccggtaaaacctcagccttacgaggaacagatgagaatccatgcagaggtgtctcgggctaggcacgagcggcgtcattcggacgtctccctggctaatgcggatcttgaggatagcagaattagtatgctgagaatggaccggccgtccagacagcggtctatcagcgaaagacgggctgctatggaaaatcagcggtcctatagcatggagaggacacgggaagcccagggaccctctagctatgcccaaaggaccaccaatcactcaccaccgactcccagaagatcccctctacccatagaccggcctgatctgaggagaaccgactcccttcggaagcagcaccatctggatccgagcagcgcagtgaggaagacaaaaagagaaaagatggagactatgctgcgaaatgactctttgagctcagatcaaagcgagagtgtgcggcccccgccccctaaaccccacaaatctaagaaaggaggaaagatgagacaaatctctctctccagtagcgaggaggaactggcgagtacaccggaatatacgtcttgcgacgatgtggaaatagagtccgaatccgtgtccgagaaaggcgatatggactacaactggttggatcacacaagctggcactctagcgaagcttcgcccatgagtctacatcccgtcacttggcagccctcaaaggacggggaccggctcattgggcgaattttgctcaataaacgtctgaaagacgggagcgtaccacgggacagcggagcgatgttgggcttgaaggttgtgggagggaagatgactgaatccggcagactatgcgcatttatcacaaaggtgaagaaggggagccttgctgatacagtaggccaccttaggcccggagatgaagtacttgaatggaacgggagattgctgcagggtgccacgttcgaagaggtgtacaatattattcttgagtcgaagcctgaaccccaggtagaattggtcgtatcccggccaataggggatatccctcggataccggattccacacatgcgcaactggagtcctcgtcatcctctttcgagagccagaagatggacagaccctctatatctgtgacttcacctatgtccccaggaatgctccgggacgtaccccaattcctgagcggacagctgagttcacagtcgctgtctagaagaaccacgcctttcgtgccacgggtgcaaatcaaactgtggttcgataaggtgggacatcagcttattgttacaattttgggtgcaaaggaccttccttcacgggaggacggacgaccccgcaacccctatgtcaagatatacttcctccctgatcgctcagataagaataagaggcgcacgaaaactgtgaagaaaacgctggagcccaagtggaaccaaacattcatatatagtcccgttcatcgtcgagagtttcgggaaagaatgctcgagattacgttgtgggatcaggcacgtgtgcgtgaggaggagagtgaattcctgggagaaatactgattgagcttgaaactgcactgctggacgacgagccacactggtacaagcttcaaacccatgacgtgagttctcttcctttgccccatcccagtccgtacatgccgaggagacagctgcacggggagagccccacccgaaggttgcagagatccaaacggatatctgattcggaggtttctgactacgattgcgacgatggtatcggtgtggtgtcagattaccggcacgacggacgtgacctgcagtccagtaccctgtcagtgcctgagcaggttatgtctagcaatcactgcagcccatcggggagcccccatcgggtagatgtgatcggccgtaccaggtcttggtcaccaagtgttcctcctccacagtctcgaaacgtggagcagggtctgaggggcacaaggacgatgacaggtcactacaataccatttctcggatggatcgacacagagtgatggacgatcactacagtcccgacagggaccgggattgtgaggccgctgaccgtcagccctaccaccggagtagaagtacagagcagaggccgctgctggagcggacaacgacccgaagtagatcaacagagcgacccgacaccaatctcatgcgctccatgccatccctgatgacagggcgatccgctcctccttcccctgccctctccagaagccacccccgtaccggcagtgtccaaacctctccatcttccacccctgtggcgggccgaagaggcagacagctcccccagctgccccccaaaggaaccctagatcggaaggcaggcgggaaaaagctgcgctctacagtgcagcgtagtactgagacaggcctcgctgtggagatgcgtaattggatgactcgccaggcctcccgggaatcaacagatggcagtatgaactcctattcttctgagggtaacctcatctttcctggcgtgcgtctcgctagtgacagccaattttccgactttcttgacggactgggacccgcccagctcgtagggcgccagacactggcaacgcctgctatgggagatatacaggtgggaatgatggataagaaggggcaattagaagtcgagatcatacgcgctcgcggattagtagttaagccaggctccaagactctacctgctccatatgtgaaagtgtatctcctcgataatggcgtgtgtatagctaaaaagaaaacgaaggtcgcaaggaaaaccctcgagcccttgtatcagcagcttcttagtttcgaggagagtccgcaggggaaggtgctgcagatcattgtgtggggcgattatggccgcatggatcataaatcattcatgggtgtcgcacaaatccttctggacgagctagaactctcaaacatggtcatcggatggtttaagctgtttcccccatcttcattagtcgaccccaccctggcaccactgacaagacgcgcctcacaaagcagccttgagtctagcaccggcccttcatatagccggagttag

SEQ ID NO: 202825 - DNA, 3492 bp, Artificial Sequence
  Description of Artificial Sequence: Synthetic coding sequence
atgcagttcgagaccctgcggcaggtgtgcaacagcgtgctgagccactttcacggtgtgttttcttcacctcccaatatccttcagaatgaattgtttggacagaccttgaataatgcccggaaacggtcaccctcagtgagccgagaccagaacagaagatatgaccagagagaggaacgggaggaatactcccagtacgccacgagcgatacggccatgcctcgcagccctagcgattacgccgaccgacgctcgcagcatgaacctcagttctatgaggacagcgatcacctgtcatatcgtgactccaacaggaggagccacagacactccaaggagtacattgtcgatgacgaagatgtagagtcgcgggatgagtacgagagacagagacgcgaggaggaataccagagtaggtatagaagcgaccctaacctcgctaggtaccccgtcaagcctcagccttatgaagagcagatgagaatccatgctgaggtgagtcgcgcgcgtcatgagcggcggcactccgacgtctccctggccaacgcagacctggaggattcacgcataagcatgttaaggatggataggccttcacggcaacgcagtatttccgagcggcgggcagctatggagaaccaacgctcatacagtatggaacgaactcgtgaggcacagggaccttcttcttatgcccaacggaccacgaaccattcccctccaactccgcgccggagtcctttacctattgaccggcccgatttgaggagaacagattccctccgaaagcaacaccatttagatccctcatccgccgtgcggaaaaccaaacgggaaaaaatggagacaatgctgcgcaacgacagcctatcctccgatcagagcgagtccgtgcgacctccacctcccaaaccccataaatccaagaaagggggaaagatgcggcaaataagcctgagctctagcgaagaagaactagccagtacccctgaatacacaagctgtgatgacgtggaaatcgagtcggaaagcgtctcggagaaaggggacatggattataattggttagaccacactagttggcatagcagtgaggcatctccaatgtctctgcatccagtgacctggcagccaagtaaagatggcgaccgtttgatcgggcgcattctgctgaacaagcgtctgaaggacgggtcggtaccccgggatagcggggccatgctgggacttaaggtcgttggcgggaaaatgacggagtcaggccgcctgtgtgctttcatcactaaggtgaagaaaggaagccttgcagacacagtgggccatcttcggcccggtgacgaggtgctcgagtggaacggacgactccttcaaggggccacttttgaagaagtgtacaacattattctggaatccaagcctgagcctcaggtagagctggtggtgtcccgtccgataggagacatacctagaattcccgactctactcacgcacaactcgagtcctcttctagcagcttcgaaagccagaagatggacaggcctagcatcagcgtcacctctcccatgtccccaggaatgttacgagacgtcccccagttcctctcgggccagctgagcataaagctctggtttgacaaagtcggccatcagttgatagttaccatccttggagccaaggacctaccttctagggaagacggccgcccacgaaacccatatgtgaaaatctacttcctgccagaccggtctgataaaaacaagaggagaactaaaacagttaagaagacactggagccaaagtggaaccagactttcatatatagcccagtgcatcggcgcgagttccgggaaagaatgctcgagattacactctgggaccaggcccgagtacgcgaggaagaatcagagttcttaggggagatccttatcgagctcgagacagcccttctcgatgacgagcctcactggtataagctgcagacccacgacgtttcctccctgccactccctcacccctccccttatatgccccgacggcagctccacggggagtcccctacaaggcgcctccagaggtctaagagaatttcagacagcgaagtgagcgattacgactgcgatgacggaattggagtggtgtccgattacagacacgacggtagggatttacagtcgtccacattgtcagtcccagagcaggttatgtcatctaaccactgttcaccatctggatctccgcatcgcgtcgatgtgattggcagaacacgctcttggagccccagtgtacctccgccccagtctagaaatgtggaacaaggcctgcggggcactcgaacaatgacaggccattacaataccatttccagaatggaccgccaccgggtcatggatgatcactattcccccgatagggatagccatttcctgaccctgcccagatctcggtacagtcagacgatcgatcatcaccatcgagacgggagggactgtgaggctgcagacagacaaccctaccaccggtcccgcagtaccgaacagcgtcccctgctcgaaagaaccaccacccgaagtcgaagtactgaacgccctgatacaaaccttatgcgcagcatgccctctcttatgactgggcgcagtgcacctcccagcccagctctcagcaggtcccaccctagaacaggctctgtccaaacatctcccagctcaaccccagttgctggccggcgcgggcgccagcttcctcagctgcctcccaagggaactctggataggaaggccggcggcaagaagttgcgatccacagttcaaaggtctaccgagacaggactggccgtcgaaatgcggaattggatgaccaggcaggcttcgagggagtctacagacggctctatgaattcctacagcagtgaaggcaatctgatcttcccaggcgtgcgactggcctcagactctcagttcagcgactttcttgatggtctgggtccagcccagctggttggccggcagactctggccacacctgcaatgggagacatccaggtgggcatgatggataagaaggggcagctggaagtcgagatcataagagcacgtgggctcgtggtcaaaccaggaagtaaaactttgcccgcaccttacgtgaaagtgtacttgcttgataatggtgtgtgcattgccaagaagaagacgaaggtggcccggaagacacttgaaccactgtatcagcagctgctgagttttgaggagtccccacaggggaaagtcttgcagattatcgtgtggggcgattacggcagaatggaccacaaatccttcatgggcgtggcccagatcttactcgatgagctggagctttctaacatggtcattggttggttcaaactcttcccaccaagtagtttggttgatcccactctcgcacccttgacgagaagagccagccagagctcactggagtcgagcacagggccctcctattcacgtagctag

SEQ ID NO: 202826 - DNA, 927 bp, Artificial Sequence
  Description of Artificial Sequence: Synthetic coding sequence
atgttcaacggcgagcccggccccgccagcagcggcgccagccggaatgtggttagatcctcctcaatctccggcgagatctgtggctcccagcaggctggtggaggggccggaacaaccacagcaaaaaagagacggtcgtctctgggggccaaaatggtggctatcgtggggctgacacagtggtccaaaagcacactgcagctgccccaacctgagggtgctactaaaaagttacgatccaatatccgcagaagcacagaaaccggaattgccgtagagatgcgttctcgcgtgacaaggcaaggctctcgagagagcacagatggttcaaccaattcgaatagcagtgacggtactttcatcttcccgaccacacgtcttggcgcagagagccagttctccgacttcctcgacggtctgggtcctgctcaaatcgtgggtcggcaaacactggccacccctccaatgggagatgtccacattgctatcatggatcgttccggccaactggaagtagaagtcattgaggcacgcggccttacccccaagccagggtcgaagagcctccctgccacttatatcaaagtgtatttgctcgagaatggcgcatgcttagctaaaaaaaagaccaaaatgacaaagaagacgtgtgatccactctaccaacaggctctgctttttgatgaaggaccacaggggaaagtgttgcaagtcattgtctggggggactatggaaggatggatcacaagtgcttcatggggatggctcagattatgcttgatgaactggacctgagtgcggctgtgactggctggtataagctgttccccactagtagtgtggctgactccactttgggaagcctgacgcggagactgtcccaaagcagcctagagagcgcgacaagcccaagctgttcctag

SEQ ID NO: 202827 - DNA, 927 bp, Artificial Sequence
  Description of Artificial Sequence: Synthetic coding sequence
atgttcaacggcgagcccggccccgccagcagcggcgccagccggaatgtggtgcgcagcagcagcatttccggcgaaatctgtggctctcagcaggccggtggcggggctggaaccacgaccgcaaagaaaaggcggagtagcttgggggctaagatggtggctattgttgggctgacacagtggtccaagtccacgctgcagctcccacaacccgagggggccactaagaaactcaggtctaacatccgacgctctaccgagaccggaatagctgtggagatgcggtctcgtgtgaccagacagggctcccgcgaatccaccgatgggagcacaaactcaaactcctccgatggaacatttatatttccaacaacacgcttgggagccgagtctcagttttctgactttttggacggtctcgggcccgctcagattgtgggccgacagaccttggccaccccaccgatgggcgacgtacacatcgccatcatggataggtcagggcagcttgaggtcgaggtgatagaggcgagaggcctgacgccaaagcctggttccaaatccctccccgcaacctacatcaaggtgtatctgctcgagaacggcgcttgtctcgccaaaaagaagaccaagatgaccaaaaagacttgtgatcctctgtaccagcaggcactcctctttgatgaagggcctcagggtaaggtgcttcaggtcatcgtatggggggactacgggcgcatggaccacaaatgtttcatggggatggcgcagattatgttggacgagctagatttgagcgccgctgtaaccgggtggtataagcttttccctaccagctctgtggccgattccacactgggttctctcacccggcgactttctcagagcagcctcgagagtgcaacatccccctcttgtagttag

SEQ ID NO: 202828 - DNA, 810 bp, Artificial Sequence
  Description of Artificial Sequence: Synthetic coding sequence
atggagcggagccagagccggctgagcctgagcgccagcttcgaggcgcttgctatttacttcccgtgcatgaacagcttcgacgacgaagacgccggagacagccgccggttgaagggggcaatccagaggtcaacagagacaggattagcagtagaaatgcccagccgtaccttgagacaggcgagccatgaaagcatcgaagacagtatgaactcatacggatccgagggcaatttaaattatggaggagtgtgtctcgcgtccgacgcccaattttctgattttttgggttcaatgggccccgcacagttcgtcggcagacaaactctggcaaccacaccaatgggagatgtcgaaatcggattgcaggaacgcaatggccagcttgaagtggatatcatccaggccaggggactgactgctaaacccggctctaaaaccttgcccgcagcatacataaaggcctatttactcgagaatggaatctgcatcgctaaaaagaaaactaaggtggcccgtaaatctctggaccctctgtacaatcaggtccttctgtttcccgaaagccctcagggcaaggtactgcaggtaatcgtatggggcaactatggccgaatggagaggaaacagttcatgggggttgcacgggtgctgctggaggagctggacctgaccaccttggctgtgggatggtataagctctttcctacaagctcaatggtcgatcccgccacaggaccactcttgcgtcaggcttcgcaattgtcccttgagagtactgtcgggccctgcggcgagagatcatag

SEQ ID NO: 202829 - DNA, 813 bp, Artificial Sequence
  Description of Artificial Sequence: Synthetic coding sequence
atggagcggagccagagccggctgagcctgagcgccagcttcgaggcgcttgccatttactttccatgcatgaacagctttgacgatgaagatgccgaaggcgattcgaggcggttaaaaggagccattcaacgtagcactgagacgggactcgccgttgaaatgccgagccggacactgaggcaggcctctcacgagtcaatagaggattccatgaattcttacggctcagaaggaaatctaaattacgggggagtctgcctcgcaagcgatgcacaattcagcgacttcctgggttccatgggtccagcacagtttgtcggacgtcagaccctggctactactccgatgggggacgttgagatcggccttcaagagcgtaacgggcaattggaggtcgacatcatccaggcccgcgggctcactgctaagcctggctccaagactctgcctgctgcatatattaaagcgtatctgctggaaaatgggatatgcattgccaaaaaaaaaaccaaggtagcccgcaagagcttggatcccctgtataaccaagtattgctattccccgagtccccacaaggcaaggtgctccaagtgattgtgtggggcaactacggacgtatggagagaaagcaatttatgggcgtggctagggtgctgctggaagagctggatcttaccaccttggccgttggttggtacaaactcttccctaccagtagcatggtggatcctgcgaccggcccactgttgagacaagcaagccagcttagtcttgaatccactgtcggaccttgcggagaaaggtcatag

SEQ ID NO: 202830 - DNA, 759 bp, Artificial Sequence
  Description of Artificial Sequence: Synthetic coding sequence
atggaggacggcgtggccggcccccagctgggcgccgccgccgaggccgcggaggcggctgaggctcgtgccagaccgggagtgacattaaggcccttcgcccccctatccggagcagcagaagccgacgaaggggggggggactggtccttcatagactgcgagatggaggaggtggaccttcaggatttgccctcggccacaatcgcctgccacctggacccccgtgtatttgttgacggcctgtgccgtgctaaatttgagagtctgtttaggacatacgataaagacatcacttttcagtatttcaaatcctttaaacgggttagaattaatttttcaaatccgttttccgctgcagacgccaggttacagttacataaaacagaatttctgggaaaggagatgaagctttattttgcacagaccctgcatatcggcagttcgcacctagcccccccaaaccccgataagcaattccttatttctccaccagctagtccgcccgttggctggaagcaagttgaagacgccacccccgtcattaattatgacctgctctacgctatttccaagctgggaccaggcgagaaatatgagctgcatgctgccacagacacaacaccctcagttgtggttcacgtatgcgagtctgatcaggagaaggaggaagaggaggagatggaaagaatgcggcgcccaaaaccaaagattattcaaacgcgccgccccgaatatacccccatacacctctcatag

SEQ ID NO: 202831 - DNA, 594 bp, Artificial Sequence
  Description of Artificial Sequence: Synthetic coding sequence
atgcacttccggaacttcaactacagcttcagcagcctgatcgcctgcgtggctaattcggacattttctctgagagtgaaacccgagccaaattcgagtccctattccgtacatatgacaaggacattaccttccaatattttaagtctttcaaaagagtgcggatcaatttcagcaaccctttttcggccgctgatgcccgcttacagttgcacaaaactgaattccttgggaaggagatgaagctttatttcgctcagacattgcatattgggtcttctcacctggctccccctaatcctgataagcaatttctgatctctccccccgctagcccccctgttggttggaaacaggtggaagatgctaccccagttataaattatgacctgctttatgccatttctaaactagggccaggagagaaatacgagttgcatgcggcaacagacacaacccccagtgttgttgtccatgtgtgcgagtcagaccaggagaaagaggaagaggaggagatggagaggatgcgacgccccaagcctaagattattcaaacgagacggcccgaatacactcccatccacctcagttag

SEQ ID NO: 202832 - DNA, 729 bp, Artificial Sequence
  Description of Artificial Sequence: Synthetic coding sequence
atgcagggcgagcagggccggcggctgttccggctgctgctgaacgatctgcccggccgagacaggctgccatgctcataccctcagccgcatgtggaacaggcatcaacctcggccagtccccgcttgttggctgtgaatatccccgaagacacactcttatcctatcccgagtctagtttgccactccagaggcactgtgcattccaccgctttagcaaggccaagttcgagtcgctatttagaacatatgataaagatattaccttccagtacttcaagtcttttaaaagagttcgcatcaacttttccaaccctttttccgccgccgacgctcggctacaacttcacaagacagagttcctgggaaaggaaatgaagctctattttgcgcagactctccacatcggctcgtcacacttagctccccctaatccagacaagcaatttctcatctctcctccagcttcaccccccgtgggctggaagcaggttgaggacgccacccctgtaatcaattacgacctgctgtatgccatcagtaagcttgggccaggggagaagtacgagctgcacgctgcaactgatactaccccaagtgtggtggttcacgtgtgcgagtccgatcaggagaaggaagaagaggaagagatggaacgaatgcggcggcctaagcctaaaattatccaaacaaggcggcccgaatataccccaatccatctgtcttag

SEQ ID NO: 202833 - DNA, 354 bp, Artificial Sequence
  Description of Artificial Sequence: Synthetic coding sequence
atgaagctgtacttcgcccagaccctgcacatcggcagcagccacctggcccctccaaatcctgacaagcagtttctcatttccccaccagcctcaccccccgtcggctggaagcaggtggaagatgcaacccctgttattaactatgacttgttgtacgctatctctaagctgggacctggtgaaaagtacgaactgcacgctgcaaccgataccacgccatcggtcgtcgtgcatgtgtgtgaaagcgatcaagagaaagaggaagaggaagagatggagaggatgcgtagacctaagcctaaaatcattcagacgagacgccctgaatatactccaatacatttgagctag

SEQ ID NO: 202834 - DNA, 354 bp, Artificial Sequence
  Description of Artificial Sequence: Synthetic coding sequence
atgaagctgtacttcgcccagaccctgcacatcggcagcagccaccttgcaccccccaatcccgacaaacagttcctgatctctccgccggcttcgccccccgttggctggaaacaagtcgaagatgccaccccagtgataaactacgatttactgtatgcgatttcaaaactgggtcccggagaaaaatacgaattgcacgctgccaccgacaccacaccctcagtggtggtgcatgtgtgtgagtccgaccaggagaaggaagaagaggaagaaatggaaagaatgcggagacccaagccaaagataattcagacccgtcgccctgagtatacacccatccacttgtcctag

SEQ ID NO: 202835 - DNA, 354 bp, Artificial Sequence
  Description of Artificial Sequence: Synthetic coding sequence
atgaagctgtacttcgcccagaccctgcacatcggcagcagccacctagcgccacccaatcctgacaaacagttcctgatcagccccccagctagtccacccgttgggtggaaacaggtggaagacgccacccctgtcatcaattatgatctgctgtacgcaatctcaaagttgggtccaggggagaagtacgagcttcatgcagccactgatacaacaccaagcgtcgtcgttcacgtctgtgagagtgaccaggagaaggaggaggaagaagaaatggaaagaatgagacgccccaagccaaaaatcatccaaacacggcgcccagaatatactccgattcatctctcctag

SEQ ID NO: 202836 - DNA, 732 bp, Artificial Sequence
  Description of Artificial Sequence: Synthetic coding sequence
atgcggggcgagagctacttcatcggcatgcggagccccggccagcaggggcacgtcccggaggacggcggtctgtttctgctttgctgtattgatagagattgggctgtaacccggtgttttgcagaagaagcattccaggccataactgacttcaatgaccttccaaacagtctgtttgcatgtaatgttcaccagtccgtattcgagggtgaggaatccaaggagaagttcgagggcctttttagaacatatgacgactgcgtgacattccagttgtttaagtcatttaggagagtccgtatcaacttcagcaaccctaagtccgccgccagggcacgtattgagcttcatgaaacccagttccgtggaaagaaactcaaactttactttgcacaggttcaaacccccgaaaccgatggggacaagcttcacctggctcctccacagcccgcaaagcagtttttgataagtcccccaagctctcccccggtggggtggcagccaattaatgacgcgacccctgtgctcaattacgatttgctgtacgcagttgcaaagcttggcccaggtgagaaatacgagttgcatgcaggtaccgaaagtacaccatccgtggtggtgcatgtgtgcgactctgacatcgaggaagaagaggacccaaaaacgtctcctaaaccaaaaataattcagaccagaaggcccggtctgcctccatccgtctccaactag

SEQ ID NO: 202837 - DNA, 594 bp, Artificial Sequence
  Description of Artificial Sequence: Synthetic coding sequence
atgcccgcccccagcatggactgcgacgtgagcaccctggtggcctgcgtcgtcgatgtggaggtcttcaccaatcaagaggttaaggaaaaattcgaaggtctgttcaggacatacgacgattgcgtgacctttcaactgtttaaaagctttcgccgggttcgaatcaatttctccaatcccaagtcggccgcacgtgcacgaatagagctgcacgagactcagtttcggggaaagaagctaaagctgtatttcgcccaggtgcagaccccagaaacagacggggataaattacacctagcaccgccacagccggccaagcagttcctgatctcaccaccatcctcccctccggtcggctggcaacccataaacgatgctacgcccgtccttaactatgacctgctgtacgcagttgcaaagctgggtcccggggaaaaatacgaactgcacgcaggcactgaaagcactccttctgttgtggtacacgtttgtgattctgatatcgaagaggaagaggatcccaagacatctccgaaacccaaaattatccagaccaggaggccaggcttacccccaagcgtttcaaactag

SEQ ID NO: 202838 - DNA, 732 bp, Artificial Sequence
  Description of Artificial Sequence: Synthetic coding sequence
atgcggggcgagagctacttcatcggcatgcggagccccggccagcaggggcacgtgcccgaagacggcggcttgtttctgctttgctgcatagatagagactgggccgtcaccaggtgctttgcagaggaggccttccaggctatcaccgacttcaatgacctcccaaactctctgtttgcgtgcaacgttcaccagagcgtcttcgagggggaagagtctaaggagaaattcgaaggcctctttcgcacttatgacgattgtgtcacttttcagctttttaagagcttccgaagggtcaggatcaacttttctaaccccaagtcggctgcaagagctcggattgagctgcatgagacgcaattccgcggaaaaaagctgaaactctactttgctcaggtgcagacaccagagactgacggagacaaactgcatctggccccaccacaacccgccaaacagttcttaatcagccccccctcttctcctcccgtcggttggcagcctatcaatgatgcgactcccgtgctcaactacgatctgttgtacgccgtcgcgaagctgggacccggggaaaagtatgaactgcatgcaggcaccgagagtaccccctccgtagtcgtccatgtgtgcgattctgacattgaggaggaagaggatcctaaaaccagtcccaagcccaagatcatccagacccgtcgccctggactgcccccaagcgtgtctaactag

SEQ ID NO: 202839 - DNA, 732 bp, Artificial Sequence
  Description of Artificial Sequence: Synthetic coding sequence
atgcggggcgagagctacttcatcggcatgcggagccccggccagcaggggcatgtccctgaggacggagggttatttcttctttgctgtatagatcgcgactgggccgtcacacgctgtttcgccgaagaggccttccaagcaattactgactttaacgatctgcccaattcattgttcgcatgcaacgtccatcagagtgtgttcgaaggagaggagtccaaggaaaagttcgaggggctctttcgtacctatgatgactgtgtgactttccagctgtttaagagcttccgacgcgtcagaatcaatttttcgaacccaaagtcagcggcgcgcgccagaattgagctgcatgaaacccagtttagaggcaagaaactcaagctctacttcgcccaagtgcaaacccccgagacagacggggataagttgcatcttgcccctccccaaccagctaagcagtttctgatttctcctccctcatccccccccgtgggctggcagccaattaatgacgccacaccagttctcaactatgatctcctctatgcagttgctaaactggggccaggagaaaaatatgagctgcacgccggaacagaaagcaccccctcggtggtggtacacgtctgtgattcagatatcgaggaagaagaagatcctaagacttcacctaagcccaagattattcaaacacgccgcccaggactcccaccttctgtcagcaactag

SEQ ID NO: 202840 - DNA, 1596 bp, Artificial Sequence
  Description of Artificial Sequence: Synthetic coding sequence
atggtggacgtgggcaagtggcccatcttcaccctgctgagcccccaggaaatcgcatctatcagaaaagcttgcgtgtttgggacctccgcttccgaggcgttgtatgtcacggacaacgacgaagtgtttgtgtttggcctgaattacagcaattgtctgggcaccggtgataatcagtcaactctggtgccaaaaaagctcgagggcctgtgtgggaaaaaaatcaagtcgttaagttatggctccggccctcacgtgctgctgtctactgaggacggagtcgtctacgcatggggacataatggctactctcagctcggcaacggtactacaaatcagggtattgcacccgttcaggtctgcactaacctgttgattaaacaggtcgtggaggtcgcgtgcggatctcaccactctatggcacttgctgcggacggggaagtcttcgcttggggctacaacaattgcggacaagtgggtagcggttccaccgccaaccagccaacccctcgcaaggtcactaactgtcttcatatcaagcgggtggtgggcatagcctgcggacagacatccagcatggctgtgctggataatggggaggtttacgggtggggctacaatgggaatgggcaacttggtcttggcaataacggaaaccaactgacacccgtgagggtagccgctctccattccgtgtgcgtgaatcaaatcgtttgtgggtatgcacatacgttggcgctcaccgatgagggcctcttatacgcctggggcgctaacacgtatgggcagctgggcaccggaaacaaaaataacctactgagtcccgcccacattatggtggagaaagaaagagtggtggaaattgcagcttgccatagcgcccatacctccgccgctaagactcaaggcggccatgtgtatatgtgggggcagtgccggggccagtccgttatactgccccatctcactcactttagttgtaccgatgacgtgttcgcctgctttgccacacctgccgtatcgtggcgactgctatctgtggagcatgaggatttcctgaccgtcgctgaatctttaaaaaaggagtttgactcccccgagacagctgatcttaagttccgaatcgatggtaaatacatccacgtccacaaggctgttctgaagattcgatgtgagcactttcgctcgatgttccagtcttattggaatgaagacatgaaggaagtcattgaaatcgaccagttctcgtaccccgtctaccgggcttttctgcagtacctgtacaccgatactgttgacctacctcctgaggacgccatcggattattggatctagcaacgtcttattgtgagaatagactgaagaaactgtgtcaacacattattaaacgaggcattactgtcgaaaatgcgttcagtctcttctccgctgctgtccgctacgacgcagaggatcttgaggaattctgctttaaattctgcatcaaccacctgacagaggttactcagacagctgcattttggcaaatggatggccccttgttaaaggaattcatcgccaaggcctccaagtgtggagctttcaagaattag

SEQ ID NO: 202841 - DNA, 1596 bp, Artificial Sequence
  Description of Artificial Sequence: Synthetic coding sequence
atggtggacgtgggcaagtggcccatcttcaccctgctgagcccccaggagatcgcatcgatcagaaaggcatgtgtgtttggtacttcggcatccgaggccttgtatgttactgataatgatgaggtgtttgtattcggtctcaactattctaattgtctgggcaccggcgacaaccaatccactctggttccaaaaaaacttgaggggttatgcggcaagaagatcaaatccctatcttatggctcaggccctcatgtgttgctgagtacggaggacggtgttgtgtatgcctgggggcataacgggtactctcaacttggcaacggcacaaccaaccagggcattgctcctgtccaggtgtgcaccaacctattaatcaaacaagtggttgaggtggcatgtggctcccatcacagcatggccctggccgctgatggcgaagtgtttgcatgggggtacaataattgcgggcaagtgggaagcggatcaacggctaatcagcccactccccgcaaggtcacgaactgtctacatataaagagggttgtcggaatcgcctgcggccaaacaagctccatggcagtacttgacaatggagaggtttatggttgggggtacaacggcaacgggcagctggggctcggaaataacggcaaccagttgacgcctgtgcgcgtggccgccctgcactccgtgtgtgtgaaccagatcgtgtgcggctacgcccacacacttgccttgaccgacgagggccttctgtacgcatggggggcaaatacgtacggccagctgggtaccggcaataaaaacaatttactgtctcctgcacatatcatggtcgaaaaggagagggtggtggaaatcgcagcgtgtcatagcgcccacacctccgccgccaaaacccaaggtggacatgtgtatatgtggggtcagtgccggggccaatccgtgatcctgccgcacctcactcacttcagttgtacggatgatgtctttgcctgctttgctactcctgccgtgagctggaggctcttaagtgtggagcacgaagactttctaacggtagctgaatctctcaagaaagaattcgacagtcccgagacggcagacttgaaattcagaattgacggcaagtatatccatgttcataaagcagtcctcaaaattcgttgtgaacacttccggagcatgttccagtcatactggaacgaggacatgaaggaggttattgagatcgaccagttcagctacccagtgtaccgggcctttctgcagtatctctacaccgacacagtggacttaccacctgaggatgccattggcttgctggacttggctacaagctactgcgagaatagacttaagaagctctgccaacatatcattaaaaggggtattaccgtggaaaacgccttctctctgttctccgcggccgtgagatacgacgctgaagacctcgaggagttttgctttaagttttgtatcaatcacctgactgaagtgacacagactgcagctttctggcaaatggatggtccccttttgaaggaattcatcgcaaaagcctccaagtgcggagcattcaagaattag

SEQ ID NO: 202842 - DNA, 1068 bp, Artificial Sequence
  Description of Artificial Sequence: Synthetic coding sequence
atggtggacgtgggcaagtggcccatcttcaccctgctgagcccccaagagatcgcttccatcagaaaggcttgcgtgtttggcacatctgctagtgaggccttatacgtcaccgataacgacgaggtgttcgtttttggcttaaattatagcaactgcctgggcacaggagacaaccaaagtactctcgttccaaaaaaactggagggcctttgcggcaagaagatcaagagtctgtcttacgggagtggaccccacgtcttgctgagcaccgaagacggggtggtgtacgcttggggacataatggctactcacagctcggcaacggcaccaccaaccagggcatagcacctgtccaggtctgtaccaacctcctaatcaaacaggtggtagaggtcgcttgcggctcccaccacagtatggccctggctgcagatggagaggtatttgcatgggggtataataattgtggacaagtgggttcagggtccaccgctaatcagcctacccccaggaaagtgaccaactgcttgcacattaagcgggtagtcggaattgcttgtgggcagacaagctcaatggccgtgctagacaatggcgaggtctatggctgggggtacaacgggaacggacaactgggcctaggtaataacggcaaccagctgacgcctgtacgagttgcagcgctgcattcagtctgtgtgaaccagattgtgtgcgggtacgctcacaccctcgccctgacggacgagggattactgtatgcgtggggcgccaatacctatgggcagctcggcacgggcaacaaaaataatctgctctctccagcccacatcatggtggaaaaagaacgagtggtggagatcgccgcctgtcactcagcccacacatctgctgcaaaaacacagggcggccacgtttatatgtggggccaatgcaggggccagtcagtcatcctgcctcacctgactcatttcagctgtacagacgacgtgtttgcatgctttgcaaccccagccgtgtcctggcggctgcttagtgtggtgtcgatcgtgatcggtaagtag

SEQ ID NO: 202843 - DNA, 1656 bp, Artificial Sequence
  Description of Artificial Sequence: Synthetic coding sequence
atggaggaggagctgcccctgttcagcggcgacagcggcaagcccgtacaggcaacgctgtcaagtctcaaaatgctcgatgtcggcaagtggcctatctttagtttgtgctccgaggaggagctgcaactgattcggcaggcctgtgtgttcggtagcgctgggaacgaggtgctctatacgacagtgaacgacgagatttttgtgctagggaccaactgctgcggctgtctgggcctaggagacgtgcagtcgaccattgagccacgtagactggatagcttgaatggaaaaaagatcgcttgcctgagctatggttctggcccgcacatcgtgctggctacaaccgagggtgaagtttttacctggggacacaatgcctattcccagctcggcaatggcacgactaatcatggcctcgtgccttgccacatttcgactaatctaagtaacaaacaggttatcgaagtggcgtgcggcagttatcactctttggtgttgactagcgatggcgaagtgtttgcatgggggtacaataattccggccaggtgggttctggatcaactgtaaaccagccaattccgcgacgtgttaccggctgtttgcagaacaaggtagtagtaaccatcgcttgcggccagatgtgttgcatggccgtggtggatacgggcgaagtgtacgtgtggggctataacggcaacggccaacttgggctggggaacagtgggaatcagccgaccccttgccgcgtggccgctctccagggaattcgtgtgcagcgggtggcctgtggctacgctcacacgctagtactcactgacgaagggcaagtgtatgcatggggggctaacagttatgggcagctaggtacagggaacaaatcaaaccaaagctatcctacccctgtgaccgtggaaaaagatagaattattgaaatcgcagcctgtcacagcacacacacatccgccgccaagacccagggcggtcacgtgtatatgtggggacaatgccgcggccagtcggtaattctgccacatttgacacattttagctgtaccgatgacgtcttcgcctgctttgccacacctgccgtgacatggcgcctgctgtctgttgagccggacgatcatctcacggtcgcagaaagtctgaaaagggagtttgataaccctgacaccgccgaccttaagtttttggtggacggcaaatacatttacgcacacaaagtcctgttaaagattcgctgtgaacactttaggtcaagcttggaggacaatgaggacgatatagtggaaatgtcggagttcagttaccccgtctatcgggcgttcctggagtatctgtacactgacagcatctccttatccccagaggaggccgtcggtttgctagacctcgctacattttatcgtgaaaatcggctcaagaagctatgtcagcaaactattaagcaggggatatgtgaagaaaatgctattgcattactcagtgccgccgtgaagtatgatgctcaagacttggaggaattttgttttcggttttgtataaaccacctgactgttgtcactcagacgtctggctttgcagaaatggaccacgacctgcttaagaactttattagcaaggcatcccgcgtcggggccttcaaaaattag

SEQ ID NO: 202844 - DNA, 1671 bp, Artificial Sequence
  Description of Artificial Sequence: Synthetic coding sequence
atgagcgccctgccccgggacctggagctgagcaacccccgggagaaactcacaaaacctgtccaagctactctttccagtctgaagatgctcgatgtgggcaagtggccgatcttttcactctgctccgaagaggaacttcagctgatccggcaagcttgtgtcttcggtagtgcaggaaacgaggtcctgtacacaacggtcaacgacgagatctttgtcctcgggacaaattgctgcggctgcctagggctgggggacgtccagtcaacaatcgagccgagaaggctggactcactcaatggcaaaaaaatcgcctgcctaagctacggcagtggccctcacattgtgctggccacgacagagggagaagtctttacttggggacacaatgcttactcccagttgggtaatggaacaactaatcacggcctagtaccctgtcacatcagcaccaatctctcgaataaacaagtgatagaggttgcctgcggatcttatcactccttagtcctgacatccgatggtgaggttttcgcatggggctacaacaattccggacaggtgggctcgggctccacagtgaatcagcccataccccggcgcgtcactggctgtctccagaacaaagtcgtggtgactattgcatgcgggcaaatgtgttgcatggctgtcgttgacacgggggaggtgtacgtgtggggctacaatggcaatggccagctcggtctcggcaattctggtaaccagcctaccccctgtcgagtggccgcactgcaaggcattcgcgtgcagcgggtggcatgcgggtatgcccatacactcgtgctgactgatgaaggccaggtgtatgcctggggcgcgaactcctatggacagctagggactggcaacaagtcgaaccaaagctatcctactccagtgacggtggaaaaagaccggatcattgagatcgccgcttgccacagtacccacacatctgcggccaaaacccagggagggcacgtgtacatgtggggccagtgtagaggacagtccgtgattctgccacaccttacccatttttcctgcacagacgacgtatttgcttgcttcgccactccggctgtgacctggcgtcttctgagcgttgagccagacgaccacctgactgtggcagagtccctaaaaagagaatttgataaccccgatactgcagacttgaaattcctcgtggatgggaaatatatctacgcacataaggtgctactaaagattagatgcgaacacttccgctcctcccttgaagacaatgaggacgacattgttgaaatgtcagaattttcatatccggtatatagggccttcctagagtacctgtacacagatagtattagcctctccccagaggaggccgtgggactgcttgatctggccacattctatagggaaaaccgcttgaagaaactctgtcaacagaccattaagcagggcatctgtgaagaaaacgccatcgctcttctgagcgctgctgttaagtatgatgcacaggacctcgaggagttctgtttcaggttctgtataaatcacttaacggtggtcacacagacatctggattcgcagaaatggaccacgatctcctgaagaatttcatttccaaagcgagccgcgtgggagcctttaaaaactag

SEQ ID NO: 202845 - DNA, 1512 bp, Artificial Sequence
  Description of Artificial Sequence: Synthetic coding sequence
atgctgcaggacggcagctgcaagcagatgctgctgatgctgctgatcgtacagcctgtccaggccacactgtcaagcctgaaaatgctcgatgtgggaaagtggccaatcttcagcctgtgtagcgaagaggaactgcagctcattcggcaggcgtgtgtttttggcagcgccgggaatgaagtgctgtacacgacagtaaacgatgaaatatttgtcttgggcactaactgctgtggatgcctcggccttggtgacgtgcagtctacaatagaacctcggaggttagattctttgaatgggaagaagattgcgtgtctctcatacggctccggaccacatatcgttttggccaccaccgaaggcgaggtgtttacttggggtcataacgcatactcccagctgggtaacggaaccaccaaccatgggctcgtcccttgccacatcagcacaaatttgtctaataaacaggtcatcgaagtggcctgcggatcttaccattcacttgttcttacatccgatggtgaggtctttgcttggggctacaataatagcggacaggtgggaagcgggagcactgtcaaccagcctattccccgcagagtaacgggctgtctacaaaataaagtggtagtgacaattgcttgtgggcagatgtgttgtatggccgtcgtagatactggggaagtatatgtgtggggatataatgggaatggacagctcggcctgggtaattcaggcaatcagccaaccccatgcagggtcgctgctctccaagggattagagtacagagggttgcatgtggatacacccacacatctgccgccaaaacccaaggcggacatgtgtacatgtggggccaatgccggggacaatccgtgattctcccacatttgacacatttcagctgtacagacgacgtattcgcctgttttgccactccggcagtaacctggagactgctttccgttgagcctgacgatcacctgaccgtggctgaatcactcaagagggagtttgataacccagataccgcagatctcaagtttctggtagatggcaaatacatttatgcccacaaagtgctgctcaagatccggtgtgagcattttagaagcagtctcgaggacaacgaggacgacattgtggaaatgtctgaattttcctatccggtgtatcgagccttccttgagtacttatacaccgatagtattagcctgagtcctgaagaggccgtaggcctactggatctggctaccttctacagagaaaaccgccttaagaaactgtgtcagcagacgatcaagcagggcatctgtgaagagaatgcaatcgctctgctgagtgcagcagtgaaatacgacgcccaggatctggaagagttctgctttcgattctgtatcaatcacctcacagtggtgactcaaactagcggattcgccgagatggaccatgacttgttgaaaaattttatcagcaaggcatcgagagtgggcgcattcaaaaactag

SEQ ID NO: 202846 - DNA, 1671 bp, Artificial Sequence
  Description of Artificial Sequence: Synthetic coding sequence
ccctgcagcaaccggtaccccggcggcggcgccgacaaggcccccgcttgcgaagaacccgtgcaagcaacattatcctccctgaaaatgcttgacgtgggaaaatggcctatctttagcttgtgctcggaggaggagctgcagctcatccggcaagcatgtgtctttggctcagccggcaacgaagttctgtacacaaccgttaatgatgaaatcttcgtcctcggcacgaactgttgcggatgtctgggccttggagatgtacagagcaccatcgagccacggaggcttgattctttaaacggtaaaaagatagcttgcctgtcctacggatccgggcctcatatagtgctggccaccacggaaggagaggtgttcacctggggacataatgcttatagccagctcggcaacggcactacaaaccatggactggttccgtgccacatctccaccaatttgtcgaataagcaagtgattgaggtcgcatgcgggtcctaccacagcttagtgctgacttctgatggtgaggtatttgcttggggttacaacaattcaggccaagttgggtctggttctacggttaatcagccaatcccccgcagggtcactgggtgcctacagaataaggtggtagttacgatagcctgtgggcagatgtgctgcatggcggtcgtcgataccggcgaagtgtatgtgtggggttacaacgggaacggacagctgggcttgggcaacagcggtaaccaacccacgccatgtagggtggccgccttgcagggcatcagggttcagcgagttgcatgtggatatgcccacaccctggtcttaaccgatgagggacaggtgtacgcctggggggctaattcctatggacagctgggcaccggaaataagagcaaccagagttatcctactcctgttacagtggaaaaagaccgcattatcgagatcgctgcctgccactccacgcacacctcagcggctaaaacacagggcgggcatgtttacatgtggggtcagtgcagaggtcagtccgtcatcctgccacatctcacacactttagttgtaccgacgacgtgttcgcttgcttcgcgacccccgccgttacgtggagactgctttccgttgaacccgatgatcacctcactgtggcggagtctcttaaacgtgagtttgataaccccgacacagccgacctgaaattcctcgtcgatgggaagtatatctacgctcataaagtgcttttaaagatacgttgcgaacacttcagatcttcactggaggataacgaagatgacattgtggagatgagtgagttttcatacccagtttacagagctttcctggaatacctgtacacagattctataagtctcagtccggaagaggcagtgggactgctggatctagccaccttttacagagagaataggctcaagaagctctgtcagcagaccatcaaacagggaatttgcgaagaaaacgccattgccctgttatctgccgctgtgaaatatgatgctcaagaccttgaagaattttgcttccgtttctgtatcaaccacctgacagtcgtcacgcagacatctgggtttgcggagatggaccatgacttgctgaagaactttatctcaaaggcgagcagggtcggggcattcaaaaattag

SEQ ID NO: 202847 - DNA, 834 bp, Artificial Sequence
  Description of Artificial Sequence: Synthetic coding sequence
atgagcggcgtgaccaccgagaccggcagcctggacagcgccaccgttgctacatctcagcctttagcagaatggcagctttgcaaggcttctgtttctcgggggatcattgagattgcagcctgccacagcacacacacctccgccgccaagacacagggtggtcacgtgtacatgtggggtcaatgccggggccagtcagttattctgcctcacctgacccatttcagttgcaccgacgatgtgttcgcctgtttcgccacacccgccgtcacttggaggctcctttccgtggagccggacgaccatctgacggtggccgagagcttgaagagggaatttgacaatccagatactgctgatcttaagtttctggtcgatggtaagtacatttacgcccataaggtgctgcttaaaatccgatgtgagcacttcaggtcaagcctcgaggacaacgaggacgacatcgtggagatgtcagaattttcgtatcctgtgtacagggccttcctcgagtatttatataccgacagcatcagcctctccccggaagaggcagtgggccttctggatttagcaaccttttaccgcgaaaacaggctcaagaagctgtgtcagcagaccattaaacagggcatctgtgaagagaacgccatcgccttgctgagcgctgctgttaagtacgacgcacaggatctagaggagttctgctttagattttgtattaaccacctgaccgtggtgacgcagaccagcgggtttgctgagatggaccatgacctgctcaagaacttcattagcaaggcaagcagggtgggagctttcaagaattag

SEQ ID NO: 202848 - DNA, 846 bp, Artificial Sequence
  Description of Artificial Sequence: Synthetic coding sequence
atgctggacgtgggcaagtggcccatcttcagcctgtgcagcgaggaggagttgcagttgattagacaggcatgtgtgttcgggtcagctggcaacgaagtcctgtatacaaccgtgaacgatgaaatcttcgtattaggaaccaactgctgcggttgcttgggcctgggagatgtgcagtcaactatcgagccgagacggctcgacagccttaacggcaaaaagattgcctgtttatcgtacggatccggcccccatatcgtgctggccactacagaaggtgaggtcttcacttgggggcacaatgcctatagtcagttaggcaacgggaccacgaatcatggcctcgtgccttgtcacattagcactaacctgtctaacaagcaggtaatcgaggttgcctgcggttcctaccattccctcgtgcttacatcagatggcgaggtgtttgcctggggatacaacaactccggtcaggttggatcaggctccaccgtgaaccaaccaattcctaggcgagtcacagggtgcctgcagaacaaggtcgtcgtgacaattgcctgtggccagatgtgttgtatggccgtggtcgataccggcgaagtgtatgtttggggatataacgggaatggtcagctgggcttaggaaacagcggaaaccagcctaccccttgtagggtcgccgctctccagggtatacgggttcagcgcgactaccgggattgctcactctccctgcatactcacgtatgcggccaagatgctggctgggcccgggtgcacgtgggaccagtgcccggatcggtgagagacccccctgctccccatcccctgctcctgcattag

SEQ ID NO: 202849 - DNA, 1359 bp, Artificial Sequence
  Description of Artificial Sequence: Synthetic coding sequence
atgagccccaagcggatcgccaagcggcggagcccccccgccgacgccatccccaagtccaagaaggtgaaagatacccgggccgccgccagtaggagggtgccaggcgcgaggtcatgtcaaggcgcctgtggaccttcaccccccgaccagaaaactagacctgtgagtcataggtcccattcaacagagcccggtctcgtcttgacacttggacaaggagatgtcggacaattggggctgggagaaaatgtcatggagcgaaaaaaacctgctctggtgtctatcccggaggatgtggtgcaggcagaggctggagggatgcacactgtgtgcttgagtaaatcgggtcaggtctacagcttcggctgcaatgacgaaggtgcattgggtcgcgatacaagtgtggaggggtctgaaatggtaccaggaaaggtggagctccaggagaaagtcgtgcaagtaagcgctggcgacagccataccgcagcactcactgacgacggaagagtgtttctctggggttcttttcgcgataataatggcgtgatcggcctgctcgaaccgatgaaaaagagcatggtgccggtacaggttcagctggatgtgcccgttgtcaaggtagcctcaggcaatgaccacctcgtcatgttgactgccgacggagacctctataccttgggatgcggggagcaggggcagctcggacgggttcctgagctctttgcgaatcggggcgggaggcagggcctggagcggctgctcgtgcccaaatgcgtcatgctgaagtctcgtggaagtcgcgggcatgtgaggtttcaggatgcgttttgtggagcctactttacattcgctatctcccacgaggggcatgtgtacggattcggactgtctaactatcatcagctcggcacaccagggacagagagctgctttattccccagaacctgacgagcttcaagaactctactaagtcgtgggtgggatttagtgggggccaacaccatacggtttgtatggattctgagggcaaggcatattctctcggaagagccgaatatggcagactcggactgggtgaaggagctgaagaaaaatccattcctactctgatatctcggcttccggccgtgagctcagtcgcctgtggcgcctccgtagggtacgcagtgacgaaggatgggagagtctttgcatggggaatgggcactaattaccagctcggtacgggccaagacgaagatgcctggagtcccgtagagatgatgggtaagcagttggagaatcgcgttgtactcagcgtctcaagcggcggccagcatacagtgctgctggtcaaagacaaagagcaatcttag

SEQ ID NO: 202850 - DNA, 1266 bp, Artificial Sequence
  Description of Artificial Sequence: Synthetic coding sequence
atgagccccaagcggatcgccaagcggcggagcccccccgccgacgcaatacctaagagcaagaaggtgaaggtttctcaccgaagccacagtaccgagcctggactggtgctgaccctaggtcaaggtgatgtcggccagctcggattgggtgaaaacgtgatggaaaggaagaaaccagcgctcgtctctatcccagaggacgtggttcaggccgaggcaggagggatgcacaccgtatgcctgtctaagtcgggacaggtgtattctttcggctgcaatgacgaaggggccctggggagggatacatcggttgaaggttccgaaatggtgccagggaaagtagaactgcaggaaaaagtagtccaggtgagcgctggtgatagtcacactgctgcactaacagacgatggtcgagtttttctgtggggatccttcagggacaacaatggagtgataggtctgctggagcccatgaagaaatccatggtgcccgtacaggttcagctggacgtacccgtcgtgaaggtcgcatccggcaacgaccacctcgtaatgctcaccgccgacggggacttatacaccttaggctgtggagaacaggggcagctagggagagttcccgaactgtttgcaaacaggggcggtagacaggggttggaacgtctgttggttccgaaatgcgtcatgctgaagtcaaggggctcaagaggccacgtgcgctttcaggacgcattctgcggggcttattttacgtttgccatcagtcacgagggccatgtgtacggattcggactctctaattatcaccagcttggaactcccggaaccgaaagctgcttcattccccagaatctgactagtttcaaaaattctacaaaaagttgggttggattcagcggcgggcagcaccacacagtatgtatggatagcgaaggcaaggcctatagcctcggcagggcagagtacggccggcttgggctcggtgaaggggccgaagaaaaatccattcccacccttatttccagactgccggccgtctcaagcgtggcctgtggtgcctcagtagggtacgctgtcactaaagatggcagagtcttcgcatgggggatgggcacgaactatcagctcggcactggtcaggacgaagacgcctggtccccggttgagatgatgggaaaacagttagagaatcgggtggtgctgagcgttagttctggtggccagcacacagtgttgctagtcaaagataaagaacagtcctag

SEQ ID NO: 202851 - DNA, 1266 bp, Artificial Sequence
  Description of Artificial Sequence: Synthetic coding sequence
atgagccccaagcggatcgccaagcggcggagcccccccgccgacgcaattccaaaaagtaagaaggtcaaggtcagccaccggagccattccactgaaccaggattggtcctcacgttgggccaaggcgacgtggggcagctggggttaggtgagaacgttatggagagaaaaaagcccgcactggtgagcataccagaagatgtcgttcaggctgaggctggaggaatgcatactgtctgtttgagcaaatctggacaggtgtacagtttcggctgcaatgatgaaggtgcgctaggtagggatacttcagtggaggggtcagagatggtgccaggaaaagtggagctgcaggagaaagtggtacaggtctcagccggggatagtcataccgctgcccttacggacgacgggagagttttcctgtggggaagcttcagagataacaacggtgtgatcggcctgctggagcctatgaagaagagtatggtccccgtccaggtgcagctcgatgtcccagttgtaaaggtagccagcgggaacgaccacctggtcatgctcacagctgatggcgatctctacacactgggatgcggtgaacaaggtcaattgggccgggttcccgagctgttcgccaacagaggaggtcggcaaggcttagagaggctgctcgtaccgaagtgtgtcatgctgaagtctcgcggtagtcgcgggcacgtacgattccaggatgccttttgtggggcatacttcaccttcgcgatatctcacgaggggcacgtgtatggcttcggcctgagtaactatcaccagttgggcacgcccggtactgagtcgtgtttcatcccccagaacctgacaagcttcaaaaattccactaaaagctgggtcggcttctccgggggccagcaccataccgtgtgtatggattctgaaggaaaggcctacagcttaggaagagctgagtatggtaggttgggccttggcgagggtgcagaggagaaaagcattcctacactgatcagccgtctgcctgccgtcagctcggtagcatgtggcgctagcgtcgggtacgccgtcacaaaggatgggagggtgttcgcatggggtatgggcacaaactaccaacttgggaccggacaagacgaggatgcctggtcccccgtcgagatgatgggcaagcagcttgagaatcgcgttgtgttatcagtctcctctggggggcagcacactgtgttgctggtcaaagacaaggaacagtcctag

SEQ ID NO: 202852 - DNA, 1266 bp, Artificial Sequence
  Description of Artificial Sequence: Synthetic coding sequence
atgagccccaagcggatcgccaagcggcggagcccccccgccgacgctattccaaagtctaaaaaggtgaaagtgtcccacaggtcccactcaaccgaaccaggtctcgtcttgaccttaggccagggagatgtcgggcagctcggtttaggagagaacgtgatggaacggaagaaacctgcactcgtctccatccctgaagatgtggtacaagccgaggctggtggcatgcacactgtgtgtctgagcaaaagcgggcaggtatattctttcggctgcaacgatgaaggagcactgggccgcgatacgagcgtcgaaggttccgagatggtgcctggtaaagtggagttacaggagaaggtggtgcaagtgtctgccggggatagtcacaccgcggccctgacggacgatggcagggttttcctatggggatcctttagggacaataatggcgtgatcgggctccttgagccaatgaagaagtcaatggtgcctgtgcaggtccagctggacgtccctgtagtcaaggtggcgagcggaaacgatcatttagtgatgctgacagcagacggtgatttatacactcttggctgcggcgagcagggacaactgggccgggtccctgagctgtttgccaacagaggcggacggcaggggctggagagactcctcgtgcctaagtgtgtcatgcttaaatcccggggctcaagagggcatgtgaggtttcaagatgctttctgtggggcctacttcacctttgctatcagccatgaagggcacgtttacggatttggactgtctaattaccaccagcttgggacacccggaacagaatcctgtttcattccacagaatctgacatcttttaaaaattctaccaagtcgtgggtgggcttcagcggtgggcagcaccacacggtatgtatggatagcgaaggtaaggcctatagtctggggagggccgaatatggtagactcggtttgggcgaaggcgctgaagagaaatcaatacctacactgattagtcgactgccagccgtctcttccgtcgcctgcggggcctccgtcggctacgctgtgactaaggatgggcgagtttttgcctggggaatgggcactaactatcaattgggaacagggcaggatgaggatgcttggtcacctgtcgagatgatgggcaagcagctcgagaaccgcgtggtcttaagcgtcagcagcggtggacagcatactgtcctgctcgtgaaagataaagaacagagctag

SEQ ID NO: 202853 - DNA, 693 bp, Artificial Sequence
  Description of Artificial Sequence: Synthetic coding sequence
atgagccccaagcggatcgccaagcggcggagcccccccgccgacgcgatcccaaaatcgaagaaggtaaaagtgtcgcacagaagtcactctaccgagcccggcctcgtgttgaccctcgggcagggagatgtggggcaactggggctgggggaaaatgtgatggagcgcaagaagcccgccctggtatccattccagaagatgtggtacaggcagaagccgggggaatgcacacggtgtgtttgagcaagagtggtcaagtgtactcatttggttgtaacgatgagggggctttggggcgggacacctccgtcgaaggctccgagatggttcctggtaaagtggagttgcaggaaaaagtggtccaagttagcgccggagactcccacaccgcagcactgaccgatgatggtcgcgtgtttctctgggggtcctttagggacaacaacggagtaatcggcctcttagaacctatgaaaaaatctatggtccccgtgcaggtccagctggacgtcccagtagtgaaggtcgccagcggcaacgatcatctggtgatgttgacagctgatggggacctttacacactgggatgcggggagcagggtcaactgggcagagtgcctgaactcttcgcaaatcgagggggtagacagggcttagagagactcttagtgcctaagtgcgtgatgtag

SEQ ID NO: 202854 - DNA, 852 bp, Artificial Sequence
  Description of Artificial Sequence: Synthetic coding sequence
atgagccccaagcggatcgccaagcggcggagcccccccgccgacgcaattcctaaatcaaaaaaggttaaggtgtctcaccgttcccacagtaccgagcctgggctagtcttaacactggggcagggcgacgtgggccaactgggcctgggggaaaacgtgatggagaggaaaaagcctgccctggtgtctattccggaagatgtagttcaggccgaggctggaggcatgcacacagtctgccttagcaagtccggtcaggtgtacagtttcgggtgtaatgacgagggcgccctaggaagagacacatccgtcgagggctccgagatggtcccaggcaaagtggagctccaggagaaggtcgttcaggtttctgccggtgattctcacacagctgctttgaccgatgatggacgcgtcttcctctgggggtccttcagggacaataatggcgttatcggactgttggagcccatgaagaagtctatggtgcccgtgcaggtccagttggacgttccagtcgtaaaagttgccagcgggaacgaccacctggttatgctcaccgccgatggagatttatacaccctcggctgtggagaacaaggccaactggggcgcgttcccgaattgttcgccaatcgagggggcagacagggattagagaggctactggtgcctaagtgtgtcatgctgaagtcacggggctccagagggcatgttaggtttcaagacgccttctgcggggcctactttacatttgcgatttcccacgaagggcacgtgtacgggtttggactgtcaaattaccaccagctgggcactcctgggacagaaagctgctttataccctag

SEQ ID NO: 202855 - DNA, 708 bp, Artificial Sequence
  Description of Artificial Sequence: Synthetic coding sequence
atggcccgggaggagtgcaaggccctgctggacggcctgaacaagacaacagcctgctatcaccacctggttctgactgtaggtggaagcgccgatagtcagaacctgcgtcaggagctccagaagactaggcaaaaagcccaagaattggccgtcagcacttgtgcaagacttacagctgtactgagagaccgaggactggccgctgatgagcgggccgaatttgagcgactgtgggtcgcattctctggctgtctggatctgctcgaggcagatatgcggcgcgctctcgaattaggggctgccttccccctgcatgcacctcgtagacccctggtgagaactggggtggccggggcaagctcaggggtcgcagccagagcacttagtaccagaagcttgcgtctcgaagccgagggggatttcgatgttgcggatctaagagagctcgaacgcgaagttctgcaggtcggcgagatgatcgacaatatggaaatgaaggtgaatgtcccaagatggacagtgcaggcccggcaggctgccggcgctgagctgctctcaacagtgagcgccggtccctcaagcgttgtctcactacaagagcgaggagggggatgcgacccccgcaaagcgctggccgccattctctttggagccgtgttgctggccgccgtggcactggcagtctgcgtggcaaagctgagttag

SEQ ID NO: 202856 - DNA, 630 bp, Artificial Sequence
  Description of Artificial Sequence: Synthetic coding sequence
atgcgggccgccgccatcagcacccccaagctggacaagatgcccggcatgtttttttccgccaaccccaaagaattgaagggaaccacacatagtctgctggatgacaaaatgcagaagcggagacctaagacattcggtatggatatgaaagcctatctaagatcaatgattccccatctcgagtccgggatgaagtccagcaagtctaaggacgtcctgtctgcagctgaagtgatgcagtggtcccaatccctggaaaagctcttagccaaccaaactgggcagaatgtgttcggaagcttcctgaagagcgagttctccgaagaaaacattgaattttggctcgcttgcgaagactataagaaaaccgagtcagacctcctaccctgcaaggctgaggagatatacaaggctttcgtccactccgacgccgctaaacaaattaatatcgattttagaactcgggaatcgactgctaagaagatcaaagccccaacccctacatgcttcgatgaggcccagaaagtgatatacacattgatggaaaaggatagctatcccagatttctgaagtccgacatctacctcaacctgctcaacgacttgcaggccaattcactcaaatag

SEQ ID NO: 202857 - DNA, 1044 bp, Artificial Sequence
  Description of Artificial Sequence: Synthetic coding sequence
atgcccggcaagcccaagcacctgggcgtgcccaacggccggatggtcttggctgttagcgatggagaactgtcctctactaccggtcctcagggccaaggggaaggaaggggctccagcctttcgattcattctctgccttccgggcctagttctccgtttcccaccttcgtgagttcgaaatcagagtcccatagaaaaagcctggggagtaccgaaggtgagtccgagtccagaccgggcaaatactgttgcgtctatcttccggacggaacagcgagtctggcactggctcgtcctgggctgactatcagagatatgctggcaggcatttgcgaaaaaagaggcttgtcactgccggacattaaagtgtacctcgttggcaacgaacagaaagcgctcgtgctcgatcaggactgcactgtgctggcagatcaggaggtgaggctcgagaatcgcataacattcgaactggaattgacggcactcgagagggtcgtcaggatttctgccaaacctacgaaaagattacaagaggcgttgcaacccatactggagaagcacggtcttagcccactggaggtggtgttacatagaccaggggagaagcagcccttggatctgggtaagctcgtgtcctctgtcgctgcccagcgactcgtgctggacacattacccggcgtgaaaatctccaaagccagggacaaatccccctgtcgcagccaggggtgccctccacgcactcaagataaagccacccatcccccccctgccagtccatcaagcctcgtgaaagtgccttcctccgcaacgggaaagaggcagacatgcgatatcgaaggtttggtagaactgcttaatagagtgcagtccagtggcgcccatgaccagagaggtctgttgcgcaaggaggaccttgtactgccagaattcctgcagctgcctgctcagggcccaagttctgaagagacacccccccagaccaagtcggctgcccagcctatcggagggagtctgaactcaacaacagacagtgccctctag

SEQ ID NO: 202858 - DNA, 1701 bp, Artificial Sequence
  Description of Artificial Sequence: Synthetic coding sequence
atgcccggcaagcccaagcacctgggcgtgcccaacggccggatggtgcttgctgtgtcagacggagagctgagcagtacgaccggaccacagggacagggtgaagggagggggagttccctctcaattcattcgctgccttctggcccttccagtcctttcccgacagaggaacagcccgtcgccagctgggctctgtcattcgagaggcttttgcaagatccgctgggccttgcttactttactgagttcctaaagaaagaattctcagcagagaatgtgaccttctggaaagcctgcgagcgctttcagcagattcccgccagcgacactcagcagttggcccaggaagctaggaacatctaccaggagttcctcagctcacaggcactgtcacccgttaatatcgaccgacaggcatggctgggagaagaggtgctggcagagcccaggcctgacatgtttcgggcccagcagttgcagatatttaacctgatgaagtttgatagttacgctagattcgtcaagtcccccctctacagagagtgtctgttagccgaagccgagggtcgcccactccgagaaccaggctcctccagactgggcagtccggatgctacccgcaaaaagcccaagctaaagcctggtaagagccttccgcttggagtcgaagaactgggacagttaccaccagtcgagggtcccggtgggcggccgcttagaaagtcttttcgacgggagttaggcggaaccgcaaacgcggcccttcggcgtgaaagtcagggaagcctcaatagcagcgcttctctggacctgggtttcctggccttcgtctctagcaagtccgaatcccaccggaagagcctggggagcactgaaggagagtctgagtcacgccccggcaaatattgttgcgtgtatctaccagacggaaccgcctccctggcactggcccgccctgggctgactatcagagacatgctagctggtatatgtgagaaacgcggattgtctctgcccgacattaaagtttacctcgttggcaacgagcaggcgctagtcctggatcaggactgtaccgtcctggctgatcaggaggtacggctcgaaaatcggatcacgtttgagctggaattgacagcgcttgaaagagtggtgcggatttccgccaaaccaacgaagcgcctacaggaagctttgcagcccattctggagaagcatggcctctcacccctggaagttgttctgcatcgccctggggagaagcagccattggacctgggcaagctcgtaagcagtgtcgcagcacagcggttggtcctggacaccctgcccggcgtgaaaataagtaaggcccgtgacaagagtccttgtcggtcgcagggctgtccgccccgaactcaagacaaggcaacacatcccccccccgcctcccccagcagcttggtcaaggtgccatctagcgccacaggtaagaggcagacttgcgatattgagggccttgtagagttgctaaacagagtccagagcagcggagcacacgaccagcgggggttgctgcgaaaagaggaccttgtcctgcccgagtttttgcagctgcctgctcagggccctagtagcgaggagacacccccccagacaaaaagtgccgcccagcccatcggtggttctctgaactccactacagatagcgccctatag

SEQ ID NO: 202859 - DNA, 1314 bp, Artificial Sequence
  Description of Artificial Sequence: Synthetic coding sequence
tgaagccccgtgaacatcgaccggcaggcctggctgggcgaggaggtgctggccgaaccccggcctgacatgttccgggcccagcagctccaaatctttaacctgatgaaattcgattcatatgccagattcgttaaatccccactttacagggagtgtttgctggccgaggctgagggccgcccactgagggagcccggatcctcccgcctggggagccctgatgctacaagaaaaaaacccaagctcaagcctggcaagagcctcccccttggagtggaggagttgggccagctaccccctgtggaggggccgggtgggaggcccctcaggaagagtttccgtcgcgagctgggaggcacggcgaacgctgctcttcgtcgcgagtcccagggaagtctcaactcctctgctagcctcgacctcggcttcctggcatttgtgtctagcaagtcagaaagccaccgcaaatctcttggaagcacggagggagagtctgagagtagaccagggaaatactgttgcgtgtacctgccagatgggacagcttcccttgccctggccaggcccggcttgactattagagatatgctcgctggtatatgtgagaagagaggcctgtcccttcccgatatcaaagtgtacttggttggaaatgagcaaaaagccctcgtcctagatcaggactgtacagtcctggccgatcaggaggtgaggctggagaatcgcatcacttttgaactagaattgactgcgctggaacgagtcgtgaggattagtgcaaaacccactaagagactgcaggaggctttgcagccgatcttagaaaagcacggcctgagccctctcgaagtcgtgttacatcgacccggcgagaaacagcccctggaccttggcaagctggtgtcttcagtcgcggcccagcgtttggtgctggacactttgccgggcgtgaaaatatctaaggcccgggataaaagcccctgccgttctcaagggtgtcccccccgtacacaagacaaggctacgcaccctccaccagcgtccccttcgagtctggtaaaggttccgtcatctgctactggtaagagacagacttgcgacatcgaagggctggtggagctgctcaatcgggtgcaaagctccggggcccacgatcagcggggactgctgcgcaaagaggaccttgtgcttcctgagttcttgcagcttcccgcccagggcccatcgagcgaggaaaccccccctcaaacaaagagcgccgctcagcctattgggggatccctgaacagcactaccgattccgctctttag

SEQ ID NO: 202860 - DNA, 609 bp, Artificial Sequence
  Description of Artificial Sequence: Synthetic coding sequence
atgtgccggaccctggccgccttccccaccacctgcctggagcgggcaaaagagttcaagactcgactaggcatttttctgcataaaagtgaacttgggtgtgataccggttccaccggaaaattcgaatgggggtctaagcatagtaaagaaaatcgaaatttcagcgaggatgtgttgggatggcgggaatcttttgatcttctcttgagctcgaagaatggcgtggcggcatttcacgccttcctgaagactgagttcagcgaggaaaatcttgaattttggctggcttgcgaggagttcaagaagattagaagcgccactaagcttgcctcaagggcgcaccagatctttgaggagtttatatgcagcgaggcaccgaaggaggtcaacatcgatcacgagacccacgagctcacaagaatgaacctccaaacggccacagccacatgttttgatgcagctcagggcaaaacacgtactcttatggagaaagattcttacccgcgatttttgaagtcaccggcctatagagacctagcagcgcaagcctctgctgcctcggctaccctgtcctcctgctccctggacgaacccagtcacacatag

SEQ ID NO: 202861 - DNA, 459 bp, Artificial Sequence
  Description of Artificial Sequence: Synthetic coding sequence
atgcccgtgaagtgctgcttctaccggagccccaccgccgagaccatgacatggagtgaaaacatggacactctgctggccaatcaggccggattggacgccttccgcatttttctgaagtccgagttctccgaggagaatgtggagttctggctggcttgcgaagactttaaaaagaccaagaatgcagacaagatcgcttctaaagcaaaaatgatctactctgagttcatagaagccgacgcacctaaggagattaacatagattttggcactagggacctgataagtaagaacatcgcggagccaaccctcaaatgcttcgatgaagcacagaaactgatatattgcctgatggcaaaagatagcttcccccgtttcctgaagtcagagatttacaaaaaactggtgaactctcagcaggtccctaaccacaaaaaatggttgcccttcctgtag

SEQ ID NO: 202862 - DNA, 1809 bp, Artificial Sequence
  Description of Artificial Sequence: Synthetic coding sequence
atggagcggagcctgcaccgggtgagcctgggcagccggcgggcccaccccgacctgtctttttacctcactacattcggtcagctgcgccttagcattgacgctcaggatcgcgtccttctcttgcacataatcgagggtaaagggctgatctctaaacaaccagggacctgcgacccctacgtgaaaatttccctgataccagaagatagcagactacggcaccagaaaacccagaccgtgcctgattgccgcgatcctgccttccatgagcatttttttttccctgttcaggaggaggatgaccagaaaagacttctggtgaccgtgtggaaccgggcatctcagagccggcagtcaggtttaattgggtgcatgtcatttggagtaaagtccctcttgacgcctgacaaggaaatctcaggatggtattatctgctgggcgagcacttggggcggacaaagcatcttaaggtggcaagaagaagactgagaccattgagggatcctcttctgagaatgcctggtggtggggacacagagaacggcaaaaaactgaaaataacaatcccccggggaaaggatggcttcgggtttacgatttgctgcgactcacccgtccgggttcaggccgttgatagcgggggtccggcggagagagccggtctacaacaacttgatactgttctacagctgaacgaaagacctgtcgaacattggaagtgcgtagaacttgcccacgagattcggagctgcccatctgagattattctcctggtgtggaggatggtccctcaagttaagcctgggcccgacggaggcgttctgaggagagcctcatgcaagtctacccacgatttacagtcaccccctaacaagcgggaaaagaactgcacccacggggttcaagccaggcccgagcagcggcacagctgtcaccttgtctgcgacagctctgatgggctcctcttgggggggtgggaaagatacaccgaagtggcaaagcgagggggccaacacaccttgccggcactgagcagggccaccgctcctacagaccccaactatattattcttgcgcccctgaatccgggcagccagctcctgcgccccgtgtaccaggaggacacaattcccgaagaaagcggatccccgtccaagggaaaaagctatacgggactggggaaaaagagtcggctcatgaagactgtgcagactatgaaaggccacggtaactaccagaattgtccggtagttagaccacatgccacccactcttcttacggaacgtatgtgacccttgcaccgaaagtcctggtctttccagtcttcgttcagccgctcgatttatgcaacccagcacgcaccctgttattaagcgaggagctgcttctgtacgaagggcgaaataaagcggctgaggtcacactgtttgcatactccgacctgctactttttactaaggaggatgaaccaggtcgctgtgatgtgctgcggaacccactgtacttgcagagtgtgaaactgcaggaggggtccagcgaagaccttaaattttgcgttctgtacctagcggaaaaggctgagtgccttttcacactggaggcccacagccaggagcaaaaaaagcgcgtgtgctggtgcctatctgagaatatcgcgaagcagcagcaacttgcagcctcgcctcctgactccaagaagctacacccctttggttctctccaacaggaaatgggccccgtgaatagcacgaacgcgactcaggaccgtagttttactagcccgggacagacactgatcggatag

SEQ ID NO: 202863 - DNA, 507 bp, Artificial Sequence
  Description of Artificial Sequence: Synthetic coding sequence
atgaagaacaagctgggcatcttccggcggcggaacgagagccccggcgcacctccagcaggcaaagcagataagatgatgaagtcctttaagccaaccagcgaggaagccctgaaatggggtgaatcgttagagaagttgctggtgcacaagtatggattggccgtgttccaagcgttcctgcgcacggaattttccgaagagaacttggagttttggctggcttgcgaggatttcaagaaagtgaagtctcaatctaaaatggcctcaaaggccaagaaaatctttgccgagtacattgccatccaggcgtgcaaggaagtaaacctcgactcctacacaagagagcacactaaggacaacctacagagtgtgacccgaggatgtttcgatctggcgcagaaaagaatctttgggctgatggagaaagattcgtacccacgctttcttcgcagcgatctttatctcgacctgatcaatcagaaaaagatgtctcccccactgtag

SEQ ID NO: 202864 - DNA, 2754 bp, Artificial Sequence
  Description of Artificial Sequence: Synthetic coding sequence
atgaaccggttcaacggcctgtgcaaggtgtgcagcgagcggcggtatcgtcaaatcactataccacgcggaaaggacggcttcggctttactatctgctgtgactcccctgtccgggtccaggccgttgactcgggaggcccggctgagagggctgggctacaacagctcgacactgtcctacagctgaatgagcggccagtggagcattggaaatgtgtagaattggcacacgagattcgcagctgccctagcgagatcatattgcttgtgtggagaatggttcctcaggtaaaacccggccccgacgggggagtgctgcggcgggcatcatgcaagtcgacgcatgatttgcaatccccgccaaacaaaagagaaaaaaactgtacacatggcgttcaggccaggcctgagcagcggcattcttgccatttggtgtgcgactcttcagatgggcttctgctgggaggttgggagcggtatacggaggtggctaagcgggggggacagcatacgcttcccgctctgtctcgggctacagcgccaactgacccaaactacatcatcctggcaccactcaatccaggctctcagcttctgcggccagtttatcaggaggacacaatcccagaagagagcggcagcccaagtaaagggaagtcatatacaggactcggtaaaaagagccgtctgatgaaaacagtacagacaatgaaagggcacggcaactaccaaaactgccctgtggtcagaccacatgccacccactcctcttacggaacttacgtgacgctagcccctaaggtgctcgtcttccctgttttcgtgcagcctctcgacctctgcaaccctgcccgcacgctgctgctgtccgaggagctactgctgtatgagggccgcaataaagccgctgaagtaactctatttgcatacagcgatctactactgttcaccaaagaagacgagcccggccgttgtgatgtgctccggaatcccctctacctgcagagcgtgaagctccaagagggcagcagcgaagacctcaaattttgtgtgctgtacctggccgaaaaagcggaatgtctgtttactctggaagcgcactcgcaggaacagaagaagagggtgtgttggtgtcttagcgaaaacatcgccaaacagcagcagcttgccgcaagccctcctgacagtaaaatgtttgagacagaggccgacgagaagagggagatggccctggaggagggcaaaggccctggagcagaggatagccctccgtcaaaggagccctcccctgggcaagagttgcccccaggccaggacctgcctcccaataaggacagcccttctgggcaggagccagccccgtctcaagaacccctgtcctctaaggactctgcaacctcggaggggtcccccccaggaccggatgcccctcctagcaaagacgtaccaccttgccaagagccgcctcccgcccaggacctcagtccctgtcaagacctacctgcaggccaggagcctctgcctcaccaggaccccctgttaacgaaggacctgcccgccatccaagaaagcccaacgcgtgacctaccaccatgtcaagacctccctccaagccaggtcagtctgcctgcaaaggctctcaccgaagatacgatgagcagtggtgacttgttggctgccactggagatcctccagcggcacccaggccagccttcgtgattccagaggtcaggctggattctacgtacagccagaaggccggggcagaacagggatgttcgggtgacgaggaagacgcagaggaagctgaagaagtagaagagggggaggaaggagaggaagatgaagacgaggacacgtccgatgacaattatggcgagaggagcgaggccaaacgtagctcaatgatagaaactggtcagggggccgaaggcggcctgagcttacgggtgcagaacagtctgagacgccggacgcactctgagggatccctgcttcaggagccccgagggccctgtttcgctagcgatacaaccctacattgctccgacggggaaggagctgctagcacatggggcatgccatcacctagcacccttaagaaggaactagggcgcaatggagggagcatgcaccatctctctcttttttttactggacatagaaagatgagcggtgctgacaccgtgggggacgacgacgaggcctcccgaaagcgcaagtccaagaatttagcaaaagatatgaagaataagcttggcatctttaggcgcagaaacgagtctccaggggctccccctgccgggaaggctgataagatgatgaagtctttcaagcccaccagcgaggaggcattgaaatggggagaatccctggaaaaattgctggtccacaagtatgggctggctgtttttcaagcgtttctacggaccgaattcagtgaagaaaatctcgaattttggttggcatgcgaggatttcaaaaaagtaaagtctcagagtaagatggctagtaaggccaaaaagatctttgccgaatacatcgcgattcaggcctgcaaggaagtgaatctggactcttatacacgcgaacatacaaaggacaatctccagtccgttacaaggggctgctttgatttagctcagaagcggatcttcggccttatggaaaaggacagttatcccaggtttctgaggtcggacctgtatctggatctgatcaatcagaaaaagatgtcccccccactgtag

SEQ ID NO: 202865 - DNA, 3597 bp, Artificial Sequence
  Description of Artificial Sequence: Synthetic coding sequence
atgcccgtgatccccgccctgtgggaggtggagatgggccggagccaaggacaggagattgagactatcttggcaaaccggtctcactcagattcaacccccctacctaatttcctgtctggatcccaccgccctgaatgttgtacctgccgacttttgactgccagcggcgcccaggatagcttgccatttggaaggcgcctgtacagcggtccttggcggtcttgtgaggaggtatgtcatgtgagtgtcctctccgtgctgagtactagttgcggacttagcctatcccttcctatctttcctggatggatggaatggctgagccccgacattgcactccctaggcgagacgagtggacccagacgtcccccgcaagaaaacgaattactcacgccaaagtccagggggcggggcaactccgcttaagtatcgacgctcaagaccgagtcctgcttttgcacattatagagggaaaggggctgatctccaagcagccagggacctgcgatccctatgtgaaaatttccctcattccagaagacagcaggttgaggcatcagaaaacgcagacagtacccgattgtagggaccccgcattccatgagcactttttttttcctgtccaggaggaggatgatcagaagaggcttctggtaacagtttggaatcgggcctcccagtccagacagagtggactcattggctgcatgagttttggggtaaaatctttgcttacaccagataaggagattagtggttggtactatttgctgggcgagcatcttggccgcactaaacacctgaaagtggcacggcgaagactacggccccttcgcgaccctctcctacgcatgccgggaggtggtgatacagaaaatggcaagaaactcaaaatcacaatcccgcgtgggaaagacgggtttggatttaccatctgctgcgactcccccgtgagagttcaggctgtggactcgggtggccccgctgaaagagcagggttgcagcagttggacacagtgctgcaattaaacgaacgacctgttgagcactggaaatgtgtggagctggctcacgaaatccggtcctgcccgtccgagatcatccttctggtctggcgtatggtgccccaggttaagccagggccagatgggggcgtgctgaggcgggccagttgcaagtctactcacgatctccagtcaccaccgaacaagagagaaaaaaattgcacccatggggtgcaggcccgccccgagcagaggcatagttgtcacttggtatgtgattcttctgacggtcttttgctggggggttgggagaggtatactgaagtggcaaagcgcggcggtcaacacacccttccagctctcagccgcgcaaccgcaccaaccgatcccaattacataatcctagcccctctgaaccctggatctcaactgctgaggcccgtctaccaggaggacactattcccgaggaaagtggttccccgagcaaaggcaagtcgtataccggactcggaaaaaaatcaagactaatgaaaacggttcagactatgaaaggccacggaaactaccaaaattgtcccgtcgtccgaccccatgcaactcatagcagttacggcacgtatgtgacactggctcccaaggtcttggtcttcccggttttcgtccaacccttagacctgtgtaatcccgccagaacgctcctgctttctgaggagctgctgttatacgaaggcaggaacaaagccgccgaggttactctgttcgcttattccgatctgctcctgtttacaaaagaggatgagcccgggcgctgcgacgtcctccggaatcctctatatttgcaatccgtgaagctgcaagagggcagttcagaagacttgaagttctgcgtgctgtatttagcggaaaaggccgagtgcctgttcaccttagaggcccattcacaggagcaaaaaaagagagtctgttggtgcctgtctgagaacatcgctaaacagcagcaattggccgcctcacctccagactccaagatgttcgagacagaagccgatgaaaagcgcgagatggccttagaagagggcaaaggcccaggcgccgaagactcccctcccagtaaggagccctcccctgggcaggagctgcctcccggacaggacctgccaccaaataaggatagcccatccggtcaggagcctgctccgtcccaggaacctctctcatcaaaagacagtgctacgagtgaggggagtcctcctgggccagatgccccaccgtcaaaagatgtgcccccgtgccaggagcccccccctgcccaagatctctcaccctgccaggacctgcctgccgggcaggagccactcccccatcaggatccactgcttacgaaggatctgccagctatccaagagtcacctactagggatctgcctccgtgccaagatctgccccctagtcaagtgtcccttccagctaaggctctcactgaagataccatgtccagcggagatctgctggcggctaccggagaccccccggctgcacctagacctgcgtttgtcatccctgaggtacgtctggactccacttacagtcagaaagctggggccgaacagggatgttccggcgatgaggaagatgccgaggaggcagaagaagtagaagagggagaggagggcgaggaggatgaagacgaggacacttctgacgacaactatggtgagcggtcggaagccaagcgaagcagcatgatcgagactggccaaggtgcagaaggcggactgagtcttcgcgttcagaacagtctgcgccgcaggacgcactccgagggttctctgttgcaggagccccggggcccatgctttgcctctgatacaaccctccactgcagtgacggtgagggtgccgcgagtacatgggggatgccatccccttcaacactgaagaaagagttggggcgaaatggcggatccatgcaccacctgtcactatttttcaccggacatagaaagatgtctggagcagacacagtgggggacgatgatgaggccagtaggaaacgcaagtcaaagaacctggctaaggacatgaaaaataagctggggatcttccgaagaaggaacgaatcacccggagctcctcctgccggaaaagctgataagatgatgaaatccttcaaaccaacaagcgaagaggccttaaagtggggagagtccctcgagaagcttttggtccacaagtacggccttgcagtctttcaggccttcctcagaactgaatttagcgaagaaaacctggagttttggttagcttgtgaggatttcaagaaagtgaagagccagagcaagatggcctcaaaggccaagaagatattcgccgagtacattgccatccaagcctgtaaggaagtgaacctggatagctatactcgcgagcatacgaaggacaatctccagagtgttactcggggctgtttcgatctcgcacaaaagagaatcttcggattaatggagaaagacagctacccccgttttttacgcagtgatctgtatcttgatttgatcaaccagaaaaaaatgtctcctccactgtag

SEQ ID NO: 202866 - DNA, 1560 bp, Artificial Sequence
  Description of Artificial Sequence: Synthetic coding sequence
atgttcgagaccgaggccgacgagaagcgggagatggccctggaggagggcaaaggacccggggccgaagattcacctccctctaaggagccatcccctggccaagagctgccccctggccaggaccttccccccaataaagatagcccctccggccaggagcccgccccgtcccaggaaccactgtcctctaaggattcagccacttccgagggttcaccaccgggacctgacgcaccccccagcaaggacgtgcctccctgtcaagagcccccgccagcccaggatcttagtccctgtcaagacctcccagctgggcaggagcctttaccacaccaggatcccctgcttactaaggatcttcccgccatacaagaaagccctacccgggacctgcctccttgtcaggatctgcctccgagccaagtttcccttcctgcgaaagcattgacggaagacacgatgtcgtcaggggacctcctcgccgctaccggtgaccctcctgctgctccaagacccgccttcgtaatacctgaggttcgattggactccacatactcccagaaagccggtgccgaacagggttgtagcggggacgaagaagacgcggaagaagctgaggaggtagaagaaggagaggaaggcgaagaagacgaggatgaagacacaagtgatgataactacggcgagcgttccgaagctaaacgctcttctatgatcgagaccggccagggggccgaaggcgggctgagtcttcgtgtgcagaattcgctgagacggcggacccacagtgagggctcgcttctacaagagccacgcggtccttgttttgcttccgatacaacactgcattgtagcgatggcgagggtgccgcgagtacttggggaatgcctagcccgagtacgctgaaaaaggaacttggcagaaatgggggttctatgcatcacttgtccctgttctttactggccacagaaagatgagtggcgcagacactgtgggtgatgatgatgaggcctcccgaaaacgcaaaagcaagaacctggccaaagatatgaaaaacaaattggggatcttcaggcgccggaacgagagtcccggggctccccccgccggaaaggccgataaaatgatgaaaagctttaagcccacctcggaagaggcgctgaaatggggagaaagcctggaaaagctgttagttcacaagtacggtttggcagtgttccaggcttttctcaggaccgagttctctgaggagaacctggagttttggctcgcctgtgaagatttcaaaaaggtcaaaagtcagagcaaaatggccagcaaggccaagaagattttcgcagaatacatagccattcaggcctgcaaagaggttaatcttgattcctatacacgagagcacacaaaagataacctgcaatcagtgaccagaggatgcttcgacctggcacagaagcggatatttggattgatggagaaggactcataccctagatttctgcgctccgacctctatctcgatttgattaaccagaagaaaatgtctccccctctgtag

SEQ ID NO: 202867 - DNA, 3597 bp, Artificial Sequence
  Description of Artificial Sequence: Synthetic coding sequence
atgcccgtgatccccgccctgtgggaggtggagatgggccggagccagggccaagaaattgaaacaatcttagccaatcgctcccatagcgacagcactccactgccaaattttctgtcaggaagtcaccggccggagtgttgtacttgccggctgctgacagccagcggcgctcaggactccctaccctttgggaggagactttactccggaccatggaggtcgtgcgaggaggtttgccacgtctccgtgttgagtgtgctgagcactagctgcggcctaagtttgagcctgccaattttccctggctggatggagtggcttagtcccgacatcgctctcccccgccgcgacgaatggacccagacgagcccagccaggaagaggatcacccacgcaaaggtccagggcgccggtcagctccgcctaagcatcgatgctcaggacagggtcctgctactgcatataatcgagggcaagggtctcatttccaagcagcccggtacatgcgacccttatgtcaagatctccctcatccctgaagatagtcgactgaggcatcaaaagacacagacggtaccagattgcagggatccggcctttcacgagcattttttcttcccagtccaagaagaagatgatcagaaaagactgctggtgactgtttggaatcgtgctagtcagtctcggcagtctggattgattggatgcatgagttttggcgtgaagtccctgctgactcccgataaggaaatctcaggttggtactatttgctgggggagcatctggggagaacaaagcaccttaaggtcgcgaggcgaagattgcggccactacgggaccccctgttacgtatgcctggaggtggggacactgagaatggaaagaaactcaagatcacgattcccaggggaaaagatgggtttgggtttacaatctgctgtgactcacccgtgcgtgtccaggccgtggactctggaggccccgccgagcgagctgggctgcaacagctcgacacggtgctgcagctgaacgaacgccccgttgaacactggaaatgcgtggagctggctcatgagattcggtcctgcccaagtgagattatcctgcttgtgtggcggatggtaccacaggttaagccaggacccgacgggggcgtactgcgccgagccagttgcaagagcacacatgacctgcagtctccccccaacaagcgtgagaaaaactgtacacacggggtgcaggctcgccctgagcagcgccactcgtgtcatctggtgtgtgattccagtgatggacttctcctgggaggatgggagcgctacactgaagtggccaagcggggagggcagcatacgctcccagcacttagcagagccactgcacctaccgaccccaattacatcatcttagctccactgaatcccggctcccagcttctgcggccagtatatcaagaggacacgattcccgaagaatcaggaagccccagcaaaggcaaatcctatacaggactcggtaagaaatcccgcctaatgaagacagttcagacaatgaaaggtcatggcaactaccagaactgcccagttgtgcggccacacgctacacacagctcatacgggacatacgtaacacttgcacccaaagtgttggtgtttcccgtgttcgtacagccactcgatctgtgcaacccagctcgtacactgctgttgtcagaagaactgctgctgtacgagggtagaaacaaagccgccgaagttaccttattcgcttattccgacctcctgctcttcactaaagaggacgagcccggcagatgcgacgtgttgaggaacccactgtacctccagagcgttaaattacaggagggatcaagtgaggatttaaagttttgtgttctgtatctagccgagaaggctgagtgcctgttcacccttgaggcacattcccaggaacaaaagaagagagtttgttggtgtctgagcgaaaatatcgcaaaacagcagcagctagctgcatcacctcccgacagcaagatgttcgagacagaggccgacgaaaagagggaaatggcgctcgaagaggggaaggggcctggcgctgaggactctcctccgtctaaagagcccagccctgggcaagagctcccacccggacaggacttgcccccaaacaaagactcgccaagtggccaggagccagcaccgtctcaggagcctttatcgtccaaagatagcgcgacttccgagggctccccaccggggccagatgctccaccctccaaagatgtgcctccttgccaggaaccaccgcccgcacaggacctttctccctgtcaagatcttcctgcgggtcaggagccattgccccatcaggatcccttactcaccaaagacctccccgcaatccaagaatcccccacgagggatctccctccttgccaagacttacccccttctcaggtatccctcccggccaaagcgcttaccgaggatacaatgagctccggagacctgctggctgccactggagaccctcctgccgcccccagaccagcttttgtgatcccagaagttaggttggattccacttactctcagaaggctggtgcagagcaggggtgtagtggagatgaggaggatgccgaagaggctgaggaggtggaagaaggggaggagggtgaggaagacgaggacgaggacacatctgatgacaactatggcgagcggagcgaagccaaacgttcctctatgattgagaccggtcaaggtgctgagggcgggctctcccttagagtgcagaattcactgaggcgccgaacacactcagaggggagcctcctccaggaacctcggggtccttgtttcgctagcgacacgacactgcactgtagcgatggagagggcgccgcctccacctggggaatgccgagcccctcgaccttgaaaaaggagctgggcagaaacgggggctcaatgcatcacttgtcactattcttcaccggccaccgcaaaatgtccggggccgacaccgtgggcgatgacgatgaagcgtctcggaagcgcaaatctaaaaatttagcaaaagacatgaaaaacaaattagggatcttcaggaggagaaatgaatcccccggagcacctcccgccgggaaggcagataagatgatgaagtcattcaaacccacttcagaagaggctctcaagtggggcgaatcgctggagaagctcctcgtgcacaaatatggtctggcagttttccaggcctttctgcggacagaattctcagaagagaacctcgaattctggctggcgtgcgaggatttcaagaaggtgaagagccagagcaaaatggcctcgaaagccaagaaaatcttcgccgaatatatcgcgatccaagcatgcaaagaggtgaacctagatagttacacccgcgagcacacaaaggataacttacagagcgtcacacgcgggtgtttcgacttggcacagaagagaatcttcggtctcatggagaaagactcatacccaaggtttttacgctccgacttgtatctggatctcattaaccaaaagaaaatgagtcctccactgtag

SEQ ID NO: 202868 - DNA, 1776 bp, Artificial Sequence
  Description of Artificial Sequence: Synthetic coding sequence
atgaaccggttcaacggcctgtgcaaggtgtgcagcgagcggcggtataggcagatcactattcctaggggcaaagacgggtttggttttaccatttgctgcgactcgcctgtgcgagtgcaggccgtggacagtgggggtcctgctgagcgtgccggattacagcaactggacacagttctacagctcaatgagcggccagttgaacattggaagtgcgttgaactggctcacgaaatacggtcgtgccctagcgagatcatccttcttgtctggaggatggttccgcaggtgaaaccaggacccgacggtggtgttctgaggcgggcatcatgtaaatccactcacgacctgcagtcacctccaaataaacgcgagaaaaattgcacacacggagttcaggcacgacccgaacagagacatagctgtcatctggtatgtgactcttccgatggcctacttctgggcggttgggagagatacaccgaagttgcaaaaaggggtggtcagcatacacttccggccttgagtcgtgccacagcccccaccgatccaaactacataatcctggcaccgctgaacccagggtctcagcttctgaggccagtatatcaggaagacaccatcccagaagaatcagggagccctagcaagggcaagagctatactggcctgggcaaaaaaagccgcctgatgaagaccgtgcagaccatgaagggacacgggaactaccagaactgccctgtggtgaggccccacgcaacccacagcagttacggcacatacgttacgttggcccccaaggttcttgttttcccagtgtttgtccagccgctcgacctctgcaatccagcccggaccttgttactgtccgaggaactgttgctgtacgaggggcggaacaaggccgccgaagtcactctgttcgcctatagtgacctgctgctgttcacgaaagaagacgagccagggcggtgcgacgtacttagaaatccgctgtatctacagagtgttaagctgcaggaaggctcttctgaagatctaaaattctgtgtgttatacttagctgagaaggctgagtgtctgtttaccctggaagcacactcccaagagcagaagaagagggtttgttggtgcttgtccgaaaatattgcaaaacaacagcagctagctgctagccccccagattccaaaatgagtggagctgacaccgttggtgacgacgatgaggcctcacggaagcggaagtcaaagaatctggccaaggatatgaaaaataaactgggcattttcagaagaagaaacgaaagcccaggagcccctccagctgggaaggcggataagatgatgaaatcgttcaagcccacaagtgaggaggctttgaaatggggagagagcctagagaagctcttggtccacaaatacggccttgccgtcttccaggcatttctcaggacagagttctctgaggagaacctggagttctggctggcatgcgaagacttcaaaaaagtgaagagccagagcaagatggcctcgaaggctaaaaagattttcgccgaatatatagctatacaggcttgcaaggaggtgaacctcgatagctatacgcgcgagcacactaaagacaaccttcagtccgtgacccgggggtgttttgatctggcccagaaacggatttttgggctgatggagaaagacagctaccccagatttctgcggtcggacctgtacctcgacctcattaatcagaagaagatgagtcctcccctctag

SEQ ID NO: 202869 - DNA, 1560 bp, Artificial Sequence
  Description of Artificial Sequence: Synthetic coding sequence
atgttcgagaccgaggccgacgagaagcgggagatggccctggaggaagggaagggacctggagcggaagattctccccctagtaaggagcctagccctggacaggagctgcccccaggccaagacctgccccctaacaaagattctccatctgggcaggaacccgctccgtcgcaagaacctctttcctccaaagattctgcaacctcggaggggtctccacctggccctgatgctcccccctccaaagatgtcccgccctgtcaggagccccctcctgctcaggatctgtccccctgccaagatctgcctgctggtcaggagcccctgcctcaccaggaccccttactgactaaggacttgccggctattcaagagtcccccaccagagatctccctccctgccaggatctgcctcccagccaggtcagtctacccgcaaaggcactgactgaagatacaatgagctctggagatctgctggctgccacaggtgaccctcccgcagcccctaggccagcgtttgtgattcctgaagtgcgactggactctacttactcccagaaggcgggcgcggaacagggttgctccggagatgaagaggatgccgaagaggccgaggaagttgaggagggtgaggagggggaggaggacgaggatgaggacacaagcgatgataactacggggaacgaagtgaggccaagagatcgagtatgatcgagacaggccagggggctgaggggggcctcagcttgcgggtgcagaattcccttcggcgtcgaacccactccgaaggttccctgctccaagagcccagaggtccttgcttcgcgagcgatacgacactgcactgttccgatggagagggcgccgcctcaacatggggtatgcctagcccatccacattgaagaaggagttagggcgcaacggggggtctatgcaccacctgagcttgttctttacaggccaccggaagatgagcggggccgacactgtgggcgatgacgacgaggcctctcggaaacgcaaatctaagaacttggcaaaggatatgaagaacaaactgggcatttttagacggaggaacgagagccccggtgccccgcctgcaggcaaagctgataagatgatgaagagcttcaagccaactagtgaggaggccctaaaatggggcgagtcactcgaaaaactgctggttcacaaatatgggctggctgtgtttcaagcatttctccgaactgagttcagcgaagagaatctcgagttttggttggcctgcgaggattttaagaaagtgaaatcccagagtaaaatggcttcaaaagcaaaaaaaatattcgctgaatatatcgccatacaggcatgtaaagaagttaacctggacagctatacccgagagcacactaaggataatctgcagtcggtaacaagaggttgcttcgacctggcacagaaacgcatcttcggccttatggaaaaagattcgtatcctagatttctgaggtccgacctatacctggacctcattaaccagaagaagatgtcacctcctctgtag

SEQ ID NO: 202870 - DNA, 936 bp, Artificial Sequence
  Description of Artificial Sequence: Synthetic coding sequence
atggtgacccggcggcccgtgaccaacagctgggactggctgcccgccggagcagctccagaggccgtgccctgtcgccacatgccgctgagcaggctgccactgcgagtaggacagaaggagttcttctttccattaccgctgctggtgccccccatttcatggctgcttctcagtgagtcacagcccagactggtgccaggttccccagtgatccggccaggctttcagcgggcctgtgtagcagcggcctgcactgtcgccgccagatgccccgggcgcggcgtgggtgatagaagtcagagtggggcctcctaccgccctatttgcggacccaaggtgggggggcctactgagatgctacgcggcatgtatctcacacgtaacggcaatctacagcgcagacacacgatgaaggaggcaaaggatatgaagaataagttagggatctttcgtcgcagaaatgagtcccccggagctccaccagccgggaaagcagacaaaatgatgaaatcctttaagccaacatcggaagaggccctaaaatggggagagagcctcgagaaactcctggttcacaagtacggtctggcagtgttccaggcatttctgaggaccgaattcagtgaggagaatttggagttctggctggcatgtgaggattttaaaaaagttaagtctcagtcgaagatggcctctaaggccaagaaaattttcgccgagtatatcgcaatccaggcttgcaaggaggtgaatctggattcttataccagagagcatactaaggataacctgcaaagcgtgacaaggggatgctttgacttggcgcagaaacgaatctttgggctgatggagaaggacagttatccccggtttctgcggagtgatttatacctggatctgattaaccagaaaaaaatgtctcccccactttag

SEQ ID NO: 202871 - DNA, 564 bp, Artificial Sequence
  Description of Artificial Sequence: Synthetic coding sequence
atgaagcaccggctgggcttcctgctgcagaagagcgacagctgcgagcacaattcttctcacaacaagaaagacaaggtggtgatttgccagcgcgtcagtcaggaggaggtcaaaaagtgggcggaatcgctggagaaccttatctcccacgaatgcggattggcagctttcaaagcattcttgaagtccgagtactcagaggagaacattgatttctggatctcatgcgaagagtacaagaaaatcaagagcccctcaaagcttagccccaaagctaaaaagatttataatgagtttatcagtgtgcaggcaaccaaggaggtcaatctcgacagctgcaccagggaagaaactagtcgaaatatgttggaaccaacaataacatgtttcgacgaagcccagaagaagatattcaatctgatggaaaaggactcatataggcgctttttgaagtcccggttctacctggatcttgtgaatccctcctcatgtggcgccgagaagcagaagggggctaagagctccgccgattgcgcgtctctcgtaccccagtgcgcctag

SEQ ID NO: 202872 - DNA, 282 bp, Artificial Sequence
  Description of Artificial Sequence: Synthetic coding sequence
atgtgcaagggcctggccggcctgcccgccagctgcctgcggagcgccaaagatatgaagcaccggctgggatttctgctgcagaaaagtgactcctgcgagcacaatagtagccataacaagaaggacaaggtcgttatctgccagcgtgtctctcaggaagaagtgaaaaagtgggctgaatccctggaaaacctaattagccacgagtgtgagcccgggttcctgcatcagggccgcgataagccagaacatgcaagggcatataacaatctgttgtag

SEQ ID NO: 202873 - DNA, 618 bp, Artificial Sequence
  Description of Artificial Sequence: Synthetic coding sequence
atgtgcaagggcctggccggcctgcccgccagctgcctgcggagcgccaaggatatgaagcacagactgggctttctgctgcaaaaaagcgattcctgcgagcacaattctagccacaataagaaggataaggtagtgatttgccagagagtcagccaggaagaagtgaaaaagtgggcagaaagcttggagaacctgattagccacgagtgcgggctggcagctttcaaggcattccttaaatcagagtacagcgaggaaaacatcgatttttggatcagctgtgaggagtacaagaagatcaagtccccctcaaaactctctccaaaggcgaagaagatttacaacgagtttatctctgtgcaggcgacaaaggaggtcaacctcgattcctgtacgagagaggagacctcacgcaatatgcttgagccaactattacgtgtttcgacgaggcccagaaaaaaattttcaacctgatggagaaggatagttatagacgcttcttgaaatctcgattctatctggacttggtgaacccatcttcgtgtggcgcagagaaacaaaagggagcgaagtcctccgccgattgtgcaagcctggtgcctcagtgtgcctag

SEQ ID NO: 202874 - DNA, 909 bp, Artificial Sequence
  Description of Artificial Sequence: Synthetic coding sequence
atgtacaacatgatgctgctgatccagaagcggaagggcatcggcagccagctcctgcgcgctggagaggcagaaggggaccgcggtgccggcacagccgaacgaagttctgattggcttgatggcaggtcctgggcgatcaaggaaaccccaacaggtctcgccggaagacggagtgaggactcggataatattttcactggcgaggaagctaagtacgcgcagtcacggtctcacagcagttcttgtaggatcagctttttactggccaacagtaagttgctaaataaaatgtgtaagggacttgctggactcccagctagttgcctaaggagtgccaaggatatgaagcaccgcttgggttttctgctacagaaatctgattcctgcgaacataactcaagtcacaacaagaaggacaaggtggtcatttgtcagagggtcagccaggaggaggtcaagaaatgggctgaatccctcgagaacctcatctcccacgagtgtggactcgccgctttcaaagcattccttaagagcgagtatagcgaggagaacattgatttttggattagctgcgaggagtataaaaaaataaagtccccgagcaagttgtcacccaaggccaaaaagatctacaatgagttcataagtgtgcaggcaacaaaggaggtgaacctcgactcttgcacacgggaggaaacatctaggaacatgctggagcctactatcacctgcttcgatgaggctcagaaaaagattttcaaccttatggagaaggactcttaccggaggttcctgaaaagtcgcttctaccttgatctagtgaatccatcttcttgcggtgctgaaaaacaaaagggggccaagtccagcgccgactgcgctagcctggtgccccagtgtgcgtag

SEQ ID NO: 202875 - DNA, 564 bp, Artificial Sequence
  Description of Artificial Sequence: Synthetic coding sequence
atgaagcaccggctgggcttcctgctgcagaagagcgacagctgcgagcacaatagcagccacaacaaaaaggataaggtggtcatatgccagcgcgtctcccaggaggaagtcaagaagtgggccgaaagtctagagaacctgatctctcatgaatgcggcctggctgcttttaaggctttccttaagtccgagtactctgaggagaacatcgacttctggatctcatgtgaagaatacaaaaaaataaagtcccctagcaagctttccccaaaggcaaaaaagatctacaacgaattcataagtgttcaggccaccaaagaggtgaatctagacagctgtacgcgggaggaaacatcacggaacatgctggagcctacaatcacttgcttcgatgaggctcaaaagaaaatctttaacctcatggaaaaggatagttatcgaagattcctcaaaagtcgattttatttggatctcgtgaaccccagttcctgcggcgccgaaaagcaaaagggggccaaatcatctgcggattgcgccagcctggtacctcagtgtgcatag

SEQ ID NO: 202876 - DNA, 432 bp, Artificial Sequence
  Description of Artificial Sequence: Synthetic coding sequence
atgaagcaccggctgggcttcctgctgcagaagagcgacagctgcgaacacaattctagccacaacaaaaaggacaaggtggttatttgtcaacgagtgtcccaggaagaggtgaagaaatgggccgagtccctggagaatctgatttcccacgagtgtggtctggcagcttttaaagcgttcctcaaaagcgagtatagtgaggaaaatatcgatttttggattagctgtgaggagtataagaagataaagagcccctcgaagctttcgcccaaagctaaaaagatctacaacgagttcattagcgtccaagccaccaaagaagttaatctggactcctgcaccagggaagagacctctagaaacatgctggaaccaacgattacttgctttgacgaggctcagaaaaagatattcaatctgatggagtag

SEQ ID NO: 202877 - DNA, 546 bp, Artificial Sequence
  Description of Artificial Sequence: Synthetic coding sequence
atgtgcaagggcctggccgccctgccccacagctgcctggagcgggccaaagagattaagatcaagttagggattttactccagaaacctgactccgtcggcgatctggtgatcccttataacgagaaacccgagaaacccgcaaagactcagaagacctcactggacgaggccttgcagtggcgggatagcttggacaaacttctgcaaaacaactacggattggccagcttcaagtcatttctgaagtcggaattttctgaggaaaatctggagttttggatagcatgcgaagactacaagaaaataaagtcaccggctaagatggccgagaaagcaaagcagatttatgaggaattcattcagactgaagcccccaaggaagtgaatatcgaccactttactaaagatatcacaatgaagaaccttgttgaaccaagcctctctagcttcgatatggcacagaagcgcatccatgccctaatggaaaaagacagcctccctcgatttgttcgctctgagttctatcaggagctgataaaatag

SEQ ID NO: 202878 - DNA, 606 bp, Artificial Sequence
  Description of Artificial Sequence: Synthetic coding sequence
atgtgcgcccggaacatcagccaggacatcctgatcctgcagatgcattccgcccattggcacatcaacggaaagtatgaagaaaaatccaacctgatgttttgggcgaaggaaatcaaaattaaactggggattttgctgcagaaacccgattccgtgggcgacctggtgattccttataatgaaaaacccgagaagccggctaagactcagaagacaagtctcgacgaggcactacagtggcgcgacagcctggacaagctactgcagaataattacggactggcatctttcaagagcttcttaaagagcgaatttagcgaagagaaccttgaattttggattgcctgtgaagattataagaagatcaaaagcccagcgaaaatggcagaaaaagccaagcaaatatacgaggagttcattcaaaccgaagcccccaaagaggtgaacattgatcacttcacaaaagacataacaatgaaaaatctcgttgagccttctctgtcaagctttgatatggcacaaaaaaggatacacgccctgatggagaaagactctttgcccagattcgtgcgttctgagttctaccaagaactgatcaagtag

SEQ ID NO: 202879 - DNA, 222 bp, Artificial Sequence
  Description of Artificial Sequence: Synthetic coding sequence
atggccgagaaggccaagcagatctacgaggagttcatccagaccgaggccccgaaggaggtgaacatagaccactttaccaaggatattactatgaagaaccttgtcgagccctccctgtcgtcatttgacatggcgcagaagcgcatccatgccttaatggaaaaggattcactgccaaggttcgtgagaagtgaattctatcaggagttgataaagtag

SEQ ID NO: 202880 - DNA, 1362 bp, Artificial Sequence
  Description of Artificial Sequence: Synthetic coding sequence
atggcccagggcagcggcgaccagcgggccgtgggcgtggccgaccctgaggagtcaagtccaaacatgatcgtgtactgtaaaattgaagatatcatcactaaaatgcaggatgacaagacgggaggcgtaccaattcgtactgtaaaatcattcttaagcaagatcccttcagtagtaactggtacagatattgtgcaatggctgatgaagaacctttccatcgaagatccagtagaggcaatacacctgggtagcctcatcgcagcacagggatatatattcccaatttcagaccacgtcctgacaatgaaagatgacgggacattttatcgctttcaggccccttatttttggccttctaactgttgggaacccgagaacaccgactacgccatctacttgtgtaagcgtaccatgcaaaataaggcaaggttagagctagcggattacgaagccgaaaatcttgccagactgcagcgggcattcgctcgaaagtgggagttcatattcatgcaggccgaagcgcaggtcaaaatcgacagaaagaaggacaaaacagaaaggaaaattctggactcccaggaacgggcattttgggatgtacatcggccggtccctgggtgcgtaaataccaccgaaatggacattagaaaatgcaggcgactcaagaaccctcagaaagtgaagaaatcagtctacggagtgactgaggaaagccaggcccagagccctgtccatgtgctatcacagccaattagaaagaccacgaaagaggatatccgcaagcagattaccttcctgaatgctcagatcgacagacactgcctgaaaatgtcaaaggttgctgaatctaaagagccttcacagcaacgagtcaaaaggtggggatttagtttcgatgaaatactcaaggatcaggtcgggagggaccaatttcttagatttttggagagtgaattttcctcagaaaacctcaggttctggttggccgttcaggatctcaagaaacagccactgcaggacgtcgccaaacgggtggaagagatctggcaggagtttcttgcccccggggcacccagtgcaattaaccttgactctcactcatacgagatcacttcacagaacgtgaaggatggggggagatatacattcgaggatgcccaggagcatatatacaaactgatgaagtctgattcctatgcccgcttccttaggtcgaatgcttaccaggatctactgttagctaaaaagaaaccagagtcagaacaaggaaggcgcacaagtttggaaaagtttacacgcagcgtggggaaaagcttggccggaaaaaggttgaccggcctgatgcagtcaagctag

SEQ ID NO: 202881 - DNA, 1383 bp, Artificial Sequence
  Description of Artificial Sequence: Synthetic coding sequence
atggcccagggcagcggcgaccagcgggccgtgggcgtggccgaccccgaagagtccagccccaacatgatcgtgtattgcaaaatcgaagatatcataacaaaaatgcaggacgataagaccggtggtgtgcccattagaaccgttaagagtttcttaagtaagattcctagtgttgttactggaaccgatatcgttcagtggctgatgaaaaacctgtctatcgaagatcccgtggaggctatacatctgggatctttgatcgcagcccaggggtatatttttccgattagcgaccatgttctgacaatgaaggacgatggaacgttctacaggtttcaggccccatacttttggccaagtaactgttgggaacccgaaaacactgactatgctatctacctgtgcaaacggactatgcagaacaaagctcgactggagcttgcagactatgaggccgaaaacctcgccaggctccagcgggcgttcgccaggaaatgggagtttatcttcatgcaggcagaagcccaggtgaagatcgaccgaaaaaaagacaaaacagaacgcaaaatcctggactcacaggagcgggcattctgggacgtgcataggccagtcccagggtgtgtgaacacgacggagatggacattagaaagtgtcgccgactaaagaaccctcagaaagtcaagaaaagcgtgtatggcgtgaccgaggagagtcaggctcagtctcctgtgcacgttctaagtcagcccattcgaaaaacaaccaaagaggatatccgtaaacagatcactttcctaaatgcccagattgacagacactgtctcaaaatgagcaaggtcgccgaatccttaatcgcctatactgagcagtatgtcgagtacgaccctctgattacacctgctgaacccagcaacccctggatatccgatgacgtggcgctgtgggatatcgaaatgagtaaggagcctagccagcaacgcgtgaaacggtggggattctctttcgacgagatcttgaaagaccaggtaggacgggatcagtttttacgtttcttagagagtgaattttcaagcgagaacttgcgcttttggctggccgttcaagacctgaaaaagcagcccttacaggatgttgcaaagcgggttgaggaaatatggcaagagtttctggcgccaggcgcaccatctgccattaacctcgatagtcactcgtacgagataacgagccagaacgtaaaagatggagggagatataccttcgaggatgcacaggaacatatttataagctgatgaaaagtgactcttatgcaaggttcttgcggagcaacgcatatcaagatttgcttctggcaaagaaaaaggtgtggctcttgtag

SEQ ID NO: 202882 - DNA, 1419 bp, Artificial Sequence
  Description of Artificial Sequence: Synthetic coding sequence
atggcccagggcagcggcgaccagcgggccgtgggcgtggccgacccagaggagtcgtctcccaacatgatagtctactgtaagatcgaggatattatcaccaaaatgcaagacgacaagacaggaggcgtgcccatccgcacggtcaagtcctttctaagtaaaattcctagtgtggtgacagggaccgatattgtacaatggctgatgaaaaaccttagcatcgaggaccccgttgaggctatccacttagggagcctcattgcggcccagggctacatcttcccaattagcgatcacgttctcactatgaaggatgacggaacattttaccggttccaggcgccctatttctggccatccaactgctgggaaccagaaaacaccgattatgccatctatctgtgcaaacgcactatgcagaataaggcccgcctcgaattggcggattacgaagctgagaatttggcccgcctccaaagagcctttgccagaaaatgggagttcatcttcatgcaggcagaggctcaggtgaagatcgaccgtaaaaaggacaaaaccgagaggaaaattcttgactcacaggagagagccttttgggacgtgcaccgcccagtgcccggctgcgttaacaccactgagatggacattaggaaatgccgccgtttgaaaaatccacagaaggtcaaaaaaagcgtttatggtgtcactgaagagtcgcaggcacaatcacccgtgcacgttctctcccagccaattagaaaaacaactaaggaggacatacggaagcaaattacatttctaaacgcgcagattgacaggcattgtctgaagatgtccaaagttgctgagtccttgattgcctacaccgaacagtacgtcgagtatgatcctctcatcaccccagcggagccaagcaacccctggatcagtgacgatgtagccctttgggacattgaaatgtctaaggaaccgtcacagcaacgagtgaaacgttggggattctcctttgatgaaatcctgaaagaccaagttggaagagatcagttcctaaggtttcttgagtccgagttctcatcagagaaccttaggttttggctagctgtgcaggatctaaagaagcagcctttgcaggacgttgccaagagggtggaggaaatttggcaggagtttttagccccaggcgcccctagtgcgatcaatctggactctcatagttacgaaatcacgtcacaaaacgtcaaagatgggggcaggtacacattcgaggacgctcaggaacatatctacaaactgatgaagagcgattcatacgcaagattcctgagaagtaacgcttaccaggacctcctgctggccaagaaaaaaggaaagagcttagccggaaaacgcttgacaggcttgatgcagtcctcgtag

SEQ ID NO: 202883 - DNA, 1443 bp, Artificial Sequence
  Description of Artificial Sequence: Synthetic coding sequence
atggcccagggcagcggcgaccagcgggccgtgggcgtggccgacccagaagagtcttcaccaaatatgatcgtttattgtaagatcgaggacattatcacaaaaatgcaagatgacaagactgggggtgtgcctatcagaaccgtgaagtcgttcctgagcaagataccatcagttgttactgggacagatatcgtccagtggctgatgaagaacttgtctatcgaggacccggtcgaagccatccacctggggagcctgatcgccgcacagggatacatctttcctatttcagatcacgtgctgacgatgaaggatgacggcacattctaccgcttccaagcgccatacttctggccctctaattgctgggagccagaaaatactgattatgccatttatctttgcaaaaggaccatgcaaaataaggcaaggttagagctcgccgactacgaggctgaaaatcttgctcggctgcagagagcttttgcccggaaatgggagttcatctttatgcaggctgaagcccaggtgaagatcgatagaaaaaaagataaaacagaacggaagattttggattctcaggagcgtgccttctgggacgttcatagaccagttccaggttgtgtcaataccaccgagatggacatacgtaagtgtcggaggctgaagaacccccaaaaagtgaagaagagtgtttacggcgtaaccgaggaatcacaagcacagtccccagtacacgtgctttcccaacctattcgcaaaaccacgaaggaagatatacgtaaacagatcacatttctgaacgcccagattgaccggcactgcctcaaaatgagcaaagtcgcagaatccttgatagcgtatactgaacagtacgtcgagtatgacccacttattaccccagctgaacctagcaacccctggatctctgatgacgtagccctgtgggacatcgaaatgtcaaaggagccatctcaacagcgcgtgaaaaggtgggggtttagctttgacgaaatcctcaaagatcaggtgggacgcgatcagttcttgcgattcttggagtcagagttttcatctgaaaatcttaggttctggctagcggtacaggatctgaaaaaacagcctctgcaggacgtagccaagagggtggaggaaatttggcaggaattccttgctcctggggcaccttcagcaattaaccttgattcacattcctacgagattaccagtcagaacgtgaaagatgggggcaggtacacttttgaagatgcgcaggagcatatatacaaactgatgaagtccgactcttacgcccgcttcttgcgctccaacgcttatcaggatctcctccttgccaagaagaaaccggagagcgaacagggacgccgcacctccttggagaagtttactaggtccgtctgcctgcagttgctgttctag

SEQ ID NO: 202884 - DNA, 1428 bp, Artificial Sequence
  Description of Artificial Sequence: Synthetic coding sequence
atggcccagggcagcggcgaccagcgggccgtgggcgtggccgacccagaggagtcaagtcccaatatgattgtctactgtaagatagaagatatcatcactaagatgcaggatgataaaactggtggcgtgcccatccgcaccgtgaaaagtttcctcagcaagatcccctcagtcgtgaccggtaccgacattgtgcaatggttgatgaaaaatctaagtatagaagaccccgtcgaagccattcatctcggcagcctgatcgccgctcaggggtatattttccctattagcgatcatgttctgacaatgaaggacgacggtactttttacaggttccaggctccatatttctggcctagcaattgctgggagccagagaacaccgactacgctatttacctttgtaagcgcacaatgcagaacaaagctcgtctagagttggccgactacgaggccgaaaaccttgctagacttcaaagggcgttcgctcgtaaatgggaattcatttttatgcaagccgaagcgcaagttaagattgatcggaagaaggacaaaacagagcggaagatcctcgacagccaggagagggcgttctgggacgtgcataggccagtgccagggtgtgttaacactaccgagatggacatccggaagtgtaggcggctcaagaatccgcagaaggtaaagaaatccgtgtacggagtgaccgaagaaagccaagcccagtcccctgtccatgtgctgagccaaccgatccggaagacgacaaaagaggacatcaggaagcagatcacgttccttaacgcccagattgacagacattgcttgaagatgtccaaggtggccgagtcattaattgcttacacagagcagtacgttgaatatgaccccctgattacaccggccgagccgagcaatccttggatttctgatgacgtcgcattgtgggacattgagatgtcgaaggaaccttcacaacaaagagtcaaaagatggggtttctcttttgacgagattttaaaggatcaggttggccgggatcagttcctgcgcttcctggaatcggagttctcatccgagaacctgaggttctggctggcggttcaagacctaaagaaacagccgcttcaggacgtggctaagagagtcgaggaaatttggcaagaatttttggccccaggcgcaccaagcgcgattaacctggatagtcactcatacgagattactagccagaacgtgaaggatggtggacgctacacatttgaagacgcgcaggagcacatctataaactcatgaaaagcgattcatacgcccgtttcttaaggagcaacgcctatcaggaccttctgctggctaagaaaaagcccgagtcagaacaaggccgcagaaccagtctggagaagttcacacgctccgtgggttag

SEQ ID NO: 202885 - DNA, 1434 bp, Artificial Sequence
  Description of Artificial Sequence: Synthetic coding sequence
atggcccagggcagcggcgaccagcgggccgtgggcgtggccgaccctgaggagagttctccgaacatgattgtgtattgcaagatcgaggatatcattaccaagatgcaggatgacaagactggtggtgtgccaatccggacagtaaagtccttcttaagtaagatcccatccgtcgtcaccgggactgacattgtccagtggctgatgaagaatctgagcatcgaggaccctgtcgaagccatccacctagggtccttgattgctgcccaaggatacatctttcccattagcgatcacgttttaacgatgaaggacgacggaaccttttacagattccaagctccgtacttctggccctccaactgctgggagccagagaacactgactatgctatttacctatgcaaacgaaccatgcaaaacaaagctagactggagttagccgattatgaagcggagaacctggcaaggctccagagagcatttgctcggaaatgggaatttatctttatgcaggccgaggcgcaagtgaagatcgatcggaaaaaggacaaaacagagaggaaaatacttgacagccaggagagagccttttgggatgtccaccgcccagtcccggggtgcgtcaatacaacagaaatggacattcgaaagtgcagacggttgaaaaatcctcagaaggttaaaaagagcgtgtacggtgtcactgaggaatcccaggctcagtcccccgtgcatgtgttaagtcagcctatcaggaaaacaacaaaggaggacattagaaagcaaatcacattccttaatgctcaaattgatcgccactgtttaaagatgagtaaggtcgctgagtcccttatcgcctacactgaacaatacgtggagtacgacccacttattactcctgccgaaccaagtaacccctggatcagcgatgacgtcgcattatgggatattgagatgtctaaagaacctagtcaacagcgcgtgaaacgatggggattttcttttgacgaaatcttgaaggatcaggtgggaagagaccagttcttgagattcttagaatctgaattcagctccgaaaacctgagattctggctggcggttcaggatttgaagaagcaaccactgcaggacgtcgctaagcgcgtcgaagagatatggcaggagttcttagccccgggggccccaagtgcaatcaatctggacagtcacagctatgagatcacttcacagaacgtcaaggacggaggacggtacacttttgaagacgcgcaggagcacatttataagctcatgaagtccgactcttacgctaggttcttgcgtagtaacgcatatcaagatctgcttttggcaaaaaagaagcctgaaagcgagcagggtcgacgtacttctctcgagaagtttacaaggagcgtccttttgttctag

SEQ ID NO: 202886 - DNA, 1620 bp, Artificial Sequence
  Description of Artificial Sequence: Synthetic coding sequence
atgaagaacctgagcatcgaggaccccgtggaggccatccacctggggtctctcatcgcagctcaaggatacattttccctattagcgatcacgtgctgaccatgaaggatgacggcaccttttatcggttccaagcaccctacttctggccctcgaattgttgggagccagagaatacagattacgcgatatacctgtgtaagcgcacgatgcaaaacaaggccagactggaactggctgactacgaggccgagaaccttgcccggctgcaacgcgccttcgcccgcaaatgggaatttatttttatgcaggctgaagcccaggtcaagatcgataggaagaaggataagaccgagcgaaagatcctggatagccaagaacgggccttttgggacgtgcatcgtcccgttcccggctgcgtaaatacgaccgagatggacattcgtaaatgtcgcaggctgaaaaacccccagaaagtgaaaaaatctgtttatggtgttactgaggagagccaggcacaatcccctgttcatgtgctgtctcagcctattcggaagacaactaaggaggacatcaggaaacagatcacattcttgaatgcgcaaatcgaccggcattgcttgaagatgagcaaagttgcagaatccttgattgcatatactgaacaatacgtcgaatatgaccccctgattactcctgcagagccgtctaacccatggattagcgatgacgtggccctctgggatatcgagatgtcaaaagaacccagccagcaacgcgtaaagaggtggggcttctcctttgatgaaatcctgaaggatcaggtgggcagggatcagttcctccggtttttggaaagcgagtttagcagcgaaaatttgaggttttggcttgctgtacaagatctgaagaagcagcctctacaggacgtggccaaaagagtcgaagaaatttggcaagagtttcttgctccgggcgcaccatctgcaatcaacctcgattctcactcctacgaaataacttcacaaaatgtgaaggacggcggccgttacacttttgaggatgcccaagagcacatttacaagctcatgaaatccgattcttatgcaaggtttctgcgctccaatgcctaccaggacctgttgcttgccaagaagaagccagaatcagagcaaggccggcgcacatcactcgaaaaatttacccggagcgttaacgtccagaatactcggcccgccggggcatggtctatctttatggcagctctccccatggcagtttggctgcgcacacctcgaagttgtcacggtctgagtgagtcacgcttgcttggactcccatcattacacgatggtttacgggaaggccagagtctgcctcaaagttgtcccgggagcagctctacagcagcagagggcgctagggagagagcatcaaacggcagaagtctcgctcgccgacagcactgtcagtgccacggccagggcgaggagactcagttatgtctctggtccagattggagtcctccaaaagatcccaacgtgcgagctccctccgaacaagtaaggccaagaaaaagcggcaaaccgtcaagcaaggccccaaggcgtggccctag

SEQ ID NO: 202887 - DNA, 1299 bp, Artificial Sequence
  Description of Artificial Sequence: Synthetic coding sequence
atcgaggacatcatcaccaagatgcaggacgacaagaccggcggcgtgcctattcggactgtgaagtcttttttgtctaaaatcccgagtgtcgttacaggtaccgacatcgtccagtggctgatgaagaatctgtctatcgaggacccagttgaagctatacacttgggatccctgatcgcagcccagggctacatttttccaatcagcgaccacgtcttgacaatgaaggatgatggcaccttctacagatttcaggcaccctatttctggccctcaaactgctgggaacctgagaatacagattacgctatatacctgtgtaaacggaccatgcagaacaaggctcggctggaacttgcggactacgaggccgaaaatcttgcacgcctgcagagagcttttgccagaaaatgggaatttatcttcatgcaagcagaggcccaggtgaagatcgatcgcaagaaagacaaaactgagcgaaagattttagattcacaagagcgggcattctgggacgtgcaccgtcccgtgcctgggtgcgtcaacacgacggagatggacatacgaaagtgtcggcggttgaagaacccgcagaaagtgaaaaaaagcgtatacggagtcacagaagagtctcaggctcagagtccggtgcatgtcctttctcagccgattcggaaaacaacaaaggaagacattcgcaagcagatcaccttcctgaacgctcagattgataggcactgcctgaagatgagcaaagtggcagagagtctgatagcttacactgagcaatacgtcgagtatgacccgttaatcacccctgcggagccctccaatccatggatctctgatgatgtagcactgtgggacatagaaatgagcaaggaacctagccagcaacgtgttaaaagatgggggttttccttcgacgaaatacttaaggaccaggtgggaagggaccagtttctacgttttttggaatctgagttctcctctgaaaacctgcgcttctggctggctgtccaagatcttaaaaaacagcccctccaggacgtcgccaagcgcgtcgaggagatttggcaggagttcctggcgcccggtgccccttcagccatcaatttggacagccacagttacgaaatcactagtcagaacgtaaaggacggcgggagatatacctttgaagacgcacaggagcatatttacaagctgatgaaaagcgacagctacgcccggttcttacggtccaatgcatatcaggatttactgctagccaagaaaaaagtttggcttttatag

SEQ ID NO: 202888 - DNA, 1041 bp, Artificial Sequence
  Description of Artificial Sequence: Synthetic coding sequence
atgcagaacaaggcccggctggagctggccgactacgaggccgagaacctcgcccgcctgcagcgcgctttcgctcgcaagtgggagttcatcttcatgcaggccgaggctcaggttaaaatcgataggaaaaaagataaaactgaacgaaaaatcttggactcgcaagaacgagccttttgggacgtgcataggcctgtccctgggtgcgtgaatacaacagaaatggatattcgaaagtgtcgccggctgaagaaccctcagaaagtgaaaaagagcgtatacggggtcacagaggaatcccaagcacaatcccccgtgcacgtgctgtctcagcctattcgcaaaaccacaaaagaagacatccggaagcaaatcaccttcttgaatgcacaaatcgacaggcactgtctgaagatgtcgaaagtggccgagtccctcatcgcgtacacggagcagtacgttgaatacgatccactaatcacaccagctgaacctagcaatccttggatttctgatgatgtagctttatgggatatagagatgtcaaaagagccaagccaacagagagtaaaaagatggggttttagcttcgacgaaattctaaaggatcaagtgggcagagaccaatttcttcgctttctggagagcgaattcagttctgagaatctgaggttttggctcgcggtacaagatttaaaaaagcagcccctgcaggacgtggctaagcgagttgaagagatctggcaggagttcctggcgcctggagcacccagcgccattaacctcgacagccattcctatgaaatcacatcacaaaacgtgaaagacggaggccgatatacttttgaggatgcccaagagcatatctataaactgatgaagagcgatagctatgcccgtttcctccgctccaatgcctaccaagacctgctgcttgccaagaaaaaacccgagtctgaacagggccgccgcacctctcttgagaagttcacgcggtccgtcctctggctgctattcccactgggaaaacgaccatag

SEQ ID NO: 202889 - DNA, 1473 bp, Artificial Sequence
  Description of Artificial Sequence: Synthetic coding sequence
atggcccagggcagcggcgaccagcgggccgtgggcgtggccgaccccgaggaatctagcccgaacatgatagtgtattgcaagatcgaggacataatcaccaagatgcaggacgataaaaccggaggtgtgccgattcgcacagtaaagtcctttctaagcaagataccaagcgtggtgacaggcacagacattgtccaatggctgatgaaaaatctgtccattgaagaccccgtggaggcgatccatctggggagcctcatcgccgcccaggggtacattttccccatttccgaccacgtgcttacaatgaaggatgacggtactttctaccgctttcaggccccatacttctggccatctaattgttgggaaccggagaataccgactatgctatctatctgtgtaagaggacaatgcagaataaggcacggctcgagctggctgactacgaggctgagaatctggcccgtctccagagggcctttgcaagaaaatgggagttcatcttcatgcaggccgaggcccaggtcaagattgatcggaagaaggacaaaacagagcggaagattctcgatagtcaggagcgggccttttgggatgtgcatagaccggtccctggctgtgttaatacaaccgagatggacattcgtaagtgccgtagactgaagaatccccagaaagtgaagaaaagtgtgtatggggtgactgaggagagtcaggcgcagtcaccagtgcatgtcctttcccaaccaattcgcaaaacgactaaggaagatatacgcaagcagattactttcctgaacgctcagatcgacagacattgcctcaagatgagtaaggtggcggaaagtctgatcgcttacaccgagcagtatgtcgagtacgatccgcttatcaccccggccgagccatcaaacccctggatttccgacgatgtagctttatgggacatcgagatgtctaaagaaccgtcccagcagcgagttaagagatggggattctcgtttgacgaaatcttgaaggatcaggtggggcgggatcagtttctccgattcctggaaagcgagtttagttctgaaaatctgaggttctggctcgctgtgcaagacttgaagaagcagccactgcaggatgtcgcaaaaagagttgaggagatatggcaggagtttctggcgccgggcgccccgtcagccatcaatctggacagtcattcttatgaaataacctcacagaacgtaaaagatggggggcgctatacttttgaagacgcccaggaacacatatataaacttatgaagtcagacagctacgctcggtttctgagatctaacgcctaccaagacctgctgctagccaaaaaaaagccggaatctgagcagggaagacgcacgagccttgaaaagtttacacggagtgtgggaaaatctctggcgggcaaacggctgacaggactcatgcagagctcatag

SEQ ID NO: 202890 - DNA, 1419 bp, Artificial Sequence
  Description of Artificial Sequence: Synthetic coding sequence
atggcccagggcagcggcgaccagcgggccgtgggcgtggccgacccagaagagtccagtccgaacatgatcgtgtactgcaaaatcgaggatatcatcactaagatgcaggatgataaaactgggggcgttcccattcggacagtcaaatccttcctgtcaaaaattccctccgtggttactggtaccgacatagtccagtggctcatgaaaaacctctctatcgaggacccagtggaagccatccatttgggtagcctaatagccgctcaggggtatatctttcctatcagtgaccatgtgctcactatgaaagatgacggaaccttctataggttccaagcaccctatttctggccctccaattgttgggaacctgagaatacggactatgcaatttacttgtgtaagcggacaatgcagaataaagctcgtctggaactagcagattacgaagctgagaacctggcacgactccagcgcgcatttgcccgtaaatgggagttcatttttatgcaagccgaggctcaagtaaaaattgatcggaagaaggacaagactgaacgcaagattctggacagtcaggaacgtgcattctgggacgtgcacagacctgtccctggctgcgttaatacgacagaaatggacattcgcaagtgccgccggctgaagaatccacagaaggtaaagaagtccgtgtacggtgtgaccgaggaaagtcaggcacagagtcccgtccatgtgctgtcccagccgattcggaagaccactaaggaagacattcgcaagcagataacatttttgaacgcacaaatcgataggcattgcctaaagatgagtaaggtggccgagagtctgattgcgtacactgaacagtatgtagagtacgacccactaataaccccagccgagccaagcaacccttggatttccgacgatgtagccctctgggacatcgagatgagtaaagaaccttctcagcagagagtgaagaggtggggattttcgttcgacgaaatacttaaggaccaagtaggcagggaccagtttctgcgatttcttgagagcgagttcagtagcgagaatctcaggttctggctcgccgtccaggacctgaaaaaacaaccactgcaagacgtggctaagcgggtggaggagatttggcaggagtttctcgcccccggcgcccccagtgcaatcaacctggactctcacagctatgagatcacatctcagaacgtaaaagacgggggacgatacacctttgaggacgctcaggagcatatctataagttaatgaagtccgacagctatgcacgctttcttcgtagcaatgcctatcaagacctgctcctcgcaaagaagaaggggaaatctctggcaggaaagaggttgaccggcctgatgcagtccagttag

SEQ ID NO: 202891 - DNA, 1041 bp, Artificial Sequence
  Description of Artificial Sequence: Synthetic coding sequence
atgcagaacaaggcccggctggagctggccgactacgaggccgagaacctcgcccgactgcagagagcttttgcgcggaaatgggagttcatctttatgcaagccgaggcgcaggttaaaattgacaggaagaaggacaagaccgagagaaagatcctggactctcaagaaagagcgttttgggatgtgcataggccagtccctggatgcgtgaatacaactgaaatggacataagaaagtgcaggcgactgaaaaacccccagaaggttaaaaaatctgtgtacggcgttactgaggagagccaagctcaatccccagtgcatgtcttatcccagccaatccggaagaccaccaaggaagacatcaggaaacagatcaccttcctaaatgcccaaattgatcgccattgcttgaaaatgagcaaggtggctgagagtttgatcgcctacactgaacaatatgtggagtatgatccattgatcaccccagccgagcccagtaacccatggatatcagatgacgtcgccctatgggatattgaaatgtctaaagaaccctcacaacagcgagtgaagcgttggggcttctcattcgatgaaatcctcaaagatcaggtcggacgggaccaattcttgaggttcctggaatctgagtttagctcagaaaacctgcgcttctggctggctgtgcaggatctaaagaagcagcctctacaggacgtcgctaaacgggtagaggagatctggcaggagtttctggcccccggcgcccccagcgccatcaatctggactcacattcttacgagattacctctcaaaatgtcaaggatggaggtcgctacacttttgaggatgcgcaggaacacatttacaagctgatgaagtctgactcctatgcgcggtttttgagatcaaacgcttatcaggaccttctccttgctaagaaaaaacccgagtcagagcaagggagacgtacttctttagagaaatttactcggtcagtgctgtactcaaatacgccgctggccaagcggccatag

SEQ ID NO: 202892 - DNA, 1419 bp, Artificial Sequence
  Description of Artificial Sequence: Synthetic coding sequence
atggcccagggcagcggcgaccagcgggccgtgggcgtggccgaccccgaggagagtagccccaacatgatcgtctactgtaagatcgaagatatcataacaaaaatgcaggatgataaaacaggcggagtccccattcggactgtgaaatcattcttgtcgaagattccaagcgtcgtgactggaacagatattgttcagtggctcatgaaaaacttaagcatcgaggaccctgtagaagctattcatttgggaagtctcatagccgcccagggttatatcttcccgataagcgaccatgtgttaacaatgaaggatgatgggacattctatcgttttcaggctccctacttctggccttctaactgttgggaacccgagaacacggattacgctatctacctctgtaaacggactatgcaaaacaaggcgcggctggagttggccgattacgaagcagaaaatctggctcggctacagagagcctttgcacggaagtgggagttcattttcatgcaggccgaagcacaggtcaagattgaccggaagaaagacaagaccgagaggaagatactggatagtcaggagcgggccttttgggatgtgcatagaccagtacccggctgtgtgaacacaactgaaatggatattcgaaaatgccgaaggcttaaaaatccacagaaggttaaaaagagcgtgtacggcgttactgaggagagccaggcgcagtcacctgtgcacgtcttgtcccaacccatccgaaagaccactaaggaagacattcggaaacagatcaccttcctcaacgcccagatagaccgccactgtctaaagatgtctaaggtggcagagtcgctcatcgcttataccgaacagtacgtggagtatgatcctttaattacaccagccgagccttcaaacccttggatcagtgacgacgtggccttatgggacatcgagatgagtaaagaacctagtcagcagagagtcaaaaggtggggcttttccttcgacgagatcttaaaggaccaagtaggccgtgatcagttccttcgtttcctggaaagcgagttcagttccgaaaacctaaggttttggttagccgtgcaagacctgaaaaagcagccacttcaggatgtggccaagagagtggaggagatctggcaggagttcctcgctccaggcgccccaagtgccatcaacctcgattcacactcgtacgagatcacaagccaaaatgtgaaagacgggggcaggtatacttttgaggacgcccaggagcatatatacaagcttatgaagtcagatagttacgcgaggttccttagatcgaacgcctatcaggatctgctccttgccaagaaaaaaggcaaatccctcgctgggaagcgactaaccgggctgatgcaatcgagctag

SEQ ID NO: 202893 - DNA, 1473 bp, Artificial Sequence
  Description of Artificial Sequence: Synthetic coding sequence
atggcccagggcagcggcgaccagcgggccgtgggcgtggccgaccccgaggagtcttctcccaatatgattgtttactgcaagatcgaggacatcattactaagatgcaagacgacaagacggggggagtccctattcgtactgtgaagtcttttctgtccaagattccatcggtcgtcacggggacggacatcgtccagtggctgatgaagaatttgagcatcgaagaccccgtggaggccatccacctgggctccctgatcgccgcccaggggtatatatttccgatctccgatcatgttcttacaatgaaggacgatggaacattttaccggttccaagctccttacttctggcctagcaattgttgggagccagagaacaccgactatgcaatctacctgtgtaaaaggactatgcagaacaaggcacgactggagctagctgattatgaggccgaaaacttagcccggttacagagggctttcgcgaggaagtgggagttcatttttatgcaggccgaggcccaggtaaagatcgatagaaaaaaggataagactgaacggaagatcctggattcacaggaacgggcattttgggatgtgcacaggccagtgccagggtgcgtcaataccactgagatggacatccggaagtgcaggaggctaaaaaacccacagaaagttaagaaaagcgtgtatggagtcacagaagaaagccaagcccagtccccggtgcacgtgctctcccaaccaatcaggaagacaacaaaggaagacatcagaaagcagattacgttccttaatgctcagatagatagacattgtttgaaaatgagtaaggtagctgaaagtctgatcgcatacacagagcagtacgttgaatatgacccactgatcacccccgccgaaccgtctaatccttggatctcggacgacgttgcgctctgggacattgagatgtctaaggagccaagccagcagagagtgaagagatggggattctctttcgatgaaatcctcaaggaccaagttggacgtgatcagtttctgaggttcctggaaagcgaattcagcagtgagaatctcaggttctggctggccgttcaagacctgaagaaacaaccactgcaggacgttgccaagcgtgtggaagagatctggcaagagttcttggcccccggcgccccgtctgccatcaaccttgatagccatagctacgagattacctctcaaaatgtgaaagacggagggcggtacacattcgaagatgcccaagagcatatctataaactcatgaagtccgacagttatgcgcggttcctgaggtccaacgcgtaccaggatctcctgctagccaagaaaaaaccagagtcagaacagggccgacgcacttcattggagaagttcactcgcagcgttggaaaatcactcgccggaaaaaggcttactggcctcatgcagtcttcgtag

SEQ ID NO: 202894 - DNA, 1398 bp, Artificial Sequence
  Description of Artificial Sequence: Synthetic coding sequence
atggcccagggcagcggcgaccagcgggccgtgggcgtggccgacccagaagagtcgtctcctaacatgattgtatattgtaaaattgaagacattataacaaagatgcaagacgataaaaccgggggagttccgattagaacagtcaaatcttttcttagtaagatccccagcgtggtcacagggactgatatagtacagtggctgatgaaaaatctgtctatagaggacccagtggaagctattcatttgggcagtctcattgctgcccaggggtatatttttcccatctccgatcacgttttgactatgaaggatgacggaaccttctaccgcttccaagccccctacttctggccctccaactgctgggagccagaaaacacggattacgccatttacctgtgcaagaggaccatgcagaataaggctcgcctggagctcgcggattatgaggccgaaaaccttgcgcggctgcaacgcgcttttgccagaaaatgggagtttatttttatgcaggcagaagcgcaggttaaaatcgacagaaaaaaagacaagacagaacggaagatcctggatagccaagagagggccttctgggatgtccacaggcctgttcctggatgcgtgaatactacagaaatggacattagaaagtgtcgccggctcaagaacccccagaaagtgaagaaatccgtctacggtgttactgaggagagtcaggcccagtctcctgtgcatgtcctttcacagcccatcaggaaaaccaccaaagaagatatcagaaaacaaattaccttcttgaacgcgcaaattgatcgtcactgtctgaagatgtccaaagtagcggagagcctgatcgcttataccgaacaatacgtggaatacgatccgctcatcacccctgccgaaccatcgaatccttggatctccgacgatgtggcgttgtgggacatcgagatgtccaaggagccatctcagcagcgggtgaagcggtggggtttttcattcgacgagattctgaaggatcaggtcggtagggatcagttcctacggttcctggagagcgagtttagctccgagaacttacgcttctggttggcagtgcaggatctcaaaaagcagcccttacaggacgtagccaagcgcgtggaagaaatttggcaggagtttctggctcccggcgctccttccgccattaacctggactcccactcttatgagatcacatctcagaacgtgaaggatggcgggcgctacaccttcgaagatgctcaagagcacatatacaagctcatgaagtcagactcttacgcccgcttcctaagaagcaacgcctaccaggatctactcttggccaaaaaaaaaaaagtctcaaaggtggtggagctgccatag

SEQ ID NO: 202895 - DNA, 1356 bp, Artificial Sequence
  Description of Artificial Sequence: Synthetic coding sequence
atggaggacgtgatcgcccggatgcaggacgagaagaacggcatccccatcaggacagttaagtcatttctcagcaaaatcccatcagtgtttagcggaagtgatatcgtccaatggcttattaagaacctgactatagaagatcctgtggaggccctgcatcttgggaccctgatggccgcccacggctacttcttccccatctctgaccacgtcctgacacttaaagatgacgggacattctatagattccagactccctatttttggccaagcaattgttgggagccagagaacacggactatgctgtctacctgtgtaagcgcactatgcaaaataaggcccgacttgagctggctgactatgaggctgagtccttggcccgccttcagcgggcctttgcaaggaagtgggagttcatctttatgcaggccgaggcgcaggctaaggttgacaaaaagagggataaaattgaacggaagatcctagattcccaggaaagagcattttgggatgtgcaccgtcctgtgccagggtgcgtcaacacgacagaagttgacattaagaaatcctctcgaatgcgaaacccccataaaactaggaagtcggtgtatggcctacagaacgacattcggagccattctccaacccacacaccaaccccagagactaaacctccaaccgaggatgagcttcagcaacagatcaaatattggcagatacagctagataggcatcgcctcaagatgtctaaagttgctgattcattattgtcatatactgaacagtatctagagtatgatccctttttgctcccccctgacccgtccaatccctggctgtctgatgatacaacattttgggagctggaggcctcaaaagaacccagtcaacagagagtaaaacgttggggcttcggaatggacgaggcgctgaaggaccccgttgggcgcgagcagtttcttaaattcttggaaagtgaattcagctccgaaaacctgcggttttggctggcagtggaggatctcaaaaagcgacccattaaggaagtaccttcccgggtacaggagatctggcaagaattcttggcccctggggctccaagcgctatcaatctggactccaaatcctacgacaaaactacccagaacgtgaaggaaccaggccgctacaccttcgaggatgcccaggagcatatatataagctgatgaagtccgattcatacccacgattcatcagatcctctgcatatcaagagctcctgcaggccaagaaaaaaggaagaaatattcctatttttccctgtcataaaaactgtacaccgacactcagagctagtacaaacttgttgtag

SEQ ID NO: 202896 - DNA, 1275 bp, Artificial Sequence
  Description of Artificial Sequence: Synthetic coding sequence
atggcccagggcaacaactacggccagaccagcaacggcgtggccgacgaatccccaaatatgctggtgtatcgaaagatggaggacgttattgccagaatgcaggatgaaaagaatggcatcccaatcagaacagtcaaatccttcttgagcaaaatcccatcagtgttttcggggtccgatatcgtccagtggctcataaagaacctcacaattgaggatcctgcagtgtatctatgcaagaggaccatgcagaacaaggcccggcttgaattggcggattacgaagccgagtccttagccaggctacagcgtgctttcgcccggaagtgggagtttatttttatgcaggccgaagcccaggcaaaggtggataagaaacgggacaagatcgagcggaaaatcttagattcacaagagcgtgccttttgggatgttcatcggcccgttccaggatgtgtgaacacaacggaagtggacataaagaaatcatccaggatgaggaatccccataagacgagaaagtctgtctatgggttacaaaatgatatccggtctcactctcccacacatacgccaacccctgaaacaaaacccccaacagaggacgagttgcaacagcaaattaaatattggcagattcagttagaccgtcatcgcctgaagatgagtaaggttgccgatagtctgctatcctatacagagcagtatcttgagtatgatccgtttttgctgcctcccgatccgtccaatccatggctaagtgatgatactaccttctgggagctcgaagcgtcaaaagagccatcgcagcagagggtgaaaaggtggggtttcggcatggacgaagccctgaaagaccccgtaggaagagagcaatttctaaagtttctggaatccgagttctcctccgaaaacctccgcttttggcttgctgtcgaagaccttaagaagaggcctataaaggaagtaccttcaagagtgcaggagatttggcaagaatttctggcacctggcgcacccagtgccattaatttggatagcaagtcatatgacaaaactacccagaacgtcaaggaacccgggaggtataccttcgaggatgcccaggaacacatctacaagctaatgaaaagtgattcatatcccagatttatccgatctagtgcctatcaggaactgcttcaggcaaaaaaaaagggccgaaatatccccatcttcccctgtcacaagaactgtacccctactctaagagccagcaccaacttgctgtag

SEQ ID NO: 202897 - DNA, 1410 bp, Artificial Sequence
  Description of Artificial Sequence: Synthetic coding sequence
atggcccagggcaacaactacggccagaccagcaacggcgtggccgacgagtcacctaacatgctggtttacaggaagatggaggatgtgatagcacggatgcaagacgagaaaaatgggattccgattagaactgtaaagtcctttctatctaaaattccaagtgtctttagtggatcagatattgttcagtggctgattaagaatctaactatcgaggaccccgtggaggctctacaccttggcacactcatggcagcgcatggctatttcttccctatttctgatcacgtgctcaccctcaaagacgatggaacattctaccgctttcagaccccttacttctggccctctaactgttgggaaccagagaatactgattacgctgtttacctctgtaagagaacgatgcagaacaaagctcgtctggaattggccgactacgaggcagaaagcctggctcggcttcaacgcgccttcgcccggaaatgggaatttatattcatgcaggctgaagcgcaggcgaaggtcgataagaaacgggacaagatagagcgcaagattctggactcgcaggaaagagccttctgggatgtgcaccgccctgtgccaggatgcgtgaacacaaccgaggtggatattaaaaaaagttcccgcatgagaaacccccacaaaacacgcaagagtgtctatggcctgcagaacgacatcagatcacattcacccacccatacccccactcctgagaccaagcctcccacggaagatgaactgcagcaacagataaagtattggcagatccagctggaccgacaccgccttaagatgtccaaagtagcagacagcctgctctcatacaccgaacaatacctggagtacgatccgtttctacttccccccgacccaagcaatccatggctttctgacgacactacattctgggagctggaggccagtaaggaaccttctcaacaacgcgtaaagagatgggggttcggcatggacgaggcactgaaggacccagtaggccgcgaacagtttctgaaatttttggaatccgagttttctagcgagaatttgaggttctggctggcagtggaggacctgaaaaaaagacccatcaaagaggtcccaagtagggtacaggagatctggcaggaatttttggcacccggcgcgccctcggcgatcaacctggatagcaagtcctatgataagacaacccagaatgtcaaggaacctggcagatacaccttcgaggacgcccaggagcatatctacaagcttatgaaaagtgattcctatccgcgattcattaggtcatctgcttatcaagagcttcttcaagccaagaagaaagggaaaagtctgacaagcaaacgtctcaccagtctcgctcagagctattag

SEQ ID NO: 202898 - DNA, 1434 bp, Artificial Sequence
  Description of Artificial Sequence: Synthetic coding sequence
atggcccagggcaacaactacggccagaccagcaacggcgtggccgacgagagccctaacatgttggtgtacagaaagatggaggacgtgatcgcgcgaatgcaggacgaaaaaaatggcatacccatcagaaccgtgaaaagctttctcagcaaaatccccagtgtcttttcaggttcagacatcgtccagtggttaatcaaaaatctaacaatcgaggaccccgtggaagctctgcatctcggaaccctcatggcggctcacggttactttttcccaatcagcgaccacgtccttaccctgaaggacgatggcaccttttatcgctttcagactccttatttctggccttccaactgttgggaacccgagaatactgattacgccgtatacctatgcaaaaggactatgcaaaacaaggcgcgcctagagctcgccgattacgaagcggagagccttgccagattacagcgggcctttgcccgaaagtgggaatttatattcatgcaggccgaggctcaggccaaggtcgacaaaaaaagagataagatagaacggaaaatcctggattcccaggagcgggccttctgggatgtccacagaccggtgcctggttgtgtaaataccaccgaggtcgacattaagaagagttctcggatgaggaatcctcacaagacccgcaagtccgtgtacgggcttcagaatgatatcagatcccactccccaacccacacccccactccagagaccaagcccccaacagaggacgaacttcagcagcagattaagtactggcaaatccaattggatcggcacagattgaagatgtcaaaggtcgctgactcattattgtcatacacggagcagtacctggaatacgatccattcttgctcccccccgacccaagcaacccttggctgtccgatgacactaccttctgggaactcgaggcttctaaagagcctagtcaacaacgagtaaagagatggggatttggaatggatgaagccttgaaagatccggtggggcgggaacagttcttaaaatttctggaatctgaattttcttccgaaaacttgagattctggctggcagtggaggatcttaagaagcgccccataaaggaggttccatctagagttcaggagatctggcaggagttccttgccccgggtgcaccatccgccatcaacttggacagcaaaagttacgacaaaacgacgcaaaacgtgaaggaacctggcagatataccttcgaagatgcccaagagcacatctacaagctgatgaaatctgattcttatcctaggtttatcagaagttccgcgtaccaggagctcttgcaggccaagaaaaaaggacgcaatattccaatcttcccctgccacaagaactgtacccctaccctacgggcctccacaaatctgctgtag

SEQ ID NO: 202899 - DNA, 1410 bp, Artificial Sequence
  Description of Artificial Sequence: Synthetic coding sequence
atggcccagggcaacaactacggccagaccagcaacggcgtggccgacgaaagtccaaatatgctcgtttatagaaagatggaggacgtcattgcacgcatgcaggacgaaaagaacgggatcccaataagaactgtgaagtccttcctgtcaaaaataccctccgtgttcagcggctcggacatagtgcaatggctgataaagaacctgactattgaagacccagttgaggcccttcatctggggaccctgatggcagcccacggctattttttcccaatcagcgatcacgttctgactctcaaggacgatggcaccttttacaggtttcagacaccatacttctggccctcaaattgctgggagcccgagaataccgactatgccgtgtatctgtgcaaacggacgatgcaaaataaagccagactggaacttgcagactatgaggccgagtccctcgcacgcctgcaaagggctttcgcccggaagtgggagttcattttcatgcaggcggaggcccaagccaaggtggataaaaagcgggataagatcgagcggaagattttagattcacaggagcgtgccttttgggacgtacatcgcccagttcccggttgcgtgaacactacagaggtcgatatcaaaaagagcagtaggatgcgcaatccacacaagacgcgtaagagcgtgtatgggttgcagaacgatataagatctcacagcccaacacacacgccaactccagaaacgaaaccaccaactgaagatgaattacagcaacagatcaaatactggcagattcaactggatagacacaggctaaagatgagtaaggtcgcagactccttgttgtcctatacagagcagtatctcgaatatgacccctttctgctaccaccagatccatctaacccttggctttctgatgataccacattttgggagctcgaggccagtaaagagccatcccaacaacgtgtgaaaaggtggggtttcggaatggacgaagctctgaaggatcccgtaggccgagaacagttcctgaagttcctggagtctgagttcagttccgaaaatctacggttctggctggctgttgaagacctgaagaagcggcccattaaagaggtgccgtctcgggtccaggaaatctggcaggaattcctggccccaggggccccatccgccatcaatctggatagtaagtcatacgataagactacacagaacgtgaaggagcctggcagatacacgtttgaagacgcccaggagcatatatacaagctgatgaagtcagattcctatcctcgtttcattagatcctccgcctatcaggagctccttcaagcgaagaagaagggaaagagcctcactagcaaacgcctcacgagcctggctcagagttactag

SEQ ID NO: 202900 - DNA, 1464 bp, Artificial Sequence
  Description of Artificial Sequence: Synthetic coding sequence
atggcccagggcaacaactacggccagaccagcaacggcgtggccgacgagagcccaaatatgttagtataccggaagatggaggatgtgatcgcacgcatgcaggacgaaaagaacggaatacccatcaggacagtcaaaagttttctctctaaaattccgtcggtgttctcagggtccgacatcgttcagtggctgattaagaatcttactattgaagatccagtggaggccctccacctagggacactgatggctgcacacggttatttttttccaatcagcgaccatgtgttgactctcaaggatgatggaaccttttatcggtttcaaactccttacttttggcctagcaattgctgggagccagaaaacaccgactatgctgtgtacctgtgtaaaagaacgatgcagaacaaagccagactggagcttgcagattacgaggcagaaagtctcgcaagacttcagcgtgcctttgccaggaaatgggagttcattttcatgcaggcggaggctcaggcaaaagtcgacaagaagcgggataaaattgagcgcaagattcttgattctcaggaaagggctttctgggacgtccaccggccggtccctggctgcgtaaatacaaccgaagttgacattaagaaatcctctcggatgaggaatccgcataaaactcgaaagtcagtgtatggcttacagaatgacattaggtctcattcaccaacccatactcccacccccgagaccaaaccaccgacagaggatgagctgcagcagcagatcaagtactggcagatccagcttgaccgccaccgccttaaaatgagtaaggtggccgattccttgctgtcatacaccgagcagtacctagaatacgatccttttttattgcctccggaccctagtaacccgtggctctctgacgatacaacgttctgggagcttgaagcctccaaggagccctctcaacaacgcgtgaagcggtggggttttggaatggacgaagctctcaaagatccagtcgggcgggagcagttcctaaaattcctggaatcagaattctcgagtgagaatttgcgattctggctggcagttgaagatttgaagaaacgtccgatcaaggaggtccctagtcgggtgcaagagatatggcaggagttcttggcacccggggccccaagcgccataaatttggattccaagagttatgataaaaccactcagaatgtgaaggaacctggccgttacacgttcgaagatgcgcaggagcatatctataaacttatgaagtccgacagttaccccagatttatccgcagctccgcttaccaggagctcctgcaggctaaaaagaagagcggaaacagcatggacagaaggacgtcctttgagaagtttgcgcaaaacgtggggaaatctctcacatctaagcgcctgacttccttagctcagtcctactag

SEQ ID NO: 202901 - DNA, 1275 bp, Artificial Sequence
  Description of Artificial Sequence: Synthetic coding sequence
atggcccagggcaacaactacggccagaccagcaacggcgtggccgacgaaagccctaacatgctcgtgtacagaaaaatggaagatgtgatcgccagaatgcaagatgagaagaacggtattcccatcaggaccgtgaagagctttctctcaaaaatcccaagtgtcttcagcggaagcgacatagttcagtggctgattaagaacctgacgatagaagatccagcagtatacttgtgcaaacgtaccatgcagaacaaggcccgcctggagctggccgactatgaggctgagtccctggctcgacttcaaagagcattcgctaggaagtgggagttcatcttcatgcaggctgaggctcaagctaaagtggataagaagcgcgataagatagaacgtaaaatattggacagccaggagagagctttctgggatgtgcatcgcccggtgccaggatgtgttaatacaaccgaggtcgacattaagaaaagtagccgcatgaggaatcctcataaaacgagaaaatctgtgtacgggctgcaaaacgacataaggtctcattccccaacgcatacacccacaccagaaactaagccgcccaccgaggacgagctgcagcagcagataaagtattggcagatccagctcgatcggcataggctgaagatgtccaaagtggctgactccctcttaagctatactgagcagtaccttgaatacgatcccttcctgctccctccggatcccagcaacccatggctcagcgacgacaccacattttgggaactggaggcgtcaaaggaaccaagccagcaaagagtcaaaaggtgggggttcggcatggacgaagctctgaaagatcctgtgggtcgggagcaattcctgaagtttctcgagtcagagttctcgtcagaaaatctgcgattctggctcgccgtggaagacctgaagaaacgacctatcaaagaggtgccaagcagggtgcaagagatatggcaggagtttctggcacccggcgcgccttcagccatcaatctggacagtaagtcctatgacaagacaactcaaaacgtgaaagagcccggtcgttataccttcgaggacgctcaagagcacatttacaagctgatgaagtcagattcctacccccgcttcataaggtcttccgcttaccaagaactgttgcaggcgaagaaaaaagggagaaacattcctatttttccctgtcataaaaactgcaccccaaccctccgcgctagcacaaacctgctttag

SEQ ID NO: 202902 - DNA, 1488 bp, Artificial Sequence
  Description of Artificial Sequence: Synthetic coding sequence
atggcccagggcaacaactacggccagaccagcaacggcgtggccgacgagtcacccaatatgctggtctaccgcaagatggaggatgtgattgcgcggatgcaggacgagaaaaacggtattccaatcagaactgtgaaatccttcctttcaaagattccatccgtcttttctggctcagatattgttcagtggctcattaagaacctgaccattgaagatcccgtagaggctttgcacctcggcacactgatggctgcccatggctacttctttcctatttctgatcacgtcttgaccttgaaagacgacgggacgttttatcgattccagaccccctatttttggcccagcaactgctgggagccggagaacacggattacgcagtttatctgtgtaagagaactatgcagaacaaggccaggttggaacttgccgactacgaagccgagagcctcgctaggctccagcgcgcttttgccaggaaatgggagtttatcttcatgcaggcggaggcccaggccaaggtggataaaaagcgggacaagattgaacgtaaaatcctggactctcaggagcgtgccttctgggacgttcaccgacctgtacccggctgcgtcaacacaaccgaggtggatattaagaagagttcaagaatgagaaaccctcataagactcgtaaatcagtctatgggttgcagaacgacattaggtcccattcaccaacacacaccccaacaccggaaacaaagccgcccacggaagatgaacttcagcagcagattaagtattggcagattcaactggaccgccaccgcctgaagatgagcaaagtggctgactccctcctatcctacacggagcaatatttggaatatgatccgttcctccttccccccgaccccagcaatccctggctttccgacgacaccaccttttgggaattggaagccagcaaagaacctagccagcaaagggtgaagcggtggggctttggcatggatgaggccttgaaggatcctgtgggtagggagcagtttctaaaattcctggagtctgagtttagctcagagaacctacggttctggctggccgtggaggatctgaagaagaggccgattaaagaagtgcccagtagagtccaggagatatggcaggagttcctggcccctggagctcctagtgctatcaacctggactcgaagtcttacgacaagaccacacaaaacgttaaggaacctggtaggtacaccttcgaagatgcacaggagcatatatacaaactgatgaagagcgactcttacccacgctttattcggtcttccgcttaccaagaactgcttcaggcaaagaagaagagcggaaatagcatggaccgcaggacatcatttgagaagtttgcacagaacgttggtagaaatatccccatcttcccctgtcacaagaattgcactcctaccttaagagcatcaactaacctgttgtag

SEQ ID NO: 202903 - DNA, 981 bp, Artificial Sequence
  Description of Artificial Sequence: Synthetic coding sequence
caggccgaggcccaggccaaggtggacaagaagcgggacaagatcgaaagaaagatcctggactcgcaggagagggcattctgggacgtgcacaggcctgtgcctgggtgtgtaaacacaaccgaggttgatatcaagaaatcatccaggatgcggaatccccacaagacccggaaatccgtgtatggactgcaaaacgacatccgaagccattctcccactcacacaccaacacccgagactaaaccaccaactgaggatgagctacaacagcagatcaaatactggcaaattcagttagatagacatcgcttaaagatgagcaaagttgcggacagtctcctcagctacacagaacagtacctcgagtatgatcctttcctgttgccaccagacccatcaaacccctggctgtctgatgatacaactttctgggaacttgaggcatccaaggagccatcacagcagcgtgtgaagcgatggggcttcgggatggatgaggcactgaaagatcccgtgggcagggagcagttccttaagttcctggaatcagaattttcctccgaaaatctcaggttttggctagccgtagaggacctcaagaagcgacctatcaaggaggtacccagccgggtgcaggagatttggcaggaattcctagcccctggagctccatctgcgatcaacttggacagcaagagctacgacaagacaacccagaacgtcaaggaaccaggaaggtacacattcgaagacgcgcaggaacacatatacaaacttatgaagagcgattcctaccccagatttattcgcagcagcgcctatcaggagttgctgcaggctaagaaaaagtcaggcaacagcatggaccgcaggacgtcctttgagaaatttgctcagaacgtgggaaggaatatccctatctttccatgtcacaagaattgtacccctacactgagggcatcaaccaatcttctctag

SEQ ID NO: 202904 - DNA, 1182 bp, Artificial Sequence
  Description of Artificial Sequence: Synthetic coding sequence
atggccgcccacggctacttcttccccatcagcgaccacgtgctgaccttaaaagacgacgggacattctataggtttcagaccccttatttctggccctctaactgctgggagcccgaaaataccgactacgctgtctatctttgtaagagaacaatgcagaacaaggcaagactggagctggccgactacgaagctgaaagtcttgcgaggctccagcgcgctttcgcccggaagtgggaatttatttttatgcaagcagaagcccaggcaaaggttgacaagaagagagacaagatcgagagaaagattctggacagccaggagcgtgcgttttgggacgtacacagacctgtgcccggctgtgtgaatacaaccgaggtagacattaagaaaagcagtcggatgcggaacccacacaagacgagaaaatccgtgtatggcttacaaaatgacatcagatcccattcacctacacacacacctaccccagaaacaaaaccaccaacagaggacgaattgcagcaacagataaagtattggcagatccagcttgatcgtcacagattgaagatgagcaaagtagcagattctctcctgtcttataccgagcaatacctagagtacgatccattcctgctgccacctgatccctccaatccgtggttaagtgacgacacaacgttctgggaactcgaggcttccaaggagccctcacaacagcgcgttaagcgatgggggtttggaatggacgaggctctgaaggatccagttggtcgcgagcagtttcttaagtttttagaaagtgagttctctagcgaaaatttgagattttggttagcggtcgaggacctcaagaaacgcccaatcaaagaggtaccttcgcgagtgcaggaaatctggcaagaatttcttgccccaggggccccgagtgcaattaatttggacagtaaatcttatgataagaccacacagaacgttaaagagcccggaagatacactttcgaagatgctcaagagcacatatataaactgatgaagtccgactcctatccccgctttattaggtcttctgcctatcaggagctccttcaggccaagaagaaagggagaaacatccccatcttcccttgtcacaaaaattgcaccccaacactgcgcgccagcacgaacctgctgtag

SEQ ID NO: 202905 - DNA, 774 bp, Artificial Sequence
  Description of Artificial Sequence: Synthetic coding sequence
atgagcagcgcccccaacggccggaagaagcggcccagccggagcacaaggagctccatatttcagatctcaaaaccaccgctgcagagcggggactgggaacggagaggctccggctccgagagcgcgcacaagacccagcgcgcactggacgattgcaagatgctggtgcaggagttcaatacccaggttgctctgtatcgggaactggtcatctccataggtgatgtctccgtatcctgtcctagcttgagggccgagatgcacaagactagaactaagggctgtgagatggccaggcaggcccaccagaaactggcggctatctcaggacccgaggacggcgagatccatcccgagatctgccgtctgtatatccagttacagtgctgtttggagatgtacaccaccgaaatgctgaagagcatctgtttactgggaagcctgcagtttcatcggaaaggcaaggaacctggcgggggcactaagagcctggattgcaaaatagaggaatctgcggagacgcctgccttggaagactcctcttcatcacccgtggactcccagcagcatagttggcaggtgagtactgacatagaaaacaccgaaagagacatgagggagatgaagaatcttctcagtaaacttcgcgaaactatgcccctcccgcttaagaaccaagatgattcatcactgctgaacttaaccccttatcccctagtacggcgccgcaagcgtcgcttttttgggctgtgctgtctcatttcttcctag

SEQ ID NO: 202906 - DNA, 2025 bp, Artificial Sequence
  Description of Artificial Sequence: Synthetic coding sequence
atgaccatccggcaccagggccagcagtaccggccccggatggcctttctccaaaagattgaagctctggtgaaggatatgcagaacccagagactggcgttagaatgcagaaccaaagggtactcgttacatccgttccccacgccatgactggttccgacgtgctgcagtggatagtgcaaagattgtggatcagttcgcttgaagcccagaacctgggaaacttcattgtgcgttacggctatatctaccccctgcaggacccaaaaaacttgatccttaagcccgacggctctttgtaccggtttcaaaccccatatttctggcccacccagcagtggcctgccgaagacacagactacgccatctacctcgcaaagagaaatataaagaagaagggtatcctagaggagtatgaaaaggaaaactacaattttctgaaccagaagatgaattacaaatgggatttcgtgattatgcaggctaaagagcagtacagagcggggaaggagcgtaataaggcagatagatacgccctggattgtcaagagaaagcatactggctggtccacagatgtcctccaggaatggataatgtgctcgattatggattggatcgcgtgaccaatccgaatgaggtcaaggtgaaccagaaacaaaccgtagtcgccgttaagaaggaaatcatgtactaccaacaggctctgatgagatcaacagtgaagtccagcgtgtccctcggcggcattgtgaagtacagcgagcagttttcgtcgaatgatgccatcatgagtggatgtctgccgtccaatccctggatcaccgatgatacgcagttctgggacctcaacgccaagctcgtagagatcccaaccaagatgcgggtggagaggtgggcgtttaatttctcggaattgatccgcgatcctaaagggcgtcagtctttccaatacttccttaaaaaagagtttagtggggagaacctggggttttgggaagcatgtgaagatttaaagtatggggatcagtcgaaagtgaaggagaaggctgaggagatatacaagctgtttctggcaccaggcgctcggaggtggatcaacatcgatggcaagactatggatattacagtcaaagggctgaagcacccacatcggtatgtgctggacgcagcacagacccacatttatatgctcatgaagaaagatagttatgcgcgctaccttaaaagcccaatctacaaggacatgctggccaaagctattgagcctcaggagacaactaagaaatctagcactctgccctttatgcgcagacacctgcggtcatcgccctcccctgtgatattgagacagttggaggaagaagccaaagcccgagaggcggctaataccgtcgacatcacccagcctggacagcatatggctcccagcccacacttgactgtatataccggaacctgtatgcccccttcccctagctctcctttctccagttcttgccgcagtccacgcaaacctttcgcatccccatcccgattcatccggcgacccagcacaactatttgtccttccccaatccgtgtcgccctggagtcttctagcggccttgagcagaagggcgagtgttcaggcagtatggcccctcgtggaccaagtgtaaccgagtctagtgaggcatctttggacaccagctggccccggagccggcccagggccccacccaaagcacgcatggcattaagcttttctcggttcctgaggaggggttgtttggcctccccagtgttcgcccgactttcgccaaaatgccccgccgtgtcccacgggcgtgtgcagcctctcggtgatgtggggcagcagctccccagactaaagtctaagcgcgttgctaacttttttcagattaaaatggacgtgccaacgggctccggcacctgtctgatggattccgaagatgccggcacgggcgagagcggggatagagcgaccgagaaggaggtaatctgtccctgggaatccctttag

SEQ ID NO: 202907 - DNA, 2016 bp, Artificial Sequence
  Description of Artificial Sequence: Synthetic coding sequence
atgaccatccggcaccagggccagcagtaccggccccggatggcctttctacaaaagatcgaagctctggtcaaggatatgcagaatcccgagaccggcgttaggatgcagaatcagcgggtcctcgtgacatctgttccccacgcaatgactggcagcgacgttctgcagtggatagtgcagaggctgtggatcagcagtctggaagcccagaacctcggcaacttcattgtaagatacggatacatctaccctcttcaggacccaaagaatctaattttaaaacccgatggcagtttgtaccggttccagaccccgtacttttggccgacccagcaatggcctgccgaagatacagactatgccatctatctcgctaagaggaacatcaagaaaaaaggaattctggaggagtacgaaaaagaaaattacaattttcttaatcagaagatgaattacaaatgggatttcgtgatcatgcaggccaaggagcagtatcgggctggtaaggagagaaataaagcggaccggtatgctctcgattgccaggaaaaagcgtactggctggtccacaggtgtcctccagggatggacaatgtgctggattatggcctggacagggtaaccaacccgaacgaggtgaaaaaacaaaccgttgttgcagtgaagaaagagatcatgtactatcagcaggcgctgatgagatccaccgttaaatctagcgtgtctctcggcggaattgtcaagtactccgagcagtttagttccaatgacgcaatcatgtccggatgcttgccttctaatccctggatcacagacgacacacagttctgggacctgaacgccaagctcgttgaaatacctaccaaaatgcgcgtcgagcggtgggcatttaatttcagtgaactaatccgagacccaaaaggccgccagtcttttcaatatttcctcaagaaggagttctctggggagaacctgggtttttgggaagcgtgcgaggacctcaaatatggggaccagagtaaggttaaggagaaagccgaggagatatacaagctgttcctcgcccccggagccaggaggtggatcaacatcgacggaaaaaccatggacattactgtgaaaggcctgaagcatcctcacagatacgtgctggacgctgctcagacccacatctacatgttgatgaaaaaggattcctacgcccgctacctgaagtctccaatatacaaagacatgctcgccaaagcgattgaaccgcaggaaaccacgaaaaaatccagtactctcccattcatgagacggcacctgcgctcttctccttcccccgtaatacttcggcaacttgaagaggaggccaaggctcgagaagcggccaacaccgtcgacatcacccagcccggacagcacatggccccgtcaccccaccttaccgtgtatacgggcacctgtatgcctccttctccaagttcccccttctctagcagctgccggtcacccagaaaaccgttcgcctctccgtccaggttcattaggaggcccagtaccaccatttgtccgagcccaataagagttgctctagagtctagctctggtcttgaacaaaaaggagaatgcagcgggagcatggcaccaaggggaccctccgtcactgagagttcggaggccagtttggacacatcctggccacgaagccgcccacgggcccctcccaaagcccgaatggctctgtcctttagccgcttcctgcgccgagggtgcctggcatcgcctgtgttcgcacgccttagcccaaaatgcccagccgtaagtcatgggcgcgtgcagccacttggtgatgtgggtcaacagctgcctagactgaaatccaagcgggtcgcaaatttcttccagataaaaatggacgtccctaccggctctggtacgtgtctgatggactccgaggatgccggaactggagagagcggggaccgggctacagagaaggaagtcatttgcccttgggagtcactgtag

SEQ ID NO: 202908 - DNA, 4008 bp, Artificial Sequence
  Description of Artificial Sequence: Synthetic coding sequence
atggagagcgagatgctgcagagccccctgctgggcctgggcgaggaagacgaggcagatttgacagactggaatctaccactcgcctttatgaagaaaagacactgtgagaaaattgaaggctccaaatctctggctcagtcctggcggatgaaagaccggatgaaaacagtctcagtggccctcgtgctgtgcctgaatgtcggcgttgatccccccgatgtcgtgaagaccacgccatgcgctcgcctggagtgttggattgatccgttatccatggggccgcaaaaagccctggagaccataggcgctaatctgcagaaacagtatgagaattggcagccccgggcacgttataaacagtcactcgaccccaccgtcgacgaagtgaagaagctgtgtaccagcctgagacgcaatgctaaagaggagcgcgtcctctttcactataatggtcacggtgtgccacgtcctaccgtgaacggcgaggtgtgggtattcaataagaactatacccagtatatacctctctctatctacgatctccagacatggatgggctcaccatcgattttcgtttatgattgttccaacgctggcctgattgtcaagagttttaagcagtttgccctccagcgggagcaggagctggaagtggctgccattaacccgaaccacccactggctcagatgcctttgcccccaagtatgaagaattgcatacaattagccgcttgtgaggcaacagaactcctccctatgatacccgatctccccgccgacctattcacttcttgtctgaccactcctataaagattgcgctgaggtggttttgtatgcaaaagtgtgtctcccttgtcccaggagtcacattagatcttatcgagaaaatccctggtcgacttaatgaccggcgcacccctttgggtgaactgaattggatcttcactgcaatcaccgatacgattgcatggaatgtgctgccccgcgacctgttccagaagcttttccgccaggatcttctggtcgcctccctgtttcgaaatttcttgctggcagagcggataatgaggagctataactgtactcctgtgagctcaccaaggctgccccccacgtacatgcacgccatgtggcaggcgtgggatctggctgtggacatctgtctgagccaactcccaacgatcattgaggagggcacagcattccgtcactccccattcttcgcagagcagctcaccgcattccaggtttggctgacaatgggcgtcgagaaccggaaccctcctgagcagctccccattgtgctccaggtgctgctgtcccaggtccatcgcctgcgggctcttgatctgctcggaagattcctggacctcggaccctgggcagtgtccttggccttgtccgtcggcatctttccctacgtcctcaagctgttacagagcagtgctcgggagctgcgacctctactggtgttcatttgggccaagattcttgccgttgattcctcctgtcaggccgatctggtcaaggataacggacataaatacttcctgagcgtgttggccgatccatatatgcccgctgaacatagaaccatgaccgcatttatcctggccgtgatagtcaatagctaccataccgggcaagaggcatgcctgcaaggaaacctgatcgctatatgcctcgaacaactcaatgaccctcacccgctgcttcgacaatgggtcgccatctgtttgggccgcatctggcagaactttgacagcgcccgatggtgcggggtccgggattctgctcatgagaagctgtattcactgctgtctgaccctattccagaggtaagatgcgccgctgtgttcgcgctcgggacatttgttgggaacagcgcagaaaggaccgatcactcaactactatcgaccataatgtggcaatgatgctagcacagctggtgagtgatggctctcctatggtgagaaaggagttggtggttgccctgtcccatctggtggttcagtatgagagcaacttttgcactgttgcactgcagttcatcgaggaggagaagaattacgcactgccctctcccgcaacaactgagggcggctccctgacccccgtgcgtgattcgccatgtacacctcggctgcgttctgtcagttcatatgggaacatcagggcagtagctacagctcgctccttaaataaatctttgcagaaccttagcttgacagaggagagtggaggagcggtggccttctccccaggcaacttgagcacgagcagtagcgccagttctacactcggaagtcccgagaatgaggagcacatactctcttttgaaactattgacaagatgcgacgagcgagcagttatagctcgctgaacagcctgatcggggtgtcctttaacagcgtttatacacaaatttggcgggttctgctccatctagcagctgatccttatcccgaagtctccgacgttgccatgaaggtcctcaactctatcgcgtacaaggccaccgtgaacgctcgtccacagcgtgtcctggacacatcaagtttaacacagtcagcgcctgctagcccgaccaacaagggggtacatattcaccaggccggaggctctcccccagcttcttctacctcctcttcaagccttacaaacgacgtagctaaacagccagtaagcagggatctgccaagcggacgtcctggcactaccggccccgctggggcccagtacacccctcacagtcaccaatttccgagaactagaaaaatgtttgacaaaggcccagagcagactgcagatgacgcagacgacgcagccggtcacaagtcttttatatctgctaccgtgcagaccgggttttgcgactggtctgcgagatacttcgctcagcctgtgatgaaaatccctgaggaacacgacttggaatcccagattcggaaggagcgggagtggaggttcctccgcaacagcagggtcagacgccaggcgcagcaggtaatccagaagggaattacccgactagatgaccagatcttcttaaatagaaaccccggcgtaccctcagttgtgaaatttcacccattcactccatgcatcgccgtcgcggataaagacagtatttgtttttgggactgggagaagggggaaaaactggactacttccacaacggaaacccccgctatacacgcgtgacagcgatggagtatttgaatggtcaggattgtagcctcctgctgaccgccaccgatgatggcgcaattcgggtctggaaaaacttcgctgacctcgaaaagaatcccgagatggtgacagcctggcagggcctgtcggatatgttacccacgacccgcggagccggtatggtggtcgattgggagcaggaaaccggcctgctcatgagctccggagacgtccggatagtgcgcatctgggataccgatcgcgagatgaaggtgcaagatatccctactggagccgactcgtgcgtgacctctctctcctgtgacagtcaccgctcactgatcgtggccggcctgggagacggcagtataagagtttatgataggcgtatggccttgagcgagtgtcgggtgatgacctatagagagcatacagcttgggtcgtgaaagctagtttgcagaaaaggccagatggacatatcgtttcagtaagcgttaacggtgatgtgcgaatcttcgaccctcgtatgccggagtccgttaacgtgctgcagattgtgaagggcttgaccgcactggacattcacccacaagctgacttgatcgcatgcggcagtgtgaatcagttcacagccatctataattcctccggcgagttaattaataacatcaagtactacgacggcttcatgggccagagggttggggccatttcatgtctggcctttcatccccattggccccaccttgccgttggaagcaacgattattacatatcagtctatagcgtggaaaaacgagtgcgatag

SEQ ID NO: 202909 - DNA, 990 bp, Artificial Sequence
  Description of Artificial Sequence: Synthetic coding sequence
atgggcagccccagcatcttcgtgtacgactgcagcaacgccggccttattgttaagagttttaagcaattcgcattgcaaagagagcaggagttagaggtggccgctataaacccaaaccaccctttagcacaaatgcccctccccccttctatgaagaattgtatacaattagcagcttgtgaggctactgaactgctgcccatgattcctgatctccccgctgacctttttacatcttgcttgacaaccccaataaaaatcgccttgcgctggttctgtatgcaaaagtgcgtcagtctcgtgccgggagttacattagacttgattgagaaaatccctggccgcttaaacgacaggagaactcccttgggagaactgaattggatatttacagcaattaccgatacaatcgcttggaacgttctccctagggatttgttccaaaagctgtttcgacaggatttacttgtggcgtccttgttccggaactttcttctcgctgagagaatcatgagatcgtacaactgtacccccgtgtcatcaccaagactccctcccacctacatgcatgctatgtggcaggcctgggatctggccgtcgatatttgtctctcacagttgccgaccatcattgaggagggcacagctttcaggcactctcctttcttcgctgaacaattaacagccttccaggtgtggctcaccatgggcgttgagaatcggaaccctcccgagcagctgcccatcgtcctgcaggtgcttctttcccaggtgcaccggctcagagctctggacctgctcggcaggtttctcgacctgggcccttgggccgtatccctggccctctctgtcgggatctttccgtacgtgctgaaactcttacagtcctctgccagggagctaagaccacttctggtgttcatttgggcaaagatacttgcagttgattcagtctccatccccgcacttttgcctagggttatgtag

SEQ ID NO: 202910 - DNA, 3534 bp, Artificial Sequence
  Description of Artificial Sequence: Synthetic coding sequence
atggagagcgagatgctgcagagccccctgctgggcctgggcgaggaagacgaggccgatcttacagattggaatctaccattagcattcatgaagaagcgacactgcgaaaagattgagggtagcaaatccctggcacaatcttggcgcatgaaggatagaatgaagacagtgagcgttgccctggtattatgcctgaacgtaggcgtggacccccccgacgtcgtgaagaccacaccatgcgcccgtctagagtgttggatcgaccctttgtccatgggacctcagaaggcgctagagactattggcgcgaacctccaaaagcagtacgagaactggcagcctagggcacgatacaagcagtcactggaccctaccgtggatgaagtcaaaaaactgtgtacaagcctcaggcgaaacgctaaagaggagagggtgttgttccactataacggccatggcgtccctcggcccactgttaatggagaagtctgggtgttcaacaagaattacacacagtatattcccctgagtatatatgatctgcaaacttggatggggtccccttcaatttttgtgtacgactgcagtaacgcgggcctaatcgtaaagagttttaagcagtttgctctgcagcgggagcaggagctggaagtggcggctatcaatcctaaccacccgctggcgcagatgcctctccctccttctatgaagaactgtatccagctggccgcctgtgaggcgaccgagcttctacctatgatcccagatttacccgcagacctatttacctcttgtctgaccacaccaatcaagatcgctttacgctggttttgtatgcagaagtgcgtgtcactggttccaggcgtgacactagacctgatcgagaagatccccggtcggttgaacgataggcgcactcccctgggggaacttaactggatttttactgccatcaccgatacgattgcctggaatgtgctaccgcgggacttatttcagaagctctttaggcaggatctattggtggcctcattgttccggaattttctcctcgccgaacgcataatgcgctcttacaattgtactccagtgtccagtccacggctaccaccaacctacatgcatgccatgtggcaggcatgggatttggccgtagacatctgtttaagccagctgcccactatcatagaagaggggaccgcattccgccacagcccgttctttgccgaacagctaaccgcttttcaggtgtggctcactatgggagttgaaaatcgaaatcccccagagcagctcccaatagtgttacaggttcttctgtctcaggtgcaccgactgagggcactggacctgttggggcgattcttggacctggggccatgggctgtgtccctagccctgtctgttggaatttttccctacgtgctcaaactgctacagtcttccgccagagagctgcgacccctgctagtcttcatctgggcaaagatactagcggtcgactccgaactagtggtagcactttcacacctcgtggtgcagtacgaaagcaacttttgtaccgtcgccctgcagttcatcgaagaggaaaaaaactatgctctgcctagccctgctacaaccgaggggggctctctgaccccagtgagggattccccatgcacgccccgattaaggtccgtttcaagttatgggaacattagagctgtggctacagcaaggtctttaaacaaaagtctgcagaatctgtctctgacagaagaatccgggggagccgtcgctttctcaccaggcaacctgagcaccagttcatcagcctcgagcactctggggagccctgagaacgaagagcacatccttagcttcgagaccatcgataagatgcgtcgggcctcttcctatagcagccttaattccctcatcggggtatctttcaactcagtttacactcagatatggcgtgtcttgctgcatctcgctgctgatccttaccccgaggtaagcgacgtcgctatgaaggttcttaatagcatcgcatacaaagctaccgtgaatgctaggcctcaacgtgtactggatacatcgtctctaactcagagcgcaccagccagccccacaaacaagggggtacacatacaccaggctgggggcagtcccccagccagttctacctcgagctcttctctcacgaatgacgtcgcaaaacaaccagtgtctcgcgacctgccatctggtcgtcctggaaccactggacctgcaggcgcccaatatactccacactcccaccaattccccagaactaggaagatgttcgataaagggcccgagcagaccgccgatgacgcagacgatgccgctggccataaaagttttatttccgcaaccgtacaaaccggattctgcgattggtcggccagatacttcgctcagcccgttatgaaaatccccgaggaacacgatctggagtcacagataaggaaagaacgcgaatggaggtttctgaggaattcccgggtgcggaggcaagcacagcaggtcatccagaaaggaattacccggctcgacgaccagatctttctgaatcgaaatcccggtgtgccatccgtcgtcaagtttcacccatttactccatgcatagctgtcgctgataaggattcaatttgtttctgggactgggaaaaaggagaaaaactggactacttccacaatggtaatcccaggtatactcgggtgaccgcgatggagtacctgaacgggcaagattgcagcctgttgctgactgctacagatgatggcgctatccgcgtgtggaaaaatttcgcagacctcgagaaaaaccctgaaatggtaaccgcttggcagggcttgtccgatatgttgccaacgacacgcggagccggcatggttgtggattgggagcaggagaccgggctgcttatgtcgagtggcgacgtgagaatcgtccgcatctgggacacggaccgtgagatgaaggtccaggacattccgactggggccgattcctgtgtgacaagtctgagttgcgattctcatcgctccttaatcgtggctggactgggcgacggatccattcgggtgtacgatcgtcgaatggctcttagcgaatgccgagtcatgacttaccgggagcatacagcctgggttgttaaggcctccctgcagaagcgccccgatgggcatatcgtatccgtcagcgttaacggggacgtacggatatttgatcctcggatgcccgaaagcgtcaacgtattacagattgtaaaagggttgacagccctcgatattcacccccaggctgatttgatcgcatgcggtagcgtaaaccagttcacagcaatttataactcaagcggagaactgattaataacatcaagtactacgatggcttcatgggtcagcgcgttggcgctattagttgtctggcctttcatccacattggcctcacctggcggtagggtctaatgactactacatatccgtatattcggtggaaaaacgggtgcgctag

SEQ ID NO: 202911 - DNA, 2097 bp, Artificial Sequence
  Description of Artificial Sequence: Synthetic coding sequence
atgcagaacagcgagggcggcgccgacagccccgccagcgtggccctcagaccctccgccgctgccccccctgtccctgcttcaccacagcgggtgctggtgcaagcagcctcatcgaaccctaagggagctcaaatgcagcctatttctctccctcgagtgcagcaggtccctcaacaggtgcagccagtccagcatgtgtatccagctcaggtgcaatacgtggaagggggcgatgcagtctacacaaacggggcaataaggaccgcgtatacctataaccccgaacctcagatgtatgccccaagcagcacagcgagctattttgaggcaccgggaggagctcaggtgacagtcgcggcctctagcccccccgccgtgcccagccatagcatggtcggaatcacaatggatgtgggcgggagccctattgtaagttccgctggcgcctatcttatccacgggggaatggattcgacgaggcatagccttgcccatacttccagatcttcccctgccaccctgcagtggctcctagacaactacgagaccgcagagggagtaagcctcccgcgttcaagcctctataaccactatctgcggcattgccaggaacataagctcgatccagtcaacgcggccagctttggcaaactcatccgtagtgtattcatgggcttgaggactcgccgcctggggacccggggaaacagcaaataccactattacggcatccggttaaagccggatagcccgttaaataggctgcaggaggacactcagtacatggccatgcgccagcaacctatgcatcagaagccaagataccggccggcccagaaaacggattccttaggggattccgggagccactcggggctgcattccacaccggagcaaaccatggccgttcaatcgcagcaccaccagcagtacatcgatgtgtcccatgtctttccggaattcccagcgcccgatttaggctccttcctcctgcaggacggggtgacactccatgacgtgaaagcactgcagctggtataccggcggcactgcgaagcgaccgtcgacgtagtgatgaacctgcagtttcattacattgagaagttgtggctcagtttttggaattctaaagctagcagtagcgacggacctaccagtcttccggctagtgacgaggatcctgaaggcgcagtgctgccaaaagataagctgatctctctttgtcagtgcgaccctattcttaggtggatgagatcatgcgatcacattctctaccaggcacttgtcgagatcttgatcccagatgtcctgagacccgtgccctctacattaactcaggctatacgcaatttcgcaaaatccctcgaaggctggctgactaacgccatgtccgattttccgcaacaggtgatacaaactaaagtgggagtagtcagtgctttcgcgcagaccctcaggcggtacacaagcctcaaccacctggctcaggcggcacgcgccgtgttgcagaatacttcccagattaatcaaatgctttccgatctcaatcgcgtggattttgcaaatgttcaggagcaagcttcttgggtctgccaatgtgaggagtccgtagtgcagaggcttgaacaggattttaaactcaccttacaacagcagtcttcccttgatcaatgggcctcttggttggacagtgtggttacacaagtcttgaagcagcatgccggatctccctcgtttccaaaggccgcacggcagttccttctgaaatggtctttttactcctccatggtgattcgcgatctgaccctgcggtccgctgcgtcgttcggctcatttcacctcatccgcctgctctatgacgaatacatgttttatcttgtagagcacagggtggccgaggccacgggggaaactcctattgccgttatgggcgaatttaacgaccttgcctcattaagtcttacgctcctcgacaaggatgacatgggcgatgagcaacgcggctccgaagctgggcccgacgccaggagtctcggggaaccacttgtcaaacgtgagagaagcgatccaaatcattctctgcaagggatctag

SEQ ID NO: 202912 - DNA, 2940 bp, Artificial Sequence
  Description of Artificial Sequence: Synthetic coding sequence
atggccacccaggcctacaccgagctgcaggccgccccccccccctctcagccaccgcaggcaccacctcaggctcaacctcaacctccaccacctccgccgccagcagccccgcaaccccctcagccaccgaccgctgcggcaactccccagcctcagtatgttactgaattacagtcgcctcagcctcaagctcagcctcctgggggacagaagcagtatgtaaccgaattacctgccgtgcctgccccttcacagcctactggggcgcctaccccatcacctgctccccagcaatacattgtggtaacagtatctgaaggcgccatgcgcgcttcagagaccgttagtgaggccagcccaggaagcaccgcatcacagacgggggttccgacccaggtggtgcagcaagttcagggaacacagcagcggcttcttgtgcagacttccgtacaggccaagcctggtcacgtgtctcccctccagcttacaaacatccaggtgccacagcaggcactcccgactcagagactcgtggtgcagtccgccgctcctggatcgaagggcggccaggtatcactgaccgtgcacgggacccaacaggtccactcgccacctgaacagtctcccgtgcaggcaaattctagctctagcaaaacagccggcgctccaactggaaccgtgccacagcagctgcaagttcatggtgtccagcagtccgtgcccgtgacacaggaacgctctgttgtgcaggctaccccccaggctcctaagcccggacccgtgcagccccttaccgtgcagggcctgcagcccgtacacgttgcccaggaagtgcaacagctccagcaagtcccagtgccccacgtgtattcctcccaagtgcaatatgtcgagggcggcgacgcaagttatacagcatcagccatacgttcctcaacctactcctaccccgaaacccccctctacacccagaccgccagcacatcatactatgaggcagctggaaccgcgacacaggtcagcacacccgccactagccaagcagtggcgtcaagcggaagcatgccaatgtatgtgtccgggagccaagtggtggcttctagcacctcaaccggagctggggctagcaatagctccggcggtggcggatcagggggcggcgggggcggcggcggaggaggagggggggggggctcaggtagtacgggaggtggcggttcaggcgctggaacctacgtgattcagggaggttatatgttgggctcagcctcccagtcttattctcacacgacaagggcatcacctgctactgtgcagtggctcttggacaattatgagaccgccgaaggcgtgagcctgccccgctcaactctttattgccattatttgctgcactgccaggaacagaagctggagcccgtcaatgcggcttctttcggaaaactgattaggtctgtgttcatgggcctcagaactagacgcctgggcacaaggggaaacagcaaatatcattactatgggctgcgtatcaaggcctccagtccccttctgcgccttatggaggatcagcagcatatggcaatgcgggggcagccattcagtcagaaacaacgactcaaacctatacaaaaaatggaagggatgacaaacggtgtagctgtgggccaacagccttcaactggactttcagatattagtgctcaggtccagcagtaccagcaatttctggacgctagcagatctctcccagattttaccgaactcgacctgcaggggaaggtgctgcctgaaggcgtgggcccgggggacatcaaagcttttcaggtgctgtatcgggagcactgcgaggctattgtcgacgtgatggttaatctgcaattcacattagtagagacgctgtggaaaacgttttggaggtataatttatcacagccttcagaagccccaccgctcgccgtccatgacgaggccgaaaaaaggctgcccaaagcaattctcgtcttgctgtcgaagttcgaacctgttctgcagtggacgaagcactgcgacaacgtgctctaccagggcctggtggaaatcctgataccagatgttctgagacccatcccttccgcactcacccaggccatcaggaattttgccaaaagcctagaaagctggctgacccacgccatggtgaacatacctgaggaaatgctgagggttaaggttgctgccgccggggcttttgctcagaccctgagaaggtacacctccctcaaccatctggctcaagctgctcgggccgtgctccagaataccgcccagatcaaccagatgctcagcgacttgaacagggtagacttcgcaaacgtccaggagcaggccagctgggtctgtcgttgtgaggacagagtggtacagaggctggaacaagacttcaaggtgacactccagcagcaaaattccttggagcagtgggccgcctggctagatggagttgtgtcccaagtgctgaagccatatcagggatccgccggcttcccaaaggcagccaagctctttctgctcaagtggtctttctacagttctatggtaatcagggatctgaccctgcgttctgcagccagttttgggtcttttcatctcatccggttactttacgacgagtatatgtattacctgatcgaacatagagtcgcacaggccaagggagagacccctatagcagtaatgggcgagtttgctaatctcgccacgagcttgaaccctctcgacccagataaggacgaagaagaggaggaggaagaagaaagcgaggacgagctcccgcaggacatctccctcgccgcaggcggcgagagccctgccttggggccggagacattagaaccaccagcgaagctcgccaggacagatgccagaggactcttcgtccaggccctgccttcttcttag

SEQ ID NO: 202913 - DNA, 2172 bp, Artificial Sequence
  Description of Artificial Sequence: Synthetic coding sequence
atgcagaacagcgagggcggcgccgacagccccgccagcgtggccctgcgtccatctgcagccgcccccccagtacctgcttccccacaaagggtgctcgtgcaagcggcgagttctaatcctaagggcgcccagatgcaacccatttccttacctcgtgtgcagcaggtccctcagcaggtccagccggtgcaacatgtttatcccgcccaggttcagtacgtcgaggggggtgacgcggtttacacaaatggcgccatccgtaccgcttacacctataatccagaacctcaaatgtacgcaccatcttcgacagccagttattttgaggcccctggaggcgcccaggtgacggtcgccgcatcaagtcctcccgccgtgccctctcacagcatggtggggattactatggacgtcggcgggagccccatcgtaagcagcgctggtgcgtacttaatccacggggggatggactcaacaaggcattcacttgcacatacctcccggagctctccggccacattagagatggcaattgaaaatttgcagaagtcagaagggatcacctctcataagagcggattacttaactcccacctgcagtggctgctggataattatgaaactgcggagggagtgtccctccccaggagctctttgtacaaccactatttgagacattgtcaggaacacaaactggaccccgtcaacgctgccagtttcggtaagctcattcgtagcgtgttcatgggtctgcgtactagaaggttgggcaccagaggaaacagcaaataccactactatggaatacgactgaagccagactcgcccctgaataggctgcaagaggatactcagtacatggcaatgagacagcagcccatgcaccagaaacctaggtaccgcccagcgcagaagacagattccttgggtgacagcggctcacattccggtcttcattccactccggaacagaccatggcggtccaatcacagcaccatcagcaatacatcgatgtgtcccatgttttccccgaatttcctgcacccgacttaggcagtttcctgctgcaggacggcgtgaccttgcacgacgtgaaggcgcttcagctggtttaccgacgacactgcgaagccacagtcgatgtcgtgatgaacttacagttccattatatcgagaagctgtggctgagtttctggaacagcaaggcgagttcaagcgacggacctacttccctgcccgcttccgacgaggatccggagggtgcagtcctcccaaaagacaagctgatcagtctctgtcaatgtgaccctattttgaggtggatgaggtcatgcgaccacatactgtatcaggcccttgtcgaaatcttaatccctgacgtgctgagacccgtgccctcaaccctgacacaggccattcgtaattttgcgaagagtctagagggatggctgacaaatgcaatgtctgacttcccccagcaggtgattcaaacaaaggtaggtgtagtatcagccttcgctcagactctgagacgctacacgtccttgaaccatctagcccaggcagcgagagccgttcttcagaatacaagccagatcaaccaaatgctctcagacctcaacagagtagacttcgcaaatgtccaggaacaggcctcatgggtgtgtcagtgcgaggaaagtgtcgttcaaaggcttgagcaggactttaagctcaccctgcagcagcagtccagcttggatcagtgggctagctggttagactccgtcgtgacccaagtgttaaagcagcatgcagggagtccctccttcccaaaggctgcgcggcagtttttgcttaaatggtctttctactcatctatggtgatacgtgacctgactctgcgcagtgctgcttccttcggctcattccacctcataagacttctgtatgacgaatatatgttttacctggttgaacacagagtcgccgaggccaccggagagacaccaatcgctgtgatgggagagttcaatgatctggcatctctgtccctgactctcttggataaggacgacatgggggatgagcaaaggggaagtgaggcgggtcctgatgcaagatcactcggtgagcccctagtgaaacgggagagatcggaccctaatcacagccttcaggggatctag

SEQ ID NO: 202914 - DNA, 2097 bp, Artificial Sequence
  Description of Artificial Sequence: Synthetic coding sequence
atgcagaacagcgagggcggcgccgacagccccgccagcgtggccctgcgcccctccgcagccgctccacctgtccccgcgtcaccacagcgggtgctagtgcaagccgctagcagcaatcccaaaggagcgcaaatgcagcccatttccctgccaagagttcagcaggtacctcaacaggtgcaacctgtgcagcatgtctacccagctcaggtgcagtatgtcgagggcggcgatgctgtgtatacgaatggggcgattagaactgcgtatacttataaccccgaaccccaaatgtatgctccaagttctacggctagttactttgaggctcccggcggcgcacaagtgacggtagccgccagttcccctcccgcggtcccctcgcactcaatggtgggaataacaatggacgttggaggtagccccattgtgtcctcggccggcgcctaccttatccatggcggcatggacagtacacgtcattccctcgcacacacctccagatcctcccctgccacacttcagtggcttttggacaactatgaaaccgccgaaggggtcagtctcccacggtcttccctgtacaaccattatctgcggcattgccaggagcataagctggaccctgtcaacgctgcttcattcggcaagctaattcggagcgtcttcatgggtcttcgcacccgaaggctgggtacccgaggaaatagtaagtaccactattatggtattaggcttaagccagacagtccccttaacaggctgcaagaagatactcagtacatggctatgcgtcagcaacccatgcaccagaaacctagatacagacccgcacagaaaacagattcactgggggattccggcagccactctggcctgcacagcaccccggagcagacgatggccgtccagtctcagcaccaccagcagtacatcgacgtaagtcacgtttttccagagtttcctgcccctgatcttggcagtttcctgttgcaagatggcgtgactctgcacgatgtgaaggctcttcagctggtgtatcgtaggcattgcgaggccactgtcgatgtcgttatgaacctgcagtttcattatattgagaaactgtggctgagcttctggaactctaaggccagcagctctgatggacctacttccctgccggcaagtgacgaggatccggagggtgccgtgctgcccaaggataagctgatctccctgtgtcagtgtgaccccatcctgcggtggatgaggagctgtgaccacatcttatatcaggcgctggtggagattctcatccccgatgtgctacggcccgtcccctctaccttaactcaggccatccggaacttcgctaaatctcttgaaggatggttaacaaacgcaatgtctgatttccctcagcaagtcatccaaacaaaggtgggagtggtgtccgcctttgcgcagaccttgcgtaggtatacatccttgaaccatctggcccaagcagcgcgagccgtcctccaaaacacgtcccagattaatcagatgcttagcgatctaaatcgcgtggacttcgccaatgtgcaggaacaggcgtcttgggtgtgccagtgtgaggaaagcgtggtacaaaggctcgaacaagactttaagctcaccctccaacagcaaagctctcttgatcaatgggcctcttggttagattctgtcgtgactcaggtcctgaaacagcatgccggttctccaagttttcctaaagctgcaaggcaattcttgctcaagtggagcttttattcttctatggtgatccgcgatctcaccctgcggtccgccgcctcttttgggtccttccatctgatcagactgctatacgatgaatacatgttttatttggtggaacacagggtcgccgaggcaaccggggagactccaatagcagtgatgggcgaattcaatgatctcgcatccctctcactgacactgctcgataaggacgatatgggagacgagcagaggggaagcgaagccggtcccgacgcgcggtctctcggcgagcccctagtaaagcgagagcgatccgaccctaaccacagcctgcagggcatttag

SEQ ID NO: 202915 - DNA, 1851 bp, Artificial Sequence
  Description of Artificial Sequence: Synthetic coding sequence
atggccgaggacgagcccgacgccaagagccccaagaccggcggcagggctccgccaggaggcgcagaagcaggtgagcctacaaccctgctccaacgcctgagaggcactatctccaaggccgtgcagaataaagtagagggtatccttcaggatgtgcagaagttttcggacaatgataagctttatctgtatctgcagttaccctcaggcccaaccacgggcgataagtcaagcgaaccctccaccctgagcaacgaggagtacatgtatgcatacagatggatcagaaaccatctcgaggaacataccgacacatgtctccccaaacagagtgtgtacgacgcataccggaagtattgtgagagtcttgcttgttgtcgccccctgtccaccgccaattttggaaaaatcatccgggagatctttcccgacatcaaagcacgaagattgggcggccgggggcagtccaaatactgttatagcggtatcaggcggaagactttggtgagcatgccgcctttaccgggcctggatctgaaggggtcagagtctcccgagatgggaccagaagttactcctgcccctcgcgacgagcttgtggaggctgcctgtgctcttacgtgcgattgggccgaaagaatactgaaacgctctttctcctcaatcgtggaggtggcgaggtttctgctccagcagcacctcatcagcgcccgctctgcacacgcacatgttcttaaggcaatggggctggcagaagaggatgaacatgctccacgggagagatctagcaagccaaagaatggactggagaaccccgagggcggagcgcataaaaagcccgagagattggcgcagcccccaaaggatctcgaggcaaggacaggagcagggcctctggctcgaggtgaaaggaagaagagcgtagtggagtcctcggctcctggggcgaataatttacaggtgaatgcactcgtggccaggttgcctctcctgctgcctagagcccccagatctctgatccctccaatccctgtatcgcccccaattttagcccccaggcttagcagcggagccctgaaggtggcaaccctcccgctgagctcgagagctggtgccccaccagccgcagtgcccattataaacatgatcctcccgacagtgccggccctgccaggcccagggcccggccctggtcgcgcccctcccggaggcttgacccaaccccgagggaccgaaaatcgcgaggtgggaatcggcggagaccagggccctcacgacaagggcgttaagcgcaccgctgaagtccctgtgagtgaagcttctggacaggcaccccctgccaaggctgcgaagcaggatatagaggatacagccagtgacgccaagaggaaacgaggccgcccacgcaagaaaagcggcggcagtggcgagcgtaactctaccccccttaagtctgccgccgctatggaaagtgcacagagcagccggctcccttgggagacttggggatccggaggcgaaggaaattccgccgggggcgccgagagaccaggcccaatgggcgaagctgaaaagggagcagtcttggcccagggacagggtgatggaaccgtctcaaagggtggccgcggtccaggatctcagcacaccaaggaggccgaagacaagattccgctggtgccttccaaggtgagcgtgatcaaggggagcaggtctcagaaagaggcttttccccttgccaagggggaggtcgatacagcccctcaaggtaataaagacttgaaagaacatgtgctgcagagctctctgtcccaggagcataaagaccctaaggctactcctccttag

SEQ ID NO: 202916 - DNA, 1851 bp, Artificial Sequence
  Description of Artificial Sequence: Synthetic coding sequence
atggccgaggacgagcccgacgccaagagccccaagaccggcggcagggcgccgcccggtggcgctgaggcgggcgaacccactaccctccttcaacgtctgaggggaacgattagtaaagctgtgcagaacaaggtggaaggcattcttcaggatgttcaaaaattttccgacaatgacaaactctacctgtatctccagctgccatccggtccaacaactggcgataagtccagcgaaccctccacactctccaacgaagagtacatgtacgcataccggtggattaggaatcacctcgaggagcataccgacacctgtctgcccaagcagtccgtctatgacgcatataggaagtactgcgagtccctagcctgttgccggcccctgagcaccgcaaacttcggtaaaattatacgggaaattttccctgatataaaggcccggcgcttaggcggccgggggcagagcaagtattgttattccgggattaggcgaaagaccctggtgtccatgcctccactgccaggactcgacttgaaaggcagcgagtcccctgagatggggcctgaggttacacccgcgccccgggatgaattggttgaagcggcctgcgcactcacatgcgactgggccgagaggatactgaagcgatccttcagtagcatcgttgaggtggcaaggtttctgttgcagcagcatctgatctctgccagatctgctcacgcccatgttctcaaggcaatggggctggccgaggaagacgagcacgccccaagggagagaagctctaaaccgaaaaacggcctcgaaaacccagaaggaggcgcccacaagaagcccgaacggttggctcagccccccaaggacctggaggctcggaccggggctggacccctggcccgcggcgaaaggaagaaaagcgtcgtcgaatccagcgcccctggggccaacaacctgcaggtgaatgcgttggtggccagactcccgttgctgctgccccgggccccccgctcactcattcctcccattcctgtgagtcctccaatcctggcgccacggctgtcttctggagccctgaaagtggccaccttgccattgtcgtctagggcgggcgctcctcccgccgcagtgccgattataaacatgatcctacccacagtccctgcccttccagggcccggccccggaccgggacgcgcccctcctggggggttgacccaaccccgcggaaccgagaacagggaagtcgggatcggtggagatcaagggccccacgataaaggagtgaaaaggactgccgaggtgcctgtgagcgaggcaagtgggcaagctcccccggcaaaggccgccaagcaggatatagaagacaccgcctctgatgctaagcgtaaacggggccgcccccgtaaaaagagtggaggtagtggagaacggaactccacgccactgaagtcagcagcagctatggagagcgcacaaagctcacggctaccatgggaaacctggggaagcggaggggagggcaactccgccgggggagccgaacgccccgggcccatgggggaggcagaaaagggcgctgtcctggcacagggccagggagatggcaccgtctcaaaaggaggccgtgggcccggctcccaacacaccaaggaggccgaagacaagatcccccttgtgccctctaaggtgtcagttatcaagggttctagaagccagaaggaggccttcccgctcgctaaaggcgaagttgacacagccccccagggaaacaaagatttaaaagagcacgtcttacaaagctcactgtcccaggaacataaagatccgaaggccactcctccatag

SEQ ID NO: 202917 - DNA, 1791 bp, Artificial Sequence
  Description of Artificial Sequence: Synthetic coding sequence
atggccgaggacgagcccgacgccaagagccccaagaccggcggccgcgcgccccccggcggagccgaagccggagaacctacaactctacttcagcgattgcgaggcaccatctcaaaagcagtccagaataaggtggaaggcattctgcaggacgtacaaaagtttagcgacaacgataagctgtacttatacctgcaactaccatctggtcctaccactggcgacaagagcagcgagccctctactctgtctaacgaggaatacatgtatgcttataggtggatccgaaatcacctagaggagcacacagatacatgcctacccaaacaaagcgtctacgacgcttaccggaagtactgcgagtcactcgcttgttgtcggcctcttagcacggcgaactttggcaagatcatcagagagatatttcccgatataaaggcgcgaagactgggaggtcgtggtcagagcaagtactgctattccggaattcgcaggaaaactctcgtatcaatgccaccattacccggtctggatctcaaggggtccgagtctccagaaatgggtccagaggtaactccggccccgcgagacgaacttgtggaagccgcctgtgcattaacgtgtgactgggcagaaagaatcctgaaacgaagctttagttctatcgtggaagtggctcgattcttgctgcagcaacacctgatcagcgcaagaagtgcccacgcccacgtgctcaaggccatgggactggcagaggaggacgagcatgctcccagagagagatcctcgaagccaaagaacggattggaaaacccagaagggggagcacacaagaagccagaaaggctggcccaaccgcccaaggacttggaagcccggacaggagcaggcccactcgcccgaggggagcgaaagaaaagcgttgtagaaagtagcgccccaggcgccaacaacctccaggtgaacgcgctcgttgccagactgcctctgctgctgccccgagctccccggagcctgatccctcccatacccgtctctcccccaatcctggctcccagattgagttcaggtgccctgaaggtggccactctaccactgagctcaagagccggcgctccccctgccgccgtccctattattaacatgattctcccaaccgtacccgccctgcccggaccaggacccgggcccgggagagcacctcccgggggcttaacacagccaagaggaacagaaaacagagaagtgggaatcggaggcgaccaaggccctcacgacaaaggtgtaaagcgcacagccgaagtccccgtttccgaggcaagcggacaggccccccccgccaaggctgccaagcaagatatagaagacacagctagtgatgccaagcggaagcgggggaggcctagaaagaaaagcggcggatcaggagagcgaaactccaccccgctcaagtcagcagctgcaatggagtccgctcagtcctccaggctgccttgggaaacatgggggtccgggggcgagggaaattcagccgggggggcagagcgtcccgggcctatgggagaagccgaaaaaggtgctgtcttagcacaggggcagggcgatggcacagtatcaaagggaggcaggggcccagggtcacagcacactaaggaggcggaggataagattcccctggttccaagtaaggtatcggtaataaaaggtagtcgctcacaaaaagaagcctttccacttgccaagggtgaggtggacacagcaccacaggggaacaaagatctgaagtag

SEQ ID NO: 202918 - DNA, 357 bp, Artificial Sequence
  Description of Artificial Sequence: Synthetic coding sequence
atggccgaggacgagcccgacgccaagagccccaagaccggcggccgcgcccccccaggcggtgctgaagccggcgaaccgacaaccctgctccagaggctccggggcactatctccaaagccgtccagaacaaggttgagggcattttacaggatgtacaaaaattcagtgacaacgacaaactttatctgtatctgcaactgcctagtggacccaccaccggcgataaaagtagtgagccgagcaccctcagcaacgaggagtacatgtatgcctacaggtggattcggaaccatcttgaagaacataccgacacatgccttcctaagcagtcagtctacgatgcctaccggtag

SEQ ID NO: 202919 - DNA, 693 bp, Artificial Sequence
  Description of Artificial Sequence: Synthetic coding sequence
atggccgaggacgagcccgacgccaagagccccaagaccggcggccgagctccacctggtggagccgaggccggagagccaactacgctactccagcggctgaggggcaccatttccaaggccgttcagaacaaggtcgagggtatactccaagacgtacagaaattcagtgataatgacaaactctatttgtacctccagctgcccagcggccccacaaccggcgacaaaagctcagagcctagcaccctgtccaatgaagagtatatgtatgcctacaggtggattaggaatcacctagaggaacataccgatacttgtcttccaaaacaaagcgtttacgacgcctatcggaaatactgcgaaagtcttgcctgctgccgccccctgagcacagcaaactttggcaagattatcagagaaatttttcccgacattaaagcaagaaggctcggaggacgaggccagagcaagtattgctatagcggtatccgaaggaaaacccttgtctcaatgccccctctcccaggcttggatctaaagggcagcgagtcacccgagatgggccctgaggtcacaccggccccccgtgatgaactggtagaagcagcatgcgccctgacgtgtgactgggccgagcgaattctgaagcgctcttttagctcgattgtcgaggtggctagatttctgtag

SEQ ID NO: 202920 - DNA, 372 bp, Artificial Sequence
  Description of Artificial Sequence: Synthetic coding sequence
atggccgaggacgagcccgacgccaagagccccaagaccggcggccgggctccacccggtggtgctgaggctggagaaccgaccactctgctacagagacttagaggcaccataagcaaagcggtgcaaaataaagtagaggggattctgcaggatgtacagaagttctcagataacgacaagctgtatctgtacctgcagcttccatcgggacctacaacgggggataaaagcagtgagccctctaccctctcaaatgaggagtatatgtatgcctaccgctggatacgcaaccacctggaggagcatacagacacatgtttgccgaagcagagcgtgtacgatgcatacagaaaatattgtgagtcatag

SEQ ID NO: 202921 - DNA, 291 bp, Artificial Sequence
  Description of Artificial Sequence: Synthetic coding sequence
atggccgaggacgagcccgacgccaagagccccaagaccggcggcagggccccgccggggggggctgaggcaggggaacccactaccctgctccagaggctgcgtggcacaatcagtaaggctgttcaaaataaagtagaagggatccttcaggatgtgcagaagttttcagacaacgataagctctacctatatttgcaacttccaagcggccccacaaccggcgacaaatccagtgaaccttcaacactatcgaatgaggagtatatgtatgcttacagatggatctag

SEQ ID NO: 202922 - DNA, 321 bp, Artificial Sequence
  Description of Artificial Sequence: Synthetic coding sequence
atggccgaggacgagcccgacgccaagagccccaagaccggcggcagagccccccccggaggagccgaagcgggagagccaaccacattgctgcagcgcctgcgagggacaatctcaaaggccgtgcagaacaaagtggagggcattctgcaggatgtacagaaattttcggacaacgataagttgtatttgtatttgcaattacccagcggccctactactggcgataaatcctctgagccttcgaccctgtctaatgaggagtatatgtatgcgtacaggtggatccgaaatcacctagaagagcacacagacacctag

SEQ ID NO: 202923 - DNA, 555 bp, Artificial Sequence
  Description of Artificial Sequence: Synthetic coding sequence
atggccgaggacgagcccgacgccaagagccccaagaccggcggcagagcccctcccgggggggccgaagctggagaacccactacattactgcagagacttagaggcaccatctcgaaagccgtccagaataaagtggaagggattttgcaagatgtgcagaagttttctgataacgacaagctttacctctacctgcagctccccagtggacctactacaggcgataagtctagtgaaccaagtaccttatccaatgaagaatacatgtatgcttacaggtggattcgaaaccatcttgaagaacatacggacacatgcctcccaaagcagagcgtgtacgatgcctacagaaagtattgcgagtcccttgcatgttgcaggcccctctccactgccaacttcggtaagattattcgggagatatttccagatatcaaggcacggaggctgggcggtagggggcaatctaagtactgctacagcggcatccgccgcaagactctggtctccatgcccccgctgcccgggttggatctgaagggatctgagtag

SEQ ID NO: 202924 - DNA, 1731 bp, Artificial Sequence
  Description of Artificial Sequence: Synthetic coding sequence
atggccgaggacgagcccgacgccaagagccccaagaccggcggcagagctccgcctgggggagccgaggccggagagccaacaactctcctccagcggcttaggggtacaatcagcaaggccgtgcagaacaaggttgagggcattctgcaggatgtgcagaaattttcagataatgacaaactctatctctacttacaactcccatccggcccaacgactggggataaaagaaagtattgtgagtctctcgcttgttgcaggcctctgagtaccgcgaactttggaaaaatcattcgagaaatcttccctgacatcaaagcacgtcggctgggtgggagagggcagtctaagtattgctactccgggattcggcggaaaactctggttagcatgcccccactgccagggttggacttgaaggggagcgagagccctgaaatgggccctgaagtaaccccagcgccacgcgacgagttggtagaggctgcgtgtgccttgacatgtgattgggcagagcggatcctgaaacgaagcttcagtagcatagtggaggtggctcgctttctcctgcagcagcacctgatttctgccaggtccgctcacgcccatgtgctaaaggccatggggctggccgaggaagacgagcacgcccccagggaacggagtagcaagccaaagaatggtctggagaatcctgagggtggcgctcacaaaaaacctgagcggttggcacaacctcctaaggatttggaagcaaggactggcgcaggtcctttggcaagaggcgagagaaagaagagcgtggttgaatcctcagcccccggggccaacaacctccaggttaatgccctggtcgcccgtctgcctctgctgctgcctcgggctccacgttctctgattcctccaattcccgtcagtcctcccatccttgccccccggctgtctagcggtgcccttaaagtggcaacactacccctctcttcgagagcaggagcaccaccagctgctgtaccaataatcaatatgatcctgcctacagttccagccctgcctggccccgggcccggtccgggccgcgctccccccggcgggctgacccagccccggggaacggagaaccgcgaagtagggattggcggcgatcaagggccccatgacaaaggcgtaaagcggacagctgaagtgccggtaagcgaagcttccgggcaggcacctcccgcgaaggcagctaagcaggacattgaggatacggcctcagatgccaagcgaaagcggggcaggcccaggaagaagtccggtgggagcggcgaacggaactcgactcctctgaaaagcgccgccgccatggaatcagcacaatcctccaggctgccctgggagacttggggttccgggggggaggggaatagcgccggaggggcagagagaccaggccctatgggcgaggcagaaaaaggcgcagtgctcgctcaggggcagggggacgggacggtctccaaaggaggtagaggtccggggtcccagcatacaaaggaggctgaggataagatcccattggtgccttcaaaggtgtctgtaataaaaggaagtcggagtcagaaggaagctttccctcttgccaagggagaggtcgataccgcaccccagggcaataaggatctgaaagagcacgtgcttcagagcagcctttcacaggaacacaaggatccaaaagccactcctccatag

SEQ ID NO: 202925 - DNA, 1851 bp, Artificial Sequence
  Description of Artificial Sequence: Synthetic coding sequence
atggccgaggacgagcccgacgccaagagccccaagaccggcggccgagccccaccaggcggcgctgaggccggagaaccaaccactctgttgcaacggctgagaggaactattagcaaggccgtccaaaacaaagtcgaagggatccttcaggacgtgcagaagttctctgacaatgacaaactgtatttatacctgcagctaccatctggtcccaccacaggtgacaagtcaagcgaaccgtccaccctgtctaacgaggagtatatgtatgcatacagatggattcgcaatcaccttgaggagcacactgacacttgccttccaaaacaatcagtctacgatgcgtacagaaaatattgtgaatctctggcttgctgtcgtccactgtccaccgccaattttggcaagataatccgggagatcttcccagacatcaaggccaggagactgggaggccgcgggcagtcaaagtactgctatagtggcataaggaggaagactctggtgtccatgccccccttgcccggcctcgacctgaagggtagtgagagccccgaaatgggcccagaggttaccccagcacctcgggacgaactggtggaagccgcatgcgcccttacatgcgattgggccgagagaattttgaagagaagcttcagctcaatcgtcgaggtggcacggtttcttctccagcagcacctcatttcagcacggtccgctcatgcgcacgtgcttaaagctatgggtctcgctgaggaggacgagcatgccccccgggaaaggtcttctaagcctaagaacgggttggagaatccggaagggggcgcccataaaaagcccgaacgccttgctcagccacctaaagatttggaagccaggacgggggccggaccactcgcgcgcggcgagagaaaaaagtccgtggtggaatcaagtgcaccgggtgcgaataacctacaggtaaacgcactcgtggcccgactgcccctccttttacctcgcgccccgcggtccttgattccccccattccggtaagccctccgattctggctccaaggctttcttccggggcactcaaggtggcaaccctgccgttgtcgtcccgcgcaggcgcacccccggcagccgtaccgattattaacatgatcctcccaactgtgcctgccttgcccggccctggccctggtcctggccgggccccaccaggaggcctaacgcaacctagaggcaccgagaatagagaggtgggcatagggggggaccagggccctcacgataaaggagtcaagcgcactgccgaggtacctgtctctgaagcctccggccaggctcctcccgcaaaagctgccaaacaggacattgaagatactgcatcagacgctaagcgaaagcgtggccgtccacgaaagaagtcaggagggagtggggagcgcaatagcacacccctgaaaagcgctgccgcaatggagagcgctcagagctccagactcccatgggagacatggggcagtgggggcgagggaaacagcgccggaggcgcggagagacccggacccatgggcgaagccgaaaaaggcgctgtgctggcgcagggtcagggtgatggcacagtgagcaaagggggaagaggacctgggtctcagcacactaaggaggcagaggataaaattccgcttgtcccttccaaggttagcgtgatcaagggtagtagaagccagaaagaggcattccccctggcgaaaggggaggtcgacacagccccacaaggcaataaagatctgaaagaacacgtgctccagtcatccttgagccaggagcataaagatcccaaggccaccccaccctag

SEQ ID NO: 202926 - DNA, 498 bp, Artificial Sequence
  Description of Artificial Sequence: Synthetic coding sequence
atggccgaggacgagcccgacgccaagagccccaagaccggcggccgcgcccctccaggcggggcagaggccggagaacctacgacccttctgcagcgacttagggggacgatatccaaagccgtgcaaaacaaggttgaggggattctgcaagatgtacagaagttctccgataatgacaagctatatctgtatctgcaattaccatccggccccactacaggggacaaatcttccgagccctctactctttccaatgaggagtacatgtatgcgtaccggtggattagaaatcatctcgaagagcataccgatacctgtctccccaagcagtcagtgtacgatgcatataggaaatactgcgagagccttgcttgctgtaggcctctgtccacggccaactttgggaagattattcgtgaaatctttcccgacattaaggcaaggcgactgggaggccgtggtcaaagtaaatattgctatagtggcattcgttag

SEQ ID NO: 202927 - DNA, 2787 bp, Artificial Sequence
  Description of Artificial Sequence: Synthetic coding sequence
atggccaaggtgcccgagctggaggacaccttcctgcaggcccagcctgcaccacagctcagtcctgggatacaggaagactgctgtgttcagctgctgggcaaaggtttactcgtctaccctgaggagacagtgtacctcgccgcggaggggcagcccggcggcgagcagggcggaggagagaagggagaagacccagagctacccggggcagtcaaaagtgaaatgcacctgaataacggcaacttttcgtccgaagaagaggacgctgataatcatgacagtaagactaaggccgctgatcagtacctctcgcagaaaaagacaataacgcaaatcgtgaaagacaagaagaaacagacccagctgacactacagtggttggaggagaactacatagtgtgtgaaggcgtttgtttgccacgttgcatcctgtacgctcattacctcgatttctgcaggaaggagaaacttgagcctgcatgcgcagccacctttggaaagacaattagacagaagtttccgctgttgactacgcgacggctcgggacaaggggacactctaaataccattactacgggattggcattaaagagagcagcgcatactatcactctgtgtatagcggtaagggacttactaggttttctgggagcaaacttaagaacgaaggcggctttactcggaagtatagcctgagcagtaagacaggcacccttctgccagagtttccctcagctcagcatctggtgtaccagggctgcatctccaaagacaaagtggacacccttattatgatgtataaaacccactgccagtgcattctagataacgctatcaatggtaattttgaggaaattcaacactttttactgcatttttggcagggcatgcctgatcatctcctgcctctgctggaaaaccctgtgatcattgatattttctgtgtgtgtgattcaatcctttacaaagtccttacggatgtgctaatcccagctaccatgcaagagatgcccgagtcactgctggctgatatacggaacttcgcaaaaaattgggagcaatgggtcgtgagctctcttgaaaacctcccggaagccttgactgataagaagattcccatcgtgaggcggttcgtgagttctttgaagaggcaaacaagctttttacatctagctcagatcgcccggcccgccctattcgatcagcatgtcgtgaacagcatggtctctgatatagagagggttgacctgaactccattggctctcaggctctcttaacgatatcaggtagtacagacaccgagtcagggatctatacagagcacgacagcataaccgtctttcaggagcttaaggacctccttaaaaagaacgctacggttgaggcctttatcgagtggcttgacacagtggtcgagcagcgcgtgattaagacatccaagcagaacggtaggtcgctaaaaaagcgcgcccaggatttcctgctgaaatggagcttctttggggcccgagtaatgcacaacctgactttgaacaacgcaagttcgttcggttccttccaccttattagaatgctacttgacgagtacatccttctagcaatggaaacccaatttaataatgacaaagagcaggagctgcagaacttgttagataaatacatgaaaaattccgatgctagtaaggcagcctttacggccagcccctcctcttgttttctggccaatcgaaacaagggctcaatggtcagtagcgacgcggtgaaaaatgagagccacgttgaaaccacgtacctgccacttccatcttctcagccgggcggactcggacctgctctccaccagttccctgccggcaacaccgacaatatgcccctcaccggacagatggagctttctcagatcgctggacatttaatgacacctccaatttctccagcgatggcatctagaggctctgtcatcaatcagggtccaatggcgggcaggccgccatcagtgggccctgtcctttcagcaccgtcccattgcagcacctaccccgagcccatttaccccaccctgccacaggcgaatcacgacttttatagcaccagctctaattaccagaccgtgttcagagcacagccccacagcaccagtggtctgtacccccatcacaccgagcacggtcggtgcatggcttggactgagcagcagctgtcaagggactttttctcgggaagctgtgcgggttcgccatacaatagcaggccccctagtagttacggcccttcactgcaagcccaggattctcacaacatgcagttcctgaataccggctccttcaacttcttatctaatactggcgccgcctcttgtcagggggctacactgccgcccaacagtcccaacggatactacgggtccaacataaattatcccgaaagccacaggctgggctccatggttaatcagcacgtgtcggttatttccagcatccggtcactccccccatacagtgatattcatgacccattgaacattctcgacgactcaggacggaagcagacctcatcattctacaccgatacttcgtctccagtggcatgccgcactccagtcctcgcgtcctccctgcagactccaattccttcaagtagctcccagtgcatgtacggcacctcaaatcaatatcctgcgcaagagacactcgactcacacggaacctcctccagggagatggtgagctcactgcccccaattaacacggtctttatgggcacggccgcaggagggacgtag

SEQ ID NO: 202928 - DNA, 4122 bp, Artificial Sequence
  Description of Artificial Sequence: Synthetic coding sequence
atggccgaggagcagcagcagccccccccccagcagcccgacgcccatcagcagttgccgccttcagcaccaaacagcggcgtggctctgcccgccctagtgcctggcctccctggcacagaggcatctgccctgcaacataaaatcaaaaacagcatttgcaagaccgttcagtctaaggtggactgcatcttgcaggaagtggagaaattcactgatcttgagaagctatacctgtatctccagcttccctccggcttgtcgaatggggagaaaagtgaccaaaacgcaatgagctcgtcccgcgcgcagcagatgcatgcctttagttggatccgcaacacattggaggagcatccagagacttccctcccaaagcaagaagtgtatgacgaatacaaatcctactgcgacaatctcggctaccatcccctgagtgcagctgattttggaaaaatcatgaaaaatgtgtttcctaacatgaaggcacggcggctcgggactagaggaaagagtaaatattgctatagtgggttaagaaagaaagctttcgtgcatatgccgacgctccccaacctggatttccataagactggcgacggcctggagggcgctgagccgtccggccaacttcagaacatagatgaagaggtgatctcaagtgcctgtcgtcttgtttgcgagtgggcacagaaagtgctttctcaaccgttcgacaccgtgctagagttagcccggtttttggtcaaaagccactacattggtacaaaaagtatggctgccctaaccgtgatggcggccgcccccgcaggcatgaagggtattactcagccctctgcctttatcccaactgccgagtcgaattcatttcagcctcaggtaaagaccctgccatctcctatcgacgcgaaacagcagctccagagaaaaattcagaaaaaacagcaagagcagaaacttcagtcacctcttcctggtgaatccgcagcgaaaaagtctgagagcgcaacgtccaacggggttactaacctacccaacggcaatccatctatactgtcacctcaaccgatcgggattgttgttgcagctgtcccatcacccataccagtccagagaaccagacaactggtgaccagcccctctcctatgtcatccagcgatggcaaagtgttgccattgaacgtgcaggtcgttactcagcatatgcagtccgtcaagcaggcccccaagactccacagaatgtgcctgcctctccaggaggggatcgcagcgcccgccataggtatccacagatccttccgaaacccgccaacacatcagccctgaccattcgaagcccgacgactgtccttttcacatcctcccccatcaaaactgccgtcgtgccagcctcacatatgtcatccttaaacgttgtgaagatgacgaccatctcactaaccccttctaatagtaatacccccctaaaacactccgcctctgttagcagtgctactggaacgacggaggagtctcgttccgtaccccagataaagaacggatcggtggtgagcctgcagagccctgggtcccggtctagttctgccggtggtacctcagcagtggaggttaaggtggaaccggagactagctctgatgaacatcccgtacagtgccaggaaaattccgacgaagcaaaggccccccagacaccgtccgccctcttagggcagaaatctaacacggacggagcacttcagaagccctctaatgagggggtgattgaaatcaaagcaacgaaggtttgtgatcagcgcactaagtgcaaatctagatgtaatgaaatgttgccagggaccagcacaggaaacaatcaaagcacaattaccctctccgtcgcctctcagaatctgactttcacctcaagttcatcacccccaaacggagattccatcaacaaagaccctaagctctgcactaaatccccaagaaagagactcagctccacactgcaggagacccaggtgcctcccgtaaaaaagccaatagtagagcagctgagcgcggccacaatcgagggccagaaacaaggctctgtgaagaaagatcagaaagttccccactcgggtaaaaccgagggctctacagcaggagcccaaataccatctaaagtgtctgtgaacgtgtccagccacattggagcaaatcaaccactgaacagtagtgcattggttatatctgactcagcgcttgaacagcaaacaaccccttccagctcaccggacataaaggtaaagttggaggggtcagtctttttgttggactctgattctaaatctgtaggatcctttaaccccaacggatggcagcagatcacaaaggatagcgagttcatttctgcatcttgtgagcagcagcaggacatctccgtgatgactattcctgagcacagtgatatcaacgatcttgaaaaaagcgtatgggaacttgagggcatgccccaagatacttactcacaacagttgcacagtcaaatacaggagtccagcctaaaccagattcaggctcactcctccgatcagctgccactccagagcgagttgaaggaatttgaacctagcgtctctcagactaacgaatcctattttccctttgatgatgagctgacccaggacagtattgttgaggaactggtgttgatggagcagcagatgagcatgaacaactctcactcgtacggtaattgcctcgggatgactttgcagagccaatctgtgacccccggggctcctatgagctcccataccagtagtacgcacttttatcatcctatccattcgaacgggacccccattcatacccccaccccaacccccacacccacccctacccctacacctaccccaacaccaacatccgaaatgatcgcagggtcacagtccctgagccgggagagcccttgttcaaggctggcccagacaacacctgtggattcggcactcggttcttcccgacacactcctattggtacgccgcacagcaattgttcctcaagcgtacccccttccccggttgagtgcaggaacccattcgctttcaccccaatcagttcctcgatggcttatcatgatgcttcaattgtgtcaagcagccccgtaaagcccatgcaacgtcctatggccactcaccctgacaagacaaaactggagtggatgaacaacggctacagcggcgttggcaattcgtccgtttcgggccacggcatcctgccgagttatcaagaacttgtcgaggatcggtttaggaaacctcacgcgtttgcagttcccgggcaatcttaccaatcgcagtctcgccaccatgacacgaactttggccgactcacccctgtatctccagtccagcatcagggtgccacggtgaacaatacaaataagcaggaaggcttcgcagttcccgccccgctggataacaaggggacgaacagcagcgccagtagtaatttccgatgccgctccgtctcccctgccgttcaccggcagaggaaccttagcggctccactctatatcctgttagcaatatacctcgcagcaacgtcacaccctttggctctccggtgacaccggaagtacacgtctttacaaacgtgcacaccgacgcttgcgccaacaatatcgcccagcgatctcagtcggtgcctttgactgtgatgatgcagaccgcatttccaaacgccctgcagaagcaggctaacagcaagaaaatcaccaacgtcttgctgagcaaactggatagcgacaatgacgacgcggtgcgcggcctcggtatgaataatctgccaagcaactacacagcaaggatgaacctcacccagattctcgagccgtccacggtttttccttcggccaacccccagaatatgatagattcttctactagcgtttacgagtttcagaccccgtcttatctaacaaagtctaatagcacaggtcagataaatttttcaccaggcgataatcaagcccaaagcgagattggtgagcagcagctagattttaactctacagtcaaggacctgctgagcggagattcattacagacgaaccagcaactgaagtatccggatgttttgggcgaatag

SEQ ID NO: 202929 - DNA, 3846 bp, Artificial Sequence
  Description of Artificial Sequence: Synthetic coding sequence
atgagcagcagccgggcccagcagatgcacgccttcagctggatccggaataccctagaggaacacccagaaacaagtttacccaagcaggaagtgtacgatgagtacaagtcctactgcgataacctagggtaccatccactgtccgctgccgattttggtaaaatcatgaaaaatgtattccctaatatgaaagctcggcgcctgggcacgcgcgggaaatccaaatactgttactccgggctgcggaagaaggccttcgtgcacatgccgaccctcccaaacctggactttcataaaaccggcgatggtttggaaggagccgaacccagtggccagctgcagaacattgacgaggaagtaatatcttccgcatgccgcctggtctgcgaatgggctcagaaagtgctgtcccagccgtttgacaccgttctggagcttgcacgctttctggtgaagtcacattatatcggcaccaagtctatggcagcattgaccgtgatggctgcagcacccgcagggatgaagggcataacacagccttccgcatttataccgacagcagaatctaactcatttcaaccacaagtgaagaccctgccaagccctatagatgcaaagcagcaacttcagagaaagatccaaaaaaagcaacaagagcaaaagctgcagagcccattgccaggcgagagcgccgccaaaaaaagtgagagcgctacctcaaatggtgtcaccaaccttcctaatggtaatccttcaattctgtctcctcagccgatcggtattgtggtggctgccgtcccctctccaatccccgtgcagcgaacccgccaactcgtgacttccccatctccaatgtccagctccgacggaaaagtgttaccgctgaacgtccaagtggtcacacagcacatgcagagtgttaagcaggcccctaaaactccacagaacgtccctgcctccccaggcggggaccgcagtgcacggcaccggtatccccagattctgcccaaaccagcaaatacatctgcgctcaccattcgatcacccactactgtcctgtttactagctccccgataaaaaccgcagtcgtgcctgccagccacatgtcaagcctgaacgtggttaaaatgaccaccatttcactgacgcctagtaacagcaataccccactgaagcattcagctagcgtttcctccgctaccggcacgacggaagagtctaggtccgtgccacagattaaaaacggcagcgtggtatcccttcagtcacctggctctaggtcctcatctgcaggaggcacttctgcggttgaagtgaaggtggaacctgaaacgtcttctgacgaacatcccgtccaatgtcaggagaatagcgatgaggcaaaggcaccacaaacgccgtcagccctgctgggacagaaaagcaataccgatggcgccctgcagaaaccttccaacgagggagtaattgagatcaaagctacaaaggtttgcgaccagagaaccaaatgcaaatctagatgtaatgagatgctccctggtactagtacaggaaacaaccaatccacaataaccttgagcgtcgcctcccaaaacttgacctttacttcttcgagctccccgcccaacggagacagcatcaacaaagaccccaagttgtgtaccaagtcccctcgcaagagactaagtagtacactgcaagagacgcaagtaccaccggttaaaaagcctatcgtggagcagctctctgctgcgaccatcgagggccagaagcagggcagtgtgaagaaagatcagaaggttccccatagcggcaagaccgaaggctctactgccggcgcacagattccatctaaggtgtccgtcaatgtttccagccacatcggagcgaatcaacctcttaactcctccgccctggtgattagcgattctgcactcgagcaacagacgactccctcttcctctccagatatcaaggtaaagctggaaggctctgtcttcctgctggactccgacagcaagtctgtcggaagttttaacccaaatggatggcagcagattacaaaggattctgaattcatcagcgcctcatgtgagcagcagcaggacatatccgtcatgacaatccccgaacattcagatatcaacgacctggagaagtccgtgtgggaactggagggaatgccacaggacacatactcccagcaattgcacagccagatccaggaatcttcactaaaccaaattcaggctcactcatcggaccagcttcccctccagtctgagctgaaagagtttgaaccttctgtgagccaaaccaacgagtcctacttcccgtttgatgatgagctgactcaggactcgatagtcgaggagctggtgctcatggaacagcagatgtctatgaataactctcattcttacgggaactgcctcgggatgaccctccagtcacaaagtgtgactcctggagcgcctatgtcgtcacatacttcaagtactcatttctatcatcccatccacagcaacggaactccaatacatacgccaacgcctacccccacacctaccccaaccccgactcctacgccaaccccgacctcggagatgatcgccggatctcagagcctgagtcgggagtctccttgcagccggctggcccagaccacccccgtcgatagcgctctgggctccagccgacataccccgatcgggactcctcactcgaattgcagctcgtctgttccccctagcccagtcgaatgccgcaatcccttcgcgttcactccaatttctagctccatggcttatcatgacgccagtattgtttctagcagtccagttaagcctatgcagagacccatggccacacacccagacaaaacaaaattggagtggatgaacaatggctattctggagttggcaatagctccgtgagtggtcacggtatcctcccctcctaccaggagctcgtggaggatcgcttccgtaagcctcacgccttcgcagtgcctggtcagtcctaccaaagccaatcaaggcaccacgatacgaacttcgggcggcttactcctgtgagccccgttcaacaccagggcgctacagtgaataacaccaacaaacaggaagggttcgccgtgcccgcgccactcgataacaagggtacaaatagttccgcgtcttcaaattttcgttgccgcagcgttagcccagccgtccacaggcagaggaatctgagcggttccactttgtatcctgtgagcaacattccccggtcgaatgtcacaccctttggcagcccggttactcctgaagtgcatgtgtttactaacgttcacactgacgcctgcgcaaacaatatagcgcagcggtcgcagagcgtcccgctgaccgtaatgatgcagacagccttccctaacgccctacaaaaacaggccaactccaaaaaaatcaccaatgttctgcttagtaagcttgactccgacaatgacgacgctgtccgcggcctgggcatgaacaacctcccatcaaactacactgctcggatgaacttgactcaaatcctcgaaccctccactgtatttccaagcgcaaatccccagaatatgatcgactctagcaccagcgtgtacgagttccagacaccctcttaccttaccaagtcaaattcaaccggccagatcaacttctcaccaggagacaatcaggcccagtcagagatcggcgaacagcaactggacttcaattcgactgtgaaggatctgctctcgggggactccctccagacgaaccagcagctgtgcagctgccccagttccttactggccggaatgcagatgtag

SEQ ID NO: 202930 - DNA, 4383 bp, Artificial Sequence
  Description of Artificial Sequence: Synthetic coding sequence
atggccgaggagcagcagcagccccccccccagcagcccgacgcccaccagcaattgcctcccagtgctcccaattccggagtggcattgccagctctcgtgcccggcctgcccgggactgaagctagcgcacttcaacacaaaattaagaactccatctgcaagactgtccagagcaaggtggactgtatccttcaggaagttgaaaagtttaccgacttagaaaaactttatctctatctccaactgccctctggactttcaaacggggagaagtccgaccagaacgctatgtcatccagtcgcgcgcagcagatgcatgccttttcttggattagaaacactctggaggagcacccagagacctcattgcccaagcaagaggtgtacgatgagtacaaatcttattgtgataacctcggctaccacccactgtcagcagcagacttcggtaagatcatgaagaatgtctttcccaatatgaaagctaggcgtctggggacaagaggcaagagcaagtactgctatagtgggctgcgcaagaaggcttttgtacatatgccaactctgcccaacctggacttccacaagacaggagacgggctggaaggggccgagccctccggtcagctgcagaatattgatgaggaagttatctccagcgcttgtagactggtgtgcgaatgggcccagaaggtgttgtcccagccctttgacaccgtcctggaacttgctcggtttctggttaagagccactatattggaaccaaaagcatggccgcactgactgtcatggccgcggcccctgctggaatgaaaggcattacacaaccctcagctttcatcccgacagctgaatctaatagcttccaaccacaggtgaagacactgccatccccgatagatgccaagcaacagttacagcggaagattcaaaagaagcagcaggaacaaaaactccaaagcccactgcccggcgagtccgcggccaagaagagcgaatcagctacgagcaacggagtgacaaatctgcccaacggtaaccccagcatcctgtcaccccagccaatcggtatcgttgtcgccgcggtcccatctcccattcctgttcagcgcacgcggcagttagtcaccagcccctctccaatgtcttcttctgatgggaaagtcctgcccctgaatgttcaggtcgtgactcagcatatgcagagcgttaaacaggcaccgaaaacaccccagaatgtgcctgcctcgccaggcggagacaggtctgcccggcaccggtatccacaaatcttgcctaagccagccaatacatctgccttgacaatcaggagcccgacgaccgtgctattcacttctagccccataaagaccgcagtggttcccgctagccacatgagtagcctgaatgttgttaaaatgactacgatcagccttaccccatctaactcaaacactccccttaagcatagtgcctcggtgtcatctgccacaggcacaaccgaggaatcccgtagcgtaccccaaatcaagaacggctctgtggtctcactccagagtccagggtcccggtcttcaagcgcgggaggcactagcgcagttgaagtcaaggtcgaacctgaaacatcctctgacgaacacccggtgcagtgccaggagaacagtgacgaggcaaaagcgcctcagactccatcggcattgctgggccaaaagagtaacactgacggggccctgcaaaagccctctaacgagggggtgattgagattaaggccaccaaagtgtgtgaccaacggaccaaatgtaagtcccgctgtaacgaaatgttgcctggaacttcgaccggaaataaccagagcacaataacgctctctgtggcatcgcagaatcttactttcacttcatcttcttcacctccgaacggagattccataaataaagatccaaaactgtgcaccaagtcacctcggaaacgcctctcctccactctccaggagacccaggttccgcccgtcaagaagccgatcgtggagcagctgagcgctgctactatcgagggccagaagcaaggcagcgttaagaaggaccagaaggtgccgcatagtggtaagacggaaggatctactgctggcgcacaaatcccctcaaaagtgtcagttaacgtgtcgagccatattggcgctaaccagcctctgaattcaagcgccctggtgatctctgacagcgcattggaacagcagacaactcccagcagctcccccgatatcaaagtgaagttggagggctcagtgttcctgctcgatagcgactcaaagtctgtcggctcctttaacccaaacggttggcagcagataacaaaggacagtgagtttatctcggcctcctgtgaacaacagcaggacatcagtgtgatgaccatacccgaacactctgatataaacgacttggagaagagcgtgtgggaattggagggaatgccacaggacacctattcacagcagctgcattcacagatacaagaatcctccctgaaccaaattcaggctcactccagcgaccagctgcctcttcagtccgaactgaaagaattcgaaccatcagtgtcgcaaacaaacgagagctattttccattcgacgatgaactcacccaagattccatcgttgaggagttggttctgatggagcagcaaatgtctatgaataactctcactcctacggcaactgtctagggatgacactgcagtctcagtccgtgactcccggcgccccaatgtcaagtcatacgagttctacacacttttaccaccccatccattcaaatggaacgcctattcatacccccacacccactccaacaccaaccccgacaccgaccccgacacctacaccgactagtgagatgatcgcgggatcccaaagcctgtccagagagtccccttgtagcagacttgctcagactacacccgtcgatagcgcactagggagcagtcgacacacacccatcgggaccccacattctaattgcagctcgagcgtgcccccctctccagttgagtgccgcaacccctttgcctttaccccaatctccagctctatggcttaccacgacgctagcatagtgtcctcctccccagtgaagccaatgcagcggcccatggcaactcatcctgacaagaccaaactggagtggatgaataacgggtactccggagtcggaaattcttccgtgagcggccatgggattctgcccagctaccaggaactcgttgaggatcgttttcgcaaaccacacgcctttgctgtccccggccaatcctaccagagccaatcgaggcatcacgacacaaattttgggcggctgaccccagtgtctcccgtgcagcatcaaggcgcgactgtgaataatacaaacaagcaagagggattcgccgtaccagcgcccttggataacaagggaacgaattcgagcgcttcttccaactttaggtgtaggtctgtgagcccagcggtgcaccggcaacggaatctttctggctctaccttgtatcccgtgtcgaacatcccccgtagcaacgtgacccctttcggaagccccgtaacaccggaggtccacgtgtttaccaatgtgcacaccgacgcctgcgccaataatatcgctcagaggtctcaatctgtacccctcacagtcatgatgcagacagcctttcctaatgctttgcagaaacaggctaatagcaagaaaattaccaatgtattgctgtccaagctggactcagataacgacgacgctgtgaggggcctgggaatgaataacttgcctagtaactacactgccaggatgaacttgacacagattctcgaaccgagtacagtcttcccaagtgcaaacccacagaacatgattgacagcagcacttcggtctacgagtttcaaacaccaagctatctgacaaaatctaacagtaccggccagatcaacttctccccaggagataaccaggcccagagcgaaattggtgaacagcaactggattttaacagtactgtgaaggatctcctctctggagacagtctgcagacaaaccagcagctcgtgggccaaggagcatccgatttaactaacactgcgtcggacttttccagcgatattcggctgtcaagcgaattgagcgggagcattaatgatctgaacacactggatcctaatttgctgtttgaccctggtagacagcagggtcaggacgacgaggccaccttagaagagctgaaaaacgacccgctcttccaacagatctgtagtgaaagcatgaacagcatgacttcatcgggattcgagtggatcgagtcaaaggatcatccgactgtggaaatgctcggctag

SEQ ID NO: 202931 - DNA, 4092 bp, Artificial Sequence
  Description of Artificial Sequence: Synthetic coding sequence
atgagcagcagccgggcccagcagatgcacgccttcagctggatcaggaacaccctcgaagagcaccccgagacttcattgccaaagcaagaggtgtatgacgagtacaaaagttattgtgacaatctggggtaccatccattatcagccgcggactttggaaagattatgaagaatgtcttcccgaatatgaaggcccgacggctgggcaccagggggaaaagcaagtactgctactcaggcctccgaaagaaggcgtttgtacacatgcctaccctcccgaacttagactttcataagacgggcgacgggctggagggggccgagccaagtggacagctgcagaacatcgatgaagaggttatttcttccgcctgtcgcctggtgtgcgagtgggctcagaaagttctgtctcagccattcgatactgtcttagagttggcccgatttttggtgaaatctcactacattggaacgaagagtatggccgcgctaaccgtgatggcggccgcacccgccgggatgaagggcattacacagccgagcgccttcataccaactgccgaatcaaactcgtttcaaccccaggtgaagactctcccatcccctatcgacgctaaacagcagttgcaaagaaagatacaaaagaagcaacaagaacaaaaattacagtctccactgcctggcgagagtgctgcaaagaaatccgagtccgcaacatctaacggcgtgacaaatcttccaaacggcaatccttcgattctgtctcctcagccaatagggattgtagtcgcggcggttccaagccctatccctgtgcagcgtaccaggcagctggttacatctccttcaccaatgtcctctagcgacggcaaggtgctgcccttaaacgtgcaggtggtgacacagcacatgcagtcggtaaagcaggctcccaagacccctcaaaatgtgcccgcgtcccccggcggagataggtctgcccgacatcgatatccccagattcttccgaagcccgctaacacctccgcattgacaattcggtcacccaccacagtgcttttcacctccagccctatcaagactgcagtggtccctgcttcccatatgtcttctttgaatgtggtgaagatgaccacaatatcactgaccccatctaattccaacactcctctaaaacattcagctagtgtgagctccgcgaccggaacaacagaagaatccaggtccgtgcctcagatcaagaacggatccgttgtgtcccttcagtccccaggctctagatcttctagcgctggtggtacaagtgcagtcgaagttaaggttgagccagaaacatcttccgacgagcatccggtgcagtgccaggaaaatagcgatgaagccaaagcacctcagaccccaagtgcgttattaggacagaaatctaacacagacggcgccctgcagaaaccatcaaacgagggagtcattgagatcaaggcgacaaaagtatgtgaccagagaactaagtgtaagtcacgctgcaatgagatgttgccaggtacctccacagggaataatcagagtactatcacgttgagtgtcgccagccagaacttgaccttcacaagctccagtagtcctcccaacggggattccatcaataaggatcccaagctgtgtaccaagtcaccccggaaacggctcagcagcacactgcaggagacccaagtgccccctgtgaaaaagccaattgttgaacagttgagcgccgccacgatcgaggggcagaaacagggctccgtaaaaaaggaccagaaagttcctcattcaggtaagaccgaggggtctacggccggtgcccagattccaagcaaggtgtccgtcaacgtctcaagccatataggtgctaaccagccacttaatagctccgctctcgtcatcagcgattctgcactggagcagcagacaactccatcctcttcccccgacatcaaggtgaagttagagggctcagtgttcctcctggatagcgattctaagtccgtgggcagctttaaccctaatggatggcagcaaataactaaggactctgaatttatatccgcgagttgtgagcaacaacaggatattagcgtgatgactataccagagcactccgatatcaatgacctggagaagtccgtctgggaattggaaggcatgccgcaggatacctacagtcagcagttgcactctcagattcaggagtctagcctcaaccagatccaagcacacagctcagaccagttaccacttcagtcagagcttaaggagtttgaaccctcagtgagtcaaaccaatgaatcttattttccttttgacgatgagctgacacaggattccattgtcgaagagctcgtccttatggaacagcaaatgtcaatgaacaatagccactcgtacgggaattgcctcggcatgacactgcagagtcagagcgttaccccgggcgctcctatgtccagtcacaccagctcaacacatttttaccacccaattcacagtaacggtacacccatccacacacctaccccaacacctaccccaaccccaaccccgaccccgacaccaacccccacatccgagatgatagcgggcagtcagtccctgtctagagaaagcccgtgctctagattggcccaaacaactccagtggattccgccctcggatccagccggcacacgccaatcgggaccccacattccaattgctccagcagcgtcccaccaagccctgtggagtgtagaaatcccttcgcctttactcctattagttcctcaatggcctaccacgacgctagtatagtaagctcaagcccagttaagcctatgcagaggcccatggcaacccacccagataaaacaaagctggagtggatgaacaacggttattccggcgtcgggaattctagcgtgagcggccacggtatcctgccatcgtatcaagaactcgtggaggataggtttaggaagccgcacgccttcgccgttccaggacaatcctatcagtcacagagccgccaccatgacactaattttggaagattgaccccggtctcccctgttcaacaccaaggagcaactgtgaacaataccaataagcaagagggattcgccgtgccagccccactggacaataaaggaacaaattcttctgccagctccaattttcgctgtagaagcgtgagccctgctgttcacagacagagaaatttatccggatccactctgtaccccgtctccaatattcctcgaagcaacgtgactccattcggttccccagttacacctgaagtccacgtcttcacaaacgtccacaccgatgcttgcgctaataacatcgcccagcggtcacaaagtgttccactgaccgtgatgatgcaaacggcgtttcctaatgcccttcagaaacaggcgaattctaagaaaataacgaatgtgctcctgagtaaacttgactcagataatgacgacgcggtgaggggattgggcatgaataatctacccagcaactatacagctcgtatgaatctaacccaaatactggaaccatccacagtgtttccctccgcaaatcctcagaatatgatagattctagcaccagcgtatacgagtttcagacgccttcctacctgactaagagcaactctacaggccagattaatttttcgccgggagacaaccaagcacagtctgagatcggggaacagcagctggatttcaactcgactgtcaaagacttgctgtcgggagattctttacagacaaaccagcagctggtcggtcaaggagcttccgacctcacgaacaccgccagcgacttcagttcagacatccgattgtcgtcggaattgagtggtagcatcaatgaccttaacacactcgatccaaatctccttttcgaccccggtcgccagcagggacaagatgatgaggcaacattggaagaattgaagaatgacccactgtttcaacagatttgttcagagtccatgaattctatgacctccagtggttttgagtggatagaaagcaaggaccatcctaccgtggagatgctcgggtag

SEQ ID NO: 202932 - DNA, 783 bp, Artificial Sequence
  Description of Artificial Sequence: Synthetic coding sequence
atggagctgacccagcccgccgaggacctgatccagacccagcagacgccagcatcagaactgggagacccagaggatcccggcgaagaagcagcagacggctcagataccgtggtcctgtctctgttcccatgcacacctgaaccggtgaatccagagccagatgcctctgtttcaagcccccaggccggatcttctcttaagcactcaacaaccctgactaacaggcagcgaggaaacgaagtgtccgcactccctgctactctggactctctgtcaatccatcagctagcggcgcagggtgaactggatcagctcaaggagcatttaagaaaaggagacaatttggtgaataagcccgacgaacgcggcttcactccgttaatttgggcttcggccttcggggagatcgagacagttcggttccttctggagtggggtgccgatcctcatattttggctaaggagcgggagtctgcactctccctggcctctaccgggggttacactgacatagtggggctgcttctcgagcgcgacgtggatatcaatatttatgactggaatggcgggactccactgctttatgcagttcggggaaaccacgtcaagtgtgttgaagccctccttgcccgcggcgcagatctgacaacggaggcggacagcggttacactcccatggacctcgccgtggcattaggctatcgcaaggtgcagcaagtcatagaaaaccacatcctgaaactcttccagtccaacctggtgccagccgatccggaatag

SEQ ID NO: 202933 - DNA, 714 bp, Artificial Sequence
  Description of Artificial Sequence: Synthetic coding sequence
atggagctgacccagcccgccgaggacctgatccagacccagcagaccccagcttccgagttgggggaccccgaagatcctggggaggaggccgcagacggttccgacaccgtggtattatcactgtttccctgtactccagagcctgtgaacccagagcctgacgcatcagttagctcccctcaagggtctagcttgaagcacagcacgacgctaactaaccggcagcgtggtaatgaggtgtccgccctgcccgctactctggattgtgataatcttgtcaataaaccggatgagagaggatttacccctctgatttgggcttctgcatttggagagatcgaaactgttcggtttcttctggagtggggagcagacccccatatccttgccaaggaaagagaatcagctctttccctggcctccacaggcggctacacagatatcgtgggtcttctgctagagcgagacgttgacattaacatttacgattggaatggggggacacccctcctgtatgccgtccgtggaaaccacgtgaagtgcgtcgaggccttattggcaagaggcgcagatctcactactgaggcagactccggctacacaccaatggacctggctgtcgctctcggttatagaaaagtccaacaagtcattgaaaatcacattctgaaattgtttcagtcaaacctggtgccggcggacccagagtag

SEQ ID NO: 202934 - DNA, 192 bp, Artificial Sequence
  Description of Artificial Sequence: Synthetic coding sequence
atggagctgacccagcccgccgaggacctgatccagacccagcagactcccgcttccgaactcggcgatcctgaggacccaggagaagaggcagccgatggctcagacacggtggtgttatcgttatttccctgcactcctgagccagtgaatcctgagcccgacgcaagcgtctctagtccccaggcatag

SEQ ID NO: 202935 - DNA, 717 bp, Artificial Sequence
  Description of Artificial Sequence: Synthetic coding sequence
atggagctgacccagcccgccgaggacctgatccagacccagcagacccctgcaagtgagctcggggaccccgaggatccaggcgaagaggctgccgatggatcagacacggttgtgcttagcttgtttccttgcacacccgaacccgttaatccagagccagacgccagcgtgtcaagccctcaggcggggtcatctcttaaacacagcacaaccttaaccaatcggcaacgggggaacgaggttagcgcgctgccagctacactggattgcgataacttagtgaataagccggatgagcgaggatttacaccccttatatgggcctctgcatttggggagatcgagactgtgaggtttttactggagtggggcgctgatccacacatcctggccaaagagagagaatctgcgctgtccctggcaagtacgggcgggtataccgacattgttggattgctgttggagcgtgatgttgacataaatatctatgattggaacggtggtacccccctgctctatgcggtgcgcggaaatcacgttaaatgcgttgaggcattgctggcccgaggtgctgatctgactaccgaagctgatagcggctacacaccaatggacctggccgtggctttaggatacaggaaagtacaacaggttattgagaaccatatcctgaagctcttccagagcaatttggtgccggctgatcccgaatag

SEQ ID NO: 202936 - DNA, 819 bp, Artificial Sequence
  Description of Artificial Sequence: Synthetic coding sequence
atggaggcccagggcgtggccgagggcgccggccccggcgccgccagcggggtgccgcacccggccgcacttgcgcccgccgccgcccctactttggctcctgccagtgtcgccgccgccgcctcccagtttaccttgctggtcatgcagccatgcgccggtcaggatgaagccgcggctccaggcggtagcgtaggcgctggcaagcctgttcgctacctctgcgagggcgcaggagatggcgaagaggaggccggcgaagatgaggcagacctcctggatacatcggatcctcccgggggtggcgagtcagccgctagtctggaggacctggaggacgaagaaacccatagcggaggggaaggctcatccggaggagcacgtaggagaggaagtggtgggggctctatgtctaaaacatgcacctacgagggctgttctgagacgacatctcaagttgctaaacagcgtaagccttggatgtgcaaaaaacatcggaataagatgtataaggacaaatataagaagaagaaaagtgatcaggccctcaattgcgggggaacggcctctacaggctctgccggaaatgtgaaattagaagagtctgcagataatattctgagtatagtgaagcagaggaccgggtctttcggggatagacccgcccgacccactctgttggagcaggtccttaaccagaaacggctcagtctgctgaggtccccggaagttgtgcagtttctccagaagcagcaacagttgttgaaccagcaggtccttgagcagagacaacaacagttccccggcaccagcatgtag

SEQ ID NO: 202937 - DNA, 1854 bp, Artificial Sequence
  Description of Artificial Sequence: Synthetic coding sequence
atgagcagcctgcccaccagcgacggcttcaaccaccccgcccggtcatccggacagtccccagacgtgggaaatcctatgagcctggcacgcagcgtgtcagcttccgtctgcccaatcaaaccgagcgacagtgacagaattgagccgaaggctgtaaaggcccttaaagcttccgcagaatttcagctgaatagcgagaagaaggagcatttatccttgcaggatttgtccgaccacgcctcctccgcagaccatgcccccaccgaccagtccccagccatgcctatgcagaattctagcgaggagatcacagtagctggcaacctcgaaaagagcgctgaaaggagcacgcagggactaaagtttcaccttcacaccagacaagaggcttccctgtccgtgactagtacaaggatgcacgagccccaaatgttcctcggagagaaagattggcacccggaaaaccagaacctgagccaggttagtgatccacagcaacatgaggaaccaggtaacgagcagtacgaggtggctcagcaaaaagcttcacacgaccaggagtatctgtgcaatatcggagatcttgagctccctgaggagcggcaacagaaccaacacaaaatagtggatctggaggccaccatgaaaggcaacggtctaccccagaacgtggaccccccatccgcaaaaaaatccatcccttcaagcgagtgcagtggatgctctaacagcgagacatttatggaaattgacaccgcacaacaatcccttgtgacactacttaacagcactgggcggcagaatgcaaatgtgaagaatatcggcgccttggacctcacgctggataacccactgatggaagtggagacctctaaatgcaacccttccagcgagatcctgaacgacagcatcagtactcaggacctgcagccacctgagaccaacgttgagatccccggaaccaataaagagtacggacattatagttcccccagcttatgcggttcttgtcagccatcagtcgaatccgcggaggagtcgtgcccatccatcacggcagctctcaaggaactgcacgaactattggtcgttagcagtaaacctgctagcgagaataccagtgaggaggttatctgccagtctgagactattgccgaaggccagacatccatcaaggacctttccgagaggtggactcagaacgaacacttgactcagaacgagcagtgcccccaagtctccttccaccaagccataagcgtcagtgtcgagactgagaagctaactggtacctctagcgacacgggcagagaggctgtggaaaacgtcaacttcagaagtctgggggacgggcttagtacagacaaagagggtgtgcccaagagcagggagagcatcaacaagaacaggtccgtaactgtgacgtcagcaaagaccagtaatcagctgcattgcacactaggagtggaaattagcccaaagttgctggcgggcgaggaggacgctctgaatcagacctccgagcagaccaaatccctttccagtaattttatcctagtcaaagacctgggccagggaattcaaaacagtgtgactgacaggcccgagacaagagagaacgtctgtccagatgcctccaggcccttgctggagtatgaaccacccacgagtcacccctctagctcccccgccatcctgccacctctcatctttcccgctacggatatcgaccgaatcctgcgcgctggattcacccttcaggaagccttgggcgcactgcaccgggttggaggaaatgcggacctcgcactgctggttctcctggccaagaatattgttgttcctacttag

SEQ ID NO: 202938 - DNA, 657 bp, Artificial Sequence
  Description of Artificial Sequence: Synthetic coding sequence
atgagcagcggcgccgccagcggcaccggccggggccggccccggggtggtggccctgggcccggcgaccctccgccatcagagacacataaactagtcgtcgtgggcggcggaggcgtgggcaagtctgcactgaccattcagttcatacaatcctactttgtttcagattacgacccgacgatcgaggattcgtacacaaagatttgtagtgtggatggtatacctgcccggttggatatcttggatactgctggtcaggaggaattcggggccatgagggagcagtacatgagggctggccatgggtttctgctggtgttcgccatcaatgaccgacagtcctttaacgaggtgggcaaactctttacccaaatcctgcgggttaaagatcgggacgattttccggttgtgttggttggtaataaagccgatttggagtcacagcgccaggtaccccgatctgaagcctcggcctttggtgcttctcatcatgtggcctacttcgaggcctcggccaaactgcgattaaacgtagatgaagcctttgaacaactggtccgcgccgtgcgtaaatatcaggagcaggagctccctccatcacctccgtccgcccctaggaaaaaggggggcgggtgcccctgtgttttgctgtag

SEQ ID NO: 202939 - DNA, 615 bp, Artificial Sequence
  Description of Artificial Sequence: Synthetic coding sequence
atggccgccgccggctggcgggacggcagcggccaggagaagtaccgcctcgtggttgttggaggtgggggcgttggaaagagcgcactaaccatacagtttatacagtcttatttcgtgacagattatgatccgactatcgaggactcatacactaaacaatgcgtgattgacgaccgcgctgcccgactggatattctggataccgctggccaggaggagttcggtgccatgcgtgagcagtatatgcggaccggggaggggtttctattggttttttccgttacagatcgcggttcctttgaagaaatctacaaattccaacgacagatcctcagagtgaaagaccgagatgagttcccaatgatacttattggaaacaaagctgacctcgaccatcagagacaggtcactcaagaggagggtcagcagctagcccggcagctgaaggtaacgtacatggaagccagcgcaaagattcgtatgaacgttgatcaggcctttcacgaacttgtaagagtgatccgcaaattccaagagcaagagtgccccccttctccggaacccactcggaaggaaaaagacaagaagggctgccactgcgtcattttttag

SEQ ID NO: 202940 - DNA, 384 bp, Artificial Sequence
  Description of Artificial Sequence: Synthetic coding sequence
atgcgggagcagtacatgcggaccggcgagggcttcctgctggtgttctcggtcactgacagaggaagcttcgaagagatttataagttccagcgccagattctccgcgtcaaggacagggacgagttccccatgatcctgatcggaaacaaagcagatttagaccatcaacgccaggtgacacaggaagaggggcagcagctcgcccgacagctcaaagtgacgtacatggaggcttctgccaagatcagaatgaacgtggatcaggcttttcacgagctcgtgagggtcatcaggaaatttcaggaacaggagtgcccgccctcaccagagccgacgcgcaaggagaaggataagaagggctgtcactgcgttatattttag

SEQ ID NO: 202941 - DNA, 384 bp, Artificial Sequence
  Description of Artificial Sequence: Synthetic coding sequence
atgcgggagcagtacatgcggaccggcgagggcttcctgctggtgtttagtgtgacggacaggggaagcttcgaagaaatctataaatttcagcggcagatcctgcgtgtgaaggaccgtgacgaatttccgatgatactgatagggaataaggctgaccttgatcatcagcggcaggtcactcaggaggagggccagcagctcgcacggcagcttaaggtgacttatatggaagcctcagcaaaaatccggatgaatgttgatcaggctttccatgagcttgttagagtgatccgcaaatttcaagaacaagagtgtcctccatcaccagaacccacacgtaaagaaaaggataagaagggctgtcattgtgtgattttctag

SEQ ID NO: 202942 - DNA, 384 bp, Artificial Sequence
  Description of Artificial Sequence: Synthetic coding sequence
atgcgggagcagtacatgcggaccggcgagggcttcctgctggtgttttctgtgactgaccggggatctttcgaagagatttacaagtttcagcgacagatccttagagttaaggatcgggacgagttcccaatgatactgattggaaacaaagcagacctagaccaccaacggcaagtcacccaggaggagggacagcagctggcccgacaactgaaggtgacatatatggaggcgagcgccaagataagaatgaatgttgatcaggcattccacgagctcgtgagggtaatccggaagtttcaggaacaggagtgccccccatcacccgagcccacccgcaaggaaaaagataaaaaggggtgccactgtgtaattttctag

SEQ ID NO: 202943 - DNA, 210 bp, Artificial Sequence
  Description of Artificial Sequence: Synthetic coding sequence
atgcgggagcagtacatgcggaccggcgagggcttcctgctggtgttttctgtgactgatcgcggttcatttgaggagatatataagttccagcgccaaattctgcgggtcaaagaccgggatgaatttccaatgatcttgattggtaacaaggccgacctcgaccatcagaggcaagtgactcaagaagaaggacagcaactcgcgtag

SEQ ID NO: 202944 - DNA, 384 bp, Artificial Sequence
  Description of Artificial Sequence: Synthetic coding sequence
atgcgggagcagtacatgcggaccggcgagggcttcctgctggtgttcagcgtgaccgacaggggaagcttcgaggaaatttacaagttccagagacagatattaagagtcaaagatcgagacgagtttcccatgatcctaatcggcaataaggctgatctggaccatcagagacaggtgacccaggaggaaggtcagcagctggctcggcagcttaaggtgacctatatggaggctagtgccaaaatccgaatgaatgttgaccaggcatttcatgaattggtccgagtgataagaaagttccaggagcaagagtgtccaccctcccccgaacctactcgaaaggagaaagataaaaaggggtgtcattgtgtgatcttttag

SEQ ID NO: 202945 - DNA, 384 bp, Artificial Sequence
  Description of Artificial Sequence: Synthetic coding sequence
atgcgggagcagtacatgcggaccggcgagggcttcctgctggtgttctccgtcacagacagaggatccttcgaagagatctataagttccagaggcagatcctgcgtgtgaaggaccgcgacgagttcccgatgatcttgatagggaacaaggctgacctggatcaccaacgtcaggtgacccaggaagagggtcagcagttggcccgccaactgaaagtgacgtatatggaggcttcggcaaagatccggatgaatgtagatcaggcattccacgagctggtgcgggtgatcaggaaatttcaggagcaggaatgtccaccctcgccagaacccacacgtaaggagaaggacaaaaagggctgtcattgtgtcattttctag

SEQ ID NO: 202946 - DNA, 510 bp, Artificial Sequence
  Description of Artificial Sequence: Synthetic coding sequence
atgagctacttcgtgaccgactacgaccccaccatcgaggacagctacacaaagcaatgcgtgatcgatgaccgggcggctcgcctggacatattagacacagcaggccaagaggaattcggcgcaatgcgagagcagtacatgaggactggagagggtttccttcttgtgtttagtgtgacagatagggggagcttcgaagagatatataagttccagcggcaaatccttagagtgaaagaccgggatgagtttcctatgattttgatcggcaataaggcagacttagaccaccagcgacaggtgacgcaagaggagggacagcagctagctcgacagctaaaagtcacatacatggaagcttccgccaaaattcgaatgaatgtcgaccaggcttttcatgaattggtgcgggtcattcgcaagttccaggaacaggaatgtcctcccagtcccgagccaacacggaaagaaaaggataagaagggctgccattgtgtgattttttag

SEQ ID NO: 202947 - DNA, 633 bp, Artificial Sequence
  Description of Artificial Sequence: Synthetic coding sequence
atggccgccgccggctggcgggacggcagcggccaggagaagtaccgactcgttgtagtcggcggcggtggagtcggtaaatccgccctcaccatccagtttatccagttttttctcttcctccagtcatactttgtcaccgattacgacccaacgattgaggacagttacacaaaacagtgcgtgatagatgatcgggccgctcggctagacatattggacacggcagggcaggaggaattcggcgctatgcgcgagcagtacatgagaactggcgagggttttctcctggtcttcagcgtgaccgaccgaggatcctttgaagagatttacaagtttcagcgccaaatcctcagggtgaaggatcgggatgagtttcctatgatcctgattgggaataaggctgatctggaccaccaacgccaagtgactcaggaggaggggcaacagttggcacgacagctgaaagtgacctatatggaggccagcgctaagatccgcatgaacgtggaccaggccttccacgagctagtacgcgttataagaaaattccaagagcaggagtgtcccccttccccagagcctactcgtaaagagaaagataagaaaggatgtcactgcgtgatattctag

SEQ ID NO: 202948 - DNA, 633 bp, Artificial Sequence
  Description of Artificial Sequence: Synthetic coding sequence
atgggctgctgcagcagcagcgacccccggcgggaggacgacctgcgcgcacgggaaaaattaaagaaaaccaagattatattcgtggtgggcggacctgggtccggaaagggtactcagtgtgaaaagatcgtacagaaatacggttacactcacctttctacaggcgaccttctgcggtccgaggtctcaagcgggagcgctcggggaaaaaaattgagcgagatcatggaaaagggtcagctggtccctcttgaaacggtactcgatatgctgagggatgctatggttgcaaaggtcaacacctctaaaggcttcttgattgatggctacccccgggaggtccaacagggcgaagaattcgagcgacgaataggacagcccacactactgctgtatgtggacgcaggcccagagacaatgacccagcggctgcttaaacgcggagagacgagtggacgcgtggatgataacgaagagactatcaaaaaacgcctggagacttattataaggcaactgagccggtaattgcgttttatgagaagcgcgggattgtccgaaaggtgaatgcagaaggcagtgtcgacagcgtcttcagccaggtgtgtacgcatcttgacgccctgaagtag

SEQ ID NO: 202949 - DNA, 354 bp, Artificial Sequence
  Description of Artificial Sequence: Synthetic coding sequence
atgccccggctgttcctgttccacctgctggagttctgcctgctgctgaatcagtttagcagggctgtcgctgctaagtggaaggacgatgttattaagctgtgtggaagagagctggttagagcgcagatcgctatctgcggaatgagcacatggagcaagcgctctttatcccaagaagacgccccgcagacacccagaccggttgctggcgactttatccaaacagtgagcctcggaatttcgcctgacggcggcaaggccctgcgaacaggatcttgttttaccagggaatttctgggagccctgtccaaattgtaccatccatcgtctaccaaaattcaaaaactttag

SEQ ID NO: 202950 - DNA, 429 bp, Artificial Sequence
  Description of Artificial Sequence: Synthetic coding sequence
atggcccggtacatgctgctgctgctgctggccgtgtgggtgctgaccggtgaactgtggccaggagctgaggctagggcagccccatacggtgtcaggttgtgcggcagagaattcatcagagccgttatttttacttgcggcggcagccgatggagacgtagcgatatactggctcacgaggcaatgggcgatacattcccggacgctgatgctgacgaagactctctggcaggcgaattagatgaagctatgggatcaagcgaatggcttgcgctaaccaaaagcccgcaggccttttacagaggacggccctcctggcagggaacccccggcgtcctcaggggttctagagacgtgctcgccggcctgtcgagctcttgctgcaagtggggctgtagcaaatcggagattagtagtttgtgctag

SEQ ID NO: 202951 - DNA, 1293 bp, Artificial Sequence
  Description of Artificial Sequence: Synthetic coding sequence
atgaagcccagcctgctgtgccggcccctgagctgcttcctgatgctcctcccatggcctctagcaacactgacttcaacaactctgtggcaatgcccacctggtgaggagcctgacctggaccctggccagggtaccctctgtcggccatgcccaccaggtacctttagcgcagcctgggggtcatccccgtgccagccacacgctaggtgctcactctggcgcaggctggaggcccaagtgggcatggctaccagggatactctgtgtggggattgctggccggggtggtttgggccatggggcgttccaagagtgccctgccagccctgctcatgggcacctctcggtactcatggctgtgatgagtggggtcgacgcgcccgccgcggagtggaggtggctgcgggagcttccagtggaggcgaaacaagacagcccggtaacggcactcgggcaggggggccagaagagacggctgcgcagtacgccgtcatagctattgtgcccgtgttttgtttaatgggactgctgggcatcctggtctgtaacctgctcaaaagaaagggctatcactgcaccgcccataaagaagtgggtcccggacctggggggggggggtcaggtatcaatccagcttaccggaccgaagacgctaacgaggacaccataggagtccttgtgcggctgatcactgaaaagaaggaaaatgccgccgctctggaagagttgctgaaggagtatcattccaaacagcttgtccagacatcacacaggcccgtgagtaaactcccccccgccccccccaacgtcccacacatttgcccccaccggcaccacctgcatactgtccagggccttgccagtctctctggcccttgctgcagtaggtgctcacagaaaaaatggcccgaggtacttctgagccccgaggccgttgccgctactacgccagttccaagtctgttaccaaaccctacacgtgttcccaaagccggcgcaaaggccgggcgtcagggagaaataacaattctgagtgtcgggaggttccgggttgctaggattcccgaacagcgcacatcaagtatggtgagcgaggtgaagacaataaccgaggccggcccctcatggggcgacctgccggactcacctcagccaggcctcccgcccgagcaacaggccctgctggggtccggcggatcgcgaaccaaatggttgaagcccccggcagaaaataaggccgaagagaaccgttacgttgtccgcctctctgagtcgaatctggttatctag

SEQ ID NO: 202952 - DNA, 1293 bp, Artificial Sequence
  Description of Artificial Sequence: Synthetic coding sequence
atgaagcccagcctgctgtgccggcccctgagctgcttcctgatgttgctcccttggcccctggctacgctcacatccaccacgctgtggcaatgtccccctggagaagagcccgacttggaccctggtcaagggactctttgccgtccatgtccacccggaacattctctgcggcttggggctcttccccctgccaaccacacgcccggtgtagcctgtggaggagattagaagcccaggtcggtatggcaacaagagatacactctgcggtgattgttggcccgggtggttcggcccctggggcgtaccacgggtgccctgccagccgtgtagctgggcacccctgggcactcatggctgtgatgagtggggaagacgagccaggaggggtgtggaagtggcagcaggtgccagcagcgggggtgaaactcggcagccagggaatggcactagagctggaggacctgaggagacagctgctcagtacgcagtgattgcaattgtgcctgtgttctgccttatgggactcctgggcatcctagtgtgcaacctgcttaaaaggaagggctaccattgtaccgcacacaaagaagtggggccagggccgggtggcggcgggagtggaattaaccctgcataccggaccgaagacgccaatgaggataccataggcgtcctcgttcgtctgataactgagaagaaagaaaatgctgccgctctggaggaactactaaaagagtaccacagcaagcagctggttcagacgtctcatagacctgtgtccaagctccctcctgccccacctaacgtcccccacatctgtccacaccgacaccatttacacaccgtacaaggcttggcttccttatcaggtccctgctgctcccggtgcagtcagaaaaaatggccggaggtcttgctgtccccagaggctgtcgctgccaccacaccggtgccctcacttctgcccaacccgacgagagtgcccaaagcgggagcaaaagccggccggcagggggagataacaatcctcagcgtggggagattccgtgtggcccgtatccccgagcagaggactagctcgatggtgagtgaggtcaaaaccatcactgaagcaggcccctcctggggcgaccttccggatagcccgcagcccggccttccaccagagcagcaggcgttgctcggaagcggaggatcacgcaccaaatggcttaagccccccgctgaaaataaggcagaagaaaataggtatgtggtcaggctgagcgaaagcaatcttgttatttag

SEQ ID NO: 202953 - DNA, 897 bp, Artificial Sequence
  Description of Artificial Sequence: Synthetic coding sequence
atgcaccccggctgctgggtgcaggaggccctggtgctgaaccacgaaggtgatatggggttctccgagccaggatcccacatttgcagagcccttggtggcctgagtccaaagtgcacgtgctccggaccccttcgccgccccgggctcccttccgccggccgttcctggtttagttcaggtgtacgccttcccccatcacctggaagcgggccattcagttctcccggcatcaatcctgcctaccgtactgaggacgcaaacgaggacaccattggggttttggtgagacttattacagaaaaaaaggagaacgcggccgcccttgaagaactcctgaaggaatatcactccaagcagctcgttcagactagccatagacctgtcagcaagctgccacctgcccctccaaacgtgccccacatctgccctcatagacaccaccttcacactgtgcagggtctggcatctctctctggcccttgctgctccaggtgtagccagaagaagtggcccgaagttctgttatcaccagaagctgtcgccgctacaactcccgtaccgtctctcctccccaacccaacccgcgtacccaaagccggcgccaaggctggacgacagggggaaataacaatcttgagcgtgggccggtttcgcgttgccaggattccagagcaacgcacaagctccatggtctctgaagttaaaactatcactgaagcgggccccagctggggcgacctccctgattcaccccagcccggtttgccccccgaacagcaggcccttctgggatccggaggaagccggaccaaatggttaaagcccccagctgagaacaaggccgaggagaacaggtatgtcgttcggttatcagaatccaatctggtaatatag

SEQ ID NO: 202954 - DNA, 306 bp, Artificial Sequence
  Description of Artificial Sequence: Synthetic coding sequence
atgaagcccagcctgctgtgccggcccctgagctgcttcctgatgctcctgccctggcccttggccactctgacatcaaccacactctggcagtgccccccaggcgaggaaccggacctggaccctggtcagggcaccctttgtcgtccgtgtcccccaggaaccttttctgcagcttggggtagcagtccctgccagccacacgccagatgttctctttggcgccggctggaagcgcaggtcggcatggcgactcgcgacaccctctgcggagactgttggccaggctggttcgggccttggtag

SEQ ID NO: 202955 - DNA, 4326 bp, Artificial Sequence
  Description of Artificial Sequence: Synthetic coding sequence
atggccaccgccgccgccgccgccgccgtgatggccccccccggctgtccaggaagctgccctaattttgccgtcgtgtgtagttttctggaacgatacggacctctcctcgaccttccagaactgccatttccagagctggagcgtgtgctgcaggccccaccaccggacgtgggcaacggtgaggttcccaaggagctggtggaactgcatctgaaactgatgcgaaagataggcaagtcagtcaccgcagataggtgggaaaaataccttataaaaatctgccaggaattcaacagcacgtgggcttgggaaatggagaagaagggctatctggaaatgtccgtggagtgcaagcttgccctgttgaagtacctctgtgaatgtcagttcgacgacaacctgaaattcaaaaacataatcaacgaggaggacgctgatacaatgcggctccagcctataggacgcgataaagacggtttaatgtactggtaccagctggatcaggatcacaatgtccgtatgtacatagaagaacaggatgatcaagatggctcctcatggaagtgtattgttcggaaccgtaacgaactcgccgaaacgttggccctcctgaaggcccagatcgatcctgtcctcctcaaaaatagctctcagcaggacaactcctcccgggagagcccctccctggaagacgaggagacgaagaaagaggaagagaccccaaaacaggaggagcaaaaagaatctgaaaaaatgaagagcgaagaacaacctatggatctggagaatcggtcaactgctaatgtgcttgaagagaccacggtaaagaaggagaaggaggacgaaaaggagctggtgaaactgcccgtgatcgttaaactggaaaagccccttcccgaaaatgaagagaagaaaattatcaaagaggagagcgatagcttcaaagagaacgtgaaacccatcaaggtggaggtaaaagagtgtagagcagaccctaaggacacaaaaagctccatggagaagcccgtcgcacaggagccagaaagaatagaattcggcggcaatataaaatctagtcatgaaattacagaaaagagcactgaggaaacggagaagttaaagaatgaccagcaggctaaaatccctcttaaaaagcgagaaataaagctgagtgacgactttgattctcctgtgaagggccccctgtgtaaaagtgtgacacccactaaagaattccttaaggatgagatcaaacaggaggaagagacttgcaaacgcatctccacaatcacagcgctgggccacgagggcaagcagctggtcaatggggaagtgtccgacgagagggtagccccaaacttcaagaccgagccaattgagacaaaattctacgaaacaaaagaagaatcttacagtccctcaaaggatcgaaatataattacggaaggcaatggcacagagtctttaaattcagtgatcacctcaatgaaaaccggagagctagaaaaagagaccgcccccctgcggaaggacgccgactcctccatctctgttttggagatacactcacagaaagcccagattgaagagccagacccacccgagatggaaacatcgttggattcttcagagatggcaaaagacctgtcatctaaaaccgcgctttccagtacagaaagctgtacaatgaaaggcgaggaaaaatctcctaaaaccaaaaaagataagcggcctccaatcctggagtgcctcgaaaaacttgaaaaaagtaaaaagacctttctcgataaggacgctcagaggctgagtcctatacccgaggaggttcctaaatctacactggaaagcgagaagccaggctctccggaggccgccgagaccagcccccctagtaacatcattgaccactgtgaaaaactggcttccgagaaggaggtagtggaatgtcagtctacgagcacggtgggaggacagagcgtcaagaaggtggacctggaaacgttaaaggaagactccgaattcactaaggtcgaaatggacaacttggataacgcacaaacatccggaatcgaagaaccatccgaaacaaagggatcgatgcagaagagcaaatttaagtataagctggtgcctgaggaagagaccaccgcatccgagaacactgaaattacctccgagcggcaaaaggaggggattaaactgaccattcgaataagctcccggaaaaaaaagcccgattctccccccaaggtcctcgaacctgagaacaagcaggaaaagacagagaaggaggaagaaaaaaccaacgttggccggactcttcgccgtagtcccaggatcagcagacccacagctaaagttgccgaaattagggaccaaaaggctgacaagaaacgcggggaaggggaggatgaggttgaggaagagtctacagccctgcaaaaaacagacaagaaagaaattctcaagaaatccgaaaaggacacaaattcgaaggtttcaaaagtgaaacctaaaggtaaagtacgatggaccggcagcagaactaggggacggtggaagtatagttccaatgacgagtcagagggctcaggatctgagaagtcctcagctgcatctgaggaagaggaggagaaagagagtgaagaggctatcctagcagacgatgacgagccgtgtaaaaagtgcggcttgcccaatcatcccgaacttatcctgctttgcgatagctgcgacagcgggtatcatactgcttgtctgcggccgcctttaatgatcatcccggacggagagtggttctgccccccttgtcagcacaaactgctttgcgaaaagctcgaggagcaactgcaggatctggatgtggctctgaagaagaaagagcgggcagaacgccgaaaggagcgactggtgtacgtgggcatcagcatcgagaatatcatcccgccccaggagcctgatttctcagaagaccaagaagagaaaaagaaggactcaaagaagtcaaaagcgaacctactggaacggagatctacaaggacacggaaatgtatctcttacaggttcgatgagttcgacgaggcgattgatgaggcaattgaagatgatatcaaagaagctgacggaggtggggtcggtagggggaaggatatcagcacaattactgggcacagggggaaggacattagcactatcctggacgaggagagaaaggaaaataagaggcctcagagggctgctgccgctagaagaaaaaagcgccgtaggctcaacgacttggactccgactcaaatcttgatgaggaggagagcgaggatgagtttaaaatctcggacggctcacaggatgagttcgtagtgagcgatgaaaatcccgacgagagcgaggaggatccacctagtaacgatgacagtgacactgacttttgcagccgcagactgcggcgacacccgtctcgcccgatgagacagtctagacggctaaggaggaaaacacccaagaaaaaatactcagatgacgatgaagaagaggaatccgaggaaaactccagggattctgagagcgatttcagtgacgatttttccgatgattttgtagagacccgacggcgacggagtcgcaggaatcagaagcggcaaatcaattataaggaagactctgagtcggatgggtctcaaaaatctcttcggcgcgggaaggagatccgacgcgtacacaagagaagactgagttcttcggaatcagaagagagctatctgtctaaaaactctgaagacgacgaactggcgaaggagtctaaaagaagcgttcgcaaaagaggcagatcgaccgacgaatattcagaggccgatgaggaggaagaggaagaggagggcaagcccagcaggaaacgcctgcaccggatagaaactgatgaagaggagagctgcgataacgctcacggcgatgccaaccagccagcacgcgacagtcagccacgcgtgctacctagcgagcaggaatccacaaagaaaccatatagaattgagtctgatgaggaggaggactttgaaaatgtgggaaaggttgggtcacccctagactatagtctggtagacctgccttctacaaacgggcagtcacctggcaaggccattgagaacttaattggcaaacctacggaaaagtctcagacccccaaagacaactcaaccgccagcgcatctctagcatccaatggcacgagcggtggccaggaggccggcgcccccgaagaggaagaggatgaactgctgagggtcacagatctcgtggattacgtgtgcaattctgagcagctctag

SEQ ID NO: 202956 - DNA, 4233 bp, Artificial Sequence
  Description of Artificial Sequence: Synthetic coding sequence
atggccaccgccgccgccgccgccgccgtgatggccccccccggctgccccggttcttgccccaatttcgccgtggtgtgtagttttttagagcggtacggcccccttctggatttgcccgagttgccgttccctgaactagagcgtgttctccaggcacctccccctgatgtgggcaacggtgaagtccctaaagaactggtggaactgcatttgaagcttatgagaaagatcgggaaatctgtcacggccgacagatgggagaaataccttattaagtacctgtgcgagtgtcagtttgacgacaaccttaagtttaagaatatcatcaatgaggaggacgctgatacaatgcgcctgcaacctattggaagagacaaggatggtctgatgtattggtaccagctggaccaggaccacaacgtgcgaatgtatatcgaagagcaagatgatcaggacggctcgtcatggaagtgcattgtgcgcaatcggaacgaactcgccgagacgttggctttactcaaggcccagatcgatcccgtgctcctgaagaattctagtcagcaggacaactcttctcgagagtcaccttccctcgaagacgaggagacgaaaaaagaggaagagacgcccaaacaggaggagcagaaggaaagcgaaaagatgaaatctgaagagcagcctatggacttagagaatcgcagcaccgcaaacgtgctggaggaaaccacagttaaaaaggaaaaggaggatgaaaaggaacttgtgaagctgccagtgattgttaagttggagaaaccactgcccgaaaacgaggagaaaaagataattaaggaggagtctgatagcttcaaagagaacgtgaagcccatcaaggtggaagtgaaagagtgccgcgccgacccgaaggacacaaagagtagtatggagaaacccgtcgctcaagaacccgagaggatcgagtttggcggcaatataaaaagttcacatgagattacggagaagtccacagaggaaaccgagaagctcaagaacgaccaacaggccaagattcctctaaagaaacgggaaattaaattgtccgatgatttcgatagccccgtgaaaggacccctgtgtaagagtgtgacacccacaaaagagtttctgaaggacgaaataaaacaggaggaggagacttgtaaacggatttccaccattaccgctttgggccacgagggtaaacagcttgtaaatggcgaagtgtcagacgaaagagtggcccctaatttcaagaccgagccgattgagacaaagttttacgaaacaaaagaggagtcttacagcccatcaaaagaccgcaatatcatcacagagggaaatggcacagagagtctaaacagcgtaatcacatccatgaaaaccggcgagctggagaaggagactgctccgctgagaaaagatgctgattcttccatatcagtcttagagattcactctcagaaagctcagatcgaagaaccggatcccccggagatggaaacatcgttagactcttcagagatggctaaggatctcagcagcaagacagctctcagctctaccgaatcttgcaccatgaagggggaggaaaagagtccaaagactaagaaagacaagcggccaccaatactggagtgcttggaaaaactcgagaagtctaagaaaactttcttggacaaggatgcccagaggctgagcccgatccctgaagaggtccctaagagcactctggaatcagaaaaaccaggaagccctgaagccgctgagacgagcccaccgtcgaatattatagatcattgcgaaaagttggcaagtgaaaaagaggttgtggaatgtcaatccactagcaccgttggagggcagagtgttaagaaggtggacctggaaaccctgaaggaagactcagagtttacgaaagtcgaaatggataacctagacaacgcacagacttccggcatcgaggagcctagtgagacgaaggggagtatgcagaaaagtaagttcaaatacaaacttgtgccagaagaggaaactacagcatctgagaacacagagatcacttccgaaagacagaaggaaggtattaaactcaccattaggattagctctcggaaaaagaaacccgacagtcctccaaaggtactggaaccggaaaataagcaggagaaaacagagaaggaagaggaaaagaccaacgtgggccggacactgcgtcgaagccctcgtatatctcgccctactgcaaaggtagccgagattcgcgatcagaaggccgacaaaaaaaggggagagggggaggacgaggtggaagaagagagtacagctttgcagaagacagataagaaggaaatcctgaaaaagtccgagaaagacacgaacagcaaagtgtcgaaagtgaaacctaaaggaaaggttagatggaccgggtcaagaactcggggacggtggaaatactccagcaatgacgaaagtgagggttccggaagcgaaaaatcaagtgcagcatccgaagaagaagaagaaaaggagagtgaggaggcaatcttagccgacgatgacgaaccctgtaaaaaatgtggtttgccaaatcaccccgagcttatcttgctgtgcgattcttgcgactcaggttatcacacagcctgtctgaggcctcccctcatgattatccctgacggagagtggttttgtcctccatgccagcacaagctgctttgtgaaaagctggaggagcaactgcaggacctcgatgtggcgctgaagaagaaagaaagagctgagcgaagaaaagagagattggtctatgtcggaataagcatcgagaatattatccctcctcaggagcctgactttagcgaggatcaggaggaaaaaaaaaaggattctaagaagtcaaaagctaatttgctggagcggcggagtacccgcacccgcaagtgtatctcgtaccgatttgatgaattcgatgaagcgattgatgaggccatcgaggacgacattaaagaagctgacggtggcggcgtcggacggggaaaagatatctccactattacaggacatagaggaaaagatattagcactatcttggacgaggaacgcaaggagaataaacggccccagagggcagcagctgcacgtagaaaaaagcgacggaggttgaacgacctggactccgacagtaacttggatgaagaagagagtgaggacgaattcaagatttctgatggctcacaggatgagtttgttgtgtccgacgaaaatccggatgagtctgaagaggaccctcccagcaacgatgactcagacaccgatttttgcagccgacgactccggcgccatccttctcgacccatgcgccagtcccgacggctcaggagaaagacccctaaaaaaaaatacagtgacgatgatgaagaggaagagagcgaggagaatagtagagactcagaatcggatttttcagacgatttttccgacgacttcgtggaaactcgcagaagaagatcccggcgaaaccagaaacgtcaaataaattataaagaggatagtgagagtgacgggtcccagaaatctctgcggagaggtaaagaaatccgccgtgtgcataagcgacggctttcttctagcgaaagtgaagagtcatacctctcaaaaaatagcgaagacgatgagcttgccaaggagagtaaaaggtcagtcaggaagaggggtcgatcaacggacgagtatagtgaagcagatgaggaagaggaggaagaggagggtaaaccctccagaaaacggctccacagaatcgaaaccgacgaagaggagtcctgtgataacgctcacggggatgctaaccaaccagctagggactcacagcccagagtgcttccatcagagcaggaaagtactaagaagccatatcgaatcgaatccgatgaggaagaagattttgaaaatgtcggcaaggttggcagcccattagattatagcctggtggacctcccatctactaacggccagtctcctggcaaagccatcgagaatctgattggcaaacctaccgagaaatcacagactcccaaagacaactccactgcctccgcttcactggcctcaaacggtacatccggtggccaggaagcaggggcacccgaagaggaggaagatgaactgttacgggtgacagacctggtggattacgtgtgcaactcggagcagctctag

SEQ ID NO: 202957 - DNA, 3570 bp, Artificial Sequence
  Description of Artificial Sequence: Synthetic coding sequence
atgaagagcgaggagcagcccatggacctggagaaccggagcaccgctaacgtgctagaagagaccacagttaagaaagagaaggaagacgagaaagaattggtgaagcttcccgtcatagtgaaacttgagaagcctctccccgaaaatgaggaaaagaagataataaaggaggaaagtgatagcttcaaggagaacgtgaagcccataaaggtagaggtaaaagaatgcagggccgatcctaaagatactaagagttccatggaaaagccagtggcacaggagccagaacgcatcgagttcgggggcaacatcaagtcatcacacgaaataacagaaaagtctaccgaggaaaccgagaaactcaaaaatgaccagcaggctaagattccgctgaagaagcgagaaattaagctttccgacgactttgattctccagtaaagggccccctctgtaaatctgtcacaccaaccaaggaatttcttaaggatgagattaagcaagaggaagaaacatgcaaaagaatctctaccattacggcccttggccatgaaggaaagcaattagtgaatggcgaggtgagcgatgagcgcgtagctcctaacttcaagactgagcccatcgaaacgaaattctacgagactaaagaggagtcctactccccttctaaagatcgcaacatcattaccgagggtaacggcacagagtctctgaactccgtgattacaagtatgaagaccggcgaactcgagaaggagacagcacccctgcggaaagacgcagatagttctattagcgttctcgagatccattcacaaaaggcccagatagaggagcctgacccaccagaaatggagacatccctggatagcagcgaaatggctaaggatctctcttccaagaccgctctgagctctaccgagtcttgtactatgaagggagaggaaaagtcaccaaagactaagaaggacaagagacctcctatcttggaatgcctggagaaacttgagaagtcgaagaaaacatttttagataaagatgctcagcgcctttctccgattcccgaagaagtgccgaaatccaccctcgagtcagagaagcctggctctcctgaggcagcggagacttctccaccaagcaatatcatcgaccactgcgaaaagcttgccagtgagaaggaagtggtagaatgccagtccacatccaccgtcggcggccaatccgttaaaaaagtggatctggaaacgctaaaggaggactccgaatttacaaaggtggaaatggacaatctggataatgcgcagactagcggcatagaggagcccagcgagacaaaggggagtatgcagaagtctaaattcaaatacaagctcgtcccggaagaagagaccacggcctcagagaacaccgaaatcactagtgagcgacagaaagaggggattaagctgacaatccgaatttcttccaggaagaagaagccggattcccctcctaaggtattggaacccgaaaataaacaggaaaaaactgagaaggaagaggagaaaactaacgttgggcgcacactgagaaggtctccacgaatcagcaggccaacggcaaaagtggccgaaatccgcgatcaaaaggcagataagaaaaggggtgagggggaggatgaggtggaggaggaatcaacagcccttcaaaaaaccgacaagaaagagatactgaaaaagagcgagaaggacactaactctaaagtcagtaaggtgaagccaaagggaaaggtacggtggactggctctcgcaccaggggaagatggaagtatagttccaacgacgagtccgagggttcaggctcagagaagagcagcgccgctagcgaagaggaggaggagaaggagtctgaagaagctatcctcgccgatgatgacgaaccgtgtaagaagtgtggtcttcctaaccatccggagctaatcttgctgtgtgactcctgtgatagcggatatcacactgcttgcctgcggccccccttgatgatcattccagacggcgagtggttctgtccgccctgccaacacaaactcctgtgtgaaaagctggaagaacagctacaagacttggatgtcgctcttaaaaagaaggagcgggccgagcgcaggaaggagagactggtctacgttggcatatccatcgaaaacatcattcctccgcaggaaccagacttcagcgaggatcaagaagagaaaaagaaagactccaagaagagcaaagcaaacctgctggaacggcggtctacccgaacaagaaaatgcatctcttatcgatttgatgaattcgacgaggcaatcgacgaggccattgaggatgacatcaaagaagcagacggtggaggcgtgggtcggggaaaggatatctctacaattacagggcacaggggaaaggatatcagcacaattctcgatgaggagcgcaaagagaataaaaggccccagagagcagccgctgccaggcgaaagaagcgtagaaggctgaatgacctggattccgattccaatctggatgaagaggagtctgaggatgaatttaagattagcgacggctctcaggatgagttcgtagtctccgacgagaatcccgatgaaagtgaggaggatcccccctcgaacgacgacagcgacactgacttctgctctcggagactgagacgacaccccagcaggcccatgcgacaaagtagacgactgcggcgaaaaactccaaaaaaaaaatattctgatgatgacgaggaggaggagtccgaagagaacagcagggacagtgaatccgacttctcagacgacttctccgatgactttgtggaaacgcgtcgaaggcgatccaggaggaaccagaagcgccagattaactacaaggaagattccgagtccgacggaagtcagaaaagcctacgaagaggaaaggagatcaggagggtgcacaagaggagactctcctcaagtgagtcagaagagagttacttgagtaagaattctgaagacgacgaacttgccaaggagtccaagaggtccgttcgtaagagaggaaggagcactgacgagtattctgaggccgatgaagaagaggaagaggaagaagggaagcccagtcgaaaaaggttgcatcggatagaaaccgatgaggaggagagctgcgacaacgctcatggagacgctaaccagcctgcaagagactcccaaccaagggtcctcccttccgaacaagaatccaccaagaaaccctatcgcattgaatctgatgaggaggaggattttgagaacgtcggcaaagtgggatcaccactggattatagcctcgttgacttaccatccacaaacggccagagccctggaaaagctatcgaaaacttgattgggaaacctactgagaaaagccagactcccaaagataacagcacagccagcgccagtctggctagtaatggcacatcagggggacaagaggcaggggcccccgaggaggaagaagacgagctgttgagggttaccgatttggttgactacgtctgcaattctgagcagttgtag

SEQ ID NO: 202958 - DNA, 2412 bp, Artificial Sequence
  Description of Artificial Sequence: Synthetic coding sequence
gagaccctggccctgctgaaggcccagatcgaccccgtgctgctgaagaattcatcccagcaggacaattccagtcgcgaaagcccaagtctcgaggacgaagagaccaaaaaagaggaggaaacgcccaaacaagaggagcaaaaggaaagtgagaaaatgaaatctgaagagcaaccaatggatcttgagaatcggagcacggctaatgtgctggaagaaaccaccgtcaagaaggagaaggaggatgagaaggaactggtgaagctgccagtgatcgttaaactcgagaagccccttcccgagaacgaagagaaaaagatcatcaaggaggaaagcgactccttcaaagagaacgtcaagccaattaaggtggaggtaaaggagtgccgcgctgatcccaaagacaccaagagctccatggaaaaaccggtggcacaggaacctgaacgcatcgaattcggcggaaacattaaatcctcacacgagattactgagaagagcaccgaggaaaccgagaaactgaagaatgaccagcaggccaaaatacccctaaaaaagcgagaaattaaactgagtgacgactttgattcccctgtcaaaggacccctctgcaagtctgttactccaacgaaggagttcttgaaagacgagatcaagcaggaggaagagacctgcaaacgcatttcaactattaccgccttaggccatgaaggtaaacagttggtgaacggtgaggtgtctgacgaacgggtcgcccctaatttcaaaaccgaacccatcgaaactaagttttatgagactaaggaggaatcttactcacctagtaaggacagaaatatcatcacagaaggcaatggcacagagtccctcaactctgtgattacctcgatgaaaactggagagcttgaaaaagagactgcccccttgcgaaaggatgccgactcctcaatatcagttcttgaaatccactcccaaaaagctcagatcgaggaaccagacccacccgaaatggagaccagtctggatagttctgagatggccaaggatttgagttcaaaaaccgccttgtcctctaccgagtcctgtactatgaagggggaggaaaagagtccaaaaaccaaaaaggacaagagacccccaatccttgaatgcctggaaaagttggaaaagagtaagaaaacttttctggacaaggacgcccagcgcttaagccccatccccgaagaggttcccaagagcacactggaaagtgagaaaccgggctctccagaggccgctgagacatcaccaccatctaacataatcgatcattgcgaaaagcttgcttcagagaaagaggtggtggagtgtcagagcacttccacagtggggggtcaaagcgtgaagaaggtggacctcgagacacttaaagaagacagtgagtttaccaaggtagaaatggataacctcgataatgctcaaacttcgggcatcgaggagccatccgagacaaagggctccatgcagaaatccaagttcaaatacaagcttgtccccgaagaggagacaaccgccagtgaaaataccgagattacttcggaacggcagaaggagggcatcaagctgacaatccgaatatcttcacggaagaaaaaacccgacagtccacctaaggttctagaacctgaaaacaagcaggaaaaaaccgaaaaggaggaggaaaagaccaatgtaggtcgcaccctgcgccgatctcccaggatctccagaccgactgccaaagtggccgaaatacgcgaccagaaagccgacaaaaaacgcggagaaggggaagatgaagtcgaagaggaaagtaccgctctgcagaaaactgacaaaaaagaaattttaaagaaatctgagaaggatactaatagtaaagttagcaaagtgaagcctaaagggaaggtgcggtggaccggatcacgtacgagaggccgatggaaatacagcagtaatgatgaatccgagggttcaggatcagagaaatcatctgctgctagcgaagaggaggaagaaaaggaaagtgaagaggccatactagctgatgacgatgagccttgcaagaagtgtggattaccaaatcacccagagctgattctcctatgtgactcgtgcgacagcggttaccacactgcttgccttcggcccccattaatgatcattcctgatggcgagtggttctgtcccccgtgccagcacaagctgctgtgcgagaagctggaagagcagttacaggacctggacgtggcacttaaaaaaaaagagagggcggagagacggaaggagcgactggtgtacgtgggaatctccatagagaatatcattcccccccaagaacctgacttttccgaagaccaggaggaaaagaagaaagatagcaagaagtag

SEQ ID NO: 202959 - DNA, 2109 bp, Artificial Sequence
  Description of Artificial Sequence: Synthetic coding sequence
gccaccgccgccgccgccgccgccgtgatggccccccccggctgcccaggatcttgtccaaactttgctgtggtatgtagtttcctggaacgttatggaccgcttctggaccttcctgagctgccattcccagaactggaacgcgttcttcaggcacctccccctgacgtgggcaatggcgaagtgccaaaagaactcgtcgaactgcacctgaaactgatgcggaagatcggaaaaagcgttactgcagaccgttgggagaaatatctcataaagatctgtcaggagttcaacagcacgtgggcttgggagatggaaaagaaaggctatctggagatgagtgtggaatgcaaactggccttactgaagtatctgtgcgagtgccagttcgatgacaacttgaagttcaaaaacattatcaacgaggaagacgctgatactatgaggcttcagcctatcggccgtgataaagatggactgatgtactggtaccagcttgatcaagaccacaatgtacgaatgtatattgaagagcaagatgatcaagatgggagttcgtggaaatgcatcgtccggaaccgtaatgagctggctgaaacactagctctgctcaaggcgcagatcgacccagtactactcaagaattccagtcagcaagacaatagcagtcgtgagagcccaagtctggaggacgaggaaaccaagaaagaagaagagacaccaaagcaggaggaacagaaggagtctgaaaaaatgaaatccgaagagcagccgatggacttggaaaataggtccactgccaacgttcttgaagaaacaactgtcaaaaaagagaaagaggatgagaaagagctcgtgaagctccccgtgattgtcaagctagagaaacctttgcccgagaacgaggaaaaaaaaatcattaaagaagagtccgactctttcaaagagaatgtgaagcctatcaaggtcgaagtgaaggagtgtagggcggaccccaaagataccaagtcatcaatggagaaacctgtggcccaggagcccgagcgcatcgaattcggaggtaatatcaaatctagccatgagatcactgagaaaagcacagaggagaccgaaaagctgaagaatgatcagcaggcaaagatacccctgaagaagagggaaatcaaactttccgacgacttcgattctccagtcaagggcccactctgcaagtccgtgacaccaaccaaagaatttctgaaggatgagatcaaacaggaggaagagacttgcaaacgaataagcacaattaccgcactggggcatgaggggaaacagttagtcaacggcgaggtgagcgacgagcgagtcgcaccaaatttcaagacagagccgattgagaccaagttttatgagacaaaggaggaatcatattctccctccaaggaccggaacattatcaccgaaggaaatggcacggaaagcctcaatagcgtcattacctccatgaagactggggagttggaaaaggagacagctccactccggaaggacgccgactcaagcatctcagtgctcgagattcacagccagaaggctcaaatcgaagaacccgacccacccgaaatggagactagtctagatagctcagaaatggccaaagaccttagcagtaaaaccgcgctcagtagtacagaatcgtgcaccatgaagggagaggagaagtcccccaaaacaaaaaaagataagcggccacctattttggagtgtttggaaaagttagaaaagtcaaagaagacattcctggacaaagatgctcagagattgagcccgattcctgaggaagtccctaaaagtacactggagtcagagaagcctggctccccggaggccgcggagacctcaccgcctagtaatatcatcgatcattgtgagaaactggcctccgaaaaagaggtggtagagtgccagtctacttccaccgtaggcggacagtccgtaaagaaggtggatcttgagacattaaaggaggattcggagtttactaaggttgagatggataatcttgacaacgcccagacgtctggtatcgaggagccctctgagaccaaaggttcaatgcaaaaatag

SEQ ID NO: 202960 - DNA, 831 bp, Artificial Sequence
  Description of Artificial Sequence: Synthetic coding sequence
gagccctgcaagaagtgcggcctgcccaaccaccccgagctgatcctcctctgcgatagctgcgactcaggctatcacaccgcttgtttaagaccaccattgatgataatcccagatggagaatggttttgcccaccatgccagcataagctgctgtgtgaaaagctcgaggagcagctgcaggatcttgacgttgcactcaaaaaaaaggagcgagcagagaggcgaaaagagcgtctggtgtatgtagggatttccattgaaaacatcatccccccacaggaacccgatttttccgaggaccaggaagagaagaaaaaggattctaagaaaagtaaagccaacctcctggagaggagatcgacacgaaccaggaagtgcatttcttaccggttcgacgagttcgatgaggccattgatgaagccattgaggatgatattaaggaggccgacggcggcggagtgggtcggggtaaagatatttccacaatcactggccacaggggaaaagatatcagtacaattctcgacgaagagaggaaagagaataaacggcctcagcgagccgcggctgctaggaggaagaaaaggcggcgcctgaacgatttggatagtgacagcaatctggatgaagaggagtctgaggatgaatttaaaatttctgatggaagccaggatgagttcgtcgtgagtgacgaaaatccagacgagtcggaggaagatcctccgtcaaatgatgactccgacacagatttttgttcaagacgcttgagaaggcatccctctaggcccatgcgacagagtcggagactgagaaggaaaactccatag

SEQ ID NO: 202961 - DNA, 1029 bp, Artificial Sequence
  Description of Artificial Sequence: Synthetic coding sequence
atggcccaggtgctgatcgtgggcgccggcatgaccggcagcctgtgcgctgccctgttgagacgccaaacttccggccccctgtaccttgctgtttgggataaggccgaggattcaggaggtaggatgaccacggcctgctccccccacaacccacagtgcacagcagacctcggcgcccagtatatcacatgcactcctcactacgcgaaaaagcaccaacgattttacgacgagttgctggcttacggcgtcctgcgacccctgtcttcccctatcgaaggaatggtcatgaaggagggcgattgtaatttcgtggccccacagggtatatccagcatcatcaagcattacctcaaggagtccggtgcggaagtctattttagacatcgggtgacgcaaattaatctccgggatgataaatgggaagtcagcaaacagacagggagtcccgaacaattcgacctgatcgttctgactatgccagtgcctgagatccttcagctgcaaggggacattaccacgctgatcagcgaatgtcaacgccagcagttagaggcagtaagctactctagccggtacgctcttggcctgttctacgaagcaggaactaaaatcgatgtgccctgggctggccagtacatcacttccaatccgtgtatccgatttgtgtccattgacaacaaaaagcggaacatcgagtcctccgagattggccctagcctagtgattcacacaacagtaccctttggcgtaacctacctagagcacagcatcgaagatgttcaggaattggtttttcaacagttggagaacatcctgcctggtctgccccaacccattgctacaaagtgccagaaatggcgccactcacaggtgaccaatgccgccgccaactgccccggacagatgacgctacatcacaagccattccttgcatgcggcggcgacggattcacccagagcaattttgatggatgcataacatctgccctttgtgtgttagaagctctgaagaattatatttag

SEQ ID NO: 202962 - DNA, 948 bp, Artificial Sequence
  Description of Artificial Sequence: Synthetic coding sequence
atggcccaggtgctgatcgtgggcgccggcatgaccggcagcctgtgtgcggctctcttgagacggcaaacctcgggtcccctttacctggccgtatgggataaggcagaagactccgggggaagaatgaccaccgcttgctcaccacataacccacagtgtacagcagacttgggcgcccaatacatcacttgtacaccacactacgccaaaaagcatcagaggttttatgatgaactgctagcgtacggggtgttgagacccctctcatcgccaatcgaggggatggtcatgaaagagggtgactgtaatttcgtagctccgcagggaattagcagtataatcaagcattacctcaaggagtctggggccgaagtctacttcaggcaccgtgtgacccaaatcaatttgcgagacgataaatgggaggtttctaagcagacagggagccccgagcaattcgacctgatcgtcctgacaatgccagtgccagagatactccagttgcagggagacatcactaccctgattagtgagtgccagcgtcagcagctcgaagccgtttcatatagttcacgatacgccctggggctgttctacgaagccggcacgaagatcgacgtaccttgggccggccagtatatcacctctaatccatgtatcaggttcgttagtattgacaataagaaacggaacatcgaatctagcgagattggcccctcactggtgatccatactactgtgccctttggagtgacttatctcgagcattcgattgaggatgtgcaggagcttgtgtttcagcagctggaaaacattctcccggggctgccacagcctatcgcgaccaagtgtcagaaatggaggcattctcaggtgccctccgccggtgtgatcttgggatgtgcgaagagcccttggatgatggccatcggctttccaatttag

SEQ ID NO: 202963 - DNA, 699 bp, Artificial Sequence
  Description of Artificial Sequence: Synthetic coding sequence
atggcccaggtgctgatcgtgggcgccggcatgaccggcagcctgtgtgccgcactgttgcgccgccagacctccgggcccctatacctggccgtctgggataaggccgaggattctggagctgaggtttacttcagacatagagtcactcagatcaatctacgtgacgataaatgggaagtgtcaaaacaaactggttcaccagaacagttcgacttaattgtcctgacaatgcctgtgccagagatccttcagcttcagggagacatcactacactgatttcagaatgtcaacgtcaacagttggaagcagtgtcatattcttctcgctatgccctgggcctattctacgaagccggaacaaaaattgatgtgccctgggcggggcagtacattaccagcaatccttgcatccggttcgtgtctatcgataataagaagcgcaacattgaaagtagtgaaatcggaccttccttggttatccatacaaccgtgcctttcggcgtaacctacctcgaacactcaatagaggatgtacaagaacttgtgtttcaacagttggagaatatcctgccggggctcccccagcccattgcaaccaaatgtcagaagtggcgccattcgcaagtgccttcagctggagtcattttaggatgtgcaaaatccccgtggatgatggctataggctttcctatatag

SEQ ID NO: 202964 - DNA, 1221 bp, Artificial Sequence
  Description of Artificial Sequence: Synthetic coding sequence
atggacggctggcggcggatgccccggtggggcctgctgctgctgttgtgggggagctgcacttttggactgcctacagataccactactttcaagcgtatcttcctcaagcgaatgcctagcattcgggagagcctgaaggaacgcggggtggacatggctcgtttggggcccgaatggagccaaccgatgaagaggctcacgctggggaatactacttcatcagtcatccttactaactacatggatactcagtactatggtgagatcggcatcggaacacccccccagaccttcaaagtggtttttgacaccggcagttcgaatgtttgggtacccagcagtaagtgcagtagactgtacaccgcatgtgtgtatcacaaactcttcgacgctagtgacagcagttcttataagcacaacgggactgagctgacgctgcggtatagcactggaacagtatcgggtttcctttcccaggacattatcactgtgggcggaattacagtgactcaaatgttcggtgaggtgactgagatgcctgccctgccgttcatgctcgcagagttcgatggggtcgtgggaatggggtttattgagcaggccatcggccgggtgaccccgatcttcgacaacattatctcccagggggtgctgaaggaggacgtgttctccttttactacaatagggatagtgagaactctcagtctttggggggacagattgttctgggtggctccgatccccaacactatgaggggaactttcattacatcaacttaatcaagaccggagtatggcagatccaaatgaaaggagtgtccgtggggtcaagcactctcttgtgcgaagacggctgcctagctttagtcgatacaggtgcctcctatatctctggatcaaccagcagcatcgagaaactgatggaagcgctgggagcaaaaaagcgcttattcgattacgtggtaaaatgcaatgagggcccgaccttgccagatatcagtttccacctgggggggaaggagtacactttgacgtcagcagattacgttttccaggaaagttactcctctaagaaactgtgtacgctcgctatacatgccatggacattcctcctcccacaggaccgacttgggcgctgggcgctacgttcattcggaaattttatacagagtttgatcggcgaaataaccgaatcggcttcgctctggcacgatag

SEQ ID NO: 202965 - DNA, 1212 bp, Artificial Sequence
  Description of Artificial Sequence: Synthetic coding sequence
atggacggctggcggcggatgccccggtggggcctgctgctgctgctttggggctcctgcacgttcgggcttcccaccgacaccactacgtttaagaggattttcctcaaacggatgccttctattagggagtctctcaaggaacgcggtgtggatatggccagactgggacctgagtggtctcagcccatgaaaagactaactctgggcaacactacatcttctgtcatcctgaccaactatatggatacacagtactacggtgaaatcgggattggcacaccacctcagaccttcaaagtcgtctttgatactggctcttccaacgtttgggtaccatccagcaagtgctcccgcctttacactgcatgtgtctaccacaagctattcgacgccagtgacagcagcagttacaagcacaacggcaccgagttgacattaagatactctaccgggacagtgagcgggttcttatcccaggatataattacggttggcgggataactgtgactcagatgtttggggaggtgacagaaatgcctgcactcccattcatgctggccgaattcgacggcgtcgtaggtatgggcttcatcgagcaggccatcggccgtgtgaccccaattttcgacaacataattagccagggggtgttaaaggaagacgtattttctttttattacaataggaatagccagtctctggggggtcagatcgtgctgggtggcagtgatccccagcactacgagggaaatttccactacattaatctcatcaagaccggcgtgtggcagattcagatgaagggcgttagtgtgggatcctctacactcctgtgcgaagatggatgcctggctctggtagacacaggggccagttacatttctggctctacgtcatcaattgagaaactaatggaggcattgggggctaaaaagagattgttcgactatgtggttaaatgcaacgagggccccaccctgcccgatatttctttccatcttggagggaaagagtatacacttacatcggccgactacgttttccaggagtcctacagttcaaagaaattatgtacactagccattcatgccatggacataccaccaccgacaggccctacgtgggctttaggcgctacattcattcgcaaattttacaccgaatttgaccgccgcaacaataggataggatttgctttggcccgctag

SEQ ID NO: 202966 - DNA, 978 bp, Artificial Sequence
  Description of Artificial Sequence: Synthetic coding sequence
atggacacccagtactacggcgagatcggcatcggcacccccccccagactttcaaggtggtgttcgacacaggttcttctaatgtttgggtgccaagctcaaagtgcagccgtctatatacggcatgtgtataccacaagctgttcgacgcttccgacagcagcagctataagcacaatggtaccgagctgactctgcgctattccaccggcactgtttcagggtttttaagccaggatatcattaccgtcggcgggataacggtaacgcagatgtttggcgaggttaccgaaatgcctgctcttccttttatgttagcagagttcgatggggtggttggcatgggtttcattgaacaagctatagggcgggtcacccccatctttgataatattattagtcaaggtgtgttgaaggaagacgtgttctctttctattataaccgcgatggggagaatagccaatcactgggcgggcaaattgtgctgggggggtctgacccacagcactacgagggcaattttcactatattaatttgatcaagacaggagtgtggcagatccaaatgaagggagtgtcagtgggctcatcaaccctcctgtgtgaagatggttgcctggcactggtggacaccggggcctcctatattagcgggtctacctcctccatagaaaagcttatggaagcattgggagctaagaagaggctttttgactacgtggtgaagtgtaatgaaggtccaacattacccgatatatcatttcacttggggggcaaggaatacacactgacatcagccgactatgtgtttcaagaatcctatagctctaagaagctgtgcaccctggcaatccacgcgatggacatacctcctcctactggccctacctgggcactcggggccacctttataaggaagttctacacagagttcgacagacggaataataggatcggattcgcactcgctcgttag

SEQ ID NO: 202967 - DNA, 1284 bp, Artificial Sequence
  Description of Artificial Sequence: Synthetic coding sequence
atgagcaagggcctgcccgcccggcaggacatggagaaggagcgggaaaccctccaggcttggaaagagcgggtcggccaagagctggacagagttgtggctttttggatggagcactctcatgatcaggagcacggtggcttctttacatgtctgggcagggagggaagagtatacgacgatctgaagtatgtctggctgcaaggaagacaggtgtggatgtactgcaggctgtaccggaccttcgaaagattcagacatgctcagctgctggatgctgccaaggcagggggcgagtttctgctccggtacgccagagtggctccacctgggaagaaatgtgcatttgtgttgaccagagatggtcgccctgtgaaggtgcagcgtactattttctcagagtgtttctacactatggccatgaatgagctgtggcgggcgacaggcgaggtgaggtatcagacagaggctgttgagatgatggatcagatcgtgcattgggttcaggaggacgcatctggtttgggaaggcctcagctgcaaggagcccccgccgccgagccgatggctgtccccatgatgttgttaaatctggtcgagcagttgggcgaggccgacgaggaactcgccgggaagtacgctgaactaggagactggtgcgcccgaaggattctccaacatgttcaaagagatggccaggccgtcctggagaatgtctccgagggaggtaaagaacttcccggatgtctggggcggcagcaaaaccccgggcatactctggaggctggatggttcctgcttaggcactgcatccggaagggagatcctgagctcagagctcatgtgatcgataaatttttactgctcccttttcattccgggtgggatcccgatcatggcggactgttctacttccaggacgccgacaacttttgtcccacccaactggaatgggccatgaaactgtggtggccacatagtgaagccatgattgcatttctcatggggtacagcgacagtggagatcccgtacttctcagactgttttatcaggttgctgaatacaccttcaggcagttccgagacccagaatacggcgaatggtttggatacttgtcccgtgaggggaaggtcgctttaagtataaaaggagggccctttaaaggttgctttcatgtgcctaggtgcctggctatgtgcgaggaaatgttgggcgctttgctgtctagaccagctccagctccttcacccgctcccacccccgcctgccgtggcgcggagtag

SEQ ID NO: 202968 - DNA, 765 bp, Artificial Sequence
  Description of Artificial Sequence: Synthetic coding sequence
atgagcaagggcctgcccgcccggcaggacatggagaaggagcgggaaactctccaggcatggaaagaaagagtagggcaggagctcgatcgtgtagtcgctttttggatggaacactcacacgaccaggaacacggcggcttttttacctgcctggggcgtgaggggcgggtgtatgacgacctcaagtacgtatggctgcaggggaggcaagtgtggatgtattgccgactctaccgcacattcgagcgctttcgccacgcccagcttctcgacgccgcaaaagctggcggggagttcttgctgaggtatgccagagtagcacctcccggcaaaaagtgcgccttcgtgctcacaagggacgggagacctgtgaaagtgcaacgaaccatcttctccgagtgtttttatacgatggcaatgaacgagctgtggagggcaactggcgaggtgcgctatcagacggaggctgtggagatgatggatcaaatcgtgcactgggtccaagaagacgcatccggcttggggagaccccagctccagggagcacccgcagccgaaccaatggcagtccccatgatgctcctgaacctagtcgagcagctgggtgaggctgatgaggaactggctggaaagtacgcagagctgggcgactggtgcgcaaggcggatattacaacatgtccaggctaccagatggaagcccgcgggattttgtagtgtaatcgcctttgggaaagctacacccaacttcgaaccaacatag

SEQ ID NO: 202969 - DNA, 2355 bp, Artificial Sequence
  Description of Artificial Sequence: Synthetic coding sequence
atggcccagctgctgaacagcatcctgagcgtgatcgacgtgttccataagtatgccaagggcaatggtgactgtgctctgctgtgcaaggaagagctgaaacaactgctgttggccgagtttggcgatatcctccagaggcctaacgatcctgagaccgtcgaaacaatcctgaatctcctcgatcaggaccgcgatggccatatcgactttcacgagtaccttttattagttttccagctggttcaggcatgttaccacaagctagacaacaagagtcatgggggcaggacttctcagcaggagcgtggccaagagggcgctcaggactgtaaatttcctggcaacacgggcaggcagcatagacagcgccacgaagaggaacgccaaaatagccaccattcccagccggaaaggcaggacggcgactcacatcatgggcagccggagcgtcaggatcgtgacagtcaccatgggcagagcgaaaagcaggaccgggatagccatcacagtcaaccggaaagacaggatagagacagtcatcacaaccaaagtgaaaggcaggacaaggacttttcctttgatcagagtgagaggcagagtcaggattcttcctccggaaaaaaggtgtcccacaagtccacaagtggacaggccaaatggcaaggacacattttcgcactgaacaggtgtgagaagcccatacaggacagtcactatggtcaatcagagaggcatactcagcaaagcgagacacttggtcaagcctcccactttaaccagactaatcagcagaagagtgggtcctattgcggccagagcgagagattaggacaagagttagggtgcgggcagaccgatcgacagggccagtcttcccattatggacagacagaccgccaggatcagagctaccattacgggcagacagataggcagggccagagcagtcactactcccagactgaccgtcagggccagtcttcccattactcccagccagataggcaaggccagtcctcccactacggccagatggacagaaaggggcagtgctaccactatgatcagactaaccgacaagggcagggctctcactatagccaaccaaataggcagggacagagttcacactacgggcaacctgatactcaggatcagtctagtcactacgggcagaccgaccgacaggaccagagctcacactatgggcagactgaacgtcaggggcagagctcacattacagccaaatggatagacagggacagggaagccattacggacagacggatagacaagggcagtccagtcattacggccagcccgatcgtcaggggcagaactctcactatggtcagaccgatcgccaggggcaatccagccactatggccagacggaccgccagggccagagtagccattactcacagccagacaagcagggacagtcatcacactacggaaagattgatagacaagatcaatcctaccattatggccaacccgatgggcagggccagagtagccattacgggcagacagataggcagggacaatccttccactatgggcaaccagaccggcaggggcaatcatcccactactcccagatggaccggcagggccagagcagccattacgggcagactgatcggcaggggcaatcctcccattacggccagaccgataggcagggccagtcgtatcactacggccagactgacaggcagggccagtcgtcccactatatccagtctcaaaccggagagattcaggggcagaataagtactttcaaggcactgagggcacccgcaaagcatcatatgtagagcaaagcgggagaagcgggaggctgagccagcaaacccccggccaggaaggatatcaaaaccaagggcagggatttcaatcccgggatagccagcagaatggccaccaggtgtgggagccagaggaagactctcagcatcatcagcacaaacttctggctcagattcagcaggaaagacccctgtgccacaaaggaagggattggcagtcttgttcaagcgaacaggggcacaggcaggcacaaactcgtcaatcccacggagagggattatcccactgggcggaggaggagcaaggtcaccagacctgggaccgtcacagccacgaatctcaggagggaccttgtggtacccaggatcgcagaacacacaaagacgagcagaaccaccagagacgcgatcggcagacccacgaacatgagcagagccaccagaggcgagacaggcaaacccatgaggacaagcagaatagacagagacgtgaccggcagacccatgaggacgagcagaaccatcagagatag

SEQ ID NO: 202970 - DNA, 1320 bp, Artificial Sequence
  Description of Artificial Sequence: Synthetic coding sequence
atggaccggaagggccagtgctaccactacgaccagaccaaccggcagggccaaggatctcactactcccagccaaaccggcagggtcaatcctcacactacggccaaccggatactcaggaccaatcttctcattacgggcaaacagacagacaagatcaatcgagccactacggacagacagagagacaaggtcagagttctcattactctcagatggacagacagggtcaggggtcacattacgggcaaaccgaccgtcagggccaatctagccattacggccagcctgatcgtcagggtcagaacagtcactatgggcagacagatcgacagggccagtcctcacactatgggcagacagataggcaaggtcagtcatcgcattacagccagcctgacaaacagggacagtctagccactacggcaagatagatagacaagaccagtcttaccattatggccaacctgatgggcagggccagtcgtcccattatggacagaccgaccgacaagggcaaagcttccactacggtcaacctgaccggcaggggcagtccagccactactcccaaatggaccgacagggccagagttcccattatggtcagacagatcgccagggccagagtagtcactatggccagactgaccgccaggggcagtcttaccactacggccagactgacagacaggggcaaagttcccactacatccagtcccagactggtgaaattcagggccagaacaagtatttccaaggcaccgaagggacgaggaaggcatcctatgttgaacagagcggtcgctcaggcagactatcccagcagactcctggccaggagggctaccaaaaccaaggccagggcttccagtcccgcgactcccagcagaatgggcatcaggtgtgggagccagaagaggactcacagcaccatcaacataaacttctggcacagattcagcaggagcgtccactttgtcacaagggacgggactggcagagctgctctagtgagcagggacaccgacaggcccagactaggcaaagtcacggtgaaggcctgagtcactgggcagaggaggagcagggccaccaaacatgggacaggcattcacatgaaagccaggagggcccctgcgggactcaggatcgaaggacccataaggatgagcagaaccatcagcgtagggaccggcagacacacgagcacgagcagtctcaccagcgacgcgacaggcagactcatgaggataagcagaacaggcagcggcgggataggcaaactcatgaggatgagcagaatcaccagcggtag

SEQ ID NO: 202971 - DNA, 1065 bp, Artificial Sequence
  Description of Artificial Sequence: Synthetic coding sequence
atggaggtggaggccgtgtgcggcggcgccggcgaggtggaggcccaagactcagatcccgcacctgcctttagcaaggcgcctggcagcgcagggcactacgaattaccgtgggtcgagaaatacagaccagtcaaattgaacgaaattgtaggcaacgaggatacggttagtcgccttgaggtcttcgcccgggagggcaatgtgcctaacattattatagcaggcccccccgggaccgggaagactacatcgatcctatgtttagcgagggcattactgggtccagcattaaaggacgctatgctagaactgaacgcatccaatgaccgtggcattgatgttgtccggaataaaatcaagatgtttgcccagcagaaggtaactctgcctaaaggacggcacaagatcattatcttagacgaagccgattctatgacagatggcgcccagcaggccctccggagaactatggaaatttattccaagacgacaaggttcgcactcgcctgtaacgcatccgataaaatcatcgaaccgatccagagccgctgcgccgtgctccggtataccaaactaactgacgcgcagatcttgacccgccttatgaacgtgatcgagaaggagagggtcccgtacacagacgatggactggaggccatcattttcacagcacaaggagatatgagacaagccctcaacaatctgcagtctaccttttctggcttcggatttattaacagtgaaaatgttttcaaagtgtgtgatgaaccccacccactgttagtgaaggagatgattcagcactgtgtgaatgctaatattgacgaggcttataaaattctcgcccacctctggcatctggggtattctcccgaagacatcataggaaacattttcagggtgtgtaaaaccttccagatggctgaataccttaaactggagtttattaaggagatcggatatacccacatgaagatcgctgaaggggttaatagcctcttacagatggctggtctgctggccaggctctgtcaaaaaaccatggctcccgtagcctcttag

SEQ ID NO: 202972 - DNA, 963 bp, Artificial Sequence
  Description of Artificial Sequence: Synthetic coding sequence
atggaggtggaggccgtgtgcggcggcgccggcgaggtggaggcccaagattccgacccagctccggccttctccaaagctcctggatccgccggacattacgagctcccctgggtcgaaaaatatcgcccagtcaagctgaacgagatagtgggtaatgaagatacagtcagtagattggaagtatttgcaagggaagggaatgttcccaatattattattgctgggcccccaggtaccggtaaaacgacctccatactgtgccttgctcgagctttactgggacccgccctgaaggatgcaatgctggaactgaacgcttctaatgattcaatgaccgatggagctcagcaggcactgaggcgaaccatggaaatttactccaagacaactaggtttgccctggcttgcaacgcttctgacaagatcatcgaacctatacaatccagatgcgcagtgctcagatacactaaactcactgatgcgcaaattttaacccgactcatgaacgttatagaaaaggaaagggtgccttacacagacgacggcctggaggccatcatctttaccgcccaaggcgacatgagacaggccctgaataacctgcagagtaccttttcaggctttgggttcattaacagtgagaacgtcttcaaggtgtgtgacgagccccaccccctccttgtgaaggagatgattcagcactgtgtgaacgcgaacattgatgaggcttacaaaatcctggctcatctgtggcatctggggtacagccctgaggatatcatcggaaacatctttagagtgtgtaaaaccttccagatggccgagtacctgaagctggagtttatcaaagagatcggatatactcacatgaaaattgcggaaggcgtcaactcactcttacagatggctggattgctagcccggctctgccagaaaacaatggcacccgtagcttcatag

SEQ ID NO: 202973 - DNA, 1071 bp, Artificial Sequence
  Description of Artificial Sequence: Synthetic coding sequence
atgagcctgtgggtggacaagtaccggccctgcagcctgggccggctggactatcacaaagaacaagcggcacagctgcgaaacctcgtgcagtgcggtgacttcccccatctactagtatacgggccctctggagctggcaaaaagacaagaatcatgtgcattctcagggaactctatggcgtgggcgtggagaagttgagaatcgagcaccagactataaccaccccttcaaagaagaaaatcgagatatcaactatagcatccaactatcatctggaggtcaatcccagcgatgctggaaattcagaccgtgtggtgatccaggagatgctgaagacagtggctcagtcccagcagctagagacaaactcccagcgggattttaaagttgtgctgcttacagaggttgataaactcactaaggacgcccagcacgccttacgccggacaatggaaaagtacatgtctacttgtagacttatcctgtgctgcaattcgacctcgaaagtgatccctcctatcaggtcaagatgcctggctgtacgcgttcctgccccaagcattgaagacatttgtcatgtcttgagcactgtgtgcaagaaggaggggttgaatcttccttcacaattggcccatcgactggccgagaaaagctgcaggaacctgcggaaagcattgctgatgtgcgaagcctgtcgggtgcaacaatatccatttaccgcggaccaagagatcccagagacagattgggaggtgtacctgagagaaacagcaaacgccatcgtgtcacagcagacaccccagaggcttctggaagttagagggcgactttacgagctgctaacccactgcatcccccccgagattatcatgaaaggacttctctcagagctactgcataattgcgatggccagctgaagggagaggtggcgcaaatggccgcctattacgagcacaggcttcagctcggttctaaggcaatttatcacctggaagcgttcgtcgcaaaattcatggccctatacaaaaagtttatggaagatgggctcgagggcatgatgttctag

SEQ ID NO: 202974 - DNA, 918 bp, Artificial Sequence
  Description of Artificial Sequence: Synthetic coding sequence
atgagcctgtgggtggacaagtaccggccctgcagcctgggccggctggactaccacaaagagcaagcggctcagcttagaaatctggtccagtgcggtgattttcctcatctgttggtgtacgggccgagtggagcaggtaagaagactcggataatgtgcattctgagagagctgtatggcgttggcgtcgagaagctccggattgagcaccagactatcacaaccccttccaagaagaaaattgagatctctacaatagcgagcaactaccaccttgaggtaaacccctccgacgctgggaatagcgaccgggtcgtcattcaagagatgcttaaaactgttgcgcagtcccagcagttagagacaaactctcagagggactttaaggtcgtgctgctgactgaagtggataaattgaccaaggatgcccagcatgctcttaggcgcacaatggagaaatatatgtctacctgcagactcatcctctgttgcaattcaaccagcaaagtaatcccacctattcgaagccgatgtctcgctgtgcgggtgccggccccaagcatcgaggacatctgccacgttctgtcaacagtttgtaaaaaagaggggcttaacctgccatctcagctggctcacaggcttgctgaaaagtcctgcaggaatttgagaaaagctctgttgatgtgcgaggcttgtcgagtgcagcagtacccatttactgccgaccaggagattcccgagacggactgggaagtctacctgcgcgagactgctaacgccattgtgagccagcagacaccgcaacggctgctagaggttcgggggcgactttacgaactactgacgcattgcatacctccagagattattatgaaagcatgtaaggaggagagccggtcttgtgacattttctag

SEQ ID NO: 202975 - DNA, 1092 bp, Artificial Sequence
  Description of Artificial Sequence: Synthetic coding sequence
atgcaggccttcctgaagggcaccagcatcagcaccaagccccccctcaccaaagatagaggtgtggctgcctccgctgggtcatcaggcgagaataagaaagctaaacccgtgccatgggtggagaaatacagaccgaagtgcgtcgacgaggtggcatttcaggaggaggtcgtcgccgtgttaaagaagagtctggagggcgccgacctaccgaatttgcttttctacggtccgccggggacaggtaagacatcgaccattctggccgcggcccgagagttgtttggtcctgagctgtttagactgcgggtactggaacttaatgcatccgacgaacgcggcattcaggttgtgagggaaaaggtgaagaatttcgcacaattgacagtgtccgggtcccggtcagatggtaagccttgtccaccatttaagattgtgattctcgacgaagctgacagtatgacatccgcggcccaggctgcccttaggagaaccatggaaaaggagagtaagactacacggttctgtctgatctgtaactatgtgtcacgaattatcgaacctttaacttcccgttgttccaagtttcgcttcaaacccctgagcgataagattcagcagcagagactgttggatatcgctaaaaaggaaaacgtgaagattagtgatgaagggatcgcttaccttgtgaaagtcagtgagggcgacctgcgcaaagctatcacttttctgcagtcggccactcgcttgaccggagggaaggagatcaccgagaaggtaattaccgatatcgcgggagtgatacctgccgagaagatcgacggagtgttcgctgcctgccagtcaggttcctttgacaagctcgaagctgtggtcaaagacttaattgacgagggccacgccgctacccagttggtcaaccagctgcatgacgttgtggttgagaataacctttcagacaaacagaaatccataatcactgaaaagctcgcagaagtagacaaatgcttggcggatggcgccgatgaacatctgcagctgattagcctttgcgcaacagtgatgcagcagctgtcacaaaactgctag

SEQ ID NO: 202976 - DNA, 1092 bp, Artificial Sequence
  Description of Artificial Sequence: Synthetic coding sequence
atgcaggccttcctgaagggcaccagcatcagcaccaagccccccctgactaaagacaggggtgtggccgctagtgctgggtcttcaggcgaaaacaagaaagcaaagcccgtgccgtgggttgagaaatacaggcctaagtgcgttgacgaggtagccttccaggaagaggtcgtggccgtgttgaagaagtccttagagggcgcagatctacctaacctgctcttttacgggcctcccggaaccgggaaaacgagtactatcctggccgcagcacgcgaattgtttgggcccgaattgttcaggcttcgggttctggagttgaacgcctcagacgagaggggcatccaggtggtcagggagaaagtgaagaatttcgcccagctaaccgttagtggctcgcgaagcgacggtaagccttgtccgccattcaaaatcgtgattctcgatgaggccgactctatgacttctgctgctcaggcagccctgaggcgcactatggaaaaagaatcaaaaaccacacgcttctgtctgatctgcaattatgtgtcccggataatagaaccactcacttcaaggtgctccaagttccggtttaagcctctgtctgacaagattcagcagcaaagactcctcgatattgccaaaaaagaaaacgtgaagatcagtgacgagggtattgcatacctggtgaaggtatccgaaggggacttacggaaggcaattacctttctgcagtccgcgacccgccttacagggggtaaggagatcaccgagaaggttattaccgacatagccggagtcatcccagcggaaaagattgacggcgtctttgccgcctgccagagcggcagttttgacaaacttgaagccgttgtgaaggatctgatcgatgaggggcacgctgcgacccagctggttaatcagctccacgatgtggtggtagagaataatctgtcggacaagcaaaaaagtatcattaccgagaagctggcagaggtcgacaagtgccttgccgacggtgcggacgaacatctccagctcatatctctttgcgcgaccgtcatgcaacaactcagccagaactgttag

SEQ ID NO: 202977 - DNA, 132 bp, Artificial Sequence
  Description of Artificial Sequence: Synthetic coding sequence
atgcaggccttcctgaagggcaccagcatcagcaccaagccccccctgaccaaagatagaggggttgccgcctccgcgggcagtagtggcgaaaataagaaagctaagcccgtaccttgggtggagaaatag

SEQ ID NO: 202978 - DNA, 645 bp, Artificial Sequence
  Description of Artificial Sequence: Synthetic coding sequence
atgcaggccttcctgaagggcaccagcatcagcaccaagccccccctcacgaaagatcggggtgtagctgccagtgctggctcgtctggcgagaacaaaaaagccaaaccggtgccctgggtcgaaaagtacagaccaaagtgcgtagatgaagtggcttttcaggaagaggtggtggccgtcctcaaaaaatccctggagggtgccgatcttccaaaccttctgttctatggccccccaggaaccgggaaaaccagcacaattctcgctgctgctcgcgagttattcggaccagagctattccgtcttagagttttggaactcaacgcgagtgatgaacggggaattcaagttgttagggagaaagtgaaaaattttgcccaactcaccgtaagtggaagcaggtctgacggaaagccgtgtcctcccttcaagatcgtgatcctggatgaggccgattctatgacttccgcggcccaggcagctcttagaaggaccatggagaaagagtcaaagaccacaaggttctgcctaatctgtaactatgtgtctagaatcatcgaacctttaaccagcagatgcagcaaattccgtttcaagccattgagtgacaaaattcagcaacagcgcctactggatatctag

SEQ ID NO: 202979 - DNA, 372 bp, Artificial Sequence
  Description of Artificial Sequence: Synthetic coding sequence
atgcaggccttcctgaagggcaccagcatcagcaccaagccccccctgaccaaagacaggggagttgccgcatctgctgggagttcaggtgagaataaaaaagcaaaacctgtcccatgggtggaaaagtaccgtcctaagtgtgtggatgaagtggcctttcaggaagaggtcgtggccgtccttaagaagagtctggagggggcggatctgcccaacctgttattctatggcccccctggaactggaaaaacttccaccattttagcagctgcaagggagctctttggccccgagctattccggttgcgcgtgttagagttgaacgcttctgatgagcggggcatacaagttgtgcgggagaaggtctag

SEQ ID NO: 202980 - DNA, 504 bp, Artificial Sequence
  Description of Artificial Sequence: Synthetic coding sequence
atgcaggccttcctgaagggcaccagcatcagcaccaagccccccttaaccaaggatcgcggggtggcagcttccgccggttccagcggagaaaataagaaggccaagccagttccctgggtagaaaaatacagacccaaatgtgtggacgaagtcgcctttcaagaagaggtcgtggccgtgctgaaaaagtccttggagggggcagacctgcctaacctcctcttttacgggccgcccgggacaggaaagacaagcaccattttggccgccgcccgggaactgtttggacctgaattgtttcgcctcagggtgctggaactcaatgcctcagatgagagaggaatacaggtggttcgcgagaaggtgaagaactttgcccagctgacggtgtcaggttcccgctccgatggtaaaccctgcccccccttcaagatcgtgatcctcgacgaagccgattcaatgactagcgccgcccaggctgctctgcgacgcactatgtag

SEQ ID NO: 202981 - DNA, 288 bp, Artificial Sequence
  Description of Artificial Sequence: Synthetic coding sequence
atgcaggccttcctgaagggcaccagcatcagcaccaagccccccctgaccaaagaccgtggggtggccgcttcagccggatcgagtggtgagaacaagaaagctaagccggtgccctgggttgaaaaataccgcccaaagtgtgtcgatgaagtggcctttcaagaggaggtggtggcagtcctcaagaaatccctagagggagccgacctgcccaacctcctgttttatggacccccggggacaggaaaaaccagtacaatcctcgcggctgcccgtgaactgtag

SEQ ID NO: 202982 - DNA, 1746 bp, Artificial Sequence
  Description of Artificial Sequence: Synthetic coding sequence
atgcagcggcccggcccccggctgtggctggtgctgcaggtgatgggcagctgcgccgccatcagtagtatggatatggaacggccaggggatggaaaatgtcagcctattgagatccctatgtgtaaggatattggatacaacatgactcggatgccaaacctcatgggacacgagaatcagagggaagccgcaatccagctccacgagttcgcacctctggtggaatatggctgtcatggccatctcaggttcttcttgtgtagtttatatgccccaatgtgcactgagcaggttagtacaccgatccccgcttgtcgggtcatgtgtgagcaagctcgcttaaaatgctcgcctattatggagcaatttaacttcaagtggcccgacagcctcgattgcaggaagctcccgaataagaatgaccctaactatctgtgcatggaagctcctaacaacggaagcgacgagcctaccagggggagcggactgttccctcccctgttcagaccacagcgtccacacagtgcccaagagcacccacttaaggacggaggacccggccgagggggctgcgacaacccagggaaatttcatcatgtggagaagtctgcctcctgtgcccctctctgtaccccgggggtcgacgtatactggagtcgcgaggataagcgtttcgctgtggtctggctcgccatttgggccgtgttgtgcttctttagctcagcctttaccgtcctcacttttcttatagatccagctcggtttagataccccgagcggcccatcattttcctttccatgtgctattgcgtgtattcggtaggctatctcatcagactcttcgccggcgctgaatctatcgcttgcgacagagattccgggcaactgtatgtaattcaggaggggctcgagagcaccggttgcactttagtgtttctggtgctttactacttcgggatggcctccagcctatggtgggttgtgctgacccttacctggtttttggctgcaggaaaaaaatggggtcacgaggccatcgaagcaaattcttcctactttcacctggctgcttgggcaattccagccgtgaagaccatactcatactggtaatgcgccgggtggcgggggatgagttaactggagtctgctatgtcgggtccatggatgtgaatgcattgaccggctttgtcttgatccccctggcgtgctatctagtgatcggcacgtccttcatcctgagcggattcgtggcactgttccatatccggagggttatgaagaccggtggcgagaacactgataagcttgagaagttgatggtacggattggactttttagtgtgctgtataccgtgccagctacctgcgtaattgcttgctatttttacgagaggctgaacatggactactggaagatacttgccgcgcagcacaagtgcaaaatgaacaaccaaacaaagacactggactgtctaatggcagctagcatacctgcggtggagatattcatggtgaagatttttatgctgctcgtagtcggcatcacgtccggaatgtggatctggacatctaagacactgcaatcttggcagcaggtgtgctcaaggaggctgaaaaagaagtcgagacgcaaacctgcatccgtgattacctccggaggaatctataaaaaggctcaacacccacagaagactcaccacggcaaatacgagatcccagcccaatctccaacatgtgtgtag

SEQ ID NO: 202983 - DNA, 960 bp, Artificial Sequence
  Description of Artificial Sequence: Synthetic coding sequence
atggtggagaagtaccggccccagaccctgaacgacctgatcagccatcaggatatcctatccacaatccaaaagttcattaacgaggatcgtctaccacacctgttgctgtatggcccacccggaaccgggaaaaccagtactatactcgcttgcgctaagcaattatataaggataaagagttcggcagcatggtgcttgagctgaatgcaagcgacgacagagggatcgatatcattaggggcccaatcctgtctttcgcctctacccggacgatttttaagaaaggatttaagctcgttatcctcgacgaggctgacgcgatgacccaggacgctcagaatgcgcttcggagggtgattgagaaattcacagagaacactagattttgtctgatctgtaactacttatccaaaataatccctgctctgcagagtcgctgtactcgcttccgctttggccccttgacgccagaactcatggttccaaggctggagcacgtcgttgaagaggagaaagtcgacatcagtgaggacgggatgaaagccctggtgactctgtcttctggcgatatgagaagagctctgaacatcttgcagtctacaaatatggctttcgggaaggtgaccgaggagacggtatacacttgtaccgggcatccactgaaaagcgatatcgccaacattctggactggatgctaaatcaggatttcactacggcataccgcaacattactgaactcaagaccctaaaaggactggccctgcacgatattttaacagagattcacctgttcgtgcatcgcgtggacttccctagctccgtgcgtatccatcttctcacaaagatggcagatatagaatatcgcctctccgttggtaccaacgaaaagattcagctatcgagtctgatcgccgcattccaggtcactcgtgacttgatcgtggcggaagcatag

SEQ ID NO: 202984 - DNA, 315 bp, Artificial Sequence
  Description of Artificial Sequence: Synthetic coding sequence
atggtggagaagtaccggccccagaccctgaacgacctgatcagccaccaggacatcttgagcaccatccagaaatttataaatgaagacagactgccccatttgttgctctatggtcccccgggtacaggcaagacgagtactattctcgcgtgtgcaaaacagctatataaggacaaggaatttggatcaatggttttagagctgaatgcttcggatgacaggggaatagatatcatacgtggccctattctgagttttgcctctactcgaacgatatttaagaagggcttcaagctggttattctggattag

SEQ ID NO: 202985 - DNA, 1023 bp, Artificial Sequence
  Description of Artificial Sequence: Synthetic coding sequence
atggagaccagcgccctgaagcagcaggagcagcccgccgccaccaaaattcgaaatcttccctgggtcgagaaatacagacctcagacgcttaacgacctgatctcccaccaggacattctcagtacaattcaaaagttcattaacgaagataggttaccgcatctgctcttgtacggacctcccgggacagggaagacctctacgatccttgcgtgtgctaaacaactctacaaggataaagagtttgggagtatggtgctggagctgaacgcttctgatgatcgggggatcgatattattcgagggcccattctgtccttcgcctccacacgtactatatttaaaaagggcttcaagctcgtaattctcgacgaggccgacgccatgacccaggatgctcagaacgccctgcggcgggtaattgaaaaatttactgaaaataccagattttgcctgatctgcaactacctgtctaagatcatcccggctcttcagagccggtgcactcggttccgtttcgggccccttacacccgaattgatggtccccagattggagcatgtggtcgaggaagaaaaagtggacattagcgaggatggaatgaaagcccttgtgaccttgagctctggagatatgcgccgggccttaaacattttgcagtcgactaacatggccttcggaaaagtgacagaggagaccgtgtatacatgtacagggcacccattaaaaagtgacatagcgaacattctggactggatgcttaaccaggactttactactgcctacaggaacattaccgaactgaaaacattgaaaggcctggccctgcatgatatcctaacagaaatacatctgttcgtgcatcgcgttgacttccccagttccgtgagaattcacctcttaactaaaatggctgacatagaatatcggctctctgtaggcacaaacgagaagatacaactgagctccttgattgctgcttttcaggtaacgcgagatcttattgtggccgaggcatag

SEQ ID NO: 202986 - DNA, 192 bp, Artificial Sequence
  Description of Artificial Sequence: Synthetic coding sequence
atggtggagaagtaccggccccagaccctgaacgacctgatcagccatcaagacatcttgagtactatccagaaattcattaacgaagaccgactgcctcatttactgttgtatggacctccgggtacaggaaagacaagcaccatcctggcctgtgccaagcagttatacaaggataaagagttcgggtag

SEQ ID NO: 202987 - DNA, 1077 bp, Artificial Sequence
  Description of Artificial Sequence: Synthetic coding sequence
atgtggaacagcaacgacggcggcgccggctggcggcggaagcggatcgccggcggtttttccaaaagagcttctctggggtctgaacggagggtggtggctggggaggaaggacgggagaggagctggggcgtgtgggggtcacctgctggtcgccggcgcggccggctcgggcgcttgggccagtgcctgaaaggccgaagcttacgcgagcccgctgggtttagcgaggcttgggacgtcgcccaggcccttatcctcctgtttaagactggaggcttcgagtcgtacggcagctcgtcgtacgggggtgctggggggtacacccaatcaccaggaggcttcggtagccccgccccgtcccaagcagagaaaaagtcaagagccagagcgcagcatatagttccatgtacgatctcccagttactttccgccacactagtggacgaggttttcaggatcggtaatgtcgagatttctcaggtgacgatagtggggatcattaggcatgctgaaaaagctcctacaaatatcgtgtataagatcgatgatatgacagctgcccctatggacgtacggcagtgggtggatacagatgatacatctagtgagaatactgtggtaccacccgagacatacgtgaaggttgccggacacctccgtagcttccaaaataagaagtccctcgtggccttcaagatcatgcctctggaggacatgaatgagtttacaacccacattcttgaggttattaacgcccacatggtgctgtctaaggctaattcccagccatccgccggaagagctcccattagtaaccccggaatgagtgaggccggtaatttcggaggtaatagcttcatgcccgctaatggcctcactgttgctcagaatcaggttttgaacctgatcaaggcctgtccaagaccggaaggacttaacttccaggacctcaagaatcagctgaaacacatgtctgtttcctctatcaaacaagccgtcgacttcctaagcaacgaaggacacatttactcaaccgtggatgatgatcacttcaaatctacggacgcggagtag

SEQ ID NO: 202988 - DNA, 837 bp, Artificial Sequence
  Description of Artificial Sequence: Synthetic coding sequence
atgggccggggcgaccggaacaagcggagcatccggggcttcgagtcatatgggtcttcgtcttacggtggtgccggcggctacacgcagagtcctgggggttttggaagtcccgctccctcacaggccgagaagaaatccagagcgcgagcccagcatatagttccctgtactatctcccaactcctatcggccacacttgttgacgaggtatttaggatcgggaacgtggagatatctcaagtcactattgttggaatcatacggcatgcagagaaggctcccaccaacattgtctacaagatagatgatatgacagcagcccctatggatgtgcgacagtgggtggacactgatgacaccagctctgagaacacagtggtgcccccagaaacttatgttaaggttgcgggccatctgcgctctttccagaacaagaaaagtcttgtggcttttaaaatcatgccactcgaagatatgaacgagtttacaacccatatcctcgaggtaatcaatgcccacatggtattgagtaaagcaaatagtcagccttccgccggacgggctcccatcagcaacccaggcatgagtgaggctggaaacttcggcggtaatagctttatgcccgccaatggcctcacagtcgctcagaaccaagtcttaaacttgattaaagcctgtccccggcctgaaggcctaaatttccaggatctgaagaatcagctgaaacatatgtcagtctcctccataaagcaggccgtagactttttgagcaacgagggccatatttatagcacagtcgatgatgatcatttcaaaagtaccgacgccgagtag

SEQ ID NO: 202989 - DNA, 813 bp, Artificial Sequence
  Description of Artificial Sequence: Synthetic coding sequence
atgtggaacagcggcttcgagagctacggcagcagcagctacggcggggccggcggatacactcagtcccccggaggattcgggagccccgctccatctcaggcagagaagaaatctcgcgcaagagctcagcatattgtcccctgtacaatctcacagcttctttctgccactttagtggacgaggtgtttagaatcggcaatgtggagattagtcaggtcacaatcgtgggtattattcgacatgccgagaaggctccgacaaacatcgtgtataaaatagatgacatgacagcagcacctatggacgtccgacagtgggttgacacagatgacacgtcaagtgaaaacacagtggtaccacctgagacctacgtgaaggttgcaggtcacctgagatcctttcagaacaagaagagccttgttgcgttcaagatcatgcctctcgaggatatgaatgaattcacaacccatatacttgaagttataaatgcgcatatggtgttgagcaaagcaaactcccagccaagtgcaggccgcgccccaattagtaatcccggcatgtcggaggctggaaactttggcggaaacagcttcatgcccgccaatgggctgaccgtggctcaaaatcaggtattgaatcttattaaggcctgtcccagacctgaaggactcaactttcaggatctgaaaaaccaattaaaacatatgagcgtgagcagcattaaacaggccgtcgactttctctccaacgagggtcacatctatagcaccgtggacgatgaccatttcaaaagcaccgatgctgaatag

SEQ ID NO: 202990 - DNA, 369 bp, Artificial Sequence
  Description of Artificial Sequence: Synthetic coding sequence
ctggaggacatgaacgagttcaccacccacatcctggaggtgatcaatgcacacatggttctgagtaaagccaactctcagccttctgctggaagagccccaattagtaatcctggcatgagtgaggcgggcaactttggagggaattcctttatgcctgcaaacggcctcaccgtcgcacaaaaccaagtgctgaatctcatcaaggcatgcccacgccccgagggcctgaattttcaggacttgaaaaaccagctcaagcacatgtccgtgtccagcattaaacaagctgtcgactttctgtcgaacgagggccacatctacagcactgtggacgatgaccatttcaagagcacggatgctgagtag

SEQ ID NO: 202991 - DNA, 540 bp, Artificial Sequence
  Description of Artificial Sequence: Synthetic coding sequence
atgtggaacagcaacgacggcggcggcttcgagagctacggcagctcttcttatgggggcgccggcggctacacccagagcccggggggcttcgggtctccggccccgagccaggctgagaaaaagagtcgtgccagggcacagcacatcgttccttgcacaatatcgcagctattatcagctaccttagtcgatgaggtgtttagaatcggaaacgttgaaatatctcaggtgaccattgttgggatcatcaggcatgctgaaaaggccccaactaacattgtgtacaagatcgacgacatgaccgccgcccccatggacgttcgccagtgggtagataccgatgatacgtcctctgagaacaccgtggtcccccctgaaacatacgtaaaagtggccggacatctccgatcctttcaaaataaaaagtctttggttgctttcaaaatcatgccacttgaagacatgaacgagtttaccacccatatcctggaggttattaatgctcacatggtcctctctaaagcaaactcacagtag

SEQ ID NO: 202992 - DNA, 786 bp, Artificial Sequence
  Description of Artificial Sequence: Synthetic coding sequence
atgagcaagagcggcttcggcagctacggcagcatcagcgccgccgacggcgccagtgggggttccgaccagctgtgtgaacgggacgccacccctgcgataaagacccagagacctaaggtgcggatccaggatgtggtgccgtgtaatgtcaaccagcttctgtcctccacagtgttcgaccctgtgtttaaggtgcgcggaataattgtttcccaagtatcaatagtgggcgtgatccggggagctgagaaggcaagcaaccatatttgttataaaattgacgacatgacagctaaacccattgaggcgaggcagtggtttggacgggaaaaagtaaaacaggtgactcccctatcagtcggagtctacgttaaggtatttgggatcctcaaatgcccgaccggcacaaagtctctggaggtgctcaaaatccacgtgcttgaggatatgaatgagtttactgtccacatcctggagaccgtcaacgcgcacatgatgcttgacaaggcccgcagggacacaaccgttgagtccgttccagttagtcccagcgaagtaaatgacgcaggcgacaacgacgagtcacacagaaactttatacaagacgaggttctgcggcttatacatgagtgtcctcaccaggagggcaagtcgattcacgagctgcgagctcagctctgtgatttgtcagtcaaggcaatcaaagaggctatcgattatctcacagtggaaggtcatatctatcctaccgtagaccgggagcacttcaaaagtgcagattag

SEQ ID NO: 202993 - DNA, 330 bp, Artificial Sequence
  Description of Artificial Sequence: Synthetic coding sequence
atgaaccccgccctgggcaaccagaccgacgtggccggcctgttcctggcaaattctagtgaggctttagagagagcggtgcgctgttgcacgcaggcgtcagtggtgactgatgacggcttcgccgaaggtggcccagacgagagatccttgtatattatgcgagtggttcagatagctgtcatgtgtgtgctatccctgactgttgtgttcggaatctttttcttggggtgtaacctgctgatcaaatcagaggggatgatcaacttcctggtcaaggaccggagacccagcaaagaagtggaagccgtcgtcgtgggtccttactag
